United States Patent 9,254,311 (MODIFIED POLYNUCLEOTIDES FOR THE PRODUCTION OF PROTEINS) - sequence listing, part 12

SEQ ID NO: 23122 - DNA, 1938 bp, Artificial Sequence
  Description of Artificial Sequence: Synthetic coding sequence
gagagacccgccgaggaggccgaccagcccaccaccgagcccggcatggtgctggacagcgtggaggccggcgacaccaccccccccaccaagagaaagagcaagttcagcggcttcggcaagatcttcaagccctggaagtggagaaagaagaagagcagcgacaagttcaaggagaccagcgaggtgctggagagaaagatcagcatgagaaagcccagagaggagctggtgaagagaggcgtgctgctggaggaccccgagcagggcggcgaggaccccggcaagcccagcgacgccatgctgaagaacggccacaccacccccatcggcaacgccagaagcagcagccccgtgcaggtggaggaggagcccgtgagactggccagcctgagaaaggccatccccgaggaggacctgaagaagagactgggcagcaccggcagccagcccaacagcgaggccgagagcgtgcccgagaacgtgcccaagccccccctgctgccccccaagagacccctgagcagcagccacgaggccagcgagggccaggccaaggacgccaccagcagcggcggcaccgccagattcatcatcagcaccagcatcaccaccgcccccgccgccaccaccgccgccaccagcctggccaagaccgtgaacctgagcgtgacccccagccccgcccccagaaccctgcccgccgcccccgccagcaccaacaccaccgccacccccagcctgacccacatggtgcccgccaagcagccccccatccccccccccaagcccgcccacagaaacagcaaccccgtgatcgccgagctgagccaggccatcaacagcggcaccctgctgagcaagcccagcccccccctgccccccaagagaggcatccccagcaccagcgtgcccaccctggagagcgccgccgccatcaccaccaagacccccagcgacgagagagagaagagcacctgcagcatgggcagcgagctgctgcccatgatcagccccagaagccccagcccccccctgcccacccacatcccccccgagccccccagaaccccccccttccccgccaagaccttccaggtggtgcccgagatcgagttcccccccagcctggacctgcaccaggagatcccccagcaggaggaccagaagaaggaggtgcccaagagaatcctggaccagaacttcggcgagccccacatccccagcagactgccccccctgcccctgcacatcagaatccagcaggccctgaccagccccctgcccatgacccccatcctggagggcagccacagagcccacagcctgctgttcgagaacagcgacagcttcagcgaggacagcagcaccctgggcagaaccagaagcctgcccatcaccatcgagatgctgaaggtgcccgacgacgaggaggaggaggagcagacctgccccagcaccttcagcgaggagatgacccccaccagcgtgatccccaagctgccccagtgcctgagagaggaggaggagaaggagagcgacagcgacagcgagggccccatccagtacagagacgaggaggacgaggacgagagctaccagagcgccctggccaacaaggtgaagagaaaggacaccctggccatgaagctgaaccacagacccagcgagcccgagctgaacctgaacagctggccctgcaagagcaaggaggagtggaacgagatcagacaccagatcggcaacaccctgatcagaagactgagccagagacccacccccgaggagctggagcagagaaacatcctgcagcagtacagagtgaagttcggcctgaagagcctgctgaccgagaaggtgtgggccagcctgggcctgttcgtgagcatgttcagcctgaccaaccccagccccgtgctgagcgccctgctgggctag

SEQ ID NO: 23123 - DNA, 2109 bp, Artificial Sequence
  Description of Artificial Sequence: Synthetic coding sequence
atggaggaccccttcgaggaggccgaccagcccaccaccgagcccggcatggtgctggacagcgtggaggccggcgacaccaccccccccaccaagagaaagagcaagttcagcggcttcggcaagatcttcaagccctggaagtggagaaagaagaagagcagcgacaagttcaaggagaccagcgaggtgctggagagaaagatcagcatgagaaagcccagagaggagctggtgaagagaggcgtgctgctggaggaccccgagcagggcggcgaggaccccggcaagcccagcgacgccatgctgaagaacggccacaccacccccatcggcaacgccagaagcagcagccccgtgcaggtggaggaggagcccgtgagactggccagcctgagaaaggccatccccgaggaggacctgaagaagagactgggcagcaccggcagccagcccaacagcgaggccgagagcgtgcccgagaacgtgcccaagccccccctgctgccccccaagagacccctgagcagcagccacgaggccagcgagggccaggccaaggacgccaccagcagcggcggcaccgccagattcatcatcagcaccagcatcaccaccgcccccgccgccaccaccgccgccaccagcctggccaagaccgtgaacctgagcgtgacccccagccccgcccccagaaccctgcccgccgcccccgccagcaccaacaccaccgccacccccagcctgacccacatggtgcccgccaagcagccccccatccccccccccaagcccgcccacagaaacagcaaccccgtgatcgccgagctgagccaggccatcaacagcggcaccctgctgagcaagcccagcccccccctgccccccaagagaggcatccccagcaccagcgtgcccaccctggagagcgccgccgccatcaccaccaagacccccagcgacgagagagagaagagcacctgcagcatgggcagcgagctgctgcccatgatcagccccagaagccccagcccccccctgcccacccacatcccccccgagccccccagaaccccccccttccccgccaagaccttccaggtggtgcccgagatcgagttcccccccagcctggacctgcaccaggagatcccccagcaggaggaccagaagaaggaggtgcccaagagaatcctggaccagaacttcggcgagccccacatccccagcagactgccccccctgcccctgcacatcagaatccagcaggccctgaccagccccctgcccatgacccccatcctggagggcagccacagagcccacagcctgctgttcgagaacagcgacagcttcagcgaggacagcagcaccctgggcagaaccagaagcctgcccatcaccatcgagatgctgaaggtgcccgacgacgaggaggaggaggagcagacctgccccagcaccttcagcgaggagatgacccccaccagcgtgatccccaagctgccccagtgcctgagagaggaggaggagaaggagagcgacagcgacagcgagggccccatccagtacagagacgaggaggacgaggacgagagctaccagagcgccctggccaacaaggtgaagagaaaggacaccctggccatgaagctgaaccacagacccagcgagcccgagctgaacctgaacagctggccctgcaagagcaaggaggagtggaacgagatcagacaccagatcggcaacaccctgatcagaagactgagccagagacccacccccgaggagctggagcagagaaacatcctgcagcccaagaacgaggccgacagacaggccgagaagagagagatcaagagaagactgaccagaaagctgagccagagacccaccgtggccgagctgctggccagaaagatcctgagattcaacgagtacgtggaggtgaccgacgcccaggactacgacagaagagccgacaagccctggaccaagctgacccccgccgacaaggccgccatcagaaaggagctgaacgagttcaagagcagcgagatggaggtgcacgaggagagcaagcacttcaccagataccacagaccctag

SEQ ID NO: 23124 - DNA, 804 bp, Artificial Sequence
  Description of Artificial Sequence: Synthetic coding sequence
atgagcggctgcttccccgtgagcggcctgagatgcctgagcagagacggcagaatggccgcccagggcgcccccagattcctgctgaccttcgacttcgacgagaccatcgtggacgagaacagcgacgacagcatcgtgagagccgcccccggccagagactgcccgagagcctgagagccacctacagagagggcttctacaacgagtacatgcagagagtgttcaagtacctgggcgagcagggcgtgagacccagagacctgagcgccatctacgaggccatccccctgagccccggcatgagcgacctgctgcagttcgtggccaagcagggcgcctgcttcgaggtgatcctgatcagcgacgccaacaccttcggcgtggagagcagcctgagagccgccggccaccacagcctgttcagaagaatcctgagcaaccccagcggccccgacgccagaggcctgctggccctgagacccttccacacccacagctgcgccagatgccccgccaacatgtgcaagcacaaggtgctgagcgactacctgagagagagagcccacgacggcgtgcacttcgagagactgttctacgtgggcgacggcgccaacgacttctgccccatgggcctgctggccggcggcgacgtggccttccccagaagaggctaccccatgcacagactgatccaggaggcccagaaggccgagcccagcagcttcagagccagcgtggtgccctgggagaccgccgccgacgtgagactgcacctgcagcaggtgctgaagagctgctag

SEQ ID NO: 23125 - DNA, 879 bp, Artificial Sequence
  Description of Artificial Sequence: Synthetic coding sequence
atgtgccagagactgtggccctggcccgccaaccagcccctgcccggcggcctgctgcccagacccctgagcctggcccccagcagcagcagcagctgctgcagccccccctgcagccaggacggcagaatggccgcccagggcgcccccagattcctgctgaccttcgacttcgacgagaccatcgtggacgagaacagcgacgacagcatcgtgagagccgcccccggccagagactgcccgagagcctgagagccacctacagagagggcttctacaacgagtacatgcagagagtgttcaagtacctgggcgagcagggcgtgagacccagagacctgagcgccatctacgaggccatccccctgagccccggcatgagcgacctgctgcagttcgtggccaagcagggcgcctgcttcgaggtgatcctgatcagcgacgccaacaccttcggcgtggagagcagcctgagagccgccggccaccacagcctgttcagaagaatcctgagcaaccccagcggccccgacgccagaggcctgctggccctgagacccttccacacccacagctgcgccagatgccccgccaacatgtgcaagcacaaggtgctgagcgactacctgagagagagagcccacgacggcgtgcacttcgagagactgttctacgtgggcgacggcgccaacgacttctgccccatgggcctgctggccggcggcgacgtggccttccccagaagaggctaccccatgcacagactgatccaggaggcccagaaggccgagcccagcagcttcagagccagcgtggtgccctgggagaccgccgccgacgtgagactgcacctgcagcaggtgctgaagagctgctag

SEQ ID NO: 23126 - DNA, 615 bp, Artificial Sequence
  Description of Artificial Sequence: Synthetic coding sequence
atgagcggctgcttccccgtgagcggcctgagatgcctgagcagagacggcagaatggccgcccagggcgcccccagattcctgctgaccttcgacttcgacgagaccatcgtggacgagaacagcgacgacagcatcgtgagagccgcccccggccagagactgcccgagagcctgagagccacctacagagagggcttctacaacgagtacatgcagagagtgttcaagtacctgggcgagcagggcgtgagacccagagacctgagcgccatctacgaggccatccccctgagccccggcatgagcgacctgctgcagttcgtggccaagcagggcgcctgcttcgaggtgatcctgatcagcgacgccaacaccttcggcgtggagagcagcctgagagccgccggccaccacagcctgttcagaagaatcctgagcaaccccagcggccccgacgccagaggcctgctggccctgagacccttccacacccacagctgcgccagatgccccgccaacatgtgcaagcacaaggtgctgagcgactacctgagagagagagcccacgacggcgtgcacttcgagagactgttctacgtgggcgacggctag

SEQ ID NO: 23127 - DNA, 336 bp, Artificial Sequence
  Description of Artificial Sequence: Synthetic coding sequence
atgtgccagagactgtggccctggcccgccaaccagcccctgcccggcggcctgctgcccagacccctgagcctggcccccagcagcagcagcagctgctgcagccccccctgcagccaggacggcagaatggccgcccagggcgcccccagattcctgctgaccttcgacttcgacgagaccatcgtggacgagaacagcgacgacagcatcgtgagagccgcccccggccagagactgcccgagagcctgagagccacctacagagagggcttctacaacgagtacatgcagagagtgttcaagtacctgggcgagcagggcgtgagaccctag

SEQ ID NO: 23128 - DNA, 879 bp, Artificial Sequence; identical to SEQ ID NO: 23125
  Description of Artificial Sequence: Synthetic coding sequence

SEQ ID NO: 23129 - DNA, 726 bp, Artificial Sequence
  Description of Artificial Sequence: Synthetic coding sequence
atgaagatcctgctggtgttcgacttcgacaacaccatcatcgacgacaacagcgacacctggatcgtgcagtgcgcccccaacaagaagctgcccatcgagctgagagacagctacagaaagggcttctggaccgagttcatgggcagagtgttcaagtacctgggcgacaagggcgtgagagagcacgagatgaagagagccgtgaccagcctgcccttcacccccggcatggtggagctgttcaacttcatcagaaagaacaaggacaagttcgactgcatcatcatcagcgacagcaacagcgtgttcatcgactgggtgctggaggccgccagcttccacgacatcttcgacaaggtgttcaccaaccccgccgccttcaacagcaacggccacctgaccgtggagaactaccacacccacagctgcaacagatgccccaagaacctgtgcaagaaggtggtgctgatcgagttcgtggacaagcagctgcagcagggcgtgaactacacccagatcgtgtacatcggcgacggcggcaacgacgtgtgccccgtgaccttcctgaagaacgacgacgtggccatgcccagaaagggctacaccctgcagaagaccctgagcagaatgagccagaacctggagcccatggagtacagcgtggtggtgtggagcagcggcgtggacatcatcagccacctgcagttcctgatcaaggactag

SEQ ID NO: 23130 - DNA, 411 bp, Artificial Sequence
  Description of Artificial Sequence: Synthetic coding sequence
atgaagatcctgctggtgttcgacttcgacaacaccatcatcgacgacaacagcgacacctggatcgtgcagtgcgcccccaacaagaagctgcccatcgagctgagagacagctacagaaagggcttctggaccgagttcatgggcagagtgttcaagtacctgggcgacaagggcgtgagagagcacgagatgaagagagccgtgaccagcctgcccttcacccccggcatggtggagctgttcaacttcatcagaaagaacaaggacaagttcgactgcatcatcatcagcgacagcaacagcgtgttcatcgactgggtgctggaggccgccagcttccacgacatcttcgacaaggtgttcaccaaccccgccgccttcaacagcaacggccacctgaccgtgtag

SEQ ID NO: 23131 - DNA, 171 bp, Artificial Sequence
  Description of Artificial Sequence: Synthetic coding sequence
atgaagatcctgctggtgttcgacttcgacaacaccatcatcgacgacaacagcgacacctggatcgtgcagtgcgcccccaacaagaagctgcccatcgagctgagagacagctacagaaagggcttctggaccgagttcatgggcagagtgttcaagtacctgggctag

SEQ ID NO: 23132 - DNA, 150 bp, Artificial Sequence
  Description of Artificial Sequence: Synthetic coding sequence
atgaagatcctgctggtgttcgacttcgacaacaccatcatcgacgacaacagcgacacctggatcgtgcagtgcgcccccaacaagaagctgcccatcgagctgagagacagctacagaaagggcttctggaccgagttcatgggctag

SEQ ID NO: 23133 - DNA, 936 bp, Artificial Sequence
  Description of Artificial Sequence: Synthetic coding sequence
atggtgcaggccatcaagtgggtggacgaggtggtgcccgccgccccctacgtgaccaccctggagaccctggacaagtacaactgcgacttctgcgtgcacggcaacgacatcaccctgaccgtggacggcagagacacctacgaggaggtgaagcaggccggcagatacagagagtgcaagagaacccagggcgtgagcaccaccgacctggtgggcagaatgctgctggtgaccaaggcccaccacagcagccaggagatgagcagcgagtacagagagtacgccgacagcttcggcaagtgccccggcggcagaaacccctggaccggcgtgagccagttcctgcagaccagccagaagatcatccagttcgccagcggcaaggagccccagcccggcgagaccgtgatctacgtggccggcgccttcgacctgttccacatcggccacgtggacttcctggagaaggtgcacagactggccgagagaccctacatcatcgccggcctgcacttcgaccaggaggtgaaccactacaagggcaagaactaccccatcatgaacctgcacgagagaaccctgagcgtgctggcctgcagatacgtgagcgaggtggtgatcggcgccccctacgccgtgaccgccgagctgctgagccacttcaaggtggacctggtgtgccacggcaagaccgagatcatccccgacagagacggcagcgacccctaccaggagcccaagagaagaggcatcttcagacagatcgacagcggcagcaacctgaccaccgacctgatcgtgcagagaatcatcaccaacagactggagtacgaggccagaaaccagaagaaggaggccaaggagctggccttcctggaggccgccagacagcaggccgcccagcccctgggcgagagagacggcgacttctag

SEQ ID NO: 23134 - DNA, 1224 bp, Artificial Sequence
  Description of Artificial Sequence: Synthetic coding sequence
atgatcagaaacggcagaggcgccgccggcggcgccgagcagcccggccccggcggcagaagagccgtgagagtgtggtgcgacggctgctacgacatggtgcactacggccacagcaaccagctgagacaggccagagccatgggcgactacctgatcgtgggcgtgcacaccgacgaggagatcgccaagcacaagggcccccccgtgttcacccaggaggagagatacaagatggtgcaggccatcaagtgggtggacgaggtggtgcccgccgccccctacgtgaccaccctggagaccctggacaagtacaactgcgacttctgcgtgcacggcaacgacatcaccctgaccgtggacggcagagacacctacgaggaggtgaagcaggccggcagatacagagagtgcaagagaacccagggcgtgagcaccaccgacctggtgggcagaatgctgctggtgaccaaggcccaccacagcagccaggagatgagcagcgagtacagagagtacgccgacagcttcggcaagcccccccaccccatccccgccggcgacatcctgagcagcgagggctgcagccagtgccccggcggcagaaacccctggaccggcgtgagccagttcctgcagaccagccagaagatcatccagttcgccagcggcaaggagccccagcccggcgagaccgtgatctacgtggccggcgccttcgacctgttccacatcggccacgtggacttcctggagaaggtgcacagactggccgagagaccctacatcatcgccggcctgcacttcgaccaggaggtgaaccactacaagggcaagaactaccccatcatgaacctgcacgagagaaccctgagcgtgctggcctgcagatacgtgagcgaggtggtgatcggcgccccctacgccgtgaccgccgagctgctgagccacttcaaggtggacctggtgtgccacggcaagaccgagatcatccccgacagagacggcagcgacccctaccaggagcccaagagaagaggcatcttcagacagatcgacagcggcagcaacctgaccaccgacctgatcgtgcagagaatcatcaccaacagactggagtacgaggccagaaaccagaagaaggaggccaaggagctggccttcctggaggccgccagacagcaggccgcccagcccctgggcgagagagacggcgacttctag

SEQ ID NO: 23135 - DNA, 1170 bp, Artificial Sequence
  Description of Artificial Sequence: Synthetic coding sequence
atgatcagaaacggcagaggcgccgccggcggcgccgagcagcccggccccggcggcagaagagccgtgagagtgtggtgcgacggctgctacgacatggtgcactacggccacagcaaccagctgagacaggccagagccatgggcgactacctgatcgtgggcgtgcacaccgacgaggagatcgccaagcacaagggcccccccgtgttcacccaggaggagagatacaagatggtgcaggccatcaagtgggtggacgaggtggtgcccgccgccccctacgtgaccaccctggagaccctggacaagtacaactgcgacttctgcgtgcacggcaacgacatcaccctgaccgtggacggcagagacacctacgaggaggtgaagcaggccggcagatacagagagtgcaagagaacccagggcgtgagcaccaccgacctggtgggcagaatgctgctggtgaccaaggcccaccacagcagccaggagatgagcagcgagtacagagagtacgccgacagcttcggcaagtgccccggcggcagaaacccctggaccggcgtgagccagttcctgcagaccagccagaagatcatccagttcgccagcggcaaggagccccagcccggcgagaccgtgatctacgtggccggcgccttcgacctgttccacatcggccacgtggacttcctggagaaggtgcacagactggccgagagaccctacatcatcgccggcctgcacttcgaccaggaggtgaaccactacaagggcaagaactaccccatcatgaacctgcacgagagaaccctgagcgtgctggcctgcagatacgtgagcgaggtggtgatcggcgccccctacgccgtgaccgccgagctgctgagccacttcaaggtggacctggtgtgccacggcaagaccgagatcatccccgacagagacggcagcgacccctaccaggagcccaagagaagaggcatcttcagacagatcgacagcggcagcaacctgaccaccgacctgatcgtgcagagaatcatcaccaacagactggagtacgaggccagaaaccagaagaaggaggccaaggagctggccttcctggaggccgccagacagcaggccgcccagcccctgggcgagagagacggcgacttctag

SEQ ID NO: 23136 - DNA, 1515 bp, Artificial Sequence
  Description of Artificial Sequence: Synthetic coding sequence
atgagcgagaagcagatgaaggaggccttcgtgagcaacctgaacggcaccaccgtgctggagatcacccagggcctgtgcttccccgccttctgcatcctgtgcagaggcttcctgatcatcttcagccagtacctgtgcagcttcagccccacctggaagaccagattcctgaccgacttcgtggtgctgatcgtgcccatggtggccaccctgaccatctgggccagcttcatcctgctggagctgctgggcgtgatcatcttcggcgccggcctgctgtaccagatctacagaagaagaacctgctacgccagactgcccttcctgaagatcctggagaagttcctgaacatcagcctggagagcgagtacaaccccgccatcagctgcttcagagtgatcaccagcgccttcaccgccatcgccatcctggccgtggacttccccctgttccccagaagattcgccaagaccgagctgtacggcaccggcgccatggacttcggcgtgggcggcttcgtgttcggcagcgccatggtgtgcctggaggtgagaagaagaaagtacatggagggcagcaagctgcactacttcaccaacagcctgtacagcgtgtggcccctggtgttcctgggcatcggcagactggccatcatcaagagcatcggctaccaggagcacctgaccgagtacggcgtgcactggaacttcttcttcaccatcatcgtggtgaagctgatcacccccctgctgctgatcatcttccccctgaacaagagctggatcatcgccctgggcatcaccgtgctgtaccagctggccctggacttcaccagcctgaagagactgatcctgtacggcaccgacggcagcggcaccagagtgggcctgctgaacgccaacagagagggcatcatcagcaccctgggctacgtggccatccacatggccggcgtgcagaccggcctgtacatgcacaagaacagaagccacatcaaggacctgatcaaggtggcctgcttcctgctgctggccgccatcagcctgttcatcagcctgtacgtggtgcaggtgaacgtggaggccgtgagcagaagaatggccaacctggccttctgcatctggatcgtggccagcagcctgatcctgctgagcagcctgctgctgggcgacatcatcctgagcttcgccaagttcctgatcaagggcgccctggtgccctgcagctggaagctgatccagagccccgtgaccaacaagaagcacagcgagagcctggtgcccgaggccgagagaatggagcccagcctgtgcctgatcaccgccctgaacagaaagcagctgatcttcttcctgctgagcaacatcaccaccggcctgatcaacctgatggtggacaccctgcacagcagcaccctgtgggccctgttcgtggtgaacctgtacatgttcagcaactgcctgatcgtgtacgtgctgtacctgcaggacaagaccgtgcagttctggtag

SEQ ID NO: 23137 - DNA, 807 bp, Artificial Sequence
  Description of Artificial Sequence: Synthetic coding sequence
atgctgctgaaggagtacagaatctgcatgcccctgaccgtggacgagtacaagatcggccagctgtacatgatcagcaagcacagccacgagcagagcgacagaggcgagggcgtggaggtggtgcagaacgagcccttcgaggacccccaccacggcaacggccagttcaccgagaagagagtgtacctgaacagcaagctgcccagctgggccagagccgtggtgcccaagatcttctacgtgaccgagaaggcctggaactactacccctacaccatcaccgagtacacctgcagcttcctgcccaagttcagcatccacatcgagaccaagtacgaggacaacaagggcagcaacgacaccatcttcgacaacgaggccaaggacgtggagagagaggtgtgcttcatcgacatcgcctgcgacgagatccccgagagatactacaaggagagcgaggaccccaagcacttcaagagcgagaagaccggcagaggccagctgagagagggctggagagacagccaccagcccatcatgtgcagctacaagctggtgaccgtgaagttcgaggtgtggggcctgcagaccagagtggagcagttcgtgcacaaggtggtgagagacatcctgctgatcggccacagacaggccttcgcctgggtggacgagtggtacgacatgaccatggacgacgtgagagagtacgagaagaacatgcacgagcagaccaacatcaaggtgtgcaaccagcacagcagccccgtggacgacatcgagagccacgcccagaccagcacctag

SEQ ID NO: 23138 - DNA, 807 bp, Artificial Sequence
  Description of Artificial Sequence: Synthetic coding sequence
atgctgctgaaggagtacagaatctgcatgcccctgaccgtggacgagtacaagatcggccagctgtacatgatcagcaagcacagccacgagcagagcgacagaggcgagggcgtggaggtggtgcagaacgagcccttcgaggacccccaccacggcaacggccagttcaccgagaagagagtgtacctgaacagcaagctgcccagctgggccagagccgtggtgcccaagatcttctacgtgaccgagaaggcctggaactactacccctacaccatcaccgagtacaagtgcagcttcctgcccaagttcagcatccacatcgagaccaagtacgaggacaacaagggcagcaacgacaccatcttcgacaacgaggccaaggacgtggagagagaggtgtgcttcatcgacatcgcctgcgacgagatccccgagagatactacaaggagagcgaggaccccaagcacttcaagagcgagaagaccggcagaggccagctgagagagggctggagagacagccaccagcccatcatgtgcagctacaagctggtgaccgtgaagttcgaggtgtggggcctgcagaccagagtggagcagttcgtgcacaaggtggtgagagacatcctgctgatcggccacagacaggccttcgcctgggtggacgagtggtacgacatgaccatggacgacgtgagagagtacgagaagaacatgcacgagcagaccaacatcaaggtgtgcaaccagcacagcagccccgtggacgacatcgagagccacgcccagaccagcacctag

SEQ ID NO: 23139 - DNA, 999 bp, Artificial Sequence
  Description of Artificial Sequence: Synthetic coding sequence
atgctgctgaaggagtacagaatctgcatgcccctgaccgtggacgagtacaagatcggccagctgtacatgatcagcaagcacagccacgagcagagcgacagaggcgagggcgtggaggtggtgcagaacgagcccttcgaggacccccaccacggcaacggccagttcaccgagaagagagtgtacctgaacagcaagctgcccagctgggccagagccgtggtgcccaagatcttctacgtgaccgagaaggcctggaactactacccctacaccatcaccgagtacaagtgcagcttcctgcccaagttcagcatccacatcgagaccaagtacgaggacaacaagggcagcaacgacaccatcttcgacaacgaggccaaggacgtggagagagaggtgtgcttcatcgacatcgcctgcgacgagatccccgagagatactacaaggagagcgaggaccccaagcacttcaagagcgagaagaccggcagaggccagctgagagagggctggagagacagccaccagcccatcatgtgcagctacaagctggtgaccgtgaagttcgaggtgtggggcctgcagaccagagtggagcagttcgtgcacaaggtggtgagagacatcctgctgatcggccacagacaggccttcgcctgggtggacgagtggtacgacatgaccatggacgaggtgagagagttcgagagagccacccaggaggccaccaacaagaagatcggcatcttcccccccgccatcagcatcagcagcatccccctgctgcccagcagcgtgagaagcgcccccagcagcgcccccagcacccccctgagcaccgacgcccccgagttcctgagcgtgcccaaggacagacccagaaagaagagcgcccccgagaccctgaccctgcccgaccccgagaagaaggccaccctgaacctgcccggcatgcacagcagcgacaagccctgcagacccaagagcgagtag

SEQ ID NO: 23140 - DNA, 801 bp, Artificial Sequence
  Description of Artificial Sequence: Synthetic coding sequence
atgcacaacatcctgaagaagtaccaccagtacatcgtggagtgccacggcatcaccctgctgccccagttcctgggcatgtacagactgaacgtggacggcgtggagatctacgtgatcgtgaccagaaacgtgttcagccacagactgagcgtgtacagaaagtacgacctgaagatggccaacctgaaggccaccttcaccttccccaagcccaccggcagcaccgtggccagagaggccagcgacaaggagaaggccaaggagctgcccaccctgaaggacaacgacttcatcaacgagggccagaagatctacatcgacgacaacaacaagaaggtgttcctggagaagctgaagaaggacgtggagttcctggcccagctgaagctgatggactacagcctgctggtgggcatccacgacgtggagagagccgagcaggaggaggtggagtgcgaggagaacgacggcgaggaggagggcgagagcgacggcacccaccccgtgggcaccccccccgacagccccggcaacaccctgaacagcagcccccccctggcccccggcgagttcgaccccaacatcgacgtgtacggcatcaagtgccacgagaacagccccagaaaggaggtgtacttcatggccatcatcgacatcctgacccactacgacgccaagaagaaggccgcccacgccgccaagaccgtgaagcacggcgccggcgccgagatcagcaccgtgaaccccgagcagtacagcaagagattcctggacttcatcggccacatcctgacctag

SEQ ID NO: 23141 - DNA, 669 bp, Artificial Sequence
  Description of Artificial Sequence: Synthetic coding sequence
atgtggggcgtgaaccacagcatcaacgagctgagccacgtgcagatccccgtgatgctgatgcccgacgacttcaaggcctacagcaagatcaaggtggacaaccacctgttcaacaaggagaacatgcccagccacttcaagttcaaggagtactgccccatggtgttcagaaacctgagagagagattcggcatcgacgaccaggacttccagaacagcctgaccagaagcgcccccctgcccaacgacagccaggccagaagcggcgccagattccacaccagctacgacaagagatacatcatcaagaccatcaccagcgaggacgtggccgagatgcacaacatcctgaagaagtaccaccagtacatcgtggagtgccacggcatcaccctgctgccccagttcctgggcatgtacagactgaacgtggacggcgtggagatctacgtgatcgtgaccagaaacgtgttcagccacagactgagcgtgtacagaaagtacgacctgaagggcagcaccgtggccagagaggccagcgacaaggagaagagccccacccccgccatcgtggtgctgcccgtgccccacagcgccgccaccagcgagaagcactgcatcgaccccatgagagtgctgctgcacttcagcagcagcaactgctag

SEQ ID NO: 23142 - DNA, 1221 bp, Artificial Sequence
  Description of Artificial Sequence: Synthetic coding sequence
atggccacccccggcaacctgggcagcagcgtgctggccagcaagaccaagaccaagaagaagcacttcgtggcccagaaggtgaagctgttcagagccagcgaccccctgctgagcgtgctgatgtggggcgtgaaccacagcatcaacgagctgagccacgtgcagatccccgtgatgctgatgcccgacgacttcaaggcctacagcaagatcaaggtggacaaccacctgttcaacaaggagaacatgcccagccacttcaagttcaaggagtactgccccatggtgttcagaaacctgagagagagattcggcatcgacgaccaggacttccagaacagcctgaccagaagcgcccccctgcccaacgacagccaggccagaagcggcgccagattccacaccagctacgacaagagatacatcatcaagaccatcaccagcgaggacgtggccgagatgcacaacatcctgaagaagtaccaccagtacatcgtggagtgccacggcatcaccctgctgccccagttcctgggcatgtacagactgaacgtggacggcgtggagatctacgtgatcgtgaccagaaacgtgttcagccacagactgagcgtgtacagaaagtacgacctgaagggcagcaccgtggccagagaggccagcgacaaggagaaggccaaggagctgcccaccctgaaggacaacgacttcatcaacgagggccagaagatctacatcgacgacaacaacaagaaggtgttcctggagaagctgaagaaggacgtggagttcctggcccagctgaagctgatggactacagcctgctggtgggcatccacgacgtggagagagccgagcaggaggaggtggagtgcgaggagaacgacggcgaggaggagggcgagagcgacggcacccaccccgtgggcaccccccccgacagccccggcaacaccctgaacagcagcccccccctggcccccggcgagttcgaccccaacatcgacgtgtacggcatcaagtgccacgagaacagccccagaaaggaggtgtacttcatggccatcatcgacatcctgacccactacgacgccaagaagaaggccgcccacgccgccaagaccgtgaagcacggcgccggcgccgagatcagcaccgtgaaccccgagcagtacagcaagagattcctggacttcatcggccacatcctgacctag

SEQ ID NO: 23143 - DNA, 648 bp, Artificial Sequence
  Description of Artificial Sequence: Synthetic coding sequence
atcaacgagctgagccacgtgcagatccccgtgatgctgatgcccgacgacttcaaggcctacagcaagatcaaggtggacaaccacctgttcaacaaggagaacatgcccagccacttcaagttcaaggagtactgccccatggtgttcagaaacctgagagagagattcggcatcgacgaccaggacttccagaacagcctgaccagaagcgcccccctgcccaacgacagccaggccagaagcggcgccagattccacaccagctacgacaagagatacatcatcaagaccatcaccagcgaggacgtggccgagatgcacaacatcctgaagaagtaccaccagtacatcgtggagtgccacggcatcaccctgctgccccagttcctgggcatgtacagactgaacgtggacggcgtggagatctacgtgatcgtgaccagaaacgtgttcagccacagactgagcgtgtacagaaagtacgacctgaagggcagcaccgtggccagagaggccagcgacaaggagaagagccccacccccgccatcgtggtgctgcccgtgccccacagcgccgccaccagcgagaagcactgcatcgaccccatgagagtgctgctgcacttcagcagcagcaactgctag

SEQ ID NO: 23144 - DNA, 228 bp, Artificial Sequence
  Description of Artificial Sequence: Synthetic coding sequence
atcaacgagctgagccacgtgcagatccccgtgatgctgatgcccgacgacttcaaggcctacagcaagatcaaggtggacaaccacctgttcaacaaggagaacatgcccagccacttcaagttcaaggagtactgccccatggtgttcagaaacctgagagagagattcggcatcgacgaccaggacttccaggtgagctgcgtgtgcaacatctgcttccagtag

SEQ ID NO: 23145 - DNA, 1044 bp, Artificial Sequence
  Description of Artificial Sequence: Synthetic coding sequence
atgctgatgcccgacgacttcaaggcctacagcaagatcaaggtggacaaccacctgttcaacaaggagaacatgcccagccacttcaagttcaaggagtactgccccatggtgttcagaaacctgagagagagattcggcatcgacgaccaggacttccagaacagcctgaccagaagcgcccccctgcccaacgacagccaggccagaagcggcgccagattccacaccagctacgacaagagatacatcatcaagaccatcaccagcgaggacgtggccgagatgcacaacatcctgaagaagtaccaccagtacatcgtggagtgccacggcatcaccctgctgccccagttcctgggcatgtacagactgaacgtggacggcgtggagatctacgtgatcgtgaccagaaacgtgttcagccacagactgagcgtgtacagaaagtacgacctgaagggcagcaccgtggccagagaggccagcgacaaggagaaggccaaggagctgcccaccctgaaggacaacgacttcatcaacgagggccagaagatctacatcgacgacaacaacaagaaggtgttcctggagaagctgaagaaggacgtggagttcctggcccagctgaagctgatggactacagcctgctggtgggcatccacgacgtggagagagccgagcaggaggaggtggagtgcgaggagaacgacggcgaggaggagggcgagagcgacggcacccaccccgtgggcaccccccccgacagccccggcaacaccctgaacagcagcccccccctggcccccggcgagttcgaccccaacatcgacgtgtacggcatcaagtgccacgagaacagccccagaaaggaggtgtacttcatggccatcatcgacatcctgacccactacgacgccaagaagaaggccgcccacgccgccaagaccgtgaagcacggcgccggcgccgagatcagcaccgtgaaccccgagcagtacagcaagagattcctggacttcatcggccacatcctgacctag

SEQ ID NO: 23146 - DNA, 972 bp, Artificial Sequence
  Description of Artificial Sequence: Synthetic coding sequence
atgggcggccaggtgagcgccagcaacagcttcagcagactgcactgcagaaacgccaacgaggactggatgagcgccctgtgccccagactgtgggacgtgcccctgcaccacctgagcatccccggcagccacgacaccatgacctactgcctgaacaagaagagccccatcagccacgaggagagcagactgctgcagctgctgaacaaggccctgccctgcatcaccagacccgtggtgctgaagtggagcgtgacccaggccctggacgtgaccgagcagctggacgccggcgtgagatacctggacctgagaatcgcccacatgctggagggcagcgagaagaacctgcacttcgtgcacatggtgtacaccaccgccctggtggaggacaccctgaccgagatcagcgagtggctggagagacaccccagagaggtggtgatcctggcctgcagaaacttcgagggcctgagcgaggacctgcacgagtacctggtggcctgcatcaagaacatcttcggcgacatgctgtgccccagaggcgaggtgcccaccctgagacagctgtggagcagaggccagcaggtgatcgtgagctacgaggacgagagcagcctgagaagacaccacgagctgtggcccggcgtgccctactggtggggcaacagagtgaagaccgaggccctgatcagatacctggagaccatgaagagctgcggcagacccggcggcctgttcgtggccggcatcaacctgaccgagaacctgcagtacgtgctggcccaccccagcgagagcctggagaagatgaccctgcccaacctgcccagactgagcgcctgggtgagagagcagtgccccggccccggcagcagatgcaccaacatcatcgccggcgacttcatcggcgccgacggcttcgtgagcgacgtgatcgccctgaaccagaagctgctgtggtgctag

SEQ ID NO: 23147 - DNA, 972 bp, Artificial Sequence; identical to SEQ ID NO: 23146
  Description of Artificial Sequence: Synthetic coding sequence

SEQ ID NO: 23148 - DNA, 972 bp, Artificial Sequence; identical to SEQ ID NO: 23146
  Description of Artificial Sequence: Synthetic coding sequence

SEQ ID NO: 23149 - DNA, 537 bp, Artificial Sequence
  Description of Artificial Sequence: Synthetic coding sequence
atgggcggccaggtgagcgccagcaacagcttcagcagactgcactgcagaaacgccaacgaggactggatgagcgccctgtgccccagactgtgggacgtgcccctgcaccacctgagcatccccggcagccacgacaccatgacctactgcctgaacaagaagagccccatcagccacgaggagagcagactgctgcagctgctgaacaaggccctgccctgcatcaccagacccgtggtgctgaagtggagcgtgacccaggccctggacgtgaccgagcagctggacgccggcgtgagatacctggacctgagaatcgcccacatgctggagggcagcgagaagaacctgcacttcgtgcacatggtgtacaccaccgccctggtggaggacaccctgaccgagatcagcgagtggctggagagacaccccagagaggtggtgatcctggcctgcagaaacttcgagggcctgagcgaggacctgcacgagtacctggtggcctgcatcaagaacatcttcggcgacatgtag

SEQ ID NO: 23150 - DNA, 183 bp, Artificial Sequence
  Description of Artificial Sequence: Synthetic coding sequence
atgggcggccaggtgagcgccagcaacagcttcagcagactgcactgcagaaacgccaacgaggactggatgagcgccctgtgccccagactgtgggacgtgcccctgcaccacctgagcatccccggcagccacgacaccatgacctactgcctgaacaagaagagccccatcagccactag

SEQ ID NO: 23151 - DNA, 525 bp, Artificial Sequence
  Description of Artificial Sequence: Synthetic coding sequence
atgggcggccaggtgagcgccagcaacagcttcagcagactgcactgcagaaacgccaacgaggactggatgagcgccctgtgccccagactgtgggacgtgcccctgcaccacctgagcatccccggcagccacgacaccatgacctactgcctgaacaagaagagccccatcagccacgaggagagcagactgctgcagctgctgaacaaggccctgccctgcatcaccagacccgtggtgctgaagtggagcgtgacccaggccctggacgtgaccgagcagctggacgccggcgtgagatacctggacctgagaatcgcccacatgctggagggcagcgagaagaacctgcacttcgtgcacatggtgtacaccaccgccctggtggaggacaccctgaccgagatcagcgagtggctggagagacaccccagagaggtggtgatcctggcctgcagaaacttcgagggcctgagcgaggacctgcacgagtacctggtggcctgcatcaagaacatctag

SEQ ID NO: 23152 - DNA, 225 bp, Artificial Sequence
  Description of Artificial Sequence: Synthetic coding sequence
atgggcggccaggtgagcgccagcaacagcttcagcagactgcactgcagaaacgccaacgaggactggatgagcgccctgtgccccagactgtgggacgtgcccctgcaccacctgagcatccccggcagccacgacaccatgacctactgcctgaacaagaagagccccatcagccacgaggagagcagactgctgcagctgctgaacaaggccctgccctag

SEQ ID NO: 23153 - DNA, 267 bp, Artificial Sequence
  Description of Artificial Sequence: Synthetic coding sequence
atgggcggccaggtgagcgccagcaacagcttcagcagactgcactgcagaaacgccaacgaggactggatgagcgccctgtgccccagactgtgggacgtgcccctgcaccacctgagcatccccggcagccacgacaccatgacctactgcctgaacaagaagagccccatcagccacgaggagagcagactgctgcagctgctgaacaaggccctgccctgcatcaccagacccgtggtgctgaagtggagcgtgacccagtag

SEQ ID NO: 23154 - DNA, 525 bp, Artificial Sequence; identical to SEQ ID NO: 23151
  Description of Artificial Sequence: Synthetic coding sequence

SEQ ID NO: 23155 - DNA, 375 bp, Artificial Sequence
  Description of Artificial Sequence: Synthetic coding sequence
atgggcggccaggtgagcgccagcaacagcttcagcagactgcactgcagaaacgccaacgaggactggatgagcgccctgtgccccagactgtgggacgtgcccctgcaccacctgagcatccccggcagccacgacaccatgacctactgcctgaacaagaagagccccatcagccacgaggagagcagactgctgcagctgctgaacaaggccctgccctgcatcaccagacccgtggtgctgaagtggagcgtgacccaggccctggacgtgaccgagcagctggacgccggcgtgagatacctggacctgagaatcgcccacatgctggagggcagcgagaagaacctgcacttcgtgcacatggtgtag

SEQ ID NO: 23156 - DNA, 915 bp, Artificial Sequence
  Description of Artificial Sequence: Synthetic coding sequence
atgctggccgtgagaaaggccagaagaaagctgagaatgggcaccatctgcagccccaaccccagcggcaccaagaccagcagcgaggtgtgcaacgccgactggatggccagcctgcccccccacctgcacaacctgcccctgagcaacctggccatccccggcagccacgacagcttcagctactgggtggacgagaagagccccgtgggccccgaccagacccaggccatcaagagactggccagaatcagcctggtgaagaagctgatgaagaagtggagcgtgacccagaacctgaccttcagagagcagctggaggccggcatcagatacttcgacctgagagtgagcagcaagcccggcgacgccgaccaggagatctacttcatccacggcctgttcggcatcaaggtgtgggacggcctgatggagatcgacagcttcctgacccagcacccccaggagatcatcttcctggacttcaaccacttctacgccatggacgagacccaccacaagtgcctggtgctgagaatccaggaggccttcggcaacaagctgtgccccgcctgcagcgtggagagcctgaccctgagaaccctgtgggagaagaactgccaggtgctgatcttctaccactgccccttctacaagcagtaccccttcctgtggcccggcaagaagatccccgccccctgggccaacaccaccagcgtgagaaagctgatcctgttcctggagaccaccctgagcgagagagccagcagaggcagcttccacgtgagccaggccatcctgacccccagagtgaagaccatcgccagaggcctggtgggcggcctgaagaacaccctggtgcacagactggccctgatccccgtgtaccccctgagattcagcagaagaagctag

SEQ ID NO: 23157 - DNA, 918 bp, Artificial Sequence
  Description of Artificial Sequence: Synthetic coding sequence
atgctggccgtgagaaaggccagaagaaagctgagaatgggcaccatctgcagccccaaccccagcggcaccaagaccagcagcgaggtgtgcaacgccgactggatggccagcctgcccccccacctgcacaacctgcccctgagcaacctggccatccccggcagccacgacagcttcagctactgggtggacgagaagagccccgtgggccccgaccagacccaggccatcaagagactggccagaatcagcctggtgaagaagctgatgaagaagtggagcgtgacccagaacctgaccttcagagagcagctggaggccggcatcagatacttcgacctgagagtgagcagcaagcccggcgacgccgaccaggagatctacttcatccacggcctgttcggcatcaaggtgtgggacggcctgatggagatcgacagcttcctgacccagcacccccaggagatcatcttcctggacttcaaccacttctacgccatggacgagacccaccacaagtgcctggtgctgagaatccaggaggccttcggcaacaagctgtgccccgcctgcagcgtggagagcctgaccctgagaaccctgtgggagaagaactgccaggtgctgatcttctaccactgccccttctacaagcagtaccccttcctgtggcccggcaagaagatccccgccccctgggccaacaccaccagcgtgagaaagctgatcctgttcctggagaccaccctgagcgagagagccagcagaggcagcttccacgtgagccaggccatcctgacccccagagtgaagaccatcgccagaggcctggtgggcggcctgaagaacaccctggtgcacagcaacagatggaacagccacggccccagcctgctgagccaggagagaagctag

SEQ ID NO: 23158 - DNA, 966 bp, Artificial Sequence
  Description of Artificial Sequence: Synthetic coding sequence
atggccagcagccagggcaagaacgagctgaagctggccgactggatggccaccctgcccgagagcatgcacagcatccccctgaccaacctggccatccccggcagccacgacagcttcagcttctacatcgacgaggccagccccgtgggccccgagcagcccgagaccgtgcagaacttcgtgagcgtgttcggcaccgtggccaagaagctgatgagaaagtggctggccacccagaccatgaacttcaccggccagctgggcgccggcatcagatacttcgacctgagaatcagcaccaagcccagagaccccgacaacgagctgtacttcgcccacggcctgttcagcgccaaggtgaacgagggcctggaggagatcaacgccttcctgaccgaccaccacaaggaggtggtgttcctggacttcaaccacttctacggcatgcagaagtaccaccacgagaagctggtgcagatgctgaaggacatctacggcaacaagatgtgccccgccatcttcgcccaggaggtgagcctgaagtacctgtgggagaaggactaccaggtgctggtgttctaccacagccccgtggccctggaggtgcccttcctgtggcccggccagatgatgcccgccccctgggccaacaccaccgaccccgagaagctgatccagttcctgcaggccagcatcaccgagagaagaaagaagggcagcttcttcatcagccaggtggtgctgacccccaaggccagcaccgtggtgaagggcgtggccagcggcctgagagagaccatcaccgagagagccctgcccgccatgatgcagtgggtgagaacccagaagcccggcgagagcggcatcaacatcgtgaccgccgacttcgtggagctgggcgacttcatcagcaccgtgatcaagctgaactacgtgttcgacgagggcgaggccaacacctag

SEQ ID NO: 23159 - DNA, 966 bp, Artificial Sequence; identical to SEQ ID NO: 23158
  Description of Artificial Sequence: Synthetic coding sequence

SEQ ID NO: 23160 - DNA, 351 bp, Artificial Sequence
  Description of Artificial Sequence: Synthetic coding sequence
atgggccccaaggaccacatggtgaccagcagcttctgctgccagagcgacggctgcaacagcgccttcctgagcgtgcccctgaccaacctgaccgagaacggcctgatgtgccccgcctgcaccgccagcttcagagacaagtgcatgggccccatgacccactgcaccggcaaggagaaccactgcgtgagcctgagcggccacgtgcaggccggcatcttcaagcccagattcgccatgagaggctgcgccaccgagagcatgtgcttcaccaagcccggcgccgaggtgcccaccggcaccaacgtgctgttcctgcaccacatcgagtgcacccacagcccctag

SEQ ID NO: 23161 - DNA, 615 bp, Artificial Sequence
  Description of Artificial Sequence: Synthetic coding sequence
atgagactgagcagaagacccgagaccttcctgctggccttcgtgctgctgtgcaccctgctgggcctgggctgccccctgcactgcgagatctgcaccgccgccggcagcagatgccacggccagatgaagacctgcagcagcgacaaggacacctgcgtgctgctggtgggcaaggccaccagcaagggcaaggagctggtgcacacctacaagggctgcatcagaagccaggactgctacagcggcgtgatcagcaccaccatgggccccaaggaccacatggtgaccagcagcttctgctgccagagcgacggctgcaacagcgccttcctgagcgtgcccctgaccaacctgaccgagaacggcctgatgtgccccgcctgcaccgccagcttcagagacaagtgcatgggccccatgacccactgcaccggcaaggagaaccactgcgtgagcctgagcggccacgtgcaggccggcatcttcaagcccagattcgccatgagaggctgcgccaccgagagcatgtgcttcaccaagcccggcgccgaggtgcccaccggcaccaacgtgctgttcctgcaccacatcgagtgcacccacagcccctag

SEQ ID NO: 23162 - DNA, 2520 bp, Artificial Sequence
  Description of Artificial Sequence: Synthetic coding sequence
atgagagccaagtgcatcaccgagcccgtgggcatcgagctggccccctgcctgcaggcccccagcgtgcccgagaccgacctgaagggcgtggtgcaggccagaggcggcggcgccagcgtgctggagaagcccagagagggcttcaagagagccgagcaggtgcccgtgagccagaccgactgcttcgtgagcctgtggctgcccaccgccagccagaagaagctgagaaccagaaccatcagcaactgccccaaccccgagtggaacgagagcttcaacttccagatccagagcagagtgaagaacgtgctggagctgagcgtgtgcgacgaggacaccgtgacccccgacgaccacctgctgaccgtgctgtacgacctgaccaagctgtgcttcagaaagaagacccacgtgaagttccccctgaacccccagggcatggaggagctggaggtggagttcctgctggaggagagccccagcccccccgagaccctggtgaccaacggcgtgctggtgagcagacaggtgagctgcctggaggtgcacgcccagagcagaagaagaagaaagagagagaagatgaaggacctgctggtgatggtgaacgagagcttcgagaacacccagagagtgagaccctgcctggagccctgctgccccaccagcgcctgcttccagaccgccgcctgcttccactaccccaagtacttccagagccaggtgcacgtggaggtgcccaagagccactggagctgcggcctgtgctgcagaagcagaaagaagggccccatcagccagcccctggactgcctgagcgacggccaggtgatgaccctgcccgtgggcgagagctacgagctgcacatgaagagcaccccctgccccgagaccctggacgtgagactgggcttcagcctgtgccccgccgagctggagttcctgcagaagagaaaggtggtggtggccaaggccctgaagcaggtgctgcagctggaggaggacctgcaggaggacgaggtgcccctgatcgccatcatggccaccggcggcggcaccagaagcatgaccagcatgtacggccacctgctgggcctgcagaagctgaacctgctggactgcgccagctacatcaccggcctgagcggcgccacctggaccatggccaccctgtacagagaccccgactggagcagcaagaacctggagcccgccatcttcgaggccagaagacacgtggtgaaggacaagctgcccagcctgttccccgaccagctgagaaagttccaggaggagctgagacagagaagccaggagggctacagagtgaccttcaccgacttctggggcctgctgatcgagacctgcctgggcgacgagagaaacgagtgcaagctgagcgaccagagagccgccctgagctgcggccagaaccccctgcccatctacctgaccatcaacgtgaaggacgacgtgagcaaccaggacttcagagagtggttcgagttcagcccctacgaggtgggcctgcagaagtacggcgccttcatccccagcgagctgttcggcagcgagttcttcatgggcagactggtgaagagaatccccgagagcagaatctgctacatgctgggcctgtggagcagcatcttcagcctgaacctgctggacgcctggaacctgagccacaccagcgaggagttcttccacagatggaccagagagaaggtgcaggacatcgaggacgagcccatcctgcccgagatccccaagtgcgacgccaacatcctggagaccaccgtggtgatccccggcagctggctgagcaacagcttcagagagatcctgacccacagaagcttcgtgagcgagttccacaacttcctgagcggcctgcagctgcacaccaactacctgcagaacggccagttcagcagatggaaggacaccgtgctggacggcttccccaaccagctgaccgagagcgccaaccacctgtgcctgctggacaccgccttcttcgtgaacagcagctacccccccctgctgagacccgagagaaaggccgacctgatcatccacctgaactactgcgccggcagccagaccaagcccctgaagcagacctgcgagtactgcaccgtgcagaacatccccttccccaagtacgagctgcccgacgagaacgagaacctgaaggagtgctacctgatggagaacccccaggagcccgacgcccccatcgtgaccttcttccccctgatcaacgacaccttcagaaagtacaaggcccccggcgtggagagaagccccgaggagctggagcagggccaggtggacatctacggccccaagaccccctacgccaccaaggagctgacctacaccgaggccaccttcgacaagctggtgaagctgagcgagtacaacatcctgaacaacaaggacaccctgctgcaggccctgagactggccgtggagaagaagaagagactgaagggccagtgccccagctag

SEQ ID NO: 23163 - DNA, 2388 bp, Artificial Sequence
  Description of Artificial Sequence: Synthetic coding sequence
atgaccagcggcgccaccagatacagactgagctgcagcctgagaggccacgagctggacgtgagaggcctggtgtgctgcgcctacccccccggcgccttcgtgagcgtgagcagagacagaaccaccagactgtgggcccccgacagccccaacagaagcttcaccgagatgcactgcatgagcggccacagcaacttcgtgagctgcgtgtgcatcatccccagcagcgacatctacccccacggcctgatcgccaccggcggcaacgaccacaacatctgcatcttcagcctggacagccccatgcccctgtacatcctgaagggccacaagaacaccgtgtgcagcctgagcagcggcaagttcggcaccctgctgagcggcagctgggacaccaccgccaaggtgtggctgaacgacaagtgcatgatgaccctgcagggccacaccgccgccgtgtgggccgtgaagatcctgcccgagcagggcctgatgctgaccggcagcgccgacaagaccgtgaagctgtggaaggccggcagatgcgagagaaccttcagcggccacgaggactgcgtgagaggcctggccatcctgagcgagaccgagttcctgagctgcgccaacgacgccagcatcagaagatggcagatcaccggcgagtgcctggaggtgtactacggccacaccaactacatctacagcatcagcgtgttccccaactgcagagacttcgtgaccaccgccgaggacagaagcctgagaatctggaagcacggcgagtgcgcccagaccatcagactgcccgcccagagcatctggtgctgctgcgtgctggacaacggcgacatcgtggtgggcgccagcgacggcatcatcagagtgttcaccgagagcgaggacagaaccgccagcgccgaggagatcaaggccttcgagaaggagctgagccacgccaccatcgacagcaagaccggcgacctgggcgacatcaacgccgagcagctgcccggcagagagcacctgaacgagcccggcaccagagagggccagaccagactgatcagagacggcgagaaggtggaggcctaccagtggagcgtgagcgagggcagatggatcaagatcggcgacgtggtgggcagcagcggcgccaaccagcagaccagcggcaaggtgctgtacgagggcaaggagttcgactacgtgttcagcatcgacgtgaacgagggcggccccagctacaagctgccctacaacaccagcgacgacccctggctgaccgcctacaacttcctgcagaagaacgacctgaaccccatgttcctggaccaggtggccaagttcatcatcgacaacaccaagggccagatgctgggcctgggcaaccccagcttcagcgaccccttcaccggcggcggcagatacgtgcccggcagcagcggcagcagcaacaccctgcccaccgccgaccccttcaccggcgccggcagatacgtgcccggcagcgccagcatgggcaccaccatggccggcgtggaccccttcaccggcaacagcgcctacagaagcgccgccagcaagaccatgaacatctacttccccaagaaggaggccgtgaccttcgaccaggccaaccccacccagatcctgggcaagctgaaggagctgaacggcaccgcccccgaggagaagaagctgaccgaggacgacctgatcctgctggagaagatcctgagcctgatctgcaacagcagcagcgagaagcccaccgtgcagcagctgcagatcctgtggaaggccatcaactgccccgaggacatcgtgttccccgccctggacatcctgagactgagcatcaagcaccccagcgtgaacgagaacttctgcaacgagaaggagggcgcccagttcagcagccacctgatcaacctgctgaaccccaagggcaagcccgccaaccagctgctggccctgagaaccttctgcaactgcttcgtgggccaggccggccagaagctgatgatgagccagagagagagcctgatgagccacgccatcgagctgaagagcggcagcaacaagaacatccacatcgccctggccaccctggccctgaactacagcgtgtgcttccacaaggaccacaacatcgagggcaaggcccagtgcctgagcctgatcagcaccatcctggaggtggtgcaggacctggaggccaccttcagactgctggtggccctgggcaccctgatcagcgacgacagcaacgccgtgcagctggccaagagcctgggcgtggacagccagatcaagaagtacagcagcgtgagcgagcccgccaaggtgagcgagtgctgcagattcatcctgaacctgctgtag

SEQ ID NO: 23164 - DNA, 2367 bp, Artificial Sequence
  Description of Artificial Sequence: Synthetic coding sequence
atgctgtgcggcagatggagaagatgcagaagaccccccgaggagccccccgtggccgcccaggtggccgcccaggtggccgcccccgtggccctgcccagcccccccacccccagcgacggcggcaccaagagacccggcctgagagccctgaagaagatgggcctgaccgaggacgaggacgtgagagccatgctgagaggcagcagactgagaaagatcagaagcagaacctggcacaaggagagactgtacagactgcaggaggacggcctgagcgtgtggttccagagaagaatccccagagcccccagccagcacatcttcttcgtgcagcacatcgaggccgtgagagagggccaccagagcgagggcctgagaagattcggcggcgccttcgcccccgccagatgcctgaccatcgccttcaagggcagaagaaagaacctggacctggccgcccccaccgccgaggaggcccagagatgggtgagaggcctgaccaagctgagagccagactggacgccatgagccagagagagagactggacccctggatccacagctacctgcacagagccgacagcaaccaggacagcaagatgagcttcaaggagatcaagagcctgctgagaatggtgaacgtggacatgaacgacatgtacgcctacctgctgttcaaggagtgcgaccacagcaacaacgacagactggagggcgccgagatcgaggagttcctgagaagactgctgaagagacccgagctggaggagatcttccaccagtacagcggcgaggacagagtgctgagcgcccccgagctgctggagttcctggaggaccagggcgaggagggcgccaccctggccagagcccagcagctgatccagacctacgagctgaacgagaccgccaagcagcacgagctgatgaccctggacggcttcatgatgtacctgctgagccccgagggcgccgccctggacaacacccacacctgcgtgttccaggacatgaaccagcccctggcccactacttcatcagcagcagccacaacacctacctgaccgacagccagatcggcggccccagcagcaccgaggcctacgacagagccttcgcccagggctgcagatgcgtggagctggactgctgggagggccccggcggcgagcccgtgatctaccacggccacaccctgaccagcaagatcctgttcagagacgtggtgcaggccgtgagagaccacgccttcaccctgagcccctaccccgtgatcctgagcctggagaaccactgcggcctggagcagcaggccgccatggccagacacctgtgcaccatcctgggcgacatgctggtgacccaggccctggacagccccaaccccgaggagctgcccagccccgagcagctgaagggcagagtgctggtgaagggcaagaagctgcccgccgccagaagcgaggacggcagagccctgagcgacagagaggaggaggaggaggacgacgaggaggaggaggaggaggtggaggccgccgcccagagaagactggccaagcagatcagccccgagctgagcgccctggccgtgtactgccacgccaccagactgagactgcaccccgcccccaacgccccccagccctgccaggtgagcagcctgagcgagagaaaggccaagaagctgatcagagaggccggcaacagcttcgtgagacacaacgccagacagctgaccagagtgtaccccctgggcctgagaatgaacagcgccaactacagcccccaggagatgtggaacagcggctgccagctggtggccctgaacttccagacccccggctacgagatggacctgaacgccggcagattcctggtgaacggccagtgcggctacgtgctgaagcccgcctgcctgagacagcccgacagcaccttcgaccccgagtaccccggcccccccagaaccaccctgagcatccaggtgctgaccgcccagcagctgcccaagctgaacgccgagaagccccacagcatcgtggaccccctggtgagaatcgagatccacggcgtgcccgccgactgcgccagacaggagaccgactacgtgctgaacaacggcttcaaccccagatggggccagaccctgcagttccagctgagagcccccgagctggccctggtgagattcgtggtggaggactacgacgccaccagccccaacgacttcgtgggccagttcaccctgcccctgagcagcctgaagcagggctacagacacatccacctgctgagcaaggacggcgccagcctgagccccgccaccctgttcatccagatcagaatccagagaagctag

SEQ ID NO: 23165 - DNA, 144 bp, Artificial Sequence
  Description of Artificial Sequence: Synthetic coding sequence
atgagccagcagaagtgcatcgtgatcttcgccctggtgtgctgcttcgccatcctggtggccctgatcttcagcgccgtggacatcatgggcgaggacgaggacggcctgagcgagaagaactgccagaacaagtgcagatag

SEQ ID NO: 23166 - DNA, 816 bp, Artificial Sequence
  Description of Artificial Sequence: Synthetic coding sequence
atggccagcaaggacgcccagaaccagagaagaggcctgcccggcttcctgcccggcgcccccgaccccgaccagagcctgcccgccagcagcaaccccggcaaccaggcctggcagctgagcctgcccctgcccagcagcttcctgcccaccgtgagcctgccccccggcctggagtacctgagccagctggacctgatcatcatccaccagcaggtggagctgctgggcatgatcctgggcaccgagaccagcaacaagtacgagatcaagaacagcctgggccagagaatctacttcgccgtggaggagagcatctgcttcaacagaaccttctgcagcaccctgagaagctgcaccctgagaatcaccgacaacagcggcagagaggtgatcaccgtgaacagacccctgagatgcaacagctgctggtgcccctgctacctgcaggagctggagatccaggccccccccggcaccatcgtgggctacgtgacccagaagtgggaccccttcctgcccaagttcaccatccagaacgccaacaaggaggacatcctgaagatcgtgggcccctgcgtgacctgcggctgcttcggcgacgtggacttcgaggtgaagaccatcaacgagaagctgaccatcggcaagatcagcaagtactggagcggcttcgtgaacgacgtgttcaccaacgccgacaacttcggcatccacgtgcccgccgacctggacgtgaccgtgaaggccgccatgatcggcgcctgcttcctgttcgacttcatgttcttcgagcacagcctggccggcctgtag

SEQ ID NO: 23167 - DNA, 816 bp, Artificial Sequence; identical to SEQ ID NO: 23166
  Description of Artificial Sequence: Synthetic coding sequence

SEQ ID NO: 23168 - DNA, 3033 bp, Artificial Sequence
  Description of Artificial Sequence: Synthetic coding sequence
atggccgccagagtgctgatcatcggcagcggcggcagagagcacaccctggcctggaagctggcccagagccaccacgtgaagcaggtgctggtggcccccggcaacgccggcaccgcctgcagcgagaagatcagcaacaccgccatcagcatcagcgaccacaccgccctggcccagttctgcaaggagaagaagatcgagttcgtggtggtgggccccgaggcccccctggccgccggcatcgtgggcaacctgagaagcgccggcgtgcagtgcttcggccccaccgccgaggccgcccagctggagagcagcaagagattcgccaaggagttcatggacagacacggcatccccaccgcccagtggaaggccttcaccaagcccgaggaggcctgcagcttcatcctgagcgccgacttccccgccctggtggtgaaggccagcggcctggccgccggcaagggcgtgatcgtggccaagagcaaggaggaggcctgcaaggccgtgcaggagatcatgcaggagaaggccttcggcgccgccggcgagaccatcgtgatcgaggagctgctggacggcgaggaggtgagctgcctgtgcttcaccgacggcaagaccgtggcccccatgccccccgcccaggaccacaagagactgctggagggcgacggcggccccaacaccggcggcatgggcgcctactgccccgccccccaggtgagcaacgacctgctgctgaagatcaaggacaccgtgctgcagagaaccgtggacggcatgcagcaggagggcaccccctacaccggcatcctgtacgccggcatcatgctgaccaagaacggccccaaggtgctggagttcaactgcagattcggcgaccccgagtgccaggtgatcctgcccctgctgaagagcgacctgtacgaggtgatccagagcaccctggacggcctgctgtgcaccagcctgcccgtgtggctggagaaccacaccgccctgaccgtggtgatggccagcaagggctaccccggcgactacaccaagggcgtggagatcaccggcttccccgaggcccaggccctgggcctggaggtgttccacgccggcaccgccctgaagaacggcaaggtggtgacccacggcggcagagtgctggccgtgaccgccatcagagagaacctgatcagcgccctggaggaggccaagaagggcctggccgccatcaagttcgagggcgccatctacagaaaggacgtgggcttcagagccatcgccttcctgcagcagcccagaagcctgacctacaaggagagcggcgtggacatcgccgccggcaacatgctggtgaagaagatccagcccctggccaaggccaccagcagaagcggctgcaaggtggacctgggcggcttcgccggcctgttcgacctgaaggccgccggcttcaaggaccccctgctggccagcggcaccgacggcgtgggcaccaagctgaagatcgcccagctgtgcaacaagcacgacaccatcggccaggacctggtggccatgtgcgtgaacgacatcctggcccagggcgccgagcccctgttcttcctggactacttcagctgcggcaagctggacctgagcgtgaccgaggccgtggtggccggcatcgccaaggcctgcggcaaggccggctgcgccctgctgggcggcgagaccgccgagatgcccgacatgtacccccccggcgagtacgacctggccggcttcgccgtgggcgccatggagagagaccagaagctgccccacctggagagaatcaccgagggcgacgtggtggtgggcatcgccagcagcggcctgcacagcaacggcttcagcctggtgagaaagatcgtggccaagagcagcctgcagtacagcagccccgcccccgacggctgcggcgaccagaccctgggcgacctgctgctgacccccaccagaatctacagccacagcctgctgcccgtgctgagaagcggccacgtgaaggccttcgcccacatcaccggcggcggcctgctggagaacatccccagagtgctgcccgagaagctgggcgtggacctggacgcccagacctggagaatccccagagtgttcagctggctgcagcaggagggccacctgagcgaggaggagatggccagaaccttcaactgcggcgtgggcgccgtgctggtggtgagcaaggagcagaccgagcagatcctgagagacatccagcagcacaaggaggaggcctgggtgatcggcagcgtggtggccagagccgagggcagccccagagtgaaggtgaagaacctgatcgagagcatgcagatcaacggcagcgtgctgaagaacggcagcctgaccaaccacttcagcttcgagaagaagaaggccagagtggccgtgctgatcagcggcaccggcagcaacctgcaggccctgatcgacagcaccagagagcccaacagcagcgcccagatcgacatcgtgatcagcaacaaggccgccgtggccggcctggacaaggccgagagagccggcatccccaccagagtgatcaaccacaagctgtacaagaacagagtggagttcgacagcgccatcgacctggtgctggaggagttcagcatcgacatcgtgtgcctggccggcttcatgagaatcctgagcggccccttcgtgcagaagtggaacggcaagatgctgaacatccaccccagcctgctgcccagcttcaagggcagcaacgcccacgagcaggccctggagaccggcgtgaccgtgaccggctgcaccgtgcacttcgtggccgaggacgtggacgccggccagatcatcctgcaggaggccgtgcccgtgaagagaggcgacaccgtggccaccctgagcgagagagtgaagctggccgagcacaagatcttccccgccgccctgcagctggtggccagcggcaccgtgcagctgggcgagaacggcaagatctgctgggtgaaggaggagtag

SEQ ID NO: 23169 - DNA, 3033 bp, Artificial Sequence; identical to SEQ ID NO: 23168
  Description of Artificial Sequence: Synthetic coding sequence

SEQ ID NO: 23170 - DNA, 3033 bp, Artificial Sequence; identical to SEQ ID NO: 23168
  Description of Artificial Sequence: Synthetic coding sequence

SEQ ID NO: 23171 - DNA, 993 bp, Artificial Sequence
  Description of Artificial Sequence: Synthetic coding sequence
atggagctgctgagcaccccccacagcatcgagatcaacaacatcacctgcgacagcttcagaatcagctgggccatggaggacagcgacctggagagagtgacccactacttcatcgacctgaacaagaaggagaacaagaacagcaacaagttcaagcacagagacgtgcccaccaagctggtggccaaggccgtgcccctgcccatgaccgtgagaggccactggttcctgagccccagaaccgagtacagcgtggccgtgcagaccgccgtgaagcagagcgacggcgagtacctggtgagcggctggagcgagaccgtggagttctgcaccggcgactacgccaaggagcacctggcccagctgcaggagaaggccgagcagatcgccggcagaatgctgagattcagcgtgttctacagaaaccaccacaaggagtacttccagcacgccagaacccactgcggcaacatgctgcagccctacctgaaggacaacagcggcagccacggcagccccaccagcggcatgctgcacggcgtgttcttcagctgcaacaccgagttcaacaccggccagcccccccaggacagcccctacggcagatggagattccagatccccgcccagagactgttcaaccccagcaccaacctgtacttcgccgacttctactgcatgtacaccgcctaccactacgccatcctggtgctggcccccaagggcagcctgggcgacagattctgcagagacagactgcccctgctggacatcgcctgcaacaagttcctgacctgcagcgtggaggacggcgagctggtgttcagacacgcccaggacctgatcctggagatcatctacaccgagcccgtggacctgagcctgggcaccctgggcgagatcagcggccaccagctgatgagcctgagcaccgccgacgccaagaaggaccccagctgcaagacctgcaacatcagcgtgggcagatag

SEQ ID NO: 23172 - DNA, 714 bp, Artificial Sequence
  Description of Artificial Sequence: Synthetic coding sequence
atggagctgctgagcaccccccacagcatcgagatcaacaacatcacctgcgacagcttcagaatcagctgggccatggaggacagcgacctggagagagtgacccactacttcatcgacctgaacaagaaggagaacaagaacagcaaccaccacaaggagtacttccagcacgccagaacccactgcggcaacatgctgcagccctacctgaaggacaacagcggcagccacggcagccccaccagcggcatgctgcacggcgtgttcttcagctgcaacaccgagttcaacaccggccagcccccccaggacagcccctacggcagatggagattccagatccccgcccagagactgttcaaccccagcaccaacctgtacttcgccgacttctactgcatgtacaccgcctaccactacgccatcctggtgctggcccccaagggcagcctgggcgacagattctgcagagacagactgcccctgctggacatcgcctgcaacaagttcctgacctgcagcgtggaggacggcgagctggtgttcagacacgcccaggacctgatcctggagatcatctacaccgagcccgtggacctgagcctgggcaccctgggcgagatcagcggccaccagctgatgagcctgagcaccgccgacgccaagaaggaccccagctgcaagacctgcaacatcagcgtgggcagatag

SEQ ID NO: 23173 - DNA, 993 bp, Artificial Sequence; identical to SEQ ID NO: 23171
  Description of Artificial Sequence: Synthetic coding sequence

SEQ ID NO: 23174 - DNA, 894 bp, Artificial Sequence
  Description of Artificial Sequence: Synthetic coding sequence
atggcctgcctgagccccagccagctgcagaagttccagcaggacggcttcctggtgctggagggcttcctgagcgccgaggagtgcgtggccatgcagcagagaatcggcgagatcgtggccgagatggacgtgcccctgcactgcagaaccgagttcagcacccaggaggaggagcagctgagagcccagggcagcaccgactacttcctgagcagcggcgacaagatcagattcttcttcgagaagggcgtgttcgacgagaagggcaacttcctggtgccccccgagaagagcatcaacaagatcggccacgccctgcacgcccacgaccccgtgttcaagagcatcacccacagcttcaaggtgcagaccctggccagaagcctgggcctgcagatgcccgtggtggtgcagagcatgtacatcttcaagagccccctgatcagaaccccccccagctgcaccagaagcccctgggccggctgctgggcctgcggcagccagtggagaatgcccagatggagaaccgccgtgagcggcagcagcctggcccccacccccgtggtgtgccaggagggctggagcggccccctgctggcccagagactggtgcccgccagcctgggccagagccagcccggcatcaccgccagcctgtgccccccccagtgcagagagggcccctggagcagcagcatggagaagtggtacaccagagccagcagaaccagcctgaccgccagagccagacccaccctgagcaccagctggagacccctggccccccccggcgccagaagaaccggcagcagccagcagctgaactgccccttccccaactgcacccccaagggcagcagaagagccggcgccctggccccccccggctag

SEQ ID NO: 23175 - DNA, 813 bp, Artificial Sequence
  Description of Artificial Sequence: Synthetic coding sequence
atggcctgcctgagccccagccagctgcagaagttccagcaggacggcttcctggtgctggagggcttcctgagcgccgaggagtgcgtggccatgcagcagagaatcggcgagatcgtggccgagatggacgtgcccctgcactgcagaaccgagttcagcacccaggaggaggagcagctgagagcccagggcagcaccgactacttcctgagcagcggcgacaagatcagattcttcttcgagaagggcgtgttcgacgagaagggcaacttcctggtgccccccgagaagagcatcaacaagatcggccacgccctgcacgcccacgaccccgtgttcaagagcatcacccacagcttcaaggtgcagcagccccacttcggcggcgaggtgagcccccaccaggacgccagcttcctgtacaccgagcccctgggcagagtgctgggcgtgtggatcgccgtggaggacgccaccctggagaacggctgcctgtggttcatccccggcagccacaccagcggcgtgagcagaagaatggtgagagcccccgtgggcagcgcccccggcaccagcttcctgggcagcgagcccgccagagacaacagcctgttcgtgcccacccccgtgcagagaggcgccctggtgctgatccacggcgaggtggtgcacaagagcaagcagaacctgagcgacagaagcagacaggcctacaccttccacctgatggaggccagcggcaccacctggagccccgagaactggctgcagcccaccgccgagctgcccttcccccagctgtacacctag

SEQ ID NO: 23176 - DNA, 876 bp, Artificial Sequence
  Description of Artificial Sequence: Synthetic coding sequence
atggcctgcctgagccccagccagctgcagaagttccagcaggacggcttcctggtgctggagggcttcctgagcgccgaggagtgcgtggccatgcagcagagaatcggcgagatcgtggccgagatggacgtgcccctgcactgcagaaccgagttcagcacccaggaggaggagcagctgagagcccagggcagcaccgactacttcctgagcagcggcgacaagatcagattcttcttcgagaagggcgtgttcgacgagaagggcaacttcctggtgccccccgagaagagcatcaacaagatcggccacgccctgcacgcccacgaccccgtgttcaagagcatcacccacagcttcaaggtgcagaccctggccagaagcctgggcctgcagatgcccgtggtggtgcagagcatgtacatcttcaagcagccccacttcggcggcgaggtgagcccccaccaggacgccagcttcctgtacaccgagcccctgggcagagtgctgggcgtgtggatcgccgtggaggacgccaccctggagaacggctgcctgtggttcatccccggcagccacaccagcggcgtgagcagaagaatggtgagagcccccgtgggcagcgcccccggcaccagcttcctgggcagcgagcccgccagagacaacagcctgttcgtgcccacccccgtgcagagaggcgccctggtgctgatccacggcgaggtggtgcacaagagcaagcagaacctgagcgacagaagcagacaggcctacaccttccacctgatggaggccagcggcaccacctggagccccgagaactggctgcagcccaccgccgagctgcccttcccccagctgtacacctag

SEQ ID NO: 23177 - DNA, 201 bp, Artificial Sequence
  Description of Artificial Sequence: Synthetic coding sequence
atggcctgcctgagccccagccagctgcagaagttccagcaggacggcttcctggtgctggagggcttcctgagcgccgaggagtgcgtggccatgcagcagagaatcggcgagatcgtggccgagatggacgtgcccctgcactgcagaaccgagttcagcacccaggaggaggagcagctgagagcccagggcagctag

SEQ ID NO: 23178 - DNA, 813 bp, Artificial Sequence; identical to SEQ ID NO: 23175
  Description of Artificial Sequence: Synthetic coding sequence

SEQ ID NO: 23179 - DNA, 534 bp, Artificial Sequence
  Description of Artificial Sequence: Synthetic coding sequence
atggcctgcctgagccccagccagctgcagaagttccagcaggacggcttcctggtgctggagggcttcctgagcgccgaggagtgcgtggccatgcagcagagaatcggcgagatcgtggccgagatggacgtgcccctgcactgcagaaccgagttcagcacccaggaggaggagcagctgagagcccagggcagcaccgactacttcctgagcagcggcgacaagatcagattcttcttcgagaagggcgtgttcgacgagaagggcaacttcctggtgccccccgagaagagcatcaacaagatcggccacgccctgcacgcccacgaccccgtgttcaagagcatcacccacagcttcaaggtgcagaccctggccagaagcctgggcctgcagatgcccgtggtggtgcagagcatgtacatcttcaagcagccccacttcggcggcgaggtgagcccccaccaggacgccagcttcctgtacaccgagcccctgggcagagtgctgggcgtgtggatcgccgtgtag

SEQ ID NO: 23180 - DNA, 195 bp, Artificial Sequence
  Description of Artificial Sequence: Synthetic coding sequence
atggcctgcctgagccccagccagctgcagaagttccagcaggacggcttcctggtgctggagggcttcctgagcgccgaggagtgcgtggccatgcagcagagaatcggcgagatcgtggccgagatggacgtgcccctgcactgcagaaccgagttcagcacccaggaggaggagcagctgagagcccagtag

SEQ ID NO: 23181 - DNA, 1779 bp, Artificial Sequence
  Description of Artificial Sequence: Synthetic coding sequence
atggccagcaccagcagagacgtgatcgccggcagaggcatccacagcaaggtgaagagcgccaagctgctggaggtgctgaacgccatggaggaggaggagagcaacaacaacagagaggagatcttcatcgccccccccgacaacgccgccggcgagttcaccgacgaggacagcggcgacgaggacagccagagaggcgcccacctgcccggcagcgtgctgcacgccagcgtgctgtgcgaggacagcggcaccggcgaggacaacgacgacctggagctgcagcccgccaagaagagacagaaggccgtggtgaagccccagagaatctggaccaagagagacatcagacccgacttcggcagctggaccgccagcgacccccacatcgaggacctgaagagccaggagctgagccccgtgggcctgttcgagctgttcttcgacgagggcaccatcaacttcatcgtgaacgagaccaacagatacgcctggcagaagaacgtgaacctgagcctgaccgcccaggagctgaagtgcgtgctgggcatcctgatcctgagcggctacatcagctaccccagaagaagaatgttctgggagaccagccccgacagccaccaccacctggtggccgacgccatcagaagagacagattcgagctgatcttcagctacctgcacttcgccgacaacaacgagctggacgccagcgacagattcgccaaggtgagacccctgatcatcagaatgaactgcaacttccagaagcacgcccccctggaggagttctacagcttcggcgagagcatgtgcgagtacttcggccacagaggcagcaagcagctgcacagaggcaagcccgtgagactgggctacaagatctggtgcggcaccaccagcagaggctacctggtgtggttcgagcccagccagggcaccctgttcaccaagcccgacagaagcctggacctgggcggcagcatggtgatcaagttcgtggacgccctgcaggagagaggcttcctgccctaccacatcttcttcgacaaggtgttcaccagcgtgaagctgatgagcatcctgagaaagaagggcgtgaaggccaccggcaccgtgagagagtacagaaccgagagatgccccctgaaggaccccaaggagctgaagaagatgaagagaggcagcttcgactacaaggtggacgagagcgaggagatcatcgtgtgcagatggcacgacagcagcgtggtgaacatctgcagcaacgccgtgggcatcgagcccgtgagactgaccagcagacacagcggcgccgccaagaccagaacccaggtgcaccagcccagcctggtgaagctgtaccaggagaaggtgggcggcgtgggcagaatggaccagaacatcgccaagtacaaggtgaagatcagaggcatgaagtggtacagcagcttcatcggctacgtgatcgacgccgccctgaacaacgcctggcagctgcacagaatctgctgccaggacgcccaggtggacctgctggccttcagaagatacatcgcctgcgtgtacctggagagcaacgccgacaccaccagccagggcagaagaagcagaagactggagaccgagagcagattcgacatgatcggccactggatcatccaccaggacaagagaaccagatgcgccctgtgccacagccagaccaacaccagatgcgagaagtgccagaagggcgtgcacgccaagtgcttcagagagtaccacatcagatag

SEQ ID NO: 23182 - DNA, 1026 bp, Artificial Sequence
  Description of Artificial Sequence: Synthetic coding sequence
atgaactgcaacttccagaagcacgcccccctggaggagttctacagcttcggcgagagcatgtgcgagtacttcggccacagaggcagcaagcagctgcacagaggcaagcccgtgagactgggctacaagatctggtgcggcaccaccagcagaggctacctggtgtggttcgagcccagccagggcaccctgttcaccaagcccgacagaagcctggacctgggcggcagcatggtgatcaagttcgtggacgccctgcaggagagaggcttcctgccctaccacatcttcttcgacaaggtgttcaccagcgtgaagctgatgagcatcctgagaaagaagggcgtgaaggccaccggcaccgtgagagagtacagaaccgagagatgccccctgaaggaccccaaggagctgaagaagatgaagagaggcagcttcgactacaaggtggacgagagcgaggagatcatcgtgtgcagatggcacgacagcagcgtggtgaacatctgcagcaacgccgtgggcatcgagcccgtgagactgaccagcagacacagcggcgccgccaagaccagaacccaggtgcaccagcccagcctggtgaagctgtaccaggagaaggtgggcggcgtgggcagaatggaccagaacatcgccaagtacaaggtgaagatcagaggcatgaagtggtacagcagcttcatcggctacgtgatcgacgccgccctgaacaacgcctggcagctgcacagaatctgctgccaggacgcccaggtggacctgctggccttcagaagatacatcgcctgcgtgtacctggagagcaacgccgacaccaccagccagggcagaagaagcagaagactggagaccgagagcagattcgacatgatcggccactggatcatccaccaggacaagagaaccagatgcgccctgtgccacagccagaccaacaccagatgcgagaagtgccagaagggcgtgcacgccaagtgcttcagagagtaccacatcagatag

SEQ ID NO: 23183 - DNA, 1770 bp, Artificial Sequence
  Description of Artificial Sequence: Synthetic coding sequence
atgggcagagacgtgatcgccggcagaggcatccacagcaaggtgaagagcgccaagctgctggaggtgctgaacgccatggaggaggaggagagcaacaacaacagagaggagatcttcatcgccccccccgacaacgccgccggcgagttcaccgacgaggacagcggcgacgaggacagccagagaggcgcccacctgcccggcagcgtgctgcacgccagcgtgctgtgcgaggacagcggcaccggcgaggacaacgacgacctggagctgcagcccgccaagaagagacagaaggccgtggtgaagccccagagaatctggaccaagagagacatcagacccgacttcggcagctggaccgccagcgacccccacatcgaggacctgaagagccaggagctgagccccgtgggcctgttcgagctgttcttcgacgagggcaccatcaacttcatcgtgaacgagaccaacagatacgcctggcagaagaacgtgaacctgagcctgaccgcccaggagctgaagtgcgtgctgggcatcctgatcctgagcggctacatcagctaccccagaagaagaatgttctgggagaccagccccgacagccaccaccacctggtggccgacgccatcagaagagacagattcgagctgatcttcagctacctgcacttcgccgacaacaacgagctggacgccagcgacagattcgccaaggtgagacccctgatcatcagaatgaactgcaacttccagaagcacgcccccctggaggagttctacagcttcggcgagagcatgtgcgagtacttcggccacagaggcagcaagcagctgcacagaggcaagcccgtgagactgggctacaagatctggtgcggcaccaccagcagaggctacctggtgtggttcgagcccagccagggcaccctgttcaccaagcccgacagaagcctggacctgggcggcagcatggtgatcaagttcgtggacgccctgcaggagagaggcttcctgccctaccacatcttcttcgacaaggtgttcaccagcgtgaagctgatgagcatcctgagaaagaagggcgtgaaggccaccggcaccgtgagagagtacagaaccgagagatgccccctgaaggaccccaaggagctgaagaagatgaagagaggcagcttcgactacaaggtggacgagagcgaggagatcatcgtgtgcagatggcacgacagcagcgtggtgaacatctgcagcaacgccgtgggcatcgagcccgtgagactgaccagcagacacagcggcgccgccaagaccagaacccaggtgcaccagcccagcctggtgaagctgtaccaggagaaggtgggcggcgtgggcagaatggaccagaacatcgccaagtacaaggtgaagatcagaggcatgaagtggtacagcagcttcatcggctacgtgatcgacgccgccctgaacaacgcctggcagctgcacagaatctgctgccaggacgcccaggtggacctgctggccttcagaagatacatcgcctgcgtgtacctggagagcaacgccgacaccaccagccagggcagaagaagcagaagactggagaccgagagcagattcgacatgatcggccactggatcatccaccaggacaagagaaccagatgcgccctgtgccacagccagaccaacaccagatgcgagaagtgccagaagggcgtgcacgccaagtgcttcagagagtaccacatcagatag

SEQ ID NO: 23184 - DNA, 1782 bp, Artificial Sequence
  Description of Artificial Sequence: Synthetic coding sequence
atgcccagaaccctgagcctgcacgagatcaccgacctgctggagaccgacgacagcatcgaggccagcgccatcgtgatccagccccccgagaacgccaccgcccccgtgagcgacgaggagagcggcgacgaggagggcggcaccatcaacaacctgcccggcagcctgctgcacaccgccgcctacctgatccaggacggcagcgacgccgagagcgacagcgacgaccccagctacgcccccaaggacgacagccccgacgaggtgcccagcaccttcaccgtgcagcagcccccccccagcagaagaagaaagatgaccaagatcctgtgcaagtggaagaaggccgacctgaccgtgcagcccgtggccggcagagtgaccgccccccccaacgacttcttcaccgtgatgagaacccccaccgagatcctggagctgttcctggacgacgaggtgatcgagctgatcgtgaagtacagcaacctgtacgcctgcagcaagggcgtgcacctgggcctgaccagcagcgagttcaagtgcttcctgggcatcatcttcctgagcggctacgtgagcgtgcccagaagaagaatgttctgggagcagagaaccgacgtgcacaacgtgctggtgagcgccgccatgagaagagacagattcgagaccatcttcagcaacctgcacgtggccgacaacgccaacctggaccccgtggacaagttcagcaagctgagacccctgatcagcaagctgaacgagagatgcatgaagttcgtgcccaacgagacctacttcagcttcgacgagttcatggtgccctacttcggcagacacggctgcaagcagttcatcagaggcaagcccatcagattcggctacaagttctggtgcggcgccacctgcctgggctacatctgctggttccagccctaccagggcaagaaccccaacaccaagcacgaggagtacggcgtgggcgccagcctggtgctgcagttcagcgaggccctgaccgaggcccaccccggccagtaccacttcgtgttcaacaacttcttcaccagcatcgccctgctggacaagctgagcagcatgggccaccaggccaccggcaccgtgagaaaggaccacatcgacagagtgcccctggagagcgacgtggccctgaagaagaaggagagaggcaccttcgactacagaatcgacggcaagggcaacatcgtgtgcagatggaacgacaacagcgtggtgaccgtggccagcagcggcgccggcatccaccccctgtgcctggtgagcagatacagccagaagctgaagaagaagatccaggtgcagcagcccaacatgatcaaggtgtacaaccagttcatgggcggcgtggacagagccgacgagaacatcgacaagtacagagccagcatcagaggcaagaagtggtacagcagccccctgctgttctgcttcgagctggtgctgcagaacgcctggcagctgcacaagacctacgacgagaagcccgtggacttcctggagttcagaagaagagtggtgtgccactacctggagacccacggccacccccccgagcccggccagaagggcagaccccagaagagaaacatcgacagcagatacgacggcatcaaccacgtgatcgtgaagcagggcaagcagaccagatgcgccgagtgccacaagaacaccaccttcagatgcgagaagtgcgacgtggccctgcacgtgaagtgcagcgtggagtaccacaccgagtag

SEQ ID NO: 23185 - DNA, 1782 bp, Artificial Sequence; identical to SEQ ID NO: 23184
  Description of Artificial Sequence: Synthetic coding sequence

SEQ ID NO: 23186 - DNA, 1758 bp, Artificial Sequence
  Description of Artificial Sequence: Synthetic coding sequence
atgagcaaccccagaaagagaagcatccccatgagagacagcaacaccggcctggagcagctgctggccgaggacagcttcgacgagagcgacttcagcgagatcgacgacagcgacaacttcagcgacagcgccctggaggccgacaagatcagacccctgagccacctggagagcgacggcaagagcagcaccagcagcgacagcggcagaagcatgaagtggagcgccagagccatgatccccagacagagatacgacttcaccggcacccccggcagaaaggtggacgtgagcgacatcaccgaccccctgcagtacttcgagctgttcttcaccgaggagctggtgagcaagatcaccagagagaccaacgcccaggccgccctgctggccagcaagccccccggccccaagggcttcagcagaatggacaagtggaaggacaccgacaacgacgagctgaaggtgttcttcgccgtgatgctgctgcagggcatcgtgcagaagcccgagctggagatgttctggagcaccagacccctgctggacaccccctacctgagacagatcatgaccggcgagagattcctgctgctgttcagatgcctgcacttcgtgaacaacagcagcatcagcgccggccagagcaaggcccagatcagcctgcagaagatcaagcccgtgttcgacttcctggtgaacaagttcagcaccgtgtacacccccaacagaaacatcgccgtggacgagagcctgatgctgttcaagggccccctggccatgaagcagtacctgcccaccaagagagtgagattcggcctgaagctgtacgtgctgtgcgagagccagagcggctacgtgtggaacgccctggtgcacaccggccccggcatgaacctgaaggacagcgccgacggcctgaagagcagcagaatcgtgctgaccctggtgaacgacctgctgggccagggctactgcgtgttcctggacaacttcaacatcagccccatgctgttcagagagctgcaccagaacagaaccgacgccgtgggcaccgccagactgaacagaaagcagatccccaacgacctgaagaagagaatcgccaagggcaccaccgtggccagattctgcggcgagctgatggccctgaagtggtgcgacggcaaggaggtgaccatgctgagcaccttccacaacgacaccgtgatcgaggtgaacaacagaaacggcaagaagaccaagagacccagagtgatcgtggactacaacgagaacatgggcgccgtggacagcgccgaccagatgctgaccagctaccccagcgagagaaagagacacaaggtgtggtacaagaagttcttccaccacctgctgcacatcaccgtgctgaacagctacatcctgttcaagaaggacaaccccgagcacaccatgagccacatcaacttcagactggccctgatcgagagaatgctggagaagcaccacaagcccggccagcagcacctgagaggcagaccctgcagcgacgacgtgacccccctgagactgagcggcagacacttccccaagagcatccccgccaccagcggcaagcagaaccccaccggcagatgcaagatctgctgcagccagtacgacaaggacggcaagaagatcagaaaggagaccagatacttctgcgccgagtgcgacgtgcccctgtgcgtggtgccctgcttcgagatctaccacaccaagaagaactactag

SEQ ID NO: 23187 - DNA, 948 bp, Artificial Sequence
  Description of Artificial Sequence: Synthetic coding sequence
atggagaccagcagcaagggcctgctgacccaggtgacccagttctggaacctgctggacgacctggcccagagcgaccccgagggctacgagaagttcatccagcagcagctgaaggagggcaagcagctgtgcgccgcccccgagccccagctgtgcctgcagaccagaatcctgaagcccaaggagaagatcctgttcatcaacctgtgccagtggaccagaatccccgccccccagagcaccacccaccccgtgcccctgaccgtgggcaagcccgaggacaccaccgagatcagcgacgcctacaccgtgatcgacgtggcctacaaccccgacgtgctgcacgccgccgagaaggaccaggtgaagaagaaccagctgatccagatggccatgaagtgcatcgaggagaagttccagttcaccctgagccacagctaccacatcaccaagttcagaatcaagggcagcatccagagaatgaagcagaacctgatgggcatccagaccgacagcatcgacctgagagagaagatgagaagagagctgaccctgggccagatcagaagcagcaccatgagcaaccccgaccacttcccccagctgctgctgcccaaggaccaggtgagcggcaaggccgtgtgcctgatcgaggagatcagcagcaccgagatccaggtggagatgaagatgcccgcctacgagctgaagatcgtgcacgaccacagcgagaagcccctgaagatcgagctgaaggtggagctgcccggcatcaacagcgtgagcctgtgcgacctgagcgtgagcgaggacgacctgctgatcgaggtgagcgagaagtacagactgcacctgaacctgcccaagctgatcgacaccgagatgaccaccgccaagttcatcaaggagaagagcaccctgatcatcaccatgcccctggtgtag

SEQ ID NO: 23188 - DNA, 867 bp, Artificial Sequence
  Description of Artificial Sequence: Synthetic coding sequence
atggagaccagcagcaagggcctgctgacccaggtgacccagttctggaacctgctggacgacctggcccagagcgaccccgagggctacgagaagttcatccagcagcagctgaaggagggcaagcagctgtgcgccgcccccgagccccagctgtgcctgcagaccagaatcctgaagcccaaggagaagatcctgttcatcaacctgtgccagtggaccagaatccccgccccccagagcaccacccaccccgtgcccctgaccgtgggcaagcccgaggacaccaccgagatcagcgacgcctacaccgtgatcgacgtggcctacaaccccgacgtgctgcacgccgccgagaaggaccaggtgaagaagaaccagctgatccagatggccatgaagtgcatcgaggagaagttccagttcaccctgagccacagctaccacatcaccaagttcagaatcaagggcagcatccagagaatgaagcagaacctgatgggcatccagaccgacagcatcgacctgagagagaagatgagaagagagctgaccctgggccagatcagaagcagcaccatgagcaaccccgaccacttcccccagctgctgctgcccaaggaccaggtgagcggcaaggccgtgtgcctgatcgaggagatcagcagcaccgagatccaggtggagatgaagatgcccgcctacgagctgaagatcgtgcacgaccacagcgagaagcccctgaagatcgagctgaaggtggagctgcccggcatcaacagcgtgagcctgtgcgacctgagcgtgagcgagggcaccaccgagccccaggccctggccaaggacgagctgagcctgaagttctag

SEQ ID NO: 23189 - DNA, 867 bp, Artificial Sequence; identical to SEQ ID NO: 23188
  Description of Artificial Sequence: Synthetic coding sequence

SEQ ID NO: 23190 - DNA, 948 bp, Artificial Sequence; identical to SEQ ID NO: 23187
  Description of Artificial Sequence: Synthetic coding sequence

SEQ ID NO: 23191 - DNA, 636 bp, Artificial Sequence
  Description of Artificial Sequence: Synthetic coding sequence
atgagccacggccacagccacggcggcggcggctgcagatgcgccgccgagagagaggagccccccgagcagagaggcctggcctacggcctgtacctgagaatcgacctggagagactgcagtgcctgaacgagagcagagagggcagcggcagaggcgtgttcaagccctgggaggagagaaccgacagaagcaagttcgtggagagcgacgccgacgaggagctgctgttcaacatccccttcaccggcaacgtgaagctgaagggcatcatcatcatgggcgaggacgacgacagccaccccagcgagatgagactgtacaagaacatcccccagatgagcttcgacgacaccgagagagagcccgaccagaccttcagcctgaacagagacctgaccggcgagctggagtacgccaccaagatcagcagattcagcaacgtgtaccacctgagcatccacatcagcaagaacttcggcgccgacaccaccaaggtgttctacatcggcctgagaggcgagtggaccgagctgagaagacacgaggtgaccatctgcaactacgaggccagcgccaaccccgccgaccacagagtgcaccaggtgaccccccagacccacttcatcagctag

SEQ ID NO: 23192 - DNA, 297 bp, Artificial Sequence
  Description of Artificial Sequence: Synthetic coding sequence
atgagcttcgacgacaccgagagagagcccgaccagaccttcagcctgaacagagacctgaccggcgagctggagtacgccaccaagatcagcagattcagcaacgtgtaccacctgagcatccacatcagcaagaacttcggcgccgacaccaccaaggtgttctacatcggcctgagaggcgagtggaccgagctgagaagacacgaggtgaccatctgcaactacgaggccagcgccaaccccgccgaccacagagtgcaccaggtgaccccccagacccacttcatcagctag

SEQ ID NO: 23193 - DNA, 213 bp, Artificial Sequence
  Description of Artificial Sequence: Synthetic coding sequence
atgggcgaggacgacgacagccaccccagcgagatgagactgtacaagaacatcccccagatgagcttcgacgacaccgagagagagcccgaccagaccttcagcctgaacagagacctgaccggcgagctggagtacgccaccaagatcagcagattcagcaacgtgtaccacctgagcatccacatcagcaagaacttcggcgccgactag

SEQ ID NO: 23194 - DNA, 903 bp, Artificial Sequence
  Description of Artificial Sequence: Synthetic coding sequence
atggagccccccatggagcccagcggcggcgagcaggagcccggcgccgtgagattcctggacctgccctgggaggacgtgctgctgccccacgtgctgaacagagtgcccctgagacagctgctgagactgcagagagtgagcagagccttcagaagcctggtgcagctgcacctggccggcctgagaagattcgacgccgcccaggtgggcccccagatccccagagccgccctggccagactgctgagagacgccgagggcctgcaggagctggccctggccccctgccacgagtggctgagcgacgaggacctggtgcccgtgctggccagaaacccccagctgagaagcgtggccctgggcggctgcggccagctgagcagaagagccctgggcgccctggccgagggctgccccagactgcagagactgagcctggcccactgcgactgggtggacggcctggccctgagaggcctggccgacagatgccccgccctggaggagctggacctgaccgcctgcagacagctgaaggacgaggccatcgtgtacctggcccagagaagaggcgccggcctgagaagcctgagcctggccgtgaacgccaacgtgggcgacgccgccgtgcaggagctggccagaaactgccccgagctgcaccacctggacctgaccggctgcctgagagtgggcagcgacggcgtgagaaccctggccgagtactgccccgtgctgagaagcctgagagtgagacactgccaccacgtggccgagagcagcctgagcagactgagaaagagaggcgtggacatcgacgtggagccccccctgcaccaggccctggtgctgctgcaggacatggccggcttcgcccccttcgtgaacctgcaggtgtag

SEQ ID NO: 23195 - DNA, 3093 bp, Artificial Sequence
  Description of Artificial Sequence: Synthetic coding sequence
atgagaaacgtggccctgagaagagccgccggccccgtgtgcgccgaggccgccgagagaagaacctgcaccccccagagcgtggccatggagcagtacaagctgggcgacaagatccacggcttcaccgtgaaccaggtgaccagcgtgcccgagctgttcctgaccgccgtgaagctgacccacgacgacaccggcgccagatacctgcacctggccagagaggacaccaacaacctgttcagcgtgcagttcagaaccacccccatggacagcaccggcgtgccccacatcctggagcacaccgtgctgtgcggcagccagaagtacccctgcagagaccccttcttcaagatgctgaacagaagcctgagcaccttcatgaacgccttcaccgccagcgactacaccctgtaccccttcagcacccagaaccccaaggacttccagaacctgctgagcgtgtacctggacgccaccttcttcccctgcctgagagagctggacttctggcaggagggctggagactggagcacgagaaccccagcgacccccagacccccctggtgttcaagggcgtggtgttcaacgagatgaagggcgccttcaccgacaacgagagaatcttcagccagcacctgcagaacagactgctgcccgaccacacctacagcgtggtgagcggcggcgaccccctgtgcatccccgagctgacctgggagcagctgaagcagttccacgccacccactaccaccccagcaacgccagattcttcacctacggcaacttccccctggagcagcacctgaagcagatccacgaggaggccctgagcaagttccagaagatcgagcccagcaccgtggtgcccgcccagaccccctgggacaagcccagagagttccagatcacctgcggccccgacagcttcgccaccgaccccagcaagcagaccaccatcagcgtgagcttcctgctgcccgacatcaccgacaccttcgaggccttcaccctgagcctgctgagcagcctgctgaccagcggccccaacagccccttctacaaggccctgatcgagagcggcctgggcaccgacttcagccccgacgtgggctacaacggctacaccagagaggcctacttcagcgtgggcctgcagggcatcgccgagaaggacatcgagaccgtgagaagcctgatcgacagaaccatcgacgaggtggtggagaagggcttcgaggacgacagaatcgaggccctgctgcacaagatcgagatccagatgaagcaccagagcaccagcttcggcctgatgctgaccagctacatcgccagctgctggaaccacgacggcgaccccgtggagctgctgaagctgggcaaccagctggccaagttcagacagtgcctgcaggagaaccccaagttcctgcaggagaaggtgaagcagtacttcaagaacaaccagcacaagctgaccctgagcatgagacccgacgacaagtaccacgagaagcaggcccaggtggaggccaccaagctgaagcagaaggtggaggccctgagccccggcgacagacagcagatctacgagaagggcctggagctgagaagccagcagagcaagccccaggacgccagctgcctgcccgccctgaaggtgagcgacatcgagcccaccatccccgtgaccgagctggacgtggtgctgaccgccggcgacatccccgtgcagtactgcgcccagcccaccaacggcatggtgtacttcagagccttcagcagcctgaacaccctgcccgaggagctgagaccctacgtgcccctgttctgcagcgtgctgaccaagctgggctgcggcctgctggactacagagagcaggcccagcagatcgagctgaagaccggcggcatgagcgccagcccccacgtgctgcccgacgacagccacatggacacctacgagcagggcgtgctgttcagcagcctgtgcctggacagaaacctgcccgacatgatgcagctgtggagcgagatcttcaacaacccctgcttcgaggaggaggagcacttcaaggtgctggtgaagatgaccgcccaggagctggccaacggcatccccgacagcggccacctgtacgccagcatcagagccggcagaaccctgacccccgccggcgacctgcaggagaccttcagcggcatggaccaggtgagactgatgaagagaatcgccgagatgaccgacatcaagcccatcctgagaaagctgcccagaatcaagaagcacctgctgaacggcgacaacatgagatgcagcgtgaacgccaccccccagcagatgccccagaccgagaaggccgtggaggacttcctgagaagcatcggcagaagcaagaaggagagaagacccgtgagaccccacaccgtggagaagcccgtgcccagcagcagcggcggcgacgcccacgtgccccacggcagccaggtgatcagaaagctggtgatggagcccaccttcaagccctggcagatgaagacccacttcctgatgcccttccccgtgaactacgtgggcgagtgcatcagaaccgtgccctacaccgaccccgaccacgccagcctgaagatcctggccagactgatgaccgccaagttcctgcacaccgagatcagagagaagggcggcgcctacggcggcggcgccaagctgagccacaacggcatcttcaccctgtacagctacagagaccccaacaccatcgagaccctgcagagcttcggcaaggccgtggactgggccaagagcggcaagttcacccagcaggacatcgacgaggccaagctgagcgtgttcagcaccgtggacgcccccgtggcccccagcgacaagggcatggaccacttcctgtacggcctgagcgacgagatgaagcaggcccacagagagcagctgttcgccgtgagccacgacaagctgctggccgtgagcgacagatacctgggcaccggcaagagcacccacggcctggccatcctgggccccgagaaccccaagatcgccaaggaccccagctggatcatccagtag

SEQ ID NO: 23196 - DNA, 3117 bp, Artificial Sequence
  Description of Artificial Sequence: Synthetic coding sequence
atgtggagatgcggcggcagacagggcctgtgcgtgctgagaagactgagcggcggccacgcccaccacagagcctggagatggaacagcaacagagcctgcgagagagccctgcagtacaagctgggcgacaagatccacggcttcaccgtgaaccaggtgaccagcgtgcccgagctgttcctgaccgccgtgaagctgacccacgacgacaccggcgccagatacctgcacctggccagagaggacaccaacaacctgttcagcgtgcagttcagaaccacccccatggacagcaccggcgtgccccacatcctggagcacaccgtgctgtgcggcagccagaagtacccctgcagagaccccttcttcaagatgctgaacagaagcctgagcaccttcatgaacgccttcaccgccagcgactacaccctgtaccccttcagcacccagaaccccaaggacttccagaacctgctgagcgtgtacctggacgccaccttcttcccctgcctgagagagctggacttctggcaggagggctggagactggagcacgagaaccccagcgacccccagacccccctggtgttcaagggcgtggtgttcaacgagatgaagggcgccttcaccgacaacgagagaatcttcagccagcacctgcagaacagactgctgcccgaccacacctacagcgtggtgagcggcggcgaccccctgtgcatccccgagctgacctgggagcagctgaagcagttccacgccacccactaccaccccagcaacgccagattcttcacctacggcaacttccccctggagcagcacctgaagcagatccacgaggaggccctgagcaagttccagaagatcgagcccagcaccgtggtgcccgcccagaccccctgggacaagcccagagagttccagatcacctgcggccccgacagcttcgccaccgaccccagcaagcagaccaccatcagcgtgagcttcctgctgcccgacatcaccgacaccttcgaggccttcaccctgagcctgctgagcagcctgctgaccagcggccccaacagccccttctacaaggccctgatcgagagcggcctgggcaccgacttcagccccgacgtgggctacaacggctacaccagagaggcctacttcagcgtgggcctgcagggcatcgccgagaaggacatcgagaccgtgagaagcctgatcgacagaaccatcgacgaggtggtggagaagggcttcgaggacgacagaatcgaggccctgctgcacaagatcgagatccagatgaagcaccagagcaccagcttcggcctgatgctgaccagctacatcgccagctgctggaaccacgacggcgaccccgtggagctgctgaagctgggcaaccagctggccaagttcagacagtgcctgcaggagaaccccaagttcctgcaggagaaggtgaagcagtacttcaagaacaaccagcacaagctgaccctgagcatgagacccgacgacaagtaccacgagaagcaggcccaggtggaggccaccaagctgaagcagaaggtggaggccctgagccccggcgacagacagcagatctacgagaagggcctggagctgagaagccagcagagcaagccccaggacgccagctgcctgcccgccctgaaggtgagcgacatcgagcccaccatccccgtgaccgagctggacgtggtgctgaccgccggcgacatccccgtgcagtactgcgcccagcccaccaacggcatggtgtacttcagagccttcagcagcctgaacaccctgcccgaggagctgagaccctacgtgcccctgttctgcagcgtgctgaccaagctgggctgcggcctgctggactacagagagcaggcccagcagatcgagctgaagaccggcggcatgagcgccagcccccacgtgctgcccgacgacagccacatggacacctacgagcaggtgggcgtgctgttcagcagcctgtgcctggacagaaacctgcccgacatgatgcagctgtggagcgagatcttcaacaacccctgcttcgaggaggaggagcacttcaaggtgctggtgaagatgaccgcccaggagctggccaacggcatccccgacagcggccacctgtacgccagcatcagagccggcagaaccctgacccccgccggcgacctgcaggagaccttcagcggcatggaccaggtgagactgatgaagagaatcgccgagatgaccgacatcaagcccatcctgagaaagctgcccagaatcaagaagcacctgctgaacggcgacaacatgagatgcagcgtgaacgccaccccccagcagatgccccagaccgagaaggccgtggaggacttcctgagaagcatcggcagaagcaagaaggagagaagacccgtgagaccccacaccgtggagaagcccgtgcccagcagcagcggcggcgacgcccacgtgccccacggcagccaggtgatcagaaagctggtgatggagcccaccttcaagccctggcagatgaagacccacttcctgatgcccttccccgtgaactacgtgggcgagtgcatcagaaccgtgccctacaccgaccccgaccacgccagcctgaagatcctggccagactgatgaccgccaagttcctgcacaccgagatcagagagaagggcggcgcctacggcggcggcgccaagctgagccacaacggcatcttcaccctgtacagctacagagaccccaacaccatcgagaccctgcagagcttcggcaaggccgtggactgggccaagagcggcaagttcacccagcaggacatcgacgaggccaagctgagcgtgttcagcaccgtggacgcccccgtggcccccagcgacaagggcatggaccacttcctgtacggcctgagcgacgagatgaagcaggcccacagagagcagctgttcgccgtgagccacgacaagctgctggccgtgagcgacagatacctgggcaccggcaagagcacccacggcctggccatcctgggccccgagaaccccaagatcgccaaggaccccagctggatcatccagtag

SEQ ID NO: 23197 - DNA, 1788 bp, Artificial Sequence
  Description of Artificial Sequence: Synthetic coding sequence
atgtggaagagcagcttccagtacatcgccagctgctggaaccacgacggcgaccccgtggagctgctgaagctgggcaaccagctggccaagttcagacagtgcctgcaggagaaccccaagttcctgcaggagaaggtgaagcagtacttcaagaacaaccagcacaagctgaccctgagcatgagacccgacgacaagtaccacgagaagcaggcccaggtggaggccaccaagctgaagcagaaggtggaggccctgagccccggcgacagacagcagatctacgagaagggcctggagctgagaagccagcagagcaagccccaggacgccagctgcctgcccgccctgaaggtgagcgacatcgagcccaccatccccgtgaccgagctggacgtggtgctgaccgccggcgacatccccgtgcagtactgcgcccagcccaccaacggcatggtgtacttcagagccttcagcagcctgaacaccctgcccgaggagctgagaccctacgtgcccctgttctgcagcgtgctgaccaagctgggctgcggcctgctggactacagagagcaggcccagcagatcgagctgaagaccggcggcatgagcgccagcccccacgtgctgcccgacgacagccacatggacacctacgagcagggcgtgctgttcagcagcctgtgcctggacagaaacctgcccgacatgatgcagctgtggagcgagatcttcaacaacccctgcttcgaggaggaggagcacttcaaggtgctggtgaagatgaccgcccaggagctggccaacggcatccccgacagcggccacctgtacgccagcatcagagccggcagaaccctgacccccgccggcgacctgcaggagaccttcagcggcatggaccaggtgagactgatgaagagaatcgccgagatgaccgacatcaagcccatcctgagaaagctgcccagaatcaagaagcacctgctgaacggcgacaacatgagatgcagcgtgaacgccaccccccagcagatgccccagaccgagaaggccgtggaggacttcctgagaagcatcggcagaagcaagaaggagagaagacccgtgagaccccacaccgtggagaagcccgtgcccagcagcagcggcggcgacgcccacgtgccccacggcagccaggtgatcagaaagctggtgatggagcccaccttcaagccctggcagatgaagacccacttcctgatgcccttccccgtgaactacgtgggcgagtgcatcagaaccgtgccctacaccgaccccgaccacgccagcctgaagatcctggccagactgatgaccgccaagttcctgcacaccgagatcagagagaagggcggcgcctacggcggcggcgccaagctgagccacaacggcatcttcaccctgtacagctacagagaccccaacaccatcgagaccctgcagagcttcggcaaggccgtggactgggccaagagcggcaagttcacccagcaggacatcgacgaggccaagctgagcgtgttcagcaccgtggacgcccccgtggcccccagcgacaagggcatggaccacttcctgtacggcctgagcgacgagatgaagcaggcccacagagagcagctgttcgccgtgagccacgacaagctgctggccgtgagcgacagatacctgggcaccggcaagagcacccacggcctggccatcctgggccccgagaaccccaagatcgccaaggaccccagctggatcatccagtag

SEQ ID NO: 23198 - DNA, 261 bp, Artificial Sequence
  Description of Artificial Sequence: Synthetic coding sequence
gtgaacgccaccccccagcagatgccccagaccgagaaggccgtggaggacttcctgagaagcatcggcagaagcaagaaggagagaagacccgtgagaccccacaccgtggagaagcccgtgcccagcagcagcggcggcgacgcccacgtgccccacggcagccaggtgatcagaaagctggtgatgtacaccctgagacaccacgtgaagatcggcggcctgcacgtgagcttcaccgtgagaaactgcgtggagtag

SEQ ID NO: 23199 - DNA, 702 bp, Artificial Sequence
  Description of Artificial Sequence: Synthetic coding sequence
tgactgatcgagagcggcctgggcaccgacttcagccccgacgtgggctacaacggctacaccagagaggcctacttcagcgtgggcctgcagggcatcgccgagaaggacatcgagaccgtgagaagcctgatcgacagaaccatcgacgaggtggtggagaagggcttcgaggacgacagaatcgaggccctgctgcacaagatcgagatccagatgaagcaccagagcaccagcttcggcctgatgctgaccagctacatcgccagctgctggaaccacgacggcgaccccgtggagctgctgaagctgggcaaccagctggccaagttcagacagtgcctgcaggagaaccccaagttcctgcaggagaaggtgaagcagtacttcaagaacaaccagcacaagctgaccctgagcatgagacccgacgacaagtaccacgagaagcaggcccaggtggaggccaccaagctgaagcagaaggtggaggccctgagccccggcgacagacagcagatctacgagaagggcctggagctgagaagccagcagagcaagccccaggacgccagctgcctgcccgccctgaaggtgagcgacatcgagcccaccatccccgtgaccgagctggacgtggtgctgaccggccactgcgagagatacgccttccccggcagcagagtgccctggggcaactag

SEQ ID NO: 23200 - DNA, 2820 bp, Artificial Sequence
  Description of Artificial Sequence: Synthetic coding sequence
atgagaaacgtggccctgagaagagccgccggccccgtgtgcgccgaggccgccgagagaagagtgaccagcgtgcccgagctgttcctgaccgccgtgaagctgacccacgacgacaccggcgccagatacctgcacctggccagagaggacaccaacaacctgttcagcgtgcagttcagaaccacccccatggacagcaccggcgtgccccacatcctggagcacaccgtgctgtgcggcagccagaagtacccctgcagagaccccttcttcaagatgctgaacagaagcctgagcaccttcatgaacgccttcaccgccagcgactacaccctgtaccccttcagcacccagaaccccaaggacttccagaacctgctgagcgtgtacctggacgccaccttcttcccctgcctgagagagctggacttctggcaggagggctggagactggagcacgagaaccccagcgacccccagacccccctggtgttcaagggcgtggtgttcaacgagatgaagggcgccttcaccgacaacgagagaatcttcagccagcacctgcagaacagactgctgcccgaccacacctacagcgtggtgagcggcggcgaccccctgtgcatccccgagctgacctgggagcagctgaagcagttccacgccacccactaccaccccagcaacgccagattcttcacctacggcaacttccccctggagcagcacctgaagcagatccacgaggaggccctgagcaagttccagaagatcgagcccagcaccgtggtgcccgcccagaccccctgggacaagcccagagagttccagatcacctgcggccccgacagcttcgccaccgaccccagcaagcagaccaccatcagcgtgagcttcctgctgcccgacatcaccgacaccttcgaggccttcaccctgagcctgctgagcagcctgctgaccagcggccccaacagccccttctacaaggccctgatcgagagcggcctgggcaccgacttcagccccgacgtgggctacaacggctacaccagagaggcctacttcagcgtgggcctgcagggcatcgccgagaaggacatcgagaccgtgagaagcctgatcgacagaaccatcgacgaggtggtggagaagggcttcgaggacgacagaatcgaggccctgctgcacaagatcgagatccagatgaagcaccagagcaccagcttcggcctgatgctgaccagctacatcgccagctgctggaaccacgacggcgaccccgtggagctgctgaagctgggcaaccagctggccaagttcagacagtgcctgcaggagaaccccaagttcctgcaggagaaggtgaagcagtacttcaagaacaaccagcacaagctgaccctgagcatgagacccgacgacaagtaccacgagaagcaggcccaggtggaggccaccaagctgaagcagaaggtggaggccctgagccccggcgacagacagcagatctacgagaagggcctggagctgagaagccagcagagcaagccccaggacgccagctgcctgcccgccctgaaggtgagcgacatcgagcccaccatccccgtgaccgagctggacgtggtgctgaccgccggcgacatccccgtgcagtactgcgcccagcccaccaacggcatggtgtacttcagagccttcagcagcctgaacaccctgcccgaggagctgagaccctacgtgcccctgttctgcagcgtgctgaccaacccctgcttcgaggaggaggagcacttcaaggtgctggtgaagatgaccgcccaggagctggccaacggcatccccgacagcggccacctgtacgccagcatcagagccggcagaaccctgacccccgccggcgacctgcaggagaccttcagcggcatggaccaggtgagactgatgaagagaatcgccgagatgaccgacatcaagcccatcctgagaaagctgcccagaatcaagaagcacctgctgaacggcgacaacatgagatgcagcgtgaacgccaccccccagcagatgccccagaccgagaaggccgtggaggacttcctgagaagcatcggcagaagcaagaaggagagaagacccgtgagaccccacaccgtggagaagcccgtgcccagcagcagcggcggcgacgcccacgtgccccacggcagccaggtgatcagaaagctggtgatggagcccaccttcaagccctggcagatgaagacccacttcctgatgcccttccccgtgaactacgtgggcgagtgcatcagaaccgtgccctacaccgaccccgaccacgccagcctgaagatcctggccagactgatgaccgccaagttcctgcacaccgagatcagagagaagggcggcgcctacggcggcggcgccaagctgagccacaacggcatcttcaccctgtacagctacagagaccccaacaccatcgagaccctgcagagcttcggcaaggccgtggactgggccaagagcggcaagttcacccagcaggacatcgacgaggccaagctgagcgtgttcagcaccgtggacgcccccgtggcccccagcgacaagggcatggaccacttcctgtacggcctgagcgacgagatgaagcaggcccacagagagcagctgttcgccgtgagccacgacaagctgctggccgtgagcgacagatacctgggcaccggcaagagcacccacggcctggccatcctgggccccgagaaccccaagatcgccaaggaccccagctggatcatccagtag

SEQ ID NO: 23201 - DNA, 780 bp, Artificial Sequence
  Description of Artificial Sequence: Synthetic coding sequence
tgattcagcagcctgtgcctggacagaaacctgcccgacatgatgcagctgtggagcgagatcttcaacaacccctgcttcgaggaggaggagcacttcaaggtgctggtgaagatgaccgcccaggagctggccaacggcatccccgacagcggccacctgtacgccagcatcagagccggcagaaccctgacccccgccggcgacctgcaggagaccttcagcggcatggaccaggtgagactgatgaagagaatcgccgagatgaccgacatcaagcccatcctgagaaagctgcccagaatcaagaagcacctgctgaacggcgacaacatgagatgcagcgtgaacgccaccccccagcagatgccccagaccgagaaggccgtggaggacttcctgagaagcatcggcagaagcaagaaggagagaagacccgtgagaccccacaccgtggagaagcccgtgcccagcagcagcggcggcgacgcccacgtgccccacggcagccaggtgatcagaaagctggtgatggagcccaccttcaagccctggcagatgaagacccacttcctgatgcccttccccgtgaactacgtgggcgagtgcatcagaaccgtgccctacaccgaccccgaccacgccagaaagagacccgtgtgcggcagcggcgacctgggcctgatcagccccagagccagcagcagaagcctgtgcctgtgctgcagacccagccaccactgcctgcccagactgctgagcgaggtggacgtgttctag

SEQ ID NO: 23202 - DNA, 555 bp, Artificial Sequence
  Description of Artificial Sequence: Synthetic coding sequence
aagcccgtgcccagcagcagcggcggcgacgcccacgtgccccacggcagccaggtgatcagaaagctggtgatggagcccaccttcaagccctggcagatgaagacccacttcctgatgcccttccccgtgaactacgtgggcgagtgcatcagaaccgtgccctacaccgaccccgaccacgccagcctgaagatcctggccagactgatgaccgccaagttcctgcacaccgagatcagagagaagggcggcgcctacggcggcggcgccaagctgagccacaacggcatcttcaccctgtacagctacagagaccccaacaccatcgagaccctgcagagcttcggcaaggccgtggactgggccaagagcggcaagttcacccagcaggacatcgacgaggccaagctgagcgtgttcagcaccgtggacgcccccgtggcccccagcgacaagggcatcctgagcatcaccgtgagaatcagcacccacagcctgaccgacgacgtggccgtgttccaggtgcccggcatgcacggccaggagcactag

SEQ ID NO: 23203 - DNA, 534 bp, Artificial Sequence
  Description of Artificial Sequence: Synthetic coding sequence
atgaactggttcggcagcaacttcttcagatgccccgaggacctgagcctgctgaacatctacagccccctgctgagccacatgagcagcgaggacgagcacttcatcagcaacctgagaggccacgtgcccgccagcgccgtggtgaagcagcccgtgagaggcgccagcggcagaaccaccatcaccgccatcgtgcagaccggcggcggctggagcaccggcctgttcagcgtgtgcagagacagaagaatctgcttctgcggcctgttctgccccatgtgcctggagtgcgacatcgccagacactacggcgagtgcctgtgctggcccctgctgcccggcagcaccttcgccctgagaatcggcaccagagagagacacaagatccagggcaccctgtgcgaggactggctggccgtgcactgctgctgggccttcagcatctgccaggtggccagagagctgaagatgagaaccagccaggtgtacgagatctgcgccgtgcccatgaccaaggacaccctggtgtag

SEQ ID NO: 23204 - DNA, 348 bp, Artificial Sequence
  Description of Artificial Sequence: Synthetic coding sequence
atgcaggcccaggcccccgtggtggtggtgacccagcccggcgtgggccccggccccgccccccagaacagcaactggcagaccggcatgtgcgactgcttcagcgactgcggcgtgtgcctgtgcggcaccttctgcttcccctgcctgggctgccaggtggccgccgacatgaacgagtgctgcctgtgcggcaccagcgtggccatgagaaccctgtacagaaccagatacggcatccccggcagcatctgcgacgactacatggccaccctgtgctgcccccactgcaccctgtgccagatcaagagagacatcaacagaagaagagccatgagaaccttctag

SEQ ID NO: 23205 - DNA, 348 bp, Artificial Sequence; identical to SEQ ID NO: 23204
  Description of Artificial Sequence: Synthetic coding sequence

SEQ ID NO: 23206 - DNA, 348 bp, Artificial Sequence; identical to SEQ ID NO: 23204
  Description of Artificial Sequence: Synthetic coding sequence

SEQ ID NO: 23207 - DNA, 348 bp, Artificial Sequence; identical to SEQ ID NO: 23204
  Description of Artificial Sequence: Synthetic coding sequence

SEQ ID NO: 23208 - DNA, 1893 bp, Artificial Sequence
  Description of Artificial Sequence: Synthetic coding sequence
atggacgagatggccaccacccagatcagcaaggacgagctggacgagctgaaggaggccttcgccaaggtggacctgaacagcaacggcttcatctgcgactacgagctgcacgagctgttcaaggaggccaacatgcccctgcccggctacaaggtgagagagatcatccagaagctgatgctggacggcgacagaaacaaggacggcaagatcagcttcgacgagttcgtgtacatcttccaggaggtgaagagcagcgacatcgccaagaccttcagaaaggccatcaacagaaaggagggcatctgcgccctgggcggcaccagcgagctgagcagcgagggcacccagcacagctacagcgaggaggagaagtacgccttcgtgaactggatcaacaaggccctggagaacgaccccgactgcagacacgtgatccccatgaaccccaacaccgacgacctgttcaaggccgtgggcgacggcatcgtgctgtgcaagatgatcaacctgagcgtgcccgacaccatcgacgagagagccatcaacaagaagaagctgacccccttcatcatccaggagaacctgaacctggccctgaacagcgccagcgccatcggctgccacgtggtgaacatcggcgccgaggacctgagagccggcaagccccacctggtgctgggcctgctgtggcagatcatcaagatcggcctgttcgccgacatcgagctgagcagaaacgaggccctggccgccctgctgagagacggcgagaccctggaggagctgatgaagctgagccccgaggagctgctgctgagatgggccaacttccacctggagaacagcggctggcagaagatcaacaacttcagcgccgacatcaaggacagcaaggcctacttccacctgctgaaccagatcgcccccaagggccagaaggagggcgagcccagaatcgacatcaacatgagcggcttcaacgagaccgacgacctgaagagagccgagagcatgctgcagcaggccgacaagctgggctgcagacagttcgtgacccccgccgacgtggtgagcggcaaccccaagctgaacctggccttcgtggccaacctgttcaacaagtaccccgccctgaccaagcccgagaaccaggacatcgactggaccctgctggagggcgagaccagagaggagagaaccttcagaaactggatgaacagcctgggcgtgaacccccacgtgaaccacctgtacgccgacctgcaggacgccctggtgatcctgcagctgtacgagagaatcaaggtgcccgtggactggagcaaggtgaacaagcccccctaccccaagctgggcgccaacatgaagaagctggagaactgcaactacgccgtggagctgggcaagcaccccgccaagttcagcctggtgggcatcggcggccaggacctgaacgacggcaaccagaccctgaccctggccctggtgtggcagctgatgagaagatacaccctgaacgtgctggaggacctgggcgacggccagaaggccaacgacgacatcatcgtgaactgggtgaacagaaccctgagcgaggccggcaagagcaccagcatccagagcttcaaggacaagaccatcagcagcagcctggccgtggtggacctgatcgacgccatccagcccggctgcatcaactacgacctggtgaagagcggcaacctgaccgaggacgacaagcacaacaacgccaagtacgccgtgagcatggccagaagaatcggcgccagagtgtacgccctgcccgaggacctggtggaggtgaagcccaagatggtgatgaccgtgttcgcctgcctgatgggcagaggcatgaagagagtgtag

SEQ ID NO: 23209 - DNA, 3849 bp, Artificial Sequence
  Description of Artificial Sequence: Synthetic coding sequence
atggccgccgacctgaacctggagtggatcagcctgcccagaagctggacctacggcatcaccagaggcggcagagtgttcttcatcaacgaggaggccaagagcaccacctggctgcaccccgtgaccggcgaggccgtggtgaccggccacagaagacagagcaccgacctgcccaccggctgggaggaggcctacaccttcgagggcgccagatactacatcaaccacaacgagagaaaggtgacctgcaagcaccccgtgaccggccagcccagccaggacaactgcatcttcgtggtgaacgagcagaccgtggccaccatgaccagcgaggagaagaaggagagacccatcagcatgatcaacgaggccagcaactacaacgtgaccagcgactacgccgtgcaccccatgagccccgtgggcagaaccagcagagccagcaagaaggtgcacaacttcggcaagagaagcaacagcatcaagagaaaccccaacgcccccgtggtgagaagaggctggctgtacaagcaggacagcaccggcatgaagctgtggaagaagagatggttcgtgctgagcgacctgtgcctgttctactacagagacgagaaggaggagggcatcctgggcagcatcctgctgcccagcttccagatcgccctgctgaccagcgaggaccacatcaacagaaagtacgccttcaaggccgcccaccccaacatgagaacctactacttctgcaccgacaccggcaaggagatggagctgtggatgaaggccatgctggacgccgccctggtgcagaccgagcccgtgaagagaatcaccttcaacttcagagtggacaagatcaccagcgagaacgcccccaccaaggagaccaacaacatccccaaccacagagtgctgatcaagcccgagatccagaacaaccagaagaacaaggagatgagcaagatcgaggagaagaaggccctggaggccgagaagtacggcttccagaaggacggccaggacagacccctgaccaagatcaacagcgtgaagctgaacagcctgcccagcgagtacgagagcggcagcgcctgccccgcccagaccgtgcactacagacccatcaacctgagcagcagcgagaacaagatcgtgaacgtgagcctggccgacctgagaggcggcaacagacccaacaccggccccctgtacaccgaggccgacagagtgatccagagaaccaacagcatgcagcagctggagcagtggatcaagatccagaagggcagaggccacgaggaggagaccagaggcgtgatcagctaccagaccctgcccagaaacatgcccagccacagagcccagatcatggccagataccccgagggctacagaaccctgcccagaaacagcaagaccagacccgagagcatctgcagcgtgacccccagcacccacgacaagaccctgggccccggcgccgaggagaagagaagaagcatgagagacgacaccatgtggcagctgtacgagtggcagcagagacagttctacaacaagcagagcaccctgcccagacacagcaccctgagcagccccaagaccatggtgaacatcagcgaccagaccatgcacagcatccccaccagccccagccacggcagcatcgccgcctaccagggctacagcccccagagaacctacagaagcgaggtgagcagccccatccagagaggcgacgtgaccatcgacagaagacacagagcccaccaccccaagcacgtgtacgtgcccgacagaagaagcgtgcccgccggcctgaccctgcagagcgtgagcccccagagcctgcagggcaagacccccgaggagctgaccctgctgctgatcaagctgagaagacagcaggccgagctgagcagcatcagagagcacaccctggcccagctgatgcagctgaagctggaggcccacagccccaagaacgagatcctgagccaccacctgcagagaaacaccatctacctggaccaccagatgaaggagaacgagcccatcatcaccatggtgcacaccatgatcgagaacagcgccctgagaccccagctgtaccagcagttcctgagacagaagagcaagatcagcctgtactgcctgagccaggacgagggcagaggcaccctgtacaagtacagacccgaggaggtggacatcgacgccaagctgagcagactgtgcgagcaggacaaggtggtgcacgccctggaggagaagctgcagcagctgcacaaggagaagtacaccctggagcaggccctgctgagcgccagccaggagatcgagatgcacgccgacaaccccgccgccatccagaccgtggtgctgcagagagacgacctgcagaacggcctgctgagcacctgcagagagctgagcagagccaccgccgagctggagagagcctggagagagtacgacaagctggagtacgacgtgaccgtgaccagaaaccagatgcaggagcagctggaccacctgggcgaggtgcagaccgagagcgccggcatccagagagcccagatccagaaggagctgtggagaatccaggacgtgatggagggcctgagcaagcacaagcagcagagaggcaccaccgagatcggcatgatcggcagcaagcccttcagcaccgtgaagtacaagaacgaggaggaggaggtggtgccccccagaccccccctgcccagaagctacgacttcaccgagcagccccccatcatcccccccctgcccagcgacagcagcagcctgctgtgctacagcagaggccccgtgcacctgcccgaggagaagaagatgtaccaggtgcagggctaccccagaaacggcagccactgcggccccgactacagactgtacaagagcgagcccgagctgaccaccgtggccgaggtggacgagagcaacggcgaggagaagagcgagcccgtgagcgagatcgagaccagcgtggtgaagggcagccacttccccgtgggcgtggtgccccccagagccaagagccccacccccgagagcagcaccatcgccagctacgtgaccctgagaaagaccaagaagatgatggacctgagaaccgagagacccagaagcgccgtggagcagctgtgcctggccgagagcaccagacccagaatgaccgtggaggagcagatggagagaatcagaagacaccagcaggcctgcctgagagagaagaagaagggcctgaacgtgatcggcgccagcgaccagagccccctgcagagccccagcaacctgagagacaaccccttcagaaccacccagaccagaagaagagacgacaaggagctggacaccgccatcagagagaacgacgtgaagcccgaccacgagacccccgccaccgagatcgtgcagctgaaggagaccgagccccagaacgtggacttcagcaaggagctgaagaagaccgagaacatcagctacgagatgctgttcgagcccgagcccaacggcgtgaacagcgtggagatgatggacaaggagagaaacaaggacaagatgcccgaggacgtgaccttcagcccccaggacgagacccagaccgccaaccacaagcccgaggagcaccccgaggagaacaccaagaacagcgtggacgagcaggaggagaccgtgatcagctacgagagcacccccgaggtgagcagaggcaaccagaccatggccgtgaagagcctgagccccagccccgagagcagcgccagccccgtgcccagcacccagccccagctgaccgagggcagccacttcatgtgcgtgtag

SEQ ID NO: 23210 - DNA, 231 bp, Artificial Sequence
  Description of Artificial Sequence: Synthetic coding sequence
atggccgccgacctgaacctggagtggatcagcctgcccagaagctggacctacggcatcaccagaggcggcagagtgttcttcatcaacgaggaggccaagagcaccacctggctgcaccccgtgaccggcgaggccgtggtgaccggccacagaagacagagcaccgacctgcccaccggctgggaggaggcctacaccttcgagggcgccagatactacatcaactag

SEQ ID NO: 23211 - DNA, 2382 bp, Artificial Sequence
  Description of Artificial Sequence: Synthetic coding sequence
atgcccctgcccggcggcctgtggtggctgctgtgctgcagaagaggcttcaccctgctgcacagagactacggcgacggcgagctgagcggcgacggcgacgaggacgaggacgaggagaccttcgagctgagaacccccagccccgccggcggcggcagaggccccctggaggtgaccctgacccagcccgtgagaagcggccccgtgagcaacagactgcagagctgggaggagacctggagcctgatccccgagaagggcctgcccgaggacgaccccgacatcgtggtgaagggctggctgtacagagagcccagaggcggcggcgccagaccctggctgccccccagaagagcctggttcgtgctgaccagagacagcctggaccagttcagcagcagcggcaagggcgccagaagactgggcagcctggtgctgaccagcctgtgcagcgtgaccggccccgagagaagaagaaaggagaccggcctgtggagcgtgaccgtgagcggcagaaagcacagcgtgagactgtgcagccccagacaggccgaggccgagagatggggcgtggccctgagagaggtgatcgccagcaaggcccccctggagacccccacccagctgctgctgagagacatccaggagagctgcggcgaccccgaggccgtggccctgatctacctgagaaaccccatcctgagacacaccagcggcgccctgtacgcccccctgctgcccctgccctacggcgtgagcgcccccggccccggctacgcccccctgagagaggaggccgtgagactgttcctggccctgcaggccctggagggcgccagaagacccggccccctgatgcagggcgtgctgcagacctgcagagacctgcccgccctgagagacgagctgttcctgcagctggccaagcagaccagcggccccgccggcccccccggcctgcccgccacccaggaccccgccgccctgagatactggcagctgctgacctgcatgagctgcaccttcagacccggcggcgccgtgagaggccacctgctgggccacctggagagaaccgagcaggccctgcccgacagcgagctggccgagtacgccagattcatcagaaaggccctgggcagaaccagaggcagagagctggtgcccagcctggccgagatcagcgccctgagccagagacaggagctgctgtgcaccgtgcactgccccggcgccggcgcctgcgccgtggccatcgacagccacaccaccgccggcgaggtggccagagagctggtgggcagactgggcctggccagaagcagaaacgccttcgccctgtacgagcagagaggcgcccaggagagagccctggccggcggcaccctggtggccgacgtgctgaccagattcgagaacctggccgccgaggaggccggcctggaggacagccccgacagcggctggagactgtgcctgagactgcacggccccctgcaccccgagggcctgagccccgacggccacgagctgcccttcctgttcgagcaggcccacgccctgctgctgagaggcagaccccccccccccgacgacaccctgagagccctggccgccctgagactgcagagcctgcagagagacttcagccccagagtgcccctgcccagactggacagactgctgcccccccccgccccccccagagaggacccccccagacccacccccagacccccccccagcgccgccctgctggccggcgccctgtggagccccggcctggccaagagaagagccgagagagccagaagaggcggcgccggcagaaccgccggcagcatcgccagagagggcggcggcggcgccggcaccgccgccgccgtgctgggcggctggaagagactgagaggcatgggcagagccgaggccatggccgcctacctggccctggccgcccagtgccccggcttcggcgccgccagatacgacgtgctggagctgagcaccgagcccggcagaggcgccccccagaagctgtgcctgggcctgggcgccaaggccatgagcctgagcagacccggcgagaccgagcccatccacagcgtgagctacggccacgtggccgcctgccagctgatgggcccccacaccctggccctgagagtgggcgagagccagctgctgctgcagagcccccaggtggaggagatcatgcagctggtgaacgcctacctggccaaccccagccccgagagaccctgcagcagcagcagccccccctgccaggacctgcccgacaccagcccccccagccagagacccggcctggacgagccccagggccagagcggctgcctgggccagctgcaggactag

SEQ ID NO: 23212 - DNA, 450 bp, Artificial Sequence
  Description of Artificial Sequence: Synthetic coding sequence
atgagatacaacgagaaggagctgcaggccctgagcagacagcccgccgagatggccgccgagctgggcatgagaggccccaagaagggcagcgtgctgaagagaagactggtgaagctggtggtgaacttcctgttctacttcagaaccgacgaggccgagcccgtgggcgccctgctgctggagagatgcagagtggtgagagaggagcccggcaccttcagcatcagcttcatcgaggaccccgagagaaagtaccacttcgagtgcagcagcgaggagcagtgccaggagtggatggaggccctgagaagagccagctacgagttcatgagaagaagcctgatcttctacagaaacgagatcagaaaggtgaccggcaaggaccccctggagcagttcggcatcagcgaggaggccagattccagctgagcggcctgcaggcctag

SEQ ID NO: 23213 - DNA, 3351 bp, Artificial Sequence
  Description of Artificial Sequence: Synthetic coding sequence
atggccgccgacctgaacctggagtggatcagcctgcccagaagctggacctacggcatcaccagaggcggcagagtgttcttcatcaacgaggaggccaagagcaccacctggctgcaccccgtgaccggcgaggccgtggtgaccggccacagaagacagagcaccgacctgcccaccggctgggaggaggcctacaccttcgagggcgccagatactacatcaaccacaacgagagaaaggtgacctgcaagcaccccgtgaccggccagcccagccaggacaactgcatcttcgtggtgaacgagcagaccgtggccaccatgaccagcgaggagaagaaggagagacccatcagcatgatcaacgaggccagcaactacaacgtgaccagcgactacgccgtgcaccccatgagccccgtgggcagaaccagcagagccagcaagaaggtgcacaacttcggcaagagaagcaacagcatcaagagaaaccccaacgcccccgtggtgagaagaggctggctgtacaagcaggacagcaccggcatgaagctgtggaagaagagatggttcgtgctgagcgacctgtgcctgttctactacagagacgagaaggaggagggcatcctgggcagcatcctgctgcccagcttccagatcgccctgctgaccagcgaggaccacatcaacagaaagtacgccttcaaggccgcccaccccaacatgagaacctactacttctgcaccgacaccggcaaggagatggagctgtggatgaaggccatgctggacgccgccctggtgcagaccgagcccgtgaagagagtggacaagatcaccagcgagaacgcccccaccaaggagaccaacaacatccccaaccacagagtgctgatcaagcccgagatccagaacaaccagaagaacaaggagatgagcaagatcgaggagaagaaggccctggaggccgagaagtacggcttccagaaggacggccaggacagacccctgaccaagatcaacagcgtgaagctgaacagcctgcccagcgagtacgagagcggcagcgcctgccccgcccagaccgtgcactacagacccatcaacctgagcagcagcgagaacaagatcgtgaacgtgagcctggccgacctgagaggcggcaacagacccaacaccggccccctgtacaccgaggccgacagagtgatccagagaaccaacagcatgcagcagctggagcagtggatcaagatccagaagggcagaggccacgaggaggagaccagaggcgtgatcagctaccagaccctgcccagaaacatgcccagccacagagcccagatcatggccagataccccgagggctacagaaccctgcccagaaacagcaagaccagacccgagagcatctgcagcgtgacccccagcacccacgacaagaccctgggccccggcgccgaggagaagagaagaagcatgagagacgacaccatgtggcagctgtacgagtggcagcagagacagttctacaacaagcagagcaccctgcccagacacagcaccctgagcagccccaagaccatggtgaacatcagcgaccagaccatgcacagcatccccaccagccccagccacggcagcatcgccgcctaccagggctacagcccccagagaacctacagaagcgaggtgagcagccccatccagagaggcgacgtgaccatcgacagaagacacagagcccaccaccccaagcacgtgtacgtgcccgacagaagaagcgtgcccgccggcctgaccctgcagagcgtgagcccccagagcctgcagggcaagaccctgagccaggacgagggcagaggcaccctgtacaagtacagacccgaggaggtggacatcgacgccaagctgagcagactgtgcgagcaggacaaggtggtgcacgccctggaggagaagctgcagcagctgcacaaggagaagtacaccctggagcaggccctgctgagcgccagccaggagatcgagatgcacgccgacaaccccgccgccatccagaccgtggtgctgcagagagacgacctgcagaacggcctgctgagcacctgcagagagctgagcagagccaccgccgagctggagagagcctggagagagtacgacaagctggagtacgacgtgaccgtgaccagaaaccagatgcaggagcagctggaccacctgggcgaggtgcagaccgagagcgccggcatccagagagcccagatccagaaggagctgtggagaatccaggacgtgatggagggcctgagcaagcacaagcagcagagaggcaccaccgagatcggcatgatcggcagcaagcccttcagcaccgtgaagtacaagaacgagggccccgactacagactgtacaagagcgagcccgagctgaccaccgtggccgaggtggacgagagcaacggcgaggagaagagcgagcccgtgagcgagatcgagaccagcgtggtgaagggcagccacttccccgtgggcgtggtgccccccagagccaagagccccacccccgagagcagcaccatcgccagctacgtgaccctgagaaagaccaagaagatgatggacctgagaaccgagagacccagaagcgccgtggagcagctgtgcctggccgagagcaccagacccagaatgaccgtggaggagcagatggagagaatcagaagacaccagcaggcctgcctgagagagaagaagaagggcctgaacgtgatcggcgccagcgaccagagccccctgcagagccccagcaacctgagagacaaccccttcagaaccacccagaccagaagaagagacgacaaggagctggacaccgccatcagagagaacgacgtgaagcccgaccacgagacccccgccaccgagatcgtgcagctgaaggagaccgagccccagaacgtggacttcagcaaggagctgaagaagaccgagaacatcagctacgagatgctgttcgagcccgagcccaacggcgtgaacagcgtggagatgatggacaaggagagaaacaaggacaagatgcccgaggacgtgaccttcagcccccaggacgagacccagaccgccaaccacaagcccgaggagcaccccgaggagaacaccaagaacagcgtggacgagcaggaggagaccgtgatcagctacgagagcacccccgaggtgagcagaggcaaccagaccatggccgtgaagagcctgagccccagccccgagagcagcgccagccccgtgcccagcacccagccccagctgaccgagggcagccacttcatgtgcgtgtag

SEQ ID NO: 23214 - DNA, 1953 bp, Artificial Sequence
  Description of Artificial Sequence: Synthetic coding sequence
atggccgccgacctgaacctggagtggatcagcctgcccagaagctggacctacggcatcaccagaggcggcagagtgttcttcatcaacgaggaggccaagagcaccacctggctgcaccccgtgaccggcgaggccgtggtgaccggccacagaagacagagcaccgacctgcccaccggctgggaggaggcctacaccttcgagggcgccagatactacatcaaccacaacgagagaaaggtgacctgcaagcaccccgtgaccggccagcccagccaggacaactgcatcttcgtggtgaacgagcagaccgtggccaccatgaccagcgaggagaagaaggagagacccatcagcatgatcaacgaggccagcaactacaacgtgaccagcgactacgccgtgcaccccatgagccccgtgggcagaaccagcagagccagcaagaaggtgcacaacttcggcaagagaagcaacagcatcaagagaaaccccaacgcccccgtggtgagaagaggctggctgtacaagcaggacagcaccggcatgaagctgtggaagaagagatggttcgtgctgagcgacctgtgcctgttctactacagagacgagaaggaggagggcatcctgggcagcatcctgctgcccagcttccagatcgccctgctgaccagcgaggaccacatcaacagaaagtacgccttcaaggccgcccaccccaacatgagaacctactacttctgcaccgacaccggcaaggagatggagctgtggatgaaggccatgctggacgccgccctggtgcagaccgagcccgtgaagagagtggacaagatcaccagcgagaacgcccccaccaaggagaccaacaacatccccaaccacagagtgctgatcaagcccgagatccagaacaaccagaagaacaaggagatgagcaagatcgaggagaagaaggccctggaggccgagaagtacggcttccagaaggacggccaggacagacccctgaccaagatcaacagcgtgaagctgaacagcctgcccagcgagtacgagagcggcagcgcctgccccgcccagaccgtgcactacagacccatcaacctgagcagcagcgagaacaagatcgtgaacgtgagcctggccgacctgagaggcggcaacagacccaacaccggccccctgtacaccgaggccgacagagtgatccagagaaccaacagcatgcagcagctggagcagtggatcaagatccagaagggcagaggccacgaggaggagaccagaggcgtgatcagctaccagaccctgcccagaaacatgcccagccacagagcccagatcatggccagataccccgagggctacagaaccctgcccagaaacagcaagaccagacccgagagcatctgcagcgtgacccccagcacccacgacaagaccctgggccccggcgccgaggagaagagaagaagcatgagagacgacaccatgtggcagctgtacgagtggcagcagagacagttctacaacaagcagagcaccctgcccagacacagcaccctgagcagccccaagaccatggtgaacatcagcgaccagaccatgcacagcatccccaccagccccagccacggcagcatcgccgcctaccagggctacagcccccagagaacctacagaagcgaggtgagcagccccatccagagaggcgacgtgaccatcgacagaagacacagagcccaccaccccaagcacgtgtacgtgcccgacagaagaagcgtgcccgccggcctgaccctgcagagcgtgagcccccagagcctgcagggcaagacctggggcagagagaaggtggccaccgccaccggcgccgccgaggccgtggccagcgacacccacctgcccagaaccggcagcagcagccccagcctgctgtgcgtgtag

SEQ ID NO: 23215 - DNA, 3540 bp, Artificial Sequence
  Description of Artificial Sequence: Synthetic coding sequence
atggccgccgacctgaacctggagtggatcagcctgcccagaagctggacctacggcatcaccagaggcggcagagtgttcttcatcaacgaggaggccaagagcaccacctggctgcaccccgtgaccggcgaggccgtggtgaccggccacagaagacagagcaccgacctgcccaccggctgggaggaggcctacaccttcgagggcgccagatactacatcaaccacaacgagagaaaggtgacctgcaagcaccccgtgaccggccagcccagccaggacaactgcatcttcgtggtgaacgagcagaccgtggccaccatgaccagcgaggagaagaaggagagacccatcagcatgatcaacgaggccagcaactacaacgtgaccagcgactacgccgtgcaccccatgagccccgtgggcagaaccagcagagccagcaagaaggtgcacaacttcggcaagagaagcaacagcatcaagagaaaccccaacgcccccgtggtgagaagaggctggctgtacaagcaggacagcaccggcatgaagctgtggaagaagagatggttcgtgctgagcgacctgtgcctgttctactacagagacgagaaggaggagggcatcctgggcagcatcctgctgcccagcttccagatcgccctgctgaccagcgaggaccacatcaacagaaagtacgccttcaaggccgcccaccccaacatgagaacctactacttctgcaccgacaccggcaaggagatggagctgtggatgaaggccatgctggacgccgccctggtgcagaccgagcccgtgaagagagtggacaagatcaccagcgagaacgcccccaccaaggagaccaacaacatccccaaccacagagtgctgatcaagcccgagatccagaacaaccagaagaacaaggagatgagcaagatcgaggagaagaaggccctggaggccgagaagtacggcttccagaaggacggccaggacagacccctgaccaagatcaacagcgtgaagctgaacagcctgcccagcgagtacgagagcggcagcgcctgccccgcccagaccgtgcactacagacccatcaacctgagcagcagcgagaacaagatcgtgaacgtgagcctggccgacctgagaggcggcaacagacccaacaccggccccctgtacaccgaggccgacagagtgatccagagaaccaacagcatgcagcagctggagcagtggatcaagatccagaagggcagaggccacgaggaggagaccagaggcgtgatcagctaccagaccctgcccagaaacatgcccagccacagagcccagatcatggccagataccccgagggctacagaaccctgcccagaaacagcaagaccagacccgagagcatctgcagcgtgacccccagcacccacgacaagaccctgggccccggcgccgaggagaagagaagaagcatgagagacgacaccatgtggcagctgtacgagtggcagcagagacagttctacaacaagcagagcaccctgcccagacacagcaccctgagcagccccaagaccatggtgaacatcagcgaccagaccatgcacagcatccccaccagccccagccacggcagcatcgccgcctaccagggctacagcccccagagaacctacagaagcgaggtgagcagccccatccagagaggcgacgtgaccatcgacagaagacacagagcccaccaccccaagcacgtgtacgtgcccgacagaagaagcgtgcccgccggcctgaccctgcagagcgtgagcccccagagcctgcagggcaagaccctgagccaggacgagggcagaggcaccctgtacaagtacagacccgaggaggtggacatcgacgccaagctgagcagactgtgcgagcaggacaaggtggtgcacgccctggaggagaagctgcagcagctgcacaaggagaagtacaccctggagcaggccctgctgagcgccagccaggagatcgagatgcacgccgacaaccccgccgccatccagaccgtggtgctgcagagagacgacctgcagaacggcctgctgagcacctgcagagagctgagcagagccaccgccgagctggagagagcctggagagagtacgacaagctggagtacgacgtgaccgtgaccagaaaccagatgcaggagcagctggaccacctgggcgaggtgcagaccgagagcgccggcatccagagagcccagatccagaaggagctgtggagaatccaggacgtgatggagggcctgagcaagcacaagcagcagagaggcaccaccgagatcggcatgatcggcagcaagcccttcagcaccgtgaagtacaagaacgaggaggaggaggtggtgccccccagaccccccctgcccagaagctacgacttcaccgagcagccccccatcatcccccccctgcccagcgacagcagcagcctgctgtgctacagcagaggccccgtgcacctgcccgaggagaagaagatgtaccaggtgcagggctaccccagaaacggcagccactgcggccccgactacagactgtacaagagcgagcccgagctgaccaccgtggccgaggtggacgagagcaacggcgaggagaagagcgagcccgtgagcgagatcgagaccagcgtggtgaagggcagccacttccccgtgggcgtggtgccccccagagccaagagccccacccccgagagcagcaccatcgccagctacgtgaccctgagaaagaccaagaagatgatggacctgagaaccgagagacccagaagcgccgtggagcagctgtgcctggccgagagcaccagacccagaatgaccgtggaggagcagatggagagaatcagaagacaccagcaggcctgcctgagagagaagaagaagggcctgaacgtgatcggcgccagcgaccagagccccctgcagagccccagcaacctgagagacaaccccttcagaaccacccagaccagaagaagagacgacaaggagctggacaccgccatcagagagaacgacgtgaagcccgaccacgagacccccgccaccgagatcgtgcagctgaaggagaccgagccccagaacgtggacttcagcaaggagctgaagaagaccgagaacatcagctacgagatgctgttcgagcccgagcccaacggcgtgaacagcgtggagatgatggacaaggagagaaacaaggacaagatgcccgaggacgtgaccttcagcccccaggacgagacccagaccgccaaccacaagcccgaggagcaccccgaggagaacaccaagaacagcgtggacgagcaggaggagaccgtgatcagctacgagagcacccccgaggtgagcagaggcaaccagaccatggccgtgaagagcctgagccccagccccgagagcagcgccagccccgtgcccagcacccagccccagctgaccgagggcagccacttcatgtgcgtgtag

SEQ ID NO: 23216 - DNA, 3525 bp, Artificial Sequence
  Description of Artificial Sequence: Synthetic coding sequence
atggccgccgacctgaacctggagtggatcagcctgcccagaagctggacctacggcatcaccagaggcggcagagtgttcttcatcaacgaggaggccaagagcaccacctggctgcaccccgtgaccggcgaggccgtggtgaccggccacagaagacagagcaccgacctgcccaccggctgggaggaggcctacaccttcgagggcgccagatactacatcaaccacaacgagagaaaggtgacctgcaagcaccccgtgaccggccagcccagccaggacaactgcatcttcgtggtgaacgagcagaccgtggccaccatgaccagcgaggagaagaaggagagacccatcagcatgatcaacgaggccagcaactacaacgtgaccagcgactacgccgtgcaccccatgagccccgtgggcagaaccagcagagccagcaagaaggtgcacaacttcggcaagagaagcaacagcatcaagagaaaccccaacgcccccgtggtgagaagaggctggctgtacaagcaggacagcaccggcatgaagctgtggaagaagagatggttcgtgctgagcgacctgtgcctgttctactacagagacgagaaggaggagggcatcctgggcagcatcctgctgcccagcttccagatcgccctgctgaccagcgaggaccacatcaacagaaagtacgccttcaaggccgcccaccccaacatgagaacctactacttctgcaccgacaccggcaaggagatggagctgtggatgaaggccatgctggacgccgccctggtgcagaccgagcccgtgaagagagtggacaagatcaccagcgagaacgcccccaccaaggagaccaacaacatccccaaccacagagtgctgatcaagcccgagatccagaacaaccagaagaacaaggagatgagcaagatcgaggagaagaaggccctggaggccgagaagtacggcttccagaaggacggccaggacagacccctgaccaagatcaacagcgtgaagctgaacagcctgcccagcgagtacgagagcggcagcgcctgccccgcccagaccgtgcactacagacccatcaacctgagcagcagcgagaacaagatcgtgaacgtgagcctggccgacctgagaggcggcaacagacccaacaccggccccctgtacaccgaggccgacagagtgatccagagaaccaacagcatgcagcagctggagcagtggatcaagatccagaagggcagaggccacgaggaggagaccagaggcgtgatcagctaccagaccctgcccagaaacatgcccagccacagagcccagatcatggccagataccccgagggctacagaaccctgcccagaaacagcaagaccagacccgagagcatctgcagcgtgacccccagcacccacgacaagaccctgggccccggcgccgaggagaagagaagaagcatgagagacgacaccatgtggcagctgtacgagtggcagcagagacagttctacaacaagcagagcaccctgcccagacacagcaccctgagcagccccaagaccatggtgaacatcagcgaccagaccatgcacagcatccccaccagccccagccacggcagcatcgccgcctaccagggctacagcccccagagaacctacagaagcgaggtgagcagccccatccagagaggcgacgtgaccatcgacagaagacacagagcccaccaccccaagcacgtgtacgtgcccgacagaagaagcgtgcccgccggcctgaccctgcagagcgtgagcccccagagcctgcagggcaagacccccgaggagctgaccctgctgctgatcaagctgagaagacagcaggccgagctgagcagcatcagagagcacaccctggcccagctgatgcagctgaagctggaggcccacagccccaagaacgagatcctgagccaccacctgcagagaaacaccatctacctggaccaccagctgagccaggacgagggcagaggcaccctgtacaagtacagacccgaggaggtggacatcgacgccaagctgagcagactgtgcgagcaggacaaggtggtgcacgccctggaggagaagctgcagcagctgcacaaggagaagtacaccctggagcaggccctgctgagcgccagccaggagatcgagatgcacgccgacaaccccgccgccatccagaccgtggtgctgcagagagacgacctgcagaacggcctgctgagcacctgcagagagctgagcagagccaccgccgagctggagagagcctggagagagtacgacaagctggagtacgacgtgaccgtgaccagaaaccagatgcaggagcagctggaccacctgggcgaggtgcagaccgagagcgccggcatccagagagcccagatccagaaggagctgtggagaatccaggacgtgatggagggcctgagcaagcacaagcagcagagaggcaccaccgagatcggcatgatcggcagcaagcccttcagcaccgtgaagtacaagaacgagggccccgactacagactgtacaagagcgagcccgagctgaccaccgtggccgaggtggacgagagcaacggcgaggagaagagcgagcccgtgagcgagatcgagaccagcgtggtgaagggcagccacttccccgtgggcgtggtgccccccagagccaagagccccacccccgagagcagcaccatcgccagctacgtgaccctgagaaagaccaagaagatgatggacctgagaaccgagagacccagaagcgccgtggagcagctgtgcctggccgagagcaccagacccagaatgaccgtggaggagcagatggagagaatcagaagacaccagcaggcctgcctgagagagaagaagaagggcctgaacgtgatcggcgccagcgaccagagccccctgcagagccccagcaacctgagagacaaccccttcagaaccacccagaccagaagaagagacgacaaggagctggacaccgccatcagagagaacgacgtgaagcccgaccacgagacccccgccaccgagatcgtgcagctgaaggagaccgagccccagaacgtggacttcagcaaggagctgaagaagaccgagaacatcagctacgagatgctgttcgagcccgagcccaacggcgtgaacagcgtggagatgatggacaaggagagaaacaaggacaagatgcccgaggacgtgaccttcagcccccaggacgagacccagaccgccaaccacaagcccgaggagcaccccgaggagaacaccaagaacagcgtggacgagcaggaggagaccgtgatcagctacgagagcacccccgaggtgagcagaggcaaccagaccatggccgtgaagagcctgagccccagccccgagagcagcgccagccccgtgcccagcacccagccccagctgaccgagggcagccacttcatgtgcgtgtag

SEQ ID NO: 23217 - DNA, 3183 bp, Artificial Sequence
  Description of Artificial Sequence: Synthetic coding sequence
atggccgccgacctgaacctggagtggatcagcctgcccagaagctggacctacggcatcaccagaggcggcagagtgttcttcatcaacgaggaggccaagagcaccacctggctgcaccccgtgaccggcgaggccgtggtgaccggccacagaagacagagcaccgacctgcccaccggctgggaggaggcctacaccttcgagggcgccagatactacatcaaccacaacgagagaaaggtgacctgcaagcaccccgtgaccggccagcccagccaggacaactgcatcttcgtggtgaacgagcagaccgtggccaccatgaccagcgaggagaagaaggagagacccatcagcatgatcaacgaggccagcaactacaacgtgaccagcgactacgccgtgcaccccatgagccccgtgggcagaaccagcagagccagcaagaaggtgcacaacttcggcaagagaagcaacagcatcaagagaaaccccaacgcccccgtggtgagaagaggctggctgtacaagcaggacagcaccggcatgaagctgtggaagaagagatggttcgtgctgagcgacctgtgcctgttctactacagagacgagaaggaggagggcatcctgggcagcatcctgctgcccagcttccagatcgccctgctgaccagcgaggaccacatcaacagaaagtacgccttcaaggccgcccaccccaacatgagaacctactacttctgcaccgacaccggcaaggagatggagctgtggatgaaggccatgctggacgccgccctggtgcagaccgagcccgtgaagagagtggacaagatcaccagcgagaacgcccccaccaaggagaccaacaacatccccaaccacagagtgctgatcaagcccgagatccagaacaaccagaagaacaaggagatgagcaagatcgaggagaagaaggccctggaggccgagaagtacggcttccagaaggacggccaggacagacccctgaccaagatcaacagcgtgaagctgaacagcctgcccagcgagtacgagagcggcagcgcctgccccgcccagaccgtgcactacagacccatcaacctgagcagcagcgagaacaagatcgtgaacgtgagcctggccgacctgagaggcggcaacagacccaacaccggccccctgtacaccgaggccgacagagtgatccagagaaccaacagcatgcagcagctggagcagtggatcaagatccagaagggcagaggccacgaggaggagaccagaggcgtgatcagctaccagaccctgcccagaaacatgcccagccacagagcccagatcatggccagataccccgagggctacagaaccctgcccagaaacagcaagaccagacccgagagcatctgcagcgtgacccccagcacccacgacaagaccctgggccccggcgccgaggagaagagaagaagcatgagagacgacaccatgtggcagctgtacgagtggcagcagagacagttctacaacaagcagagcaccctgcccagacacagcaccctgagcagccccaagaccatggtgaacatcagcgaccagaccatgcacagcatccccaccagccccagccacggcagcatcgccgcctaccagggctacagcccccagagaacctacagaagcgaggtgagcagccccatccagagaggcgacgtgaccatcgacagaagacacagagcccaccaccccaagcacgtgtacgtgcccgacagaagaagcgtgcccgccggcctgaccctgcagagcgtgagcccccagagcctgcagggcaagaccctgagccaggacgagggcagaggcaccctgtacaagtacagacccgaggaggtggacatcgacgccaagctgagcagactgtgcgagcaggacaaggtggtgcacgccctggaggagaagctgcagcagctgcacaaggagaagtacaccctggagcaggccctgctgagcgccagccaggagatcgagatgcacgccgacaaccccgccgccatccagaccgtggtgctgcagagagacgacctgcagaacggcctgctgagcacctgcagagagctgagcagagccaccgccgagctggagagagcctggagagagtacgacaagctggagtacgacgtgaccgtgaccagaaaccagatgcaggagcagctggaccacctgggcgaggtgcagaccgagagcgccggcatccagagagcccagatccagaaggagctgtggagaatccaggacgtgatggagggcctgagcaagcacaagcagcagagaggcaccaccgagatcggcagccacttccccgtgggcgtggtgccccccagagccaagagccccacccccgagagcagcaccatcgccagctacgtgaccctgagaaagaccaagaagatgatggacctgagaaccgagagacccagaagcgccgtggagcagctgtgcctggccgagagcaccagacccagaatgaccgtggaggagcagatggagagaatcagaagacaccagcaggcctgcctgagagagaagaagaagggcctgaacgtgatcggcgccagcgaccagagccccctgcagagccccagcaacctgagagacaaccccttcagaaccacccagaccagaagaagagacgacaaggagctggacaccgccatcagagagaacgacgtgaagcccgaccacgagacccccgccaccgagatcgtgcagctgaaggagaccgagccccagaacgtggacttcagcaaggagctgaagaagaccgagaacatcagctacgagatgctgttcgagcccgagcccaacggcgtgaacagcgtggagatgatggacaaggagagaaacaaggacaagatgcccgaggacgtgaccttcagcccccaggacgagacccagaccgccaaccacaagcccgaggagcaccccgaggagaacaccaagaacagcgtggacgagcaggaggagaccgtgatcagctacgagagcacccccgaggtgagcagaggcaaccagaccatggccgtgaagagcctgagccccagccccgagagcagcgccagccccgtgcccagcacccagccccagctgaccgagggcagccacttcatgtgcgtgtag

SEQ ID NO: 23218 - DNA, 963 bp, Artificial Sequence
  Description of Artificial Sequence: Synthetic coding sequence
atggccgccgacctgaacctggagtggatcagcctgcccagaagctggacctacggcatcaccagaggcggcagagtgttcttcatcaacgaggaggccaagagcaccacctggctgcaccccgtgaccggcgaggccgtggtgaccggccacagaagacagagcaccgacctgcccaccggctgggaggaggcctacaccttcgagggcgccagatactacatcaaccacaacgagagaaaggtgacctgcaagcaccccgtgaccggccagcccagccaggacaactgcatcttcgtggtgaacgagcagaccgtggccaccatgaccagcgaggagaagaaggagagacccatcagcatgatcaacgaggccagcaactacaacgtgaccagcgactacgccgtgcaccccatgagccccgtgggcagaaccagcagagccagcaagaaggtgcacaacttcggcaagagaagcaacagcatcaagagaaaccccaacgcccccgtggtgagaagaggctggctgtacaagcaggacagcaccggcatgaagctgtggaagaagagatggttcgtgctgagcgacctgtgcctgttctactacagagacgagaaggaggagggcatcctgggcagcatcctgctgcccagcttccagatcgccctgctgaccagcgaggaccacatcaacagaaagtacgccttcaaggccgcccaccccaacatgagaacctactacttctgcaccgacaccggcaaggagatggagctgtggatgaaggccatgctggacgccgccctggtgcagaccgagcccgtgaagagagtggacaagatcaccagcgagaacgcccccaccaaggagaccaacaacatccccaaccacagagtgctgatcaagcccgagatccagaacaaccagaagaacaaggagaagaagaagaagaagaagaagaagtag

SEQ ID NO: 23219 - DNA, 3318 bp, Artificial Sequence
  Description of Artificial Sequence: Synthetic coding sequence
atgaccagcgaggagaagaaggagagacccatcagcatgatcaacgaggccagcaactacaacgtgaccagcgactacgccgtgcaccccatgagccccgtgggcagaaccagcagagccagcaagaaggtgcacaacttcggcaagagaagcaacagcatcaagagaaaccccaacgcccccgtggtgagaagaggctggctgtacaagcaggacagcaccggcatgaagctgtggaagaagagatggttcgtgctgagcgacctgtgcctgttctactacagagacgagaaggaggagggcatcctgggcagcatcctgctgcccagcttccagatcgccctgctgaccagcgaggaccacatcaacagaaagtacgccttcaaggccgcccaccccaacatgagaacctactacttctgcaccgacaccggcaaggagatggagctgtggatgaaggccatgctggacgccgccctggtgcagaccgagcccgtgaagagagtggacaagatcaccagcgagaacgcccccaccaaggagaccaacaacatccccaaccacagagtgctgatcaagcccgagatccagaacaaccagaagaacaaggagatgagcaagatcgaggagaagaaggccctggaggccgagaagtacggcttccagaaggacggccaggacagacccctgaccaagatcaacagcgtgaagctgaacagcctgcccagcgagtacgagagcggcagcgcctgccccgcccagaccgtgcactacagacccatcaacctgagcagcagcgagaacaagatcgtgaacgtgagcctggccgacctgagaggcggcaacagacccaacaccggccccctgtacaccgaggccgacagagtgatccagagaaccaacagcatgcagcagctggagcagtggatcaagatccagaagggcagaggccacgaggaggagaccagaggcgtgatcagctaccagaccctgcccagaaacatgcccagccacagagcccagatcatggccagataccccgagggctacagaaccctgcccagaaacagcaagaccagacccgagagcatctgcagcgtgacccccagcacccacgacaagaccctgggccccggcgccgaggagaagagaagaagcatgagagacgacaccatgtggcagctgtacgagtggcagcagagacagttctacaacaagcagagcaccctgcccagacacagcaccctgagcagccccaagaccatggtgaacatcagcgaccagaccatgcacagcatccccaccagccccagccacggcagcatcgccgcctaccagggctacagcccccagagaacctacagaagcgaggtgagcagccccatccagagaggcgacgtgaccatcgacagaagacacagagcccaccaccccaagcacgtgtacgtgcccgacagaagaagcgtgcccgccggcctgaccctgcagagcgtgagcccccagagcctgcagggcaagaccatgaaggagaacgagcccatcatcaccatggtgcacaccatgatcgagaacagcgccctgagaccccagctgtaccagcagttcctgagacagaagagcaagatcagcctgtactgcctgagccaggacgagggcagaggcaccctgtacaagtacagacccgaggaggtggacatcgacgccaagctgagcagactgtgcgagcaggacaaggtggtgcacgccctggaggagaagctgcagcagctgcacaaggagaagtacaccctggagcaggccctgctgagcgccagccaggagatcgagatgcacgccgacaaccccgccgccatccagaccgtggtgctgcagagagacgacctgcagaacggcctgctgagcacctgcagagagctgagcagagccaccgccgagctggagagagcctggagagagtacgacaagctggagtacgacgtgaccgtgaccagaaaccagatgcaggagcagctggaccacctgggcgaggtgcagaccgagagcgccggcatccagagagcccagatccagaaggagctgtggagaatccaggacgtgatggagggcctgagcaagcacaagcagcagagaggcatgatcggcagcaagcccttcagcaccgtgaagtacaagaacgaggaggaggaggtggtgccccccagaccccccctgcccagaagctacgacttcaccgagcagccccccatcatcccccccctgcccagcgacagcagcagcctgctgtgctacagcagaggccccgtgcacctgcccgaggagaagaagatgtaccaggtgcagggctaccccagaaacggcagccactgcggccccgactacagactgtacaagagcgagcccgagctgaccaccgtggccgaggtggacgagagcaacggcgaggagaagagcgagcccgtgagcgagatcgagaccagcgtggtgaagggcagccacttccccgtgggcgtggtgccccccagagccaagagccccacccccgagagcagcaccatcgccagctacgtgaccctgagaaagaccaagaagatgatggacctgagaaccgagagacccagaagcgccgtggagcagctgtgcctggccgagagcaccagacccagaatgaccgtggaggagcagatggagagaatcagaagacaccagcaggcctgcctgagagagaagaagaagggcctgaacgtgatcggcgccagcgaccagagccccctgcagagccccagcaacctgagagacaaccccttcagaaccacccagaccagaagaagagacgacaaggagctggacaccgccatcagagagaacgacgtgaagcccgaccacgagacccccgccaccgagatcgtgcagctgaaggagaccgagccccagaacgtggacttcagcaaggagctgaagaagaccgagaacatcagctacgagatgctgttcgagcccgagcccaacggcgtgaacagcgtggagatgatggacaaggagagaaacaaggacaagatgcccgaggacgtgaccttcagcccccaggacgagacccagaccgccaaccacaagcccgaggagcaccccgaggagaacaccaagaacagcgtggacgagcaggaggagaccgtgatcagctacgagagcacccccgaggtgagcagaggcaaccagaccatggccgtgaagagcctgagccccagccccgagagcagcgccagccccgtgcccagcacccagccccagctgaccgagggcagccacttcatgtgcgtgtag

SEQ ID NO: 23220 - DNA, 3525 bp, Artificial Sequence; identical to SEQ ID NO: 23216
  Description of Artificial Sequence: Synthetic coding sequence

SEQ ID NO: 23221 - DNA, 1194 bp, Artificial Sequence
  Description of Artificial Sequence: Synthetic coding sequence
tacaccctggagcaggccctgctgagcgccagccaggagatcgagatgcacgccgacaaccccgccgccatccagaccgtggtgctgcagagagacgacctgcagaacggcctgctgagcacctgcagagagctgagcagagccaccgccgagctggagagagcctggagagagtacgacaagctggagtacgacgtgaccgtgaccagaaaccagatgcaggagcagctggaccacctgggcgaggtgcagaccgagagcgccggcatccagagagcccagatccagaaggagctgtggagaatccaggacgtgatggagggcctgagcaagcacaagcagcagagaggcaccaccgagatcggcagccacttccccgtgggcgtggtgccccccagagccaagagccccacccccgagagcagcaccatcgccagctacgtgaccctgagaaagaccaagaagatgatggacctgagaaccgagagacccagaagcgccgtggagcagctgtgcctggccgagagcaccagacccagaatgaccgtggaggagcagatggagagaatcagaagacaccagcaggcctgcctgagagagaagaagaagggcctgaacgtgatcggcgccagcgaccagagccccctgcagagccccagcaacctgagagacaaccccttcagaaccacccagaccagaagaagagacgacaaggagctggacaccgccatcagagagaacgacgtgaagcccgaccacgagacccccgccaccgagatcgtgcagctgaaggagaccgagccccagaacgtggacttcagcaaggagctgaagaagaccgagaacatcagctacgagatgctgttcgagcccgagcccaacggcgtgaacagcgtggagatgatggacaaggagagaaacaaggacaagatgcccgaggacgtgaccttcagcccccaggacgagacccagaccgccaaccacaagcccgaggagcaccccgaggagaacaccaagaacagcgtggacgagcaggaggagaccgtgatcagctacgagagcacccccgaggtgagcagaggcaaccagaccatggccgtgaagagcctgagccccagccccgagagcagcgccagccccgtgcccagcacccagccccagctgaccgagggcagccacttcatgtgcgtgtag

SEQ ID NO: 23222 - DNA, 2625 bp, Artificial Sequence
  Description of Artificial Sequence: Synthetic coding sequence
atgagaacctactacttctgcaccgacaccggcaaggagatggagctgtggatgaaggccatgctggacgccgccctggtgcagaccgagcccgtgaagagagtggacaagatcaccagcgagaacgcccccaccaaggagaccaacaacatccccaaccacagagtgctgatcaagcccgagatccagaacaaccagaagaacaaggagatgagcaagatcgaggagaagaaggccctggaggccgagaagtacggcttccagaaggacggccaggacagacccctgaccaagatcaacagcgtgaagctgaacagcctgcccagcgagtacgagagcggcagcgcctgccccgcccagaccgtgcactacagacccatcaacctgagcagcagcgagaacaagatcgtgaacgtgagcctggccgacctgagaggcggcaacagacccaacaccggccccctgtacaccgaggccgacagagtgatccagagaaccaacagcatgcagcagctggagcagtggatcaagatccagaagggcagaggccacgaggaggagaccagaggcgtgatcagctaccagaccctgcccagaaacatgcccagccacagagcccagatcatggccagataccccgagggctacagaaccctgcccagaaacagcaagaccagacccgagagcatctgcagcgtgacccccagcacccacgacaagaccctgggccccggcgccgaggagaagagaagaagcatgagagacgacaccatgtggcagctgtacgagtggcagcagagacagttctacaacaagcagagcaccctgcccagacacagcaccctgagcagccccaagaccatggtgaacatcagcgaccagaccatgcacagcatccccaccagccccagccacggcagcatcgccgcctaccagggctacagcccccagagaacctacagaagcgaggtgagcagccccatccagagaggcgacgtgaccatcgacagaagacacagagcccaccaccccaagcacgtgtacgtgcccgacagaagaagcgtgcccgccggcctgaccctgcagagcgtgagcccccagagcctgcagggcaagaccctgagccaggacgagggcagaggcaccctgtacaagtacagacccgaggaggtggacatcgacgccaagctgagcagactgtgcgagcaggacaaggtggtgcacgccctggaggagaagctgcagcagctgcacaaggagaagtacaccctggagcaggccctgctgagcgccagccaggagatcgagatgcacgccgacaaccccgccgccatccagaccgtggtgctgcagagagacgacctgcagaacggcctgctgagcacctgcagagagctgagcagagccaccgccgagctggagagagcctggagagagtacgacaagctggagtacgacgtgaccgtgaccagaaaccagatgcaggagcagctggaccacctgggcgaggtgcagaccgagagcgccggcatccagagagcccagatccagaaggagctgtggagaatccaggacgtgatggagggcctgagcaagcacaagcagcagagaggcaccaccgagatcggcatgatcggcagcaagcccttcagcaccgtgaagtacaagaacgagggccccgactacagactgtacaagagcgagcccgagctgaccaccgtggccgaggtggacgagagcaacggcgaggagaagagcgagcccgtgagcgagatcgagaccagcgtggtgaagggcagccacttccccgtgggcgtggtgccccccagagccaagagccccacccccgagagcagcaccatcgccagctacgtgaccctgagaaagaccaagaagatgatggacctgagaaccgagagacccagaagcgccgtggagcagctgtgcctggccgagagcaccagacccagaatgaccgtggaggagcagatggagagaatcagaagacaccagcaggcctgcctgagagagaagaagaagggcctgaacgtgatcggcgccagcgaccagagccccctgcagagccccagcaacctgagagacaaccccttcagaaccacccagaccagaagaagagacgacaaggagctggacaccgccatcagagagaacgacgtgaagcccgaccacgagacccccgccaccgagatcgtgcagctgaaggagaccgagccccagaacgtggacttcagcaaggagctgaagaagaccgagaacatcagctacgagatgctgttcgagcccgagcccaacggcgtgaacagcgtggagatgatggacaaggagagaaacaaggacaagatgcccgaggacgtgaccttcagcccccaggacgagacccagaccgccaaccacaagcccgaggagcaccccgaggagaacaccaagaacagcgtggacgagcaggaggagaccgtgatcagctacgagagcacccccgaggtgagcagaggcaaccagaccatggccgtgaagagcctgagccccagccccgagagcagcgccagccccgtgcccagcacccagccccagctgaccgagggcagccacttcatgtgcgtgtag

SEQ ID NO: 23223 - DNA, 3555 bp, Artificial Sequence
  Description of Artificial Sequence: Synthetic coding sequence
atggccgccgacctgaacctggagtggatcagcctgcccagaagctggacctacggcatcaccagaggcggcagagtgttcttcatcaacgaggaggccaagagcaccacctggctgcaccccgtgaccggcgaggccgtggtgaccggccacagaagacagagcaccgacctgcccaccggctgggaggaggcctacaccttcgagggcgccagatactacatcaaccacaacgagagaaaggtgacctgcaagcaccccgtgaccggccagcccagccaggacaactgcatcttcgtggtgaacgagcagaccgtggccaccatgaccagcgaggagaagaaggagagacccatcagcatgatcaacgaggccagcaactacaacgtgaccagcgactacgccgtgcaccccatgagccccgtgggcagaaccagcagagccagcaagaaggtgcacaacttcggcaagagaagcaacagcatcaagagaaaccccaacgcccccgtggtgagaagaggctggctgtacaagcaggacagcaccggcatgaagctgtggaagaagagatggttcgtgctgagcgacctgtgcctgttctactacagagacgagaaggaggagggcatcctgggcagcatcctgctgcccagcttccagatcgccctgctgaccagcgaggaccacatcaacagaaagtacgccttcaaggccgcccaccccaacatgagaacctactacttctgcaccgacaccggcaaggagatggagctgtggatgaaggccatgctggacgccgccctggtgcagaccgagcccgtgaagagaatcttcttcagcgacttcagagtggacaagatcaccagcgagaacgcccccaccaaggagaccaacaacatccccaaccacagagtgctgatcaagcccgagatccagaacaaccagaagaacaaggagatgagcaagatcgaggagaagaaggccctggaggccgagaagtacggcttccagaaggacggccaggacagacccctgaccaagatcaacagcgtgaagctgaacagcctgcccagcgagtacgagagcggcagcgcctgccccgcccagaccgtgcactacagacccatcaacctgagcagcagcgagaacaagatcgtgaacgtgagcctggccgacctgagaggcggcaacagacccaacaccggccccctgtacaccgaggccgacagagtgatccagagaaccaacagcatgcagcagctggagcagtggatcaagatccagaagggcagaggccacgaggaggagaccagaggcgtgatcagctaccagaccctgcccagaaacatgcccagccacagagcccagatcatggccagataccccgagggctacagaaccctgcccagaaacagcaagaccagacccgagagcatctgcagcgtgacccccagcacccacgacaagaccctgggccccggcgccgaggagaagagaagaagcatgagagacgacaccatgtggcagctgtacgagtggcagcagagacagttctacaacaagcagagcaccctgcccagacacagcaccctgagcagccccaagaccatggtgaacatcagcgaccagaccatgcacagcatccccaccagccccagccacggcagcatcgccgcctaccagggctacagcccccagagaacctacagaagcgaggtgagcagccccatccagagaggcgacgtgaccatcgacagaagacacagagcccaccaccccaagcacgtgtacgtgcccgacagaagaagcgtgcccgccggcctgaccctgcagagcgtgagcccccagagcctgcagggcaagacccccgaggagctgaccctgctgctgatcaagctgagaagacagcaggccgagctgagcagcatcagagagcacaccctggcccagctgatgcagctgaagctggaggcccacagccccaagaacgagatcctgagccaccacctgcagagaaacaccatctacctggaccaccagatgaaggagaacgagcccatcatcaccatggtgcacaccatgatcgagaacagcgccctgagaccccagctgtaccagcagttcctgagacagaagagcaagatcagcctgtactgcctgagccaggacgagggcagaggcaccctgtacaagtacagacccgaggaggtggacatcgacgccaagctgagcagactgtgcgagcaggacaaggtggtgcacgccctggaggagaagctgcagcagctgcacaaggagaagtacaccctggagcaggccctgctgagcgccagccaggagatcgagatgcacgccgacaaccccgccgccatccagaccgtggtgctgcagagagacgacctgcagaacggcctgctgagcacctgcagagagctgagcagagccaccgccgagctggagagagcctggagagagtacgacaagctggagtacgacgtgaccgtgaccagaaaccagatgcaggagcagctggaccacctgggcgaggtgcagaccgagagcgccggcatccagagagcccagatccagaaggagctgtggagaatccaggacgtgatggagggcctgagcaagcacaagcagcagagaggcatgatcggcagcaagcccttcagcaccgtgaagtacaagaacgaggaggaggaggtggtgccccccagaccccccctgcccagaagctacgacttcaccgagcagccccccatcatcccccccctgcccagcgacagcagcagcctgctgtgctacagcagaggccccgtgcacctgcccgaggagaagaagatgtaccaggtgcagggctaccccagaaacggcagccactgcggccccgactacagactgtacaagagcgagcccgagctgaccaccgtggccgaggtggacgagagcaacggcgaggagaagagcgagcccgtgagcgagatcgagaccagcgtggtgaagggcagccacttccccgtgggcgtggtgccccccagagccaagagccccacccccgagagcagcaccatcgccagctacgtgaccctgagaaagaccaagaagatgatggacctgagaaccgagagacccagaagcgccgtggagcagctgtgcctggccgagagcaccagacccagaatgaccgtggaggagcagatggagagaatcagaagacaccagcaggcctgcctgagagagaagaagaagggcctgaacgtgatcggcgccagcgaccagagccccctgcagagccccagcaacctgagagacaaccccttcagaaccacccagaccagaagaagagacgacaaggagctggacaccgccatcagagagaacgacgtgaagcccgaccacgagacccccgccaccgagatcgtgcagctgaaggagaccgagccccagaacgtggacttcagcaaggagctgaagaagaccgagaacatcagctacgagatgctgttcgagcccgagcccaacggcgtgaacagcgtggagatgatggactag

SEQ ID NO: 23224 - DNA, 3297 bp, Artificial Sequence
  Description of Artificial Sequence: Synthetic coding sequence
atgaccagcgaggagaagaaggagagacccatcagcatgatcaacgaggccagcaactacaacgtgaccagcgactacgccgtgcaccccatgagccccgtgggcagaaccagcagagccagcaagaaggtgcacaacttcggcaagagaagcaacagcatcaagagaaaccccaacgcccccgtggtgagaagaggctggctgtacaagcaggacagcaccggcatgaagctgtggaagaagagatggttcgtgctgagcgacctgtgcctgttctactacagagacgagaaggaggagggcatcctgggcagcatcctgctgcccagcttccagatcgccctgctgaccagcgaggaccacatcaacagaaagtacgccttcaaggccgcccaccccaacatgagaacctactacttctgcaccgacaccggcaaggagatggagctgtggatgaaggccatgctggacgccgccctggtgcagaccgagcccgtgaagagagtggacaagatcaccagcgagaacgcccccaccaaggagaccaacaacatccccaaccacagagtgctgatcaagcccgagatccagaacaaccagaagaacaaggagatgagcaagatcgaggagaagaaggccctggaggccgagaagtacggcttccagaaggacggccaggacagacccctgaccaagatcaacagcgtgaagctgaacagcctgcccagcgagtacgagagcggcagcgcctgccccgcccagaccgtgcactacagacccatcaacctgagcagcagcgagaacaagatcgtgaacgtgagcctggccgacctgagaggcggcaacagacccaacaccggccccctgtacaccgaggccgacagagtgatccagagaaccaacagcatgcagcagctggagcagtggatcaagatccagaagggcagaggccacgaggaggagaccagaggcgtgatcagctaccagaccctgcccagaaacatgcccagccacagagcccagatcatggccagataccccgagggctacagaaccctgcccagaaacagcaagaccagacccgagagcatctgcagcgtgacccccagcacccacgacaagaccctgggccccggcgccgaggagaagagaagaagcatgagagacgacaccatgtggcagctgtacgagtggcagcagagacagttctacaacaagcagagcaccctgcccagacacagcaccctgagcagccccaagaccatggtgaacatcagcgaccagaccatgcacagcatccccaccagccccagccacggcagcatcgccgcctaccagggctacagcccccagagaacctacagaagcgaggtgagcagccccatccagagaggcgacgtgaccatcgacagaagacacagagcccaccaccccaagcacgtgtacgtgcccgacagaagaagcgtgcccgccggcctgaccctgcagagcgtgagcccccagagcctgcagggcaagaccatgaaggagaacgagcccatcatcaccatggtgcacaccatgatcgagaacagcgccctgagaccccagctgtaccagcagctgagccaggacgagggcagaggcaccctgtacaagtacagacccgaggaggtggacatcgacgccaagctgagcagactgtgcgagcaggacaaggtggtgcacgccctggaggagaagctgcagcagctgcacaaggagaagtacaccctggagcaggccctgctgagcgccagccaggagatcgagatgcacgccgacaaccccgccgccatccagaccgtggtgctgcagagagacgacctgcagaacggcctgctgagcacctgcagagagctgagcagagccaccgccgagctggagagagcctggagagagtacgacaagctggagtacgacgtgaccgtgaccagaaaccagatgcaggagcagctggaccacctgggcgaggtgcagaccgagagcgccggcatccagagagcccagatccagaaggagctgtggagaatccaggacgtgatggagggcctgagcaagcacaagcagcagagaggcaccaccgagatcggcatgatcggcagcaagcccttcagcaccgtgaagtacaagaacgaggaggaggaggtggtgccccccagaccccccctgcccagaagctacgacttcaccgagcagccccccatcatcccccccctgcccagcgacagcagcagcctgctgtgctacagcagaggccccgtgcacctgcccgaggagaagaagatgtaccaggtgcagggctaccccagaaacggcagccactgcggccccgactacagactgtacaagagcgagcccgagctgaccaccgtggccgaggtggacgagagcaacggcgaggagaagagcgagcccgtgagcgagatcgagaccagcgtggtgaagggcagccacttccccgtgggcgtggtgccccccagagccaagagccccacccccgagagcagcaccatcgccagctacgtgaccctgagaaagaccaagaagatgatggacctgagaaccgagagacccagaagcgccgtggagcagctgtgcctggccgagagcaccagacccagaatgaccgtggaggagcagatggagagaatcagaagacaccagcaggcctgcctgagagagaagaagaagggcctgaacgtgatcggcgccagcgaccagagccccctgcagagccccagcaacctgagagacaaccccttcagaaccacccagaccagaagaagagacgacaaggagctggacaccgccatcagagagaacgacgtgaagcccgaccacgagacccccgccaccgagatcgtgcagctgaaggagaccgagccccagaacgtggacttcagcaaggagctgaagaagaccgagaacatcagctacgagatgctgttcgagcccgagcccaacggcgtgaacagcgtggagatgatggacaaggagagaaacaaggacaagatgcccgaggacgtgaccttcagcccccaggacgagacccagaccgccaaccacaagcccgaggagcaccccgaggagaacaccaagaacagcgtggacgagcaggaggagaccgtgatcagctacgagagcacccccgaggtgagcagaggcaaccagaccatggccgtgaagagcctgagccccagccccgagagcagcgccagccccgtgcccagcacccagccccagctgaccgagggcagccacttcatgtgcgtgtag

SEQ ID NO: 23225 - DNA, 3147 bp, Artificial Sequence
  Description of Artificial Sequence: Synthetic coding sequence
atgagcaacaagaccggcggcaagagacccgccaccaccaacagcgacatccccaaccacaacatggtgagcgaggtgccccccgagagacccagcgtgagagccaccagaaccgccagaaaggccgtggccttcggcaagagaagccacagcatgaagagaaaccccaacgcccccgtgaccaaggccggctggctgttcaagcaggccagcagcggcgtgaagcagtggaacaagagatggttcgtgctggtggacagatgcctgttctactacaaggacgagaaggaggagagcatcctgggcagcatccccctgctgagcttcagagtggccgccgtgcagcccagcgacaacatcagcagaaagcacaccttcaaggccgagcacgccggcgtgagaacctacttcttcagcgccgagagccccgaggagcaggaggcctggatccaggccatgggcgaggccgccagagtgcagatcccccccgcccagaagagcgtgccccaggccgtgagacacagccacgagaagcccgacagcgagaacgtgccccccagcaagcaccaccagcagcccccccacaacagcctgcccaagcccgagcccgaggccaagaccagaggcgagggcgacggcagaggctgcgagaaggccgagagaagacccgagagacccgaggtgaagaaggagccccccgtgaaggccaacggcctgcccgccggccccgagcccgccagcgagcccggcagcccctaccccgagggccccagagtgcccggcggcggcgagcagcccgcccagcccaacggctggcagtaccacagccccagcagacccggcagcaccgccttccccagccaggacggcgagaccggcggccacagaagaagcttcccccccagaaccaaccccgacaagatcgcccagagaaagagcagcatgaaccagctgcagcagtgggtgaacctgagaagaggcgtgcccccccccgaggacctgagaagccccagcagattctaccccgtgagcagaagagtgcccgagtactacggcccctacagcagccagtaccccgacgactaccagtactacccccccggcgtgagacccgagagcatctgcagcatgcccgcctacgacagaatcagccccccctgggccctggaggacaagagacacgccttcagaaacggcggcggccccgcctaccagctgagagagtggaaggagcccgccagctacggcagacaggacgccaccgtgtggatccccagccccagcagacagcccgtgtactacgacgagctggacgccgccagcagcagcctgagaagactgagcctgcagcccagaagccacagcgtgcccagaagccccagccagggcagctacagcagagccagaatctacagccccgtgagaagccccagcgccagattcgagagactgccccccagaagcgaggacatctacgccgaccccgccgcctacgtgatgagaagaagcatcagcagccccaaggtgcccccctaccccgaggtgttcagagacagcctgcacacctacaagctgaacgagcaggacaccgacaagctgctgggcaagctgtgcgagcagaacaaggtggtgagagagcaggacagactggtgcagcagctgagagccgagaaggagagcctggagagcgccctgatgggcacccaccaggagctggagatgttcggcagccagcccgcctaccccgagaagctgagacacaagaaggacagcctgcagaaccagctgatcaacatcagagtggagctgagccaggccaccaccgccctgaccaacagcaccatcgagtacgagcacctggagagcgaggtgagcgccctgcacgacgacctgtgggagcagctgaacctggacacccagaacgaggtgctgaacagacagatccagaaggagatctggagaatccaggacgtgatggagggcctgagaaagaacaaccccagcagaggcaccgacaccgccaagcacagaggcggcctgggccccagcgccacctacagcagcaacagccccgccagccccctgagcagcgccagcctgaccagccccctgagccccttcagcctggtgagcggcagccagggcagccccaccaagcccggcagcaacgagcccaaggccaactacgagcagagcaagaaggacccccaccagaccctgcccctggacacccccagagacatcagcctggtgcccaccagacaggaggtggaggccgagaagcaggccgccctgaacaaggtgggcgtggtgccccccagaaccaagagccccaccgacgacgaggtgacccccagcgccgtggtgagaagaaacgccagcggcctgaccaacggcctgagcagccaggagagacccaagagcgccgtgttccccggcgagggcaaggtgaagatgagcgtggaggagcagatcgacagaatgagaagacaccagagcggcagcatgagagagaagagaagaagcctgcagctgcccgccagccccgcccccgaccccagccccagacccgcctacaaggtggtgagaagacacagaagcatccacgaggtggacatcagcaacctggaggccgccctgagagccgaggagcccggcggccacgcctacgagacccccagagaggagatcgccagactgagaaagatggagctggagccccagcactacgacgtggacatcaacaaggagctgagcacccccgacaaggtgctgatccccgagagatacatcgacctggagcccgacacccccctgagccccgaggagctgaaggagaagcagaagaaggtggagagaatcaagaccctgatcgccaagagcagcatgcagaacgtggtgcccatcggcgagggcgacagcgtggacgtgccccaggacagcgagagccagctgcaggagcaggagaagagaatcgagatcagctgcgccctggccaccgaggccagcagaagaggcagaatgctgagcgtgcagtgcgccacccccagcccccccaccagccccgccagccccgccccccccgccaaccccctgagcagcgagagccccagaggcgccgacagcagctacaccatgagagtgtag

SEQ ID NO: 23226 - DNA, 321 bp, Artificial Sequence
  Description of Artificial Sequence: Synthetic coding sequence
agagccagaatctacagccccgtgagaagccccagcgccagattcgagagactgccccccagaagcgaggacatctacgccgaccccgccgcctacgtgatgagaagaagcatcagcagccccaagtacgactacctgggcgacagaagacccgtgcccgccggcctgttcccctacaactacccccccagccccaccgtgcacgacaagatggtgcccccctaccccgaggtgttcagagacagcctgcacacctacaagctgaacgagcaggacaccgacaagctgctgggcaagctgtgcgagcagaacaaggtgtag

SEQ ID NO: 23227 - DNA, 3207 bp, Artificial Sequence
  Description of Artificial Sequence: Synthetic coding sequence
atgagcaacaagaccggcggcaagagacccgccaccaccaacagcgacatccccaaccacaacatggtgagcgaggtgccccccgagagacccagcgtgagagccaccagaaccgccagaaaggccgtggccttcggcaagagaagccacagcatgaagagaaaccccaacgcccccgtgaccaaggccggctggctgttcaagcaggccagcagcggcgtgaagcagtggaacaagagatggttcgtgctggtggacagatgcctgttctactacaaggacgagaaggaggagagcatcctgggcagcatccccctgctgagcttcagagtggccgccgtgcagcccagcgacaacatcagcagaaagcacaccttcaaggtgaccgtgtgctgggtggacgaggccgaggccagcagcaccagatgcctgagcccccaggccgagcacgccggcgtgagaacctacttcttcagcgccgagagccccgaggagcaggaggcctggatccaggccatgggcgaggccgccagagtgcagatcccccccgcccagaagagcgtgccccaggccgtgagacacagccacgagaagcccgacagcgagaacgtgccccccagcaagcaccaccagcagcccccccacaacagcctgcccaagcccgagcccgaggccaagaccagaggcgagggcgacggcagaggctgcgagaaggccgagagaagacccgagagacccgaggtgaagaaggagccccccgtgaaggccaacggcctgcccgccggccccgagcccgccagcgagcccggcagcccctaccccgagggccccagagtgcccggcggcggcgagcagcccgcccagcccaacggctggcagtaccacagccccagcagacccggcagcaccgccttccccagccaggacggcgagaccggcggccacagaagaagcttcccccccagaaccaaccccgacaagatcgcccagagaaagagcagcatgaaccagctgcagcagtgggtgaacctgagaagaggcgtgcccccccccgaggacctgagaagccccagcagattctaccccgtgagcagaagagtgcccgagtactacggcccctacagcagccagtaccccgacgactaccagtactacccccccggcgtgagacccgagagcatctgcagcatgcccgcctacgacagaatcagccccccctgggccctggaggacaagagacacgccttcagaaacggcggcggccccgcctaccagctgagagagtggaaggagcccgccagctacggcagacaggacgccaccgtgtggatccccagccccagcagacagcccgtgtactacgacgagctggacgccgccagcagcagcctgagaagactgagcctgcagcccagaagccacagcgtgcccagaagccccagccagggcagctacagcagagccagaatctacagccccgtgagaagccccagcgccagattcgagagactgccccccagaagcgaggacatctacgccgaccccgccgcctacgtgatgagaagaagcatcagcagccccaaggtgcccccctaccccgaggtgttcagagacagcctgcacacctacaagctgaacgagcaggacaccgacaagctgctgggcaagctgtgcgagcagaacaaggtggtgagagagcaggacagactggtgcagcagctgagagccgagaaggagagcctggagagcgccctgatgggcacccaccaggagctggagatgttcggcagccagcccgcctaccccgagaagctgagacacaagaaggacagcctgcagaaccagctgatcaacatcagagtggagctgagccaggccaccaccgccctgaccaacagcaccatcgagtacgagcacctggagagcgaggtgagcgccctgcacgacgacctgtgggagcagctgaacctggacacccagaacgaggtgctgaacagacagatccagaaggagatctggagaatccaggacgtgatggagggcctgagaaagaacaaccccagcagaggcaccgacaccgccaagcacagaggcggcctgggccccagcgccacctacagcagcaacagccccgccagccccctgagcagcgccagcctgaccagccccctgagccccttcagcctggtgagcggcagccagggcagccccaccaagcccggcagcaacgagcccaaggccaactacgagcagagcaagaaggacccccaccagaccctgcccctggacacccccagagacatcagcctggtgcccaccagacaggaggtggaggccgagaagcaggccgccctgaacaaggtgggcgtggtgccccccagaaccaagagccccaccgacgacgaggtgacccccagcgccgtggtgagaagaaacgccagcggcctgaccaacggcctgagcagccaggagagacccaagagcgccgtgttccccggcgagggcaaggtgaagatgagcgtggaggagcagatcgacagaatgagaagacaccagagcggcagcatgagagagaagagaagaagcctgcagctgcccgccagccccgcccccgaccccagccccagacccgcctacaaggtggtgagaagacacagaagcatccacgaggtggacatcagcaacctggaggccgccctgagagccgaggagcccggcggccacgcctacgagacccccagagaggagatcgccagactgagaaagatggagctggagccccagcactacgacgtggacatcaacaaggagctgagcacccccgacaaggtgctgatccccgagagatacatcgacctggagcccgacacccccctgagccccgaggagctgaaggagaagcagaagaaggtggagagaatcaagaccctgatcgccaagagcagcatgcagaacgtggtgcccatcggcgagggcgacagcgtggacgtgccccaggacagcgagagccagctgcaggagcaggagaagagaatcgagatcagctgcgccctggccaccgaggccagcagaagaggcagaatgctgagcgtgcagtgcgccacccccagcccccccaccagccccgccagccccgccccccccgccaaccccctgagcagcgagagccccagaggcgccgacagcagctacaccatgagagtgtag

SEQ ID NO: 23228 - DNA, 315 bp, Artificial Sequence
  Description of Artificial Sequence: Synthetic coding sequence
agagccagaatctacagccccgtgagaagccccagcgccagattcgagagactgccccccagaagcgaggacatctacgccgaccccgccgcctacgtgatgagaagaagcatcagcagccccaagatgagcgagagcgagaccctgatcagcatggtgaacagaatggtggagaacagcagccccagaagccagctgttcatgcaggtgcccccctaccccgaggtgttcagagacagcctgcacacctacaagctgaacgagcaggacaccgacaagctgctgggcaagctgtgcgagcagaacaaggtgtag

SEQ ID NO: 23229 - DNA, 456 bp, Artificial Sequence
  Description of Artificial Sequence: Synthetic coding sequence
agagccagaatctacagccccgtgagaagccccagcgccagattcgagagactgccccccagaagcgaggacatctacgccgaccccgccgcctacgtgatgagaagaagcatcagcagccccaagtacgactacctgggcgacagaagacccgtgcccgccggcctgttcccctacaactacccccccagccccaccgtgcacgacaagatggacgagctgctggacctgcagctgcagagaaacctggagtacctggaccagcagatgagcgagagcgagaccctgatcagcatggtgaacagaatggtggagaacagcagccccagaagccagctgttcatgcaggtgcccccctaccccgaggtgttcagagacagcctgcacacctacaagctgaacgagcaggacaccgacaagctgctgggcaagctgtgcgagcagaacaaggtgtag

SEQ ID NO: 23230 - DNA, 375 bp, Artificial Sequence
  Description of Artificial Sequence: Synthetic coding sequence
agagccagaatctacagccccgtgagaagccccagcgccagattcgagagactgccccccagaagcgaggacatctacgccgaccccgccgcctacgtgatgagaagaagcatcagcagccccaagtacgactacctgggcgacagaagacccgtgcccgccggcctgttcccctacaactacccccccagccccaccgtgcacgacaagatggacgagctgctggacctgcagctgcagagaaacctggagtacctggaccagcaggtgcccccctaccccgaggtgttcagagacagcctgcacacctacaagctgaacgagcaggacaccgacaagctgctgggcaagctgtgcgagcagaacaaggtgtag

SEQ ID NO: 23231 - DNA, 252 bp, Artificial Sequence
  Description of Artificial Sequence: Synthetic coding sequence
agagccagaatctacagccccgtgagaagccccagcgccagattcgagagactgccccccagaagcgaggacatctacgccgaccccgccgcctacgtgatgagaagaagcatcagcagccccaagtacgactacctgggcgacagaagacccgtgcccgccggcctgttcccctacaactacccccccagccccaccgtgcacgacaagatgaagctgctgggcaagctgtgcgagcagaacaaggtgtag

SEQ ID NO: 23232 - DNA, 402 bp, Artificial Sequence
  Description of Artificial Sequence: Synthetic coding sequence
agagccagaatctacagccccgtgagaagccccagcgccagattcgagagactgccccccagaagcgaggacatctacgccgaccccgccgcctacgtgatgagaagaagcatcagcagccccaagtacgactacctgggcgacagaagacccgtgcccgccggcctgttcccctacaactacccccccagccccaccgtgcacgacaagatgatgagcgagagcgagaccctgatcagcatggtgaacagaatggtggagaacagcagccccagaagccagctgttcatgcaggtgcccccctaccccgaggtgttcagagacagcctgcacacctacaagctgaacgagcaggacaccgacaagctgctgggcaagctgtgcgagcagaacaaggtgtag

SEQ ID NO: 23233 - DNA, 1386 bp, Artificial Sequence
  Description of Artificial Sequence: Synthetic coding sequence
atgaacaacttcggcaacgaggagttcgactgccacttcctggacgagggcttcaccgccaaggacatcctggaccagaagatcaacgaggtgagcagcagcgacgacaaggacgccttctacgtggccgacctgggcgacatcctgaagaagcacctgagatggctgaaggccctgcccagagtgacccccttctacgccgtgaagtgcaacgacagcaaggccatcgtgaagaccctggccgccaccggcaccggcttcgactgcgccagcaagaccgagatccagctggtgcagagcctgggcgtgccccccgagagaatcatctacgccaacccctgcaagcaggtgagccagatcaagtacgccgccaacaacggcgtgcagatgatgaccttcgacagcgaggtggagctgatgaaggtggccagagcccaccccaaggccaagctggtgctgagaatcgccaccgacgacagcaaggccgtgtgcagactgagcgtgaagttcggcgccaccctgagaaccagcagactgctgctggagagagccaaggagctgaacatcgacgtggtgggcgtgagcttccacgtgggcagcggctgcaccgaccccgagaccttcgtgcaggccatcagcgacgccagatgcgtgttcgacatgggcgccgaggtgggcttcagcatgtacctgctggacatcggcggcggcttccccggcagcgaggacgtgaagctgaagttcgaggagatcaccggcgtgatcaaccccgccctggacaagtacttccccagcgacagcggcgtgagaatcatcgccgagcccggcagatactacgtggccagcgccttcaccctggccgtgaacatcatcgccaagaagatcgtgctgaaggagcagaccggcagcgacgacgaggacgagagcagcgagcagaccttcatgtactacgtgaacgacggcgtgtacggcagcttcaactgcatcctgtacgaccacgcccacgtgaagcccctgctgcagaagagacccaagcccgacgagaagtactacagcagcagcatctggggccccacctgcgacggcctggacagaatcgtggagagatgcgacctgcccgagatgcacgtgggcgactggatgctgttcgagaacatgggcgcctacaccgtggccgccgccagcaccttcaacggcttccagagacccaccatctactacgtgatgagcggccccgcctggcagctgatgcagcagttccagaaccccgacttcccccccgaggtggaggagcaggacgccagcaccctgcccgtgagctgcgcctgggagagcggcatgaagagacacagagccgcctgcgccagcgccagcatcaacgtgtag

SEQ ID NO: 23234 - DNA, 930 bp, Artificial Sequence
  Description of Artificial Sequence: Synthetic coding sequence
atggccttcgtgaagagcggctggctgctgagacagagcaccatcctgaagagatggaagaagaactggttcgacctgtggagcgacggccacctgatctactacgacgaccagaccagacagaacatcgaggacaaggtgcacatgcccatggactgcatcaacatcagaaccggccaggagtgcagagacacccagccccccgacggcaagagcaaggactgcatgctgcagatcgtgtgcagagacggcaagaccatcagcctgtgcgccgagagcaccgacgactgcctggcctggaagttcaccctgcaggacagcagaaccaacaccgcctacgtgggcagcgccgtgatgaccgacgagaccagcgtggtgagcagcccccccccctacaccgcctacgccgcccccgcccccgaggagctgcacagcaagggccccaagatccacaccaccaccagcgccaagacccaggccgtgctgcccaccagatgcttcttccccagcgagagccccatcagaagaagcgtgcagatcagcgtgctgctgcccgccgtgaacatcagaagaagaatcaagctgaccttcccccagcccgccagacccagagcccccagaagcctgtgcctgtggcagacctggttcgccggcaagagagcccccagcctgcccaccgccgccaccgcccccgccctgcccagctgccccagcccccccgcccccagccaggccctgccccccagcctggccggctggagaagccccagcagcgcccccctgccccccgagcaggccctggcccccagaagcttccagctgagcaagcaccaggccagacccagaccccacagacccggcaccccccccgtgcccgcctggcccggcgtgcccccccccccccccgccagaccccccgccctgagatag

SEQ ID NO: 23235 - DNA, 669 bp, Artificial Sequence
  Description of Artificial Sequence: Synthetic coding sequence
atggccttcgtgaagagcggctggctgctgagacagagcaccatcctgaagagatggaagaagaactggttcgacctgtggagcgacggccacctgatctactacgacgaccagaccagacagaacatcgaggacaaggtgcacatgcccatggactgcatcaacatcagaaccggccaggagtgcagagacacccagccccccgacggcaagagcaaggactgcatgctgcagatcgtgtgcagagacggcaagaccatcagcctgtgcgccgagagcaccgacgactgcctggcctggaagttcaccctgcaggacagcagaaccaacaccgcctacgtgggcagcgccgtgatgaccgacgagaccagcgtggtgagcagcccccccccctacaccgcctacgccgcccccgcccccgagcaggcctacggctacggcccctacggcggcgcctacccccccggcacccaggtggtgtacgccgccaacggccaggcctacgccgtgccctaccagtacccctacgccggcctgtacggccagcagcccgccaaccaggtgatcatcagagagagatacagagacaacgacagcgacctggccctgggcatgctggccggcgccgccaccggcatggccctgggcagcctgttctgggtgttctag

SEQ ID NO: 23236 - DNA, 930 bp, Artificial Sequence; identical to SEQ ID NO: 23234
  Description of Artificial Sequence: Synthetic coding sequence

SEQ ID NO: 23237 - DNA, 669 bp, Artificial Sequence; identical to SEQ ID NO: 23235
  Description of Artificial Sequence: Synthetic coding sequence

SEQ ID NO: 23238 - DNA, 669 bp, Artificial Sequence; identical to SEQ ID NO: 23235
  Description of Artificial Sequence: Synthetic coding sequence

SEQ ID NO: 23239 - DNA, 537 bp, Artificial Sequence
  Description of Artificial Sequence: Synthetic coding sequence
atggccttcgtgaagagcggctggctgctgagacagagcaccatcctgaagagatggaagaagaactggttcgacctgtggagcgacggccacctgatctactacgacgaccagaccagacagaacatcgaggacaaggtgcacatgcccatggactgcatcaacatcagaaccggccaggagtgcagagacacccagccccccgacggcaagagcaaggactgcatgctgcagatcgtgtgcagagacggcaagaccatcagcctgtgcgccgagagcaccgacgactgcctggcctggaagttcaccctgcaggacagcagaaccaacaccgcctacgtgggcagcgccgtgatgaccgacgagaccagcgtggtgagcagcccccccccctacaccgcctacgccgcccccgcccccgaggacttcatggacagcagcctgctgaccaagagcagcttcgagagcgccatcgagaccaccaccgccacctggcactgggcctgctggcaggagcagcccagagcctggccctag

SEQ ID NO: 23240 - DNA, 513 bp, Artificial Sequence
  Description of Artificial Sequence: Synthetic coding sequence
atggccttcgtgaagagcggctggctgctgagacagagcaccatcctgaagagatggaagaagaactggttcgacctgtggagcgacggccacctgatctactacgacgaccagaccagacagaacatcgaggacaaggtgcacatgcccatggactgcatcaacatcagaaccggccaggagtgcagagacacccagccccccgacggcaagagcaaggactgcatgctgcagatcgtgtgcagagacggcaagaccatcagcctgtgcgccgagagcaccgacgactgcctgctgatggccatgggccacaccgtggtgagaaccagacaggagctgaagctgagcaccctgagaatgggcagaagaatgccctgccccaccagcacccacatgcaggacttcatggacagcagcctgctgaccaagagcagcttcgagagcgccatcgagaccaccaccgccacctggcactgggcctgctggcaggagcagcccagagcctggccctag

SEQ ID NO: 23241 - DNA, 525 bp, Artificial Sequence
  Description of Artificial Sequence: Synthetic coding sequence
atgcccatggactgcatcaacatcagaaccggccaggagtgcagagacacccagccccccgacggcaagagcaaggactgcatgctgcagatcgtgtgcagagacggcaagaccatcagcctgtgcgccgagagcaccgacgactgcctggcctggaagttcaccctgcaggacagcagaaccaacaccgcctacgtgggcagcgccgtgatgaccgacgagaccagcgtggtgagcagcccccccccctacaccgcctacgccgcccccgcccccgagcaggcctacggctacggcccctacggcggcgcctacccccccggcacccaggtggtgtacgccgccaacggccaggcctacgccgtgccctaccagtacccctacgccggcctgtacggccagcagcccgccaaccaggtgatcatcagagagagatacagagacaacgacagcgacctggccctgggcatgctggccggcgccgccaccggcatggccctgggcagcctgttctgggtgttctag

SEQ ID NO: 23242 - DNA, 1521 bp, Artificial Sequence
  Description of Artificial Sequence: Synthetic coding sequence
atgttcaccagcaagagcaacagcgtgagccccagccccagcctggagcaggccgacagcgacgccctggacatcagcaccaaggtgcagctgtacggcgtgctgtggaagagacccttcggcagacccagcgccaagtggagcagaagattcttcatcatcaaggagagcttcctgctgtactacagcgagagcgagaagaagagcttcgagaccaacaagtacttcaacatccaccccaagggcgtgatccccctgggcggctgcctggtggagcccaaggaggagcccagcatgccctacgccatgaagatcagccaccaggacttccacggcaacatcctgctggccgccgagagcgagttcgagcagacccagtggctggagatgctgcaggagagcggcaaggtgacctggaagaacgcccagctgggcgaggccatgatcaagagcctggaggcccagggcctgcagctggccaaggagaagcaggagtacctggacaagctgatggaggagaccgaggagctgtgcctgcagagagagcagagagaggagctggagagactgaaccaggtgctggaggccgagaagcagcagttcgaggaggtggtgcaggagctgagaatggagcaggagcagatcaagagagagctggagctgaccgccagatgcctgaagggcgtggagcaggagaagaaggagctgagacacctgaccgagagcctgcagcagaccctggaggagctgagcatcgagaagaagaagaccctggagatgctggaggagaacgagaaccacctgcagaccctggccaaccagagcgagcagcccccccccagcggcggcctgcacagcaacctgagacagatcgaggagaagatgcagcagctgctggaggagaagctgctggccgagaagagaatgaaggagaacgaggagagaagcagagccctggaggaggagagagagttctacagcagccagagccaggccctgcagaacagcctgcaggagctgaccgccgagaagcagcaggccgagagagagctgaaggccgaggtgaaggtgagaatggacctggagagaagactgagagaggccgagggcgccctgagaagcctggagcagggcctgaacagcaaggtgagaaacaaggagaaggaggagagaatgagagccgacgtgagccacctgaagagattcttcgaggagtgcatcagaaacgccgagctggaggccaagatgcccgtgatcatgaagaacagcgtgtacatccacaaggccgccaccagaagaatcaagagctgcagattccacagaagaagaagcagcaccagctggaacgacatgaagcccagccagagcttcatgaccagccagctggacgccaacaacatggaggagctgaaggaggtggccaagagactgagcagagaccagagattcagagagagcatctaccacatcatggccacccagcccggcgcccccagcgccctgagcagaggcggcaagtag

SEQ ID NO: 23243 - DNA, 4158 bp, Artificial Sequence
  Description of Artificial Sequence: Synthetic coding sequence
atggagctgagcgacagcgacagacccgtgagcttcggcagcaccagcagcagcgccagcagcagagacagccacggcagcttcggcagcagaatgaccctggtgagcaacagccacatgggcctgttcaaccaggacaaggaggtgggcgccatcaagctggagctgatccccgccagacccttcagcagcagcgagctgcagagagacaaccccgccaccggccagcagaacgccgacgagggcagcgagagaccccccagagcccagtggagagtggacagcaacggcgcccccaagaccatcgccgacagcgccaccagccccaagctgctgtacgtggacagagtggtgcaggagatcctggagaccgagagaacctacgtgcaggacctgaagagcatcgtggaggactacctggactgcatcagagaccagaccaagctgcccctgggcaccgaggagagaagcgccctgttcggcaacatccaggacatctaccacttcaacagcgagctgctgcaggacctggagaactgcgagaacgaccccgtggccatcgccgagtgcttcgtgagcaagagcgaggagttccacatctacacccagtactgcaccaactaccccagaagcgtggccgtgctgaccgagtgcatgagaaacaagatcctggccaagttcttcagagagagacaggagaccctgaagcacagcctgcccctgggcagctacctgctgaagcccgtgcagagaatcctgaagtaccacctgctgctgcacgagatcgagaaccacctggacaaggacaccgagggctacgacgtggtgctggacgccatcgacaccatgcagagagtggcctggcacatcaacgacatgaagagaaagcacgagcacgccgtgagactgcaggagatccagagcctgctgaccaactggaagggccccgacctgaccagctacggcgagctggtgctggagggcaccttcagaatccagagagccaagaacgagagaaccctgttcctgttcgacaagctgctgctgatcaccaagaagagagacgacaccttcacctacaaggcccacatcctgtgcggcaacctgatgctggtggaggtgatccccaaggagcccctgagcttcagcgtgttccactacaagaaccccaagctgcagcacaccgtgcaggccaagagccagcaggacaagagactgtgggtgctgcacctgaagagactgatcctggagaaccacgccgccaagatccccgccaaggccaagcaggccatcctggagatggacgccatccaccaccccggcttctgctacagccccgagggcggcaccaaggccctgttcggcagcaaggagggcagcgccccctacagactgagaagaaagagcgagcccagcagcagaagccacaaggtgctgaagaccagcgagaccgcccaggacatccagaaggtgagcagagaggagggcagcccccagctgagcagcgccagacccagccccgcccagagaaacagccagcccagcagcagcaccatgatcagcgtgctgagagccggcggcgccctgagaaacatctggaccgaccaccagatcagacaggccctgttccccagcagaagaagcccccaggagaacgaggacgacgaggacgactaccagatgttcgtgcccagcttcagcagcagcgacctgaacagcaccagactgtgcgaggacagcaccagcagcagaccctgcagctggcacatgggccagatggagagcaccgagaccagcagcagcggccacagaatcgtgagaagagccagcagcgccggcgagagcaacacctgcccccccgagatcggcaccagcgacagaaccagagagctgcagaacagccccaagaccgagggccaggaggagatgacccccttcggcagcagcatcgagctgaccatcgacgacatcgaccacgtgtacgacaacatcagctacgaggacctgaagctgatggtggccaagagagaggaggccgagagcacccccagcaagagcgccagagacagcgtgagacccaagagcacccccgagctggccttcaccaagagacaggccggccacagcaagggcagcctgtacgcccagaccgacggcaccctgagcggcggcgaggccagcagccagagcacccacgagctgcaggccgtggaggagaacatctacgacaccatcggcctgcccgacccccccagcctgggcttcaagtgcagcagcctgaagagagccaagagaagcaccttcctgggcctggaggccgacttcgtgtgctgcgacagcctgagacccttcgtgagccaggacagcctgcagctgagcgaggacgaggccccctaccaccaggccacccccgaccacggctacctgagcctgctgtacgacagccccagcggcaacctgagcatgccccacaagcccgtgagcgacaagctgagcgaggaggtggacgagatctggaacgacctggagaactacatcaagaagaacgaggacaaggccagagacagactgctggccgccttccccgtgagcaaggacgacgtgcccgacagactgcacgccgagagcacccccgagctgagcagagacgtgggcagaagcgtgagcaccctgagcctgcccgagagccaggccctgctgacccccgtgaagagcagagccggcagagccagcagagccaactgccccttcgaggaggacctgatcagcaaggagggcagcttcatgagcctgaacagactgagcctggccagcgagatgcccctgatggacaacccctacgacctggccaacagcggcctgagccagaccgaccccgagaaccccgacctgggcatggaggccaccgacaagaccaagagcagagtgttcatgatggccagacagtacagccagaagatcaagaaggccaaccagctgctgaaggtgaagagcctggagctggagcagccccccgccagccagcaccagaagagcatgcacaaggacctggccgccatcctggaggagaagaagcagggcggccccgccatcggcgccagaatcgccgagtacagccagctgtacgaccagatcgtgttcagagagagccccctgaagatccagaaggacggctgggccagcccccaggagagcagcctgctgagaagcgtgagccccagccaggtgcaccacggcagcggcgactggctgctgcacagcacctacagcaacggcgagctggccgacttctgcctgccccccgagcaggacctgagaagcagataccccaccttcgagatcaacaccaagagcacccccagacagctgagcgccgcctgcagcgtgcccagcctgcagaccagcgaccccctgcccggcagcgtgcagagatgcagcgtggtggtgagccagcccaacaaggagaactggtgccaggaccacctgtacaacagcctgggcagaaagggcatcagcgccaagagccagccctaccacagaagccagagcagcagcagcgtgctgatcaacaagagcatggacagcatcaactaccccagcgacgtgggcaagcagcagctgctgagcctgcacagaagcagcagatgcgagagccaccaggacctgctgcccgacatcgccgacagccaccagcagggcaccgagaagctgagcgacctgaccctgcaggacagccagaaggtggtggtggtgaacagaaacctgcccctgaacgcccagatcgccacccagaactacttcagcaacttcaaggagaccgacggcgacgaggacgactacgtggagatcaagagcgaggaggacgagagcgagctggagctgagccacaacagaagaagaaagagcgacagcaagttcgtggacgccgacttcagcgacaacgtgtgcagcggcaacaccctgcacagcctgaacagccccagaacccccaagaagcccgtgaacagcaagctgggcctgagcccctacctgaccccctacaacgacagcgacaagctgaacgactacctgtggagaggccccagccccaaccagcagaacatcgtgcagagcctgagagagaagttccagtgcctgagcagcagcagcttcgcctag

SEQ ID NO: 23244 - DNA, 141 bp, Artificial Sequence
  Description of Artificial Sequence: Synthetic coding sequence
atggagctgagcgacagcgacagacccgtgagcttcggcagcaccagcagcagcgccagcagcagagacagccacggcagcttcggcagcagaatgaccctggtgagcaacagccacatgggcctgttcaaccaggactag

SEQ ID NO: 23245 - DNA, 4158 bp, Artificial Sequence; identical to SEQ ID NO: 23243
  Description of Artificial Sequence: Synthetic coding sequence

SEQ ID NO: 23246 - DNA, 2859 bp, Artificial Sequence
  Description of Artificial Sequence: Synthetic coding sequence
atggagctgagcgacagcgacagacccgtgagcttcggcagcaccagcagcagcgccagcagcagagacagccacggcagcttcggcagcagaatgaccctggtgagcaacagccacatgggcctgttcaaccaggacaaggaggtgggcgccatcaagctggagctgatccccgccagacccttcagcagcagcgagctgcagagagacaaccccgccaccggccagcagaacgccgacgagggcagcgagagaccccccagagcccagtggagagtggacagcaacggcgcccccaagaccatcgccgacagcgccaccagccccaagctgctgtacgtggacagagtggtgcaggagatcctggagaccgagagaacctacgtgcaggacctgaagagcatcgtggaggactacctggactgcatcagagaccagaccaagctgcccctgggcaccgaggagagaagcgccctgttcggcaacatccaggacatctaccacttcaacagcgagctgctgcaggacctggagaactgcgagaacgaccccgtggccatcgccgagtgcttcgtgagcaagagcgaggagttccacatctacacccagtactgcaccaactaccccagaagcgtggccgtgctgaccgagtgcatgagaaacaagatcctggccaagttcttcagagagagacaggagaccctgaagcacagcctgcccctgggcagctacctgctgaagcccgtgcagagaatcctgaagtaccacctgctgctgcacgagatcgagaaccacctggacaaggacaccgagggctacgacgtggtgctggacgccatcgacaccatgcagagagtggcctggcacatcaacgacatgaagagaaagcacgagcacgccgtgagactgcaggagatccagagcctgctgaccaactggaagggccccgacctgaccagctacggcgagctggtgctggagggcaccttcagaatccagagagccaagaacgagagaaccctgttcctgttcgacaagctgctgctgatcaccaagaagagagacgacaccttcacctacaaggcccacatcctgtgcggcaacctgatgctggtggaggtgatccccaaggagcccctgagcttcagcgtgttccactacaagaaccccaagctgcagcacaccgtgcaggccaagagccagcaggacaagagactgtgggtgctgcacctgaagagactgatcctggagaaccacgccgccaagatccccgccaaggccaagcaggccatcctggagatggacgccatccaccaccccggcttctgctacagccccgagggcggcaccaaggccctgttcggcagcaaggagggcagcgccccctacagactgagaagaaagagcgagcccagcagcagaagccacaaggtgctgaagaccagcgagaccgcccaggacatccagaaggtgagcagagaggagggcagcccccagctgagcagcgccagacccagccccgcccagagaaacagccagcccagcagcagcaccatgatcagcgtgctgagagccggcggcgccctgagaaacatctggaccgaccaccagatcagacaggccctgttccccagcagaagaagcccccaggagaacgaggacgacgaggacgactaccagatgttcgtgcccagcttcagcagcagcgacctgaacagcaccagactgtgcgaggacagcaccagcagcagaccctgcagctggcacatgggccagatggagagcaccgagaccagcagcagcggccacagaatcgtgagaagagccagcagcgccggcgagagcaacacctgcccccccgagatcggcaccagcgacagaaccagagagctgcagaacagccccaagaccgagggccaggaggagatgacccccttcggcagcagcatcgagctgaccatcgacgacatcgaccacgtgtacgacaacatcagctacgaggacctgaagctgatggtggccaagagagaggaggccgagagcacccccagcaagagcgccagagacagcgtgagacccaagagcacccccgagctggccttcaccaagagacaggccggccacagcaagggcagcctgtacgcccagaccgacggcaccctgagcggcggcgaggccagcagccagagcacccacgagctgcaggccgtggaggagaacatctacgacaccatcggcctgcccgacccccccagcctgggcttcaagtgcagcagcctgaagagagccaagagaagcaccttcctgggcctggaggccgacttcgtgtgctgcgacagcctgagacccttcgtgagccaggacagcctgcagctgagcgaggacgaggccccctaccaccaggccacccccgaccacggctacctgagcctgctgtacgacagccccagcggcaacctgagcatgccccacaagcccgtgagcgacaagctgagcgaggaggtggacgagatctggaacgacctggagaactacatcaagaagaacgaggacaaggccagagacagactgctggccgccttccccgtgagcaaggacgacgtgcccgacagactgcacgccgagagcacccccgagctgagcagagacgtgggcagaagcgtgagcaccctgagcctgcccgagagccaggccctgctgacccccgtgaagagcagagccggcagagccagcagagccaactgccccttcgaggaggacctgatcagcaaggagggcagcttcatgagcctgaacagactgagcctggccagcgagatgaccctgtgccaggccctgtgcagagacgccgcctggtag

SEQ ID NO: 23247 - DNA, 3492 bp, Artificial Sequence
  Description of Artificial Sequence: Synthetic coding sequence
atgcccgtgagcaccagcctgcaccaggacggcagccaggagagacccgtgagcctgaccagcaccaccagcagcagcggcagcagctgcgacagcagaagcgccatggaggagcccagcagcagcgaggcccccgccaagaacggcgccggcagcctgagaagcagacacctgcccaacagcaacaacaacagcagcagctggctgaacgtgaagggccccctgagccccttcaacagcagagccgccgccggccccgcccaccacaagctgagctacctgggcagagtggtgagagagatcgtggagaccgagagaatgtacgtgcaggacctgagaagcatcgtggagagccaggagttcgacatctacacccagtactgcaacaactaccccaacagcgtggccgccctgaccgagtgcatgagagacaagcagcaggccaagttcttcagagacagacaggagctgctgcagcacagcctgcccctgggcagctacctgctgaagcccgtgcagagaatcctgaagtaccacctgctgctgcaggagatcgccaagcacttcgacgaggaggaggacggcttcgaggtggtggaggacgccatcgacaccatgacctgcgtggcctggtacatcaacgacatgaagagaagacacgagcacgccgtgagactgcaggagatccagagcctgctgatcaactggaagggccccgacctgaccacctacggcgagctggtgctggagggcaccttcagagtgcacagagtgagaaacgagagaaccttcttcctgttcgacaagaccctgctgatcaccaagaagagaggcgaccacttcgtgtacaagggcaacatcccctgcagcagcctgatgctgatcgagagcaccagagacagcctgtgcttcaccgtgacccactacaagcacagcaagcagcagtacagcatccaggccaagaccgtggaggagaagagaaactggacccaccacatcaagagactgatcctggagaaccaccacgccaccatcccccagaaggccaaggaggccatcctggagatggacagctactaccccaacagatacagatgcagccccgagagactgaagaaggcctggagcagccaggacgaggtgagcaccaacgtgagacagggcagaagacagagcgagcccaccaagcacctgctgagacagctgaacgagaaggccagagccgccggcatgaagggcaagggcagaagagagagcgagagcagcagaagcagcagaagacccagcggcagaagccccaccagcaccgagaagagaatgagcttcgagagcatcagcagcctgcccgaggtggagcccgaccccgaggccggcagcgagcaggaggtgttcagcgccgtggagggccccagcgccgaggagacccccagcgacaccgagagccccgaggtgctggagacccagctggacgcccaccagggcctgctgggcatggacccccccggcgacatggtggacttcgtggccgccgagagcaccgaggacctgaaggccctgagcagcgaggaggaggaggagatgggcggcgccgcccaggagcccgagagcctgctgccccccagcgtgctggaccaggccagcgtgatcgccgagagattcgtgagcagcttcagcagaagaagcagcgtggcccaggaggacagcaagagcagcggcttcggcagccccagactggtgagcagaagcagcagcgtgctgagcctggagggcagcgagaagggcctggccagacacggcagcgccaccgacagcctgagctgccagctgagccccgaggtggacatcagcgtgggcgtggccaccgaggacagccccagcgtgaacggcatggagccccccagccccggctgccccgtggagcccgacagaagcagctgcaagaagaaggagagcgccctgagcaccagagacagactgctgctggacaagatcaagagctactacgagaacgccgagcaccacgacgccggcttcagcgtgagaagaagagagagcctgagctacatccccaagggcctggtgagaaacagcatcagcagattcaacagcctgcccagacccgaccccgagcccgtgccccccgtgggcagcaagagacaggtgggcagcagacccaccagctgggccctgttcgagctgcccggccccagccaggccgtgaagggcgaccccccccccatcagcgacgccgagttcagacccagcagcgagatcgtgaagatctgggagggcatggagagcagcggcggcagccccggcaagggccccggccagggccaggccaacggcttcgacctgcacgagcccctgttcatcctggaggagcacgagctgggcgccatcaccgaggagagcgccaccgccagccccgagagcagcagccccaccgagggcagaagccccgcccacctggccagagagctgaaggagctggtgaaggagctgagcagcagcacccagggcgagctggtggcccccctgcaccccagaatcgtgcagctgagccacgtgatggacagccacgtgagcgagagagtgaagaacaaggtgtaccagctggccagacagtacagcctgagaatcaagagcaacaagcccgtgatggccagaccccccctgcagtgggagaaggtggcccccgagagagacggcaagagccccaccgtgccctgcctgcaggaggaggccggcgagcccctgggcggcaagggcaagagaaagcccgtgctgagcctgttcgactacgagcagctgatggcccaggagcacagcccccccaagcccagcagcgccggcgagatgagcccccagagattcttcttcaaccccagcgccgtgagccagagaaccaccagccccggcggcagacccagcgccagaagccccctgagccccaccgagaccttcagctggcccgacgtgagagagctgtgcagcaagtacgccagcagagacgaggccagaagagccggcggcggcagacccagaggcccccccgtgaacagaagccacagcgtgcccgagaacatggtggagccccccctgagcggcagagtgggcagatgcagaagcctgagcaccaagagaggcagaggcggcggcgaggccgcccagagccccggccccctgccccagagcaagcccgacggcggcgagaccctgtacgtgaccgccgacctgaccctggaggacaacagaagagtgatcgtgatggagaagggccccctgcccagccccaccgccggcctggaggagagcagcggccagggccccagcagccccgtggccctgctgggccaggtgcaggacttccagcagagcgccgagtgccagcccaaggaggagggcagcagagaccccgccgaccccagccagcagggcagagtgagaaacctgagagagaagttccaggccctgaacagcgtgggctag

SEQ ID NO: 23248 - DNA, 3660 bp, Artificial Sequence
  Description of Artificial Sequence: Synthetic coding sequence
atgcccgtgagcaccagcctgcaccaggacggcagccaggagagacccgtgagcctgaccagcaccaccagcagcagcggcagcagctgcgacagcagaagcgccatggaggagcccagcagcagcgaggcccccgccaagaacggcgccggcagcctgagaagcagacacctgcccaacagcaacaacaacagcagcagctggctgaacgtgaagggccccctgagccccttcaacagcagagccgccgccggccccgcccaccacaagctgagctacctgggcagagtggtgagagagatcgtggagaccgagagaatgtacgtgcaggacctgagaagcatcgtggaggactacctgctgaagatcatcgacacccccggcctgctgaagcccgagcaggtgagcgccctgttcggcaacatcgagaacatctacgccctgaacagccagctgctgagagacctggacagctgcaacagcgaccccgtggccgtggccagctgcttcgtggagagaagccaggagttcgacatctacacccagtactgcaacaactaccccaacagcgtggccgccctgaccgagtgcatgagagacaagcagcaggccaagttcttcagagacagacaggagctgctgcagcacagcctgcccctgggcagctacctgctgaagcccgtgcagagaatcctgaagtaccacctgctgctgcaggagatcgccaagcacttcgacgaggaggaggacggcttcgaggtggtggaggacgccatcgacaccatgacctgcgtggcctggtacatcaacgacatgaagagaagacacgagcacgccgtgagactgcaggagatccagagcctgctgatcaactggaagggccccgacctgaccacctacggcgagctggtgctggagggcaccttcagagtgcacagagtgagaaacgagagaaccttcttcctgttcgacaagaccctgctgatcaccaagaagagaggcgaccacttcgtgtacaagggcaacatcccctgcagcagcctgatgctgatcgagagcaccagagacagcctgtgcttcaccgtgacccactacaagcacagcaagcagcagtacagcatccaggccaagaccgtggaggagaagagaaactggacccaccacatcaagagactgatcctggagaaccaccacgccaccatcccccagaaggccaaggaggccatcctggagatggacagctactaccccaacagatacagatgcagccccgagagactgaagaaggcctggagcagccaggacgaggtgagcaccaacgtgagacagggcagaagacagagcgagcccaccaagcacctgctgagacagctgaacgagaaggccagagccgccggcatgaagggcaagggcagaagagagagcgagagcagcagaagcagcagaagacccagcggcagaagccccaccagcaccgagaagagaatgagcttcgagagcatcagcagcctgcccgaggtggagcccgaccccgaggccggcagcgagcaggaggtgttcagcgccgtggagggccccagcgccgaggagacccccagcgacaccgagagccccgaggtgctggagacccagctggacgcccaccagggcctgctgggcatggacccccccggcgacatggtggacttcgtggccgccgagagcaccgaggacctgaaggccctgagcagcgaggaggaggaggagatgggcggcgccgcccaggagcccgagagcctgctgccccccagcgtgctggaccaggccagcgtgatcgccgagagattcgtgagcagcttcagcagaagaagcagcgtggcccaggaggacagcaagagcagcggcttcggcagccccagactggtgagcagaagcagcagcgtgctgagcctggagggcagcgagaagggcctggccagacacggcagcgccaccgacagcctgagctgccagctgagccccgaggtggacatcagcgtgggcgtggccaccgaggacagccccagcgtgaacggcatggagccccccagccccggctgccccgtggagcccgacagaagcagctgcaagaagaaggagagcgccctgagcaccagagacagactgctgctggacaagatcaagagctactacgagaacgccgagcaccacgacgccggcttcagcgtgagaagaagagagagcctgagctacatccccaagggcctggtgagaaacagcatcagcagattcaacagcctgcccagacccgaccccgagcccgtgccccccgtgggcagcaagagacaggtgggcagcagacccaccagctgggccctgttcgagctgcccggccccagccaggccgtgaagggcgaccccccccccatcagcgacgccgagttcagacccagcagcgagatcgtgaagatctgggagggcatggagagcagcggcggcagccccggcaagggccccggccagggccaggccaacggcttcgacctgcacgagcccctgttcatcctggaggagcacgagctgggcgccatcaccgaggagagcgccaccgccagccccgagagcagcagccccaccgagggcagaagccccgcccacctggccagagagctgaaggagctggtgaaggagctgagcagcagcacccagggcgagctggtggcccccctgcaccccagaatcgtgcagctgagccacgtgatggacagccacgtgagcgagagagtgaagaacaaggtgtaccagctggccagacagtacagcctgagaatcaagagcaacaagcccgtgatggccagaccccccctgcagtgggagaaggtggcccccgagagagacggcaagagccccaccgtgccctgcctgcaggaggaggccggcgagcccctgggcggcaagggcaagagaaagcccgtgctgagcctgttcgactacgagcagctgatggcccaggagcacagcccccccaagcccagcagcgccggcgagatgagcccccagagattcttcttcaaccccagcgccgtgagccagagaaccaccagccccggcggcagacccagcgccagaagccccctgagccccaccgagaccttcagctggcccgacgtgagagagctgtgcagcaagtacgccagcagagacgaggccagaagagccggcggcggcagacccagaggcccccccgtgaacagaagccacagcgtgcccgagaacatggtggagccccccctgagcggcagagtgggcagatgcagaagcctgagcaccaagagaggcagaggcggcggcgaggccgcccagagccccggccccctgccccagagcaagcccgacggcggcgagaccctgtacgtgaccgccgacctgaccctggaggacaacagaagagtgatcgtgatggagaagggccccctgcccagccccaccgccggcctggaggagagcagcggccagggccccagcagccccgtggccctgctgggccaggtgcaggacttccagcagagcgccgagtgccagcccaaggaggagggcagcagagaccccgccgaccccagccagcagggcagagtgagaaacctgagagagaagttccaggccctgaacagcgtgggctag

SEQ ID NO: 23249 - DNA, 486 bp, Artificial Sequence
  Description of Artificial Sequence: Synthetic coding sequence
atgcccgtgagcaccagcctgcaccaggacggcagccaggagagacccgtgagcctgaccagcaccaccagcagcagcggcagcagctgcgacagcagaagcgccatggaggagcccagcagcagcgaggcccccgccaagaacggcgccggcagcctgagaagcagacacctgcccaacagcaacaacaacagcagcagctggctgaacgtgaagggccccctgagccccttcaacagcagagccgccgccggccccgcccaccacaagctgagctacctgggcagagtggtgagagagatcgtggagaccgagagaatgtacgtgcaggacctgagaagcatcgtggaggactacctgctgaagatcatcgacacccccggcctgctgaagcccgagcaggtgagcgccctgttcggcaacatcgagaacatctacgccctgaacagccagctgctgagagacctggacagctgcaacagctag

SEQ ID NO: 23250 - DNA, 567 bp, Artificial Sequence
  Description of Artificial Sequence: Synthetic coding sequence
atgcccgtgagcaccagcctgcaccaggacggcagccaggagagacccgtgagcctgaccagcaccaccagcagcagcggcagcagctgcgacagcagaagcgccatggaggagcccagcagcagcgaggcccccgccaagaacggcgccggcagcctgagaagcagacacctgcccaacagcaacaacaacagcagcagctggctgaacgtgaagggccccctgagccccttcaacagcagagccgccgccggccccgcccaccacaagctgagctacctgggcagagtggtgagagagatcgtggagaccgagagaatgtacgtgcaggacctgagaagcatcgtggaggactacctgctgaagatcatcgacacccccggcctgctgaagcccgagcaggtgagcgccctgttcggcaacatcgagaacatctacgccctgaacagccagctgctgagagacctggacagctgcaacagcgaccccgtggccgtggccagctgcttcgtggagagaagccaggagttcgacatctacacccagtactgcaacaactacccctag

SEQ ID NO: 23251 - DNA, 3816 bp, Artificial Sequence
  Description of Artificial Sequence: Synthetic coding sequence
atggaggccctgagaaaccccatgcccctgggcagcagcgaggaggccctgggcgacctggcctgcagcagcctgaccggcgccagcagagacctgggcaccggcgccgtggccagcggcacccaggaggagaccagcggccccagaggcgacccccagcagacccccagcctggagaaggagagacacacccccagcagaaccggccccggcgccgccggcagaaccctgcccagaagaagcagaagctgggagagagcccccagaagcagcagaggcgcccaggccgccgcctgccacaccagccaccacagcgccggcagcagacccggcggccacctgggcggccaggccgtgggcacccccaactgcgtgcccgtggagggccccggctgcaccaaggaggaggacgtgctggccagcagcgcctgcgtgagcaccgacggcggcagcctgcactgccacaaccccagcggccccagcgacgtgcccgccagacagccccaccccgagcaggagggctggccccccggcaccggcgacttccccagccaggtgcccaagcaggtgctggacgtgagccaggagctgctgcagagcggcgtggtgaccctgcccggcaccagagacagacacggcagagccgtggtgcaggtgagaaccagaagcctgctgtggaccagagagcacagcagctgcgccgagctgaccagactgctgctgtacttccacagcatccccagaaaggaggtgagagacctgggcctggtggtgctggtggacgccagaagaagccccgccgcccccgccgtgagccaggccctgagcggcctgcagaacaacaccagccccatcatccacagcatcctgctgctggtggacaaggagagcgccttcagacccgacaaggacgccatcatccagtgcgaggtggtgagcagcctgaaggccgtgcacaagttcgtggacagctgccagctgaccgccgacctggacggcagcttcccctacagccacggcgactggatctgcttcagacagagactggagcacttcgccgccaactgcgaggaggccatcatcttcctgcagaacagcttctgcagcctgaacacccacagaacccccagaaccgcccaggaggtggccgagctgatcgaccagcacgagaccatgatgaagctggtgctggaggaccccctgctggtgagcctgagactggagggcggcaccgtgctggccagactgagaagagaggagctgggcaccgaggacagcagagacaccctggaggccgccaccagcctgtacgacagagtggacgaggaggtgcacagactggtgctgaccagcaacaacagactgcagcagctggagcacctgagagagctggccagcctgctggagggcaacgaccagcagagctgccagaagggcctgcagctggccaaggagaacccccagagaaccgaggagatggtgcaggacttcagaagaggcctgagcgccgtggtgagccaggccgagtgcagagagggcgagctggccagatggaccagaagcagcgagctgtgcgagaccgtgagcagctggatgggccccctggaccccgaggcctgccccagcagccccgtggccgagtgcctgagaagctgccaccaggaggccaccagcgtggccgccgaggccttccccggcgccggcgtggccgtgctgaagccccacgccctgggcaagccctgggccagccagcaggacctgtggctgcagtacccccagaccagactgagactggaggaggccctgagcgaggccgcccccgaccccagcctgccccccctggcccagagcccccccaagcacgagagagcccaggaggccatgagaagacaccagaagccccccagcttccccagcaccgacagcggcggcggcgcctgggagcccgcccagcccctgagcggcctgcccggcagagccctgctgtgcggccaggacggcgagaccctgagacccggcctgtgcgccctgtgggaccccctgagcctgctgagaggcctgcccggcgccggcgccaccaccgcccacctggaggacagcagcgcctgcagcagcgagcccacccagaccctggccagcagacccagaaagcacccccagaagaagatgatcaagaagacccagagcttcgagatcccccagcccgacagcggccccagagacagctgccagcccgaccacaccagcgtgttcagcaagggcctggaggtgaccagcaccgtggccaccgagaagaagctgcccctgtggcagcacgccagaagcccccccgtgacccagagcagaagcctgagcagccccagcggcctgcaccccgccgaggaggacggcagacagcaggtgggcagcagcagactgagacacatcatggccgagatgatcgccaccgagagagagtacatcagatgcctgggctacgtgatcgacaactacttccccgagatggagagaatggacctgccccagggcctgagaggcaagcaccacgtgatcttcggcaacctggagaagctgcacgacttccaccagcagcacttcctgagagagctggagagatgccagcactgccccctggccgtgggcagaagcttcctgagacacgaggagcagttcggcatgtacgtgatctacagcaagaacaagccccagagcgacgccctgctgagcagccacggcaacgccttcttcaaggacaagcagagagagctgggcgacaagatggacctggccagctacctgctgagacccgtgcagagagtggccaagtacgccctgctgctgcaggacctgctgaaggaggccagctgcggcctggcccagggccaggagctgggcgagctgagagccgccgaggtggtggtgtgcttccagctgagacacggcaacgacctgctggccatggacgccatcagaggctgcgacgtgaacctgaaggagcagggccagctgagatgcagagacgagttcatcgtgtgctgcggcagaaagaagtacctgagacacgtgttcctgttcgaggacctgatcctgttcagcaagacccagaaggtggagggcagccacgacgtgtacctgtacaagcagagcttcaagaccgccgagatcggcatgaccgagaacgtgggcgacagcggcctgagattcgagatctggttcagaagaagaagaaagagccaggacacctacatcctgcaggccagcagcgccgaggtgaagagcgcctggaccgacgtgatcggcagaatcctgtggagacaggccctgaagagcagagagctgagaatccaggagatggccagcatgggcatcggcaaccagcccttcatggacgtgaagcccagagacagaacccccgactgcgccgtgatcagcgacagagcccccaagtgcgccgtgatgagcgacagagtgcccgacagcatcgtgaagggcaccgagagccagatgagaggcagcaccgccgtgagcagcagcgaccacgccgcccccttcaagagaccccacagcaccatcagcgacagcagcaccagcagcagcagcagccagagcagcagcatcctgggcagcctgggcctgctggtgagcagcagccccgcccaccccggcctgtggagccccgcccacagcccctggagcagcgacatcagagcctgcgtggaggaggacgagcccgagcccgagctggagaccggcacccaggccgccgtgtgcgagggcgcccccgccgtgctgctgagcagaaccagacaggcctag

SEQ ID NO: 23252 - DNA, 1140 bp, Artificial Sequence
  Description of Artificial Sequence: Synthetic coding sequence
atgatcttcatgaacaccctgagatacctgcagacccacgagtacctgctggacgtggacctgtggagactgttcgccaacctggaggagctgacccagaccagcctgggcttcgtgaacagcctgttcggcatcatcaaggactacgtggacgccagcgagatcagcagcagcctggacttcatcagcgtgctgaccaagtacttcagaggcagcctgtgccagagccaccagacctactgcctgaactacagcgccgccatcttctacctggagagcctgagacagagagacgacttcggcatctacctgaagtggtgcgagcagaacgagcagtgcagaagactgcacgtgcccgagctgctggtggcccccctgcagagactgaccagataccccctgctgctgaagaacatctggaagagaagcatggacagcgccgagaagatcatgatctacagcatcaaggagaaggtggagaagagcatcagagacctggagggcaaggtgaagtggctggacaacttccagaagttcagatacctgcaggagatcatcgtgtggccccccctgtgggacagagacaagagattcttcatccccgagtgcctgaagcacatcttcaaggagcacatggccgagaacatcctgagccccaccagcagacacctgctgtacgagggcaagctgaccctggccgagagcaccagattcctggacgtgtacctgttcctgttcaacgacttcctgctggtgaccaagaccaagtgcaacaagaagaagctgggcggcagcgaccccggcctgatgtgccccagcctgacccccgagctgcaggccgtgatcaaggagggcggcagctgcaccgtgctggaccagcccatccccctggacagactggtggtgaagagcatcgagcccctgcacgtgagcgtgttcggcctgagaaacgccttcctgatccagcacgagaacagatacagacagtgcatcgccgccttcctgctgcaggcccagaccgagaacatcaagaagacctggatggcccagatcaccaccgccatcagctgcttcaccaagagccaggagaccaagaagatcagcctgttcaccctgcccgccgagagcagcgagatctag

SEQ ID NO: 23253 - DNA, 4095 bp, Artificial Sequence
  Description of Artificial Sequence: Synthetic coding sequence
atggccgagctgaaggtggaggcccccgccagcgtggactggcagaagagatgcctgaccctggagacccagctgttcagattcagactgcaggccagcaagatcagagagctgctggccgacaagatgcaggagctggagcagagactgctggaggccgagcagagagccgagaacgccgagacccaggtgggcgtgatggaggagaaggtgaagctgagcaacctgaagaacgtggacagcgagggcagcctgcacagaaagtaccaggagctgctgaaggccatcaagggcaaggacgagctgatcagccagctggaggcccagctggagaagcagaagcagatgagagccgaggaggccaagaccgtgcaggagaaggccgccaagatcaaggagtgggtgaccctgaagctggccaagctggagatggagaaccagcacctgaagagccacaaccagagactggtggagcaggtgggcagcctgcaggacgccctggaggccatccagatcgcccccagcagaaagctgctggtgcccccctacggcgccgccgagcaggacagcgtgcccagcgagcccggcatccagcccatgggccaggacagcggcagccaggcccagggcctgaaggccgccgtgctggcccccagccccggcgccctgcagagcaaggacagcgtgagcgaggccgccagccccctggaggacagcagcagcagcaccgtgcacagcggcgagaccgtggaggccaagcccctgcagccccacctgggcagagagagccccccccaccagccctgcatgaagctgctgaccttcagatgcagcagcgccagctggggcgagggcctggtgaccgcccagagaggcatgctgcccggcaccaagaccagcgccagagagggcggccccggcagcagcctgaccctgcccaaggtgagagcccccggcacccccagagacagcatccagctggccaagagacaccacagccagccccaggtgggccacggccacttcggcagagtggtgaacatcgagaccgaggccttcagcgccctgcaccccagcggcctgcccgagctggagagcagagccagaagcagagaggagcccgagaagatggagatggaggagcccccccccgccggcaagaacgaggagagagagagccccaaggccctgggcgccgagctggaggaggtggagctgggcaacaagccccccaccccccccctgcaccagttcagcagctgggagagcagaatctacgccgtggccaccagcggcatgagactgagcgacatgagccccagaagcaacaccgcctgctgcgccagcagcccccccgccctggtgagccccggcagcttcagcggcctggtgtacaagaacgtgaccgtgcccgtgtacaccgccctgaagggcagagccacccagatcagcaacatgcccttcatggacgagagcagcggcagcgacgacgactgcagcagccaggccagcttcagaatcagcgtgcccagcagcgagagcagaaagaccagcggcctgggcagccccagagccatcaagagaggcgtgagcatgagcagcctgagcagcgagggcgactacgccatcccccccgacgcctgcagcctggacagcgactacagcgagcccgagcacaagctgcagagaaccagcagctacagcaccgacggcctgggcctgggcggcgagagcctggagaagagcggctacctgctgaagatgggcagccaggtgaagacctggaagagaagatggttcgtgctgagacagggccagatcatgtactacaagagccccagcgacgtgatcagaaagccccagggccaggtggacctgaacagcagatgccagatcgtgagaggcgagggcagccagaccttccagctgatcagcgagaagaagacctactacctgaccgccgacagccccagcctgctggaggagtggatcagagtgctgcagagcctgctgaaggtgcaggccaccggcccccccgccctgctgagaggcggcaccaagcccaccgtgaagggctggctgaccaaggtgaagcacggccacagcaaggtggtgtggtgcgccctggtgggcaagatcttctactactacagaagccacgaggacaagagacccctgggctgcctgcccgtgagagacgcccacatcgaggaggtggacagaagctgcgacagcgacgaggactacgaggccggcggcaccagaagactgctgagcagccactgcaccctggtgatccaccccaccgagcacagccccacctacctgctgatcggcaccaagcacgagaaggacacctggctgtaccacctgaccgtggccgccggcggcagcagcgccaaggtgggcaccgcctacgagcagctgatcggcaagctgatggacggcgagggcgaccccgacagccccctgtggagacaccccatgctgtgctacagcaaggacggcctgtacgccagcctgaccaccctgcccagcgaggccctgcagaccgaggccctgaagctgttcaagagctgccagctgttcatcaacgtgcccgtggaggccgccagcgtggactaccacgtgagcctggcccagaccgccctgcaggtgtgcctggtgcaccccgagctgcagagcgagatctactgccagctgatgaagcagaccagctgcagacccccccagaagtacagcctgatgcagtgctggcagctgctggccctgtgcgcccccctgttcctgccccagcaccacttcctgtggtacgtgaagcagcagctgcagagacacgccgaccccagaagcgagaccggccagtacgccacctactgccagagagccgtggagagaaccctgagaaccggcgagagagaggccagacccagcagaatggaggtggtgagcatcctgctgagaaaccccttccaccacagcctgcccttcagcatccccgtgcacttcaccaacggcacctaccacgtggtgggcttcgacggcagcagcaccgtggacgagttcctgcagagactgaaccaggagatcggcatgagaaagcccagccacagcggcttcgccctgttcaccgacgaccccagcggcagagacctggagcactgcctgcagggcagcgtgaagatctgcgacgccatcagcaagtgggagcaggccatgaaggagctgcaccccggcaagagcgagggcggcaccagagtggtgaagctgatgtacaagaacagactgtacttcagaagccaggtgaagggcgagaccgacagagagagactgctgctggccagccagaccagcagagagatcgtggccggcagattccccatcaacaaggagctggccctggagatggccgccctgatggcccaggtggagtacggcgacctggagaagcccgccctgcccggccccggcggcaccagccccgccaaggcccagcacctgctgcagcaggtgctggacagattccaccccagaagatacagacacggcgcccccgccgagcagctgagacacctggccgacatgctgaccaccaagtgggccaccctgcagggctgcagcccccccgagtgcatcagaatctacctgaccgtggccagaaagtggcccttcttcggcgccaagctgttcgccgcccagcccgcccagctgagcagcaaggagaacgccctggtgtggatcgccgtgaacgaggacggcgtgagcatcctggaccacaacaccatgcaggtgcacatcacctacccctacagcagcgtgaccaccttcggcggctgcagagacgacttcatgctggtgatcagaagcatccccgacaagagcagcggcaagagccacatcgagaagctgatcttcagaatggccgcccccaagatcgccgaggccaccttcatcatggccagctacatgaaccactgcaccaccaccgtgaacccccccaccaacccccccggcgcctgccagctgtgggagctggacggcagacagttcttcagcagcgtgagctgcgccaccaagggccccaccctgctgtag

SEQ ID NO: 23254 - DNA, 990 bp, Artificial Sequence
  Description of Artificial Sequence: Synthetic coding sequence
atggccgccctgatggcccaggtggagtacggcgacctggagaagcccgccctgcccggccccggcggcaccagccccgccaaggcccagcacctgctgcagcaggtgctggacagattccaccccagaagatacagacacggcgcccccgccgagcagctgagacacctggccgacatgctgaccaccaagtgggccaccctgcagggctgcagcccccccgagtgcatcagaatctacctgaccgtggccagaaagtggcccttcttcggcgccaagctgttcgccgcccagcccgcccagctgagcagcaaggagaacgccctggtgtggatcgccgtgaacgaggacggcgtgagcatcctggaccacaacaccatgcaggtgcacatcacctacccctacagcagcgtgaccaccttcggcggctgcagagacgacttcatgctggtgatcagaagcatccccgacaagagcagcggcaagagccacatcgagaagctgatcttcagaatggccgcccccaagccccagcaccacgccgtgctgagctgggtgctgacctgcagcagcctgccctgcagcagcccccagggcagagccgacagcagcctgagagccaaccagagcagaaccctgggcctgctgttcagcgagggccactgcgccagcgagagaatcagcagacccaccggcgcccacaccaccggccccctgaacagcaccgtgatgatccccttcggctacttcctgcccgactgcagaagctacctgcaccacggccagctgtacgagcccctgcactacaactgcgagcccccccaccagcccaccagaagcctgcccgccgtgggcaccggctggaccaccgtgctgttcttctgcttcctgtgctaccagggcgccaacgtggccgtgaacatcagccccaccagattccccaacaccaccagcgccagcggcttcagagacatctaccccagagtgtag

SEQ ID NO: 23255 - DNA, 2382 bp, Artificial Sequence; identical to SEQ ID NO: 23211
  Description of Artificial Sequence: Synthetic coding sequence

SEQ ID NO: 23256 - DNA, 1851 bp, Artificial Sequence
  Description of Artificial Sequence: Synthetic coding sequence
atgcccctgcccggcggcctgtggtggctgctgtgctgcagaagaggcttcaccctgctgcacagagactacggcgacggcgagctgagcggcgacggcgacgaggacgaggacgaggagaccttcgagctgagaacccccagccccgccggcggcggcagaggccccctggaggtgaccctgacccagcccgtgagaagcggccccgtgagcaacagactgcagagctgggaggagacctggagcctgatccccgagaagggcctgcccgaggacgaccccgacatcgtggtgaagggctggctgtacagagagcccagaggcggcggcgccagaccctggctgccccccagaagagcctggttcgtgctgaccagagacagcctggaccagttcagcagcagcggcaagggcgccagaagactgggcagcctggtgctgaccagcctgtgcagcgtgaccggccccgagagaagaagaaaggagaccggcctgtggagcgtgaccgtgagcggcagaaagcacagcgtgagactgtgcagccccagacaggccgaggccgagagatggggcgtggccctgagagaggtgatcgccagcaaggcccccctggagacccccacccagctgctgctgagagacatccaggagagctgcggcgaccccgaggccgtggccctgatctacctgagaaaccccatcctgagacacaccagcggcgccctgtacgcccccctgctgcccctgccctacggcgtgagcgcccccggccccggctacgcccccctgagagaggaggccgtgagactgttcctggccctgcaggccctggagggcgccagaagacccggccccctgatgcagggcgtgctgcagacctgcagagacctgcccgccctgagagacgagctgttcctgcagctggccaagcagaccagcggccccgccggcccccccggcctgcccgccacccaggaccccgccgccctgagatactggcagctgctgacctgcatgagctgcaccttcagacccggcggcgccgtgagaggccacctgctgggccacctggagagaaccgagcaggccctgcccgacagcgagctggccgagtacgccagattcatcagaaaggccctgggcagaaccagaggcagagagctggtgcccagcctggccgagatcagcgccctgagccagagacaggagctgctgtgcaccgtgcactgccccggcgccggcgcctgcgccgtggccatcgacagccacaccaccgccggcgaggtggccagagagctggtgggcagactgggcctggccagaagcagaaacgccttcgccctgtacgagcagagaggcgcccaggagagagccctggccggcggcaccctggtggccgacgtgctgaccagcctggccgccgaggaggccggcctggaggacagccccgacagcggctggagactgtgcctgagactgcacggccccctgcaccccgagggcctgagccccgacggccacgagctgcccttcctgttcgagcagcccgacagcgccagcctgagcgccggcgcctggagcggctacggccacgtggccgcctgccagctgatgggcccccacaccctggccctgagagtgggcgagagccagctgctgctgcagagcccccaggtggaggagatcatgcagctggtgaacgcctacctggccaaccccagccccgagagaccctgcagcagcagcagccccccctgccaggacctgcccgacaccagcccccccagccagagacccggcctggacgagccccagggccagagcggctgcctgggccagctgcaggactag

SEQ ID NO: 23257 - DNA, 1095 bp, Artificial Sequence
  Description of Artificial Sequence: Synthetic coding sequence
atgagctgcaccttcagacccggcggcgccgtgagaggccacctgctgggccacctggagagaaccgagcaggccctgcccgacagcgagctggccgagtacgccagattcatcagaaaggccctgggcagaaccagaggcagagagctggtgcccagcctggccgagatcagcgccctgagccagagacaggagctgctgtgcaccgtgcactgccccggcgccggcgcctgcgccgtggccatcgacagccacaccaccgccggcgaggtggccagagagctggtgggcagactgggcctggccagaagcagaaacgccttcgccctgtacgagcagagaggcgcccaggagagagccctggccggcggcaccctggtggccgacgtgctgaccagcctggccgccgaggaggccggcctggaggacagccccgacagcggctggagactgtgcctgagactgcacggccccctgcaccccgagggcctgagccccgacggccacgagctgcccttcctgttcgagcaggcccacgccctgctgctgagaggcagaccccccccccccgacgacaccctgagagccctggccgccctgagactgcagagcctgcagagagacttcagccccagagtgcccctgcccagactggacagactgctgcccccccccgccccccccagagaggacccccccagacccacccccagacccccccccagcgccgccctgctggccggcgccctgtggagccccggcctggccaagagaagagccgagagagccagaagaggcggcgccggcagaaccgccggcagcatcgccagagagggcggcggcggcgccggcaccgccgccgccgtgctgggcggctggaagagactgagaggcatgggcagagccgaggccatggccgcctacctggccctggccgcccagtgccccggcttcggcgccgccagaagcctggtgggcgtgctgcacagaagctgcgcctgggcctgggagcccagaccctgccccagccccggccagggcagaagaagccccagcaccgtgagcgccatggccatgtggccccccgccagctag

SEQ ID NO: 23258 - DNA, 450 bp, Artificial Sequence; identical to SEQ ID NO: 23212
  Description of Artificial Sequence: Synthetic coding sequence

SEQ ID NO: 23259 - DNA, 3000 bp, Artificial Sequence
  Description of Artificial Sequence: Synthetic coding sequence
atggagcccggcgaggtgaaggacagaatcctggagaacatcagcctgagcgtgaagaagctgcagagctacttcgccgcctgcgaggacgagatccccgccatcagaaaccacgacaaggtgctgcagagactgtgcgagcacctggaccacgccctgctgtacggcctgcaggacctgagcagcggctactgggtgctggtggtgcacttcaccagaagagaggccatcaagcagatcgaggtgctgcagcacgtggccaccaacctgggcagaagcagagcctggctgtacctggccctgaacgagaacagcctggagagctacctgagactgttccaggagaacctgggcctgctgcacaagtactacgtgaagaacgccctggtgtgcagccacgaccacctgaccctgttcctgaccctggtgagcggcctggagttcatcagattcgagctggacctggacgccccctacctggacctggccccctacatgcccgactactacaagccccagtacctgctggacttcgaggacagactgcccagcagcgtgcacggcagcgacagcctgagcctgaacagcttcaacagcgtgaccagcaccaacctggagtgggacgacagcgccatcgcccccagcagcgaggacggcgacctgaccgacaccgtgagcggccccagaagcaccgccagcgacctgaccagcagcaaggccagcaccagaagccccacccagagacagaaccccttcaacgaggagcccgccgagaccgtgagcagcagcgacaccacccccgtgcacaccaccagccaggagaaggaggaggcccaggccctggacccccccgacgcctgcaccgagctggaggtgatcagagtgaccaagaagaagaagatcggcaagaagaagaagagcagaagcgacgaggaggccagccccctgcaccccgcctgcagccagaagaagtgcgccaagcagggcgacggcgacagcagaaacggcagccccagcctgggcagagacagccccgacaccatgctggccagcccccaggaggagggcgagggccccagcagcaccaccgagagcagcgagagaagcgagcccggcctgctgatccccgagatgaaggacaccagcatggagagactgggccagcccctgagcaaggtgatcgaccagctgaacggccagctggaccccagcacctggtgcagcagagccgagccccccgaccagagcttcagaaccggcagccccggcgacgcccccgagagaccccccctgtgcgacttcagcgagggcctgagcgcccccatggacttctacagattcaccgtggagagccccagcaccgtgaccagcggcggcggccaccacgaccccgccggcctgggccagcccctgcacgtgcccagcagccccgaggccgccggccaggaggaggagggcggcggcggcgagggccagacccccagacccctggaggacaccaccagagaggcccaggagctggaggcccagctgagcctggtgagagagggccccgtgagcgagcccgagcccggcacccaggaggtgctgtgccagctgaagagagaccagcccagcccctgcctgagcagcgccgaggacagcggcgtggacgagggccagggcagccccagcgagatggtgcacagcagcgagttcagagtggacaacaaccacctgctgctgctgatgatccacgtgttcagagagaacgaggagcagctgttcaagatgatcagaatgagcaccggccacatggagggcaacctgcagctgctgtacgtgctgctgaccgactgctacgtgtacctgctgagaaagggcgccaccgagaagccctacctggtggaggaggccgtgagctacaacgagctggactacgtgagcgtgggcctggaccagcagaccgtgaagctggtgtgcaccaacagaagaaagcagttcctgctggacaccgccgacgtggccctggccgagttcttcctggccagcctgaagagcgccatgatcaagggctgcagagagcccccctaccccagcatcctgaccgacgccaccatggagaagctggccctggccaagttcgtggcccaggagagcaagtgcgaggccagcgccgtgaccgtgagattctacggcctggtgcactgggaggaccccaccgacgagagcctgggccccaccccctgccactgcagcccccccgagggcaccatcaccaaggagggcatgctgcactacaaggccggcaccagctacctgggcaaggagcactggaagacctgcttcgtggtgctgagcaacggcatcctgtaccagtaccccgacagaaccgacgtgatccccctgctgagcgtgaacatgggcggcgagcagtgcggcggctgcagaagagccaacaccaccgacagaccccacgccttccaggtgatcctgagcgacagaccctgcctggagctgagcgccgagagcgaggccgagatggccgagtggatgcagcacctgtgccaggccgtgagcaagggcgtgatcccccagggcgtggcccccagcccctgcatcccctgctgcctggtgctgaccgacgacagactgttcacctgccacgaggactgccagaccagcttcttcagaagcctgggcaccgccaagctgggcgacatcagcgccgtgagcaccgagcccggcaaggagtactgcgtgctggagttcagccaggacagccagcagctgctgcccccctgggtgatctacctgagctgcaccagcgagctggacagactgctgagcgccctgaacagcggctggaagaccatctaccaggtggacctgccccacaccgccatccaggaggccagcaacaagaagaagttcgaggacgccctgagcctgatccacagcgcctggcagagaagcgacagcctgtgcagaggcagagccagcagagacccctggtgctag

SEQ ID NO: 23260 - DNA, 2154 bp, Artificial Sequence
  Description of Artificial Sequence: Synthetic coding sequence
atggaggccctggaggtggacgacatcagccccgccctggaggtgaccgaggagttcttcagcaccctggacagcaacctggagaaggccgtgcagcaggccgaggtgtacggcatccaggaggtgcccgagctggtgggccacgaggtgctgagcaacatcaccgacaacggcgccatgagaaacgtgaccagcctgggcaagggcggcatgatctgggaccactgcaagagcagactgctggagaccaaggcccagaacgtgttccccgccaaggagcagttcatggtgcagagaggcaccacccccgacaacctgagctggatggagcagaaggaggccagcaccttcaacttcttcaacatctgccagagaagaagagacagacccagaagcgtgaacgacctgctggacgagaccagcaccttcaagcccggccacgccagaagcagaagcgacatcacccaggtggactggagagtggtgctgaagaccacccccctgcagcagcagcagcagcagcagcccctgctgcagggcccccacgtgaccagacccagcttcctgctgcccagccccaacaagatcgaggacgcccagggcaacaccgagcacaagcagaccttccccaacatcctgaagaagggctacctggagatcagaaaggaccacgacagctactggcagagctgctacgccgagctgagcccctacaacctgtacttctacagcctggacagcagcggcaaccagaacctgtacgccacctaccagctgagccacttccagagcatcagcgtgctgggcaacctggaggccagaatggtggacaccgtgctgtacgacaacacccagctgcagctgaaggccgagagcccctgggaggccctggactggggccagaagctgtgggaggtggtgcacgccgccgtgcccggctacatgggcagacagaacgagctgaccatcagccccggcctgggccaccacgacgactacacccagaaccacagcttccagaagaagaccagcggcctgctgccccccagccccgtgctggacagcagcaagcagtaccagaacatcctgaagagcggcaccctgtacagactgaccgtgcagaacaactggaaggccttcaccttcgtgctgagcagagcctacctgatggccttccagcccggcaagctggacgaggaccccctgctgagctacaacgtggacgtgtgcctggccgtgcagatggacaacctggacggctgcgacagctgcttccaggtgatcttcccccaggacgtgctgagactgagagccgagaccagacagagagcccaggagtggatggaggccctgaagatcgccgccaacgtggccagaagcagcgagcagaacctgcaggtgaccctgagaaacaagcccaaggaccagatgggcggccacgagctgagaaagaacaagagacagagcgtgaccaccagcttcctgagcatcctgaccaccctgagcctggagagaggcctgaccgcccagagcttcaagtgcgccggctgccagagaagcatcggcctgagcaacggcaaggccaaggtgtgcaactacagcggctggtactactgcagcagctgccacgtggacgacagcttcctgatccccgccagaatcgtgcacaactgggacaccagcaagtacaaggtgagcaagcaggccaaggagttcctggagtacgtgtacgaggagcccctgatcgacatccagcaggagaacgccatgctgtaccaccacgccgagcccctggccgccgtgctgagactgagacagagactgaagagcctgagagcctacctgttcagctgcagagccgccgtggccgaggacctgagaagaagaatcttccccagagagtacctgctgcagcagatccacctgtacagcctggccgacctgcagcaggtgatcgagggcaagctggcccccttcctgggcaaggtgatcaagttcgccaccagccacgtgtacagctgcagcctgtgcagccagaagggcttcatctgcgagatctgcaacaacggcgagatcctgtaccccttcgaggacatcagcaccagcagattcggcgacccctacgccgacctgctgcagggctacgtggcctag

SEQ ID NO: 23261 - DNA, 2286 bp, Artificial Sequence
  Description of Artificial Sequence: Synthetic coding sequence
atggaggccctggaggtggacgacatcagccccgccctggaggtgaccgaggagttcttcagcaccctggacagcaacctggagaaggccgtgcagcaggccgaggtgtacggcatccaggaggtgcccgagctggtgggccacgaggtgctgagcaacatcaccgacaacggcgccatgagaaacgtgaccagcctgggcaagggcggcatgatctgggaccactgcaagagcagactgctggagaccaaggcccagaacgtgttccccgccaaggagcagttcatggtgcagagaggcaccacccccgacaacctgagctggatggagcagaaggaggccagcaccttcaacttcttcaacatctgccagagaagaagagacagacccagaagcgtgaacgacctgctggacgagaccagcaccttcaagcccggccacgccagaagcagaagcgacatcacccaggtggactggagagtggtgctgaagaccacccccctgcagcagcagcagcagcagcagcccctgctgcagggcccccacgtgaccagacccagcttcctgctgcccagccccaacaagatcgaggacgcccagggcaacaccgagcacaagcagaccttccccaacatcctgaagaagggctacctggagatcagaaaggaccacgacagctactggcagagctgctacgccgagctgagcccctacaacctgtacttctacagcctggacagcagcggcaaccagaacctgtacgccacctaccagctgagccacttccagagcatcagcgtgctgggcaacctggaggccagaatggtggacaccgtgctgtacgacaacacccagctgcagctgaaggccgagagcccctgggaggccctggactggggccagaagctgtgggaggtggtgcacgccgccgtgcccggctacatgggcagacagaacgagctgaccatcagccccggcctgggccaccacgacgactacacccagaaccacagcttccagaagaagaccagcggcctgctgccccccagccccgtgctggacagcagcaagcagtaccagaacatcctgaagagcggcaccctgtacagactgaccgtgcagaacaactggaaggccttcaccttcgtgctgagcagagcctacctgatggccttccagcccggcaagctggacgaggaccccctgctgagctacaacgtggacgtgtgcctggccgtgcagatggacaacctggacggctgcgacagctgcttccaggtgatcttcccccaggacgtgctgagactgagagccgagaccagacagagagcccaggagtggatggaggccctgaagatcgccgccaacgtggccagaagcagcgagcagaacctgcaggtgaccctgagaaacaagcccaaggaccagatgggcggccacgagctgagaaagaacaagagacagagcgtgaccaccagcttcctgagcatcctgaccaccctgagcctggagagaggcctgaccgcccagagcttcaagtgcgccggctgccagagaagcatcggcctgagcaacggcaaggccaaggtgtgcaactacagcggctggtactactgcagcagctgccacgtggacgacagcttcctgatccccgccagaatcgtgcacaactgggacaccagcaagtacaaggtgagcaagcaggccaaggagttcctggagtacgtgtacgaggagcccctgatcgacatccagcaggagaacgccatgctgtaccaccacgccgagcccctggccgccgtgctgagactgagacagagactgaagagcctgagagcctacctgttcagctgcagagccgccgtggccgaggacctgagaagaagaatcttccccagagagtacctgctgcagcagatccacctgtacagcctggccgacctgcagcaggtgatcgagggcaagctggcccccttcctgggcaaggtgatcaagttcgccaccagccacgtgtacagctgcagcctgtgcagccagaagggcttcatctgcgagatctgcaacaacggcgagatcctgtaccccttcgaggacatcagcaccagcagatgcgagagctgcggcgccgtgttccacagcgagtgcaaggagaagagcgtgccctgccccagatgcgtgagaagagagctgcagaagaagcagaagagcttctggcagagactgaacatggacgagagcctggaggaggcctgcaccatgttcgagctgagctaccagaacacctag

SEQ ID NO: 23262 - DNA, 1410 bp, Artificial Sequence
  Description of Artificial Sequence: Synthetic coding sequence
tgaaaccagaacctgtacgccacctaccagctgagccacttccagagcatcagcgtgctgggcaacctggaggccagaatggtggacaccgtgctgtacgacaacacccagctgcagctgaaggccgagagcccctgggaggccctggactggggccagaagctgtgggaggtggtgcacgccgccgtgcccggctacatgggcagacagaacgagctgaccatcagccccggcctgggccaccacgacgactacacccagaaccacagcttccagaagaagaccagcggcctgctgccccccagccccgtgctggacagcagcaagcagtaccagaacatcctgaagagcggcaccctgtacagactgaccgtgcagaacaactggaaggccttcaccttcgtgctgagcagagcctacctgatggccttccagcccggcaagctggacgaggaccccctgctgagctacaacgtggacgtgtgcctggccgtgcagatggacaacctggacggctgcgacagctgcttccaggtgatcttcccccaggacgtgctgagactgagagccgagaccagacagagagcccaggagtggatggaggccctgaagatcgccgccaacgtggccagaagcagcgagcagaacctgcaggtgaccctgagaaacaagcccaaggaccagatgggcggccacgagctgagaaagaacaagagacagagcgtgaccaccagcttcctgagcatcctgaccaccctgagcctggagagaggcctgaccgcccagagcttcaagtgcgccggctgccagagaagcatcggcctgagcaacggcaaggccaaggtgtgcaactacagcggctggtactactgcagcagctgccacgtggacgacagcttcctgatccccgccagaatcgtgcacaactgggacaccagcaagtacaaggtgagcaagcaggccaaggagttcctggagtacgtgtacgaggagcccctgatcgacatccagcaggagaacgccatgctgtaccaccacgccgagcccctggccgccgtgctgagactgagacagagactgaagagcctgagagcctacctgttcagctgcagagccgccgtggccgaggacctgagaagaagaatcttccccagagagtacctgctgcagcagatccacctgtacagcctggccgacctgcagcaggtgatcgagggcaagctggcccccttcctgggcaaggtgatcaagttcgccaccagccacgtgtacagctgcagcctgtgcagccagaagggcttcatctgcgagatctgcaacaacggcgagatcctgtaccccttcgaggacatcagcaccagcagattcggcgacccctacgccgacctgctgcagggctacgtggcctag

SEQ ID NO: 23263 - DNA, 1731 bp, Artificial Sequence
  Description of Artificial Sequence: Synthetic coding sequence
atgggcaacagccactgcgtgccccaggcccccagaagactgagagccagcttcagcagaaagcccagcctgaagggcaacagagaggacagcgccagaatgagcgccggcctgcccggccccgaggccgccagaagcggcgacgccgccgccaacaagctgttccactacatccccggcaccgacatcctggacctggagaaccagagagagaacctggagcagcccttcctgagcgtgttcaagaagggcagaagaagagtgcccgtgagaaacctgggcaaggtggtgcactacgccaaggtgcagctgagattccagcacagccaggacgtgagcgactgctacctggagctgttccccgcccacctgtacttccaggcccacggcagcgagggcctgaccttccagggcctgctgcccctgaccgagctgagcgtgtgccccctggagggcagcagagagcacgccttccagatcaccggccccctgcccgcccccctgctggtgctgtgccccagcagagccgagctggacagatggctgtaccacctggagaagcagaccgccctgctgggcggccccagaagatgccacagcgcccccccccagggcagctgcggcgacgagctgccctggaccctgcagagaagactgaccagactgagaaccgccagcggccacgagcccggcggcagcgccgtgtgcgccagcagagtgaagctgcagcacctgcccgcccaggagcagtgggacagactgctggtgctgtaccccaccagcctggccatcttcagcgaggagctggacggcctgtgcttcaagggcgagctgcccctgagagccgtgcacatcaacctggaggagaaggagaagcagatcagaagcttcctgatcgagggccccctgatcaacaccatcagagtggtgtgcgccagctacgaggactacggccactggctgctgtgcctgagagccgtgacccacagagagggcgccccccccctgcccggcgccgagagcttccccggcagccaggtgatgggcagcggcagaggcagcctgagcagcggcggccagaccagctgggacagcggctgcctggccccccccagcaccagaaccagccacagcctgcccgagagcagcgtgcccagcaccgtgggctgcagcagccagcacacccccctgcacagactgagcctggagagcagccccgacgcccccgaccacaccagcgagaccagccacagccccctgtacgccgacccctacaccccccccgccaccagccacagaagagtgaccgacgtgagaggcctggaggagttcctgagcgccatgcagagcgccagaggccccacccccagcagccccctgcccagcgtgcccgtgagcgtgcccgccagcgaccccagaagctgcagcagcggccccgccggcccctacctgctgagcaagaagggcgccctgcagagcagagccgcccagagacacagaggcagcgccaaggacggcggcccccagccccccgacgccccccagctggtgagcagcgccagagagggcagccccgagccctggctgcccctgaccgacggcagaagccccagaagaagcagagaccccggctacgaccacctgtgggacgagaccctgagcagcagccaccagaagtgcccccagctgggcggccccgaggccagcggcggcctggtgcagtggatctag

SEQ ID NO: 23264 - DNA, 1992 bp, Artificial Sequence
  Description of Artificial Sequence: Synthetic coding sequence
atgggcaacagccactgcgtgccccaggcccccagaagactgagagccagcttcagcagaaagcccagcctgaagggcaacagagaggacagcgccagaatgagcgccggcctgcccggccccgaggccgccagaagcggcgacgccgccgccaacaagctgttccactacatccccggcaccgacatcctggacctggagaaccagagagagaacctggagcagcccttcctgagcgtgttcaagaagggcagaagaagagtgcccgtgagaaacctgggcaaggtggtgcactacgccaaggtgcagctgagattccagcacagccaggacgtgagcgactgctacctggagctgttccccgcccacctgtacttccaggcccacggcagcgagggcctgaccttccagggcctgctgcccctgaccgagctgagcgtgtgccccctggagggcagcagagagcacgccttccagatcaccggcgtgtgggacgccagcagagcccccagaggcacccccgaccccggcctgggcgagggccccgccctgtggctgagaagcacctgcgtgtacgtgtgcgccctgagcgccctgcccgccggccccctgcccgcccccctgctggtgctgtgccccagcagagccgagctggacagatggctgtaccacctggagaagcagaccgccctgctgggcggccccagaagatgccacagcgcccccccccagggcagctgcggcgacgagctgccctggaccctgcagagaagactgaccagactgagaaccgccagcggccacgagcccggcggcagcgccgtgtgcgccagcagagtgaagctgcagcacctgcccgcccaggagcagtgggacagactgctggtgctgtaccccaccagcctggccatcttcagcgaggagctggacggcctgtgcttcaagggcgagctgcccctgagagccgtgcacatcaacctggaggagaaggagaagcagatcagaagcttcctgatcgagggccccctgatcaacaccatcagagtggtgtgcgccagctacgaggactacggccactggctgctgtgcctgagagccgtgacccacagagagggcgccccccccctgcccggcgccgagagcttccccggcagccaggtgatgggcagcggcagaggcagcctgagcagcggcggccagaccagctgggacagcggctgcctggccccccccagcaccagaaccagccacagcctgcccgagagcagcgtgcccagcaccgtgggctgcagcagccagcacacccccgaccaggccaacagcgacagagccagcatcggcagaagaagaaccgagctgagaagaagcggcagcagcagaagccccggcagcaaggccagagccgagggcagaggccccgtgacccccctgcacctggacctgacccagctgcacagactgagcctggagagcagccccgacgcccccgaccacaccagcgagaccagccacagccccctgtacgccgacccctacaccccccccgccaccagccacagaagagtgaccgacgtgagaggcctggaggagttcctgagcgccatgcagagcgccagaggccccacccccagcagccccctgcccagcgtgcccgtgagcgtgcccgccagcgaccccagaagctgcagcagcggccccgccggcccctacctgctgagcaagaagggcgccctgcagagcagagccgcccagagacacagaggcagcgccaaggacggcggcccccagccccccgacgccccccagctggtgagcagcgccagagagggcagccccgagccctggctgcccctgaccgacggcagaagccccagaagaagcagagaccccggctacgaccacctgtgggacgagaccctgagcagcagccaccagaagtgcccccagctgggcggccccgaggccagcggcggcctggtgcagtggatctag

SEQ ID NO: 23265 - DNA, 1836 bp, Artificial Sequence
  Description of Artificial Sequence: Synthetic coding sequence
atgggcaacagccactgcgtgccccaggcccccagaagactgagagccagcttcagcagaaagcccagcctgaagggcaacagagaggacagcgccagaatgagcgccggcctgcccggccccgaggccgccagaagcggcgacgccgccgccaacaagctgttccactacatccccggcaccgacatcctggacctggagaaccagagagagaacctggagcagcccttcctgagcgtgttcaagaagggcagaagaagagtgcccgtgagaaacctgggcaaggtggtgcactacgccaaggtgcagctgagattccagcacagccaggacgtgagcgactgctacctggagctgttccccgcccacctgtacttccaggcccacggcagcgagggcctgaccttccagggcctgctgcccctgaccgagctgagcgtgtgccccctggagggcagcagagagcacgccttccagatcaccggccccctgcccgcccccctgctggtgctgtgccccagcagagccgagctggacagatggctgtaccacctggagaagcagaccgccctgctgggcggccccagaagatgccacagcgcccccccccagagaagactgaccagactgagaaccgccagcggccacgagcccggcggcagcgccgtgtgcgccagcagagtgaagctgcagcacctgcccgcccaggagcagtgggacagactgctggtgctgtaccccaccagcctggccatcttcagcgaggagctggacggcctgtgcttcaagggcgagctgcccctgagagccgtgcacatcaacctggaggagaaggagaagcagatcagaagcttcctgatcgagggccccctgatcaacaccatcagagtggtgtgcgccagctacgaggactacggccactggctgctgtgcctgagagccgtgacccacagagagggcgccccccccctgcccggcgccgagagcttccccggcagccaggtgatgggcagcggcagaggcagcctgagcagcggcggccagaccagctgggacagcggctgcctggccccccccagcaccagaaccagccacagcctgcccgagagcagcgtgcccagcaccgtgggctgcagcagccagcacacccccgaccaggccaacagcgacagagccagcatcggcagaagaagaaccgagctgagaagaagcggcagcagcagaagccccggcagcaaggccagagccgagggcagaggccccgtgacccccctgcacctggacctgacccagctgcacagactgagcctggagagcagccccgacgcccccgaccacaccagcgagaccagccacagccccctgtacgccgacccctacaccccccccgccaccagccacagaagagtgaccgacgtgagaggcctggaggagttcctgagcgccatgcagagcgccagaggccccacccccagcagccccctgcccagcgtgcccgtgagcgtgcccgccagcgaccccagaagctgcagcagcggccccgccggcccctacctgctgagcaagaagggcgccctgcagagcagagccgcccagagacacagaggcagcgccaaggacggcggcccccagccccccgacgccccccagctggtgagcagcgccagagagggcagccccgagccctggctgcccctgaccgacggcagaagccccagaagaagcagagaccccggctacgaccacctgtgggacgagaccctgagcagcagccaccagaagtgcccccagctgggcggccccgaggccagcggcggcctggtgcagtggatctag

SEQ ID NO: 23266 - DNA, 1473 bp, Artificial Sequence
  Description of Artificial Sequence: Synthetic coding sequence
atggaggaggagggcgtgaaggaggccggcgagaagcccagaggcgcccagatggtggacaaggccggctggatcaagaagagcagcggcggcctgctgggcttctggaaggacagatacctgctgctgtgccaggcccagctgctggtgtacgagaacgaggacgaccagaagtgcgtggagaccgtggagctgggcagctacgagaagtgccaggacctgagagccctgctgaagagaaagcacagattcatcctgctgagaagccccggcaacaaggtgagcgacatcaagttccaggcccccaccggcgaggagaaggagagctggatcaaggccctgaacgagggcatcaacagaggcaagaacaaggccttcgacgaggtgaaggtggacaagagctgcgccctggagcacgtgaccagagacagagtgagaggcggccagagaagaagaccccccaccagagtgcacctgaaggaggtggccagcgccgccagcgacggcctgctgagactggacctggacgtgcccgacagcggcccccccgtgttcgcccccagcaaccacgtgagcgaggcccagcccagagagacccccagacccctgatgccccccaccaagcccttcctggcccccgagaccaccagccccggcgacagagtggagacccccgtgggcgagagagcccccacccccgtgagcgccagcagcgaggtgagccccgagagccaggaggacagcgagacccccgccgaggaggacagcggcagcgagcagccccccaacagcgtgctgcccgacaagctgaaggtgagctgggagaaccccagcccccaggaggcccccgccgccgagagcgccgagcccagccaggccccctgcagcgagaccagcgaggccgcccccagagagggcggcaagccccccacccccccccccaagatcctgagcgagaagctgaaggccagcatgggcgagatgcaggccagcggcccccccgcccccggcaccgtgcaggtgagcgtgaacggcatggacgacagccccgagcccgccaagcccagccaggccgagggcacccccggcaccccccccaaggacgccaccaccagcaccgccctgcccccctgggacctgcccccccagttccaccccagatgcagcagcctgggcgacctgctgggcgagggccccagacaccccctgcagcccagagagagactgtacagagcccagctggaggtgaaggtggccagcgagcagaccgagaagctgctgaacaaggtgctgggcagcgagcccgcccccgtgagcgccgagaccctgctgagccaggccgtggagcagctgagacaggccacccaggtgctgcaggagatgagagacctgggcgagctgagccaggaggcccccggcctgagagagaagagaaaggagctggtgaccctgtacagaagaagcgccccctag

SEQ ID NO: 23267 - DNA, 672 bp, Artificial Sequence
  Description of Artificial Sequence: Synthetic coding sequence
atggaggaggagggcgtgaaggaggccggcgagaagcccagaggcgcccagatggtggacaaggccggctggatcaagaagagcagcggcggcctgctgggcttctggaaggacagatacctgctgctgtgccaggcccagctgctggtgtacgagaacgaggacgaccagaagtgcgtggagaccgtggagctgggcagctacgagaagtgccaggacctgagagccctgctgaagagaaagcacagattcatcctgctgagaagccccggcaacaaggtgagcgacatcaagttccaggcccccaccggcgaggagaaggagagctggatcaaggccctgaacgagggcatcaacagaggcaagaacaaggccttcgacgaggtgaaggtggacaagagctgcgccctggagcacgtgaccagagacagagtgagaggcggccagagaagaagaccccccaccagagtgcacctgaaggaggtggccagcgccgccagcgacggcctgctgagactggacctggacgtgcccgacagcggcccccccgtgttcgcccccagcaaccacgtgagcgaggcccagcccagagagacccccagacccctgatgccccccaccaagcccttcctggcccccgagaccaccagccccagcagccacctgttctag

SEQ ID NO: 23268 - DNA, 1923 bp, Artificial Sequence
  Description of Artificial Sequence: Synthetic coding sequence
atgggcaccagaagcagccccgaggagggcacccccccccccctggtgcccgagtgcgacgtggaggtgcagccccagggccaccccgaggagagcagagagcaggaggccagcgaggtgctggccgagcccagcagcagaggcggcgccgagcagcaggccgaggaggaggaggtgggcgagggcagcagcaccgagagcagcagagacgcccccgaggccaccccccccatcgccatggccgccaccccccccgccagcaccagcagcagagagggcgtgagaggcgccgccagaagactgcagggccagcagctggaggccctgaccagagtggccctgatggagcagagagtgaaggagctgcagagacagagaaaggagctgagaatcgagatggaggtggaggtggccctgctgagaggcgagctggccggcgagagagtggccgccagaagagaggaggagcagctgagagagctgctggagcagcaggccgccagcgagcagagaggcagacagcagagagagcaggagcagagaagactgagccaggagagagacagactggagggcctgagacagagactgagaaaggcccagggccagctggacagccagcccgaggaccagagagagagactgctgcagggcgtgcaggagatgagagagcagctggacgtggcccagagagcctacgaggacctggagttccagcagctggagagagagagcagacaggaggaggaggacagagacagccccggcccccaggtgcccgaccccaaggtgcaggagctgcaggccagcatggcccagcacagaagaggcgccctgcagcacagaatcagagtgctggaggagcagctgaagagcctgggcgagcagatggccgccgagagcagaggcctgagcagaaagaaggaggaggccctgcaggccctgagccaggagagaagcagactgctggagctgaactgcctgcagggcacccccggcggcgacttcagcgagcccaaccccgccctgaccaagctgctgttcacccagaagaccgacagacagctgctggtgctgcaggacgccgtggcccacagcgccgccacccccaccagcagctgcctgttcagcgtgcacagcagcctgcagggcagcatcggcctgcagagaaccggcagcctgcccagaaagagaggcgagagaggcagccagagaggcagccccagacccctgagcttccactgcaccgagagcctggaggccagcgccctgccccccgccgtgggcgacagcggcagataccccctgtaccagctgctgaactgcggcagaggcaacagctgcggcgccatccaccccgacatcgcccacatggagagactgctgcagcaggccatggccgagagagagagactgctgaaggccagagagggcaccagaagaggcaccgagggcagcagcggccccgccgtgcccgccatcaccgccccccccacccccccccacccccccggccccagaatcctggacctgagacagcacctggagggctggggccacaaccccgagaactgcccccacgtgcaggtgagcggctgctgctgcagaggccccctggtgaagatgggcggcagaatcaagacctggagaaagagatggttctgcttcgacagacaggccagaagactggcctactacgccgacaaggaggagaccaagctgaagggcgtgatctacttccaggccatcgaggaggtgtactacgaccacctgagatgcgccttcaagagccccaaccccagactgaccttctgcgtgaagacctacgagagactgttctacatggtggcccccagccccgaggccatgagaatctggatggacgtgatcgtgaccgccgccgacgagaaccacgccccctag

SEQ ID NO: 23269 - DNA, 528 bp, Artificial Sequence
  Description of Artificial Sequence: Synthetic coding sequence
atggccgaggccagcagcgccaacctgggcagcggctgcgaggagaagagacacgagggcagcagcagcgagagcgtgccccccggcaccaccatcagcagagtgaagctgctggacaccatggtggacaccttcctgcagaagctggtggccgccggcagctaccagagattcaccgactgctacaagtgcttctaccagctgcagcccgccatgacccagcagatctacgacaagttcatcgcccagctgcagaccagcatcagagaggagatcagcgacatcaaggaggagggcaacctggaggccgtgctgaacgccctggacaagatcgtggaggagggcaaggtgagaaaggagcccgcctggtgcgaggcccagagatgcagagtgcagcagagatgcagcctgtgcgtgcaggccggcggccagagaggcagcgaggagacccaggccctgcccgtgagcatggccggcagccccagccccctgcccggcagccccggcgcccaggagggcggcgtgtag

SEQ ID NO: 23270 - DNA, 663 bp, Artificial Sequence
  Description of Artificial Sequence: Synthetic coding sequence
atggccgaggccagcagcgccaacctgggcagcggctgcgaggagaagagacacgagggcagcagcagcgagagcgtgccccccggcaccaccatcagcagagtgaagctgctggacaccatggtggacaccttcctgcagaagctggtggccgccggcagctaccagagattcaccgactgctacaagtgcttctaccagctgcagcccgccatgacccagcagatctacgacaagttcatcgcccagctgcagaccagcatcagagaggagatcagcgacatcaaggaggagggcaacctggaggccgtgctgaacgccctggacaagatcgtggaggagggcaaggtgagaaaggagcccgcctgcaacggcaccccctgcggcgccatgtgcagaaacagaagacccagaaccagcagctggcagatgcccagctggcagggcggcggcagatggagaagctgcagctacagaagcagacccagcagcagacccggcagatgcgaggcccagagatgcagagtgcagcagagatgcagcctgtgcgtgcaggccggcggccagagaggcagcgaggagacccaggccctgcccgtgagcatggccggcagccccagccccctgcccggcagccccggcgcccaggagggcggcgtgtag

SEQ ID NO: 23271 - DNA, 2010 bp, Artificial Sequence
  Description of Artificial Sequence: Synthetic coding sequence
atggcccaccacctgcccgccgccatggagagccaccaggacttcagaagcatcaaggccaagttccaggccagccagcccgagcccagcgacctgcccaagaagccccccaagcccgagttcggcaagctgaagaagttcagccagcccgagctgagcgagcaccccaagaaggcccccctgcccgagttcggcgccgtgagcctgaagccccccccccccgaggtgaccgacctgcccaagaagccccccccccccgaggtgaccgacctgcccaagaagccccccccccccgaggtgaccgacctgcccaagaagccccccccccccgaggtgaccgacctgcccaagaagcccagcaagctggagctgagcgacctgagcaagaagttcccccagctgggcgccacccccttccccagaaagcccctgcagcccgaggtgggcgaggcccccctgaaggccagcctgcccgagcccggcgcccccgccagaaagcccctgcagcccgacgagctgagccaccccgccagaccccccagcgagcccaagagcggcgccttccccagaaagctgtggcagcccgaggccggcgaggccacccccagaagcccccagcccgagctgagcaccttccccaagaagcccgcccagcccgagttcaacgtgtaccccaagaagcccccccagccccaggtgggcggcctgcccaagaagagcgtgccccagcccgagttcagcgaggccgcccagacccccctgtggaagccccagagcagcgagcccaagagagacagcagcgccttccccaagaaggccagccagccccccctgagcgacttccccaagaagcccccccagcccgagctgggcgacctgaccagaaccagcagcgagcccgaggtgagcgtgctgcccaagagacccagacccgccgagttcaaggccctgagcaagaagcccccccagcccgagctgggcggcctgcccagaaccagcagcgagcccgagttcaacagcctgcccagaaagctgctgcagcccgagagaagaggcccccccagaaagttcagccagcccgagcccagcgccgtgctgaagagacacccccagcccgagttcttcggcgacctgcccagaaagccccccctgcccagcagcgccagcgagagcagcctgcccgccgccgtggccggcttcagcagcagacaccccctgagccccggcttcggcgccgccggcacccccagatggagaagcggcggcctggtgcacagcggcggcgccagacccggcctgagacccagccacccccccagaagaagacccctgccccccgccagcagcctgggccacccccccgccaagccccccctgccccccggccccgtggacatgcagagcttcagaagacccagcgccgccagcatcgacctgagaagaaccagaagcgccgccggcctgcacttccaggacagacagcccgaggacatccccgtgcccgacgagatctacgagctgtacgacgacgtggagcccagagacgacagcagccccagccccaagggcagagacgaggcccccagcgtgcagcaggccgccagaagacccccccaggaccccgccctgagaaaggagaaggacccccagccccagcagctgccccccatggaccccaagctgctgaagcagctgagaaaggccgagaaggccgagagagagttcagaaagaagttcaagttcgagggcgagatcgtggtgcacaccaagatgatgatcgaccccaacgccaagaccagaagaggcggcggcaagcacctgggcatcagaagaggcgagatcctggaggtgatcgagttcaccagcaacgaggagatgctgtgcagagaccccaagggcaagtacggctacgtgcccagaaccgccctgctgcccctggagaccgaggtgtacgacgacgtggacttctgcgaccccctggagaaccagcccctgcccctgggcagatag

SEQ ID NO: 23272 - DNA, 2013 bp, Artificial Sequence
  Description of Artificial Sequence: Synthetic coding sequence
atggcccaccacctgcccgccgccatggagagccaccaggacttcagaagcatcaaggccaagttccaggccagccagcccgagcccagcgacctgcccaagaagccccccaagcccgagttcggcaagctgaagaagttcagccagcccgagctgagcgagcaccccaagaaggcccccctgcccgagttcggcgccgtgagcctgaagccccccccccccgaggtgaccgacctgcccaagaagccccccccccccgaggtgaccgacctgcccaagaagccccccccccccgaggtgaccgacctgcccaagaagccccccccccccgaggtgaccgacctgcccaagaagcccagcaagctggagctgagcgacctgagcaagaagttcccccagctgggcgccacccccttccccagaaagcccctgcagcccgaggtgggcgaggcccccctgaaggccagcctgcccgagcccggcgcccccgccagaaagcccctgcagcccgacgagctgagccaccccgccagaccccccagcgagcccaagagcggcgccttccccagaaagctgtggcagcccgaggccggcgaggccacccccagaagcccccagcccgagctgagcaccttccccaagaagcccgcccagcccgagttcaacgtgtaccccaagaagcccccccagccccaggtgggcggcctgcccaagaagagcgtgccccagcccgagttcagcgaggccgcccagacccccctgtggaagccccagagcagcgagcccaagagagacagcagcgccttccccaagaaggccagccagccccccctgagcgacttccccaagaagcccccccagcccgagctgggcgacctgaccagaaccagcagcgagcccgaggtgagcgtgctgcccaagagacccagacccgccgagttcaaggccctgagcaagaagcccccccagcccgagctgggcggcctgcccagaaccagcagcgagcccgagttcaacagcctgcccagaaagctgctgcagcccgagagaagaggcccccccagaaagttcagccagcccgagcccagcgccgtgctgaagagacacccccagcccgagttcttcggcgacctgcccagaaagccccccctgcccagcagcgccagcgagagcagcctgcccgccgccgtggccggcttcagcagcagacaccccctgagccccggcttcggcgccgccggcacccccagatggagaagcggcggcctggtgcacagcggcggcgccagacccggcctgagacccagccacccccccagaagaagacccctgccccccgccagcagcctgggccacccccccgccaagccccccctgccccccggccccgtggacatgcagagcttcagaagacccagcgccgccagcatcgacctgagaagaaccagaagcgccgccggcctgcacttccaggacagacagcccgaggacatcccccaggtgcccgacgagatctacgagctgtacgacgacgtggagcccagagacgacagcagccccagccccaagggcagagacgaggcccccagcgtgcagcaggccgccagaagacccccccaggaccccgccctgagaaaggagaaggacccccagccccagcagctgccccccatggaccccaagctgctgaagcagctgagaaaggccgagaaggccgagagagagttcagaaagaagttcaagttcgagggcgagatcgtggtgcacaccaagatgatgatcgaccccaacgccaagaccagaagaggcggcggcaagcacctgggcatcagaagaggcgagatcctggaggtgatcgagttcaccagcaacgaggagatgctgtgcagagaccccaagggcaagtacggctacgtgcccagaaccgccctgctgcccctggagaccgaggtgtacgacgacgtggacttctgcgaccccctggagaaccagcccctgcccctgggcagatag

SEQ ID NO: 23273 - DNA, 72 bp, Artificial Sequence
  Description of Artificial Sequence: Synthetic coding sequence
aagttcagccagcccgaggtggccgagggcatgagcagacagaacctgggcctgaagctgagaggcagatag

SEQ ID NO: 23274 - DNA, 1320 bp, Artificial Sequence
  Description of Artificial Sequence: Synthetic coding sequence
atgagcaagaccatggccatgaacctgctggaggactggtgcagaggcatggaggtggacatccacagaagcctgctggtgaccggcatccccgaggactgcggccaggccgagatcgaggagaccctgaacggcgtgctgagccccctgggcccctacagagtgctgaacaagatcttcgtgagagaggagaacgtgaaggccgccctgatcgaggtgggcgagggcgtgaacctgagcaccatccccagagagttccccggcagaggcggcgtgtggagagtggtgtgcagagaccccacccaggacgccgagttcctgaagaacctgaacgagttcctggacgccgagggcagaacctgggaggacgtggtgagactgctgcagctgaaccaccccaccctgagccagaaccagcaccagccccccgagaactgggccgaggccctgggcgtgctgctgggcgccgtggtgcagatcatcttctgcatggacgccgagatcagaagcagagaggaggccagagcccaggaggccgccgagttcgaggagatggccgcctgggccctggccgccggcagaaaggtgaagaaggagcccggcctggccgccgaggtgggcagcgccctgaaggccgagacccccaacaactggaacgccaccgaggaccagcacgagcccaccaagcccctggtgagaagagccggcgccaagagcagaagcagaagaaagaagcagaagaagaacagcagacaggaggccgtgccctggaagaagcccaagggcatcaacagcaacagcaccgccaacctggaggaccccgaggtgggcgacgccgagagcatggccatcagcgagcccatcaagggcagcagaaagccctgcgtgaacaaggaggagctggccctgaagaagcccatggccaagtgcgcctggaagggccccagagagcccccccaggacgccagagccgaggccgagagccccggcggcgccagcgagagcgaccaggacggcggccacgagagcccccccaagaagaaggccgtggcctgggtgagcgccaagaaccccgcccccatgagaaagaagaagaaggtgagcctgggccccgtgagctacgtgctggtggacagcgaggacggcagaaagaagcccgtgatgcccaagaagggccccggcagcagaagagaggccagcgaccagaaggcccccagaggccagcagcccgccgaggccaccgccagcaccagcagaggccccaaggccaagcccgagggcagccccagaagagccaccaacgagagcagaaaggtgtag

SEQ ID NO: 23275 - DNA, 615 bp, Artificial Sequence
  Description of Artificial Sequence: Synthetic coding sequence
atgagcaagaccatggccatgaacctgctggaggactggtgcagaggcatggaggtggacatccacagaagcctgctggtgaccggcatccccgaggactgcggccaggccgagatcgaggagaccctgaacggcgtgctgagccccctgggcccctacagagtgctgaacaagatcttcgtgagagaggagaacgtgaaggccgccctgatcgaggtgggcgagggcgtgaacctgagcaccatccccagagagttccccggcagaggcggcgtgtggagagtggtgtgcagagaccccacccaggacgccgagttcctgaagaacctgaacgagttcctggacgccgagggcagaacctgggaggacgtggtgagactgctgcagctgaaccaccccaccctgagccagaaccagcaccagccccccgagaactgggccgaggccctgggcgtgctgctgggcgccgtggtgcagatcatcttctgcatggacgccgagatcagaagcagaagagaggagggcgaggagagaaccggcgcctgcagcagaggcggcttctgcctgaagggcagagacccccagcagctggagtgccacggcagacccgcctag

SEQ ID NO: 23276 - DNA, 1137 bp, Artificial Sequence
  Description of Artificial Sequence: Synthetic coding sequence
atgagcaagaccatggccatgaacctgctggaggactggtgcagaggcatggaggtggacatccacagaagcctgctggtgaccggcatccccgaggactgcggccaggccgagatcgaggagaccctgaacggcgtgctgagccccctgggcccctacagagtgctgaacaagatcttcgtgagagaggagaacgtgaaggccgccctgatcgaggtgggcgagggcgtgaacctgagcaccatccccagagagttccccggcagaggcggcgtgtggagagtggtgtgcagagaccccacccaggacgccgagttcctgaagaacctgaacgagttcctggacgccgagggcagaacctgggaggacgtggtgagactgctgcagctgaaccaccccaccctgagccagaaccagcaccagccccccgagaactgggccgaggccctgggcgtgctgctgggcgccgtggtgcagatcatcttctgcatggacgccgagatcagaagcagagaggaggccagagcccaggaggccgccgagttcgaggagatggccgcctgggccctggccgccggcagaaaggtgaagaaggagcccggcctggccgccgaggtgggcagcgccctgaaggccgagacccccaacaactggaacgccaccgaggaccagcacgagcccaccaagcccctggtgagaagagccggcgccaagagcagaagcagaagaaagaagcagaagaagaacagcagacaggaggccgtgccctggaagaagcccaagggcatcaacagcaacagcaccgccaacctggaggaccccgaggtgggcgacgccgagagcatggccatcagcgagcccatcaagggcagcagaaagccctgcgtgaacaaggaggagctggccctgaagaagcccatggccaagtgcgcctggaagggccccagagagcccccccaggacgccagagccgaggccgagagccccggcggcgccagcgagagcgaccaggacggcggccacgagagcccccccaagaagaaggccgtggcctgggtgagcgccaagaaccccgcccccatgagaaagaagaagaagaaccccgagagattcgacctgggcgaccacccctactag

SEQ ID NO: 23277 - DNA, 840 bp, Artificial Sequence
  Description of Artificial Sequence: Synthetic coding sequence
atggccatgagcctgctgcaggactggtgcagaagcctggacgtggacgcccacagagccctgctggtgaccggcatccccgagggcctggagcaggccgacgtggaggccgtgctgcagcccaccctgctgcccctgggcaccttcagactgagacacatgaaggccctgatgaacgagaaggcccaggccgccctggtggagttcgtggaggacgtgaaccacgccgccatccccagagagatccccggcaaggacggcgtgtggagagtgctgtggaaggacagagcccaggacaccagagtgctgagacagatgagaagactgctgctggacgacggccccacccaggccgccgaggccggcacccccggcgaggcccccaccccccccgccagcgagacccaggcccaggacagcggcgaggtgaccggccaggccggcagcctgctgggcgccgccagaaaccccagaagaggcagaagaggcagaagaaacagaaccagaagaaacagactgacccagaagggcaagaagagaagcagaggcggcagacccagcgcccccgccagaagcgaggccgaggacagcagcgacgagagcctgggcatcgtgatcgaggagatcgaccagggcgacctgagcggcgaggaggaccagagcgccctgtacgccaccctgcaggccgccgccagagagctggtgagacagtgggccccctgcaacagcgagggcggcccctgccccacctgcccctgggagggcatcggcggcttcggctgcgacctgaccgtgcagaccagactgagccagagctacgtgagagacacccagatgtag

SEQ ID NO: 23278 - DNA, 1221 bp, Artificial Sequence
  Description of Artificial Sequence: Synthetic coding sequence
atggcctggtgcgtggccaccgccgaccccgcccacaccagcagacccctgttcaccggcctggccgtgagcagaggcagcgccggccacgcctggagcgccggcttcgactgggccgccgtggtggtggtgaccggcagaagatgcagaagcggccagaccgtgcccggcgccgccagaagccccctgctgccccaccccctgcccagccccctgagagtgcccccccccaccggcgccctgggcagacccctgcccagatggccccagcccagaagaacccccttctggagcgtgatcagcaaggccaccaagctgagaagccccccctggaccagcgcccccaccgccagcaacctggagagagacagaagaatcagcagaatcgaccccatcagaagccccaccatggccggcggcctgttcgccgtgagcaagaagtacttccagtacctgggcacctacgacaccggcatggaggtgtggggcggcgagaacctggagctgagcttcagagtgtggcagtgcggcggcaagctggagatccacccctgcagccacgtgggccacgtgttccccaagagagccccctacgccagacccaacttcctgcagaacaccgccagagccgccgaggtgtggatggacgagtacaaggagcacttctacaacagaaacccccccgccagaaaggaggcctacggcgacatcagcgagagaaagctgctgagagagagactgagatgcaagagcttcgactggtacctgaagaacgtgttccccaacctgcacgtgcccgaggacagacccggctggcacggcgccatcagaagcagaggcatcagcagcgagtgcctggactacaacagccccgacaacaaccccaccggcgccaacctgagcctgttcggctgccacggccagggcggcaaccagttcttcgagtacaccagcaacaaggagatcagattcaacagcgtgaccgagctgtgcgccgaggtgcccgagcagaagaactacgtgggcatgcagaactgccccaaggacggcttccccgtgcccgccaacatcatctggcacttcaaggaggacggcaccatcttccacccccacagcggcctgtgcctgagcgcctacagaacccccgagggcagacccgacgtgcagatgagaacctgcgacgccctggacaagaaccagatctggagcttcgagaagtag

SEQ ID NO: 23279 - DNA, 1728 bp, Artificial Sequence
  Description of Artificial Sequence: Synthetic coding sequence
atggccagcgccaccgaggaccccgtgctggagagatacttcaagggccacaaggccgccatcaccagcctggacctgagccccaacggcaagcagctgggcgccggcagagccagagagctgggcagcagaagactgagcgacctgcagaagaacaccgaggacctgagcagacccctgtacaagaagccccccgccgacagcagagccctgggcgagtggggcaaggccagcaagctgcagctgaacgaggacgagctgaagcagcaggaggagctgatcgagagatacgccatcaacatctacctgagcgacagaatcagcctgcacagacacatcgaggacaagagaatgtacgagtgcaagagccagaagttcaactacagaaccctgcccaccaccagcgtgatcatcgccttctacaacgaggcctggagcaccctgctgagaaccatccacagcgtgctggagaccagccccgccgtgctgctgaaggagatcatcctggtggacgacctgagcgacagagtgtacctgaagacccagctggagacctacatcagcaacctggacagagtgagactgatcagaaccaacaagagagagggcctggtgagagccagactgatcggcgccaccttcgccaccggcgacgtgctgaccttcctggactgccactgcgagtgcaacagcggctggctggagcccctgctggagagaatcggcagagacgagaccgccgtggtgtgccccgtgatcgacaccatcgactggaacaccttcgagttctacatgcagatcggcgagcccatgatcggcggcttcgactggagactgaccttccagtggcacagcgtgcccaagcaggagagagacagaagaatcagcagaatcgaccccatcagaagccccaccatggccggcggcctgttcgccgtgagcaagaagtacttccagtacctgggcacctacgacaccggcatggaggtgtggggcggcgagaacctggagctgagcttcagagtgtggcagtgcggcggcaagctggagatccacccctgcagccacgtgggccacgtgttccccaagagagccccctacgccagacccaacttcctgcagaacaccgccagagccgccgaggtgtggatggacgagtacaaggagcacttctacaacagaaacccccccgccagaaaggaggcctacggcgacatcagcgagagaaagctgctgagagagagactgagatgcaagagcttcgactggtacctgaagaacgtgttccccaacctgcacgtgcccgaggacagacccggctggcacggcgccatcagaagcagaggcatcagcagcgagtgcctggactacaacagccccgacaacaaccccaccggcgccaacctgagcctgttcggctgccacggccagggcggcaaccagttcttcgagtacaccagcaacaaggagatcagattcaacagcgtgaccgagctgtgcgccgaggtgcccgagcagaagaactacgtgggcatgcagaactgccccaaggacggcttccccgtgcccgccaacatcatctggcacttcaaggaggacggcaccatcttccacccccacagcggcctgtgcctgagcgcctacagaacccccgagggcagacccgacgtgcagatgagaacctgcgacgccctggacaagaaccagatctggagcttcgagaagtag

SEQ ID NO: 23280 - DNA, 1476 bp, Artificial Sequence
  Description of Artificial Sequence: Synthetic coding sequence
atggagaacgaggagagcgacgtgaagccccccgactggcccaaccccatgaacgccaccagccagttcccccagccccagcacttcgacagcttcggcctgagactgcccagagacatcaccgagctgcccgagtggagcgagggctaccccttctacatggccatgggcttccccggctacgacctgagcgccgacgacatcgccggcaagttccagttcagcagaggcatgagaagaagctacgacgccggcttcaagctgatggtggtggagtacgccgagagcaccaacaactgccaggccgccaagcagttcggcgtgctggagaagaacgtgagagactggagaaaggtgaagccccagctgcagaacgcccacgccatgagaagagccttcagaggccccaagaacggcagattcgccctggtggaccagagagtggccgagtacgtgagatacatgcaggccaagggcgaccccatcaccagagaggccatgcagctgaaggccctggagatcgcccaggagatgaacatccccgagaagggcttcaaggccagcctgggctggtgcagaagaatgatgagaagatacgacctgagcctgagacacaaggtgcccgtgccccagcacctgcccgaggacctgaccgagaagctggtgacctaccagagaagcgtgctggccctgagaagagcccacgactacgaggtggcccagatgggcaacgccgacgagacccccatctgcctggaggtgcccagcagagtgaccgtggacaaccagggcgagaagcccgtgctggtgaagacccccggcagagagaagctgaagatcaccgccatgctgggcgtgctggccgacggcagaaagctgcccccctacatcatcctgagaggcacctacatcccccccggcaagttccccagcggcatggagatcagatgccacagatacggctggatgaccgaggacctgatgcaggactggctggaggtggtgtggagaagaagaaccggcgccgtgcccaagcagagaggcatgctgatcctgaacggcttcagaggccacgccaccgacagcgtgaagaacagcatggagagcatgaacaccgacatggtgatcatccccggcggcctgaccagccagctgcaggtgctggacgtggtggtgtacaagcccctgaacgacagcgtgagagcccagtacagcaactggctgctggccggcaacctggccctgagccccaccggcaacgccaagaagccccccctgggcctgttcctggagtgggtgatggtggcctggaacagcatcagcagcgagagcatcgtgcagggcttcaagaagtgccacatcagcagcaacctggaggaggaggacgacgtgctgtgggagatcgagagcgagctgcccggcggcggcgagccccccaaggactgcgacaccgagagcatggccgagagcaactag

SEQ ID NO: 23281 - DNA, 1011 bp, Artificial Sequence
  Description of Artificial Sequence: Synthetic coding sequence
atgtacaccgtgctgaccggcaccccccccttcatggccagccccctgagcgagatgtaccagaacatcagagagggccactaccccgagcccgcccacctgagcgccaacgccagaagactgatcgtgcacctgctggcccccaaccccgccgagagacccagcctggaccacctgctgcaggacgacttcttcacccagggcttcacccccgacagactgcccgcccacagctgccacagcccccccatcttcgccatccccccccccctgggcagaatcttcagaaaggtgggccagagactgctgacccagtgcagacccccctgccccttcacccccaaggaggccagcggccccggcgagggcggccccgaccccgacagcatggagtgggacggcgagagcagcctgagcgccaaggaggtgccctgcctggagggccccatccacctggtggcccagggcaccctgcagagcgacctggccggccccgagggcagcagaagacccgaggtggaggccgccctgagacacctgcagctgtgcctggacgtgggcccccccgccacccaggaccccctgggcgagcagcagcccatcctgtgggcccccaagtgggtggactacagcagcaagtacggcttcggctaccagctgctggacggcggcagaaccggcagacacccccacggccccgccacccccagaagagagggcaccctgcccacccccgtgccccccgccggccccggcctgtgcctgctgagattcctggccagcgagcacgccctgctgctgctgttcagcaacggcatggtgcaggtgagcttcagcggcgtgcccgcccagctggtgctgagcggcgagggcgagggcctgcagctgaccctgtgggagcagggcagccccggcaccagctacagcctggacgtgcccagaagccacggctgcgcccccaccaccggccagcacctgcaccacgccctgagaatgctgcagagcatctag

SEQ ID NO: 23282 - DNA, 1893 bp, Artificial Sequence
  Description of Artificial Sequence: Synthetic coding sequence
atggacatcaagggccagttctggaacgacgacgacagcgagggcgacaacgagagcgaggagttcctgtacggcgtgcagggcagctgcgccgccgacctgtacagacacccccagctggacgccgacatcgaggccgtgaaggagatctacagcgagaacagcgtgagcatcagagagtacggcaccatcgacgacgtggacatcgacctgcacatcaacatcagcttcctggacgaggaggtgagcaccgcctggaaggtgctgagaaccgagcccatcgtgctgagactgagattcagcctgagccagtacctggacggccccgagcccagcatcgaggtgttccagcccagcaacaaggagggcttcggcctgggcctgcagctgaagaagatcctgggcatgttcaccagccagcagtggaagcacctgagcaacgacttcctgaagacccagcaggagaagagacacagctggttcaaggccagcggcaccatcaagaagttcagagccggcctgagcatcttcagccccatccccaagagccccagcttccccatcatccaggacagcatgctgaagggcaagctgggcgtgcccgagctgagagtgggcagactgatgaacagaagcatcagctgcaccatgaagaaccccaaggtggaggtgttcggctacccccccagcccccaggccggcctgctgtgcccccagcacgtgggcctgcccccccccgccagaaccagccccctggtgagcggccactgcaagaacatccccaccctggagtacggcttcctggtgcagatcatgaagtacgccgagcagagaatccccaccctgaacgagtactgcgtggtgtgcgacgagcagcacgtgttccagaacggcagcatgctgaagcccgccgtgtgcaccagagagctgtgcgtgttcagcttctacaccctgggcgtgatgagcggcgccgccgaggaggtggccaccggcgccgaggtggtggacctgctggtggccatgtgcagagccgccctggagagccccagaaagagcatcatcttcgagccctaccccagcgtggtggaccccaccgaccccaagaccctggccttcaaccccaagaagaagaactacgagagactgcagaaggccctggacagcgtgatgagcatcagagagatgacccagggcagctacctggagatcaagaagcagatggacaagctggaccccctggcccaccccctgctgcagtggatcatcagcagcaacagaagccacatcgtgaagctgcccctgagcagactgaagttcatgcacaccagccaccagttcctgctgctgagcagcccccccgccaaggaggccagattcagaaccgccaagaagctgtacggcagcaccttcgccttccacggcagccacatcgagaactggcacagcatcctgagaaacggcctggtgaacgccagctacaccaagctgcagctgcacggcgccgcctacggcaagggcatctacctgagccccatcagcagcatcagcttcggctacagcggcatgggcaagggccagcacagaatgcccagcaaggacgagctggtgcagagatacaacagaatgaacaccatcccccagaccagaagcatccagagcagattcctgcagagcagaaacctgaactgcatcgccctgtgcgaggtgatcaccagcaaggacctgcagaagcacggcaacatctgggtgtgccccgtgagcgaccacgtgtgcaccagattcttcttcgtgtacgaggacggccaggtgggcgacgccaacatcaacacccaggaccccaagatccagaaggagatcatgagagtgatcggcacccaggtgtacaccaactag

SEQ ID NO: 23283 - DNA, 405 bp, Artificial Sequence
  Description of Artificial Sequence: Synthetic coding sequence
atgctgctggtgctgctgagcgtggtgctgctggccctgagcagcgcccagagcaccgacaacgacgtgaactacgaggacttcaccttcaccatccccgacgtggaggacagcagccagagacccgaccagggcccccagagacccccccccgagggcctgctgcccagaccccccggcgacagcggcaaccaggacgacggcccccagcagagaccccccaagcccggcggccaccacagacaccccccccccccccccttccagaaccagcagagaccccccagaagaggccacagacagctgagcctgcccagattccccagcgtgagcctgcaggaggccagcagcttcttccagagagacagacccgccagacacccccaggagcagcccctgtggtag

SEQ ID NO: 23284 - DNA, 699 bp, Artificial Sequence
  Description of Artificial Sequence: Synthetic coding sequence
atgttccacaaggccgaggagctgttcagcaagaccaccaacaacgaggtggacgacatggacaccagcgacacccagtggggctggttctacctggccgagtgcggcaagtggcacatgttccagcccgacaccaacagccagtgcagcgtgagcagcgaggacatcgagaagagcttcaagaccaacccctgcggcagcatcagcttcaccaccagcaagttcagctacaagatcgacttcgccgagatgaagcagatgaacctgaccaccggcaagcagagactgatcaagagagcccccttcagcatcagcgccttcagctacatctgcgagaacgaggccatccccatgcccccccactgggagaacgtgaacacccaggtgccctaccagctgatccccctgcacaaccagacccacgagtacaacgaggtggccaacctgttcggcaagaccatggacagaaacagaatcaagagaatccagagaatccagaacctggacctgtgggagttcttctgcagaaagaaggcccagctgaagaagaagagaggcgtgccccagatcaacgagcagatgctgttccacggcaccagcagcgagttcgtggaggccatctgcatccacaacttcgactggagaatcaacggcatccacggcgccgtgttcggcaaggacaacatgtggaagctgtag

SEQ ID NO: 23285 - DNA, 774 bp, Artificial Sequence
  Description of Artificial Sequence: Synthetic coding sequence
atgtgggaggtggcccacgtgagcgagatgaagcagatgaacctgaccaccggcaagcagagactgatcaagagagcccccttcagcatcagcgccttcagctacatctgcgagaacgaggccatccccatgcccccccactgggagaacgtgaacacccaggtgccctaccagctgatccccctgcacaaccagacccacgagtacaacgaggtggccaacctgttcggcaagaccatggacagaaacagaatcaagagaatccagagaatccagaacctggacctgtgggagttcttctgcagaaagaaggcccagctgaagaagaagagaggcgtgccccagatcaacgagcagatgctgttccacggcaccagcagcgagttcgtggaggccatctgcatccacaacttcgactggagaatcaacggcatccacggcgccgtgttcggcaagggcacctacttcgccagagacgccgcctacagcagcagattctgcaaggacgacatcaagcacggcaacaccttccagatccacggcgtgagcctgcagcagagacacctgttcagaacctacaagagcatgttcctggccagagtgctgatcggcgactacatcaacggcgacagcaagtacatgagaccccccagcaaggacggcagctacgtgaacctgtacgacagctgcgtggacgacacctggaaccccaagatcttcgtggtgttcgacgccaaccagatctaccccgagtacctgatcgacttccactag

SEQ ID NO: 23286 - DNA, 774 bp, Artificial Sequence; identical to SEQ ID NO: 23285
  Description of Artificial Sequence: Synthetic coding sequence

SEQ ID NO: 23287 - DNA, 141 bp, Artificial Sequence
  Description of Artificial Sequence: Synthetic coding sequence
atgaagtggatgacctggaccagacagatccccagcggcgccggcttcacctggcagaacgtgggcagcggcacctgcttcagcagaatccccaccgtgagcgtgcagctggccgtgaagatcagcaagaaggccagctag

SEQ ID NO: 23288 - DNA, 1557 bp, Artificial Sequence
  Description of Artificial Sequence: Synthetic coding sequence
atggacatcaagggccagttctggaacgacgacgacagcgagggcgacaacgagagcgaggagttcctgtacggcgtgcagggcagctgcgccgccgacctgtacagacacccccagctggacgccgacatcgaggccgtgaaggagatctacagcgagaacagcgtgagcatcagagagtacggcaccatcgacgacgtggacatcgacctgcacatcaacatcagcttcctggacgaggaggtgagcaccgcctggaaggtgctgagaaccgagcccatcgtgctgagactgagattcagcctgagccagtacctggacggccccgagcccagcatcgaggtgttccagcccagcaacaaggagggcttcggcctgggcctgcagctgaagaagatcctgggcatgttcaccagccagcagtggaagcacctgagcaacgacttcctgaagacccagcaggagaagagacacagctggttcaaggccagcggcaccatcaagaagttcagagccggcctgagcatcttcagccccatccccaagagccccagcttccccatcatccaggacagcatgctgaagggcaagctgggcgtgcccgagctgagagtgggcagactgatgaacagaagcatcagctgcaccatgaagaaccccaaggtggaggtgttcggctacccccccagcccccaggccggcctgctgtgcccccagcacgtgggcctgcccccccccgccagaaccagccccctggtgagcggccactgcaagaacatccccaccctggagtacggcttcctggtgcagatcatgaagtacgccgagcagagaatccccaccctgaacgagtactgcgtggtgtgcgacgagcagcacgtgttccagaacggcagcatgctgaagcccgccgtgtgcaccagagagctgtgcgtgttcagcttctacaccctgggcgtgatgagcggcgccgccgaggaggtggccaccggcgccgaggtggtggacctgctggtggccatgtgcagagccgccctggagagccccagaaagagcatcatcttcgagccctaccccagcgtggtggaccccaccgaccccaagaccctggccttcaaccccaagaagaagaactacgagagactgcagaaggccctggacagcgtgatgagcatcagagagatgacccagggcagctacctggagatcaagaagcagatggacaagctggaccccctggcccaccccctgctgcagtggatcatcagcagcaacagaagccacatcgtgaagctgcccctgagcagactgaagttcatgcacaccagccaccagttcctgctgctgagcagcccccccgccaaggaggccagattcagaaccgccaagaagctgtacggcagcaccttcgccttccacggcagccacatcgagaactggcacagcatcctgagaaacggcctggtgaacgccagctacaccaagctgcaggagtgggagaaggacagcaccggctgcccccccagaatgagctggagcagagacaccaccggctag

SEQ ID NO: 23289 - DNA, 1893 bp, Artificial Sequence; identical to SEQ ID NO: 23282
  Description of Artificial Sequence: Synthetic coding sequence

SEQ ID NO: 23290 - DNA, 1167 bp, Artificial Sequence
  Description of Artificial Sequence: Synthetic coding sequence
atggacatcaagggccagttctggaacgacgacgacagcgagggcgacaacgagagcgaggagttcctgtacggcgtgcagggcagctgcgccgccgacctgtacagacacccccagctggacgccgacatcgaggccgtgaaggagatctacagcgagaacagcgtgagcatcagagagtacggcaccatcgacgacgtggacatcgacctgcacatcaacatcagcttcctggacgaggaggtgagcaccgcctggaaggtgctgagaaccgagcccatcgtgctgagactgagattcagcctgagccagtacctggacggccccgagcccagcatcgaggtgttccagcccagcaacaaggagggcttcggcctgggcctgcagctgaagaagatcctgggcatgttcaccagccagcagtggaagcacctgagcaacgacttcctgaagacccagcaggagaagagacacagctggttcaaggccagcggcaccatcaagaagttcagagccggcctgagcatcttcagccccatccccaagagccccagcttccccatcatccaggacagcatgctgaagggcaagctgggcgtgcccgagctgagagtgggcagactgatgaacagaagcatcagctgcaccatgaagaaccccaaggtggaggtgttcggctacccccccagcccccaggccggcctgctgtgcccccagcacgtgggcctgcccccccccgccagaaccagccccctggtgagcggccactgcaagaacatccccaccctggagtacggcttcctggtgcagatcatgaagtacgccgagcagagaatccccaccctgaacgagtactgcgtggtgtgcgacgagcagcacgtgttccagaacggcagcatgctgaagcccgccgtgtgcaccagagagctgtgcgtgttcagcttctacaccctgggcgtgatgagcggcgccgccgaggaggtggccaccggcgccgaggtggtggacctgctggtggccatgtgcagagccgccctggagagccccagaaagagcatcatcttcgagccctaccccagcgtggtggaccccaccgaccccaagaccgtggccttcatggtggagctggaccccagaaccaccccccacagcgacggccccgactag

SEQ ID NO: 23291 - DNA, 858 bp, Artificial Sequence
  Description of Artificial Sequence: Synthetic coding sequence
atgttcaccagccagcagtggaagcacctgagcaacgacttcctgaagacccagcaggagaagagacacagctggttcaaggccagcggcaccatcaagaagttcagagccggcctgagcatcttcagccccatccccaagagccccagcttccccatcatccaggacagcatgctgaagggcaagctgggcgtgcccgagctgagagtgggcagactgatgaacagaagcatcagctgcaccatgaagaaccccaaggtggaggtgttcggctacccccccagcccccaggtgagcggccactgcaagaacatccccaccctggagtacggcttcctggtgcagatcatgaagtacgccgagcagagaatccccaccctgaacgagtactgcgtggtgtgcgacgagcagcacgtgttccagaacggcagcatgctgaagcccgccgtgtgcaccagagagctgtgcgtgttcagcttctacaccctgggcgtgatgagcggcgccgccgaggaggtggccaccggcgccgaggtggtggacctgctggtggccatgtgcagagccgccctggagagccccagaaagagcatcatcttcgagccctaccccagcgtggtggaccccaccgaccccaagaccctggccttcaaccccaagaagaagaactacgagagactgcagaaggccctggacagcgtgatgagcatcagagagatgacccagggcagctacctggagatcaagaagcagatggacaagctggaccccctggcccaccccctgctgcagtggatcatcagcagcaacagaagccacatcgtgaagctgcccctgagcagatgggtgccccactag

SEQ ID NO: 23292 - DNA, 1665 bp, Artificial Sequence
  Description of Artificial Sequence: Synthetic coding sequence
atggacatcaagggccagttctggaacgacgacgacagcgagggcgacaacgagagcgaggagttcctgtacggcgtgcagggcagctgcgccgccgacctgtacagacacccccagctggacgccgacatcgaggccgtgaaggagatctacagcgagaacagcgtgagcatcagagagtacggcaccatcgacgacgtggacatcgacctgcacatcaacatcagcttcctggacgaggaggtgagcaccgcctggaaggtgctgagaaccgagcccatcgtgctgagactgagattcagcctgagccagtacctggacggccccgagcccagcatcgaggtgttccagcccagcaacaaggagggcttcggcctgggcctgcagctgaagaagatcctgggcatgttcaccagccagcagtggaagcacctgagcaacgacttcctgaagacccagcaggagaagagacacagctggttcaaggccagcggcaccatcaagaagttcagagccggcctgagcatcttcagccccatccccaagagccccagcttccccatcatccaggacagcatgctgaagggcaagctgggcgtgcccgagctgagagtgggcagactgatgaacagaagcatcagctgcaccatgaagaaccccaaggtggaggtgttcggctacccccccagcccccaggccggcctgctgtgcccccagcacgtgggcctgcccccccccgccagaaccagccccctggtgagcggccactgcaagaacatccccaccctggagtacggcttcctggtgcagatcatgaagtacgccgagcagagaatccccaccctgaacgagtactgcgtggtgtgcgacgagcagcacgtgttccagaacggcagcatgctgaagcccgccgtgtgcaccagagagctgtgcgtgttcagcttctacaccctgggcgtgatgagcggcgccgccgaggaggtggccaccggcgccgaggtggtggacctgctggtggccatgtgcagagccgccctggagagccccagaaagagcatcatcttcgagccctaccccagcgtggtggaccccaccgaccccaagaccctggccttcaaccccaagaagaagaactacgagagactgcagaaggccctggacagcgtgatgagcatcagagagatgacccagggcagctacctggagatcaagaagcagatggacaagctggaccccctggcccaccccctgctgcagtggatcatcagcagcaacagaagccacatcgtgaagctgcccctgagcagacagctgaagttcatgcacaccagccaccagttcctgctgctgagcagcccccccgccaaggaggccagattcagaaccgccaagaagctgtacggcagcaccttcgccttccacggcagccacatcgagaactggcacagcatcctgagaaacggcctggtgaacgccagctacaccaagctgcagctgcacggcgccgcctacggcaagggcatctacctgagccccatcagcagcatcagcttcggctacagcggcatgggcaagggccagcacagaatgcccagcaaggacgagctggtgcagagatacaacagaatgaacaccatcccccagagaagaagcttccagatctag

SEQ ID NO: 23293 - DNA, 750 bp, Artificial Sequence
  Description of Artificial Sequence: Synthetic coding sequence
atgttcaccagccagcagtggaagcacctgagcaacgacttcctgaagacccagcaggagaagagacacagctggttcaaggccagcggcaccatcaagaagttcagagccggcctgagcatcttcagccccatccccaagagccccagcttccccatcatccaggacagcatgctgaagggcaagctgggcgtgcccgagctgagagtgggcagactgatgaacagaagcatcagctgcaccatgaagaaccccaaggtggaggtgttcggctacccccccagcccccaggtgagcggccactgcaagaacatccccaccctggagtacggcttcctggtgcagatcatgaagtacgccgagcagagaatccccaccctgaacgagtactgcgtggtgtgcgacgagcagcacgtgttccagaacggcagcatgctgaagcccgccgtgtgcaccagagagctgtgcgtgttcagcttctacaccctgggcgtgatgagcggcgccgccgaggaggtggccaccggcgccgaggtggtggacctgctggtggccatgtgcagagccgccctggagagccccagaaagagcatcatcttcgagccctaccccagcgtggtggaccccaccgaccccaagaccctggccttcaaccccaagaagaagaactacgagagactgcagaaggccctggacagcgtgatgagcatcagagagatgacccagggctgcagaaactgcatcaagtag

SEQ ID NO: 23294 - DNA, 2565 bp, Artificial Sequence
  Description of Artificial Sequence: Synthetic coding sequence
atgggcatgtgcagcagacaggagagaatccagaaggacatcgacgtggtgatccagaagagcagagccgagaaggactgcctgttcgccgacttcagatacagcgacagcaccttcaccttcacctacgtgggcggccccagaagcgtgagctacagcgtgcacgtgagcgaggactaccccgacaacacctacgtgagcagcagcgagaacgacgaggacgtgctggtgaccaccgagcccatccccgtgatcttccacagaatcgccaccgagctgagaaagaccaacgacatcaactgctgcctgagcatcaagagcaagctgcagaaggagaacggcgaggagagcagacagaacagcaccgtggaggaggacagcgagggcgacaacgacagcgaggagttctactacggcggccaggtgaactacgacggcgagctgcacaagcacccccagctggaggccgacctgagcgccgtgagagagatctacggcccccacgccgtgagcctgagagagtacggcgccatcgacgacgtggacatcgacctgcacatcgacgtgagcttcctggacgaggagatcgccgtggcctgggaggtgatcagaaccgagcccatcatcgtgagactgcactgcagcctgacccagtacctgaacggccccgtgcccaccgtggacgtgttccagatcagcaccaaggagagattcggcctgggccaccagctgaagaagatcatgcagaccttcgtgacccagcagtggaagcagagcaaggagaagagcaactgcctgcacaacaagaagctgagcgagaagaaggtgaagagccccctgcacctgttcagcaccctgagaagaagccccagctaccccccccccggctgcggcaagagcaagagcaagctgaagagcgagcaggacggcatcagcaagacccacaagctgctgagaagaacctgcagcagcaccgtgaagaccgacgacgtgtgcgtgaccaagagccacagaaccttcggcagaagcctgagcagcgaccccagagccgagcaggccatgaccgccatcaagagccacaagctgctgaacagaccctgccccgccgccgtgaagagcgaggagtgcctgaccctgaagagccacagactgctgaccagaagctgcagcggcgaccccagatgcgagcacaacaccaacctgaagccccacaagctgctgagcagaagctacagcagcaacctgagaatggaggagctgtacggcctgaagaaccacaagctgctgagcaagagctacagcagcgcccccaagagcagcaagaccgagctgttcaaggagcccaacgccgagggcagaagactgagcctgaccagcggcctgatcggcatcctgacccccagcagcagcagcagcagccagctggcccccaacggcgccaagtgcatccccgtgagagacagaggcttcctggtgcagaccatcgagttcgccgagcagagaatccccgtgctgaacgagtactgcgtggtgtgcgacgagccccacgtgttccagaacggccccatgctgagacccaccgtgtgcgagagagagctgtgcgtgttcgccttccagaccctgggcgtgatgaacgaggccgccgacgagatcgccaccggcgcccaggtggtggacctgctggtgagcatgtgcagaagcgccctggagagccccagaaaggtggtgatcttcgagccctaccccagcgtggtggaccccaacgacccccagatgctggccttcaaccccagaaagaagaactacgacagagtgatgaaggccctggacagcatcaccagcatcagagagatgacccaggccccctacctggagatcaagaagcagatggacaagcaggaccccctggcccaccccctgctgcagtgggtgatcagcagcaacagaagccacatcgtgaagctgcccgtgaacagacagctgaagttcatgcacaccccccaccagttcctgctgctgagcagcccccccgccaaggagagcaacttcagagccgccaagaagctgttcggcagcaccttcgccttccacggcagccacatcgagaactggcacagcatcctgagaaacggcctggtggtggccagcaacaccagactgcagctgcacggcgccatgtacggcagcggcatctacctgagccccatgagcagcatcagcttcggctacagcggcatgaacaagaagcagaaggtgagcgccaaggacgagcccgccagcagcagcaagagcagcaacaccagccagagccagaagaagggccagcagagccagttcctgcagagcagaaacctgaagtgcatcgccctgtgcgaggtgatcaccagcagcgacctgcacaagcacggcgagatctgggtggtgcccaacaccgaccacgtgtgcaccagattcttcttcgtgtacgaggacggccaggtgggcgacgccaacatcaacacccaggagggcggcatccacaaggagatcctgagagtgatcggcaaccagaccgccaccggctag

SEQ ID NO: 23295 - DNA, 1482 bp, Artificial Sequence
  Description of Artificial Sequence: Synthetic coding sequence
atgcagaccttcgtgacccagcagtggaagcagagcaaggagaagagcaactgcctgcacaacaagaagctgagcgagaagaaggtgaagagccccctgcacctgttcagcaccctgagaagaagccccagctaccccccccccggctgcggcaagagcaagagcaagctgaagagcgagcaggacggcatcagcaagacccacaagctgctgagaagaacctgcagcagcaccgtgaagaccgacgacgtgtgcgtgaccaagagccacagaaccttcggcagaagcctgagcagcgaccccagagccgagcaggccatgaccgccatcaagagccacaagctgctgaacagaccctgccccgccgccgtgaagagcgaggagtgcctgaccctgaagagccacagactgctgaccagaagctgcagcggcgaccccagatgcgagcacaacaccaacctgaagccccacaagctgctgagcagaagctacagcagcaacctgagaatggaggagctgtacggcctgaagaaccacaagctgctgagcaagagctacagcagcgcccccaagagcagcaagaccgagctgttcaaggagcccaacgccgagggcagaagactgagcctgaccagcggcctgatcggcatcctgacccccagcagcagcagcagcagccagctggcccccaacggcgccaagtgcatccccgtgagagacagaggcttcctggtgcagaccatcgagttcgccgagcagagaatccccgtgctgaacgagtactgcgtggtgtgcgacgagccccacgtgttccagaacggccccatgctgagacccaccgtgtgcgagagagagctgtgcgtgttcgccttccagaccctgggcgtgatgaacgaggccgccgacgagatcgccaccggcgcccagaagaagaactacgacagagtgatgaaggccctggacagcatcaccagcatcagagagatgacccaggccccctacctggagatcaagaagcagatggacaagcaggaccccctggcccaccccctgctgcagtgggtgatcagcagcaacagaagccacatcgtgaagctgcccgtgaacagacagctgaagttcatgcacaccccccaccagttcctgctgctgagcagcccccccgccaaggagagcaacttcagagccgccaagaagctgttcggcagcaccttcgccttccacggcagccacatcgagaactggcacagcatcctgagaaacggcctggtggtggccagcaacaccagactgcagctgcacggcgccatgtacggcagcggcatctacctgagccccatgagcagcatcagcttcggctacagcggcatgaacaagaagcagaaggtgagcgccaaggacgagcccgccagcagcagcaagagcagcaacaccagccagagccagaagagaaccgccatccccatccccgccaagccctag

SEQ ID NO: 23296 - DNA, 174 bp, Artificial Sequence
  Description of Artificial Sequence: Synthetic coding sequence
atgggcatgtgcagcagacaggagagaatccagaaggacatcgacgtggtgatccagaagagcagagccgagaaggactgcctgttcgccgacttcagatacagcgacagcaccttcaccttcacctacgtgggcggccccagaagaaacagcgagctggcccccggcatgtag

SEQ ID NO: 23297 - DNA, 2439 bp, Artificial Sequence
  Description of Artificial Sequence: Synthetic coding sequence
atgggcatgtgcagcagacaggagagaatccagaaggacatcgacgtggtgatccagaagagcagagccgagaaggactgcctgttcgccgacttcagatacagcgacagcaccttcaccttcacctacgtgggcggccccagaagcgtgagctacagcgtgcacgtgagcgaggactaccccgacaacacctacgtgagcagcagcgagaacgacgaggacgtgctggtgaccaccgagcccatccccgtgatcttccacagaatcgccaccgagctgagaaagaccaacgacatcaactgctgcctgagcatcaagagcaagctgcagaaggagaacggcgaggagagcagacagaacagcaccgtggaggaggacagcgagggcgacaacgacagcgaggagttctactacggcggccaggtgaactacgacggcgagctgcacaagcacccccagctggaggccgacctgagcgccgtgagagagatctacggcccccacgccgtgagcctgagagagtacggcgccatcgacgacgtggacatcgacctgcacatcgacgtgagcttcctggacgaggagatcgccgtggcctgggaggtgatcagaaccgagcccatcatcgtgagactgcactgcagcctgacccagtacctgaacggccccgtgcccaccgtggacgtgttccagatcagcaccaaggagagattcggcctgggccaccagctgaagaagatcatgcagaccttcgtgacccagcagtggaagcagagcaaggagaagagcaactgcctgcacaacaagaagctgagcgagaagaaggtgaagagccccctgcacctgttcagcaccctgagaagaagccccagctaccccccccccggctgcggcaagagcaagagcaagctgaagagcgagcaggacggcatcagcaagacccacaagctgctgagaagaacctgcagcagcaccgtgaagaccgacgacgtgtgcgtgaccaagagccacagaaccttcggcagaagcctgagcagcgaccccagagccgagcaggccatgaccgccatcaagagccacaagctgctgaacagaccctgccccgccgccgtgaagagcgaggagtgcctgaccctgaagagccacagactgctgaccagaagctgcagcggcgaccccagatgcgagcacaacaccaacctgaagccccacaagctgctgagcagaagctacagcagcaacctgagaatggaggagctgtacggcctgaagaaccacaagctgctgagcaagagctacagcagcgcccccaagagcagcaagaccgagctgttcaaggagcccaacgccgagggcagaagactgagcctgaccagcggcctgatcggcatcctgacccccagcagcagcagcagcagccagctggcccccaacggcgccaagtgcatccccgtgagagacagaggcttcctggtgcagaccatcgagttcgccgagcagagaatccccgtgctgaacgagtactgcgtggtgtgcgacgagccccacgtgttccagaacggccccatgctgagacccaccgtgtgcgagagagagctgtgcgtgttcgccttccagaccctgggcgtgatgaacgaggccgccgacgagatcgccaccggcgcccagaagaagaactacgacagagtgatgaaggccctggacagcatcaccagcatcagagagatgacccaggccccctacctggagatcaagaagcagatggacaagcaggaccccctggcccaccccctgctgcagtgggtgatcagcagcaacagaagccacatcgtgaagctgcccgtgaacagacagctgaagttcatgcacaccccccaccagttcctgctgctgagcagcccccccgccaaggagagcaacttcagagccgccaagaagctgttcggcagcaccttcgccttccacggcagccacatcgagaactggcacagcatcctgagaaacggcctggtggtggccagcaacaccagactgcagctgcacggcgccatgtacggcagcggcatctacctgagccccatgagcagcatcagcttcggctacagcggcatgaacaagaagcagaaggtgagcgccaaggacgagcccgccagcagcagcaagagcagcaacaccagccagagccagaagaagggccagcagagccagttcctgcagagcagaaacctgaagtgcatcgccctgtgcgaggtgatcaccagcagcgacctgcacaagcacggcgagatctgggtggtgcccaacaccgaccacgtgtgcaccagattcttcttcgtgtacgaggacggccaggtgggcgacgccaacatcaacacccaggagggcggcatccacaaggagatcctgagagtgatcggcaaccagaccgccaccggctag

SEQ ID NO: 23298 - DNA, 2502 bp, Artificial Sequence
  Description of Artificial Sequence: Synthetic coding sequence
atggagcccgccgccctgagatgcgcctacttcagatacagcgacagcaccttcaccttcacctacgtgggcggccccagaagcgtgagctacagcgtgcacgtgagcgaggactaccccgacaacacctacgtgagcagcagcgagaacgacgaggacgtgctggtgaccaccgagcccatccccgtgatcttccacagaatcgccaccgagctgagaaagaccaacgacatcaactgctgcctgagcatcaagagcaagctgcagaaggagaacggcgaggagagcagacagaacagcaccgtggaggaggacagcgagggcgacaacgacagcgaggagttctactacggcggccaggtgaactacgacggcgagctgcacaagcacccccagctggaggccgacctgagcgccgtgagagagatctacggcccccacgccgtgagcctgagagagtacggcgccatcgacgacgtggacatcgacctgcacatcgacgtgagcttcctggacgaggagatcgccgtggcctgggaggtgatcagaaccgagcccatcatcgtgagactgcactgcagcctgacccagtacctgaacggccccgtgcccaccgtggacgtgttccagatcagcaccaaggagagattcggcctgggccaccagctgaagaagatcatgcagaccttcgtgacccagcagtggaagcagagcaaggagaagagcaactgcctgcacaacaagaagctgagcgagaagaaggtgaagagccccctgcacctgttcagcaccctgagaagaagccccagctaccccccccccggctgcggcaagagcaagagcaagctgaagagcgagcaggacggcatcagcaagacccacaagctgctgagaagaacctgcagcagcaccgtgaagaccgacgacgtgtgcgtgaccaagagccacagaaccttcggcagaagcctgagcagcgaccccagagccgagcaggccatgaccgccatcaagagccacaagctgctgaacagaccctgccccgccgccgtgaagagcgaggagtgcctgaccctgaagagccacagactgctgaccagaagctgcagcggcgaccccagatgcgagcacaacaccaacctgaagccccacaagctgctgagcagaagctacagcagcaacctgagaatggaggagctgtacggcctgaagaaccacaagctgctgagcaagagctacagcagcgcccccaagagcagcaagaccgagctgttcaaggagcccaacgccgagggcagaagactgagcctgaccagcggcctgatcggcatcctgacccccagcagcagcagcagcagccagctggcccccaacggcgccaagtgcatccccgtgagagacagaggcttcctggtgcagaccatcgagttcgccgagcagagaatccccgtgctgaacgagtactgcgtggtgtgcgacgagccccacgtgttccagaacggccccatgctgagacccaccgtgtgcgagagagagctgtgcgtgttcgccttccagaccctgggcgtgatgaacgaggccgccgacgagatcgccaccggcgcccaggtggtggacctgctggtgagcatgtgcagaagcgccctggagagccccagaaaggtggtgatcttcgagccctaccccagcgtggtggaccccaacgacccccagatgctggccttcaaccccagaaagaagaactacgacagagtgatgaaggccctggacagcatcaccagcatcagagagatgacccaggccccctacctggagatcaagaagcagatggacaagcaggaccccctggcccaccccctgctgcagtgggtgatcagcagcaacagaagccacatcgtgaagctgcccgtgaacagacagctgaagttcatgcacaccccccaccagttcctgctgctgagcagcccccccgccaaggagagcaacttcagagccgccaagaagctgttcggcagcaccttcgccttccacggcagccacatcgagaactggcacagcatcctgagaaacggcctggtggtggccagcaacaccagactgcagctgcacggcgccatgtacggcagcggcatctacctgagccccatgagcagcatcagcttcggctacagcggcatgaacaagaagcagaaggtgagcgccaaggacgagcccgccagcagcagcaagagcagcaacaccagccagagccagaagaagggccagcagagccagttcctgcagagcagaaacctgaagtgcatcgccctgtgcgaggtgatcaccagcagcgacctgcacaagcacggcgagatctgggtggtgcccaacaccgaccacgtgtgcaccagattcttcttcgtgtacgaggacggccaggtgggcgacgccaacatcaacacccaggagggcggcatccacaaggagatcctgagagtgatcggcaaccagaccgccaccggctag

SEQ ID NO: 23299 - DNA, 2565 bp, Artificial Sequence; identical to SEQ ID NO: 23294
  Description of Artificial Sequence: Synthetic coding sequence

SEQ ID NO: 23300 - DNA, 2439 bp, Artificial Sequence; identical to SEQ ID NO: 23297
  Description of Artificial Sequence: Synthetic coding sequence

SEQ ID NO: 23301 - DNA, 1485 bp, Artificial Sequence
  Description of Artificial Sequence: Synthetic coding sequence
atgcagaccttcgtgacccagcagtggaagcagagcaaggagaagagcaactgcctgcacaacaagaagctgagcgagaagaaggtgaagagccccctgcacctgttcagcaccctgagaagaagccccagctaccccccccccggctgcggcaagagcaagagcaagctgaagagcgagcaggacggcatcagcaagacccacaagctgctgagaagaacctgcagcagcaccgtgaagaccgacgacgtgtgcgtgaccaagagccacagaaccttcggcagaagcctgagcagcgaccccagagccgagcaggccatgaccgccatcaagagccacaagctgctgaacagaccctgccccgccgccgtgaagagcgaggagtgcctgaccctgaagagccacagactgctgaccagaagctgcagcggcgaccccagatgcgagcacaacaccaacctgaagccccacaagctgctgagcagaagctacagcagcaacctgagaatggaggagctgtacggcctgaagaaccacaagctgctgagcaagagctacagcagcgcccccaagagcagcaagaccgagctgttcaaggagcccaacgccgagggcagaagactgagcctgaccagcggcctgatcggcatcctgacccccagcagcagcagcagcagccagctggcccccaacggcgccaagtgcatccccgtgagagacagaggcttcctggtgcagaccatcgagttcgccgagcagagaatccccgtgctgaacgagtactgcgtggtgtgcgacgagccccacgtgttccagaacggccccatgctgagacccaccgtgtgcgagagagagctgtgcgtgttcgccttccagaccctgggcgtgatgaacgaggccgccgacgagatcgccaccggcgcccagaagaagaactacgacagagtgatgaaggccctggacagcatcaccagcatcagagagatgacccaggccccctacctggagatcaagaagcagatggacaagcaggaccccctggcccaccccctgctgcagtgggtgatcagcagcaacagaagccacatcgtgaagctgcccgtgaacagacagctgaagttcatgcacaccccccaccagttcctgctgctgagcagcccccccgccaaggagagcaacttcagagccgccaagaagctgttcggcagcaccttcgccttccacggcagccacatcgagaactggcacagcatcctgagaaacggcctggtggtggccagcaacaccagactgcagctgcacggcgccatgtacggcagcggcatctacctgagccccatgagcagcatcagcttcggctacagcggcatgaacaagaagcagaaggtgagcgccaaggacgagcccgccagcagcagcaagagcagcaacaccagccagaagaccaagaagagaaccgccatccccatccccgccaagccctag

SEQ ID NO: 23302 - DNA, 603 bp, Artificial Sequence
  Description of Artificial Sequence: Synthetic coding sequence
atggccagcctgtacgtgggcgacctgcaccccgaggtgaccgaggccatgctgtacgagaagttcagccccgccggccccatcctgagcatcagaatctgcagagacaagatcaccagaagaagcctgggctacgcctacgtgaactaccagcagcccgtggacgccaagagagccctggagaccctgaacttcgacgtgatcaagggcagacccgtgagaatcatgtggagccagagagaccccagcctgagaaagagcggcgtgggcaacgtgttcatcaagaacctgggcaagaccatcgacaacaaggccctgtacaacatcttcagcgccttcggcaacatcctgagctgcaaggtggcctgcgacgagaagggccccaagggctacggcttcgtgcacttccagaagcaggagagcgccgagagagccatcgacgtgatgaacggcatgttcctgaactacagaaagatcttcgtgggcagattcaagagccacaaggagagagaggccgagagaggcgcctgggccagacagagcaccagcgccgacgtgaaggacttcgaggaggacaccgacgaggaggccaccctgagatag

SEQ ID NO: 23303 - DNA, 603 bp, Artificial Sequence; identical to SEQ ID NO: 23302
  Description of Artificial Sequence: Synthetic coding sequence

SEQ ID NO: 23304 - DNA, 1113 bp, Artificial Sequence
  Description of Artificial Sequence: Synthetic coding sequence
atgaacgtggccgccaagtacagaatggccagcctgtacgtgggcgacctgcacgccgacgtgaccgaggacctgctgttcagaaagttcagcaccgtgggccccgtgctgagcatcagaatctgcagagaccaggtgaccagaagaagcctgggctacgcctacgtgaacttcctgcagctggccgacgcccagaaggccctggacaccatgaacttcgacatcatcaagggcaagagcatcagactgatgtggagccagagagacgcctacctgagaagaagcggcatcggcaacgtgttcatcaagaacctggacaagagcatcgacaacaagaccctgtacgagcacttcagcgccttcggcaagatcctgagcagcaaggtgatgagcgacgaccagggcagcaagggctacgccttcgtgcacttccagaaccagagcgccgccgacagagccatcgaggagatgaacggcaagctgctgaagggctgcaaggtgttcgtgggcagattcaagaacagaaaggacagagaggccgagctgagaagcaaggccagcgagttcaccaacgtgtacatcaagaacttcggcggcgacatggacgacgagagactgaaggacgtgttcagcaagtacggcaagaccctgagcgtgaaggtgatgaccgacagcagcggcaagagcaagggcttcggcttcgtgagcttcgacagccacgaggccgccaagaaggccgtggaggagatgaacggcagagacatcaacggccagctgatcttcgtgggcagagcccagaagaaggtggagagacaggccgagctgaagcagatgttcgagcagctgaagagagagagaatcagaggctgccagggcgtgaagctgtacatcaagaacctggacgacaccatcgacgacgagaagctgagaaacgagttcagcagcttcggcagcatcagcagagtgaaggtgatgcaggaggagggccagagcaagggcttcggcctgatctgcttcagcagccccgaggacgccaccaaggccatgaccgagatgaacggcagaatcctgggcagcaagcccctgagcatcgccctggcccagagacactag

SEQ ID NO: 23305 - DNA, 1287 bp, Artificial Sequence
  Description of Artificial Sequence: Synthetic coding sequence
atgagagtgctgcccgagctgggcgagagctgcctgaacagcatcgcctggcccctgtgcggcgaccccgaggccagcaccctggagcccggccagagctgcgacctggtgagcccccacagagactgcagcaagaacagcagaggccagacccacagcggcaaggacaaggagatgaacgtggccgccaagtacagaatggccagcctgtacgtgggcgacctgcacgccgacgtgaccgaggacctgctgttcagaaagttcagcaccgtgggccccgtgctgagcatcagaatctgcagagaccaggtgaccagaagaagcctgggctacgcctacgtgaacttcctgcagctggccgacgcccagaaggccctggacaccatgaacttcgacatcatcaagggcaagagcatcagactgatgtggagccagagagacgcctacctgagaagaagcggcatcggcaacgtgttcatcaagaacctggacaagagcatcgacaacaagaccctgtacgagcacttcagcgccttcggcaagatcctgagcagcaaggtgatgagcgacgaccagggcagcaagggctacgccttcgtgcacttccagaaccagagcgccgccgacagagccatcgaggagatgaacggcaagctgctgaagggctgcaaggtgttcgtgggcagattcaagaacagaaaggacagagaggccgagctgagaagcaaggccagcgagttcaccaacgtgtacatcaagaacttcggcggcgacatggacgacgagagactgaaggacgtgttcagcaagtacggcaagaccctgagcgtgaaggtgatgaccgacagcagcggcaagagcaagggcttcggcttcgtgagcttcgacagccacgaggccgccaagaaggccgtggaggagatgaacggcagagacatcaacggccagctgatcttcgtgggcagagcccagaagaaggtggagagacaggccgagctgaagcagatgttcgagcagctgaagagagagagaatcagaggctgccagggcgtgaagctgtacatcaagaacctggacgacaccatcgacgacgagaagctgagaaacgagttcagcagcttcggcagcatcagcagagtgaaggtgatgcaggaggagggccagagcaagggcttcggcctgatctgcttcagcagccccgaggacgccaccaaggccatgaccgagatgaacggcagaatcctgggcagcaagcccctgagcatcgccctggcccagagacactag

SEQ ID NO: 23306 - DNA, 762 bp, Artificial Sequence
  Description of Artificial Sequence: Synthetic coding sequence
atgcccctgctgcccagcaccgtgggcctggccggcctgctgttctgggccggccaggccgtgaacgccctgatcatgcccaacgccacccccgcccccgcccagcccgagagcaccgccatgagactgctgagcggcctggaggtgcccagatacagaagaaagagacacatcagcgtgagagacatgaacgccctgctggactaccacaaccacatcagagccagcgtgtacccccccgccgccaacatggagtacatggtgtgggacaagagactggccagagccgccgaggcctgggccacccagtgcatctgggcccacggccccagccagctgatgagatacgtgggccagaacctgagcatccacagcggccagtacagaagcgtggtggacctgatgaagagctggagcgaggagaagtggcactacctgttccccgcccccagagactgcaacccccactgcccctggagatgcgacggccccacctgcagccactacacccagatggtgtgggccagcagcaacagactgggctgcgccatccacacctgcagcagcatcagcgtgtggggcaacacctggcacagagccgcctacctggtgtgcaactacgccatcaagggcaactggatcggcgagagcccctacaagatgggcaagccctgcagcagctgcccccccagctaccagggcagctgcaacagcaacatgtgcttcaagggcctgaagagcaacaagttcacctggttctag

SEQ ID NO: 23307 - DNA, 1845 bp, Artificial Sequence
  Description of Artificial Sequence: Synthetic coding sequence
atgaacgccagcggcagcggctaccccctggccagcctgtacgtgggcgacctgcaccccgacgtgaccgaggccatgctgtacgagaagttcagccccgccggccccatcctgagcatcagagtgtgcagagacgtggccaccagaagaagcctgggctacgcctacatcaacttccagcagcccgccgacgccgagagagccctggacaccatgaacttcgagatgctgaagggccagcccatcagaatcatgtggagccagagagaccccggcctgagaaagagcggcgtgggcaacatcttcatcaagaacctggaggacagcatcgacaacaaggccctgtacgacaccttcagcaccttcggcaacatcctgagctgcaaggtggcctgcgacgagcacggcagcagaggcttcggcttcgtgcacttcgagacccacgaggccgcccagcaggccatcaacaccatgaacggcatgctgctgaacgacagaaaggtgttcgtgggccacttcaagagcagaagagagagagaggccgagctgggcgccagagccctggagttcaccaacatctacgtgaagaacctgcccgtggacgtggacgagcagggcctgcaggacctgttcagccagttcggcaagatgctgagcgtgaaggtgatgagagacaacagcggccacagcagatgcttcggcttcgtgaacttcgagaagcacgaggaggcccagaaggccgtggtgcacatgaacggcaaggaggtgagcggcagactgctgtacgccggcagagcccagaagagagtggagagacagaacgagctgaagagaagattcgagcagatgaagcaggacagactgagaagataccagggcgtgaacctgtacgtgaagaacctggacgacagcatcgacgacgacaagctgagaaaggagttcagcccctacggcgtgatcaccagcgccaaggtgatgaccgagggcggccacagcaagggcttcggcttcgtgtgcttcagcagccccgaggaggccaccaaggccgtgaccgagatgaacggcagaatcgtgggcaccaagcccctgtacgtggccctggcccagagaaaggaggagagaaaggccatcctgaccaaccagtacatgcagagactgagcaccatgagaaccctgagcaaccccctgctgggcagcttccagcagcccagcagctacttcctgcccgccatgccccagccccccgcccaggccgcctactacggctgcggccccgtgacccccacccagcccgcccccagatggaccagccagccccccagacccagctgcgccagcatggtgagaccccccgtggtgcccagaagaccccccgcccacatcagcagcgtgagacaggccagcacccaggtgcccagaaccgtgccccacacccagagagtggccaacatcggcacccagaccaccggccccagcggcgtgggctgctgcacccccggcagacccctgctgccctgcaagtgcagcagcgccgcccacagcacctacagagtgcaggagcccgccgtgcacatccccggccaggagcccctgaccgccagcatgctggccgccgcccccctgcacgagcagaagcagatgatcggcgagagactgtaccccctgatccacgacgtgcacacccagctggccggcaagatcaccggcatgctgctggagatcgacaacagcgagctgctgctgatgctggagagccccgagagcctgcacgccaagatcgacgaggccgtggccgtgctgcaggcccaccaggccatggagcagcccaaggcctacatgcactag

SEQ ID NO: 23308 - DNA, 993 bp, Artificial Sequence
  Description of Artificial Sequence: Synthetic coding sequence
atgaacgccagcggcagcggctaccccctggccagcctgtacgtgggcgacctgcaccccgacgtgaccgaggccatgctgtacgagaagttcagccccgccggccccatcctgagcatcagagtgtgcagagacgtggccaccagaagaagcctgggctacgcctacatcaacttccagcagcccgccgacgccgagagagccctggacaccatgaacttcgagatgctgaagggccagcccatcagaatcatgtggagccagagagaccccggcctgagaaagagcggcgtgggcaacatcttcatcaagaacctggaggacagcatcgacaacaaggccctgtacgacaccttcagcaccttcggcaacatcctgagctgcaaggtggcctgcgacgagcacggcagcagaggcttcggcttcgtgcacttcgagacccacgaggccgcccagcaggccatcaacaccatgaacggcatgctgctgaacgacagaaaggtgttcgtgggccacttcaagagcagaagagagagagaggccgagctgggcgccagagccctggagttcaccaacatctacgtgaagaacctgcccgtggacgtggacgagcagggcctgcaggacctgttcagccagttcggcaagatgctgagcgtgaaggtgatgagagacaacagcggccacagcagatgcttcggcttcgtgaacttcgagaagcacgaggaggcccagaaggccgtggtgcacatgaacggcaaggaggtgagcggcagactgctgtacgccggcagagcccagaagagagtggagagacagaacgagctgaagagaagattcgagcagatgaagcaggacagactgagaagataccagggcgtgaacctgtacgtgaagaacctggacgacagcatcgacgacgacaagctgagaaaggagttcagcccctacggcgtgatcaccagcgccaagaagagaagacagagaccctag

SEQ ID NO: 23309 - DNA, 1845 bp, Artificial Sequence; identical to SEQ ID NO: 23307
  Description of Artificial Sequence: Synthetic coding sequence

SEQ ID NO: 23310 - DNA, 450 bp, Artificial Sequence
  Description of Artificial Sequence: Synthetic coding sequence
atggtgagaccccccgtggtgcccagaagaccccccgcccacatcagcagcgtgagacaggccagcacccaggtgcccagaaccgtgccccacacccagagagtggccaacatcggcacccagaccaccggccccagcggcgtgggctgctgcacccccggcagacccctgctgccctgcaagtgcagcagcgccgcccacagcacctacagagtgcaggagcccgccgtgcacatccccggccaggagcccctgaccgccagcatgctggccgccgcccccctgcacgagcagaagcagatgatcggcgagagactgtaccccctgatccacgacgtgcacacccagctggccggcaagatcaccggcatgctgctggagatcgacaacagcgagctgctgctgatgctggagagccccgagagcctgcacgccaagatcagcgcctag

SEQ ID NO: 23311 - DNA, 582 bp, Artificial Sequence
  Description of Artificial Sequence: Synthetic coding sequence
atggtgagaccccccgtggtgcccagaagaccccccgcccacatcagcagcgtgagacaggccagcacccaggtgcccagaaccgtgccccacacccagagagtggccaacatcggcacccagaccaccggccccagcggcgtgggctgctgcacccccggcagacccctgctgccctgcaagtgcagcagcgccgcccacagcacctacagagtgcaggagcccgccgtgcacatccccggccaggagcccctgaccgccagcatgctggccgccgcccccctgcacgagcagaagcagatgatcggcacctgctacctggtgctgaagagatggagcgactggatggtgctgagcttcctgcccctgctgctgagctgcgacttcgagggcagcgtgagcacccccctgagcatgatgagcacccccagctggctggccagaagcagagcctgctgctggagactgaccacccagagctgctgcagctgctggagcctgcagaaccccagcatgcccagaaagggcaaccccagattccacggctgccagaaggacagcgtgagcggcagccagccctag

SEQ ID NO: 23312 - DNA, 405 bp, Artificial Sequence
  Description of Artificial Sequence: Synthetic coding sequence
tgcaagtgcagcagcgccgcccacagcacctacagagtgcaggagcccgccgtgcacatccccggccaggagcccctgaccgccagcatgctggccgccgcccccctgcacgagcagaagcagatgatcggcacctgctacctggtgctgaagagatggagcgactggatggtgctgagcttcctgcccctgctgctgagctgcgacttcgagggcagcgtgagcacccccctgagcatgatgagcacccccagctggctggccagaagcagagcctgctgctggagactgaccacccagagctgctgcagctgctggagcctgcagaaccccagcatgcccagaaagggcaaccccagattccacggctgccagaaggacagcgtgagcggcagccagccctag

SEQ ID NO: 23313 - DNA, 507 bp, Artificial Sequence
  Description of Artificial Sequence: Synthetic coding sequence
atggtgagaccccccgtggtgcccagaagaccccccgcccacatcagcagcgtgagacaggccagcacccaggtgcccagaaccgtgccccacacccagagagtggccaacatcggcacccagaccaccggccccagcggcgtgggctgctgcacccccggcagacccctgctgccctgcaagtgcagcagcgccgcccacagcacctacagagtgcaggagcccgccgtgcacatccccggccaggagcccctgaccgccagcatgctggccgccgcccccctgcacgagcagaagcagatgatcggcgagagactgtaccccctgatccacgacgtgcacacccagctggccggcaagatcaccggcatgctgctggagatcgacaacagcgagctgctgctgatgctggagagccccgagagcctgcacgccaagatcgacgaggccgtggccgtgctgcaggcccaccaggccatggagcagcccaaggcctacatgcactag

SEQ ID NO: 23314 - DNA, 459 bp, Artificial Sequence
  Description of Artificial Sequence: Synthetic coding sequence
tgacaggccagcacccaggtgcccagaaccgtgccccacacccagagagtggccaacatcggcacccagaccaccggccccagcggcgtgggctgctgcacccccggcagacccctgctgccctgcaagtgcagcagcgccgcccacagcacctacagagtgcaggagcccgccgtgcacatccccggccaggagcccctgaccgccagcatgctggccgccgcccccctgcacgagcagaagcagatgatcggcgagagactgtaccccctgatccacgacgtgcacacccagctggccggcaagatcaccggcatgctgctggagatcgacaacagcgagctgctgctgatgctggagagccccgagagcctgcacgccaaggcccagagaagaaaggtgcagagactggtgaagtacatcctggccctgaaggagctgagcacccagaacctgtag

SEQ ID NO: 23315 - DNA, 513 bp, Artificial Sequence
  Description of Artificial Sequence: Synthetic coding sequence
atggtgagaccccccgtggtgcccagaagaccccccgcccacatcagcagcgtgagacaggccagcacccaggtgcccagaaccgtgccccacacccagagagtggccaacatcggcacccagaccaccggccccagcggcgtgggctgctgcacccccggcagacccctgctgccctgcaagtgcagcagcgccgcccacagcacctacagagtgcaggagcccgccgtgcacatccccggccaggagcccctgaccgccagcatgctggccgccgcccccctgcacgagcagaagcagatgatcggcgagagactgtaccccctgatccacgacgtgcacacccagctggccggcaagatcaccggcatgctgctggagatcgacaacagcgagctgctgctgatgctggagagccccgagagcctgcacgccaaggcccagagaagaaaggtgcagagactggtgaagtacatcctggccctgaaggagctgagcacccagaacctgtag

SEQ ID NO: 23316 - DNA, 993 bp, Artificial Sequence; identical to SEQ ID NO: 23308
  Description of Artificial Sequence: Synthetic coding sequence

SEQ ID NO: 23317 - DNA, 603 bp, Artificial Sequence; identical to SEQ ID NO: 23302
  Description of Artificial Sequence: Synthetic coding sequence

SEQ ID NO: 23318 - DNA, 603 bp, Artificial Sequence; identical to SEQ ID NO: 23302
  Description of Artificial Sequence: Synthetic coding sequence

SEQ ID NO: 23319 - DNA, 603 bp, Artificial Sequence; identical to SEQ ID NO: 23302
  Description of Artificial Sequence: Synthetic coding sequence

SEQ ID NO: 23320 - DNA, 603 bp, Artificial Sequence; identical to SEQ ID NO: 23302
  Description of Artificial Sequence: Synthetic coding sequence

SEQ ID NO: 23321 - DNA, 1134 bp, Artificial Sequence
  Description of Artificial Sequence: Synthetic coding sequence
atgagcggcagcgacggcggcctggaggaggagcccgagctgagcatcaccctgaccctgagaatgctgatgcacggcaaggaggtgggcagcatcatcggcaagaagggcgagaccgtgaagagaatcagagagcagagcagcgccagaatcaccatcagcgagggcagctgccccgagagaatcaccaccatcaccggcagcaccgccgccgtgttccacgccgtgagcatgatcgccttcaagctggacgaggacctgtgcgccgcccccgccaacggcggcaacgtgagcagaccccccgtgaccctgagactggtgatccccgccagccagtgcggcagcctgatcggcaaggccggcaccaagatcaaggagatcagagagaccaccggcgcccaggtgcaggtggccggcgacctgctgcccaacagcaccgagagagccgtgaccgtgagcggcgtgcccgacgccatcatcctgtgcgtgagacagatctgcgccgtgatcctggagagcccccccaagggcgccaccatcccctaccaccccagcctgagcctgggcaccgtgctgctgagcgccaaccagggcttcagcgtgcagggccagtacggcgccgtgacccccgccgaggtgaccaagctgcagcagctgagcagccacgccgtgcccttcgccacccccagcgtggtgcccggcctggaccccggcacccagaccagcagccaggagttcctggtgcccaacgacctgatcggctgcgtgatcggcagacagggcagcaagatcagcgagatcagacagatgagcggcgcccacatcaagatcggcaaccaggccgagggcgccggcgagagacacgtgaccatcaccggcagccccgtgagcatcgccctggcccagtacctgatcaccgcctgcctggagaccgccaagagcaccagcggcggcacccccagcagcgcccccgccgacctgcccgcccccttcagcccccccctgaccgccccccagctgcccctggcctgctgggcccaccccatgcccagccccagccccaccagcagcgcccaggcccacgccctgctgggcttcaccacctgcttccccagagccgccgccggcctgtag

SEQ ID NO: 23322 - DNA, 732 bp, Artificial Sequence
  Description of Artificial Sequence: Synthetic coding sequence
atgatcgccttcaagctggacgaggacctgtgcgccgcccccgccaacggcggcaacgtgagcagaccccccgtgaccctgagactggtgatccccgccagccagtgcggcagcctgatcggcaaggccggcaccaagatcaaggagatcagagaggtgaccaagctgcagcagctgagcagccacgccgtgcccttcgccacccccagcgtggtgcccggcctggaccccggcacccagaccagcagccaggagttcctggtgcccaacgacctgatcggctgcgtgatcggcagacagggcagcaagatcagcgagatcagacagatgagcggcgcccacatcaagatcggcaaccaggccgagggcgccggcgagagacacgtgaccatcaccggcagccccgtgagcatcgccctggcccagtacctgatcaccgcctgcctggagaccgccaagagcaccagcggcggcacccccagcagcgcccccgccgacctgcccgcccccttcagcccccccctgaccgccctgcccaccgccccccccggcctgctgggcaccccctacgccatcagcctgagcaacttcatcggcctgaagcccatgcccttcctggccctgccccccgccagccccggccccccccccggcctggccgcctacaccgccaagatggccgccgccaacggcagcaagaaggccgagagacagaagttcagcccctactag

SEQ ID NO: 23323 - DNA, 1275 bp, Artificial Sequence
  Description of Artificial Sequence: Synthetic coding sequence
atgcccagatgccccgccctgatcctgtacctgcagagcagcgccagaatcaccatcagcgagggcagctgccccgagagaatcaccaccatcaccggcagcaccgccgccgtgttccacgccgtgagcatgatcgccttcaagctggacgaggacctgtgcgccgcccccgccaacggcggcaacgtgagcagaccccccgtgaccctgagactggtgatccccgccagccagtgcggcagcctgatcggcaaggccggcaccaagatcaaggagatcagagaggtgagaggcgagatctaccacccccagggcatcagaggcaagggcgccgtggtgagaggcgtgctgggcctgtggagacccccccacctggagagcagcgagcccggccagcccttcagcggcctgtgggagcagcccgaggtggcccccgtgctgtgcctgcagaccaccggcgcccaggtgcaggtggccggcgacctgctgcccaacagcaccgagagagccgtgaccgtgagcggcgtgcccgacgccatcatcctgtgcgtgagacagatctgcgccgtgatcctggagagcccccccaagggcgccaccatcccctaccaccccagcctgagcctgggcaccgtgctgctgagcgccaaccagggcttcagcgtgcagggccagtacggcgccgtgacccccgccgaggtgaccaagctgcagcagctgagcagccacgccgtgcccttcgccacccccagcgtggtgcccggcctggaccccggcacccagaccagcagccaggagttcctggtgcccaacgacctgatcggctgcgtgatcggcagacagggcagcaagatcagcgagatcagacagatgagcggcgcccacatcaagatcggcaaccaggccgagggcgccggcgagagacacgtgaccatcaccggcagccccgtgagcatcgccctggcccagtacctgatcaccgcctgcctggagaccgccaagagcaccagcggcggcacccccagcagcgcccccgccgacctgcccgcccccttcagcccccccctgaccgccctgcccaccgccccccccggcctgctgggcaccccctacgccatcagcctgagcaacttcatcggcctgaagcccatgcccttcctggccctgccccccgccagccccggccccccccccggcctggccgcctacaccgccaagatggccgccgccaacggcagcaagaaggccgagagacagaagttcagcccctactag

SEQ ID NO: 23324 - DNA, 1083 bp, Artificial Sequence
  Description of Artificial Sequence: Synthetic coding sequence
atgagcggcagcgacggcggcctggaggaggagcccgagctgagcatcaccctgaccctgagaatgctgatgcacggcaaggaggtgggcagcatcatcggcaagaagggcgagaccgtgaagagaatcagagagcagagcagcgccagaatcaccatcagcgagggcagctgccccgagagaatcaccaccatcaccggcagcaccgccgccgtgttccacgccgtgagcatgatcgccttcaagctggacgaggacctgtgcgccgcccccgccaacggcggcaacgtgagcagaccccccgtgaccctgagactggtgatccccgccagccagtgcggcagcctgatcggcaaggccggcaccaagatcaaggagatcagagagagcccccccaagggcgccaccatcccctaccaccccagcctgagcctgggcaccgtgctgctgagcgccaaccagggcttcagcgtgcagggccagtacggcgccgtgacccccgccgaggtgaccaagctgcagcagctgagcagccacgccgtgcccttcgccacccccagcgtggtgcccggcctggaccccggcacccagaccagcagccaggagttcctggtgcccaacgacctgatcggctgcgtgatcggcagacagggcagcaagatcagcgagatcagacagatgagcggcgcccacatcaagatcggcaaccaggccgagggcgccggcgagagacacgtgaccatcaccggcagccccgtgagcatcgccctggcccagtacctgatcaccgcctgcctggagaccgccaagagcaccagcggcggcacccccagcagcgcccccgccgacctgcccgcccccttcagcccccccctgaccgccctgcccaccgccccccccggcctgctgggcaccccctacgccatcagcctgagcaacttcatcggcctgaagcccatgcccttcctggccctgccccccgccagccccggccccccccccggcctggccgcctacaccgccaagatggccgccgccaacggcagcaagaaggccgagagacagaagttcagcccctactag

SEQ ID NO: 23325 - DNA, 141 bp, Artificial Sequence
  Description of Artificial Sequence: Synthetic coding sequence
atgagcggcagcgacggcggcctggaggaggagcccgagctgagcatcaccctgaccctgagaatgctgatgcacggcaaggaggtgggcagcatcatcggcaagaagggcgagaccgtgaagagaatcagagagcagtag

SEQ ID NO: 23326 - DNA, 375 bp, Artificial Sequence
  Description of Artificial Sequence: Synthetic coding sequence
atgagcggcagcgacggcggcctggaggaggagcccgagctgagcatcaccctgaccctgagaatgctgatgcacggcaaggaggtgggcagcatcatcggcaagaagggcgagaccgtgaagagaatcagagagcagagcagcgccagaatcaccatcagcgagggcagctgccccgagagaatcaccaccatcaccggcagcaccgccgccgtgttccacgccgtgagcatgatcgccttcaagctggacgaggacctgtgcgccgcccccgccaacggcggcaacgtgagcagaccccccgtgaccctgagactggtgatccccgccagccagtgcggcagcctgatcggcaaggccggcaccaagatctag

SEQ ID NO: 23327 - DNA, 507 bp, Artificial Sequence
  Description of Artificial Sequence: Synthetic coding sequence
atgagcggcagcgacggcggcctggaggaggagcccgagctgagcatcaccctgaccctgagaatgctgatgcacggcaaggaggtgggcagcatcatcggcaagaagggcgagaccgtgaagagaatcagagagcagagcagcgccagaatcaccatcagcgagggcagctgccccgagagaatcaccaccatcaccggcagcaccgccgccgtgttccacgccgtgagcatgatcgccttcaagctggacgaggacctgtgcgccgcccccgccaacggcggcaacgtgagcagaccccccgtgaccctgagactggtgatccccgccagccagtgcggcagcctgatcggcaaggccggcaccaagatcaaggagatcagagagaccaccggcgcccaggtgcaggtggccggcgacctgctgcccaacagcaccgagagagccgtgaccgtgagcggcgtgcccgacgccatcatcctgtgcgtgagacagatctgcgcctag

SEQ ID NO: 23328 - DNA, 228 bp, Artificial Sequence
  Description of Artificial Sequence: Synthetic coding sequence
atgagcggcagcgacggcggcctggaggaggagcccgagctgagcatcaccctgaccctgagaatgctgatgcacggcaaggaggtgggcagcatcatcggcaagaagggcgagaccgtgaagagaatcagagagcagagcagcgccagaatcaccatcagcgagggcagctgccccgagagaatcaccaccatcaccggcagcaccgccgccgtgttccacgcctag

SEQ ID NO: 23329 - DNA, 1083 bp, Artificial Sequence; identical to SEQ ID NO: 23324
  Description of Artificial Sequence: Synthetic coding sequence

SEQ ID NO: 23330 - DNA, 279 bp, Artificial Sequence
  Description of Artificial Sequence: Synthetic coding sequence
atgagcggcagcgacggcggcctggaggaggagcccgagctgagcatcaccctgaccctgagaatgctgatgcacggcaaggaggtgggcagcatcatcggcaagaagggcgagaccgtgaagagaatcagagagcagagcagcgccagaatcaccatcagcgagggcagctgccccgagagaatcaccaccatcaccggcagcaccgccgccgtgttccacgccgtgagcatgatcgccttcaagctggacgaggacctgtgcgccgcccccgcctag

SEQ ID NO: 23331 - DNA, 261 bp, Artificial Sequence
  Description of Artificial Sequence: Synthetic coding sequence
atgagcggcagcgacggcggcctggaggaggagcccgagctgagcatcaccctgaccctgagaatgctgatgcacggcaaggaggtgggcagcatcatcggcaagaagggcgagaccgtgaagagaatcagagagcagagcagcgccagaatcaccatcagcgagggcagctgccccgagagaatcaccaccatcaccggcagcaccgccgccgtgttccacgccgtgagcatgatcgccttcaagctggacgaggtgtag

SEQ ID NO: 23332 - DNA, 324 bp, Artificial Sequence
  Description of Artificial Sequence: Synthetic coding sequence
atgagcggcagcgacggcggcctggaggaggagcccgagctgagcatcaccctgaccctgagaatgctgatgcacggcaaggaggtgggcagcatcatcggcaagaagggcgagaccgtgaagagaatcagagagcagagcagcgccagaatcaccatcagcgagggcagctgccccgagagaatcaccaccatcaccggcagcaccgccgccgtgttccacgccgtgagcatgatcgccttcaagctggacgaggacctgtgcgccgcccccgccaacggcggcaacgtgagcagaccccccgtgaccctgagactggtgtag

SEQ ID NO: 23333 - DNA, 3024 bp, Artificial Sequence
  Description of Artificial Sequence: Synthetic coding sequence
atgaaggacgaggccggcgagagagacagagaggtgagcagcctgaacagcaagctgctgagcctgcagctggacatcaagaacctgcacgacgtgtgcaagagacagagaaagaccctgcaggacaaccagctgtgcatggaggaggccatgaacagcagccacgacaagaagcaggcccaggccctggccttcgaggagagcgaggtggagttcggcagcagcaagcagtgccacctgagacagctgcagcagctgaagaagaagctgctggtgctgcagcaggagctggagttccacaccgaggagctgcagaccagctactacagcctgagacagtaccagagcatcctggagaagcagaccagcgacctggtgctgctgcaccaccactgcaagctgaaggaggacgaggtgatcctgtacgaggaggagatgggcaaccacaacgagaacaccggcgagaagctgcacctggcccaggagcagctggccctggccggcgacaagatcgccagcctggagagaagcctgaacctgtacagagacaagtaccagagcagcctgagcaacatcgagctgctggagtgccaggtgaagatgctgcagggcgagctgggcggcatcatgggccaggagcccgagaacaagggcgaccacagcaaggtgagaatctacaccagcccctgcatgatccaggagcaccaggagacccagaagagactgagcgaggtgtggcagaaggtgagccagcaggacgacctgatccaggagctgagaaacaagctggcctgcagcaacgccctggtgctggagagagagaaggccctgatcaagctgcaggccgacttcgccagctgcaccgccacccacagatacccccccagcagcagcgaggagtgcgaggacatcaagaagatcctgaagcacctgcaggagcagaaggacagccagtgcctgcacgtggaggagtaccagaacctggtgaaggacctgagagtggagctggaggccgtgagcgagcagaagagaaacatcatgaaggacatgatgaagctggagctggacctgcacggcctgagagaggagaccagcgcccacatcgagagaaaggacaaggacatcaccatcctgcagtgcagactgcaggagctgcagctggagttcaccgagacccagaagctgaccctgaagaaggacaagttcctgcaggagaaggacgagatgctgcaggagctggagaagaagctgacccaggtgcagaacagcctgctgaagaaggagaaggagctggagaagcagcagtgcatggccaccgagctggagatgaccgtgaaggaggccaagcaggacaagagcaaggaggccgagtgcaaggccctgcaggccgaggtgcagaagctgaagaacagcctggaggaggccaagcagcaggagagactggccgcccagcaggccgcccagtgcaaggaggaggccgccctggccggctgccacctggaggacacccagagaaagctgcagaagggcctgctgctggacaagcagaaggccgacaccatccaggagctgcagagagagctgcagatgctgcagaaggagagcagcatggccgagaaggagcagaccagcaacagaaagagagtggaggagctgagcctggagctgagcgaggccctgagaaagctggagaacagcgacaaggagaagagacagctgcagaagaccgtggccgagcaggacatgaagatgaacgacatgctggacagaatcaagcaccagcacagagagcagggcagcatcaagtgcaagctggaggaggacctgcaggaggccaccaagctgctggaggacaagagagagcagctgaagaagagcaaggagcacgagaagctgatggagggcgagctggaggccctgagacaggagttcaagaagaaggacaagaccctgaaggagaacagcagaaagctggaggaggagaacgagaacctgagagccgagctgcagtgctgcagcacccagctggagagcagcctgaacaagtacaacaccagccagcaggtgatccaggacctgaacaaggagatcgccctgcagaaggagagcctgatgagcctgcaggcccagctggacaaggccctgcagaaggagaagcactacctgcagaccaccatcaccaaggaggcctacgacgccctgagcagaaagagcgccgcctgccaggacgacctgacccaggccctggagaagctgaaccacgtgaccagcgagaccaagagcctgcagcagagcctgacccagacccaggagaagaaggcccagctggaggaggagatcatcgcctacgaggagagaatgaagaagctgaacaccgagctgagaaagctgagaggcttccaccaggagagcgagctggaggtgcacgccttcgacaagaagctggaggagatgagctgccaggtgctgcagtggcagaagcagcaccagaacgacctgaagatgctggccgccaaggaggagcagctgagagagttccaggaggagatggccgccctgaaggagaacctgctggaggacgacaaggagccctgctgcctgccccagtggagcgtgcccaaggacacctgcagactgtacagaggcaacgaccagatcatgaccaacctggagcagtgggccaagcagcagaaggtggccaacgagaagctgggcaaccagctgagagagcaggtgaagtacatcgccaagctgagcggcgagaaggaccacctgcacagcgtgatggtgcacctgcagcaggagaacaagaagctgaagaaggagatcgaggagaagaagatgaaggccgagaacaccagactgtgcaccaaggccctgggccccagcagaaccgagagcacccagagagagaaggtgtgcggcaccctgggctggaagggcctgccccaggacatgggccagagaatggacctgaccaagtacatcggcatgccccactgccccggcagcagctactgctag

SEQ ID NO: 23334 - DNA, 2649 bp, Artificial Sequence
  Description of Artificial Sequence: Synthetic coding sequence
atgggcaaccacaacgagaacaccggcgagaagctgcacctggcccaggagcagctggccctggccggcgacaagatcgccagcctggagagaagcctgaacctgtacagagacaagtaccagagcagcctgagcaacatcgagctgctggagtgccaggtgaagatgctgcagggcgagctgggcggcatcatgggccaggagcccgagaacaagggcgaccacagcaaggtgagaatctacaccagcccctgcatgatccaggagcaccaggagacccagaagagactgagcgaggtgtggcagaaggtgagccagcaggacgacctgatccaggagctgagaaacaagctggcctgcagcaacgccctggtgctggagagagagaaggccctgatcaagctgcaggccgacttcgccagctgcaccgccacccacagatacccccccagcagcagcgaggagtgcgaggacatcaagaagatcctgaagcacctgcaggagcagaaggacagccagtgcctgcacgtggaggagtaccagaacctggtgaaggacctgagagtggagctggaggccgtgagcgagcagaagagaaacatcatgaaggacatgatgaagctggagctggacctgcacggcctgagagaggagaccagcgcccacatcgagagaaaggacaaggacatcaccatcctgcagtgcagactgcaggagctgcagctggagttcaccgagacccagaagctgaccctgaagaaggacaagttcctgcaggagaaggacgagatgctgcaggagctggagaagaagctgacccaggtgcagaacagcctgctgaagaaggagaaggagctggagaagcagcagtgcatggccaccgagctggagatgaccgtgaaggaggccaagcaggacaagagcaaggaggccgagtgcaaggccctgcaggccgaggtgcagaagctgaagaacagcctggaggaggccaagcagcaggagagactggccgcccagcaggccgcccagtgcaaggaggaggccgccctggccggctgccacctggaggacacccagagaaagctgcagaagggcctgctgctggacaagcagaaggccgacaccatccaggagctgcagagagagctgcagatgctgcagaaggagagcagcatggccgagaaggagcagaccagcaacagaaagagagtggaggagctgagcctggagctgagcgaggccctgagaaagctggagaacagcgacaaggagaagagacagctgcagaagaccgtggccgagcaggacatgaagatgaacgacatgctggacagaatcaagcaccagcacagagagcagggcagcatcaagtgcaagctggaggaggacctgcaggaggccaccaagctgctggaggacaagagagagcagctgaagaagagcaaggagcacgagaagctgatggagggcgagctggaggccctgagacaggagttcaagaagaaggacaagaccctgaaggagaacagcagaaagctggaggaggagaacgagaacctgagagccgagctgcagtgctgcagcacccagctggagagcagcctgaacaagtacaacaccagccagcaggtgatccaggacctgaacaaggagatcgccctgcagaaggagagcctgatgagcctgcaggcccagctggacaaggccctgcagaaggagaagcactacctgcagaccaccatcaccaaggaggcctacgacgccctgagcagaaagagcgccgcctgccaggacgacctgacccaggccctggagaagctgaaccacgtgaccagcgagaccaagagcctgcagcagagcctgacccagacccaggagaagaaggcccagctggaggaggagatcatcgcctacgaggagagaatgaagaagctgaacaccgagctgagaaagctgagaggcttccaccaggagagcgagctggaggtgcacgccttcgacaagaagctggaggagatgagctgccaggtgctgcagtggcagaagcagcaccagaacgacctgaagatgctggccgccaaggaggagcagctgagagagttccaggaggagatggccgccctgaaggagaacctgctggaggacgacaaggagccctgctgcctgccccagtggagcgtgcccaaggacacctgcagactgtacagaggcaacgaccagatcatgaccaacctggagcagtgggccaagcagcagaaggtggccaacgagaagctgggcaaccagctgagagagcaggtgaagtacatcgccaagctgagcggcgagaaggacagagagcccaccagagccagcagccccaacaccaccagacccagcagccccagccacagccacctgcacagcgtgatggtgcacctgcagcaggagaacaagaagctgaagaaggagatcgaggagaagaagatgaaggccgagaacaccagactgtgcaccaaggccctgggccccagcagaaccgagagcacccagagagagaaggtgtgcggcaccctgggctggaagggcctgccccaggacatgggccagagaatggacctgaccaagtacatcggcatgccccactgccccggcagcagctactgctag

SEQ ID NO: 23335 - DNA, 474 bp, Artificial Sequence
  Description of Artificial Sequence: Synthetic coding sequence
atgaaggacgaggccggcgagagagacagagaggtgagcagcctgaacagcaagctgctgagcctgcagctggacatcaagaacctgcacgacgtgtgcaagagacagagaaagaccctgcaggacaaccagctgtgcatggaggaggccatgaacagcagccacgacaagaagcaggcccaggccctggccttcgaggagagcgaggtggagttcggcagcagcaagcagtgccacctgagacagctgcagcagctgaagaagaagctgctggtgctgcagcaggagctggagttccacaccgaggagctgcagaccagctactacagcctgagacagtaccagagcatcctggagaagcagaccagcgacctggtgctgctgcaccaccactgcaagctgaaggaggacgaggtgatcctgtacgaggaggagatgggcaaccacaacgagaacaccggcgagaagctgtag

SEQ ID NO: 23336 - DNA, 207 bp, Artificial Sequence
  Description of Artificial Sequence: Synthetic coding sequence
atgaaggacgaggccggcgagagagacagagaggtgagcagcctgaacagcaagctgctgagcctgcagctggacatcaagaacctgcacgacgtgtgcaagagacagagaaagaccctgcaggacaaccagctgtgcatggaggaggccatgaacagcagccacgacaagaagcaggcccaggccctggccttcgaggagagctag

SEQ ID NO: 23337 - DNA, 3069 bp, Artificial Sequence
  Description of Artificial Sequence: Synthetic coding sequence
atgaaggacgaggccggcgagagagacagagaggtgagcagcctgaacagcaagctgctgagcctgcagctggacatcaagaacctgcacgacgtgtgcaagagacagagaaagaccctgcaggacaaccagctgtgcatggaggaggccatgaacagcagccacgacaagaagcaggcccaggccctggccttcgaggagagcgaggtggagttcggcagcagcaagcagtgccacctgagacagctgcagcagctgaagaagaagctgctggtgctgcagcaggagctggagttccacaccgaggagctgcagaccagctactacagcctgagacagtaccagagcatcctggagaagcagaccagcgacctggtgctgctgcaccaccactgcaagctgaaggaggacgaggtgatcctgtacgaggaggagatgggcaaccacaacgagaacaccggcgagaagctgcacctggcccaggagcagctggccctggccggcgacaagatcgccagcctggagagaagcctgaacctgtacagagacaagtaccagagcagcctgagcaacatcgagctgctggagtgccaggtgaagatgctgcagggcgagctgggcggcatcatgggccaggagcccgagaacaagggcgaccacagcaaggtgagaatctacaccagcccctgcatgatccaggagcaccaggagacccagaagagactgagcgaggtgtggcagaaggtgagccagcaggacgacctgatccaggagctgagaaacaagctggcctgcagcaacgccctggtgctggagagagagaaggccctgatcaagctgcaggccgacttcgccagctgcaccgccacccacagatacccccccagcagcagcgaggagtgcgaggacatcaagaagatcctgaagcacctgcaggagcagaaggacagccagtgcctgcacgtggaggagtaccagaacctggtgaaggacctgagagtggagctggaggccgtgagcgagcagaagagaaacatcatgaaggacatgatgaagctggagctggacctgcacggcctgagagaggagaccagcgcccacatcgagagaaaggacaaggacatcaccatcctgcagtgcagactgcaggagctgcagctggagttcaccgagacccagaagctgaccctgaagaaggacaagttcctgcaggagaaggacgagatgctgcaggagctggagaagaagctgacccaggtgcagaacagcctgctgaagaaggagaaggagctggagaagcagcagtgcatggccaccgagctggagatgaccgtgaaggaggccaagcaggacaagagcaaggaggccgagtgcaaggccctgcaggccgaggtgcagaagctgaagaacagcctggaggaggccaagcagcaggagagactggccggcgaggcccccgccgcccagcaggccgcccagtgcaaggaggaggccgccctggccggctgccacctggaggacacccagagaaagctgcagaagggcctgctgctggacaagcagaaggccgacaccatccaggagctgcagagagagctgcagatgctgcagaaggagagcagcatggccgagaaggagcagaccagcaacagaaagagagtggaggagctgagcctggagctgagcgaggccctgagaaagctggagaacagcgacaaggagaagagacagctgcagaagaccgtggccgagcaggacatgaagatgaacgacatgctggacagaatcaagcaccagcacagagagcagggcagcatcaagtgcaagctggaggaggacctgcaggaggccaccaagctgctggaggacaagagagagcagctgaagaagagcaaggagcacgagaagctgatggagggcgagctggaggccctgagacaggagttcaagaagaaggacaagaccctgaaggagaacagcagaaagctggaggaggagaacgagaacctgagagccgagctgcagtgctgcagcacccagctggagagcagcctgaacaagtacaacaccagccagcaggtgatccaggacctgaacaaggagatcgccctgcagaaggagagcctgatgagcctgcaggcccagctggacaaggccctgcagaaggagaagcactacctgcagaccaccatcaccaaggaggcctacgacgccctgagcagaaagagcgccgcctgccaggacgacctgacccaggccctggagaagctgaaccacgtgaccagcgagaccaagagcctgcagcagagcctgacccagacccaggagaagaaggcccagctggaggaggagatcatcgcctacgaggagagaatgaagaagctgaacaccgagctgagaaagctgagaggcttccaccaggagagcgagctggaggtgcacgccttcgacaagaagctggaggagatgagctgccaggtgctgcagtggcagaagcagcaccagaacgacctgaagatgctggccgccaaggaggagcagctgagagagttccaggaggagatggccgccctgaaggagaacctgctggaggacgacaaggagccctgctgcctgccccagtggagcgtgcccaaggacacctgcagactgtacagaggcaacgaccagatcatgaccaacctggagcagtgggccaagcagcagaaggtggccaacgagaagctgggcaaccagctgagagagcaggtgaagtacatcgccaagctgagcggcgagaaggaccacctgcacagcgtgatggtgcacctgcagcaggagaacaagaagctgaagaaggagatcgaggagaagaagatgaaggccgagaacaccagactgtgcaccaaggccctgggccccagcagaaccgagagcacccagagagagaaggtgtgcggcaccctgggctggaagggcctgccccaggacatgggccagagaatggacctgaccaagtacatcggcatgccccactgccccggcaccagcgccatctgccagaagaacaagtgcgacttcttcctgtag

SEQ ID NO: 23338 - DNA, 333 bp, Artificial Sequence
  Description of Artificial Sequence: Synthetic coding sequence
atgaaggacgaggccggcgagagagacagagaggtgagcagcctgaacagcaagctgctgagcctgcagctggacatcaagaacctgcacgacgtgtgcaagagacagagaaagaccctgcaggacaaccagctgtgcatggaggaggccatgaacagcagccacgacaagaagcaggcccaggccctggccttcgaggagagcgaggtggagttcggcagcagcaagcagtgccacctgagacagctgcagcagctgaagaagaagctgctggtgctgcagcaggagctggagttccacaccgaggagctgcagaccagctactacagctag

SEQ ID NO: 23339 - DNA, 144 bp, Artificial Sequence
  Description of Artificial Sequence: Synthetic coding sequence
atgaaggacgaggccggcgagagagacagagaggtgagcagcctgaacagcaagctgctgagcctgcagctggacatcaagaacctgcacgacgtgtgcaagagacagagaaagaccctgcaggacaaccagctgtgcatgtag

SEQ ID NO: 23340 - DNA, 1536 bp, Artificial Sequence
  Description of Artificial Sequence: Synthetic coding sequence
atggagagcaccggcagcgtgggcgaggcccccggcggccccagagtgctggtggtgggcggcggcatcgccggcctgggcgccgcccagagactgtgcggccacagcgccttcccccacctgagagtgctggaggccaccgccagagccggcggcagaatcagaagcgagagatgcttcggcggcgtggtggaggtgggcgcccactggatccacggccccagcagaggcaaccccgtgttccagctggccgccgagtacggcctgctgggcgagaaggagctgagccaggagaaccagctggtggagaccggcggccacgtgggcctgcccagcgtgagctacgccagcagcggcgccagcgtgagcctgcagctggtggccgagatggccaccctgttctacggcctgatcgaccagaccagagagttcctgcacgccgccgagacccccgtgcccagcgtgggcgagtacctgaagaaggagatcggccagcacgtggccggctggaccgaggacgaggagaccagaaagctgaagctggccgtgctgaacagcttcttcaacctggagtgctgcgtgagcggcacccacagcatggacctggtggccctggcccccttcggcgagtacaccgtgctgcccggcctggactgcaccttcagcaagggctaccagggcctgaccaactgcatgatggccgccctgcccgaggacaccgtggtgttcgagaagcccgtgaagaccatccactggaacggcagcttccaggaggccgccttccccggcgagaccttccccgtgagcgtggagtgcgaggacggcgacagattccccgcccaccacgtgatcgtgaccgtgcccctgggcttcctgagagagcacctggacaccttcttcgacccccccctgcccgccgagaaggccgaggccatcagaaagatcggcttcggcaccaacaacaagatcttcctggagttcgaggagcccttctgggagcccgactgccagctgatccagctggtgtgggaggacaccagccccctggaggacgccgcccccgagctgcaggacgcctggttcagaaagctgatcggcttcgtggtgctgcccgccttcgccagcgtgcacgtgctgtgcggcttcatcgccggcctggagagcgagttcatggagaccctgagcgacgaggaggtgctgctgtgcctgacccaggtgctgagaagagtgaccggcaaccccagactgcccgcccccaagagcgtgctgagaagcagatggcacagcgccccctacaccagaggcagctacagctacgtggccgtgggcagcaccggcggcgacctggacctgctggcccagcccctgcccgccgacggcgccggcgcccagctgcagatcctgttcgccggcgaggccacccacagaaccttctacagcaccacccacggcgccctgctgagcggctggagagaggccgacagactgctgagcctgtgggccccccaggtgcagcagcccagacccagactgtag

SEQ ID NO: 23341 - DNA, 1461 bp, Artificial Sequence
  Description of Artificial Sequence: Synthetic coding sequence
atggagagcaccggcagcgtgggcgaggcccccggcggccccagagtgctggtggtgggcggcggcatcgccggcctgggcgccgcccagagactgtgcggccacagcgccttcccccacctgagagtgctggaggccaccgccagagccggcggcagaatcagaagcgagagatgcttcggcggcgtggtggaggtgggcgcccactggatccacggccccagcagaggcaaccccgtgttccagctggccgccgagtacggcctgctgggcgagaaggagctgagccaggagaaccagctggtggagaccggcggccacgtgggcctgcccagcgtgagctacgccagcagcggcgccagcgtgagcctgcagctggtggccgagatggccaccctgttctacggcctgatcgaccagaccagagagttcctgcacgccgccgagacccccgtgcccagcgtgggcgagtacctgaagaaggagatcggccagcacgtggccggctggaccgaggacgaggagaccagaaagctgaagctggccgtgctgaacagcttcttcaacctggagtgctgcgtgagcggcacccacagcatggacctggtggccctggcccccttcggcgagtacaccgtgctgcccggcctggactgcaccttcagcaagggctaccagggcctgaccaactgcatgatggccgccctgcccgaggacaccgtggtgttcgagaagcccgtgaagaccatccactggaacggcagcttccaggaggccgccttccccggcgagaccttccccgtgagcgtggagtgcgaggacggcgacagattccccgcccaccacgtgatcgtgaccgtgcccctgggcttcctgagagagcacctggacaccttcttcgacccccccctgcccgccgagaaggccgaggccatcagaaagatcggcttcggcaccaacaacaagatcttcctggagttcgaggagcccttctgggagcccgactgccagctgatccagctggtgtgggaggacaccagccccctggaggacgccgcccccgagctgcaggacgcctggttcagaaagctgatcggcttcgtggtgctgcccgccttcgccagcgtgcacgtgctgtgcggcttcatcgccggcctggagagcgagttcatggagaccctgagcgacgaggaggtgctgctgtgcctgacccaggtgctgagaagagtgaccgcccccgaccccgtgtgcggcggcagccacaccagccacgtgctgctgcacgacgccagaggcagcgccgtgggcatggagggcggcagaccccccccccagagcgtgggccccgccggcgccgccgcccaggcccaggccctggccggccccagcctgctgtgcagcaccagagtgggcggcagactgggccccagcttcctgctgaccgacttcagcctggcctag

SEQ ID NO: 23342 - DNA, 342 bp, Artificial Sequence
  Description of Artificial Sequence: Synthetic coding sequence
atggccaccctgttctacggcctgatcgaccagaccagagagttcctgcacgccgccgagacccccgtgcccagcgtgggcgagtacctgaagaaggagatcggccagcacgtggccggctggaccgaggacgaggagaccagaaagctgaagctggccgtgctgaacagcttcttcaacctggagtgctgcgtgagcggcacccacagaagaaccggcctgtgctgcagagacggcggcagacccaccgccagcagcgtgtgcggccccagaagatgcagcagccccggccccggcagcagctgggcccagcccaccctgttccacccctgcagaggctag

SEQ ID NO: 23343 - DNA, 699 bp, Artificial Sequence
  Description of Artificial Sequence: Synthetic coding sequence
atggagagcaccggcagcgtgggcgaggcccccggcggccccagagtgctggtggtgggcggcggcatcgccggcctgggcgccgcccagagactgtgcggccacagcgccttcccccacctgagagtgctggaggccaccgccagagccggcggcagaatcagaagcgagagatgcttcggcggcgtggtggaggtgggcgcccactggatccacgccgcccccgagctgcaggacgcctggttcagaaagctgatcggcttcgtggtgctgcccgccttcgccagcgtgcacgtgctgtgcggcttcatcgccggcctggagagcgagttcatggagaccctgagcgacgaggaggtgctgctgtgcctgacccaggtgctgagaagagtgaccggcaaccccagactgcccgcccccaagagcgtgctgagaagcagatggcacagcgccccctacaccagaggcagctacagctacgtggccgtgggcagcaccggcggcgacctggacctgctggcccagcccctgcccgccgacggcgccggcgcccagctgcagatcctgttcgccggcgaggccacccacagaaccttctacagcaccacccacggcgccctgctgagcggctggagagaggccgacagactgctgagcctgtgggccccccaggtgcagcagcccagacccagactgtag

SEQ ID NO: 23344 - DNA, 210 bp, Artificial Sequence
  Description of Artificial Sequence: Synthetic coding sequence
atggagagcaccggcagcgtgggcgaggcccccggcggccccagagtgctggtggtgggcggcggcatcgccggcctgggcgccgcccagagactgtgcggccacagcgccttcccccacctgagagtgctggaggccaccgccagagccggcggcagaatcagaagcgagagatgcttcggcgccatcaaggacagccagaccgcctag

SEQ ID NO: 23345 - DNA, 1392 bp, Artificial Sequence
  Description of Artificial Sequence: Synthetic coding sequence
atggagagcaccggcagcgtgggcgaggcccccggcggccccagagtgctggtggtgggcggcggcatcgccggcctgggcgccgcccagagactgtgcggccacagcgccttcccccacctgagagtgctggaggccaccgccagagccggcggcagaatcagaagcgagagatgcttcggcggcgtggtggaggtgggcgcccactggatccacggccccagcagaggcaaccccgtgttccagctggccgccgagtacggcctgctgggcgagaaggagctgagccaggagaaccagctggtggagaccggcggccacgtgggcctgcccagcgtgagctacgccagcagcggcgccagcgtgagcctgcagctggtggccgagatggccaccctgttctacggcctgatcgaccagaccagagagttcctgcacgccgccgagacccccgtgcccagcgtgggcgagtacctgaagaaggagatcggccagcacgtggccggctggaccgaggacgaggagaccagaaagctgaagctggccgtgctgaacagcttcttcaacctggagtgctgcgtgagcggcacccacagcatggacctggtggccctggcccccttcggcgagtacaccgtgctgcccggcctggactgcaccttcagcaagggctaccagggcctgaccaactgcatgatggccgccctgcccgaggacaccgtggtgttcgagaagcccgtgaagaccatccactggaacggcagcttccaggaggccgccttccccggcgagaccttccccgtgagcgtggagtgcgaggacggcgacagattccccgcccaccacgtgatcgtgaccgtgcccctgggcttcctgagagagcacctggacaccagccccctggaggacgccgcccccgagctgcaggacgcctggttcagaaagctgatcggcttcgtggtgctgcccgccttcgccagcgtgcacgtgctgtgcggcttcatcgccggcctggagagcgagttcatggagaccctgagcgacgaggaggtgctgctgtgcctgacccaggtgctgagaagagtgaccggcaaccccagactgcccgcccccaagagcgtgctgagaagcagatggcacagcgccccctacaccagaggcagctacagctacgtggccgtgggcagcaccggcggcgacctggacctgctggcccagcccctgcccgccgacggcgccggcgcccagctgcagatcctgttcgccggcgaggccacccacagaaccttctacagcaccacccacggcgccctgctgagcggctggagagaggccgacagactgctgagcctgtgggccccccaggtgcagcagcccagacccagactgtag

SEQ ID NO: 23346 - DNA, 252 bp, Artificial Sequence
  Description of Artificial Sequence: Synthetic coding sequence
atggagagcaccggcagcgtgggcgaggcccccggcggccccagagtgctggtggtgggcggcggcatcagcagaagctgcctgagaggcaagccccacatcgccagattcacccccagaagaaccggcctgtgctgcagagacggcggcagacccaccgccagcagcgtgtgcggccccagaagatgcagcagccccggccccggcagcagctgggcccagcccaccctgttccacccctgcagaggctag

SEQ ID NO: 23347 - DNA, 978 bp, Artificial Sequence
  Description of Artificial Sequence: Synthetic coding sequence
atggagagcaccggcagcgtgggcgaggcccccggcggccccagagtgctggtggtgggcggcggcatcgccggcctgggcgccgcccagagactgtgcggccacagcgccttcccccacctgagagtgctggaggccaccgccagagccggcggcagaatcagaagcgagagatgcttcggcggcgtggtggaggtgggcgcccactggatccacggccccagcagaggcaaccccgtgttccagctggccgccgagtacggcctgctgggcgagaaggagctgagccaggagaaccagctggtggagaccggcggccacgtgggcctgcccagcgtgagctacgccagcagcggcgccagcgtgagcctgcagctggtggccgagatggccaccctgttctacggcctgatcgaccagaccagagagttcctgcacgccgccgagacccccgtgcccagcgtgggcgagtacctgaagaaggagatcggccagcacgtggccggctggaccgaggacgaggagaccagaaagctgaagctggccgtgctgaacagcttcttcaacctggagtgctgcgtgagcggcacccacagcatggacctggtggccctggcccccttcggcgagtacaccgtgctgcccggcctggactgcaccttcagcaagggctaccagggcctgaccaactgcatgatggccgccctgcccgaggacaccgtggtgttcgagaagcccgtgaagaccatccactggaacggcagcttccaggaggccgccttccccggcgagaccttccccgtgagcgtggagtgcgaggacggcgacagattccccgcccaccacgtgatcgtgaccgtgcccctgggcctgagcaccttcagcgtgggcagcctgcccgacctgagcctgagcagctggagactgtgcagaatgaagaagtacttctgcgtgagccccaagtgcagcggcgagtag

SEQ ID NO: 23348 - DNA, 132 bp, Artificial Sequence
  Description of Artificial Sequence: Synthetic coding sequence
atggagagcaccggcagcgtgggcgaggcccccggcggcagacacggccccagaagaggcccccaccccctgggcgccctgctgagatggagaggcggcggcggcagagccctggacccctgctgcccctag

SEQ ID NO: 23349 - DNA, 2976 bp, Artificial Sequence
  Description of Artificial Sequence: Synthetic coding sequence
atgagcgccgtgggcctggtgctgctggtgctggccctgagactgagagccaccaccgtgaagcccgaggagggcagcttctgcagcaacagccaggtggccttcagagacgcctgctacgagttcgtgcccctgggcagaaccttcagagacgcccagagctggtgcgagggccagggcggccacctggtgttcatccaggacgagggcacccagtggttcctgcagaagcacatcagccaggacagagagtggtggatcggcctgacctggaacctggccagaaacggcaccaccgagggccccggcacctggctggacaccagcaacgtgacctacagcaactggcacggcggccaggccgccgccgcccccgacacctgcggccacatcggcagaggccccagcagcgagtgggtgaccagcgactgcgcccagaccttcgccttcatgtgcgagttcagagtgggccagagcctggcctgcgagggcctgaacgccaccgtgcactgcggcctgggccaggtgatccaggtgcaggacgccgtgtacggcagacagaacccccacttctgcacccaggacgccggcagacccagcgacctggagcagggctgcagctgggccaacgtgaaggaggaggtggccggccagtgccaggagctgcagagctgccaggtggccgccgacgagacctacttcggcaacctgtgccccacccagggcagctacctgtgggtgcagtaccagtgcagagaggccctgcagctgatggtgagcagcgagagcttcatcttcgacaacgtgaccatcagcctgacctggctgctgagcccctacatcggcaacctgagctgcatcatcagcaccggcgacagccacaccttcgacccctacaacccccccagcgtgagcagcaacgtgacccaccagttcaccagccccggcgagttcaccgtgttcgccgagtgcaccaccagcgagtggcacgtgaccgcccagagacaggtgaccgtgagagacaagatggagaccctgagcgtgaccgcctgcagcggcctgagccagagcggcgccggccccctgtgccaggccgtgttcggcgaccccctgtggatccaggtggagctggacggcggcaccggcgtgacctacaccgtgctgctgggcgacatcaccctggccgagagcaccacccagaagggcagcctgccctacaacctgatcctggacagagagacccagaagctgatgggccccggcagacacagactggagatccaggccaccggcaacaccaccaccagcaccatcagcagaaacatcaccgtgcacctggtggagctgctgagcggcctgcaggccagctgggccagcgaccacctggagctgggccaggacctgctgatcaccatcagcctggcccagggcacccccgaggagctgaccttcgaggtggccggcctgaacgccaccttcagccacgagcaggtgagcttcggcgagcccttcggcatctgcagactggccgtgcccgtggagggcaccttcctggtgaccatgctggtgagaaacgccttcagcaacctgagcctggagatcggcaacatcaccatcaccgcccccagcggcctgcaggagcccagcggcatgaacgccgagggcaagagcaaggacaagggcgacatggaggtgtacatccagcccggcccctacgtggaccccttcaccaccgtgaccctgggctggcccgacaacgacaaggagctgagattccagtggagctgcggcagctgctgggccctgtggagcagctgcgtggagagacagctgctgagaaccgaccagagagagctggtggtgcccgccagctgcctgcccccccccgacagcgccgtgaccctgagactggccgtgctgagaggccaggagctggagaacagagccgagcagtgcctgtacgtgagcgccccctgggagctgagacccagagtgagctgcgagagaaactgcagacccgtgaacgccagcaaggacatcctgctgagagtgaccatgggcgaggacagccccgtggccatgttcagctggtacctggacaacacccccaccgagcaggccgagcccctgctggacgcctgcagactgagaggcttctggcccagaagcctgaccctgctgcagagcaacaccagcaccctgctgctgaacagcagcttcctgcagagcagaggcgaggtgatcagaatcagagccaccgccctgaccagacacgcctacggcgaggacacctacgtgatcagcaccgtgccccccagagaggtgcccgcctgcaccatcgcccccgaggagggcaccgtgctgaccagcttcgccatcttctgcaacgccagcaccgccctgggccccctggagttctgcttctgcctggagagcggcagctgcctgcactgcggccccgagcccgccctgcccagcgtgtacctgcccctgggcgaggagaacaacgacttcgtgctgaccgtggtgatcagcgccaccaacagagccggcgacacccagcagacccaggccatggccaaggtggccctgggcgacacctgcgtggaggacgtggccttccaggccgccgtgagcgagaagatccccaccgccctgcagggcgagggcggccccgagcagctgctgcagctggccaaggccgtgagcagcatgctgaaccaggagcacgagagccagggcagcggccagagcctgagcatcgacgtgagacagaaggtgagagagcacgtgctgggcagcctgagcgccgtgaccaccggcctggaggacgtgcagagagtgcaggagctggccgaggtgctgagagaggtgacctgcagaagcaaggagctgacccccagcgcccagggcagctgcatgggcgacagctgggagggcgccccccccgccgcccacgtgagccacgccagatag

SEQ ID NO: 23350 - DNA, 1560 bp, Artificial Sequence
  Description of Artificial Sequence: Synthetic coding sequence
tgactggcccagggcacccccgaggagctgaccttcgaggtggccggcctgaacgccaccttcagccacgagcaggtgagcttcggcgagcccttcggcatctgcagactggccgtgcccgtggagggcaccttcctggtgaccatgctggtgagaaacgccttcagcaacctgagcctggagatcggcaacatcaccatcaccgcccccagcggcctgcaggagcccagcggcatgaacgccgagggcaagagcaaggacaagggcgacatggaggtgtacatccagcccggcccctacgtggaccccttcaccaccgtgaccctgggctggcccgacaacgacaaggagctgagattccagtggagctgcggcagctgctgggccctgtggagcagctgcgtggagagacagctgctgagaaccgaccagagagagctggtggtgcccgccagctgcctgcccccccccgacagcgccgtgaccctgagactggccgtgctgagaggccaggagctggagaacagagccgagcagtgcctgtacgtgagcgccccctgggagctgagacccagagtgagctgcgagagaaactgcagacccgtgaacgccagcaaggacatcctgctgagagtgaccatgggcgaggacagccccgtggccatgttcagctggtacctggacaacacccccaccgagcaggccgagcccctgctggacgcctgcagactgagaggcttctggcccagaagcctgaccctgctgcagagcaacaccagcaccctgctgctgaacagcagcttcctgcagagcagaggcgaggtgatcagaatcagagccaccgccctgaccagacacgcctacggcgaggacacctacgtgatcagcaccgtgccccccagagaggtgcccgcctgcaccatcgcccccgaggagggcaccgtgctgaccagcttcgccatcttctgcaacgccagcaccgccctgggccccctggagttctgcttctgcctggagagcggcagctgcctgcactgcggccccgagcccgccctgcccagcgtgtacctgcccctgggcgaggagaacaacgacttcgtgctgaccgtggtgatcagcgccaccaacagagccggcgacacccagcagacccaggccatggccaaggtggccctgggcgacacctgcgtggaggacgtggccttccaggccgccgtgagcgagaagatccccaccgccctgcagggcgagggcggccccgagcagctgctgcagctggccaaggccgtgagcagcatgctgaaccaggagcacgagagccagggcagcggccagagcctgagcatcgacgtgagacagaaggtgagagagcacgtgctgggcagcctgagcgccgtgaccaccggcctggaggacgtgcagagagtgcaggagctggccgaggtgctgagagaggtgacctgcagaagcaaggagctgacccccagcgcccagggcagctgcatgggcgacagctgggagggcgccccccccgccgcccacgtgagccacgccagatag

SEQ ID NO: 23351 - DNA, 798 bp, Artificial Sequence
  Description of Artificial Sequence: Synthetic coding sequence
atgcccctgcccgtggccctgcagaccagactggccaagagaggcatcctgaagcacctggagcccgagcccgaggaggagatcatcgccgaggactacgacgacgaccccgtggactacgaggccaccagactggagggcctgccccccagctggtacaaggtgttcgaccccagctgcggcctgccctactactggaacgccgacaccgacctggtgagctggctgagcccccacgaccccaacagcgtggtgaccaagagcgccaagaagctgagaagcagcaacgccgacgccgaggagaagctggacagaagccacgacaagagcgacagaggccacgacaagagcgacagaagccacgagaagctggacagaggccacgacaagagcgacagaggccacgacaagagcgacagagacagagagagaggctacgacaaggtggacagagagagagagagagacagagagagagacagagacagaggctacgacaaggccgacagagaggagggcaaggagagaagacaccacagaagagaggagctggccccctaccccaagagcaagaaggccgtgagcagaaaggacgaggagctggaccccatggaccccagcagctacagcgacgcccccagaggcacctggagcaccggcctgcccaagagaaacgaggccaagaccggcgccgacaccaccgccgccggccccctgttccagcagagaccctaccccagccccggcgccgtgctgagagccaacgccgaggccagcagaaccaagcagcaggactag

SEQ ID NO: 23352 - DNA, 798 bp, Artificial Sequence; identical to SEQ ID NO: 23351
  Description of Artificial Sequence: Synthetic coding sequence

SEQ ID NO: 23353 - DNA, 798 bp, Artificial Sequence; identical to SEQ ID NO: 23351
  Description of Artificial Sequence: Synthetic coding sequence

SEQ ID NO: 23354 - DNA, 513 bp, Artificial Sequence
  Description of Artificial Sequence: Synthetic coding sequence
atgcccctgcccgtggccctgcagaccagactggccaagagaggcatcctgaagcacctggagcccgagcccgaggaggagatcatcgccgaggactacgacgacgaccccgtggactacgaggccaccagactggagggcctgccccccagctggtacaaggtgttcgaccccagctgcggcctgccctactactggaacgccgacaccgacctggtgagctggctgagcccccacgaccccaacagcgtggtgaccaagagcgccaagaagctgagaagcagcaacgccgccgtgagcagaaaggacgaggagctggaccccatggaccccagcagctacagcgacgcccccagaggcacctggagcaccggcctgcccaagagaaacgaggccaagaccggcgccgacaccaccgccgccggccccctgttccagcagagaccctaccccagccccggcgccgtgctgagagccaacgccgaggccagcagaaccaagcagcaggactag

SEQ ID NO: 23355 - DNA, 1446 bp, Artificial Sequence
  Description of Artificial Sequence: Synthetic coding sequence
atgtaccaggccagcgccgtgagcctgctgcccagagacatccccagctgccacagccccagccccggcttcagccacctgcccaccagcagcagccagctggcccccgacctgctgcagttccccctgggccaggaccccagcttcctggccatccccatcctgaccctgccccccagcgacagcctggtgcccccctacatcgtgtggtacatcgtgtggcccagcgccctgatcagcttcctgggctgcaccctgaccgtgcagttcagcaacggcaagctgcagagccccggcaacatgagattcaccctgtacgagaacaaggacagcaccaaccccagaaagagaaaccagagaatcctggccgccgagaccgacagactgagctacgtgggcaacaacttcggcaccggcgccctgaagtgcaacaccctgtgcagacacttcgtgggcatcctgaacaagaccagcggccagatggaggtgtacgacgccgagctgttcaacatgcagcccctgttcagcgacgtgagcgtggagagcgagctggccctggagagccagaccaagacctacagagagaagatggacagctgcatcgaggccttcggcaccaccaagcagaagagagccctgaacaccagaagaatgaacagagtgggcaacgagagcctgaacagagccgtggccaaggccgccgagaccatcatcgacaccaagggcgtgaccgccctggtgagcgacgccatccacaacgacctgcaggacgacagcctgtacctgcccccctgctacgacgacgccgccaagcccgaggacgtgtacaagttcgaggacctgctgagccccgccgagtacgaggccctgcagagccccagcgaggccttcagaaacgtgaccagcgaggagatcctgaagatgatcgaggagaacagccactgcaccttcgtgatcgaggccctgaagagcctgcccagcgacgtggagagcagagacagacaggccagatgcatctggttcctggacaccctgatcaagttcagagcccacagagtggtgaagagaaagagcgccctgggccccggcgtgccccacatcatcaacaccaagctgctgaagcacttcacctgcctgacctacaacaacggcagactgagaaacctgatcagcgacagcatgaaggccaagatcaccgcctacgtgatcatcctggccctgcacatccacgacttccagatcgacctgaccgtgctgcagagagacctgaagctgagcgagaagagaatgatggagatcgccaaggccatgagactgaagatcagcaagagaagagtgagcgtggccgccggcagcgaggaggaccacaagctgggcaccctgagcctgcccctgccccccgcccagaccagcgacagactggccaagagaagaaagatcacctag

SEQ ID NO: 23356 - DNA, 1260 bp, Artificial Sequence
  Description of Artificial Sequence: Synthetic coding sequence
atggccgccgaggtgctgcccagcgccagatggcagtactgcggcgcccccgacggcagccagagagccgtgctggtgcagttcagcaacggcaagctgcagagccccggcaacatgagattcaccctgtacgagaacaaggacagcaccaaccccagaaagagaaaccagagaatcctggccgccgagaccgacagactgagctacgtgggcaacaacttcggcaccggcgccctgaagtgcaacaccctgtgcagacacttcgtgggcatcctgaacaagaccagcggccagatggaggtgtacgacgccgagctgttcaacatgcagcccctgttcagcgacgtgagcgtggagagcgagctggccctggagagccagaccaagacctacagagagaagatggacagctgcatcgaggccttcggcaccaccaagcagaagagagccctgaacaccagaagaatgaacagagtgggcaacgagagcctgaacagagccgtggccaaggccgccgagaccatcatcgacaccaagggcgtgaccgccctggtgagcgacgccatccacaacgacctgcaggacgacagcctgtacctgcccccctgctacgacgacgccgccaagcccgaggacgtgtacaagttcgaggacctgctgagccccgccgagtacgaggccctgcagagccccagcgaggccttcagaaacgtgaccagcgaggagatcctgaagatgatcgaggagaacagccactgcaccttcgtgatcgaggccctgaagagcctgcccagcgacgtggagagcagagacagacaggccagatgcatctggttcctggacaccctgatcaagttcagagcccacagagtggtgaagagaaagagcgccctgggccccggcgtgccccacatcatcaacaccaagctgctgaagcacttcacctgcctgacctacaacaacggcagactgagaaacctgatcagcgacagcatgaaggccaagatcaccgcctacgtgatcatcctggccctgcacatccacgacttccagatcgacctgaccgtgctgcagagagacctgaagctgagcgagaagagaatgatggagatcgccaaggccatgagactgaagatcagcaagagaagagtgagcgtggccgccggcagcgaggaggaccacaagctgggcaccctgagcctgcccctgccccccgcccagaccagcgacagactggccaagagaagaaagatcacctag

SEQ ID NO: 23357 - DNA, 561 bp, Artificial Sequence
  Description of Artificial Sequence: Synthetic coding sequence
atggccgccgaggtgctgcccagcgccagatggcagtactgcggcgcccccgacggcagccagagagccgtgctggtgcagttcagcaacggcaagctgcagagccccggcaacatgagattcaccctgtacgagaacaaggacagcaccaaccccagaaagagaaaccagagaatcctggccgccgagaccgacagactgagctacgtgggcaacaacttcggcaccggcgccctgaagtgcaacaccctgtgcagacacttcgtgggcatcctgaacaagaccagcggccagatggaggtgtacgacgccgagctgttcaacatgcagcccctgttcagcgacgtgagcgtggagagcgagctggccctggagagccagaccaagacctacagagagaagatgacccccagcaccttcctgcccgccatgatgatgcagcccagcctgaagacctgcatcaacctgaagatcttcttccccctgtggagagccgagaccgccagacccgacgcctacggcttctggatccccagcagcaacttcgagctgatcggctag

SEQ ID NO: 23358 - DNA, 1050 bp, Artificial Sequence
  Description of Artificial Sequence: Synthetic coding sequence
atgatgctgaactgcagcacctgcagccactacttccaggtgttccaccaggagagcaagatcatcttctggaaggagcccagaacctgcttcctgatcctgagcctgcccctgcccggcgagctgacctgggacgtgagcgtggagagcgagctggccctggagagccagaccaagacctacagagagaagatggacagctgcatcgaggccttcggcaccaccaagcagaagagagccctgaacaccagaagaatgaacagagtgggcaacgagagcctgaacagagccgtggccaaggccgccgagaccatcatcgacaccaagggcgtgaccgccctggtgagcgacgccatccacaacgacctgcaggacgacagcctgtacctgcccccctgctacgacgacgccgccaagcccgaggacgtgtacaagttcgaggacctgctgagccccgccgagtacgaggccctgcagagccccagcgaggccttcagaaacgtgaccagcgaggagatcctgaagatgatcgaggagaacagccactgcaccttcgtgatcgaggccctgaagagcctgcccagcgacgtggagagcagagacagacaggccagatgcatctggttcctggacaccctgatcaagttcagagcccacagagtggtgaagagaaagagcgccctgggccccggcgtgccccacatcatcaacaccaagctgctgaagcacttcacctgcctgacctacaacaacggcagactgagaaacctgatcagcgacagcatgaaggccaagatcaccgcctacgtgatcatcctggccctgcacatccacgacttccagatcgacctgaccgtgctgcagagagacctgaagctgagcgagaagagaatgatggagatcgccaaggccatgagactgaagatcagcaagagaagagtgagcgtggccgccggcagcgaggaggaccacaagctgggcaccctgagcctgcccctgccccccgcccagaccagcgacagactggccaagagaagaaagatcacctag

SEQ ID NO: 23359 - DNA, 588 bp, Artificial Sequence
  Description of Artificial Sequence: Synthetic coding sequence
atggccagcagaggcggcggcagaggcagaggcagaggccagctgaccttcaacgtggaggccgtgggcatcggcaagggcgacgccctgcccccccccaccctgcagcccagccccctgttcccccccctggagttcagacccgtgcccctgcccagcggcgaggagggcgagtacgtgctggccctgaagcaggagctgagaggcgccatgagacagctgccctacttcatcagacccgccgtgcccaagagagactggagaagactgcccagagagctgaagatcagagtgagaaagctgcagaaggagagaatcaccatcctgctgcccaagagaccccccaagaccaccgaggacaaggaggagaccatccagaagctggagaccctggagaagaaggaggaggaggtgaccagcgaggaggacgaggagaaggaggaggaggaggagaaggaggaggaggaggaggaggagtacgacgaggaggagcacgaggaggagaccgactacatcatgagctacttcgacaacggcgaggacttcggcggcgacagcgacgacaacatggacgaggccatctactag

SEQ ID NO: 23360 - DNA, 657 bp, Artificial Sequence
  Description of Artificial Sequence: Synthetic coding sequence
atggccagcagaggcggcggcagaggcagaggcagaggccagctgaccttcaacgtggaggccgtgggcatcggcaagggcgacgccctgcccccccccaccctgcagcccagccccctgttcccccccctggagttcagacccgtgcccctgcccagcggcgaggagggcgagtacgtgctggccctgaagcaggagctgagaggcgccatgagacagctgccctacttcatcagacccgccgtgcccaagagagacgtggagagatacagcgacaagtaccagatgagcggccccatcgacaacgccatcgactggaaccccgactggagaagactgcccagagagctgaagatcagagtgagaaagctgcagaaggagagaatcaccatcctgctgcccaagagaccccccaagaccaccgaggacaaggaggagaccatccagaagctggagaccctggagaagaaggaggaggaggtgaccagcgaggaggacgaggagaaggaggaggaggaggagaaggaggaggaggaggaggaggagtacgacgaggaggagcacgaggaggagaccgactacatcatgagctacttcgacaacggcgaggacttcggcggcgacagcgacgacaacatggacgaggccatctactag

SEQ ID NO: 23361 - DNA, 1680 bp, Artificial Sequence
  Description of Artificial Sequence: Synthetic coding sequence
atggccaccgccaccatcgccctgcaggtgaacggccagcagggcggcggcagcgagcccgccgccgccgccgccgtggtggccgccggcgacaagtggaagcccccccagggcaccgacagcatcaagatggagaacggccagagcaccgccgccaagctgggcctgccccccctgacccccgagcagcaggaggccctgcagaaggccaagaagtacgccatggagcagagcatcaagagcgtgctggtgaagcagaccatcgcccaccagcagcagcagctgaccaacctgcagatggccgccgtgaccatgggcttcggcgaccccctgagccccctgcagagcatggccgcccagagacagagagccctggccatcatgtgcagagtgtacgtgggcagcatctactacgagctgggcgaggacaccatcagacaggccttcgcccccttcggccccatcaagagcatcgacatgagctgggacagcgtgaccatgaagcacaagggcttcgccttcgtggagtacgaggtgcccgaggccgcccagctggccctggagcagatgaacagcgtgatgctgggcggcagaaacatcaaggtgggcagacccagcaacatcggccaggcccagcccatcatcgaccagctggccgaggaggccagagccttcaacagaatctacgtggccagcgtgcaccaggacctgagcgacgacgacatcaagagcgtgttcgaggccttcggcaagatcaagagctgcaccctggccagagaccccaccaccggcaagcacaagggctacggcttcatcgagtacgagaaggcccagagcagccaggacgccgtgagcagcatgaacctgttcgacctgggcggccagtacctgagagtgggcaaggccgtgaccccccccatgcccctgctgacccccgccacccccggcggcctgccccccgccgccgccgtggccgccgccgccgccaccgccaagatcaccgcccaggaggccgtggccggcgccgccgtgctgggcaccctgggcacccccggcctggtgagccccgccctgaccctggcccagcccctgggcaccctgccccaggccgtgatggccgcccaggcccccggcgtgatcaccggcgtgacccccgccagaccccccatccccgtgaccatccccagcgtgggcgtggtgaaccccatcctggccagcccccccaccctgggcctgctggagcccaagaaggagaaggaggaggaggagctgttccccgagagcgagagacccgagatgctgagcgagcaggagcacatgagcatcagcggcagcagcgccagacacatggtgatgcagaagctgctgagaaagcaggagagcaccgtgatggtgctgagaaacatggtggaccccaaggacatcgacgacgacctggagggcgaggtgaccgaggagtgcggcaagttcggcgccgtgaacagagtgatcatctaccaggagaagcagggcgaggaggaggacgccgagatcatcgtgaagatcttcgtggagttcagcatcgccagcgagacccacaaggccatccaggccctgaacggcagatggttcgccggcagaaaggtggtggccgaggtgtacgaccaggagagattcgacaacagcgacctgagcgcctag

SEQ ID NO: 23362 - DNA, 1500 bp, Artificial Sequence
  Description of Artificial Sequence: Synthetic coding sequence
atggagaacggccagagcaccgccgccaagctgggcctgccccccctgacccccgagcagcaggaggccctgcagaaggccaagaagtacgccatggagcagagcatcaagagcgtgctggtgaagcagaccatcgcccaccagcagcagcagctgaccaacctgcagatggccgcccagagacagagagccctggccatcatgtgcagagtgtacgtgggcagcatctactacgagctgggcgaggacaccatcagacaggccttcgcccccttcggccccatcaagagcatcgacatgagctgggacagcgtgaccatgaagcacaagggcttcgccttcgtggagtacgaggtgcccgaggccgcccagctggccctggagcagatgaacagcgtgatgctgggcggcagaaacatcaaggtgggcagacccagcaacatcggccaggcccagcccatcatcgaccagctggccgaggaggccagagccttcaacagaatctacgtggccagcgtgcaccaggacctgagcgacgacgacatcaagagcgtgttcgaggccttcggcaagatcaagagctgcaccctggccagagaccccaccaccggcaagcacaagggctacggcttcatcgagtacgagaaggcccagagcagccaggacgccgtgagcagcatgaacctgttcgacctgggcggccagtacctgagagtgggcaaggccgtgaccccccccatgcccctgctgacccccgccacccccggcggcctgccccccgccgccgccgtggccgccgccgccgccaccgccaagatcaccgcccaggaggccgtggccggcgccgccgtgctgggcaccctgggcacccccggcctggtgagccccgccctgaccctggcccagcccctgggcaccctgccccaggccgtgatggccgcccaggcccccggcgtgatcaccggcgtgacccccgccagaccccccatccccgtgaccatccccagcgtgggcgtggtgaaccccatcctggccagcccccccaccctgggcctgctggagcccaagaaggagaaggaggaggaggagctgttccccgagagcgagagacccgagatgctgagcgagcaggagcacatgagcatcagcggcagcagcgccagacacatggtgatgcagaagctgctgagaaagcaggagagcaccgtgatggtgctgagaaacatggtggaccccaaggacatcgacgacgacctggagggcgaggtgaccgaggagtgcggcaagttcggcgccgtgaacagagtgatcatctaccaggagaagcagggcgaggaggaggacgccgagatcatcgtgaagatcttcgtggagttcagcatcgccagcgagacccacaaggccatccaggccctgaacggcagatggttcgccggcagaaaggtggtggccgaggtgtacgaccaggagagattcgacaacagcgacctgagcgcctag

SEQ ID NO: 23363 - DNA, 1629 bp, Artificial Sequence
  Description of Artificial Sequence: Synthetic coding sequence
atggccaccgccaccatcgccctgcaggtgaacggccagcagggcggcggcagcgagcccgccgccgccgccgccgtggtggccgccggcgacaagtggaagcccccccagggcaccgacagcatcaagatggagaacggccagagcaccgccgccaagctgggcctgccccccctgacccccgagcagcaggaggccctgcagaaggccaagaagtacgccatggagcagagcatcaagagcgtgctggtgaagcagaccatcgcccaccagcagcagcagctgaccaacctgcagatggccgcccagagacagagagccctggccatcatgtgcagagtgtacgtgggcagcatctactacgagctgggcgaggacaccatcagacaggccttcgcccccttcggccccatcaagagcatcgacatgagctgggacagcgtgaccatgaagcacaagggcttcgccttcgtggagtacgaggtgcccgaggccgcccagctggccctggagcagatgaacagcgtgatgctgggcggcagaaacatcaaggtgggcagacccagcaacatcggccaggcccagcccatcatcgaccagctggccgaggaggccagagccttcaacagaatctacgtggccagcgtgcaccaggacctgagcgacgacgacatcaagagcgtgttcgaggccttcggcaagatcaagagctgcaccctggccagagaccccaccaccggcaagcacaagggctacggcttcatcgagtacgagaaggcccagagcagccaggacgccgtgagcagcatgaacctgttcgacctgggcggccagtacctgagagtgggcaaggccgtgaccccccccatgcccctgctgacccccgccacccccggcggcctgccccccgccgccgccgtggccgccgccgccgccaccgccaagatcaccgcccaggaggccgtggccggcgccgccgtgctgggcaccctgggcacccccggcctggtgagccccgccctgaccctggcccagcccctgggcaccctgccccaggccgtgatggccgcccaggcccccggcgtgatcaccggcgtgacccccgccagaccccccatccccgtgaccatccccagcgtgggcgtggtgaaccccatcctggccagcccccccaccctgggcctgctggagcccaagaaggagaaggaggaggaggagctgttccccgagagcgagagacccgagatgctgagcgagcaggagcacatgagcatcagcggcagcagcgccagacacatggtgatgcagaagctgctgagaaagcaggagagcaccgtgatggtgctgagaaacatggtggaccccaaggacatcgacgacgacctggagggcgaggtgaccgaggagtgcggcaagttcggcgccgtgaacagagtgatcatctaccaggagaagcagggcgaggaggaggacgccgagatcatcgtgaagatcttcgtggagttcagcatcgccagcgagacccacaaggccatccaggccctgaacggcagatggttcgccggcagaaaggtggtggccgaggtgtacgaccaggagagattcgacaacagcgacctgagcgcctag

SEQ ID NO: 23364 - DNA, 891 bp, Artificial Sequence
  Description of Artificial Sequence: Synthetic coding sequence
atgggcgccgccgcccccgccgagagcgccgacctgggcaacttctggaaggccggcgagcccctgctgcagggccccgacgccctggccgcccccatgagcagaagccccagcaccccccagaccacccccagcccccagggcagacagagcccctggcccctgagaagcctgacccagagccacatccagtacttccagtggggcagacccgtgcccagcacccacctgatcgaggtgagacccacccaggaccccgccaagccccagagagtggtgagcgagggctggagaagacccgccctgcccggcgagaccgccctgggcagagacctgagctgcgcctgggagggctgcatgaagggcggcctgtgcagagcctggaaccccggcagaacctggagccccgtgaccatcggcatcgccccccccgagagacaggagagcccctggagaagccccggccagagagccagacccgccggcagacccgccgcccaggagctgctggacccctgcaccagagagaccctgctgggcgccctgagccagtgccccaagggcagcgccagattcgacggccccctgtggttcgaggtgagcgacagcaagggcggcagaagaaacctgcagcccagacccagcgccttcaagcccctgagcaagaacggcgccgtggccagcttcgtgcccagacccggccccctgaagcccagcctgggcccctggagcctgagcttctgcgacgacgcctggcccagcgtgctggtgcagcccgcccccagcgccatctgggacttctgggaggccaccacccccagctgcggcagctgcagcagagtgagcttcgccctggaggtgacccagagcgccggccccttcggcagctag

SEQ ID NO: 23365 - DNA, 2916 bp, Artificial Sequence
  Description of Artificial Sequence: Synthetic coding sequence
atgggcagcttcctgagcaagctggagctgagccccagcagccccgcccaggtgagaaccgacctgcccgagagacccaccaagagaagacccccccagcccctgcaccaggtgcacagagtgcagttcgtgcacagagcccaccccgcccccagatacagacccgtgagaagaagacccaacctggaccccgccaaccccaccacctggctggccaacgaggcctggagaagattccccatgaagaagagccagaacagccccctgggccccctgcccagcgactggtgggagagctacctgaagagaaccatctggagcctgagacaccccagacccatctggagccccgtgaccatcagaatcaccccccccgaccagagagtgccccccagcaccagccccgaggacgtgatcgccctggccggcctgccccccagcgaggagctggccgacccctgcagcaaggagaccgtgctgagagccctgagagagtgcagaaagggcaagggcagactggaggagcccctgttccccgagagcctggacagcaagagaagaagccccgagaccagacccagcgccttcaagcccctgatgaagaacggcaccctgaccagcttcgtgcccagacccggccccctgaagagaagcctgcacagctggggcagcgaccacagcctgaccaagagacccaactgcagcagcatgagcagcctggccagcatctacagaggcggcaccctgagcagcaagagaaacgccatcggcagcagctacagcagctgcagaaacttcagcgacccctggaagagaagcgtgcccagcgtgagcttcgagacccccgagtggcccatcaagaaggagaagagctgccacagacccagcagccccgtgcccctggtgagcgacttcgagagcctgggcggcagcgagagcagcggccagcagaaccagaagatcccccagctgcccagcagccccgagaacctggtgagcgagatcccccccccccagctgggctacgccgtgagcgacgagaacctgaccctgggcaagaaggccgagctgcagagcaccggcgaggccaccagcgtggcccacagccccctgaagacccccagcctgcccaccccccccggctgcagccagagcgagctgctgcccggcaccagccccgacagcaagcccaccgccaccttcatcctgctgacccccaccagccccaccctgcccgtgaccgacaccacctggccccccagcaccagccaggccgacagaagccccatgccccccgacccccccgccccccccaccatccagagcaccctgctgggcatggtgagcagccccaccagccacctgagcgccagcgccccccccgacgccaccagcgcccacctgatgctgaagcccatcctgggccccctgcacaacagcgagatcggcagcagcagctacagcagaatcagcgtgaccgccgccgccagcagcatcagcagcctgagcaccatccagggcaccctgacccccaccttcaagcccatcttcggcagcatcgaccccctgaagaccacccccatgatcgcccccttcagcagcaagcagacccccccccccttcacccacgccagcacccaccacttccacggcctggtgaaggccaccagcgtggtgatgagcaccaccctggccagcaccagcaaggacagcgtgttcaagccccccctggacttcggcgtggtgaacgtgaccagcgccgtgggcaacacctacagcgtgcccagcacctgcgacaccttcctgctgggcaccgcccaggccttcagagccgacttcacccccgccaccggcttcatcttccccccccaccaccaccccaccatccccaccgtgcacaccgtgaccatgttcacccaggtgctgagcagcgtggtgcagatcagccccagaagcagcaccgccaacttcagaggcatgggcagccccctgcccgccagcgccctggtgagcaccaactggctggccagcacccccagcatcagcaacctgacccccgccatcaccagccccctgggcagcagcagcagaccccccttccccctgagccagggcgccaacccccagcccgccttcggcgccaccaacggccagaagcagggccccagccagcccgccctgatgcccagcgtgagcagcagcttcctgttcggcagcagcgccgtggccctgcccacccccatgcccacccccgcccagcccgccttcatcagcaccacccagagcgccctgggctgcctgacccccagcgccagcaccagccagacccccgccagcacctggagcggcatcggcggcatccccgccggcttccccatcagccaggccagcaccaccggcttcagaatcgtgatccagacccaccagagcggcgccttcggcagcgtgttcggcagcagagccccccagcccttcaccttcggcggcttcgtgacccccatggactgcgacgagagcggcatcatcatgaccggccccgacatgagccccaccagcggcgccttcagcatcggcgccctgcccagcggcaccaccaacaccatgatccccttcggcaagggctggagccagaacaccgagggcctgcccagccacagaaccgccttcagcctgggcagaggcagcatcagcgccagaaagaccatggcccccatcgcccagaacacccccgtgcccggccaggccaaggccggcagcagcgtgggcttcggcatgcccttcccccccgcccagggcagcgtgggcagaggccccttcagaagcagcgccagcagcttcagcatcggcgccaagagcaagacccccaagaacagagagaagggccacagcagaagacaccacgcctacaagaagtag

SEQ ID NO: 23366 - DNA, 3108 bp, Artificial Sequence
  Description of Artificial Sequence: Synthetic coding sequence
atgggcagcttcctgagcaagctggagctgagccccagcagccccgcccaggtgagaaccgacctgcccgagagacccaccaagagaagacccccccagcccctgcaccaggtgcacagagtgcagttcgtgcacagagcccaccccgcccccagatacagacccgtgagaagaagacccaacctggaccccgccaaccccaccacctggctggccaacgaggcctggagaagattccccatgaagaagagccagaacagccccctgggccccctgcccagcgactggtgggagagctacctgaagagaaccatctggagcctgagacaccccagacccatctggagccccgtgaccatcagaatcaccccccccgaccagagagtgccccccagcaccagccccgaggacgtgatcgccctggccggcctgccccccagcgaggagctggccgacccctgcagcaaggagaccgtgctgagagccctgagagagtgcagaaagggcaagggcagactggaggagcccctgttccccgagagcctggacagcaagagaagaagccccgagaccagacccagcgccttcaagcccctgatgaagaacggcaccctgaccagcttcgtgcccagacccggccccctgaagagaagcctgcacagctggggcagcgaccacagcctgaccaagagacccaactgcagcagcatgagcagcctggccagcatctacagaggcggcaccctgagcagcaagagaaacgccatcggcagcagctacagcagctgcagaaacttcagcgacccctggaagagaagcgtgcccagcgtgagcttcgagacccccgagtggcccatcaagaaggagaagagctgccacagacccagcagccccgtgcccctggtgagcgacttcgagagcctgggcggcagcgagagcagcggccagcagaaccagaagatcccccagctgcccagcagccccgagaacctggtgagcgagatcccccccccccagctgggctacgccgtgagcgacgagaacctgaccctgggcaagaaggccgagctgcaggtgagcaacaacgccggcgaggacaccaccgaggtgaacaccgaccccttccccgagacctggctggccatccagcccagcctgagcctggccctgcccagcagcgagaccgacctgacccagggcgccaacccccagctggagaacctgagaaagatgcagaagagcctgggccccctggccagcccccagagcaccggcgaggccaccagcgtggcccacagccccctgaagacccccagcctgcccaccccccccggctgcagccagagcgagctgctgcccggcaccagccccgacagcaagcccaccgccaccttcatcctgctgacccccaccagccccaccctgcccgtgaccgacaccacctggccccccagcaccagccaggccgacagaagccccatgccccccgacccccccgccccccccaccatccagagcaccctgctgggcatggtgagcagccccaccagccacctgagcgccagcgccccccccgacgccaccagcgcccacctgatgctgaagcccatcctgggccccctgcacaacagcgagatcggcagcagcagctacagcagaatcagcgtgaccgccgccgccagcagcatcagcagcctgagcaccatccagggcaccctgacccccaccttcaagcccatcttcggcagcatcgaccccctgaagaccacccccatgatcgcccccttcagcagcaagcagacccccccccccttcacccacgccagcacccaccacttccacggcctggtgaaggccaccagcgtggtgatgagcaccaccctggccagcaccagcaaggacagcgtgttcaagccccccctggacttcggcgtggtgaacgtgaccagcgccgtgggcaacacctacagcgtgcccagcacctgcgacaccttcctgctgggcaccgcccaggccttcagagccgacttcacccccgccaccggcttcatcttccccccccaccaccaccccaccatccccaccgtgcacaccgtgaccatgttcacccaggtgctgagcagcgtggtgcagatcagccccagaagcagcaccgccaacttcagaggcatgggcagccccctgcccgccagcgccctggtgagcaccaactggctggccagcacccccagcatcagcaacctgacccccgccatcaccagccccctgggcagcagcagcagaccccccttccccctgagccagggcgccaacccccagcccgccttcggcgccaccaacggccagaagcagggccccagccagcccgccctgatgcccagcgtgagcagcagcttcctgttcggcagcagcgccgtggccctgcccacccccatgcccacccccgcccagcccgccttcatcagcaccacccagagcgccctgggctgcctgacccccagcgccagcaccagccagacccccgccagcacctggagcggcatcggcggcatccccgccggcttccccatcagccaggccagcaccaccggcttcagaatcgtgatccagacccaccagagcggcgccttcggcagcgtgttcggcagcagagccccccagcccttcaccttcggcggcttcgtgacccccatggactgcgacgagagcggcatcatcatgaccggccccgacatgagccccaccagcggcgccttcagcatcggcgccctgcccagcggcaccaccaacaccatgatccccttcggcaagggctggagccagaacaccgagggcctgcccagccacagaaccgccttcagcctgggcagaggcagcatcagcgccagaaagaccatggcccccatcgcccagaacacccccgtgcccggccaggccaaggccggcagcagcgtgggcttcggcatgcccttcccccccgcccagggcagcgtgggcagaggccccttcagaagcagcgccagcagcttcagcatcggcgccaagagcaagacccccaagaacagagagaagggccacagcagaagacaccacgcctacaagaagtag

SEQ ID NO: 23367 - DNA, 1374 bp, Artificial Sequence
  Description of Artificial Sequence: Synthetic coding sequence
atggacagcctgtggggccccggcgccggcagccaccccttcggcgtgcacaacagcagactgagccccgacctgtgccccggcaagatcgtgctgagagccctgaaggagagcggcgccggcatgcccgagcaggacaaggaccccagagtgcaggagaaccccggcgaccagagaagagtgcccgaggtgaccggcgacgcccccagcgccttcagacccctgagagacaacggcggcctgagccccttcgtgcccggccccggccccctgcagaccgacctgcacgcccagagaagcgagatcagatacgaccagagcagccagaccagctggaccagcagctgcaccaacagaaacgccatcagcagcagctacagcagcaccggcggcctgcccggcctgaagagaagaagaggccccgccagcagccactgccagctgaccctgagcagcagcaagaccgtgagcgaggacagaccccaggccgtgagcagcggccacacccagtgcgagaaggtggccgagaaggcccccggccagaccctggccctgagaaacgacagcagcagaagcgaggccagcagacccagcaccagaaagttccccctgctgccccacagaagaggcgagcccctgatgctgcccccccccgtggagctgggctacagagtgaccgccgaggacctggactgggagaaggaggccgccttccagtgcatcaagagcgccctgcaggtggaggacaaggccatcagcgactgcagacccagcagacccagccacaccctgagcagcctggccaccggcgccagcggcctgcccgccgtgagcaaggcccccagcatggacgcccagcaggagagacacaagagccaggactgcctgggcctggtggcccccctggccagcgccaccgaggtgcccagcaccgcccccatgagcggcgagaagcacagaccccccggccccctgttcagcagcagcgaccccctgcccgccaccagcagccacagccaggacagcgcccaggtgaccagcctgatccccgcccccttccccgccgccagcatggacgccggcatgagaagaaccagacccggcaccagcgcccccgccgccgccgccgccgcccccccccccagcaccctgaacagaaccctgggcagcctgctggagtggatggaggccctgcacatcagcggcccccagccccagctgcagcaggtgcccagaggccagaaccagagaagccagaccagcagaaccagcagctgccccaagagaaacgccatcagcagcagctgcagcagcaccggcgacctgcccggcagaaagagaaagagaagacagccccaccccaccgccagctag

SEQ ID NO: 23368 - DNA, 1389 bp, Artificial Sequence
  Description of Artificial Sequence: Synthetic coding sequence
atggacagcctgtggggccccggcgccggcagccaccccttcggcgtgcacaacaccagactgagccccgacctgtgccccggcaagatcgtgctgagagccctgaaggagagcggcgccggcatgcccgagcaggacaaggaccccagagtgcaggagaaccccggcgaccagagaagagtgcccgaggtgaccggcgacgcccccagcgccttcagacccctgagagacaacggcggcctgagccccttcgtgcccggccccggccccctgcagaccgacctgcacgcccagagaagcgagatcagatacaaccagaccagccagaccagctggaccagcagctgcaccaacagaaacgccatcagcagcagctacagcagcaccggcggcctgcccggcctgaagagaagaagaggccccgccagcagccactgccagctgaccctgagcagcagcaagaccgtgagcgaggacagaccccaggccgtgagcagcggccacacccagtgcgagaaggccgccgacatcgcccccggccagaccctggccctgagaaacgacagcagcaccagcgaggccagcagacccagcacccacaagttccccctgctgcccagaagaagaggcgagcccctgatgctgcccccccccctggagctgggctacagagtgaccgtggaggacctggacagagagaaggaggccgccttccagagaatcaacagcgccctgcaggtggaggacaaggccatcagcgactgcagacccagcagacccagccacaccctgagcagcctggccaccggcgccagcggcctgccccccgtgagcaaggcccccagcatggacgcccagcaggagacccacaagagccaggactgcctgggcctgctggcccccctggccagcgccgccggcgtgcccagcaccgcccccatgagcggcaagaagcacagaccccccggccccctgttcagcagcagcgaccccctgcccgccaccagcagccacagccaggacagcgcccaggtgaccagcctgatccccgcccccttccccgccgccagcatggacgccggcatgagaagaaccagatgcggcaccagcgcccccgccgccgccgccgccgcccccccccccagcaccctgaaccccaccctgggcagcctgctggagtggatggaggccctgcacatcagcggcccccagccccagctgcagcaggtgcccagaggccagaaccagagaagccagaccagcagaaccagcagctgccccaagagaaacgccatcagcagcccctacagaagcaccggcggcctgcccgagagaaagagaagaagaggccccgccagcagccactgccagctgaccctgagcagctag

SEQ ID NO: 23369 - DNA, 1389 bp, Artificial Sequence; identical to SEQ ID NO: 23368
  Description of Artificial Sequence: Synthetic coding sequence

SEQ ID NO: 23370 - DNA, 3000 bp, Artificial Sequence
  Description of Artificial Sequence: Synthetic coding sequence
atggtgtgcagccccgtgaccgtgagaatcgccccccccgacagaagattcagcagaagcgccatccccgagcagatcatcagcagcaccctgagcagccccagcagcaacgcccccgacccctgcgccaaggagaccgtgctgagcgccctgaaggagaaggagaagaagagaaccgtggaggaggaggaccagatcttcctggacggccaggagaacaagagaagaagacacgacagcagcggcagcggccacagcgccttcgagcccctggtggccaacggcgtgcccgccagcttcgtgcccaagcccggcagcctgaagagaggcctgaacagccagagcagcgacgaccacctgaacaagagaagcagaagcagcagcatgagcagcctgaccggcgcctacgccagcggcatccccagcagcagcagaaacgccatcaccagcagctacagcagcaccagaggcatcagccagctgtggaagagaaacggccccagcagcagccccttcagcagccccgccagcagcagaagccagacccccgagagacccgccaagaagatcagagaggaggagctgtgccaccacagcagcagcagcacccccctggccgccgacagagagagccagggcgagaaggccgccgacaccacccccagaaagaagcagaacagcaacagccagagcacccccggcagcagcggccagagaaagagaaaggtgcagctgctgcccagcagaagaggcgagcagctgaccctgcccccccccccccagctgggctacagcatcaccgccgaggacctggacctggagaagaaggccagcctgcagtggttcaaccaggccctggaggacaagagcgacgccgccagcaacagcgtgaccgagaccccccccatcacccagcccagcttcaccttcaccctgcccgccgccgcccccgccagcccccccaccagcctgctggcccccagcaccaaccccctgctggagagcctgaagaagatgcagaccccccccagcctgcccccctgccccgagagcgccggcgccgccaccaccgaggccctgagcccccccaagacccccagcctgctgccccccctgggcctgagccagagcggcccccccggcctgctgcccagccccagcttcgacagcaagccccccaccaccctgctgggcctgatccccgcccccagcatggtgcccgccaccgacaccaaggccccccccaccctgcaggccgagaccgccaccaagccccaggccaccagcgcccccagccccgcccccaagcagagcttcctgttcggcacccagaacaccagccccagcagccccgccgcccccgccgccagcagcgccccccccatgttcaagcccatcttcaccgccccccccaagagcgagaaggagggccccaccccccccggccccagcgtgaccgccaccgcccccagcagcagcagcctgcccaccaccaccagcaccaccgcccccaccttccagcccgtgttcagcagcatgggcccccccgccagcgtgcccctgcccgcccccttcttcaagcagaccaccacccccgccaccgcccccaccaccaccgcccccctgttcaccggcctggccagcgccaccagcgccgtggcccccatcaccagcgccagccccagcaccgacagcgccagcaagcccgccttcggcttcggcatcaacagcgtgagcagcagcagcgtgagcaccaccaccagcaccgccaccgccgccagccagcccttcctgttcggcgccccccaggccagcgccgccagcttcacccccgccatgggcagcatcttccagttcggcaagccccccgccctgcccaccaccaccaccgtgaccaccttcagccagagcctgcacaccgccgtgcccaccgccaccagcagcagcgccgccgacttcagcggcttcggcagcaccctggccaccagcgcccccgccaccagcagccagcccaccctgaccttcagcaacaccagcacccccaccttcaacatccccttcggcagcagcgccaagagccccctgcccagctaccccggcgccaacccccagcccgccttcggcgccgccgagggccagccccccggcgccgccaagcccgccctggcccccagcttcggcagcagcttcaccttcggcaacagcgccgcccccgccgccgcccccacccccgccccccccagcatgatcaaggtggtgcccgcctacgtgcccacccccatccaccccatcttcggcggcgccacccacagcgccttcggcctgaaggccaccgccagcgccttcggcgcccccgccagcagccagcccgccttcggcggcagcaccgccgtgttcttcggcgccgccaccagcagcggcttcggcgccaccacccagaccgccagcagcggcagcagcagcagcgtgttcggcagcaccacccccagccccttcaccttcggcggcagcgccgcccccgccggcagcggcagcttcggcatcaacgtggccacccccggcagcagcaccaccaccggcgccttcagcttcggcgccggccagagcggcagcaccgccaccagcacccccttcgccggcggcctgggccagaacgccctgggcaccaccggccagagcacccccttcgccttcaacgtgagcagcaccaccgagagcaagcccgtgttcggcggcaccgccacccccaccttcggcctgaacacccccgcccccggcgtgggcaccagcggcagcagcctgagcttcggcgccagcagcgcccccgcccagggcttcgtgggcgtggcccccttcggcaacaccttcgcccaccagcaggagcacagccccagaaagggccccaacaacctgagcaagagaaagctgctgcccgccgtgagagcccagggcctgcccagaagaggccaggccagcagcttccccaccagaaaggagtag

SEQ ID NO: 23371 - DNA, 1386 bp, Artificial Sequence
  Description of Artificial Sequence: Synthetic coding sequence
atggccaccttcagcagacaggagttcttccagcagctgctgcagggctgcctgctgcccaccgcccagcagggcctggaccagatctggctgctgctggccatctgcctggcctgcagactgctgtggagactgggcctgcccagctacctgaagcacgccagcaccgtggccggcggcttcttcagcctgtaccacttcttccagctgcacatggtgtgggtggtgctgctgagcctgctgtgctacctggtgctgttcctgtgcagacacagcagccacagaggcgtgttcctgagcgtgaccatcctgatctacctgctgatgggcgagatgcacatggtggacaccgtgacctggcacaagatgagaggcgcccagatgatcgtggccatgaaggccgtgagcctgggcttcgacctggacagaggcgaggtgggcaccgtgcccagccccgtggagttcatgggctacctgtacttcgtgggcaccatcgtgttcggcccctggatcagcttccacagctacctgcaggccgtgcagggcagacccctgagctgcagatggctgcagaaggtggccagaagcctggccctggccctgctgtgcctggtgctgagcacctgcgtgggcccctacctgttcccctacttcatccccctgaacggcgacagactgctgagaaacaagaagagaaaggccagaggcaccatggtgagatggctgagagcctacgagagcgccgtgagcttccacttcagcaactacttcgtgggcttcctgagcgaggccaccgccaccctggccggcgccggcttcaccgaggagaaggaccacctggagtgggacctgaccgtgagcaagcccctgaacgtggagctgcccagaagcatggtggaggtggtgaccagctggaacctgcccatgagctactggctgaacaactacgtgttcaagaacgccctgagactgggcaccttcagcgccgtgctggtgacctacgccgccagcgccctgctgcacggcttcagcttccacctggccgccgtgctgctgagcctggccttcatcacctacgtggagcacgtgctgagaaagagactggccagaatcctgagcgcctgcgtgctgagcaagagatgcccccccgactgcagccaccagcacagactgggcctgggcgtgagagccctgaacctgctgttcggcgccctggccatcttccacctggcctacctgggcagcctgttcgacgtggacgtggacgacaccaccgaggagcagggctacggcatggcctacaccgtgcacaagtggagcgagctgagctgggccagccactgggtgaccttcggctgctggatcttctacagactgatcggctag

SEQ ID NO: 23372 - DNA, 1368 bp, Artificial Sequence
  Description of Artificial Sequence: Synthetic coding sequence
atggccaccttcagcagacaggagttcttccagcagctgctgcagggctgcctgctgcccaccgcccagcagggcctggaccagatctggctgctgctggccatctgcctggcctgcagactgctgtggagactgggcctgcccagctacctgaagcacgccagcaccgtggccggcggcttcttcagcctgtaccacttcttccagctgcacatggtgtgggtggtgctgctgagcctgctgtgctacctggtgctgttcctgtgcagacacagcagccacagaggcgtgttcctgagcgtgaccatcctgatctacctgctgatgggcgagatgcacatggtggacaccgtgacctggcacaagatgagaggcgcccagatgatcgtggccatgaaggccgtgagcctgggcttcgacctggacagaggcgaggtgggcaccgtgcccagccccgtggagttcatgggctacctgtacttcgtgggcaccatcgtgttcggcccctggatcagcttccacagctacctgcaggccgtgcagggcagacccctgagctgcagatggctgcagaaggtggccagaagcctggccctggccctgctgtgcctggtgctgagcacctgcgtgggcccctacctgttcccctacttcatccccctgaacggcgacagactgctgagaaagggcaccatggtgagatggctgagagcctacgagagcgccgtgagcttccacttcagcaactacttcgtgggcttcctgagcgaggccaccgccaccctggccggcgccggcttcaccgaggagaaggaccacctggagtgggacctgaccgtgagcaagcccctgaacgtggagctgcccagaagcatggtggaggtggtgaccagctggaacctgcccatgagctactggctgaacaactacgtgttcaagaacgccctgagactgggcaccttcagcgccgtgctggtgacctacgccgccagcgccctgctgcacggcttcagcttccacctggccgccgtgctgctgagcctggccttcatcacctacgtggagcacgtgctgagaaagagactggccagaatcctgagcgcctgcgtgctgagcaagagatgcccccccgactgcagccaccagcacagactgggcctgggcgtgagagccctgaacctgctgttcggcgccctggccatcttccacctggcctacctgggcagcctgttcgacgtggacgtggacgacaccaccgaggagcagggctacggcatggcctacaccgtgcacaagtggagcgagctgagctgggccagccactgggtgaccttcggctgctggatcttctacagactgatcggctag

SEQ ID NO: 23373 - DNA, 1146 bp, Artificial Sequence
  Description of Artificial Sequence: Synthetic coding sequence
atgagcagacacgagggcgtgagctgcgacgcctgcctgaagggcaacttcagaggcagaagatacaagtgcctgatctgctacgactacgacctgtgcgccagctgctacgagagcggcgccaccaccaccagacacaccaccgaccaccccatgcagtgcatcctgaccagagtggacttcgacctgtactacggcggcgaggccttcagcgtggagcagccccagagcttcacctgcccctactgcggcaagatgggctacaccgagaccagcctgcaggagcacgtgaccagcgagcacgccgagaccagcaccgaggtgatctgccccatctgcgccgccctgcccggcggcgaccccaaccacgtgaccgacgacttcgccgcccacctgaccctggagcacagagcccccagagacctggacgagagcagcggcgtgagacacgtgagaagaatgttccaccccggcagaggcctgggcggccccagagccagaagaagcaacatgcacttcaccagcagcagcaccggcggcctgagcagcagccagagcagctacagccccagcaacagagaggccatggaccccatcgccgagctgctgagccagctgagcggcgtgagaagaagcgccggcggccagctgaacagcagcggccccagcgccagccagctgcagcagctgcagatgcagctgcagctggagagacagcacgcccaggccgccagacagcagctggagaccgccagaaacgccaccagaagaaccaacaccagcagcgtgaccaccaccatcacccagagcaccgccaccaccaacatcgccaacaccgagagcagccagcagaccctgcagaacagccagttcctgctgaccagactgaacgaccccaagatgagcgagaccgagagacagagcatggagagcgagagagccgacagaagcctgttcgtgcaggagctgctgctgagcaccctggtgagagaggagagcagcagcagcgacgaggacgacagaggcgagatggccgacttcggcgccatgggctgcgtggacatcatgcccctggacgtggccctggagaacctgaacctgaaggagagcaacaagggcaacgagcccccccccccccccctgtag

SEQ ID NO: 23374 - DNA, 705 bp, Artificial Sequence
  Description of Artificial Sequence: Synthetic coding sequence
atgccccacagaaaggagagacccagcggcagcagcctgcacacccacggcagcaccggcaccgccgagggcggcaacatgagcagactgagcctgaccagaagccccgtgagccccctggccgcccagggcatccccctgcccgcccagctgaccaagagcaacgcccccgtgcacatcgacgtgggcggccacatgtacaccagcagcctggccaccctgaccaagtaccccgacagcagaatcagcagactgttcaacggcaccgagcccatcgtgctggacagcctgaagcagcactacttcatcgacagagacggcgagatcttcagatacgtgctgagcttcctgagaaccagcaagctgctgctgcccgacgacttcaaggacttcagcctgctgtacgaggaggccagatactaccagctgcagcccatggtgagagagctggagagatggcagcaggagcaggagcagagaagaagaagcagagcctgcgactgcctggtggtgagagtgacccccgacctgggcgagagaatcgccctgagcggcgagaaggccctgatcgaggaggtgttccccgagaccggcgacgtgatgtgcaacagcgtgaacgccggctggaaccaggaccccacccacgtgatcagattccccctgaacggctactgcagactgaacagcgtgcaggacgtgctgtag

SEQ ID NO: 23375 - DNA, 915 bp, Artificial Sequence
  Description of Artificial Sequence: Synthetic coding sequence
atgaccctgagaaccagcgtgtgctgcaccagaagaagagccaccatcagcagcagcccctggtgcgccagctggagcgccggcagcagaagcagaagcagcggcgccgccgccggccccgtgaccgcctggtggtgcgccagcagacccacctgggccagcggcagccacagcgccgccagaagacccagcagcagaagaagcagccccagacccgagaccagctgcgccacccccagcacccccgccggcaccagaacccccagaaccagcagcgccagcagaagcatggccaccgccggcagcaccagatacagaagctggagcggctgcagcagaggcgtgagcgcctggctgagacccgtgggcgccgtgtggaccccccccagcagcgccagcatgtgcttcgccggcagaagcggcggcagaagccccccccccctgctgttcgagagcagcagaaacccctggaccagaccctgcttcagcgcccacctgggcccccccagagacctggagaccgtgctgggcagcagcgcctgcgtgtacctggccgtgggcatgagacccagagtgagactggagggccccaagctggcccagagagcccccggcagccaggtgagctggcagcagaacgtgggctgctggagacacgcctgcagaagaaccgtggacgccacccagagatacagcggcggcatcagcgccgccagcagccccagccccagcgccagccagcccggcgccgccagcagcgaggcccccggccccgtgggcgccggcctggaggagcccagcgccgccaccagcgaggagctgttcatccccctgcacgccggccagaccctggccggcctgctggccagcgagagatggctgatcttccagtacctgaagtggatgcagccctag

SEQ ID NO: 23376 - DNA, 498 bp, Artificial Sequence
  Description of Artificial Sequence: Synthetic coding sequence
atgagcgaccccatcaccctgaacgtgggcggcaagctgtacaccaccagcctggccaccctgaccagcttccccgacagcatgctgggcgccatgttcagcggcaagatgcccaccaagagagacagccagggcaactgcttcatcgacagagacggcaaggtgttcagatacatcctgaacttcctgagaaccagccacctggacctgcccgaggacttccaggagatgggcctgctgagaagagaggccgacttctaccaggtgcagcccctgatcgaggccctgcaggagaaggaggtggagctgagcaaggccgagaagaacgccatgctgaacatcaccctgaaccagagagtgcagaccgtgcacttcaccgtgagagaggccccccagatctacagcctgagcagcagcagcatggaggtgttcaacgccaacatcttcagcaccagctgcctgttcctgaagctgctgggcagcaagctgttctactag

SEQ ID NO: 23377 - DNA, 114 bp, Artificial Sequence
  Description of Artificial Sequence: Synthetic coding sequence
atgagcgaccccatcaccctgaacgtgggcggcaagctgtacaccaccagcctggccaccctgaccagcttccccgacagcatgctgggcgccatgttcagcggcaagatgtag

SEQ ID NO: 23378 - DNA, 351 bp, Artificial Sequence
  Description of Artificial Sequence: Synthetic coding sequence
atgagcgaccccatcaccctgaacgtgggcggcaagctgtacaccaccagcctggccaccctgaccagcttccccgacagcatgctgggcgccatgttcagcggcaagatgcccaccaagagagacagccagggcaactgcttcatcgacagagacggcaaggtgttcagatacatcctgaacttcctgagaaccagccacctggacctgcccgaggacttccaggagatgggcctgctgagaagagaggccgacttctaccaggtgcagcccctgatcgaggccctgcaggagaaggaggtggagctgagcaaggccgagaagaacgccatgctgaacatcaccctgtag

SEQ ID NO: 23379 - DNA, 216 bp, Artificial Sequence
  Description of Artificial Sequence: Synthetic coding sequence
atgagcgaccccatcaccctgaacgtgggcggcaagctgtacaccaccagcctggccaccctgaccagcttccccgacagcatgctgggcgccatgttcagcggcaagatgcccaccaagagagacagccagggcaactgcttcatcgacagagacggcaaggtgttcagatacatcctgaacttcctgagaaccagccacctggacctgccctag

SEQ ID NO: 23380 - DNA, 3450 bp, Artificial Sequence
  Description of Artificial Sequence: Synthetic coding sequence
atgttccagaccaagctgagaaacgagacctgggaggacctgcccaagatgagctgcaccaccgagatccaggccgccttcatcctgagcagcttcgtgaccttcttcagcggcctgatcatcctgctgatcttcagactgatctggagaagcgtgaagaagtggcagatcatcaagggcaccggcatcatcctggagctgttcaccagcggcaccatcgccagaagccacgtgagaagcctgcacttccagggccagttcagagaccacatcgagatgctgctgagcgcccagaccttcgtgggccaggtgctggtgatcctggtgttcgtgctgagcatcggcagcctgatcatctacttcatcaacagcgccgaccccgtgggcagctgcagcagctacgaggacaagaccatccccatcgacctggtgttcaacgccttcttcagcttctacttcggcctgagattcatggccgccgacgacaagatcaagttctggctggagatgaacagcatcgtggacatcttcaccatcccccccaccttcatcagctactacctgaagagcaactggctgggcctgagattcctgagagccctgagactgctggagctgccccagatcctgcagatcctgagagccatcaagaccagcaacagcgtgaagttcagcaagctgctgagcatcatcctgagcacctggttcaccgccgccggcttcatccacctggtggagaacagcggcgacccctggctgaagggcagaaacagccagaacatcagctacttcgagagcatctacctggtgatggccaccaccagcaccgtgggcttcggcgacgtggtggccaagaccagcctgggcagaaccttcatcatgttcttcaccctgggcagcctgatcctgttcgccaactacatccccgagatggtggagctgttcgccaacaagagaaagtacaccagcagctacgaggccctgaagggcaagaagttcatcgtggtgtgcggcaacatcaccgtggacagcgtgaccgccttcctgagaaacttcctgagagacaagagcggcgagatcaacaccgagatcgtgttcctgggcgagaccccccccagcctggagctggagaccatcttcaagtgctacctggcctacaccaccttcatcagcggcagcgccatgaagtgggaggacctgagaagagtggccgtggagagcgccgaggcctgcctgatcatcgccaaccccctgtgcagcgacagccacgccgaggacatcagcaacatcatgagagtgctgagcatcaagaactacgacagcaccaccagaatcatcatccagatcctgcagagccacaacaaggtgtacctgcccaagatccccagctggaactgggacaccggcgacaacatcatctgcttcgccgagctgaagctgggcttcatcgcccagggctgcctggtgcccggcctgtgcaccttcctgaccagcctgttcgtggagcagaacaagaaggtgatgcccaagcagacctggaagaagcacttcctgaacagcatgaagaacaagatcctgacccagagactgagcgacgacttcgccggcatgagcttccccgaggtggccagactgtgcttcctgaagatgcacctgctgctgatcgccatcgagtacaagagcctgttcaccgacggcttctgcggcctgatcctgaacccccccccccaggtgagaatcagaaagaacaccctgggcttcttcatcgccgagacccccaaggacgtgagaagagccctgttctactgcagcgtgtgccacgacgacgtgttcatccccgagctgatcaccaactgcggctgcaagagcagaagcagacagcacatcaccgtgcccagcgtgaagagaatgaagaagtgcctgaagggcatcagcagcagaatcagcggccaggacagcccccccagagtgagcgccagcaccagcagcatcagcaacttcaccaccagaaccctgcagcacgacgtggagcaggacagcgaccagctggacagcagcggcatgttccactggtgcaagcccaccagcctggacaaggtgaccctgaagagaaccggcaagagcaagtacaagttcagaaaccacatcgtggcctgcgtgttcggcgacgcccacagcgcccccatgggcctgagaaacttcgtgatgcccctgagagccagcaactacaccagaaaggagctgaaggacatcgtgttcatcggcagcctggactacctgcagagagagtggagattcctgtggaacttcccccagatctacatcctgcccggctgcgccctgtacagcggcgacctgcacgccgccaacatcgagcagtgcagcatgtgcgccgtgctgagcccccccccccagcccagcagcaaccagaccctggtggacaccgaggccatcatggccaccctgaccatcggcagcctgcagatcgacagcagcagcgaccccagccccagcgtgagcgaggagacccccggctacaccaacggccacaacgagaagagcaactgcagaaaggtgcccatcctgaccgagctgaagaaccccagcaacatccacttcatcgagcagctgggcggcctggagggcagcctgcaggagaccaacctgcacctgagcaccgccttcagcaccggcaccgtgttcagcggcagcttcctggacagcctgctggccaccgccttctacaactaccacgtgctggagctgctgcagatgctggtgaccggcggcgtgagcagccagctggagcagcacctggacaaggacaaggtgtacggcgtggccgacagctgcaccagcctgctgagcggcagaaacagatgcaagctgggcctgctgagcctgcacgagaccatcctgagcgacgtgaaccccagaaacaccttcggccagctgttctgcggcagcctggacctgttcggcatcctgtgcgtgggcctgtacagaatcatcgacgaggaggagctgaaccccgagaacaagagattcgtgatcaccagacccgccaacgagttcaagctgctgcccagcgacctggtgttctgcgccatccccttcagcaccgcctgctacaagagaaacgaggagttcagcctgcagaagagctacgagatcgtgaacaaggccagccagaccaccgagacccacagcgacaccaactgcccccccaccatcgacagcgtgaccgagaccctgtacagccccgtgtacagctaccagcccagaaccaacagcctgagcttccccaagcagatcgcctggaaccagagcagaaccaacagcatcatcagcagccagatccccctgggcgacaacgccaaggagaacgagagaaagaccagcgacgaggtgtacgacgaggaccccttcgcctacagcgagcccctgtag

SEQ ID NO: 23381 - DNA, 1302 bp, Artificial Sequence
  Description of Artificial Sequence: Synthetic coding sequence
atgaccgccgccagcagagccaacccctacagcatcgtgagcctggaggaggacggcctgcacctggtgaccatgagcggcgccaacggcttcggcaacggcaaggtgcacaccagaagaagatgcagaaacagattcgtgaagaagaacggccagtgcaacatcgccttcgccaacatggacgagaagagccagagatacctggccgacatgttcaccacctgcgtggacatcagatggagatacatgctgctgatcttcagcctggccttcctggccagctggctgctgttcggcgtgatcttctgggtgatcgccgtggcccacggcgacctggagcccgccgagggccacggcagaaccccctgcgtgatgcaggtgcacggcttcatggccgccttcctgttcagcatcgagacccagaccaccatcggctacggcctgagatgcgtgaccgaggagtgcctggtggccgtgttcatggtggtggcccagagcatcgtgggctgcatcatcgacagcttcatgatcggcgccatcatggccaagatggccagacccaagaagagagcccagaccctgctgttcagccacaacgccgtggtggccctgagagacggcaagctgtgcctgatgtggagagtgggcaacctgagaaagagccacatcgtggaggcccacgtgagagcccagctgatcaagcccagagtgaccgaggagggcgagtacatccccctggaccagatcgacatcgacgtgggcttcgacaagggcctggacagaatcttcctggtgagccccatcaccatcctgcacgagatcgacgaggccagccccctgttcggcatcagcagacaggacctggagaccgacgacttcgagatcgtggtgatcctggagggcatggtggaggccaccgccatgaccacccaggccagaagcagctacctggccaacgagatcctgtggggccacagattcgagcccgtgctgttcgaggagaagaaccagtacaagatcgactacagccacttccacaagacctacgaggtgcccagcacccccagatgcagcgccaaggacctggtggagaacaagttcctgctgcccagcgccaacagcttctgctacgagaacgagctggccttcctgagcagagacgaggaggacgaggccgacggcgaccaggacggcagaagcagagacggcctgagcccccaggccagacacgacttcgacagactgcaggccggcggcggcgtgctggagcagagaccctacagaagaggcagcgagatctag

SEQ ID NO: 23382 - DNA, 1875 bp, Artificial Sequence
  Description of Artificial Sequence: Synthetic coding sequence
atgcagaagagcagcacctgcagcttcatgtacggcgagctgaccgacaagaagaccatcgagaaggtgagacagaccttcgacaactacgagagcaactgcttcgaggtgctgctgtacaagaagaacagaacccccgtgtggttctacatgcagatcgcccccatcagaaacgagcacgagaaggtggtgctgttcctgtgcaccttcaaggacatcaccctgttcaagcagcccatcgaggacgacagcaccaagggctggaccaagttcgccagactgaccagagccctgaccaacagcagaagcgtgctgcagcagctgacccccatgaacaagaccgaggtggtgcacaagcacagcagactggccgaggtgctgcagctgggcagcgacatcctgccccagtacaagcaggaggcccccaagacccccccccacatcatcctgcactactgcgccttcaagaccacctgggactgggtgatcctgatcctgaccttctacaccgccatcatggtgccctacaacgtgagcttcaagaccaagcagaacaacatcgcctggctggtgctggacagcgtggtggacgtgatcttcctggtggacatcgtgctgaacttccacaccaccttcgtgggccccggcggcgaggtgatcagcgaccccaagctgatcagaatgaactacctgaagacctggttcgtgatcgacctgctgagctgcctgccctacgacatcatcaacgccttcgagaacgtggacgagggcatcagcagcctgttcagcagcctgaaggtggtgagactgctgagactgggcagagtggccagaaagctggaccactacctggagtacggcgccgccgtgctggtgctgctggtgtgcgtgttcggcctggtggcccactggctggcctgcatctggtacagcatcggcgactacgaggtgatcgacgaggtgaccaacaccatccagatcgacagctggctgtaccagctggccctgagcatcggcaccccctacagatacaacaccagcgccggcatctgggagggcggccccagcaaggacagcctgtacgtgagcagcctgtacttcaccatgaccagcctgaccaccatcggcttcggcaacatcgcccccaccaccgacgtggagaagatgttcagcgtggccatgatgatggtgggcagcctgctgtacgccaccatcttcggcaacgtgaccaccatcttccagcagatgtacgccaacaccaacagataccacgagatgctgaacaacgtgagagacttcctgaagctgtaccaggtgcccaagggcctgagcgagagagtgatggactacatcgtgagcacctggagcatgagcaagggcatcgacaccgagaaggtgctgagcatctgccccaaggacatgagagccgacatctgcgtgcacctgaacagaaaggtgttcaacgagcaccccgccttcagactggccagcgacggctgcctgagagccctggccgtggagttccagaccatccactgcgcccccggcgacctgatctaccacgccggcgagagcgtggacgccctgtgcttcgtggtgagcggcagcctggaggtgatccaggacgacgaggtggtggccatcctgggcaagggcgacgtgttcggcgacatcttctggaaggagaccaccctggcccacgcctgcgccaacgtgagagccctgacctactgcgacctgcacatcatcaagagagaggccctgctgaaggtgctggacttctacaccgccttcgccaacagcttcagcagaaacctgaccctgacctgcaacctgagaaagagaggctggttcagcatggccaacgccctgtag

SEQ ID NO: 23383 - DNA, 1836 bp, Artificial Sequence
  Description of Artificial Sequence: Synthetic coding sequence
atgcccggcggcaagagaggcctggtggccccccagaacaccttcctggagaacatcgtgagaagaagcagcgagagcagcttcctgctgggcaacgcccagatcgtggactggcccgtggtgtacagcaacgacggcttctgcaagctgagcggctaccacagagccgacgtgatgcagaagagcagcacctgcagcttcatgtacggcgagctgaccgacaagaagaccatcgagaaggtgagacagaccttcgacaactacgagagcaactgcttcgaggtgctgctgtacaagaagaacagaacccccgtgtggttctacatgcagatcgcccccatcagaaacgagcacgagaaggtggtgctgttcctgtgcaccttcaaggacatcaccctgttcaagcagcccatcgaggacgacagcaccaagggctggaccaagttcgccagactgaccagagccctgaccaacagcagaagcgtgctgcagcagctgacccccatgaacaagaccgaggtggtgcacaagcacagcagactggccgaggtgctgcagctgggcagcgacatcctgccccagtacaagcaggaggcccccaagacccccccccacatcatcctgcactactgcgccttcaagaccacctgggactgggtgatcctgatcctgaccttctacaccgccatcatggtgccctacaacgtgagcttcaagaccaagcagaacaacatcgcctggctggtgctggacagcgtggtggacgtgatcttcctggtggacatcgtgctgaacttccacaccaccttcgtgggccccggcggcgaggtgatcagcgaccccaagctgatcagaatgaactacctgaagacctggttcgtgatcgacctgctgagctgcctgccctacgacatcatcaacgccttcgagaacgtggacgagggcatcagcagcctgttcagcagcctgaaggtggtgagactgctgagactgggcagagtggccagaaagctggaccactacctggagtacggcgccgccgtgctggtgctgctggtgtgcgtgttcggcctggtggcccactggctggcctgcatctggtacagcatcggcgactacgaggtgatcgacgaggtgaccaacaccatccagatcgacagctggctgtaccagctggccctgagcatcggcaccccctacagatacaacaccagcgccggcatctgggagggcggccccagcaaggacagcctgtacgtgagcagcctgtacttcaccatgaccagcctgaccaccatcggcttcggcaacatcgcccccaccaccgacgtggagaagatgttcagcgtggccatgatgatggtgggcagcctgctgtacgccaccatcttcggcaacgtgaccaccatcttccagcagatgtacgccaacaccaacagataccacgagatgctgaacaacgtgagagacttcctgaagctgtaccaggtgcccaagggcctgagcgagagagtgatggactacatcgtgagcacctggagcatgagcaagggcatcgacaccgagaaggtgctgagcatctgccccaaggacatgagagccgacatctgcgtgcacctgaacagaaaggtgttcaacgagcaccccgccttcagactggccagcgacggctgcctgagagccctggccgtggagttccagaccatccactgcgcccccggcgacctgatctaccacgccggcgagagcgtggacgccctgtgcttcgtggtgagcggcagcctggaggtgatccaggacgacgaggtggtggccatcctggaccacctgagctag

SEQ ID NO: 23384 - DNA, 1755 bp, Artificial Sequence
  Description of Artificial Sequence: Synthetic coding sequence
atggtggccgaggtgtgcagcatgcccaccgccagcaccgtgaagaagcccttcgacctgagaagcaagatgggcaagtggtgccaccacagattcccctgctgcagaggcagcggcaagagcaacatgggcaccagcggcgaccacgacgacagcttcatgaagatgctgagaagcaagatgggcaagtgctgcagacactgcttcccctgctgcagaggcagcggcaccagcaacgtgggcaccagcggcgaccacgagaacagcttcatgaagatgctgagaagcaagatgggcaagtggtgctgccactgcttcccctgctgcagaggcagcagcaagagcaacgtgggcgcctggggcgactacgaccacagcgccttcatggagcccagataccacgtgagaagagaggacctggacaagctgcacagagccgcctggtggggcaaggtgcccagaaaggacctgatcgtgatgctgagagacaccgacatgaacaagagagacaaggagaagagaaccgccctgcacctggccagcgccaacggcaacagcgaggtggtgcagctgctgctggacagaagatgccagctgaacgtgctggacaacaagaagagaaccgccctgatcaaggccatccagtgccaggaggacgagtgcgtgctgatgctgctggagcacggcgccgacagaaacatccccgacgagtacggcaacaccgccctgcactacgccatctacaacgaggacaagctgatggccaaggccctgctgctgtacggcgccgacatcgagagcaagaacaagtgcggcctgacccccctgctgctgggcgtgcacgagcagaagcagcaggtggtgaagttcctgatcaagaagaaggccaacctgaacgtgctggacagatacggcagaaccgccctgatcctggccgtgtgctgcggcagcgccagcatcgtgaacctgctgctggagcagaacgtggacgtgagcagccaggacctgagcggccagaccgccagagagtacgccgtgagcagccaccaccacgtgatctgcgagctgctgagcgactacaaggagaagcagatgctgaagatcagcagcgagaacagcaaccccgagcaggacctgaagctgaccagcgaggaggagagccagagactgaaggtgagcgagaacagccagcccgagaagatgagccaggagcccgagatcaacaaggactgcgacagagaggtggaggaggagatcaagaagcacggcagcaaccccgtgggcctgcccgagaacctgaccaacggcgccagcgccggcaacggcgacgacggcctgatcccccagagaagaagcagaaagcccgagaaccagcagttccccgacaccgagaacgaggagtaccacagcgacgagcagaacgacaccagaaagcagctgagcgaggagcagaacaccggcatcagccaggacgagatcctgaccaacaagcagaagcagatcgaggtggccgagcagaagatgaacagcgagctgagcctgagccacaagaaggaggaggacctgctgagagagaacagcgtgctgcaggaggagatcgccgtgctgagactggagctggacgagaccaagcaccagaaccagctgagagagaacaagatcctggaggagatcgagagcgtgaaggagaagaccgacaagctgctgagagccatgcagctgaacgaggaggccctgaccaagaccaacatctag

SEQ ID NO: 23385 - DNA, 3228 bp, Artificial Sequence
  Description of Artificial Sequence: Synthetic coding sequence
atggtggtggaggtggacagcatgcccgccgccagcagcgtgaagaagcccttcggcctgagaagcaagatgggcaagtggtgctgcagatgcttcccctgctacagagagagcggcaagagcaacgtgggcaccagcggcgaccacgacgacagcgccatgaagaccctgagaagcaagatgggcaagtggtgccaccactgcttcccctgctgcagaggcagcggcaagagcaacgtgggcgccagcggcgaccacgacgacagcgccatgaagaccctgagaaacaagatgggcaagtggtgctgccactgcttcccctgctgcagaggcagcggcaagagcaaggtgggcgcctggggcgactacgacgacagcgccttcatggagcccagataccacgtgagaggcgaggacctggacaagctgcacagagccgcctggtggggcaaggtgcccagaaaggacctgatcgtgatgctgagagacaccgacgtgaacaagaaggacaagcagaagagaaccgccctgcacctggccagcgccaacggcaacagcgaggtggtgaagctgctgctggacagaagatgccagctgaacgtgctggacaacaagaagagaaccgccctgatcaaggccgtgcagtgccaggaggacgagtgcgccctgatgctgctggagcacggcaccgaccccaacatccccgacgagtacggcaacaccaccctgcactacgccatctacaacgaggacaagctgatggccaaggccctgctgctgtacggcgccgacatcgagagcaagaacaagcacggcctgacccccctgctgctgggcgtgcacgagcagaagcagcaggtggtgaagttcctgatcaagaagaaggccaacctgaacgccctggacagatacggcagaaccgccctgatcctggccgtgtgctgcggcagcgccagcatcgtgagcctgctgctggagcagaacatcgacgtgagcagccaggacctgagcggccagaccgccagagagtacgccgtgagcagccaccaccacgtgatctgccagctgctgagcgactacaaggagaagcagatgctgaagatcagcagcgagaacagcaaccccgagcaggagctgaagctgaccagcgaggaggagagccagagattcaagggcagcgagaacagccagcccgagaagatgagccaggagctggagatcaacaaggacggcgacagagaggtggaggaggagatgaagaagcacgagagcaacaacgtgggcctgctggagaacctgaccaacggcgtgaccgccggcaacggcgacaacggcctgatcccccagagaaagagcagaacccccgagaaccagcagttccccgacaacgagagcgaggagtaccacagaatctgcgagctgctgagcgactacaaggagaagcagatgcccaagtacagcagcgagaacagcaaccccgagcaggacctgaagctgaccagcgaggaggagagccagagactgaagggcagcgagaacggccagcccgagaagagaagccaggagcccgagatcaacaaggacggcgacagagagctggagaacttcatggccatcgaggagatgaagaagcacggcagcacccacgtgggcttccccgagaacctgaccaacggcgccaccgccggcaacggcgacgacggcctgatcccccccagaaagagcagaacccccgagagccagcagttccccgacaccgagaacgaggagtaccacagcgacgagcagaacgacacccagaagcagttctgcgaggagcagaacaccggcatcctgcacgacgagatcctgatccacgaggagaagcagatcgaggtggtggagaagatgaacagcgagctgagcctgagctgcaagaaggagaaggacgtgctgcacgagaacagcaccctgagagaggagatcgccatgctgagactggagctggacaccatgaagcaccagagccagctgagagagaagaagtacctggaggacatcgagagcgtgaagaagaagaacgacaacctgctgaaggccctgcagctgaacgagctgaccatggacgacgacaccgccgtgctggtgatcgacaacggcagcggcatgtgcaaggccggcttcgccggcgacgacgcccccagagccgtgttccccagcatcgtgggcagacccagacagcagggcatgatgggcggcatgcaccagaaggagagctacgtgggcaaggaggcccagagcaagagaggcatcctgaccctgaagtaccccatggagcacggcatcatcaccaactgggacgacatggagaagatctggcaccacaccttctacaacgagctgagagtggcccccgaggagcaccccatcctgctgaccgaggcccccctgaaccccaaggccaacagagagaagatgacccagatcatgttcgagaccttcaacacccccgccatgtacgtggccatccaggccgtgcccagcctgtacaccagcggcagaaccaccggcatcgtgatggacagcggcgacggcgtgacccacaccgtgcccatctacgagggcaacgccctgccccacgccaccctgagactggacctggccggcagagagctgcccgactacctgatgaagatcctgaccgagagaggctacagattcaccaccatggccgagagagagatcgtgagagacatcaaggagaagctgtgctacgtggccctggacttcgagcaggagatggccaccgccgccagcagcagcagcctggagaagagctacgagctgcccgacggccaggtgatcaccatcggcaacgagagattcagatgccccgaggccctgttccagccctgcttcctgggcatggagagctgcggcatccacgagaccaccttcaacagcatcatgaagagcgacgtggacatcagaaaggacctgtacaccaacaccgtgctgagcggcggcaccaccatgtaccccggcatggcccacagaatgcagaaggagatcgccgccctggcccccagcatgatgaagatcagaatcatcgccccccccaagagaaagtacagcgtgtgggtgggcggcagcatcctggccagcctgagcaccttccagcagatgtggatcagcaagcaggagtacgacgagagcggccccagcatcgtgcacagaaagtgcttctag

SEQ ID NO: 23386 - DNA, 1185 bp, Artificial Sequence
  Description of Artificial Sequence: Synthetic coding sequence
atggtggtggaggtggacagcatgcccgccgccagcagcgtgaagaagcccttcggcctgagaagcaagatgggcaagtggtgctgcagatgcttcccctgctacagagagagcggcaagagcaacgtgggcaccagcggcgaccacgacgacagcgccatgaagaccctgagaagcaagatgggcaagtggtgccaccactgcttcccctgctgcagaggcagcggcaagagcaacgtgggcgccagcggcgaccacgacgacagcgccatgaagaccctgagaaacaagatgggcaagtggtgctgccactgcttcccctgctgcagaggcagcggcaagagcaaggtgggcgcctggggcgactacgacgacagcgccttcatggagcccagataccacgtgagaggcgaggacctggacaagctgcacagagccgcctggtggggcaaggtgcccagaaaggacctgatcgtgatgctgagagacaccgacgtgaacaagaaggacaagcagaagagaaccgccctgcacctggccagcgccaacggcaacagcgaggtggtgaagctgctgctggacagaagatgccagctgaacgtgctggacaacaagaagagaaccgccctgatcaaggtgtgcagcagccagctgtaccagcacgaggccgtgcagtgccaggaggacgagtgcgccctgatgctgctggagcacggcaccgaccccaacatccccgacgagtacggcaacaccaccctgcactacgccatctacaacgaggacaagctgatggccaaggccctgctgctgtacggcgccgacatcgagagcaagaacaagcacggcctgacccccctgctgctgggcgtgcacgagcagaagcagcaggtggtgaagttcctgatcaagaagaaggccaacctgaacgccctggacagatacggcagaaccgccctgatcctggccgtgtgctgcggcagcgccagcatcgtgagcctgctgctggagcagaacatcgacgtgagcagccaggacctgagcggccagaccgccagagagtacgccgtgagcagccaccaccacgtgatctgccagctgctgagcgactacaaggagaagcagatgctgaagatcagcagcgagaacagcaaccccgagaacgtgagcagaaccagaaacaagtag

SEQ ID NO: 23387 - DNA, 1527 bp, Artificial Sequence
  Description of Artificial Sequence: Synthetic coding sequence
atggtggccgaggccggcagcatgcccgccgccagcagcgtgaagaagcccttcggcctgagaagcaagatgggcaagtggtgcagacactgcttcccctggtgcagaggcagcggcaagagcaacgtgggcaccagcggcgaccacgacgacagcgccatgaagaccctgagaagcaagatgggcaagtggtgcagacactgcttcccctggtgcagaggcagcggcaagagcaacgtgggcaccagcggcgaccacgacgacagcgccatgaagaccctgagaagcaagatgggcaagtggtgctgccactgcttcccctgctgcagaggcagcggcaagagcaaggtgggcccctggggcgactacgacgacagcgccttcatggagcccagataccacgtgagaagagaggacctggacaagctgcacagagccgcctggtggggcaaggtgcccagaaaggacctgatcgtgatgctgaaggacaccgacatgaacaagaaggacaagcagaagagaaccgccctgcacctggccagcgccaacggcaacagcgaggtggtgaagctgctgctggacagaagatgccagctgaacatcctggacaacaagaagagaaccgccctgaccaaggccgtgcagtgccaggaggacgagtgcgccctgatgctgctggagcacggcaccgaccccaacatccccgacgagtacggcaacaccgccctgcactacgccatctacaacgaggacaagctgatggccaaggccctgctgctgtacggcgccgacatcgagagcaagaacaagcacggcctgacccccctgctgctgggcgtgcacgagcagaagcagcaggtggtgaagttcctgatcaagaagaaggccaacctgaacgccctggacagatacggcagaaccgtgctgatcctggccgtgtgctgcggcagcgccagcatcgtgagcctgctgctggagcagaacatcgacgtgagcagccaggacctgagcggccagaccgccagagagtacgccgtgagcagcagacacaacgtgatctgccagctgctgagcgactacaaggagaagcagatcctgaaggtgagcagcgagaacagcaaccccgagcaggacctgaagctgaccagcgaggaggagagccagagactgaagggcagcgagaacagccagcccgaggagatgagccaggagcccgagatcaacaagggcggcgacagaaaggtggaggaggagatgaagaagcacggcagcacccacatgggcttccccgagaacctgcccaacggcgccaccgccgacaacggcgacgacggcctgatcccccccagaaagagcagaacccccgagagccagcagttccccgacaccgagaacgagcagtaccacagcgacgagcagaacgacacccagaagcagctgagcgaggagcagaacaccggcatcctgcaggacgagatcctgatccacgaggagaagcagatcgaggtggccgagaacgagttctag

SEQ ID NO: 23388 - DNA, 1629 bp, Artificial Sequence
  Description of Artificial Sequence: Synthetic coding sequence
atggtgaccgaggtgtgcagcatgcccgccgccagcgccgtgaagaagcccttcgacctgagaagcaagatgggcaagtggttccaccacagattcccctgctgcaagggcagcggcaagagcaacatgggcaccagcggcgaccacgacgacagcttcatgaagatgctgagaagcaagatgggcaagtgctgccaccactgcttcccctgctgcagaggcagcggcaccagcaacgtgggcaccagcggcgaccacgacaacagcttcatgaagaccctgagaagcaagatgggcaagtggtgctgccactgcttcccctgctgcagaggcagcggcaagagcaacgtgggcgcctggggcgactacgacgacagcgccttcatggagcccagataccacgtgagaagagaggacctggacaagctgcacagagccgcctggtggggcaaggtgcccagaaaggacctgatcgtgatgctgagagacaccgacatgaacaagagagacaagcagaagagaaccgccctgcacctggccagcgccaacggcaacagcgaggtggtgcagctgctgctggacagaagatgccagctgaacgtgctggacaacaagaagagaaccgccctgatcaaggccgtgcagtgccaggaggacgagtgcgtgctgatgctgctggagcacggcgccgaccagaacatccccgacgagtacggcaacaccaccctgcactacgccgtgcacaacgaggacaagctgatggccaaggccctgctgctgtacggcgccgacatcgagagcaagaacaagtgcggcctgacccccctgctgctgggcgtgcacgagcagaagcagcaggtggtgaagttcctgatcaagaagaaggccaacctgaacgccctggacagatacggcagaaccgccctgatcctggccgtgtgctgcggcagcgccagcatcgtgaacctgctgctggagcagaacgtggacgtgagcagccaggacctgagcggccagaccgccagagagtacgccgtgagcagccaccaccacgtgatctgcgagctgctgagcgactacaaggagaagcagatgctgaagatcagcagcgagaacagcaaccccgagcaggacctgaagctgaccagcgaggaggagagccagagactgaaggtgagcgagaacagccagcccgagaagatgagccaggagcccgagatcaacaaggactgcgacagagaggtggaggaggagatcaagaagcacggcagcaaccccgtgggcctgcccgagaacctgaccaacggcgccagcgccggcaacggcgacgacggcctgatcccccagagaagaagcagaaagcccgagaaccagcagttccccgacaccgagaacgaggagtaccacagcgacgagcagaacgacaccagaaagcagctgagcgaggagcagaacaccggcatcagccaggacgagatcctgaccaacaagcagaagcagatcgaggtggccgagaagaagatgaacagcgagctgagcctgagccacaagaaggaggaggacctgctgagagagaacagcatgctgcaggaggagatcgccatgctgatcagcggcgactggaactag

SEQ ID NO: 23389 - DNA, 1146 bp, Artificial Sequence
  Description of Artificial Sequence: Synthetic coding sequence
atggtgaccgaggtgtgcagcatgcccgccgccagcgccgtgaagaagcccttcgacctgagaagcaagatgggcaagtggttccaccacagattcccctgctgcaagggcagcggcaagagcaacatgggcaccagcggcgaccacgacgacagcttcatgaagatgctgagaagcaagatgggcaagtgctgccaccactgcttcccctgctgcagaggcagcggcaccagcaacgtgggcaccagcggcgaccacgacaacagcttcatgaagaccctgagaagcaagatgggcaagtggtgctgccactgcttcccctgctgcagaggcagcggcaagagcaacgtgggcgcctggggcgactacgacgacagcgccttcatggagcccagataccacgtgagaagagaggacctggacaagctgcacagagccgcctggtggggcaaggtgcccagaaaggacctgatcgtgatgctgagagacaccgacatgaacaagagagacaagcagaagagaaccgccctgcacctggccagcgccaacggcaacagcgaggtggtgcagctgctgctggacagaagatgccagctgaacgtgctggacaacaagaagagaaccgccctgatcaaggccgtgcagtgccaggaggacgagtgcgtgctgatgctgctggagcacggcgccgaccagaacatccccgacgagtacggcaacaccaccctgcactacgccgtgcacaacgaggacaagctgatggccaaggccctgctgctgtacggcgccgacatcgagagcaagaacaagtgcggcctgacccccctgctgctgggcgtgcacgagcagaagcagcaggtggtgaagttcctgatcaagaagaaggccaacctgaacgccctggacagatacggcagaaccgccctgatcctggccgtgtgctgcggcagcgccagcatcgtgaacctgctgctggagcagaacgtggacgtgagcagccaggacctgagcggccagaccgccagagagtacgccgtgagcagccaccaccacgtgatctgcgagctgctgagcgactacaaggagaagcagatgctgaagatcagcagcgagaacagcaaccccggcaaggaggccgaggagtag

SEQ ID NO: 23390 - DNA, 1527 bp, Artificial Sequence
  Description of Artificial Sequence: Synthetic coding sequence
atggtggccgaggccggcagcatgcccgccgccagcagcgtgaagaagcccttcggcctgagaagcaagatgggcaagtggtgcagacactgcttcccctggtgcagaggcagcggcaagagcaacgtgggcaccagcggcgaccacgacgacagcgccatgaagaccctgagaagcaagatgggcaagtggtgcagacactgcttcccctggtgcagaggcagcagcaagagcaacgtgggcaccagcggcgaccacgacgacagcgccatgaagaccctgagaagcaagatgggcaagtggtgctgccactgcttcccctgctgcagaggcagcggcaagagcaaggtgggcccctggggcgactacgacgacagcgccttcatggagcccagataccacgtgagaagagaggacctggacaagctgcacagagccgcctggtggggcaaggtgcccagaaaggacctgatcgtgatgctgaaggacaccgacatgaacaagaaggacaagcagaagagaaccgccctgcacctggccagcgccaacggcaacagcgaggtggtgaagctgctgctggacagaagatgccagctgaacatcctggacaacaagaagagaaccgccctgaccaaggccgtgcagtgcagagaggacgagtgcgccctgatgctgctggagcacggcaccgaccccaacatccccgacgagtacggcaacaccgccctgcactacgccatctacaacgaggacaagctgatggccaaggccctgctgctgtacggcgccgacatcgagagcaagaacaagcacggcctgacccccctgctgctgggcgtgcacgagcagaagcagcaggtggtgaagttcctgatcaagaagaaggccaacctgaacgccctggacagatacggcagaaccgccctgatcctggccgtgtgctgcggcagcgccagcatcgtgagcctgctgctggagcagaacatcgacgtgagcagccaggacctgagcggccagaccgccagagagtacgccgtgagcagccaccacaacgtgatctgccagctgctgagcgactacaaggagaagcagatgctgaaggtgagcagcgagaacagcaaccccgagcaggacctgaagctgaccagcgaggaggagagccagagactgaagggcagcgagaacagccagcccgaggagatgagccaggagcccgagatcaacaagggcggcgacagaaaggtggaggaggagatgaagaagcacggcagcacccacatgggcttccccgagaacctgcccaacggcgccaccgccgacaacggcgacgacggcctgatcccccccagaaagagcagaacccccgagagccagcagttccccgacaccgagaacgagcagtaccacagcgacgagcagaacgacacccagaagcagctgagcgaggagcagaacaccggcatcctgcaggacgagatcctgatccacgaggagaagcagatcgaggtggccgagaacgagttctag

SEQ ID NO: 23391 - DNA, 1461 bp, Artificial Sequence
  Description of Artificial Sequence: Synthetic coding sequence
atggtggccgaggccggcagcatgcccgccgccagcagcgtgaagaagcccttcggcctgagaagcaagatgggcaagtggtgcagacactgcttcccctggtgcagaggcagcggcaagagcaacgtgggcaccagcggcgaccacgacgacagcgccatgaagaccctgagaagcaagatgggcaagtggtgcagacactgcttcccctggtgcagaggcagcggcaagagcaacgtgggcaccagcggcgaccacgacgacagcgccatgaagaccctgagaagcaagatgggcaagtggtgctgccactgcttcccctgctgcagaggcagcggcaagagcaaggtgggcccctggggcgactacgacgacagcgccttcatggagcccagataccacgtgagaagagaggacctggacaagctgcacagagccgcctggtggggcaaggtgcccagaaaggacctgatcgtgatgctgaaggacaccgacatgaacaagaaggacaagcagaagagaaccgccctgcacctggccagcgccaacggcaacagcgaggtggtgaagctgctgctggacagaagatgccagctgaacatcctggacaacaagaagagaaccgccctgaccaaggccgtgcagtgccaggaggacgagtgcgccctgatgctgctggagcacggcaccgaccccaacatccccgacgagtacggcaacaccgccctgcactacgccatctacaacgaggacaagctgatggccaaggccctgctgctgtacggcgccgacatcgagagcaagaacaagcacggcctgacccccctgctgctgggcgtgcacgagcagaagcagcaggtggtgaagttcctgatcaagaagaaggccaacctgaacgccctggacagatacggcagaaccgtgctgatcctggccgtgtgctgcggcagcgccagcatcgtgagcctgctgctggagcagaacatcgacgtgagcagccaggacctgagcggccagaccgccagagagtacgccgtgagcagcagacacaacgtgatctgccagctgctgagcgactacaaggagaagcagatcctgaaggtgagcagcgagaacagcaaccccgagcaggacctgaagctgaccagcgaggaggagagccagagactgaagggcagcgagaacagccagcccgaggagatgagccaggagcccgagatcaacaagggcggcgacagaaaggtggaggaggagatgaagaagcacggcagcacccacatgggcttccccgagaacctgcccaacggcgccaccgccgacaacggcgacgacggcctgatcccccccagaaagagcagaacccccgagagccagcagttccccgacaccgagaacgagcagtaccacagagacttcagcggccaccccaacttccccaccaccctgcccatcaagcagtag

SEQ ID NO: 23392 - DNA, 1782 bp, Artificial Sequence
  Description of Artificial Sequence: Synthetic coding sequence
atggtggccgaggccggcagcatgcccgccgccagcagcgtgaagaagcccttcggcctgagaagcaagatgggcaagtggtgcagacactgcttcccctggtgcagaggcagcggcaagagcaacgtgggcaccagcggcgaccacgacgacagcgccatgaagaccctgagaagcaagatgggcaagtggtgcagacactgcttcccctggtgcagaggcagcggcaagagcaacgtgggcaccagcggcgaccacgacgacagcgccatgaagaccctgagaagcaagatgggcaagtggtgctgccactgcttcccctgctgcagaggcagcggcaagagcaaggtgggcccctggggcgactacgacgacagcgccttcatggagcccagataccacgtgagaagagaggacctggacaagctgcacagagccgcctggtggggcaaggtgcccagaaaggacctgatcgtgatgctgaaggacaccgacatgaacaagaaggacaagcagaagagaaccgccctgcacctggccagcgccaacggcaacagcgaggtggtgaagctgctgctggacagaagatgccagctgaacatcctggacaacaagaagagaaccgccctgaccaaggccgtgcagtgccaggaggacgagtgcgccctgatgctgctggagcacggcaccgaccccaacatccccgacgagtacggcaacaccgccctgcactacgccatctacaacgaggacaagctgatggccaaggccctgctgctgtacggcgccgacatcgagagcaagaacaagatcgagagccacagcgtgagccaggccggcgtgcagtggtgcgaccacagcagcctgcagcccagaccccccgaggcccagatggtgctgcagccccagccccagttcttcttcctgagcttcttcctgttcctgttcctgttcctgttcttcttcagcagagacgaggtgttcgccatgttcctgagactggtgctgaacagctgggcccaggccatccaccccccccagccccccaaggtgctgggcctgcagcacggcctgacccccctgctgctgggcgtgcacgagcagaagcagcaggtggtgaagttcctgatcaagaagaaggccaacctgaacgccctggacagatacggcagaaccgtgctgatcctggccgtgtgctgcggcagcgccagcatcgtgagcctgctgctggagcagaacatcgacgtgagcagccaggacctgagcggccagaccgccagagagtacgccgtgagcagcagacacaacgtgatctgccagctgctgagcgactacaaggagaagcagatcctgaaggtgagcagcgagaacagcaaccccgagcaggacctgaagctgaccagcgaggaggagagccagagactgaagggcagcgagaacagccagcccgaggagatgagccaggagcccgagatcaacaagggcggcgacagaaaggtggaggaggagatgaagaagcacggcagcacccacatgggcttccccgagaacctgcccaacggcgccaccgccgacaacggcgacgacggcctgatcccccccagaaagagcagaacccccgagagccagcagttccccgacaccgagaacgagcagtaccacagcgacgagcagaacgacacccagaagcagctgagcgaggagcagaacaccggcatcctgcaggacgagatcctgatccacgaggagaagcagatcgaggtggccgagaacgagttctag

SEQ ID NO: 23393 - DNA, 1080 bp, Artificial Sequence
  Description of Artificial Sequence: Synthetic coding sequence
atggccggccacctggccagcgacttcgccttcagccccccccccggcggcggcggcgacggcccctggggcgccgagcccggctgggtggaccccctgacctggctgagcttccagggcccccccggcggccccggcatcggccccggcgtgggccccggcagcgaggtgtggggcatccccccctgcccccccccctacgagctgtgcggcggcatggcctactgcggcccccaggtgggcgtgggcctggtgccccagggcggcctggagaccagccagcccgagagcgaggccggcgtgggcgtggagagcaacagcaacggcgccagccccgagccctgcaccgtgccccccggcgccgtgaagctggagaaggagaagctggagcagaaccccgagaagagccaggacatcaaggccctgcagaaggagctggagcagttcgccaagctgctgaagcagaagagaatcaccctgggctacacccaggccgacgtgggcctgatcctgggcgtgctgttcggcaaggtgttcagccagaagaccatctgcagattcgaggccctgcagctgagcttcaagaacatgtgcaagctgagacccctgctgcagaagtgggtggaggaggccgacaacaacgagaacctgcaggagatctgcaaggccgagaccctgatgcaggccagaaagagaaagagaaccagcatcgagaacagagtgagaggcaacctggagaacctgttcctgcagtgccccaagcccaccctgcagatcagccacatcgcccagcagctgggcctggagaaggacgtggtgagagtgtggttctgcaacagaagacagaagggcaagagaagcagcagcgactacgcccagagagaggacttcgaggccgccggcagccccttcagcggcggccccgtgagcttcccccccgcccccggcccccacttcggcacccccggctacggcagcccccacttcaccgccctgtacagcagcgtgcccttccccgagggcgaggtgttcccccccgtgagcgtgatcaccctgggcagccccatgcacagcaactag

SEQ ID NO: 23394 - DNA, 1080 bp, Artificial Sequence; identical to SEQ ID NO: 23393
  Description of Artificial Sequence: Synthetic coding sequence

SEQ ID NO: 23395 - DNA, 987 bp, Artificial Sequence
  Description of Artificial Sequence: Synthetic coding sequence
atggccggccacagacccagcaaccacttctgccccctgcccggcagcggcggcggcggccccagaggccccatgcccctgagagtggacaccctgacctggctgagcacccaggccgcccccggcagagtgatggtgtggcccgccgtgagacccggcatctgccccggccccgacgtgtggagaatccccctgggccccctgccccacgagttcagaggctggatcgccccctgcagacccagactgggcgccagcgaggccggcgactggctgagaagacccagcgagggcgccctgcccggcccctacatcgccctgagaagcatccccaagctgcccccccccgaggacatcagcggcatcctgaaggagctgcagcagctggccaaggagctgagacagaagagactgagcctgggctacagccaggccgacgtgggcatcgccgtgggcgccctgttcggcaaggtgctgagccagaccaccatctgcagattcgaggcccagcagctgagcgtggccaacatgtggaagctgagacccctgctgaagaagtggctgaaggaggtggaggccgagaacctgctgggcctgtgcaagatggagatgatcctgcagcagagcggcaagtggagaagagccagcagagagagaagaatcggcaacagcctggagaagttcttccagagatgccccaagcccaccccccagcagatcagccacatcgccggctgcctgcagctgcagaaggacgtggtgagagtgtggttctacaacagaagcaagatgggcagcagacccaccaacgacgccagccccagagagatcgtgggcaccgccggccccccctgccccggcgcccccgtgtgcttccacctgggcctgggcctgcccgtggacatcccccactacaccagactgtacagcgccggcgtggcccacagcagcgcccccgccaccaccctgggcctgctgagattctag

SEQ ID NO: 23396 - DNA, 2385 bp, Artificial Sequence
  Description of Artificial Sequence: Synthetic coding sequence
atgggccagagcggcagaagcagacaccagaagagagccagagcccaggcccagctgagaaacctggaggcctacgccgccaacccccacagcttcgtgttcaccagaggctgcaccggcagaaacatcagacagctgagcctggacgtgagaagagtgatggagcccctgaccgccagcagactgcaggtgagaaagaagaacagcctgaaggactgcgtggccgtggccggccccctgggcgtgacccacttcctgatcctgagcaagaccgagaccaacgtgtacttcaagctgatgagactgcccggcggccccaccctgaccttccaggtgaagaagtacagcctggtgagagacgtggtgagcagcctgagaagacacagaatgcacgagcagcagttcgcccacccccccctgctggtgctgaacagcttcggcccccacggcatgcacgtgaagctgatggccaccatgttccagaacctgttccccagcatcaacgtgcacaaggtgaacctgaacaccatcaagagatgcctgctgatcgactacaaccccgacagccaggagctggacttcagacactacagcatcaaggtggtgcccgtgggcgccagcagaggcatgaagaagctgctgcaggagaagttccccaacatgagcagactgcaggacatcagcgagctgctggccaccggcgccggcctgagcgagagcgaggccgagcccgacggcgaccacaacatcaccgagctgccccaggccgtggccggcagaggcaacatgagagcccagcagagcgccgtgagactgaccgagatcggccccagaatgaccctgcagctgatcaaggtgcaggagggcgtgggcgagggcaaggtgatgttccacagcttcgtgagcaagaccgaggaggagctgcaggccatcctggaggccaaggagaagaagctgagactgaaggcccagagacaggcccagcaggcccagaacgtgcagagaaagcaggagcagagagaggcccacagaaagaagagcctggagggcatgaagaaggccagagtgggcggcagcgacgaggaggccagcggcatccccagcagaaccgccagcctggagctgggcgaggacgacgacgagcaggaggacgacgacatcgagtacttctgccaggccgtgggcgaggcccccagcgaggacctgttccccgaggccaagcagaagagactggccaagagccccggcagaaagagaaagagatgggagatggacagaggcgccaagagctgccccgccaacttcctggccgccgccgacgacaagctgagcggcttccagggcgacttcctgtggcccatcctggtggtggagttcctggtggccgtggccagcaacggcctggccctgtacagattcagcatcagaaagcagagaccctggcaccccgccgtggtgttcagcgtgcagctggccgtgagcgacctgctgtgcgccctgaccctgccccccctggccgcctacctgtacccccccaagcactggagatacggcgaggccgcctgcagactggagagattcctgttcacctgcaacctgctgggcagcgtgatcttcatcacctgcatcagcctgaacagatacctgggcatcgtgcaccccttcttcgccagaagccacctgagacccaagcacgcctgggccgtgagcgccgccggctgggtgctggccgccctgctggccatgcccaccctgagcttcagccacctgaagagaccccagcagggcgccggcaactgcagcgtggccagacccgaggcctgcatcaagtgcctgggcaccgccgaccacggcctggccgcctacagagcctacagcctggtgctggccggcctgggctgcggcctgcccctgctgctgaccctggccgcctacggcgccctgggcagagccgtgctgagaagccccggcatgaccgtggccgagaagctgagagtggccgccctggtggccagcggcgtggccctgtacgccagcagctacgtgccctaccacatcatgagagtgctgaacgtggacgccagaagaagatggagcaccagatgccccagcttcgccgacatcgcccaggccaccgccgccctggagctgggcccctacgtgggctaccaggtgatgagaggcctgatgcccctggccttctgcgtgcaccccctgctgtacatggccgccgtgcccagcctgggctgctgctgcagacactgccccggctacagagacagctggaaccccgaggacgccaagagcaccggccaggccctgcccctgaacgccaccgccgcccccaagcccagcgagccccagagcagagagctgagccagtag

SEQ ID NO: 23397 - DNA, 1563 bp, Artificial Sequence
  Description of Artificial Sequence: Synthetic coding sequence
atgggccagagcggcagaagcagacaccagaagagagccagagcccaggcccagctgagaaacctggaggcctacgccgccaacccccacagcttcgtgttcaccagaggctgcaccggcagaaacatcagacagctgagcctggacgtgagaagagtgatggagcccctgaccgccagcagactgcaggtgagaaagaagaacagcctgaaggactgcgtggccgtggccggccccctgggcgtgacccacttcctgatcctgagcaagaccgagaccaacgtgtacttcaagctgatgagactgcccggcggccccaccctgaccttccaggtgaagaagtacagcctggtgagagacgtggtgagcagcctgagaagacacagaatgcacgagcagcagttcgcccacccccccctgctggtgctgaacagcttcggcccccacggcatgcacgtgaagctgatggccaccatgttccagaacctgttccccagcatcaacgtgcacaaggtgaacctgaacaccatcaagagatgcctgctgatcgactacaaccccgacagccaggagctggacttcagacactacagcatcaaggtggtgcccgtgggcgccagcagaggcatgaagaagctgctgcaggagaagttccccaacatgagcagactgcaggacatcagcgagctgctggccaccggcgccggcctgagcgagagcgaggccgagcccgacggcgaccacaacatcaccgagctgccccaggccgtggccggcagaggcaacatgagagcccagcagagcgccgtgagactgaccgagatcggccccagaatgaccctgcagctgatcaaggtgcaggagggcgtgggcgagggcaaggtgatgttccacagcttcgtgagcaagaccgaggaggagctgcaggccatcctggaggccaaggagaagaagctgagactgaaggcccagagacaggcccagcaggcccagaacgtgcagagaaagcaggagcagagagaggcccacagaaagaagagcctggagggcatgaagaaggccagagtgggcggcagcgacgaggaggccagcggcatccccagcagaaccgccagcctggagctgggcgaggacgacgacgagcaggaggacgacgacatcgagtacttctgccaggccgtgggcgaggcccccagcgaggacctgttccccgaggccaagcagaagagactggccaagagccccggcagaaagagaaagagatgggagatggacagaggcagaggcagactgtgcgaccagaagttccccaagaccaaggacaagagccagggcgcccaggtgcccagccccgccctgcccaccagctggcagctgcccaccaccaacagcgtgggcagcagaggcaccagctgcggcccctactggtggctgagcagctggtggccctggcccgccatggcctggccctgcaccgccagcgccagcggcagcagcgcccacggcacccccccctggagcagcctgagcagctggcagagcgccacctgcagcgccccctag

SEQ ID NO: 23398 - DNA, 378 bp, Artificial Sequence
  Description of Artificial Sequence: Synthetic coding sequence
tgaagcctgcagtgcgtgaagctgggcagagccaccgccagatggtggtgggtggtgaaggtgaagccccacgacaaggacgccaagatgaagtaccaggagtgcaacaagatcgtgaagcagaaggccttcgagagagccatcgccggcgacgagcacaagagaagcgtggtggacagcctggacatcgagagcatgaccatcgagggcgagtacagcggccccaagctggaggacgacaaggtgaccatcaccttcatgaagggcctgatgcagtggtacaaggaccagaagaagctgcaccagaagtgcgcctaccaggacttcagacagaagagcggcatcatcaccagccaggactgcgtgcagaccacctag

SEQ ID NO: 23399 - DNA, 486 bp, Artificial Sequence
  Description of Artificial Sequence: Synthetic coding sequence
atgggcgccaaccagctggtggtgctgaacgtgtacgacatgtactggatgaacgagtacaccagcagcatcggcatcggcgtgttccacagcggcatcgaggtgtacggcagagccgtggtgctgggcagcaccgacttcctggaggacgacatcgagaagatcgtggaggagctgggcaaggagtacaagggcaacgcctaccacctgatgcacaagaactgcaaccacttcagcagcgccctgagcgagatcctgtgcggcaaggagatccccagatggatcaacagactggcctacttcagcagctgcatccccttcctgcagagctgcctgcccaaggagtggctgacccccgccgccctgcagagcagcgtgagccaggagctgcaggacgagctggaggaggccgaggacgccgccgccagcgccagcgtggccagcaccgccgccggcagcagacccggcagacacaccaagctgtag

SEQ ID NO: 23400 - DNA, 585 bp, Artificial Sequence
  Description of Artificial Sequence: Synthetic coding sequence
atgggcgccaaccagctggtggtgctgaacgtgtacgacatgtactggatgaacgagtacaccagcagcatcggcatcggcgtgttccacagcggcatcgaggtgtacggcagagagttcgcctacggcggccacccctaccccttcagcggcatcttcgagatcagccccggcaacgccagcgagctgggcgagaccttcaagttcaaggaggccgtggtgctgggcagcaccgacttcctggaggacgacatcgagaagatcgtggaggagctgggcaaggagtacaagggcaacgcctaccacctgatgcacaagaactgcaaccacttcagcagcgccctgagcgagatcctgtgcggcaaggagatccccagatggatcaacagactggcctacttcagcagctgcatccccttcctgcagagctgcctgcccaaggagtggctgacccccgccgccctgcagagcagcgtgagccaggagctgcaggacgagctggaggaggccgaggacgccgccgccagcgccagcgtggccagcaccgccgccggcagcagacccggcagacacaccaagctgtag

SEQ ID NO: 23401 - DNA, 306 bp, Artificial Sequence
  Description of Artificial Sequence: Synthetic coding sequence
atgagactgaccttcctgaagaagatcgcccagctgaactacctggagatcctggtggtgctgctgagctacaccctgaagaccaccttccagtactggatgaacgagtacaccagcagcatcggcatcggcgtgttccacagcggcatcgaggtgtacggcagagagttcgcctacggcggccacccctaccccttcagcggcatcttcgagatcagccccggcaacgccagcgagctgggcgagaccttcaagttcaaggaggccgtggtgctgggcagcaccgacttcctggaggacgactag

SEQ ID NO: 23402 - DNA, 3072 bp, Artificial Sequence
  Description of Artificial Sequence: Synthetic coding sequence
atgagcgcctacagcgtgcccagcaccttcgcccaggccagcctgcccgtgcacaaccaggtgctgcccagcatcgagagcgtggacggcagcgaccccctggccaccctgcagacccccctgggcagactggaggccaaggaggaggaggacgaggacgaggacgaggacaccgaggaggacgaggaggaggacggcgaggacaccgacctggacgactgggagcccgacccccccagacccttcgacccccacgacctgtggtgcgaggagtgcaacaacgcccacgccagcgtgtgccccaagcacggccccctgcaccccatccccaacagacccgtgctgaccagagccagagccagcctgcccctggtgctgtacatcgacagattcctgggcggcgtgttcagcaagagaagaatccccaagagaacccagttcggccccgtggagggccccctggtgagaggcagcgagctgaaggactgctacatccacctgaaggtgagcctggacaagggcgacagaaaggagagagacctgcacgaggacctgtggttcgagctgagcgacgagaccctgtgcaactggatgatgttcgtgagacccgcccagaaccacctggagcagaacctggtggcctaccagtacggccaccacgtgtactacaccaccatcaagaacgtggagcccaagcaggagctgaaggtgtggtacgccgccagctacgccgagttcgtgaaccagaagatccacgacatcagcgaggaggagagaaaggtgctgagagagcaggagaagaactggccctgctacgagtgcaacagaagattcatcagcagcgagcagctgcagcagcacctgaacagccacgacgagaagctggacgtgttcagcagaaccagaggcagaggcagaggcagaggcaagagaagattcggccccggcagaagacccggcagaccccccaagttcatcagactggagatcaccagcgagaacggcgagaagagcgacgacggcacccaggacctgctgcacttccccaccaaggagcagttcgacgaggccgagcccgccaccctgaacggcctggaccagcccgagcagaccaccatccccatcccccagctgccccaggagacccagagcagcctggagcacgagcccgagacccacaccctgcacctgcagccccagcacgaggagagcgtggtgcccacccagagcaccctgaccgccgacgacatgagaagagccaagagaatcagaaacgccgccctgcagcacctgttcatcagaaagagcttcagacccttcaagtgcctgcagtgcggcaaggccttcagagagaaggacaagctggaccagcacctgagattccacggcagagagggcaactgccccctgacctgcgacctgtgcaacaagggcttcatcagcagcaccagcctggagagccacatgaagctgcacagcgaccagaagacctacagctgcatcttctgccccgagagcttcgacagactggacctgctgaaggaccacgtggccatccacatcaacgacggctacttcacctgccccacctgcaagaagagattccccgacttcatccaggtgaagaagcacgtgagaagcttccacagcgagaagatctaccagtgcaccgagtgcgacaaggccttctgcagacccgacaagctgagactgcacatgctgagacacagcgacagaaaggacttcctgtgcagcacctgcggcaagcagttcaagagaaaggacaagctgagagagcacatgcagagaatgcacaaccccgagagagaggccaagaaggccgacagaatcagcagaagcaagaccttcaagcccagaatcaccagcaccgactacgacagcttcaccttcaagtgcagactgtgcatgatgggcttcagaagaagaggcatgctggtgaaccacctgagcaagagacaccccgacatgaagatcgaggaggtgcccgagctgaccctgcccatcatcaagcccaacagagactacttctgccagtactgcgacaaggtgtacaagagcgccagcaagagaaaggcccacatcctgaagaaccaccccggcgccgagctgccccccagcatcagaaagctgagacccgccggccccggcgagcccgaccccatgctgagcacccacacccagctgaccggcaccatcgccaccccccccgtgtgctgcccccactgcagcaagcagtacagcagcaagaccaagatggtgcagcacatcagaaagaagcaccccgagttcgcccagctgagcaacaccatccacacccccctgaccaccgccgtgatcagcgccacccccgccgtgctgaccaccgacagcgccaccggcgagaccgtggtgaccaccgacctgctgacccaggccatgaccgagctgagccagaccctgaccaccgactacagaaccccccagggcgactaccagagaatccagtacatccccgtgagccagagcgccagcggcctgcagcagccccagcacatccagctgcaggtggtgcaggtggccagcgtgagcggccagcccctgagccccagcgcccagcaggcccagcagggcctgagccccagccacatccagggcagcagcagcacccagggccaggccctgcagcagcagcagcagcagcagcagaacagcagcgtgcagcacacctacctgcccagcgcctggaacagcttcagaggctacagcagcgagatccagatgatgaccctgccccccggccagttcgtgatcaccgacagcggcgtggccacccccgtgaccaccggccaggtgaaggccgtgaccagcggccactacgtgctgagcgagagccagagcgagctggaggagaagcagaccagcgccctgagcggcggcgtgcaggtggagccccccgcccacagcgacagcctggacccccagaccaacagccagcagcagaccacccagtacatcatcaccaccaccaccaacggcaacggcagcagcgaggtgcacatcaccaagccctag

SEQ ID NO: 23403 - DNA, 3483 bp, Artificial Sequence
  Description of Artificial Sequence: Synthetic coding sequence
atggacagcaaggacgagagcagccacgtgtggcccaccagcgccgagcacgagcagaacgccgcccaggtgcacttcgtgcccgacaccggcaccgtggcccagatcgtgtacaccgacgaccaggtgagacccccccagcaggtggtgtacaccgccgacggcgccagctacaccagcgtggacggccccgagcacaccctggtgtacatccaccccgtggaggccgcccagaccctgttcaccgaccccggccaggtggcctacgtgcagcaggacgccaccgcccagcaggccagcctgcccgtgcacaaccaggtgctgcccagcatcgagagcgtggacggcagcgaccccctggccaccctgcagacccccctgggcagactggaggccaaggaggaggaggacgaggacgaggacgaggacaccgaggaggacgaggaggaggacggcgaggacaccgacctggacgactgggagcccgacccccccagacccttcgacccccacgacctgtggtgcgaggagtgcaacaacgcccacgccagcgtgtgccccaagcacggccccctgcaccccatccccaacagacccgtgctgaccagagccagagccagcctgcccctggtgctgtacatcgacagattcctgggcggcgtgttcagcaagagaagaatccccaagagaacccagttcggccccgtggagggccccctggtgagaggcagcgagctgaaggactgctacatccacctgaaggtgagcctggacaagggcgacagaaaggagagagacctgcacgaggacctgtggttcgagctgagcgacgagaccctgtgcaactggatgatgttcgtgagacccgcccagaaccacctggagcagaacctggtggcctaccagtacggccaccacgtgtactacaccaccatcaagaacgtggagcccaagcaggagctgaaggtgtggtacgccgccagctacgccgagttcgtgaaccagaagatccacgacatcagcgaggaggagagaaaggtgctgagagagcaggagaagaactggccctgctacgagtgcaacagaagattcatcagcagcgagcagctgcagcagcacctgaacagccacgacgagaagctggacgtgttcagcagaaccagaggcagaggcagaggcagaggcaagagaagattcggccccggcagaagacccggcagaccccccaagttcatcagactggagatcaccagcgagaacggcgagaagagcgacgacggcacccaggacctgctgcacttccccaccaaggagcagttcgacgaggccgagcccgccaccctgaacggcctggaccagcccgagcagaccaccatccccatcccccagctgccccaggagacccagagcagcctggagcacgagcccgagacccacaccctgcacctgcagccccagcacgaggagagcgtggtgcccacccagagcaccctgaccgccgacgacatgagaagagccaagagaatcagactggagctgcagaacgccgccctgcagcacctgttcatcagaaagagcttcagacccttcaagtgcctgcagtgcggcaaggccttcagagagaaggacaagctggaccagcacctgagattccacggcagagagggcaactgccccctgacctgcgacctgtgcaacaagggcttcatcagcagcaccagcctggagagccacatgaagctgcacagcgaccagaagacctacagctgcatcttctgccccgagagcttcgacagactggacctgctgaaggaccacgtggccatccacatcaacgacggctacttcacctgccccacctgcaagaagagattccccgacttcatccaggtgaagaagcacgtgagaagcttccacagcgagaagatctaccagtgcaccgagtgcgacaaggccttctgcagacccgacaagctgagactgcacatgctgagacacagcgacagaaaggacttcctgtgcagcacctgcggcaagcagttcaagagaaaggacaagctgagagagcacatgcagagaatgcacaaccccgagagagaggccaagaaggccgacagaatcagcagaagcaagaccttcaagcccagaatcaccagcaccgactacgacagcttcaccttcaagtgcagactgtgcatgatgggcttcagaagaagaggcatgctggtgaaccacctgagcaagagacaccccgacatgaagatcgaggaggtgcccgagctgaccctgcccatcatcaagcccaacagagactacttctgccagtactgcgacaaggtgtacaagagcgccagcaagagaaaggcccacatcctgaagaaccaccccggcgccgagctgccccccagcatcagaaagctgagacccgccggccccggcgagcccgaccccatgctgagcacccacacccagctgaccggcaccatcgccaccccccccgtgtgctgcccccactgcagcaagcagtacagcagcaagaccaagatggtgcagcacatcagaaagaagcaccccgagttcgcccagctgagcaacaccatccacacccccctgaccaccgccgtgatcagcgccacccccgccgtgctgaccaccgacagcgccaccggcgagaccgtggtgaccaccgacctgctgacccaggccatgaccgagctgagccagaccctgaccaccgactacagaaccccccagggcgactaccagagaatccagtacatccccgtgagccagagcgccagcggcctgcagcagccccagcacatccagctgcaggtggtgcaggtggccagcgccaccagcccccaccagagccagcagagcaccgtggacgtgggccagctgcacgacccccagccctacccccagcacgccatccaggtgcagcacatccaggtgagcgagcccaccgccagcgcccccagcagcgcccaggtgagcggccagcccctgagccccagcgcccagcaggcccagcagggcctgagccccagccacatccagggcagcagcagcacccagggccaggccctgcagcagcagcagcagcagcagcagaacagcagcgtgcagcacacctacctgcccagcgcctggaacagcttcagaggctacagcagcgagatccagatgatgaccctgccccccggccagttcgtgatcaccgacagcggcgtggccacccccgtgaccaccggccaggtgaaggccgtgaccagcggccactacgtgctgagcgagagccagagcgagctggaggagaagcagaccagcgccctgagcggcggcgtgcaggtggagccccccgcccacagcgacagcctggacccccagaccaacagccagcagcagaccacccagtacatcatcaccaccaccaccaacggcaacggcagcagcgaggtgcacatcaccaagccctag

SEQ ID NO: 23404 - DNA, 3471 bp, Artificial Sequence
  Description of Artificial Sequence: Synthetic coding sequence
atggacagcaaggacgagagcagccacgtgtggcccaccagcgccgagcacgagcagaacgccgcccaggtgcacttcgtgcccgacaccggcaccgtggcccagatcgtgtacaccgacgaccaggtgagacccccccagcaggtggtgtacaccgccgacggcgccagctacaccagcgtggacggccccgagcacaccctggtgtacatccaccccgtggaggccgcccagaccctgttcaccgaccccggccaggtggcctacgtgcagcaggacgccaccgcccagcaggccagcctgcccgtgcacaaccaggtgctgcccagcatcgagagcgtggacggcagcgaccccctggccaccctgcagacccccctgggcagactggaggccaaggaggaggaggacgaggacgaggacgaggacaccgaggaggacgaggaggaggacggcgaggacaccgacctggacgactgggagcccgacccccccagacccttcgacccccacgacctgtggtgcgaggagtgcaacaacgcccacgccagcgtgtgccccaagcacggccccctgcaccccatccccaacagacccgtgctgaccagagccagagccagcctgcccctggtgctgtacatcgacagattcctgggcggcgtgttcagcaagagaagaatccccaagagaacccagttcggccccgtggagggccccctggtgagaggcagcgagctgaaggactgctacatccacctgaaggtgagcctggacaagggcgacagaaaggagagagacctgcacgaggacctgtggttcgagctgagcgacgagaccctgtgcaactggatgatgttcgtgagacccgcccagaaccacctggagcagaacctggtggcctaccagtacggccaccacgtgtactacaccaccatcaagaacgtggagcccaagcaggagctgaaggtgtggtacgccgccagctacgccgagttcgtgaaccagaagatccacgacatcagcgaggaggagagaaaggtgctgagagagcaggagaagaactggccctgctacgagtgcaacagaagattcatcagcagcgagcagctgcagcagcacctgaacagccacgacgagaagctggacgtgttcagcagaaccagaggcagaggcagaggcagaggcaagagaagattcggccccggcagaagacccggcagaccccccaagttcatcagactggagatcaccagcgagaacggcgagaagagcgacgacggcacccaggacctgctgcacttccccaccaaggagcagttcgacgaggccgagcccgccaccctgaacggcctggaccagcccgagcagaccaccatccccatcccccagctgccccaggagacccagagcagcctggagcacgagcccgagacccacaccctgcacctgcagccccagcacgaggagagcgtggtgcccacccagagcaccctgaccgccgacgacatgagaagagccaagagaatcagaaacgccgccctgcagcacctgttcatcagaaagagcttcagacccttcaagtgcctgcagtgcggcaaggccttcagagagaaggacaagctggaccagcacctgagattccacggcagagagggcaactgccccctgacctgcgacctgtgcaacaagggcttcatcagcagcaccagcctggagagccacatgaagctgcacagcgaccagaagacctacagctgcatcttctgccccgagagcttcgacagactggacctgctgaaggaccacgtggccatccacatcaacgacggctacttcacctgccccacctgcaagaagagattccccgacttcatccaggtgaagaagcacgtgagaagcttccacagcgagaagatctaccagtgcaccgagtgcgacaaggccttctgcagacccgacaagctgagactgcacatgctgagacacagcgacagaaaggacttcctgtgcagcacctgcggcaagcagttcaagagaaaggacaagctgagagagcacatgcagagaatgcacaaccccgagagagaggccaagaaggccgacagaatcagcagaagcaagaccttcaagcccagaatcaccagcaccgactacgacagcttcaccttcaagtgcagactgtgcatgatgggcttcagaagaagaggcatgctggtgaaccacctgagcaagagacaccccgacatgaagatcgaggaggtgcccgagctgaccctgcccatcatcaagcccaacagagactacttctgccagtactgcgacaaggtgtacaagagcgccagcaagagaaaggcccacatcctgaagaaccaccccggcgccgagctgccccccagcatcagaaagctgagacccgccggccccggcgagcccgaccccatgctgagcacccacacccagctgaccggcaccatcgccaccccccccgtgtgctgcccccactgcagcaagcagtacagcagcaagaccaagatggtgcagcacatcagaaagaagcaccccgagttcgcccagctgagcaacaccatccacacccccctgaccaccgccgtgatcagcgccacccccgccgtgctgaccaccgacagcgccaccggcgagaccgtggtgaccaccgacctgctgacccaggccatgaccgagctgagccagaccctgaccaccgactacagaaccccccagggcgactaccagagaatccagtacatccccgtgagccagagcgccagcggcctgcagcagccccagcacatccagctgcaggtggtgcaggtggccagcgccaccagcccccaccagagccagcagagcaccgtggacgtgggccagctgcacgacccccagccctacccccagcacgccatccaggtgcagcacatccaggtgagcgagcccaccgccagcgcccccagcagcgcccaggtgagcggccagcccctgagccccagcgcccagcaggcccagcagggcctgagccccagccacatccagggcagcagcagcacccagggccaggccctgcagcagcagcagcagcagcagcagaacagcagcgtgcagcacacctacctgcccagcgcctggaacagcttcagaggctacagcagcgagatccagatgatgaccctgccccccggccagttcgtgatcaccgacagcggcgtggccacccccgtgaccaccggccaggtgaaggccgtgaccagcggccactacgtgctgagcgagagccagagcgagctggaggagaagcagaccagcgccctgagcggcggcgtgcaggtggagccccccgcccacagcgacagcctggacccccagaccaacagccagcagcagaccacccagtacatcatcaccaccaccaccaacggcaacggcagcagcgaggtgcacatcaccaagccctag

SEQ ID NO: 23405 - DNA, 3186 bp, Artificial Sequence
  Description of Artificial Sequence: Synthetic coding sequence
atgagcgcctacagcgtgcccagcaccttcgcccaggccagcctgcccgtgcacaaccaggtgctgcccagcatcgagagcgtggacggcagcgaccccctggccaccctgcagacccccctgggcagactggaggccaaggaggaggaggacgaggacgaggacgaggacaccgaggaggacgaggaggaggacggcgaggacaccgacctggacgactgggagcccgacccccccagacccttcgacccccacgacctgtggtgcgaggagtgcaacaacgcccacgccagcgtgtgccccaagcacggccccctgcaccccatccccaacagacccgtgctgaccagagccagagccagcctgcccctggtgctgtacatcgacagattcctgggcggcgtgttcagcaagagaagaatccccaagagaacccagttcggccccgtggagggccccctggtgagaggcagcgagctgaaggactgctacatccacctgaaggtgagcctggacaagggcgacagaaaggagagagacctgcacgaggacctgtggttcgagctgagcgacgagaccctgtgcaactggatgatgttcgtgagacccgcccagaaccacctggagcagaacctggtggcctaccagtacggccaccacgtgtactacaccaccatcaagaacgtggagcccaagcaggagctgaaggtgtggtacgccgccagctacgccgagttcgtgaaccagaagatccacgacatcagcgaggaggagagaaaggtgctgagagagcaggagaagaactggccctgctacgagtgcaacagaagattcatcagcagcgagcagctgcagcagcacctgaacagccacgacgagaagctggacgtgttcagcagaaccagaggcagaggcagaggcagaggcaagagaagattcggccccggcagaagacccggcagaccccccaagttcatcagactggagatcaccagcgagaacggcgagaagagcgacgacggcacccaggacctgctgcacttccccaccaaggagcagttcgacgaggccgagcccgccaccctgaacggcctggaccagcccgagcagaccaccatccccatcccccagctgccccaggagacccagagcagcctggagcacgagcccgagacccacaccctgcacctgcagccccagcacgaggagagcgtggtgcccacccagagcaccctgaccgccgacgacatgagaagagccaagagaatcagactggagctgcagaacgccgccctgcagcacctgttcatcagaaagagcttcagacccttcaagtgcctgcagtgcggcaaggccttcagagagaaggacaagctggaccagcacctgagattccacggcagagagggcaactgccccctgacctgcgacctgtgcaacaagggcttcatcagcagcaccagcctggagagccacatgaagctgcacagcgaccagaagacctacagctgcatcttctgccccgagagcttcgacagactggacctgctgaaggaccacgtggccatccacatcaacgacggctacttcacctgccccacctgcaagaagagattccccgacttcatccaggtgaagaagcacgtgagaagcttccacagcgagaagatctaccagtgcaccgagtgcgacaaggccttctgcagacccgacaagctgagactgcacatgctgagacacagcgacagaaaggacttcctgtgcagcacctgcggcaagcagttcaagagaaaggacaagctgagagagcacatgcagagaatgcacaaccccgagagagaggccaagaaggccgacagaatcagcagaagcaagaccttcaagcccagaatcaccagcaccgactacgacagcttcaccttcaagtgcagactgtgcatgatgggcttcagaagaagaggcatgctggtgaaccacctgagcaagagacaccccgacatgaagatcgaggaggtgcccgagctgaccctgcccatcatcaagcccaacagagactacttctgccagtactgcgacaaggtgtacaagagcgccagcaagagaaaggcccacatcctgaagaaccaccccggcgccgagctgccccccagcatcagaaagctgagacccgccggccccggcgagcccgaccccatgctgagcacccacacccagctgaccggcaccatcgccaccccccccgtgtgctgcccccactgcagcaagcagtacagcagcaagaccaagatggtgcagcacatcagaaagaagcaccccgagttcgcccagctgagcaacaccatccacacccccctgaccaccgccgtgatcagcgccacccccgccgtgctgaccaccgacagcgccaccggcgagaccgtggtgaccaccgacctgctgacccaggccatgaccgagctgagccagaccctgaccaccgactacagaaccccccagggcgactaccagagaatccagtacatccccgtgagccagagcgccagcggcctgcagcagccccagcacatccagctgcaggtggtgcaggtggccagcgccaccagcccccaccagagccagcagagcaccgtggacgtgggccagctgcacgacccccagccctacccccagcacgccatccaggtgcagcacatccaggtgagcggccagcccctgagccccagcgcccagcaggcccagcagggcctgagccccagccacatccagggcagcagcagcacccagggccaggccctgcagcagcagcagcagcagcagcagaacagcagcgtgcagcacacctacctgcccagcgcctggaacagcttcagaggctacagcagcgagatccagatgatgaccctgccccccggccagttcgtgatcaccgacagcggcgtggccacccccgtgaccaccggccaggtgaaggccgtgaccagcggccactacgtgctgagcgagagccagagcgagctggaggagaagcagaccagcgccctgagcggcggcgtgcaggtggagccccccgcccacagcgacagcctggacccccagaccaacagccagcagcagaccacccagtacatcatcaccaccaccaccaacggcaacggcagcagcgaggtgcacatcaccaagccctag

SEQ ID NO: 23406 - DNA, 3225 bp, Artificial Sequence
  Description of Artificial Sequence: Synthetic coding sequence
atgagcgcctacagcgtgcccagcaccttcgcccaggccagcctgcccgtgcacaaccaggtgctgcccagcatcgagagcgtggacggcagcgaccccctggccaccctgcagacccccctgggcagactggaggccaaggaggaggaggacgaggacgaggacgaggacaccgaggaggacgaggaggaggacggcgaggacaccgacctggacgactgggagcccgacccccccagacccttcgacccccacgacctgtggtgcgaggagtgcaacaacgcccacgccagcgtgtgccccaagcacggccccctgcaccccatccccaacagacccgtgctgaccagagccagagccagcctgcccctggtgctgtacatcgacagattcctgggcggcgtgttcagcaagagaagaatccccaagagaacccagttcggccccgtggagggccccctggtgagaggcagcgagctgaaggactgctacatccacctgaaggtgagcctggacaagggcgacagaaaggagagagacctgcacgaggacctgtggttcgagctgagcgacgagaccctgtgcaactggatgatgttcgtgagacccgcccagaaccacctggagcagaacctggtggcctaccagtacggccaccacgtgtactacaccaccatcaagaacgtggagcccaagcaggagctgaaggtgtggtacgccgccagctacgccgagttcgtgaaccagaagatccacgacatcagcgaggaggagagaaaggtgctgagagagcaggagaagaactggccctgctacgagtgcaacagaagattcatcagcagcgagcagctgcagcagcacctgaacagccacgacgagaagctggacgtgttcagcagaaccagaggcagaggcagaggcagaggcaagagaagattcggccccggcagaagacccggcagaccccccaagttcatcagactggagatcaccagcgagaacggcgagaagagcgacgacggcacccaggacctgctgcacttccccaccaaggagcagttcgacgaggccgagcccgccaccctgaacggcctggaccagcccgagcagaccaccatccccatcccccagctgccccaggagacccagagcagcctggagcacgagcccgagacccacaccctgcacctgcagccccagcacgaggagagcgtggtgcccacccagagcaccctgaccgccgacgacatgagaagagccaagagaatcagactggagctgcagaacgccgccctgcagcacctgttcatcagaaagagcttcagacccttcaagtgcctgcagtgcggcaaggccttcagagagaaggacaagctggaccagcacctgagattccacggcagagagggcaactgccccctgacctgcgacctgtgcaacaagggcttcatcagcagcaccagcctggagagccacatgaagctgcacagcgaccagaagacctacagctgcatcttctgccccgagagcttcgacagactggacctgctgaaggaccacgtggccatccacatcaacgacggctacttcacctgccccacctgcaagaagagattccccgacttcatccaggtgaagaagcacgtgagaagcttccacagcgagaagatctaccagtgcaccgagtgcgacaaggccttctgcagacccgacaagctgagactgcacatgctgagacacagcgacagaaaggacttcctgtgcagcacctgcggcaagcagttcaagagaaaggacaagctgagagagcacatgcagagaatgcacaaccccgagagagaggccaagaaggccgacagaatcagcagaagcaagaccttcaagcccagaatcaccagcaccgactacgacagcttcaccttcaagtgcagactgtgcatgatgggcttcagaagaagaggcatgctggtgaaccacctgagcaagagacaccccgacatgaagatcgaggaggtgcccgagctgaccctgcccatcatcaagcccaacagagactacttctgccagtactgcgacaaggtgtacaagagcgccagcaagagaaaggcccacatcctgaagaaccaccccggcgccgagctgccccccagcatcagaaagctgagacccgccggccccggcgagcccgaccccatgctgagcacccacacccagctgaccggcaccatcgccaccccccccgtgtgctgcccccactgcagcaagcagtacagcagcaagaccaagatggtgcagcacatcagaaagaagcaccccgagttcgcccagctgagcaacaccatccacacccccctgaccaccgccgtgatcagcgccacccccgccgtgctgaccaccgacagcgccaccggcgagaccgtggtgaccaccgacctgctgacccaggccatgaccgagctgagccagaccctgaccaccgactacagaaccccccagggcgactaccagagaatccagtacatccccgtgagccagagcgccagcggcctgcagcagccccagcacatccagctgcaggtggtgcaggtggccagcgccaccagcccccaccagagccagcagagcaccgtggacgtgggccagctgcacgacccccagccctacccccagcacgccatccaggtgcagcacatccaggtgagcgagcccaccgccagcgcccccagcagcgcccaggtgagcggccagcccctgagccccagcgcccagcaggcccagcagggcctgagccccagccacatccagggcagcagcagcacccagggccaggccctgcagcagcagcagcagcagcagcagaacagcagcgtgcagcacacctacctgcccagcgcctggaacagcttcagaggctacagcagcgagatccagatgatgaccctgccccccggccagttcgtgatcaccgacagcggcgtggccacccccgtgaccaccggccaggtgaaggccgtgaccagcggccactacgtgctgagcgagagccagagcgagctggaggagaagcagaccagcgccctgagcggcggcgtgcaggtggagccccccgcccacagcgacagcctggacccccagaccaacagccagcagcagaccacccagtacatcatcaccaccaccaccaacggcaacggcagcagcgaggtgcacatcaccaagccctag

SEQ ID NO: 23407 - DNA, 1536 bp, Artificial Sequence
  Description of Artificial Sequence: Synthetic coding sequence
atgctgaagatggccgagcccatcgccagcctgatgatcgtggagtgcagagcctgcctgagatgcagccccctgttcctgtaccagagagagaaggacagaatgaccgagaacatgaaggagtgcctggcccagaccaacgccgccgtgggcgacatggtgaccgtggtgaagaccgaggtgtgcagccccctgagagaccaggagtacggccagccctgcagcagaagacccgacagcagcgccatggaggtggagcccaagaagctgaagggcaagagagacctgatcgtgcccaagagcttccagcaggtggacttctggttctgcgagagctgccaggagtacttcgtggacgagtgccccaaccacggcccccccgtgttcgtgagcgacacccccgtgcccgtgggcatccccgacagagccgccctgaccatcccccagggcatggaggtggtgaaggacaccagcggcgagagcgacgtgagatgcgtgaacgaggtgatccccaagggccacatcttcggcccctacgagggccagatcagcacccaggacaagagcgccggcttcttcagctggctgatcgtggacaagaacaacagatacaagagcatcgacggcagcgacgagaccaaggccaactggatgagatacgtggtgatcagcagagaggagagagagcagaacctgctggccttccagcacagcgagagaatctacttcagagcctgcagagacatcagacccggcgagtggctgagagtgtggtacagcgaggactacatgaagagactgcacagcatgagccaggagaccatccacagaaacctggccagaggcgagaagagactgcagagagagaagagcgagcaggtgctggacaaccccgaggacctgagaggccccatccacctgagcgtgctgagacagggcaagagcccctacaagagaggcttcgacgagggcgacgtgcacccccaggccaagaagaagaagatcgacctgatcttcaaggacgtgctggaggccagcctggagagcgccaaggtggaggcccaccagctggccctgagcaccagcctggtgatcagaaaggtgcccaagtaccaggacgacgcctacagccagtgcgccaccaccatgacccacggcgtgcagaacatcggccagacccagggcgagggcgactggaaggtgccccagggcgtgagcaaggagcccggccagctggaggacgaggaggaggagcccagcagcttcaaggccgacagccccgccgaggccagcctggccagcgacccccacgagctgcccaccaccagcttctgccccaactgcatcagactgaagaagaaggtgagagagctgcaggccgagctggacatgctgaagagcggcaagctgcccgagccccccgtgctgcccccccaggtgctggagctgcccgagttcagcgaccccgccggcaagctggtgtggatgagactgctgagcgagggcagagtgagaagcggcctgtgcggcggctag

SEQ ID NO: 23408 - DNA, 1536 bp, Artificial Sequence; identical to SEQ ID NO: 23407
  Description of Artificial Sequence: Synthetic coding sequence

SEQ ID NO: 23409 - DNA, 1434 bp, Artificial Sequence
  Description of Artificial Sequence: Synthetic coding sequence
atgaccgagaacatgaaggagtgcctggcccagaccaacgccgccgtgggcgacatggtgaccgtggtgaagaccgaggtgtgcagccccctgagagaccaggagtacggccagccctgcagcagaagacccgacagcagcgccatggaggtggagcccaagaagctgaagggcaagagagacctgatcgtgcccaagagcttccagcaggtggacttctggttctgcgagagctgccaggagtacttcgtggacgagtgccccaaccacggcccccccgtgttcgtgagcgacacccccgtgcccgtgggcatccccgacagagccgccctgaccatcccccagggcatggaggtggtgaaggacaccagcggcgagagcgacgtgagatgcgtgaacgaggtgatccccaagggccacatcttcggcccctacgagggccagatcagcacccaggacaagagcgccggcttcttcagctggctgatcgtggacaagaacaacagatacaagagcatcgacggcagcgacgagaccaaggccaactggatgagatacgtggtgatcagcagagaggagagagagcagaacctgctggccttccagcacagcgagagaatctacttcagagcctgcagagacatcagacccggcgagtggctgagagtgtggtacagcgaggactacatgaagagactgcacagcatgagccaggagaccatccacagaaacctggccagaggcgagaagagactgcagagagagaagagcgagcaggtgctggacaaccccgaggacctgagaggccccatccacctgagcgtgctgagacagggcaagagcccctacaagagaggcttcgacgagggcgacgtgcacccccaggccaagaagaagaagatcgacctgatcttcaaggacgtgctggaggccagcctggagagcgccaaggtggaggcccaccagctggccctgagcaccagcctggtgatcagaaaggtgcccaagtaccaggacgacgcctacagccagtgcgccaccaccatgacccacggcgtgcagaacatcggccagacccagggcgagggcgactggaaggtgccccagggcgtgagcaaggagcccggccagctggaggacgaggaggaggagcccagcagcttcaaggccgacagccccgccgaggccagcctggccagcgacccccacgagctgcccaccaccagcttctgccccaactgcatcagactgaagaagaaggtgagagagctgcaggccgagctggacatgctgaagagcggcaagctgcccgagccccccgtgctgcccccccaggtgctggagctgcccgagttcagcgaccccgccggcaagctggtgtggatgagactgctgagcgagggcagagtgagaagcggcctgtgcggcggctag

SEQ ID NO: 23410 - DNA, 1425 bp, Artificial Sequence
  Description of Artificial Sequence: Synthetic coding sequence
atgagcatccaggccccccccagactgctggagctggccggccagagcctgctgagagaccaggccctgagcatcagcgccatggaggagctgcccagagtgctgtacctgcccctgttcatggaggccttcagcagaagacacttccagaccctgaccgtgatggtgcaggcctggcccttcacctgcctgcccctgggcagcctgatgaagaccctgcacctggagaccctgaaggccctgctggagggcctgcacatgctgctgacccagaaggacagacccagaagatggaagctgcaggtgctggacctgagagacgtggacgagaacttctgggccagatggcccggcgcctgggccctgagctgcttccccgagaccaccagcaagagacagaccgccgaggactgccccagaatgggcgagcaccagcccctgaaggtgttcatcgacatctgcctgaaggagatcccccaggacgagtgcctgagatacctgttccagtgggtgtaccagagaagaggcctggtgcacctgtgctgcagcaagctggtgaactacctgacccccatcaagtacctgagaaagagcctgaagatcatctacctgaacagcatccaggagctggagatcagaaacatgagctggcccagactgatcagaaagctgagatgctacctgaaggagatgaagaacctgagaaagctggtgttcagcagatgccaccactacaccagcgacaacgagctgcagggcagactggtggccaagttcagcagcgtgttcctgagactggagcacctgcagctgctgaagatcaagctgatcaccttcttcagcggccacctggagcagctgatcagatgcctgcagaaccccctggagaacctggagctgacctacggctacctgctggaggaggacatgaagtgcctgagccagtaccccagcctgggctacctgaagcacctgaacctgagctacgtgctgctgttcagaatcagcctggagcccctgggcgccctgctggagaagatcgccgccagcctgaagaccctgatcctggagggctgccagatccactacagccagctgagcgccatcctgcccgccctgagcagatgcagccagctgaccaccttctacttcggcagaaactgcatgagcatcgacgccctgaaggacctgctgagacacaccagcggcctgagcaagctgagcctggagacctaccccgcccccgaggagagcctgaacagcctggtgagagtgaactgggagatcttcacccccctgagagccgagctgatgtgcaccctgagagaggtgagacagcccaagagaatcttcatcggccccaccccctgccccagctgcggcagcagccccagcgaggagctggagctgcacctgtgctgctag

SEQ ID NO: 23411 - DNA, 690 bp, Artificial Sequence
  Description of Artificial Sequence: Synthetic coding sequence
atgaagggcggcaaggcccaccagacctgccccttccacaacagaaccagcgtgctgaccggcctggtgatcaccaacgaccccgtgagcgacagcctgttcgtgaagggctgcttcgagctgcaggagagatgcctgcagaaccccctggagaacctggagctgacctacggctacctgctggaggaggacatgaagtgcctgagccagtaccccagcctgggctacctgaagcacctgaacctgagctacgtgctgctgttcagaatcagcctggagcccctgggcgccctgctggagaagatcgccgccagcctgaagaccctgatcctggagggctgccagatccactacagccagctgagcgccatcctgcccgccctgagcagatgcagccagctgaccaccttctacttcggcagaaactgcatgagcatcgacgccctgaaggacctgctgagacacaccagcggcctgagcaagctgagcctggagacctaccccgcccccgaggagagcctgaacagcctggtgagagtgaactgggagatcttcacccccctgagagccgagctgatgtgcaccctgagagaggtgagacagcccaagagaatcttcatcggccccaccccctgccccagctgcggcagcagccccagcgaggagctggagctgcacctgtgctgctag

SEQ ID NO: 23412 - DNA, 1425 bp, Artificial Sequence
  Description of Artificial Sequence: Synthetic coding sequence
atgagcctgcaggcccccagcagactgctggagctggccggccagagcctgctgagaaaccagttcctgaccatcttcaccctggacgagctgcccagagaggtgttccccctgatgttcatggaggccttcagcatgagaagattcgaggccctgaagctgatggtgcaggcctggcccttcctgagcctgcccctgggcagcctgatgaagaccctgcacctggagaccctgcaggccgtgctgagaggcctggacaccctggtggcccagaaggtgagacccagaagatggaagctgcaggtgctggacctgagagacgtggacgagaacttctggaccatctggagcggcgccagagtgctgagctgcagccccgaggccatgagcaagagacagaccgtggaggactgccccagaatgggcgagcaccagcccctgaaggtgttcatcgacctgtgcctgaaggagagcaccctggacgagtgcctgagctacctgttcggctggatccactacagaagaggcctggtgcacctgtgctgcagcaaggtgcagaactacagcatgcccaccagcagcttcagaaacctgctggagagaatctaccccgacagcatccaggagctggaggtgtggaagaagtgcagcctgaacaagaccggcaagttcgccccctacctgagccagatgagcaacctgagagagctgttcctggccttcggctacgagagagagctgtacgtgagcgtgcagtggccctgcatccccgacctggacagccccttcctgtgcctgtactacccccagatgctgtacatcaagaagatcagcaacatcaaggagcacctggagcacctgctgagatacctgaagaaccccctgggcgccttcatcttcagcgacgcctacctgaccgacagagacatggagtgcctgagccagtaccccagcctgagccagctgaaggagctgagactgatccacatcctgatgtggaccacccacctggagcccctgggcgtgctgctggagaaggtggccgccaccctgaagaccctggtgctgaaggactgcagaatccaggacccccagctgagagtgctgctgcccgccctgagccactgcagccagctgaccaccttcaacttccacggcaacgagaccagcatgaacgccctgaaggacctgctgagacacaccggcggcctgagcaagctgggcctggagctgtaccccgcccccctggagagcctggactacaagggccacgtgaactgggagatcctgacccccatcagagccgagctgatgagaaccctgagagaggtgagacagcccaagagaatcttcttcggccccgtgccctgccccaactgcggcagctggcccagcgagaaggtggacttccacctgtgcagctag

SEQ ID NO: 23413 - DNA, 1434 bp, Artificial Sequence
  Description of Artificial Sequence: Synthetic coding sequence
atgaagatgagcatcagaatcccccccagactgctggagctgggcagaagcctgctgagagaccaggccctggccgtgagcaccctggaggagctgcccaccgagctgttcccccccctgttcatggaggccttcagcagaagaagatgcgaggccctgaagctgatggtgcaggcctggcccttcagaagactgcccctgagacccctgatcaagatgccctgcctggaggccttccaggccgtgctggacggcctggacgccctgctgacccagggcgtgagacccagaagatggaagctgcaggtgctggacctgcaggacgtgtgcgagaacttctggatggtgtggagcgaggccatggcccacggctgcttcctgaacgccaagagaaacaagacccccgtgcaggactgccccagaatgagagagagacagcccctgaccgtgttcgtggagctgtggctgaagaacagaaccctggacgagtacctgacctgcctgctgctgtgggtgaagcagagaagagacctgctgcacctgtgctgcaagaagctgaagatcctgggcatgcccttcagaaacatcagaagcatcctgaagatggtgaacctggactgcatccaggaggtggaggtgaactgcaagtggatcctgcccatcctgacccagttcaccccctacctgggccacctgagaaacctgcagaagctggtgctgagccacatggacgtgagcagatacgtgagccccgagcagaagaaggagatcgtgacccagttcaccacccagttcctgaagctgagatgcctgcagaagctgtacatgaacagcgtgagcttcctggagggccacctggaccagctgctgagctgcctgaagaccagcctgaaggtgctgaccatcaccaactgcgtgctgctggagagcgacctgaagcacctgagccagtgccccagcatcagccagctgaagaccctggacctgagcggcatcagactgaccaactacagcctggtgcccctgcagatcctgctggagaaggtggccgccaccctggagtacctggacctggacgactgcggcatcatcgacagccaggtgaacgccatcctgcccgccctgagcagatgcttcgagctgaacaccttcagcttctgcggcaaccccatctgcatggccaccctggagaacctgctgagccacaccatcatcctgaagaacctgtgcctggagctgtaccccgccccccaggagagctacggcgccgacggcaccctgtgctggagcagattcgcccagatcagagccgagctgatgaagaaggtgagacacctgagacaccccaagagaatcctgttctgcaccgacaactgccccgaccacggcgacagaagcttctacgacctggaggccgaccagtactgctgctag

SEQ ID NO: 23414 - DNA, 1308 bp, Artificial Sequence
  Description of Artificial Sequence: Synthetic coding sequence
atggaggccttcagcagaagaagatgcgaggccctgaagctgatggtgcaggcctggcccttcagaagactgcccctgagacccctgatcaagatgccctgcctggaggccttccaggccgtgctggacggcctggacgccctgctgacccagggcgtgagacccagaagatggaagctgcaggtgctggacctgcaggacgtgtgcgagaacttctggatggtgtggagcgaggccatggcccacggctgcttcctgaacgccaagagaaacaagacccccgtgcaggactgccccagaatgagagagagacagcccctgaccgtgttcgtggagctgtggctgaagaacagaaccctggacgagtacctgacctgcctgctgctgtgggtgaagcagagaagagacctgctgcacctgtgctgcaagaagctgaagatcctgggcatgcccttcagaaacatcagaagcatcctgaagatggtgaacctggactgcatccaggaggtggaggtgaactgcaagtggatcctgcccatcctgacccagttcaccccctacctgggccacctgagaaacctgcagaagctggtgctgagccacatggacgtgagcagatacgtgagccccgagcagaagaaggagatcgtgacccagttcaccacccagttcctgaagctgagatgcctgcagaagctgtacatgaacagcgtgagcttcctggagggccacctggaccagctgctgagctgcctgaagaccagcctgaaggtgctgaccatcaccaactgcgtgctgctggagagcgacctgaagcacctgagccagtgccccagcatcagccagctgaagaccctggacctgagcggcatcagactgaccaactacagcctggtgcccctgcagatcctgctggagaaggtggccgccaccctggagtacctggacctggacgactgcggcatcatcgacagccaggtgaacgccatcctgcccgccctgagcagatgcttcgagctgaacaccttcagcttctgcggcaaccccatctgcatggccaccctggagaacctgctgagccacaccatcatcctgaagaacctgtgcctggagctgtaccccgccccccaggagagctacggcgccgacggcaccctgtgctggagcagattcgcccagatcagagccgagctgatgaagaaggtgagacacctgagacaccccaagagaatcctgttctgcaccgacaactgccccgaccacggcgacagaagcttctacgacctggaggccgaccagtactgctag

SEQ ID NO: 23415 - DNA, 1311 bp, Artificial Sequence
  Description of Artificial Sequence: Synthetic coding sequence
atggaggccttcagcagaagaagatgcgaggccctgaagctgatggtgcaggcctggcccttcagaagactgcccctgagacccctgatcaagatgccctgcctggaggccttccaggccgtgctggacggcctggacgccctgctgacccagggcgtgagacccagaagatggaagctgcaggtgctggacctgcaggacgtgtgcgagaacttctggatggtgtggagcgaggccatggcccacggctgcttcctgaacgccaagagaaacaagacccccgtgcaggactgccccagaatgagagagagacagcccctgaccgtgttcgtggagctgtggctgaagaacagaaccctggacgagtacctgacctgcctgctgctgtgggtgaagcagagaagagacctgctgcacctgtgctgcaagaagctgaagatcctgggcatgcccttcagaaacatcagaagcatcctgaagatggtgaacctggactgcatccaggaggtggaggtgaactgcaagtggatcctgcccatcctgacccagttcaccccctacctgggccacctgagaaacctgcagaagctggtgctgagccacatggacgtgagcagatacgtgagccccgagcagaagaaggagatcgtgacccagttcaccacccagttcctgaagctgagatgcctgcagaagctgtacatgaacagcgtgagcttcctggagggccacctggaccagctgctgagctgcctgaagaccagcctgaaggtgctgaccatcaccaactgcgtgctgctggagagcgacctgaagcacctgagccagtgccccagcatcagccagctgaagaccctggacctgagcggcatcagactgaccaactacagcctggtgcccctgcagatcctgctggagaaggtggccgccaccctggagtacctggacctggacgactgcggcatcatcgacagccaggtgaacgccatcctgcccgccctgagcagatgcttcgagctgaacaccttcagcttctgcggcaaccccatctgcatggccaccctggagaacctgctgagccacaccatcatcctgaagaacctgtgcctggagctgtaccccgccccccaggagagctacggcgccgacggcaccctgtgctggagcagattcgcccagatcagagccgagctgatgaagaaggtgagacacctgagacaccccaagagaatcctgttctgcaccgacaactgccccgaccacggcgacagaagcttctacgacctggaggccgaccagtactgctgctag

SEQ ID NO: 23416 - DNA, 1452 bp, Artificial Sequence
  Description of Artificial Sequence: Synthetic coding sequence
atgagcctgcaggccccccccagactgctggagctggccgagcagagcctgctgagagacagagccctggccatccccaccctggaggagctgcccagagagctgttcccccccctgttcatggaggccttcaccagaagatgctgcgagaccctgaccaccatggtgcaggcctggcccttcacctgcctgcccctgggcagcctgatgaagagctgcaacctggagatcttcagagccgtgctggagggcctggacgccctgctggcccagaaggtgagacccagaagatggaagctgcaggtgctggacctgagaaacgtggacgagaacttctggggcatctggagcggcgccagcgccctgagccccgaggccctgagcaagagaagaaccgccggcaactgccccagacccggcggccagcagcccctgatggtgatcctggacctgtgcttcaagaacggcatgctggacgagtgcctgacccacttcctggagtggggcaagcagagaaagggcctgctgcacgtgtgctgcaaggagctgcagatcttcggcatcgccatccacagaatcatcgaggtgctgaacaccgtggagctggactgcatccaggaggtggaggtgtgctgcccctgggagctgagcatcctgatcagattcgccccctacctgggccagatgagaaacctgagaaagctggtgctgttcaacatccacgtgagcgcctgcatccccctggacagaaaggagcagttcgtgatccagttcaccagccagttcctgaagctggactacttccagaagctgtacatgcacagcgtgagcttcctggagggccacctggaccagctgctgagatgcctgcaggcccccctggagaccgtggtgatgaccgagtgcctgctgagcgagagcgacctgaagcacctgagctggtgccccagcatcagacagctgaaggagctggacctgagaggcatcaccctgacccacttcagccccgagcccctgagcgtgctgctggagcaggccgaggccaccctgcagaccctggacctggaggactgcggcatcgtggacagccagctgagcgccatcctgcccgccctgagcagatgcagccagctgagcaccttcagcttctgcggcaacctgatcagcatggccgccctggagaacctgctgagacacaccgtgggcctgagcaagctgagcctggagctgtaccccgcccccctggagagctacgacgcccagggcgccctgtgctggggcagattcagccagctgggcgccgagctgatgaagaccctgagagacctgagacagcccaagatcatcgtgttcagcaccgtgccctgccccagatgcggcatcagagccagctacgacctggagcccagccactgcctgctgaacgcctgctgccagggcggcttcatctag

SEQ ID NO: 23417 - DNA, 1425 bp, Artificial Sequence
  Description of Artificial Sequence: Synthetic coding sequence
atgagcatccaggccccccccagactgctggagctggccggccagagcctgctgagagaccaggccctgagcatcagcgccatggaggagctgcccagagtgctgtacctgcccctgttcatggaggccttcagaagaagacacttccagaccctgaccgtgatggtgcaggcctggcccttcacctgcctgcccctgggcagcctgatgaagaccctgcacctggagaccctgaaggccctgctggagggcctgcacatgctgctgacccagaaggacagacccagaagatggaagctgcaggtgctggacctgagagacgtggacgagaacttctgggccagatggcccggcgcctgggccctgagctgcttccccgagaccatgagcaagagacagaccgccgaggactgccccagaatgggcgagcaccagcccctgaaggtgttcatcgacatctgcctgaaggagatcccccaggacgagtgcctgagatacctgttccagtgggtgtaccagagaagaggcctggtgcacctgtgctgcagcaagctggtgaactacctgacccccatcaagcacctgagaaagagcctgaagatcatctacctgaacagcatccagcagctggagatcagaaacatgagctggcccagactgatcagaaagctgagatgctacctgaaggagatgaagaacctgagaaagctggtgttcagcagatgccaccacagcatgagcgacaacgagctggagggcagactggtgaccaagttcagcagcgtgttcctgagactggagcacctgcagctgctgaagatcaagctgatcaccttcttcagcggccacctggagcagctgatcagatgcctgcagaaccccctggagaacctggagctgacctacggctacctgctggaggaggacatgaagtgcctgagccagtaccccagcctgggctacctgaagcacctgaacctgagctacgtgctgctgttcagaatcagcctggagcccctgggcgccctgctggagaagatcgccgccagcctggagaccctgatcctggagggctgccagatccactacagccagctgagcgccatcctgcccggcctgagccactgcagccagctgaccaccttctacttcggcagaaactgcatgagcatgggcgccctgaaggacctgctgagacacaccagcggcctgagcaagctgagcctggagacctaccccgcccccgaggagagcctgaacagcctggtgagagtggactgggagatcttcgccctgctgagagccgagctgatgtgcaccctgagagaggtgagacagcccaagagaatcttcatcggccccaccccctgccccagctgcggcagcagccccagcgaggagctggagctgcacctgtgctgctag

SEQ ID NO: 23418 - DNA, 1425 bp, Artificial Sequence
  Description of Artificial Sequence: Synthetic coding sequence
atgagcatccaggccccccccagactgctggagctggccggccagagcctgctgagagaccaggccctgagcatcagcgccatggaggagctgcccagagtgctgtacctgcccctgttcatggaggccttcagaagaagacacttccagaccctgaccgtgatggtgcaggcctggcccttcacctgcctgcccctgggcagcctgatgaagaccctgcacctggagaccctgaaggccctgctggagggcctgcacatgctgctgacccagaaggacagacccagaagatggaagctgcaggtgctggacctgagagacgtggacgagaacttctgggccagatggcccggcgcctgggccctgagctgcttccccgagaccatgagcaagagacagaccgccgaggactgccccagaatgggcgagcaccagcccctgaaggtgttcatcgacatctgcctgaaggagatcccccaggacgagtgcctgagatacctgttccagtgggtgtaccagagaagaggcctggtgcacctgtgctgcagcaagctggtgaactacctgacccccatcaagcacctgagaaagagcctgaagatcatctacctgaacagcatccagcagctggagatcagaaacatgagctggcccagactgatcagaaagctgagatgctacctgaaggagatgaagaacctgagaaagctggtgttcagcagatgccaccacagcatgagcgacaacgagctggagggcagactggtgaccaagttcagcagcgtgttcctgagactggagcacctgcagctgctgaagatcaagctgatcaccttcttcagcggccacctggagcagctgatcagatgcctgcagaaccccctggagaacctggagctgacctacggctacctgctggaggaggacatgaagtgcctgagccagtaccccagcctgggctacctgaagcacctgaacctgagctacgtgctgctgttcagaatcagcctggagcccctgggcgccctgctggagaagatcgccgccagcctggagaccctgatcctggagggctgccagatccactacagccagctgagcgccatcctgcccggcctgagccactgcagccagctgaccaccttctacttcggcagaaactgcatgagcatgggcgccctgaaggacctgctgtgccacaccagcggcctgagcaagctgagcctggagacctaccccgcccccgaggagagcctgaacagcctggtgagagtggactgggagatcttcgccctgctgagagccgagctgatgtgcaccctgagagaggtgagacagcccaagagaatcttcatcggccccaccccctgccccagctgcggcagcagccccagcgaggagctggagctgcacctgtgctgctag

SEQ ID NO: 23419 - DNA, 1281 bp, Artificial Sequence
  Description of Artificial Sequence: Synthetic coding sequence
atgagcatccaggccccccccagactgctggagctggccggccagagcctgctgagagaccaggccctgagcatcagcgccatggaggagctgcccagagtgctgtacctgcccctgttcatggaggccttcagaagaagacacttccagaccctgaccgtgatggtgcaggcctggcccttcacctgcctgcccctgggcagcctgatgaagaccctgcacctggagaccctgaaggccctgctggagggcctgcacatgctgctgacccagaaggacagacccagaagatggaagctgcaggtgctggacctgagagacgtggacgagaacttctgggccagatggcccggcgcctgggccctgagctgcttccccgagaccatgagcaagagacagaccgccgaggactgccccagaatgggcgagcaccagcccctgaaggtgttcatcgacatctgcctgaaggagatcccccaggacgagtgcctgagatacctgttccagtgggtgtaccagagaagaggcctggtgcacctgtgctgcagcaagctggtgaactacctgacccccatcaagcacctgagaaagagcctgaagatcatctacctgaacagcatccagcagctggagatcagaaacatgagctggcccagactgatcagaaagctgagatgctacctgaaggagatgaagaacctgagaaagctggtgttcagcagatgcctgcagaaccccctggagaacctggagctgacctacggctacctgctggaggaggacatgaagtgcctgagccagtaccccagcctgggctacctgaagcacctgaacctgagctacgtgctgctgttcagaatcagcctggagcccctgggcgccctgctggagaagatcgccgccagcctggagaccctgatcctggagggctgccagatccactacagccagctgagcgccatcctgcccggcctgagccactgcagccagctgaccaccttctacttcggcagaaactgcatgagcatgggcgccctgaaggacctgctgtgccacaccagcggcctgagcaagctgagcctggagacctaccccgcccccgaggagagcctgaacagcctggtgagagtggactgggagatcttcgccctgctgagagccgagctgatgtgcaccctgagagaggtgagacagcccaagagaatcttcatcggccccaccccctgccccagctgcggcagcagccccagcgaggagctggagctgcacctgtgctgctag

SEQ ID NO: 23420 - DNA, 1437 bp, Artificial Sequence
  Description of Artificial Sequence: Synthetic coding sequence
atgaagatgagcatcagaaccccccccagactgctggagctggccggcagaagcctgctgagagaccaggccctggccatgagcaccctggaggagctgcccaccgagctgttcccccccctgttcatggaggccttcagcagaagaagatgcgaggccctgaagctgatggtgcaggcctggcccttcagaagactgcccctgagacccctgatcaagatgccctgcctggaggccttccaggccgtgctggacggcctggacgccctgctgacccagggcgtgagacccagaagatggaagctgcaggtgctggacctgcaggacgtgtgcgagaacttctggatggtgtggagcgaggccatggcccacggctgcttcctgaacgccaagagaaacaagaagcccgtgcaggactgccccagaatgagaggcagacagcccctgaccgtgttcgtggagctgtggctgaagaacagaaccctggacgagtacctgacctacctgctgctgtgggtgaagcagagaaaggacctgctgcacctgtgctgcaagaagctgaagatcctgggcatgcccttcagaaacatcagaagcatcctgaagatggtgaacctggactgcatccaggaggtggaggtgaactgcaagtgggtgctgcccatcctgacccagttcaccccctacctgggccacatgagaaacctgcagaagctggtgctgagccacatggacgtgagcagatacgtgagccccgagcagaagaaggagatcgtgacccagttcaccacccagttcctgaagctgagatgcctgcagaagctgtacatgaacagcgtgagcttcctggagggccacctggaccagctgctgagctgcctgaagaccagcctgaaggtgctgaccatcaccaactgcgtgctgctggagagcgacctgaagcacctgagccagtgccccagcatcagccagctgaagaccctggacctgagcggcatcagactgaccaactacagcctggtgcccctgcagatcctgctggagaaggtggccgccaccctggagtacctggacctggacgactgcggcatcatcgacagccaggtgaacgccatcctgcccgccctgagcagatgcttcgagctgaacaccttcagcttctgcggcaaccccatctgcatggccaccctggagaacctgctgagccacaccatcatcctgaagaacctgtgcgtggagctgtaccccgcccccagagagagctacggcgccgacggcaccctgtgctggagcagattcgcccagatcagagccgagctgatgaacagagtgagagacctgagacaccccaagagaatcctgttctgcaccgactactgccccgactgcggcaacagaagcttctacgacctggaggccgaccagtactgctgctag

SEQ ID NO: 23421 - DNA, 1437 bp, Artificial Sequence; identical to SEQ ID NO: 23420
  Description of Artificial Sequence: Synthetic coding sequence

SEQ ID NO: 23422 - DNA, 1425 bp, Artificial Sequence
  Description of Artificial Sequence: Synthetic coding sequence
atgagcctgcagagccccagcagactgctggagctggccggccagagcctgctgagaaaccagttcctgaccatcttcatcctggacgagctgcccagagaggtgttccccctgatgttcatggaggccagcagcatgagacacttcgaggccctgaagctgatggtgcaggcctggcccttcctgagactgcccctgggcagcctgatgaagaccccccacctggagaccctgcaggccgtgctgaagggcctggacaccctgctggcccagaagctgagacccagaagatggaagctgcaggtgctggacctgagagacgtggacggcaacttctggaccatctggagcggcgccagagccctgagctgcagccccgaggccatgagaaagagacagaccgtggaggactaccccagaaccggcgagcaccagcccctgaaggtgttcatcgacctgtgccagaaggagagcaccctggacgagtgcctgagctacctgtgcagatggatccactacagaagaggcctggtgcacctgtgctgcaacaaggtgcagaactacagcatgcccaccagcagcttcagaaacctgctgaagagagtgtaccccgacagcatccaggagctggagatcaagagaaagtgcagcctgaacaagaccggcaagttcgccccctacctgagccagatgagcaacctgagaaagctgttcctggccttcggctacgacgacgagctgtacgtgagcggccagcagcagttcgtgcccgacctggactgccccttcctgtgcctgtactacccccagatgctgtacatcagaaagatcagcaacatcaaggagcacctggagcacctgctgagatgcctgaagaaccccctgggcaccttcatcttctgccacgcctacctggccgaccaggacatggagtgcctgagccagtaccccagcctgagccagctgaaggagctgcacctgatccacatcctgatgtggaccaccaacctggagcccctgggcgccctgctggagaaggtggccgccaccctggagatcctgaccctgaaggactgccagatccaggacagccagctgagagtgctgctgcccgccctgagcagatgcagccagctgaccaccttctacttcagaggcaacgagaccagcaccaacgccctgaaggacctgctgtgccacaccggcggcctgagcaagctgggcctggagctgtaccccgcccccctggagtgcctggacaacagaggccacgtgaactgggagatcctggcccccatcagagccgagctgatgtgcaccctgagagaggtgagacagcccaagagaatcttcttcggccccatcccctgccccagctgcggcagctggcccagcgagaaggtggacttccacctgtgcagctag

SEQ ID NO: 23423 - DNA, 1425 bp, Artificial Sequence
  Description of Artificial Sequence: Synthetic coding sequence
atgagcctgcagagccccagcagactgctggagctggccggccagagcctgctgagaaaccagttcctgaccatcttcatcctggacgagctgcccagagaggtgttccccctgatgttcatggaggccagcagcatgagacacttcgaggccctgaagctgatggtgcaggcctggcccttcctgagactgcccctgggcagcctgatgaagaccccccacctggagaccctgcaggccgtgctgaagggcctggacaccctgctggcccagaagctgagacccagaagatggaagctgcaggtgctggacctgagagacgtggacggcaacttctggaccatctggagcggcgccagagccctgagctgcagccccgaggccatgagcaagagacagaccgtggaggactaccccagaaccggcgagcaccagcccctgaaggtgttcatcgacctgtgccagaaggagagcaccctggacgagtgcctgagctacctgtgcagatggatccactacagaagaggcctggtgcacctgtgctgcaacaaggtgcagaactacagcatgcccaccagcagcttcagaaacctgctgaagagagtgtaccccgacagcatccaggagctggagatcaagagaaagtgcagcctgaacaagaccggcaagttcgccccctacctgagccagatgagcaacctgagaaagctgttcctggccttcggctacgacgacgagctgtacgtgagcggccagcagcagttcgtgcccgacctggactgccccttcctgtgcctgtactacccccagatgctgtacatcagaaagatcagcaacatcaaggagcacctggagcacctgctgagatgcctgaagaaccccctgggcaccttcatcttctgccacgcctacctggccgaccaggacatggagtgcctgagccagtaccccagcctgagccagctgaaggagctgcacctgatccacatcctgatgtggaccaccaacctggagcccctgggcgccctgctggagaaggtggccgccaccctggagatcctgaccctgaaggactgccagatccaggacagccagctgagagtgctgctgcccgccctgagcagatgcagccagctgaccaccttctacttcagaggcaacgagaccagcaccaacgccctgaaggacctgctgtgccacaccggcggcctgagcaagctgggcctggagctgtaccccgcccccctggagtgcctggacaacagaggccacgtgaactgggagatcctggcccccatcagagccgagctgatgtgcaccctgagagaggtgagacagcccaagagaatcttcttcggccccatcccctgccccagctgcggcagctggcccagcgagaaggtggacttccacctgtgcagctag

SEQ ID NO: 23424 - DNA, 1440 bp, Artificial Sequence
  Description of Artificial Sequence: Synthetic coding sequence
atgagcttccaggcccccagaagactgctggagctggccggccagagcctgctgagagaccaggccctggccatcagcgtgctggacgagctgcccagagagctgttccccagactgttcgtggaggccttcaccagcagaagatgcgaggtgctgaaggtgatggtgcaggcctggcccttcccctgcctgcccctgggcagcctgatgaagacccccgacctggagatcctgcactacgtggtggacggcatcgactgcctgctggcccagaaggtgagacccagaagatggaagctgcaggtgctggagatgagagacgtggacgagaacttctggaccatctggagcggcgccagacccctgagctgcagccccgaggccatgagcaagagacagaccgtggaggactgccccagaaccggcgagaagcagcccctgaaggtgttcatggacgtgtgcctgaaggagaagagcgtggacgaggacctgagcttcttcagcggctgggtgcagcacagaagaagaagcgtgcacctgtgctgcaccaaggtggtgaactacagcatgaacatcctgaacttcagaaacatcctggagaccgtgtaccccgacagcatccaggtgctggagatctggaacatgtgctggccctgcatggtggccgaggtgagcagatacctgagccagatgaagaacctgagaaagctgttcatcagcgacggctgcggctacctgcccagcttcgagagccagggccagctggtggccgagttcagcagcgtgttcctgagactggagtacctgcagatgctgtacatgagaagaatcagattcttcgagggctacctggaccagctgatcagatgcctgaagagccccctggagaccctggccctgacctacggcagcctggacgaggaggacctgaagtgcctgccctggtaccccagcctgagccagctgaagcagctgaacctgagccacggcaccctgagattcatcagactggagcccctgagagccctgctggagaaggtggccgccaccctgcagaccctgttcctggtggactgcggcatcggcgacagcaagctgagagtgatcctgcccgccctgagcagatgcagcaacctgaccaccttctgcttccacggcaacgacaccagcatggacggcctgaaggacctgctgagacacaccggcagactgagcaacctgagcctggagacctaccccgcccccagagagagcctggacaacagaggcagagtgatcagcgagctgctgacccccctgcaggccgagctgatgagaatcctgagagaggtgagagagcccaacagaatcttcttcggccccgtgagctgcccctgctgcggcatgagccccaccgagcagctggagttcaacttctgcctgagaggcagacccgcctag

SEQ ID NO: 23425 - DNA, 1233 bp, Artificial Sequence
  Description of Artificial Sequence: Synthetic coding sequence
atgaagacccccgacctggagatcctgcactacgtggtggacggcatcgactgcctgctggcccagaaggtgagacccagaagatggaagctgcaggtgctggagatgagagacgtggacgagaacttctggaccatctggagcggcgccagacccctgagctgcagccccgaggccatgagcaagagacagaccgtggaggactgccccagaaccggcgagaagcagcccctgaaggtgttcatggacgtgtgcctgaaggagaagagcgtggacgaggacctgagcttcttcagcggctgggtgcagcacagaagaagaagcgtgcacctgtgctgcaccaaggtggtgaactacagcatgaacatcctgaacttcagaaacatcctggagaccgtgtaccccgacagcatccaggtgctggagatctggaacatgtgctggccctgcatggtggccgaggtgagcagatacctgagccagatgaagaacctgagaaagctgttcatcagcgacggctgcggctacctgcccagcttcgagagccagggccagctggtggccgagttcagcagcgtgttcctgagactggagtacctgcagatgctgtacatgagaagaatcagattcttcgagggctacctggaccagctgatcagatgcctgaagagccccctggagaccctggccctgacctacggcagcctggacgaggaggacctgaagtgcctgccctggtaccccagcctgagccagctgaagcagctgaacctgagccacggcaccctgagattcatcagactggagcccctgagagccctgctggagaaggtggccgccaccctgcagaccctgttcctggtggactgcggcatcggctacagcaagctgagagtgatcctgcccgccctgagcagatgcagcaacctgaccaccttctgcttccacggcaacgacaccagcatggacggcctgaaggacctgctgagacacaccggcagactgagcaacctgagcctggagacctaccccgcccccagagagagcctggacaacagaggcagagtgatcagcgagctgctgacccccctgcaggccgagctgatgagaatcctgagagaggtgagagagcccaacagaatcttcttcggccccgtgagctgcccctgctgcggcatgagccccaccgagcagctggagttcaacttctgcctgagaggcagacccgcctag

SEQ ID NO: 23426 - DNA, 1440 bp, Artificial Sequence
  Description of Artificial Sequence: Synthetic coding sequence
atgagcttccaggcccccagaagactgctggagctggccggccagagcctgctgagagaccaggccctggccatcagcgtgctggacgagctgcccagagagctgttccccagactgttcgtggaggccttcaccagcagaagatgcgaggtgctgaaggtgatggtgcaggcctggcccttcccctgcctgcccctgggcagcctgatgaagacccccgacctggagatcctgcactacgtggtggacggcatcgactgcctgctggcccagaaggtgagacccagaagatggaagctgcaggtgctggagatgagagacgtggacgagaacttctggaccatctggagcggcgccagacccctgagctgcagccccgaggccatgagcaagagacagaccgtggaggactgccccagaaccggcgagaagcagcccctgaaggtgttcatggacgtgtgcctgaaggagaagagcgtggacgaggacctgagcttcttcagcggctgggtgcagcacagaagaagaagcgtgcacctgtgctgcaccaaggtggtgaactacagcatgaacatcctgaacttcagaaacatcctggagaccgtgtaccccgacagcatccaggtgctggagatctggaacatgtgctggccctgcatggtggccgaggtgagcagatacctgagccagatgaagaacctgagaaagctgttcatcagcgacggctgcggctacctgcccagcttcgagagccagggccagctggtggccgagttcagcagcgtgttcctgagactggagtacctgcagatgctgtacatgagaagaatcagattcttcgagggctacctggaccagctgatcagatgcctgaagagccccctggagaccctggccctgacctacggcagcctggacgaggaggacctgaagtgcctgccctggtaccccagcctgagccagctgaagcagctgaacctgagccacggcaccctgagattcatcagactggagcccctgagagccctgctggagaaggtggccgccaccctgcagaccctgttcctggtggactgcggcatcggctacagcaagctgagagtgatcctgcccgccctgagcagatgcagcaacctgaccaccttctgcttccacggcaacgacaccagcatggacggcctgaaggacctgctgagacacaccggcagactgagcaacctgagcctggagacctaccccgcccccagagagagcctggacaacagaggcagagtgatcagcgagctgctgacccccctgcaggccgagctgatgagaatcctgagagaggtgagagagcccaacagaatcttcttcggccccgtgagctgcccctgctgcggcatgagccccaccgagcagctggagttcaacttctgcctgagaggcagacccgcctag

SEQ ID NO: 23427 - DNA, 1425 bp, Artificial Sequence
  Description of Artificial Sequence: Synthetic coding sequence
atgagcatccaggccccccccagactgctggagctggccggccagagcctgctgagagaccaggccctgagcatcagcgccatggaggagctgcccagagtgctgtacctgcccctgttcagagaggccttcagcagaagacacttccagaccctgaccgtgatggtgcaggcctggcccttcacctgcctgcccctggtgagcctgatgaagaccctgcacctggagcccctgaaggccctgctggagggcctgcacatgctgctgacccagaaggacagacccagaagatggaagctgcaggtgctggacctgagagacgtggacgagaacttctgggccagatggcccggcgcctgggccctgagctgcttccccgaggccatgagcaagagacagaccgccgaggactgccccagaaccggcgagcaccagcccctgaaggtgttcatcgacatctgcctgaaggagatcccccaggacgagtgcctgagatacctgttccagtgggtgtaccagagaagaggcctggtgcacctgtgctgcagcaagctggtgaactacctgacccccatcaagtacctgagaaagagcctgaagatcatctacatcaacagcatcggcgagctggagatccacaacacctgctggccccacctgatcagaaagctgtactgctacctgaaggagatgaagaccctgtgcaagctggtgttcagcagatgccaccactacaccagcgacaacgagctggagggctggctggtgaccagattcaccagcgtgttcctgagactggagcacctgcagctgctgaagatcaagctgatcaccttcttcagcggccacctggagcagctgatcagatgcctgcagaaccccctggagaacctggagctgacctgcggcaacctgctggaggaggacctgaagtgcctgagccagttccccagcctgggctacctgaagcacctgaacctgagctacgtgctgctgttcagaatcagcctggagcccctgggcgccctgctggagaagatcgccgccagcctggagaccctggtgctggagggctgccagatccactacagccagctgagcgccatcctgcccggcctgagctgctgcagccagctgaccaccttctacttcggcagcaactgcatgagcatcgacgccctgaaggacctgctgagacacaccagcggcctgagcaagctgagcctggagacctaccccgcccccgaggagagcctgaacagcctggtgagagtgaactgggagatcttcacccccctgagagccgagctgatgtgcaccctgagagagttcagacagcccaagagaatcttcatcggccccaccccctgccccagctgcggcagcagccccagcgaggagctggagctgcacctgtgctgctag

SEQ ID NO: 23428 - DNA, 1428 bp, Artificial Sequence
  Description of Artificial Sequence: Synthetic coding sequence
atgagcatcagaaccccccccagactgctggagctggccggcagaagcctgctgagagacgaggccctggccatcagcaccctggaggagctgcccaccgagctgttcccccccctgttcatggaggccttcagcagaagacactgcgaggccctgaagctgatggtgcaggcctggcccttcctgagactgcccctgggcagcctgatgaagagaccctgccccgagaccttccaggccgtgctggacggcctggacgccctgctgacccacagagtgagactgagaagatggaagctgcaggtgctggacctgcaggacgtgagcgagaacttctggatggtgtggagcgaggccatggccagaagatgcctgcccaacgccatgatgaacagaaagcccgtgcaggactgccccagaatgagaggccagcagcccctgaccgtgttcatcgacctgtgcctgaagaacagaaccctggacgagtacttcacctgcctgttcctgtgggtgaagcagagagagggcctggtgcacctgtgctgcaagaagctgaagatgctgggcatgctgttccacaacatcagaaacatcctgaagaccgtgaacctggactgcatccaggaggtggaggtgaactgcaactggaccctgcccgtgctggccgagttcaccccctacctgggccagatgagaaacctgagaaagctggtgctgagcgacatcgacagcagatacatcagccccgagcagaagaaggagttcgtgacccagttcaccacccagttcctgaagctgagatgcctgcagaagctgtacatgaacagcgtgagcttcctggagggccacctggaccagatgctgagctgcctgaagaccagcctgaacatcctggccatcaccaactgcgtgctgctggagagcgacctgaagcacctgagcaagtaccccagcatcggccagctgaagaccctggacctgagcggcaccagactggccaacttcagcctggtgcccctgcaggtgctgctggagaaggtggccgccaccctggagtacctggacctggacgactgcggcatcgtggacagccaggtgaacgccatcctgcccgccctgagcagatgcttcgagctgaccaccttcagcttcagaggcaaccccatcagcaccgccaccctggagaacctgctgtgccacaccatcagactgaacaacctgtgcctggagctgtaccccgcccccagagagagctacgacgtgagaggcatcgtgtgcagaagcagattcgcccagctgggcgccgagctgatgggcagagtgagagccctgagagagcccgagagaatcctgttctgcaccgactactgcccccagtgcggcaacagaagcctgtacgacctggaggtggacagatgctgctgctag

SEQ ID NO: 23429 - DNA, 1428 bp, Artificial Sequence; identical to SEQ ID NO: 23428
  Description of Artificial Sequence: Synthetic coding sequence

SEQ ID NO: 23430 - DNA, 1428 bp, Artificial Sequence; identical to SEQ ID NO: 23428
  Description of Artificial Sequence: Synthetic coding sequence

SEQ ID NO: 23431 - DNA, 1446 bp, Artificial Sequence
  Description of Artificial Sequence: Synthetic coding sequence
atgagaatgagcctgcaggcccccagaagactgctggagctggccggccagagcctgctgggcgaccaggccctggccatcagcatcctggacgagctgcccagagagctgttcccccccctgttcgtggaggccttcaccagcagaagatgcgaggtgctgaaggtgatggtgcaggcctggcccttcccctgcctgcccctgggcagcctgatgaagacccccgacctggagatcctgcactacgtggtggacggcatcgactgcctgctggcccagaaggtgagacccagaagatggaagctgcaggtgctggagctgagagacgtggacgagaacttctggaccatctggagcggcgccagacccctgagctgcagccccgaggccatgagcaagagacagaccgtggaggactgccccagaaccggcgagaagcagcccctgaaggtgttcatggacgtgtgcctgaaggagaagttcatggacgaggacctgagcttcttcagcggctgggtgcagcacagaagaggcagcgtgcacctgtgctgcaccaaggtggtgaactacagcatgagcatcctgaacttcagaaacatcctggagaccgtgtaccccgacagcatccaggtgctggagatctggaacatgtgctggccctgcatgatcgtggagttcagcagatacctgagccagatgagaaacctgagaaagctgttcatcagcgacggctgcagatacctgctgagcagcgacagccaggagcagctggtggccgagttcagcagcgtgctgctgagactggagtacctgcagatgctgtacgtgagaagagtgtgcttcttcagaggccacctggaccagctgatcagatgcctgagaagccccctggagaccctggccctgacctacggcttcctggagaaggtggacctgaagtgcctgcccagataccccagcctgagccagctgaagcagctgaacctgagccacggcgccctgagattcatcagactggagcccctgagagccctgctggagaaggtggccgccaccctgcagaccctgttcctggtggactgcggcatcagagacagcaagctgagagtgatcctgcccgccctgagctgctgcagcaacctgaccaccttctgcttccacggcaacgacaccagcatggacggcctgaaggacctgctgagacacaccggcagactgagcaacctgagcctggagacctaccccgcccccagagagagcctggacgacagaggcagagtgatcagcgagctgctgacccccctgcaggccgagctgatgagaatcctgagagaggtgagagagcccaagagaatcttcttcggccccgtgagctgcccctgctgcggcaccagccccaccgagcagctggagttcaacttctgcctgtggggcagacccgcctag

SEQ ID NO: 23432 - DNA, 1440 bp, Artificial Sequence
  Description of Artificial Sequence: Synthetic coding sequence
atgagcctgcaggcccccagaagactgctggagctggccggccagagcctgctgggcgaccaggccctggccatcagcatcctggacgagctgcccagagagctgttcccccccctgttcgtggaggccttcaccagcagaagatgcgaggtgctgaaggtgatggtgcaggcctggcccttcccctgcctgcccctgggcagcctgatgaagacccccgacctggagatcctgcactacgtggtggacggcatcgactgcctgctggcccagaaggtgagacccagaagaagaaagctgcaggtgctggagctgagagacgtggacgagaacttctggaccatctggagcggcgccagacccctgagctgcagccccgaggccatgagcaagagacagaccgtggaggactgccccagaaccggcgagaagcagcccctgaaggtgttcatggacgtgtgcctgaaggagaagttcatggacgaggacctgagcttcttcagcggctgggtgcagcacagaagaggcagcgtgcacctgtgctgcaccaaggtggtgaactacagcatgagcatcctgaacttcagaaacatcctggagaccgtgtaccccgacagcatccaggtgctggagatctggaacatgtgctggccctgcatgatcgtggagttcatcagatacctgagccagatgagaaacctgagaaagctgttcatcagcgacggctgcagatacctgctgagcagcgacagccaggagcagctggtggccgagttcagcagcgtgctgctgagactggagtacctgcagatgctgtacgtgagaagagtgtgcttcttcagaggccacctggaccagctgatcagatgcctgagaagccccctggagaccctggccctgacctacggcttcctggagaaggtggacctgaagtgcctgcccagataccccagcctgagccagctgaagcagctgaacctgagccacggcgccctgagattcatcagactggagcccctgagagccctgctggagaaggtggccgccaccctgcagaccctgttcctggtggactgcggcatcagagacagcaagctgagagtgatcctgcccgccctgagctgctgcagcaacctgaccaccttctgcttccacggcaacgacaccagcatggacggcctgaaggacctgctgagacacaccggcagactgagcaacctgagcctggagacctaccccgcccccagagagagcctggacgacagaggcagagtgatcagcgagctgctgacccccctgcaggccgagctgatgagaatcctgagagaggtgagagagcccaagagaatcttcttcggccccgtgagctgcccctgctgcggcaccagccccaccgagcagctggagttcaacttctgcctgtggggcagacccgcctag

SEQ ID NO: 23433 - DNA, 1446 bp, Artificial Sequence
  Description of Artificial Sequence: Synthetic coding sequence
atgagaatgagcctgcaggcccccagaagactgctggagctggccggccagagcctgctgggcgaccaggccctggccatcagcatcctggacgagctgcccagagagctgttcccccccctgttcgtggaggccttcaccagcagaagatgcgaggtgctgaaggtgatggtgcaggcctggcccttcccctgcctgcccctgggcagcctgatgaagacccccgacctggagatcctgcactacgtggtggacggcatcgactgcctgctggcccagaaggtgagacccagaagaagaaagctgcaggtgctggagctgagagacgtggacgagaacttctggaccatctggagcggcgccagacccctgagctgcagccccgaggccatgagcaagagacagaccgtggaggactgccccagaaccggcgagaagcagcccctgaaggtgttcatggacgtgtgcctgaaggagaagttcatggacgaggacctgagcttcttcagcggctgggtgcagcacagaagaggcagcgtgcacctgtgctgcaccaaggtggtgaactacagcatgagcatcctgaacttcagaaacatcctggagaccgtgtaccccgacagcatccaggtgctggagatctggaacatgtgctggccctgcatgatcgtggagttcatcagatacctgagccagatgagaaacctgagaaagctgttcatcagcgacggctgcagatacctgctgagcagcgacagccaggagcagctggtggccgagttcagcagcgtgctgctgagactggagtacctgcagatgctgtacgtgagaagagtgtgcttcttcagaggccacctggaccagctgatcagatgcctgagaagccccctggagaccctggccctgacctacggcttcctggagaaggtggacctgaagtgcctgcccagataccccagcctgagccagctgaagcagctgaacctgagccacggcgccctgagattcatcagactggagcccctgagagccctgctggagaaggtggccgccaccctgcagaccctgttcctggtggactgcggcatcagagacagcaagctgagagtgatcctgcccgccctgagctgctgcagcaacctgaccaccttctgcttccacggcaacgacaccagcatggacggcctgaaggacctgctgagacacaccggcagactgagcaacctgagcctggagacctaccccgcccccagagagagcctggacgacagaggcagagtgatcagcgagctgctgacccccctgcaggccgagctgatgagaatcctgagagaggtgagagagcccaagagaatcttcttcggccccgtgagctgcccctgctgcggcaccagccccaccgagcagctggagttcaacttctgcctgtggggcagacccgcctag

SEQ ID NO: 23434 - DNA, 1437 bp, Artificial Sequence
  Description of Artificial Sequence: Synthetic coding sequence
atgaagatgagcatctggaccccccccagactgctggagctggccggcagaagcctgctgagagaccaggccctggccatgagcaccctggaggagctgcccaccgagctgttcccccccctgttcatggaggccttcagcagaagaagatgcgaggccctgaagctgatggtgcagagctggcccttcagaagactgcccctgagacccctgatcaagatgccctgcctggaggccttccaggccgtgctggacggcctggacgccctgctgaacctgggcgtgagacccagaagatggaagctgcaggtgctggacctgcaggacgtgtgcgagaacttctggatggtgtggagcgaggccatggcccacggctgcttcctgaacgccaagagaaacaagaagcccgtggaggactgccccagaatgagaggcagacagcccctgaccgtgttcgtggagctgtggctgaagaacagaaccctggacgagtacctgacctgcctgctgctgtgggtgaagcagagaaaggacctgctgcacctgtgctgcaagaagctgaagatcctgggcatgcccttcagaaacatcagaagcatcctgaagatggtgaacctggactgcatccaggaggtggaggtgaactgcaagtgggtgctgcccatcctgacccagttcaccccctacctgggccacatgagaaacctgcagaagctgatcctgagccacatggacgtgagcagatacgtgagccccgagcagaagaaggagatcgtgacccagttcaccacccagttcctgaagctgagatgcctgcagaagctgtacatgaacagcgtgagcttcctggagggccacctggaccagctgctgagctgcctgaagaccagcctgaagttcctgaccatcaccaactgcgtgctgctggagagcgacctgaagcacctgagccagtgccccagcatcagccagctgaagaccctggacctgagcggcatcagactgaccaactacagcctggtgcccctgcagatcctgctggagaaggtggccgccaccctggagtacctggacctggacgactgcggcatcatcgacagccaggtgaacgccatcctgcccgccctgagcagatgcttcgagctgaacaccttcagcttctgcggcaaccccatctgcatggccaccctggagaacctgctgagccacaccatcatcctgaagaacctgtgcgtggagctgtaccccgcccccagagagagctacggcgccgacggcaccctgtgctggagcagattcgcccagatcagagccgagctgatgaacagagtgagagacctgagacaccccaagagaatcctgttctgcaccgactactgccccgactgcggcaacagaagcttctacgacctggaggccgaccagtactgctgctag

SEQ ID NO: 23435 - DNA, 1431 bp, Artificial Sequence
  Description of Artificial Sequence: Synthetic coding sequence
atgagcatcagaaccccccccagactgctggagctggccggcagaagcctgctgagagaccaggccctggccatgagcaccctggaggagctgcccaccgagctgttcccccccctgttcatggaggccttcagcagaagaagatgcgaggccctgaagctgatggtgcaggcctggcccttcagaagactgcccctgagacccctgatcaagatgccctgcctggaggccttccaggccgtgctggacggcctggacgccctgctgacccagggcgtgcaccccagaagatggaagctgcaggtgctggacctgcaggacgtgtgcgagaacttctggatggtgtggagcgaggccatggcccacggctgcttcctgaacgccaagagaaacaagaagcccgtgcaggactgccccagaatgagaggccagcagcccctgaccgtgttcgtggagctgtggctgaagaacagaaccctggacgagtacctgacctgcctgctgctgtgggtgaagcagagaaaggacctgctgcacctgtgctgcaagaagctgaagatcctgggcatgcccttcagaaacatcagaagcatcctgaagatggtgaacctggactgcatccaggaggtggaggtgaactgcaagtgggtgctgcccatcctgacccagttcaccccctacctgggccacatgagaaacctgcagaagctggtgctgagccacatggacgtgagcagatacgtgagccccgagcagaagaaggagatcgtgacccagttcaccacccagttcctgaagctgtgctgcctgcagaagctgagcatgaacagcgtgagcttcctggagggccacctggaccagctgctgagctgcctgaagaccagcctgaaggtgctgaccatcaccaactgcgtgctgctggagagcgacctgaagcacctgagccagtgccccagcatcagccagctgaagaccctggacctgagcggcatcagactgaccaactacagcctggtgcccctgcagatcctgctggagaaggtggccgccaccctggagtacctggacctggacgactgcggcatcatcgacagccaggtgaacgccatcctgcccgccctgagcagatgcttcgagctgaacaccttcagcttctgcggcaaccccatcagcatggccaccctggagaacctgctgagccacaccatcatcctgaagaacctgtgcgtggagctgtaccccgcccccagagagagctacgacgccgacggcaccctgtgctggagcagattcgcccagatcagagccgagctgatgaagagagtgagagacctgagacaccccaagagaatcctgttctgcaccgactgctgccccgactgcggcaacagaagcttctacgacctggaggccgaccagtgctgctgctag

SEQ ID NO: 23436 - DNA, 1431 bp, Artificial Sequence
  Description of Artificial Sequence: Synthetic coding sequence
atgagcatcagaaccccccccagactgctggagctggccggcagaagcctgctgagagaccaggccctggccatgagcaccctggaggagctgcccaccgagctgttcccccccctgttcatggaggccttcagcagaagaagatgcgaggccctgaagctgatggtgcaggcctggcccttcagaagactgcccctgagacccctgatcaagatgccctgcctggaggccttccaggccgtgctggacggcctggacgccctgctgacccagggcgtgcaccccagaagatggaagctgcaggtgctggacctgcaggacgtgtgcgagaacttctggatggtgtggagcgaggccatggccagaggctgcttcctgaacgccaagagaaacaagacccccgtgcaggactgccccagaatgagaggccagcagcccctgaccgtgttcgtggagctgtggctgaagaacagaaccctggacgagtacctgacctgcctgctgctgtgggtgaagcagagaaaggacctgctgcacctgtgctgcaagaagctgaagatcctgggcatgcccttcagaaacatcagaagcatcctgaagatggtgaacctggactgcatccaggaggtggaggtgaactgcaagtgggtgctgcccatcctgacccagttcaccccctacctgggccacatgagaaacctgcagaagctggtgctgagccacatggacgtgagcagatacgtgagccccgagcagaagaaggagatcgtgacccagttcaccacccagttcctgaagctgtgctgcctgcagaagctgagcatgaacagcgtgagcttcctggagggccacctggaccagctgctgagctgcctgaagaccagcctgaaggtgctgaccatcaccaactgcgtgctgctggagagcgacctgaagcacctgagccagtgccccagcatcagccagctgaagaccctggacctgagcggcatcagactgaccaactacagcctggtgcccctgcagatcctgctggagaaggtggccgccaccctggagtacctggacctggacgactgcggcatcatcgacagccaggtgaacgccatcctgcccgccctgagcagatgcttcgagctgaacaccttcagcttctgcggcaaccccatcagcatggccaccctggagaacctgctgagccacaccatcatcctgaagaacctgtgcgtggagctgtaccccgcccccagagagagctacgacgccgacggcaccctgtgctggagcagattcgcccagatcagagccgagctgatgaagagagtgagagacctgagacaccccaagagaatcctgttctgcaccgactgctgccccgactgcggcaacagaagcttctacgacctggaggccgaccagtgctgctgctag

SEQ ID NO: 23437 - DNA, 1431 bp, Artificial Sequence
  Description of Artificial Sequence: Synthetic coding sequence
atgagcatcagaaccccccccagactgctggagctggccggcagaagcctgctgagagaccaggccctggccatgagcaccctggaggagctgcccaccgagctgttcccccccctgttcatggaggccttcagcagaagaagatgcgaggccctgaagctgatggtgcaggcctggcccttcagaagactgcccctgagacccctgatcaagatgccctgcctggaggccttccaggccgtgctggacggcctggacgccctgctgacccagggcgtgcaccccagaagatggaagctgcaggtgctggacctgcaggacgtgtgcgagaacttctggatggtgtggagcgaggccatggcccacggctgcttcctgaacgccaagagaaacaagaagcccgtgcaggactgccccagaatgagaggccagcagcccctgaccgtgttcgtggagctgtggctgaagaacagaaccctggacgagtacctgacctgcctgctgctgtgggtgaagcagagaaaggacctgctgcacctgtgctgcaagaagctgaagatcctgggcatgcccttcagaaacatcagaagcatcctgaagatggtgaacctggactgcatccaggaggtggaggtgaactgcaagtgggtgctgcccatcctgacccagttcaccccctacctgggccacatgagaaacctgcagaagctggtgctgagccacatggacgtgagcagatacgtgagccccgagcagaagaaggagatcgtgacccagttcaccacccagttcctgaagctgtgctgcctgcagaagctgagcatgaacagcgtgagcttcctggagggccacctggaccagctgctgagctgcctgaagaccagcctgaaggtgctgaccatcaccaactgcgtgctgctggagagcgacctgaagcacctgagccagtgccccagcatcagccagctgaagaccctggacctgagcggcatcagactgaccaactacagcctggtgcccctgcagatcctgctggagaaggtggccgccaccctggagtacctggacctggacgactgcggcatcatcgacagccaggtgaacgccatcctgcccgccctgagctgctgcttcgagctgaacaccttcagcttctgcggcaaccccatcagcatggccaccctggagaacctgctgagccacaccatcatcctgaagaacctgtgcgtggagctgtaccccgcccccagagagagctacgacgccgacggcaccctgtgctggagcagattcccccagatcagagccgagctgatgaagagagtgagagacctgagacaccccaagagaatcctgttctgcaccgactgctgccccgactgcggcaacagaagcttctacgacctggaggccgaccagtgctgctgctag

SEQ ID NO: 23438 - DNA, 1431 bp, Artificial Sequence; identical to SEQ ID NO: 23436
  Description of Artificial Sequence: Synthetic coding sequence

SEQ ID NO: 23439 - DNA, 1431 bp, Artificial Sequence; identical to SEQ ID NO: 23435
  Description of Artificial Sequence: Synthetic coding sequence

SEQ ID NO: 23440 - DNA, 1431 bp, Artificial Sequence; identical to SEQ ID NO: 23437
  Description of Artificial Sequence: Synthetic coding sequence

SEQ ID NO: 23441 - DNA, 1431 bp, Artificial Sequence; identical to SEQ ID NO: 23436
  Description of Artificial Sequence: Synthetic coding sequence

SEQ ID NO: 23442 - DNA, 1425 bp, Artificial Sequence
  Description of Artificial Sequence: Synthetic coding sequence
atgagcatcagagccccccccagactgctggagctggccagacagagactgctgagagaccaggccctggccatcagcaccatggaggagctgcccagagagctgttccccaccctgttcatggaggccttcagcagaagaagatgcgagaccctgaagaccatggtgcaggcctggcccttcaccagactgcccctgggcagcctgatgaagagcccccacctggagagcctgaagagcgtgctggagggcgtggacgtgctgctgacccaggaggtgagacccagacagagcaagctgcaggtgctggacctgagaaacgtggacgagaacttctgcgacatcttcagcggcgccaccgccagcttccccgaggccctgagccagaagcagaccgccgacaactgccccggcaccggcagacagcagcccttcatggtgttcatcgacctgtgcctgaagaacagaaccctggacgagtgcctgacccacctgctggagtggggcaagcagagaaagggcctgctgcacgtgtgctgcaaggagctgcaggtgttcggcatgcccatccacagcatcatcgaggtgctgaacatggtggagctggactgcatccaggaggtggaggtgtgctgcccctgggagctgagcaccctggtgaagttcgccccctacctgggccagatgagaaacctgagaaagctggtgctgttcaacatcagagccagcgcctgcatcccccccgacaacaagggccagttcatcgccagattcaccagccagttcctgaagctggactacttccagaacctgagcatgcacagcgtgagcttcctggagggccacctggaccagctgctgagatgcctgcaggccagcctggagatggtggtgatgaccgactgcctgctgagcgagagcgacctgaagcacctgagctggtgccccagcatcagacagctgaaggagctggacctgagaggcgtgaccctgacccacttcagccccgagcccctgaccggcctgctggagcaggtggtggccaccctgcagaccctggacctggaggactgcggcatcatggacagccagctgagcgccatcctgcccgtgctgagcagatgcagccagctgagcaccttcagcttctgcggcaacctgatcagcatggccgccctggagaacctgctgagacacaccgtgggcctgagcaagctgagcctggagctgtaccccgcccccctggagagctacgacacccagggcgccctgtgctggggcagattcgccgagctgggcgccgagctgatgaagacccccagagacctgagacagcccaagatcatcgtgttctgcaccgtgccctgccccagatgcggcatcagagccagctacgacctggagcccagccactgcctgtgctag

SEQ ID NO: 23443 - DNA, 1425 bp, Artificial Sequence; identical to SEQ ID NO: 23442
  Description of Artificial Sequence: Synthetic coding sequence

SEQ ID NO: 23444 - DNA, 1425 bp, Artificial Sequence
  Description of Artificial Sequence: Synthetic coding sequence
atgagcatcagagccccccccagactgctggagctggccagacagagactgctgagagaccaggccctggccatcagcaccatggaggagctgcccagagagctgttccccaccctgttcatggaggccttcagcagaagaagatgcgagaccctgaagaccatggtgcaggcctggcccttcaccagactgcccctgggcagcctgatgaagagcccccacctggagagcctgaagagcgtgctggagggcgtggacgtgctgctgacccaggaggtgagacccagacagagcaagctgcaggtgctggacctgagaaacgtggacgagaacttctgcgacatcttcagcggcgccaccgccagcttccccgaggccctgagccagaagcagaccgccgacaactgccccggcaccggcagacagcagcccttcatggtgttcatcgacctgtgcctgaagaacagaaccctggacgagtgcctgacccacctgctggagtggggcaagcagagaaagggcctgctgcacgtgtgctgccaggagctgcaggtgttcggcatgcccatccacagcatcatcgaggtgctgaacatggtggagctggactgcatccaggaggtggaggtgtgctgcccctgggagctgagcaccctggtgaagttcgccccctacctgggccagatgagaaacctgagaaagctggtgctgttcaacatcagagccagcgcctgcatcccccccgacaacaagggccagttcatcgccagattcaccagccagttcctgaagctggactacttccagaacctgagcatgcacagcgtgagcttcctggagggccacctggaccagctgctgagatgcctgcaggccagcctggagatggtggtgatgaccgactgcctgctgagcgagagcgacctgaagcacctgagctggtgccccagcatcagacagctgaaggagctggacctgagaggcgtgaccctgacccacttcagccccgagcccctgaccggcctgctggagcaggtggtggccaccctgcagaccctggacctggaggactgcggcatcatggacagccagctgagcgccatcctgcccgtgctgagcagatgcagccagctgagcaccttcagcttctgcggcaacctgatcagcatggccgccctggagaacctgctgagacacaccgtgggcctgagcaagctgagcctggagctgtaccccgcccccctggagagctacgacacccagggcgccctgtgctggggcagattcgccgagctgggcgccgagctgatgaagaccctgagagacctgagacagcccaagatcatcgtgttctgcaccgtgccctgccccagatgcggcatcagagccagctacgacctggagcccagccactgcctgtgctag

SEQ ID NO: 23445 - DNA, 1437 bp, Artificial Sequence; identical to SEQ ID NO: 23420
  Description of Artificial Sequence: Synthetic coding sequence

SEQ ID NO: 23446 - DNA, 522 bp, Artificial Sequence
  Description of Artificial Sequence: Synthetic coding sequence
atgttcgccagaggcagcagaagaagaagaagcggcagagccccccccgaggccgaggaccccgacagaggccagccctgcaacagctgcagagagcagtgccccggcttcctgctgcacggctggagaaagatctgccagcactgcaagtgccccagagaggagcacgccgtgcacgccgtgcccgtggacctggagagaatcatgtgcagactgatcagcgacttccagagacacagcatcagcgacgacgacagcggctgcgccagcgaggagtacgcctgggtgccccccggcctgaagcccgagcaggtgtaccagttcttcagctgcctgcccgaggacaaggtgccctacgtgaacagccccggcgagaagtacagaatcaagcagctgctgcaccagctgcccccccacgacagcgaggtgagaagagagaagaccggcagagcctgccaggcccagcacaccgcctgggccaacgccggccagggccagagaagaaagggcgagctgatctag

SEQ ID NO: 23447 - DNA, 1848 bp, Artificial Sequence
  Description of Artificial Sequence: Synthetic coding sequence
atgttcgccagaggcagcagaagaagaagaagcggcagagccccccccgaggccgaggaccccgacagaggccagccctgcaacagctgcagagagcagtgccccggcttcctgctgcacggctggagaaagatctgccagcactgcaagtgccccagagaggagcacgccgtgcacgccgtgcccgtggacctggagagaatcatgtgcagactgatcagcgacttccagagacacagcatcagcgacgacgacagcggctgcgccagcgaggagtacgcctgggtgccccccggcctgaagcccgagcaggtgtaccagttcttcagctgcctgcccgaggacaaggtgccctacgtgaacagccccggcgagaagtacagaatcaagcagctgctgcaccagctgcccccccacgacagcgaggcccagtactgcaccgccctggaggaggaggagaagaaggagctgagagccttcagccagcagagaaagagagagaacctgggcagaggcatcgtgagaatcttccccgtgaccatcaccggcgccatctgcgaggagtgcggcaagcagatcggcggcggcgacatcgccgtgttcgccagcagagccggcctgggcgcctgctggcacccccagtgcttcgtgtgcaccacctgccaggagctgctggtggacctgatctacttctaccacgtgggcaaggtgtactgcggcagacaccacgccgagtgcctgagacccagatgccaggcctgcgacgagatcatcttcagccccgagtgcaccgaggccgagggcagacactggcacatggaccacttctgctgcttcgagtgcgaggccagcctgggcggccagagatacgtgatgagacagagcagaccccactgctgcgcctgctacgaggccagacacgccgagtactgcgacggctgcggcgagcacatcggcctggaccagggccagatggcctacgagggccagcactggcacgccagcgacagatgcttctgctgcagcagatgcggcagagccctgctgggcagacccttcctgcccagaagaggcctgatcttctgcagcagagcctgcagcctgggcagcgagcccaccgcccccggccccagcagaagaagctggagcgccggccccgtgaccgcccccctggccgccagcaccgccagcttcagcgccgtgaagggcgccagcgagaccaccaccaagggcaccagcaccgagctggcccccgccaccggccccgaggagcccagcagattcctgagaggcgccccccacagacacagcatgcccgagctgggcctgagaagcgtgcccgagcccccccccgagagccccggccagcccaacctgagacccgacgacagcgccttcggcagacagagcacccccagagtgagcttcagagaccccctggtgagcgagggcggccccagaagaaccctgagcgccccccccgcccagagaagaagacccagaagccccccccccagagcccccagcagaagaagacaccaccaccacaaccaccaccaccaccacaacagacaccccagcagaagaagacactaccagtgcgacgccggcagcggcagcgacagcgagagctgcagcagcagccccagcagcagcagcagcgagagcagcgaggacgacggcttcttcctgggcgagagaatccccctgcccccccacctgtgcagacccatgcccgcccaggacaccgccatggagaccttcaacagccccagcctgagcctgcccagagacagcagagccggcatgcccagacaggccagagacaagaactgcatcgtggcctag

SEQ ID NO: 23448 - DNA, 453 bp, Artificial Sequence
  Description of Artificial Sequence: Synthetic coding sequence
atgttcgccagaggcagcagaagaagaagaagcggcagagccccccccgaggccgaggaccccgacagaggccagccctgcaacagctgcagagagcagtgccccggcttcctgctgcacggctggagaaagatctgccagcactgcaagtgccccagagaggagcacgccgtgcacgccgtgcccgtggacctggagagaatcatgtgcagactgatcagcgacttccagagacacagcatcagcgacgacgacagcggctgcgccagcgaggagtacgcctgggtgccccccggcctgaagcccgagcaggtgaccagaggccagcccagcaccctggccgtgcagtgggtgcacaccaacgcccacacccacacccacacccaggtgggcacctacttctggggctacgccagagtgtgcagccagaccgagggccccagcggcccctag

SEQ ID NO: 23449 - DNA, 996 bp, Artificial Sequence
  Description of Artificial Sequence: Synthetic coding sequence
tgaccccccctgcccagactgtgccccgcccccccccacagcggcagatgccccagcctgcccagcgccgcccagccccccgaggccgaggaccccgacagaggccagccctgcaacagctgcagagagcagtgccccggcttcctgctgcacggctggagaaagatctgccagcactgcaagtgccccagagaggagcacgccgtgcacgccgtgcccgtggacctggagagaatcatgtgcagactgatcagcgacttccagagacacagcatcagcgacgacgacagcggctgcgccagcgaggagtacgcctgggtgccccccggcctgaagcccgagcaggtgtaccagttcttcagctgcctgcccgaggacaaggtgccctacgtgaacagccccggcgagaagtacagaatcaagcagctgctgcaccagctgcccccccacgacagcgaggcccagtactgcaccgccctggaggaggaggagaagaaggagctgagagccttcagccagcagagaaagagagagaacctgggcagaggcatcgtgagaatcttccccgtgaccatcaccggcgccatctgcgaggagtgcggcaagcagatcggcggcggcgacatcgccgtgttcgccagcagagccggcctgggcgcctgctggcacccccagtgcttcgtgtgcaccacctgccaggagctgctggtggacctgatctacttctaccacgtgggcaaggtgtactgcggcagacaccacgccgagtgcctgagacccagatgccaggcctgcgacgagatcatcttcagccccgagtgcaccgaggccgagggcagacactggcacatggaccacttctgctgcttcgagtgcgaggccagcctgggcggccagagatacgtgatgagacagagcagaccccactgctgcgcctgctacgaggccagacacgccgagtactgcgacggctgcggcgagcacatcggcggctag

SEQ ID NO: 23450 - DNA, 1887 bp, Artificial Sequence
  Description of Artificial Sequence: Synthetic coding sequence
tgagtggagggcagagccctgaccagccccagcctgctgcccagactgaccagaccctgcatctgccccagacccctgcagccccccgaggccgaggaccccgacagaggccagccctgcaacagctgcagagagcagtgccccggcttcctgctgcacggctggagaaagatctgccagcactgcaagtgccccagagaggagcacgccgtgcacgccgtgcccgtggacctggagagaatcatgtgcagactgatcagcgacttccagagacacagcatcagcgacgacgacagcggctgcgccagcgaggagtacgcctgggtgccccccggcctgaagcccgagcaggtgtaccagttcttcagctgcctgcccgaggacaaggtgccctacgtgaacagccccggcgagaagtacagaatcaagcagctgctgcaccagctgcccccccacgacagcgaggcccagtactgcaccgccctggaggaggaggagaagaaggagctgagagccttcagccagcagagaaagagagagaacctgggcagaggcatcgtgagaatcttccccgtgaccatcaccggcgccatctgcgaggagtgcggcaagcagatcggcggcggcgacatcgccgtgttcgccagcagagccggcctgggcgcctgctggcacccccagtgcttcgtgtgcaccacctgccaggagctgctggtggacctgatctacttctaccacgtgggcaaggtgtactgcggcagacaccacgccgagtgcctgagacccagatgccaggcctgcgacgagatcatcttcagccccgagtgcaccgaggccgagggcagacactggcacatggaccacttctgctgcttcgagtgcgaggccagcctgggcggccagagatacgtgatgagacagagcagaccccactgctgcgcctgctacgaggccagacacgccgagtactgcgacggctgcggcgagcacatcggcctggaccagggccagatggcctacgagggccagcactggcacgccagcgacagatgcttctgctgcagcagatgcggcagagccctgctgggcagacccttcctgcccagaagaggcctgatcttctgcagcagagcctgcagcctgggcagcgagcccaccgcccccggccccagcagaagaagctggagcgccggccccgtgaccgcccccctggccgccagcaccgccagcttcagcgccgtgaagggcgccagcgagaccaccaccaagggcaccagcaccgagctggcccccgccaccggccccgaggagcccagcagattcctgagaggcgccccccacagacacagcatgcccgagctgggcctgagaagcgtgcccgagcccccccccgagagccccggccagcccaacctgagacccgacgacagcgccttcggcagacagagcacccccagagtgagcttcagagaccccctggtgagcgagggcggccccagaagaaccctgagcgccccccccgcccagagaagaagacccagaagccccccccccagagcccccagcagaagaagacaccaccaccacaaccaccaccaccaccacaacagacaccccagcagaagaagacactaccagtgcgacgccggcagcggcagcgacagcgagagctgcagcagcagccccagcagcagcagcagcgagagcagcgaggacgacggcttcttcctgggcgagagaatccccctgcccccccacctgtgcagacccatgcccgcccaggacaccgccatggagaccttcaacagccccagcctgagcctgcccagagacagcagagccggcatgcccagacaggccagagacaagaactgcatcgtggcctag

SEQ ID NO: 23451 - DNA, 1605 bp, Artificial Sequence
  Description of Artificial Sequence: Synthetic coding sequence
atgtgcagactgatcagcgacttccagagacacagcatcagcgacgacgacagcggctgcgccagcgaggagtacgcctgggtgccccccggcctgaagcccgagcaggtgaccagaggccagcccagcaccctggccgtgcagtgggtgcacaccaacgcccacacccacacccacacccaggcccagtactgcaccgccctggaggaggaggagaagaaggagctgagagccttcagccagcagagaaagagagagaacctgggcagaggcatcgtgagaatcttccccgtgaccatcaccggcgccatctgcgaggagtgcggcaagcagatcggcggcggcgacatcgccgtgttcgccagcagagccggcctgggcgcctgctggcacccccagtgcttcgtgtgcaccacctgccaggagctgctggtggacctgatctacttctaccacgtgggcaaggtgtactgcggcagacaccacgccgagtgcctgagacccagatgccaggcctgcgacgagatcatcttcagccccgagtgcaccgaggccgagggcagacactggcacatggaccacttctgctgcttcgagtgcgaggccagcctgggcggccagagatacgtgatgagacagagcagaccccactgctgcgcctgctacgaggccagacacgccgagtactgcgacggctgcggcgagcacatcggcctggaccagggccagatggcctacgagggccagcactggcacgccagcgacagatgcttctgctgcagcagatgcggcagagccctgctgggcagacccttcctgcccagaagaggcctgatcttctgcagcagagcctgcagcctgggcagcgagcccaccgcccccggccccagcagaagaagctggagcgccggccccgtgaccgcccccctggccgccagcaccgccagcttcagcgccgtgaagggcgccagcgagaccaccaccaagggcaccagcaccgagctggcccccgccaccggccccgaggagcccagcagattcctgagaggcgccccccacagacacagcatgcccgagctgggcctgagaagcgtgcccgagcccccccccgagagccccggccagcccaacctgagacccgacgacagcgccttcggcagacagagcacccccagagtgagcttcagagaccccctggtgagcgagggcggccccagaagaaccctgagcgccccccccgcccagagaagaagacccagaagccccccccccagagcccccagcagaagaagacaccaccaccacaaccaccaccaccaccacaacagacaccccagcagaagaagacactaccagtgcgacgccggcagcggcagcgacagcgagagctgcagcagcagccccagcagcagcagcagcgagagcagcgaggacgacggcttcttcctgggcgagagaatccccctgcccccccacctgtgcagacccatgcccgcccaggacaccgccatggagaccttcaacagccccagcctgagcctgcccagagacagcagagccggcatgcccagacaggccagagacaagaactgcatcgtggcctag

SEQ ID NO: 23452 - DNA, 1320 bp, Artificial Sequence
  Description of Artificial Sequence: Synthetic coding sequence
atgttcgccagaggcagcagaagaagaagaagcggcagagccccccccgaggccgaggaccccgacagaggccagccctgcaacagctgcagagagcagtgccccggcttcctgctgcacggctggagaaagatctgccagcactgcaagtgccccagagaggagcacgccgtgcacgccgtgcccgtggacctggagagaatcatgtgcagactgatcagcgacttccagagacacagcatcagcgacgacgacagcggctgcgccagcgaggagtacgcctgggtgccccccggcctgaagcccgagcaggtgaccagaggccagcccagcaccctggccgtgcagtgggtgcacaccaacgcccacacccacacccacacccaggcccagtactgcaccgccctggaggaggaggagaagaaggagctgagagccttcagccagcagagaaagagagagaacctgggcagaggcatcgtgagaatcttccccgtgaccatcaccggcgccatctgcgaggagtgcggcaagcagatcggcggcggcgacatcgccgtgttcgccagcagagccggcctgggcgcctgctggcacccccagtgcttcgtgtgcaccacctgccaggagctgctggtggacctgatctacttctaccacgtgggcaaggtgtactgcggcagacaccacgccgagtgcctgagacccagatgccaggcctgcgacgagatcatcttcagccccgagtgcacccccggccccagacccggccccgaggagcccagcagattcctgagaggcgccccccacagacacagcatgcccgagctgggcctgagaagcgtgcccgagcccccccccgagagccccggccagcccaacctgagacccgacgacagcgccttcggcagacagagcacccccagagtgagcttcagagaccccctggtgagcgagggcggccccagaagaaccctgagcgccccccccgcccagagaagaagaagacaccaccaccacaaccaccaccaccaccacaacagacaccccagcagaagaagacactaccagtgcgacgccggcagcggcagcgacagcgagagctgcagcagcagccccagcagcagcagcagcgagagcagcgaggacgacggcttcttcctgggcgagagaatccccctgcccccccacctgtgcagacccatgcccgcccaggacaccgccatggagaccttcaacagccccagcctgagcctgcccagagacagcagagccggcatgcccagacaggccagagacaagaactgcatcgtggcctag

SEQ ID NO: 23453 - DNA, 1644 bp, Artificial Sequence
  Description of Artificial Sequence: Synthetic coding sequence
atgtgcagactgatcagcgacttccagagacacagcatcagcgacgacgacagcggctgcgccagcgaggagtacgcctgggtgccccccggcctgaagcccgagcaggtgtaccagttcttcagctgcctgcccgaggacaaggtgccctacgtgaacagccccggcgagaagtacagaatcaagcagctgctgcaccagctgcccccccacgacagcgaggcccagtactgcaccgccctggaggaggaggagaagaaggagctgagagccttcagccagcagagaaagagagagaacctgggcagaggcatcgtgagaatcttccccgtgaccatcaccggcgccatctgcgaggagtgcggcaagcagatcggcggcggcgacatcgccgtgttcgccagcagagccggcctgggcgcctgctggcacccccagtgcttcgtgtgcaccacctgccaggagctgctggtggacctgatctacttctaccacgtgggcaaggtgtactgcggcagacaccacgccgagtgcctgagacccagatgccaggcctgcgacgagatcatcttcagccccgagtgcaccgaggccgagggcagacactggcacatggaccacttctgctgcttcgagtgcgaggccagcctgggcggccagagatacgtgatgagacagagcagaccccactgctgcgcctgctacgaggccagacacgccgagtactgcgacggctgcggcgagcacatcggcctggaccagggccagatggcctacgagggccagcactggcacgccagcgacagatgcttctgctgcagcagatgcggcagagccctgctgggcagacccttcctgcccagaagaggcctgatcttctgcagcagagcctgcagcctgggcagcgagcccaccgcccccggccccagcagaagaagctggagcgccggccccgtgaccgcccccctggccgccagcaccgccagcttcagcgccgtgaagggcgccagcgagaccaccaccaagggcaccagcaccgagctggcccccgccaccggccccgaggagcccagcagattcctgagaggcgccccccacagacacagcatgcccgagctgggcctgagaagcgtgcccgagcccccccccgagagccccggccagcccaacctgagacccgacgacagcgccttcggcagacagagcacccccagagtgagcttcagagaccccctggtgagcgagggcggccccagaagaaccctgagcgccccccccgcccagagaagaagacccagaagccccccccccagagcccccagcagaagaagacaccaccaccacaaccaccaccaccaccacaacagacaccccagcagaagaagacactaccagtgcgacgccggcagcggcagcgacagcgagagctgcagcagcagccccagcagcagcagcagcgagagcagcgaggacgacggcttcttcctgggcgagagaatccccctgcccccccacctgtgcagacccatgcccgcccaggacaccgccatggagaccttcaacagccccagcctgagcctgcccagagacagcagagccggcatgcccagacaggccagagacaagaactgcatcgtggcctag

SEQ ID NO: 23454 - DNA, 1665 bp, Artificial Sequence
  Description of Artificial Sequence: Synthetic coding sequence
atgcacatcaacttccacagaccccccgccaagcccaagccccagaaggtgaaggagatcgagtaccagaacctgagattccccgtggacctgagcaaccccttcgccgtggccaccgtgctgaaccaggagcccggcaagctgaagatcaaggagctgagagaggtgctggaccagggcaccgagatcagcaagaccagacagatgaaggaggccctgttcgagcagaaggtgagacaggacatccacgaggagatggagaaccacctgaagtggcaggtgcacctgggcaaggaccccatgagcttcaagctgaagaaggagctgaccgaggagtggcagaaggcctgcgccaagtacaagctggacagaggcgaccccatcctggacgaggagttccagagactgaagaccgaggtgagccacaagagagtggtgagaaaccaggaggagaagatcaaggagttccaccccaccttcgaccccctgatcaacaacacctggctgagcagaagcagagcccagaagagattccagcaggtggccagaaaggtgatgatccagggcagactgttcaacatgctgagcgccgtgagagagatggacaaggagagcatcctgagaaagatcggccaggccaagcagagcatcgcccaggaggccaacttcttcaagttcttcctgagaagaatcagccaggacgactacaccagcagattcagcgtgagccccaaggaggtgctgcccttcgccttccccgactgcagccccccccaggacagcaacgagctggcccccgacggcctgggcctggtgcccatcaagagcagcgaggtgcagatcaagcagagctacagcttcttcaacctgcaggtgccccagctgtacaagatcaagagataccagcccttcagcgtgcacaagagcagcaccagctacagaccccagaagctggccagagccctgaagcagggcgccgaggacgaggtgaccaccatcaccgccctgcccaagcaggacagcaccacccagctgagcggcaagaccagcgtgctgagcatgaagccccccgaggccctggccatgagcctggactacgaccccctgtacgtgttcaaccccaaccccggcctgttcgccgtgatgcaccccctgacctacgccgagaccctgatcgactaccacctgtgcagccaccccaagtacaagttcaccaaggagagcagacacggcagcagcatccccgtgacccagaagcagttcctgcaccacaccgacatcatccccggcatcatgcactggaagagcttccagagcctggtgctgagcagcctgcccgaccccagcaagatggagaccaccaagagctgcgacagcttcaacagcttcatgctgcccatcgacgtgcccgccatcctggacgccctgcccgaggaggacagactggagaccgtggagagagagctgtgcgagcagaacgtggaggtgatgctgacccccgagatgatcaaggtggagttccccatgctgaactacaaggacatcagaaaggagaaggaggtgaaggaccaggcccagcccgccgagaaggccggcgagaagctgctggaggagatgagaaacctgagaggcaaggccctgaacacctacctgatcctggagtag

SEQ ID NO: 23455 - DNA, 2523 bp, Artificial Sequence
  Description of Artificial Sequence: Synthetic coding sequence
atggccgtggtgaagacccccagcagaggcctgaagaacgccaaggagcccttcaacaacgccagcccccacctgctgaagaacctggtggaggagcccaagaagagaaaggaggtgcccaaccacctgctggagagcaaggtgtacgccaagctggtgaacaacaaggtgatccaggccagacccggcatcatccacttcggcggctaccaggtggagaagcagcaccagcagatcctgcacctggtgaacgtgagcaacgaggacaccagagtgcacatcctgcccccccagaccaagtacttcgagatcaactacgtgagaaaggagcaccacctggtgcccggcctgagcctgaccgtgaccgtgaccttcagccccgacgagtggagatactactacgactgcatcagagtgcactgcaagggcgacgacaccctgctggtgcccatccacgcctaccccgtgatgaacagcctggacttccccagcttcatcaacctgagcaacgtgctgctgggcgagagcaagacctacgtgatccccctgcagtgcagctgccccgtggacttcgagttctacatcaccctgatccagagccaccaggccttcgccatcgagcccaccagcggcatcatccccgccaacggcaagatgaccgtgaccatcaagttcacccccttccagtacggcaccgcccagatcaagatgcagctgtggatcagccagttcaacagccagccctacgagtgcgtgttcaccggcacctgctaccccaacatggccctgcccctggaggagttcgagagactgaacaccctgagcaagaaggtgaacgtgccccccgagaaggccatgatgcacatcaacttccacagaccccccgccaagcccaagccccagaaggtgaaggagatcgagtaccagaacctgagattccccgtggacctgagcaaccccttcgccgtggccaccgtgctgaaccaggagcccggcaagctgaagatcaaggagctgagagaggtgctggaccagggcaccgagatcagcaagaccagacagatgaaggaggccctgttcgagcagaaggtgagacaggacatccacgaggagatggagaaccacctgaagtggcaggtgcacctgggcaaggaccccatgagcttcaagctgaagaaggagctgaccgaggagtggcagaaggcctgcgccaagtacaagctggacagaggcgaccccatcctggacgaggagttccagagactgaagaccgaggtgagccacaagagagtggtgagaaaccaggaggagaagatcaaggagttccaccccaccttcgaccccctgatcaacaacacctggctgagcagaagcagagcccagaagagattccagcaggtggccagaaaggtgatgatccagggcagactgttcaacatgctgagcgccgtgagagagatggacaaggagagcatcctgagaaagatcggccaggccaagcagagcatcgcccaggaggccaacttcttcaagttcttcctgagaagaatcagccaggacgactacaccagcagattcagcgtgagccccaaggaggtgctgcccttcgccttccccgactgcagccccccccaggacagcaacgagctggcccccgacggcctgggcctggtgcccatcaagagcagcgaggtgcagatcaagcagagctacagcttcttcaacctgcaggtgccccagctgtacaagatcaagagataccagcccttcagcgtgcacaagagcagcaccagctacagaccccagaagctggccagagccctgaagcagggcgccgaggacgaggtgaccaccatcaccgccctgcccaagcaggacagcaccacccagctgagcggcaagaccagcgtgctgagcatgaagccccccgaggccctggccatgagcctggactacgaccccctgtacgtgttcaaccccaaccccggcctgttcgccgtgatgcaccccctgacctacgccgagaccctgatcgactaccacctgtgcagccaccccaagtacaagttcaccaaggagagcagacacggcagcagcatccccgtgacccagaagcagttcctgcaccacaccgacatcatccccggcatcatgcactggaagagcttccagagcctggtgctgagcagcctgcccgaccccagcaagatggagaccaccaagagctgcgacagcttcaacagcttcatgctgcccatcgacgtgcccgccatcctggacgccctgcccgaggaggacagactggagaccgtggagagagagctgtgcgagcagaacgtggaggtgatgctgacccccgagatgatcaaggtggagttccccatgctgaactacaaggacatcagaaaggagaaggaggtgaaggaccaggcccagcccgccgagaaggccggcgagaagctgctggaggagatgagaaacctgagaggcaaggccctgaacacctacctgatcctggagtag

SEQ ID NO: 23456 - DNA, 564 bp, Artificial Sequence
  Description of Artificial Sequence: Synthetic coding sequence
atggccgtggtgaagacccccagcagaggcctgaagaacgccaaggagcccttcaacaacgccagcccccacctgctgaagaacctggtggaggagcccaagaagagaaaggaggtgcccaaccacctgctggagagcaaggtgtacgccaagctggtgaacaacaaggtgatccaggccagacccggcatcatccacttcggcggctaccaggtggagaagcagcaccagcagatcctgcacctggtgaacgtgagcaacgaggacaccagagtgcacatcctgcccccccagaccaagtacttcgagatcaactacgtgagaaaggagcaccacctggtgcccggcctgagcctgaccgtgaccgtgaccttcagccccgacgagtggagatactactacgactgcatcagagtgcactgcaagggcgacgacaccctgctggtgcccatccacgcctaccccgtgatgaacagcctggacttccccagcttcatcaacctgagcaacgtgctgctgggcgagagcctgcccaacagcgtgttcctggtgcccgacaactag

SEQ ID NO: 23457 - DNA, 1200 bp, Artificial Sequence
  Description of Artificial Sequence: Synthetic coding sequence
tgacaccccaccttcgaccccctgatcaacaacacctggctgagcagaagcagagcccagaagagattccagcaggtggccagaaaggtgatgatccagggcagactgttcaacatgctgagcgccgtgagagagatggacaaggagagcatcctgagaaagatcggccaggccaagcagagcatcgcccaggaggccaacttcttcaagttcttcctgagaagaatcagccaggacgactacaccagcagattcagcgtgagccccaaggaggtgctgcccttcgccttccccgactgcagccccccccaggacagcaacgagctggcccccgacggcctgggcctggtgcccatcaagagcagcgaggtgcagatcaagcagagctacagcttcttcaacctgcaggtgccccagctgtacaagatcaagagataccagcccttcagcgtgcacaagagcagcaccagctacagaccccagaagctggccagagccctgaagcagggcgccgaggacgaggtgaccaccatcaccgccctgcccaagcaggacagcaccacccagctgagcggcaagaccagcgtgctgagcatgaagccccccgaggccctggccatgagcctggactacgaccccctgtacgtgttcaaccccaaccccggcctgttcgccgtgatgcaccccctgacctacgccgagaccctgatcgactaccacctgtgcagccaccccaagtacaagttcaccaaggagagcagacacggcagcagcatccccgtgacccagaagcagttcctgcaccacaccgacatcatccccggcatcatgcactggaagagcttccagagcctggtgctgagcagcctgcccgaccccagcaagatggagaccaccaagagctgcgacagcttcaacagcttcatgctgcccatcgacgtgcccgccatcctggacgccctgcccgaggaggacagactggagaccgtggagagagagctgtgcgagcagaacgtggaggtgatgctgacccccgagatgatcaaggtggagttccccatgctgaactacaaggacatcagaaaggagaaggaggtgaaggaccaggcccagcccgccgagaaggccggcgagaagctgctggaggagatgagaaacctgagaggcaaggccctgaacacctacctgatcctggagtag

SEQ ID NO: 23458 - DNA, 1665 bp, Artificial Sequence; identical to SEQ ID NO: 23454
  Description of Artificial Sequence: Synthetic coding sequence

SEQ ID NO: 23459 - DNA, 555 bp, Artificial Sequence
  Description of Artificial Sequence: Synthetic coding sequence
atggccagccccgccgccagcagcgtgagaccccccagacccaagaaggagccccagaccctggtgatccccaagaacgccgccgaggagcagaagctgaagctggagagactgatgaagaaccccgacaaggccgtgcccatccccgagaagatgagcgagtgggcccccagacccccccccgagttcgtgagagacgtgatgggcagcagcgccggcgccggcagcggcgagttccacgtgtacagacacctgagaagaagagagtaccagagacaggactacatggacgccatggccgagaagcagaagctggacgccgagttccagaagagactggagaagaacaagatcgccgccgaggagcagaccgccaagagaagaaagaagagacagaagctgaaggagaagaagctgctggccaagaagatgaagctggagcagaagaagcaggagggccccggccagcccaaggagcagggcagcagcagcagcgccgaggccagcggcaccgaggaggaggaggaggtgcccagcttcaccatgggcagatag

SEQ ID NO: 23460 - DNA, 786 bp, Artificial Sequence
  Description of Artificial Sequence: Synthetic coding sequence
atggcccagaacctgaaggacctggccggcagactgcccgccggccccagaggcatgggcaccgccctgaagctgctgctgggcgccggcgccgtggcctacggcgtgagagagagcgtgttcaccgtggagggcggccacagagccatcttcttcaacagaatcggcggcgtgcagcaggacaccatcctggccgagggcctgcacttcagaatcccctggttccagtaccccatcatctacgacatcagagccagacccagaaagatcagcagccccaccggcagcaaggacctgcagatggtgaacatcagcctgagagtgctgagcagacccaacgcccaggagctgcccagcatgtaccagagactgggcctggactacgaggagagagtgctgcccagcatcgtgaacgaggtgctgaagagcgtggtggccaagttcaacgccagccagctgatcacccagagagcccaggtgagcctgctgatcagaagagagctgaccgagagagccaaggacttcagcctgatcctggacgacgtggccatcaccgagctgagcttcagcagagagtacaccgccgccgtggaggccaagcaggtggccctgagcaagaaccccggctacatcaagctgagaaagatcagagccgcccagaacatcagcaagaccatcgccaccagccagaacagaatctacctgaccgccgacaacctggtgctgaacctgcaggacgagagcttcaccagaggcagcgacagcctgatcaagggcaagaagtag

SEQ ID NO: 23461 - DNA, 2769 bp, Artificial Sequence
  Description of Artificial Sequence: Synthetic coding sequence
atggacaagaagagcttcgagatggtgctggacgagatcagaaaggtggtggacctgctgagatacttcagctgggccgagccccagctgaaggccatgaaggccctgcagcacaagatggtggccgtgcagcccaccgaggtggtgaacatcctgaactgcttcaccttcagcaaggacaagctggtggccctggagctgctggccagcaacatcatcgacgcccagaacagcagacccatcgaggacctgttcagagtgaacatgagcgagaagaagagatgcaagagaatcctggagcaggccttcaagggcggctgcaaggccccccacgccatgatcagcagctgcggcaccatccccggcaacccctaccccaagggcagacccagcagaatcaacggcatcttccccggcacccccctgaagaaggacggcgaggagtgcaccaacgagggcaagggcatcgccgccagaatcctgggccccagcaagcccccccccagcacctacaacccccacaagcccgtgccctaccccatccccccctgcagaccccacgccaccatcgcccccagcgcctacaacaacgccggcctggtgcccctggccaacgtgatcgccccccccccccccccctacacccccaaccccgtgggcaccgagaacgaggacctgagcaaccccagcaagcccatccagaaccagaccttcagcacccccgccagccagctgttcagcccccacggcagcaaccccagcacccccgccgccacccccgtgcccaccgccagccccgtgaaggccatcaaccaccccagcgccagcgccgccgccaccgtgagcggcatgaacctgctgaacaccgtgctgcccgtgttccccggccaggtgagcagcgccgtgcacaccccccagcccagcatccccaaccccaccgtgatcagaacccccagcctgcccaccgcccccgtgaccagcatccacagcaccaccaccacccccgtgcccagcatcttcagcggcctggtgagcctgcccggccccagcgccacccccaccgccgccacccccacccccggccccacccccagaagcaccctgggcagcagcgaggccttcgccagcaccagcgcccccttcaccagcctgcccttcagcaccagcagcagcgccgccagcaccagcaaccccaacagcgccagcctgagcagcgtgttcgccggcctgcccctgcccctgccccccaccagccagggcctgagcaaccccacccccgtgatcgccggcggcagcacccccagcgtggccggccccctgggcgtgaacagccccctgctgagcgccctgaagggcttcctgaccagcaacgacaccaacctgatcaacagcagcgccctgagcagcgccgtgaccagcggcctggccagcctgagcagcctgaccctgcagaacagcgacagcagcgccagcgcccccaacaagtgctacgcccccagcgccatccccaccccccagagaaccagcacccccggcctggccctgttccccggcctgcccagccccgtggccaacagcaccagcacccccctgaccctgcccgtgcagagccccctggccaccgccgccagcgccagcaccagcgtgcccgtgagctgcggcagcagcgccagcctgctgagaggcccccaccccggcaccagcgacctgcacatcagcagcacccccgccgccaccaccctgcccgtgatgatcaagaccgagcccaccagccccacccccagcgccttcaagggccccagccacagcggcaaccccagccacggcaccctgggcctgagcggcaccctgggcagagcctacaccagcaccagcgtgcccatcagcctgagcgcctgcctgaaccccgccctgagcggcctgagcagcctgagcacccccctgaacggcagcaaccccctgagcagcatcagcctgcccccccacggcagcagcacccccatcgcccccgtgttcaccgccctgcccagcttcaccagcctgaccaacaacttccccctgaccggcaaccccagcctgaaccccagcgtgagcctgcccggcagcctgatcgccaccagcagcaccgccgccaccagcaccagcctgccccaccccagcagcaccgccgccgtgctgagcggcctgagcgccagcgcccccgtgagcgccgcccccttccccctgaacctgagcaccgccgtgcccagcctgttcagcgtgacccagggccccctgagcagcagcaaccccagctaccccggcttcagcgtgagcaacacccccagcgtgacccccgccctgcccagcttccccggcctgcaggcccccagcaccgtggccgccgtgacccccctgcccgtggccgccaccgcccccagccccgcccccgtgctgcccggcttcgccagcgccttcagcagcaacttcaacagcgccctggtggcccaggccggcctgagcagcggcctgcaggccgccggcagcagcgtgttccccggcctgctgagcctgcccggcatccccggcttcccccagaaccccagccagagcagcctgcaggagctgcagcacaacgccgccgcccagagcgccctgctgcagcaggtgcacagcgccagcgccctggagagctaccccgcccagcccgacggcttccccagctaccccagcgcccccggcacccccttcagcctgcagcccagcctgagccagagcggctggcagtag

SEQ ID NO: 23462 - DNA, 2835 bp, Artificial Sequence
  Description of Artificial Sequence: Synthetic coding sequence
atggacaagaagagcttcgagatggtgctggacgagatcagaaaggccgtgctgaccgagtacaagctgaaggccatcgagtacgtgcacggctacttcagcagcgagcaggtggtggacctgctgagatacttcagctgggccgagccccagctgaaggccatgaaggccctgcagcacaagatggtggccgtgcagcccaccgaggtggtgaacatcctgaactgcttcaccttcagcaaggacaagctggtggccctggagctgctggccagcaacatcatcgacgcccagaacagcagacccatcgaggacctgttcagagtgaacatgagcgagaagaagagatgcaagagaatcctggagcaggccttcaagggcggctgcaaggccccccacgccatgatcagcagctgcggcaccatccccggcaacccctaccccaagggcagacccagcagaatcaacggcatcttccccggcacccccctgaagaaggacggcgaggagtgcaccaacgagggcaagggcatcgccgccagaatcctgggccccagcaagcccccccccagcacctacaacccccacaagcccgtgccctaccccatccccccctgcagaccccacgccaccatcgcccccagcgcctacaacaacgccggcctggtgcccctggccaacgtgatcgccccccccccccccccctacacccccaaccccgtgggcaccgagaacgaggacctgagcaaccccagcaagcccatccagaaccagaccttcagcacccccgccagccagctgttcagcccccacggcagcaaccccagcacccccgccgccacccccgtgcccaccgccagccccgtgaaggccatcaaccaccccagcgccagcgccgccgccaccgtgagcggcatgaacctgctgaacaccgtgctgcccgtgttccccggccaggtgagcagcgccgtgcacaccccccagcccagcatccccaaccccaccgtgatcagaacccccagcctgcccaccgcccccgtgaccagcatccacagcaccaccaccacccccgtgcccagcatcttcagcggcctggtgagcctgcccggccccagcgccacccccaccgccgccacccccacccccggccccacccccagaagcaccctgggcagcagcgaggccttcgccagcaccagcgcccccttcaccagcctgcccttcagcaccagcagcagcgccgccagcaccagcaaccccaacagcgccagcctgagcagcgtgttcgccggcctgcccctgcccctgccccccaccagccagggcctgagcaaccccacccccgtgatcgccggcggcagcacccccagcgtggccggccccctgggcgtgaacagccccctgctgagcgccctgaagggcttcctgaccagcaacgacaccaacctgatcaacagcagcgccctgagcagcgccgtgaccagcggcctggccagcctgagcagcctgaccctgcagaacagcgacagcagcgccagcgcccccaacaagtgctacgcccccagcgccatccccaccccccagagaaccagcacccccggcctggccctgttccccggcctgcccagccccgtggccaacagcaccagcacccccctgaccctgcccgtgcagagccccctggccaccgccgccagcgccagcaccagcgtgcccgtgagctgcggcagcagcgccagcctgctgagaggcccccaccccggcaccagcgacctgcacatcagcagcacccccgccgccaccaccctgcccgtgatgatcaagaccgagcccaccagccccacccccagcgccttcaagggccccagccacagcggcaaccccagccacggcaccctgggcctgagcggcaccctgggcagagcctacaccagcaccagcgtgcccatcagcctgagcgcctgcctgaaccccgccctgagcggcctgagcagcctgagcacccccctgaacggcagcaaccccctgagcagcatcagcctgcccccccacggcagcagcacccccatcgcccccgtgttcaccgccctgcccagcttcaccagcctgaccaacaacttccccctgaccggcaaccccagcctgaaccccagcgtgagcctgcccggcagcctgatcgccaccagcagcaccgccgccaccagcaccagcctgccccaccccagcagcaccgccgccgtgctgagcggcctgagcgccagcgcccccgtgagcgccgcccccttccccctgaacctgagcaccgccgtgcccagcctgttcagcgtgacccagggccccctgagcagcagcaaccccagctaccccggcttcagcgtgagcaacacccccagcgtgacccccgccctgcccagcttccccggcctgcaggcccccagcaccgtggccgccgtgacccccctgcccgtggccgccaccgcccccagccccgcccccgtgctgcccggcttcgccagcgccttcagcagcaacttcaacagcgccctggtggcccaggccggcctgagcagcggcctgcaggccgccggcagcagcgtgttccccggcctgctgagcctgcccggcatccccggcttcccccagaaccccagccagagcagcctgcaggagctgcagcacaacgccgccgcccagagcgccctgctgcagcaggtgcacagcgccagcgccctggagagctaccccgcccagcccgacggcttccccagctaccccagcgcccccggcacccccttcagcctgcagcccagcctgagccagagcggctggcagtag

SEQ ID NO: 23463 - DNA, 3123 bp, Artificial Sequence
  Description of Artificial Sequence: Synthetic coding sequence
atggccgccgccgtgctgagcggccccagcgccggcagcgccgccggcgtgcccggcggcaccggcggcctgagcgccgtgagcagcggccccagactgagactgctgctgctggagagcgtgagcggcctgctgcagcccagaaccggcagcgccgtggcccccgtgcacccccccaacagaagcgccccccacctgcccggcctgatgtgcctgctgagactgcacggcagcgtgggcggcgcccagaacctgagcgccctgggcgccctggtgagcctgagcaacgccagactgagcagcatcaagaccagattcgagggcctgtgcctgctgagcctgctggtgggcgagagccccaccgagctgttccagcagcactgcgtgagctggctgagaagcatccagcaggtgctgcagacccaggacccccccgccaccatggagctggccgtggccgtgctgagagacctgctgagatacgccgcccagctgcccgccctgttcagagacatcagcatgaaccacctgcccggcctgctgaccagcctgctgggcctgagacccgagtgcgagcagagcgccctggagggcatgaaggcctgcatgacctacttccccagagcctgcggcagcctgaagggcaagctggccagcttcttcctgagcagagtggacgccctgagcccccagctgcagcagctggcctgcgagtgctacagcagactgcccagcctgggcgccggcttcagccagggcctgaagcacaccgagagctgggagcaggagctgcacagcctgctggccagcctgcacaccctgctgggcgccctgtacgagggcgccgagaccgcccccgtgcagaacgagggccccggcgtggagatgctgctgagcagcgaggacggcgacgcccacgtgctgctgcagctgagacagagattcagcggcctggccagatgcctgggcctgatgctgagcagcgagttcggcgcccccgtgagcgtgcccgtgcaggagatcctggacttcatctgcagaaccctgagcgtgagcagcaagaacatcagcctgcacggcgacccctgcggctgctgctgctgccccctgagcaccctggccctggacctgctgagcgccctgatcctggcctgcggcagcagactgctgagattcggcatcctgatcggcagactgctgccccaggtgctgaacagctggagcatcggcagagacagcctgagccccggccaggagagaccctacagcaccgtgagaaccaaggtgtacgccatcctggagctgtgggtgcaggtgtgcggcgccagcgccggcatgctgcagggcggcgccagcggcgaggccctgctgacccacctgctgagcgacatcagcccccccgccgacgccctgaagctgagaagccccagaggcagccccgacggcagcctgcagaccggcaagcccagcgcccccaagaagctgaagctggacgtgggcgaggccatggccccccccagccacagactgctgcccgtgccctgcaagcccagccccagcgccagcgagaagatcgccctgagaagccccctgtgcagcgaggccctggtgacctgcgccgccctgacccaccccagagtgccccccctgcagcccatgggccccacctgccccacccccgcccccgtgcccctgagaccccacagacccagcggcccccacagaagcatcctgagagccccctgcccccagtgggccccctgcccccagcaggccccctgcagcgccggccccatgcccagcgccggccccgtgcccagcgccagacccggcccccccaccaccgccaaccacctgggcctgagcgtgcccggcctggtgagcgtgccccccagactgctgcccggccccgagaaccacagagccggcagcaacgaggaccccatcctggcccccagcggcacccccccccccaccatcccccccgacgagaccttcggcggcagagtgcccagacccgccttcgtgcactacgacaaggaggaggccagcgacgtggagatcagcctggagagcgacagcgacgacagcgtggtgatcgtgcccgagggcctgccccccctgcccccccccccccccagcggcgccacccccccccccatcgcccccaccggcccccccaccgccagcccccccgtgcccgccaaggaggagcccgaggagctgcccgccgcccccggccccctgcccccccccccccccccccccccccccgtgcccggccccgtgaccctgccccccccccagctggtgcccgagggcacccccggcggcggcggcccccccgccctggaggaggacctgaccgtgatcaacatcaacagcagcgacgaggaggaggaggaggaggaggaggaggaggaggaggaggaggaggaggaggaggaggaggaggacttcgaggaggaggaggaggacgaggaggagtacttcgaggaggaggaggaggaggaggaggagttcgaggaggagttcgaggaggaggagggcgagctggaggaggaggaggaggaggaggacgaggaggaggaggaggagctggaggaggtggaggacctggagttcggcaccgccggcggcgaggtggaggagggcgccccccccccccccaccctgccccccgccctgcccccccccgagagcccccccaaggtgcagcccgagcccgagcccgagcccggcctgctgctggaggtggaggagcccggcaccgaggaggagagaggcgccgacaccgcccccaccctggcccccgaggccctgcccagccagggcgaggtggagagagagggcgagagccccgccgccggcccccccccccaggagctggtggaggaggagcccagcgccccccccaccctgctggaggaggagaccgaggacggcagcgacaaggtgcagcccccccccgagacccccgccgaggaggagatggagaccgagaccgaggccgaggccctgcaggagaaggagcaggacgacaccgccgccatgctggccgacttcatcgactgcccccccgacgacgagaagccccccccccccaccgagcccgacagctag

SEQ ID NO: 23464 - DNA, 3825 bp, Artificial Sequence
  Description of Artificial Sequence: Synthetic coding sequence
atggccgccgccgtgctgagcggccccagcgccggcagcgccgccggcgtgcccggcggcaccggcggcctgagcgccgtgagcagcggccccagactgagactgctgctgctggagagcgtgagcggcctgctgcagcccagaaccggcagcgccgtggcccccgtgcacccccccaacagaagcgccccccacctgcccggcctgatgtgcctgctgagactgcacggcagcgtgggcggcgcccagaacctgagcgccctgggcgccctggtgagcctgagcaacgccagactgagcagcatcaagaccagattcgagggcctgtgcctgctgagcctgctggtgggcgagagccccaccgagctgttccagcagcactgcgtgagctggctgagaagcatccagcaggtgctgcagacccaggacccccccgccaccatggagctggccgtggccgtgctgagagacctgctgagatacgccgcccagctgcccgccctgttcagagacatcagcatgaaccacctgcccggcctgctgaccagcctgctgggcctgagacccgagtgcgagcagagcgccctggagggcatgaaggcctgcatgacctacttccccagagcctgcggcagcctgaagggcaagctggccagcttcttcctgagcagagtggacgccctgagcccccagctgcagcagctggcctgcgagtgctacagcagactgcccagcctgggcgccggcttcagccagggcctgaagcacaccgagagctgggagcaggagctgcacagcctgctggccagcctgcacaccctgctgggcgccctgtacgagggcgccgagaccgcccccgtgcagaacgagggccccggcgtggagatgctgctgagcagcgaggacggcgacgcccacgtgctgctgcagctgagacagagattcagcggcctggccagatgcctgggcctgatgctgagcagcgagttcggcgcccccgtgagcgtgcccgtgcaggagatcctggacttcatctgcagaaccctgagcgtgagcagcaagaacatcgtgagcggcatctgccacctgttcagagccctggcccaggacaccagacagcccggcaagtactggggccccgagagcccccagaccgtgagcagctggagcagacccagagagctgcccaccttcgtgcagatcaccagcctgcccatgtgcagagacaccggcgcccagtgccagagcgtggccaacgccagcctgggcgagggcgagttcggcgacgccgagagcctgctgagaggccccgccatcctgctgaccttccaccccggcagcatcctggaggacagaggcctgatcctgctgggcgagctgagaagcggcgtgggcttcctgacctacgtgtacatctgcaagtggagcttccccgtgagcgtgagcctgtggctgagcctgagcagcagcaccctgtacctgtgccccttcttcctgcagagcctgcacggcgacggccccctgagactgctgctgctgcccagcatccacctggaggccctggacctgctgagcgccctgatcctggcctgcggcagcagactgctgagattcggcatcctgatcggcagactgctgccccaggtgctgaacagctggagcatcggcagagacagcctgagccccggccaggagagaccctacagcaccgtgagaaccaaggtgtacgccatcctggagctgtgggtgcaggtgtgcggcgccagcgccggcatgctgcagggcggcgccagcggcgaggccctgctgacccacctgctgagcgacatcagcccccccgccgacgccctgaagctgagaagccccagaggcagccccgacggcagcctgcagaccggcaagcccagcgcccccaagaagctgaagctggacgtgggcgaggccatggccccccccagccacagaaagggcgacagcaacgccaacagcgacgtgtgcgccgccgccctgagaggcctgagcagaaccatcctgatgtgcggccccctgatcaaggaggagacccacagaagactgcacgacctggtgctgcccctggtgatgggcgtgcagcagggcgaggtgctgggcagcagcccctacaccagcagcagatgcagaagagagctgtactgcctgctgctggccctgctgctggcccccagccccagatgccccccccccctggcctgcgccctgcaggccttcagcctgggccagagagaggacagcctggaggtgagcagcttctgcagcgaggccctggtgacctgcgccgccctgacccaccccagagtgccccccctgcagcccatgggccccacctgccccacccccgcccccgtgcccccccccgaggcccccagccccttcagagccccccccttccacccccccggccccatgcccagcgtgggcagcatgcccagcgccggccccatgcccagcgccggccccatgcccagcgccggccccgtgcccagcgccagacccggcccccccaccaccgccaaccacctgggcctgagcgtgcccggcctggtgagcgtgccccccagactgctgcccggccccgagaaccacagagccggcagcaacgaggaccccatcctggcccccagcggcacccccccccccaccatcccccccgacgagaccttcggcggcagagtgcccagacccgccttcgtgcactacgacaaggaggaggccagcgacgtggagatcagcctggagagcgacagcgacgacagcgtggtgatcgtgcccgagggcctgccccccctgcccccccccccccccagcggcgccacccccccccccatcgcccccaccggcccccccaccgccagcccccccgtgcccgccaaggaggagcccgaggagctgcccgccgcccccggccccctgcccccccccccccccccccccccccccgtgcccggccccgtgaccctgccccccccccagctggtgcccgagggcacccccggcggcggcggcccccccgccctggaggaggacctgaccgtgatcaacatcaacagcagcgacgaggaggaggaggaggaggaggaggaggaggaggaggaggaggaggaggaggaggaggaggaggacttcgaggaggaggaggaggacgaggaggagtacttcgaggaggaggaggaggaggaggaggagttcgaggaggagttcgaggaggaggagggcgagctggaggaggaggaggaggaggaggacgaggaggaggaggaggagctggaggaggtggaggacctggagttcggcaccgccggcggcgaggtggaggagggcgccccccccccccccaccctgccccccgccctgcccccccccgagagcccccccaaggtgcagcccgagcccgagcccgagcccggcctgctgctggaggtggaggagcccggcaccgaggaggagagaggcgccgacaccgcccccaccctggcccccgaggccctgcccagccagggcgaggtggagagagagggcgagagccccgccgccggcccccccccccaggagctggtggaggaggagcccagcgccccccccaccctgctggaggaggagaccgaggacggcagcgacaaggtgcagcccccccccgagacccccgccgaggaggagatggagaccgagaccgaggccgaggccctgcaggagaaggagcaggacgacaccgccgccatgctggccgacttcatcgactgcccccccgacgacgagaagccccccccccccaccgagcccgacagctag

SEQ ID NO: 23465 - DNA, 2721 bp, Artificial Sequence
  Description of Artificial Sequence: Synthetic coding sequence
atggagctggccgtggccgtgctgagagacctgctgagatacgccgcccagctgcccgccctgttcagagacatcagcatgaaccacctgcccggcctgctgaccagcctgctgggcctgagacccgagtgcgagcagagcgccctggagggcatgaaggcctgcatgacctacttccccagagcctgcggcagcctgaagggcaagctggccagcttcttcctgagcagagtggacgccctgagcccccagctgcagcagctggcctgcgagtgctacagcagactgcccagcctgggcgccggcttcagccagggcctgaagcacaccgagagctgggagcaggagctgcacagcctgctggccagcctgcacaccctgctgggcgccctgtacgagggcgccgagaccgcccccgtgcagaacgagggccccggcgtggagatgctgctgagcagcgaggacggcgacgcccacgtgctgctgcagctgagacagagattcagcggcctggccagatgcctgggcctgatgctgagcagcgagttcggcgcccccgtgagcgtgcccgtgcaggagatcctggacttcatctgcagaaccctgagcgtgagcagcaagaacatcagcctgcacggcgacggccccctgagactgctgctgctgcccagcatccacctggaggccctggacctgctgagcgccctgatcctggcctgcggcagcagactgctgagattcggcatcctgatcggcagactgctgccccaggtgctgaacagctggagcatcggcagagacagcctgagccccggccaggagagaccctacagcaccgtgagaaccaaggtgtacgccatcctggagctgtgggtgcaggtgtgcggcgccagcgccggcatgctgcagggcggcgccagcggcgaggccctgctgacccacctgctgagcgacatcagcccccccgccgacgccctgaagctgagaagccccagaggcagccccgacggcagcctgcagaccggcaagcccagcgcccccaagaagctgaagctggacgtgggcgaggccatggccccccccagccacagaaagggcgacagcaacgccaacagcgacgtgtgcgccgccgccctgagaggcctgagcagaaccatcctgatgtgcggccccctgatcaaggaggagacccacagaagactgcacgacctggtgctgcccctggtgatgggcgtgcagcagggcgaggtgctgggcagcagcccctacaccagcagcagatgcagaagagagctgtactgcctgctgctggccctgctgctggcccccagccccagatgccccccccccctggcctgcgccctgcaggccttcagcctgggccagagagaggacagcctggaggtgagcagcttctgcagcgaggccctggtgacctgcgccgccctgacccaccccagagtgccccccctgcagcccatgggccccacctgccccacccccgcccccgtgcccccccccgaggcccccagccccttcagagccccccccttccacccccccggccccatgcccagcgtgggcagcatgcccagcgccggccccatgcccagcgccggccccatgcccagcgccggccccgtgcccagcgccagacccggcccccccaccaccgccaaccacctgggcctgagcgtgcccggcctggtgagcgtgccccccagactgctgcccggccccgagaaccacagagccggcagcaacgaggaccccatcctggcccccagcggcacccccccccccaccatcccccccgacgagaccttcggcggcagagtgcccagacccgccttcgtgcactacgacaaggaggaggccagcgacgtggagatcagcctggagagcgacagcgacgacagcgtggtgatcgtgcccgagggcctgccccccctgcccccccccccccccagcggcgccacccccccccccatcgcccccaccggcccccccaccgccagcccccccgtgcccgccaaggaggagcccgaggagctgcccgccgcccccggccccctgcccccccccccccccccccccccccccgtgcccggccccgtgaccctgccccccccccagctggtgcccgagggcacccccggcggcggcggcccccccgccctggaggaggacctgaccgtgatcaacatcaacagcagcgacgaggaggaggaggaggaggaggaggaggaggaggaggaggaggaggaggaggaggaggaggaggacttcgaggaggaggaggaggacgaggaggagtacttcgaggaggaggaggaggaggaggaggagttcgaggaggagttcgaggaggaggagggcgagctggaggaggaggaggaggaggaggacgaggaggaggaggaggagctggaggaggtggagagagagggcgagagccccgccgccggcccccccccccaggagctggtggaggaggagcccagcgccccccccaccctgctggaggaggagaccgaggacggcagcgacaaggtgcagcccccccccgagacccccgccgaggaggagatggagaccgagaccgaggccgaggccctgcaggagaaggagcaggacgacaccgccgccatgctggccgacttcatcgactgcccccccgacgacgagaagccccccccccccaccgagcccgacagctag

SEQ ID NO: 23466 - DNA, 3543 bp, Artificial Sequence
  Description of Artificial Sequence: Synthetic coding sequence
atgctgctgcccagcctgagccccagagtgcagcccgccttcacccagtgcgccagaccccagccccccccccacgcccccagccccgtgggcggcagaagaggcgtgttcgccagcagcagacacgccaccaccggcaccagaggcaagatggccgccgccgtgctgagcggccccagcgccggcagcgccgccggcgtgcccggcggcaccggcggcctgagcgccgtgagcagcggccccagactgagactgctgctgctggagagcgtgagcggcctgctgcagcccagaaccggcagcgccgtggcccccgtgcacccccccaacagaagcgccccccacctgcccggcctgatgtgcctgctgagactgcacggcagcgtgggcggcgcccagaacctgagcgccctgggcgccctggtgagcctgagcaacgccagactgagcagcatcaagaccagattcgagggcctgtgcctgctgagcctgctggtgggcgagagccccaccgagctgttccagcagcactgcgtgagctggctgagaagcatccagcaggtgctgcagacccaggacccccccgccaccatggagctggccgtggccgtgctgagagacctgctgagatacgccgcccagctgcccgccctgttcagagacatcagcatgaaccacctgcccggcctgctgaccagcctgctgggcctgagacccgagtgcgagcagagcgccctggagggcatgaaggcctgcatgacctacttccccagagcctgcggcagcctgaagggcaagctggccagcttcttcctgagcagagtggacgccctgagcccccagctgcagcagctggcctgcgagtgctacagcagactgcccagcctgggcgccggcttcagccagggcctgaagcacaccgagagctgggagcaggagctgcacagcctgctggccagcctgcacaccctgctgggcgccctgtacgagggcgccgagaccgcccccgtgcagaacgagggccccggcgtggagatgctgctgagcagcgaggacggcgacgcccacgtgctgctgcagctgagacagagattcagcggcctggccagatgcctgggcctgatgctgagcagcgagttcggcgcccccgtgagcgtgcccgtgcaggagatcctggacttcatctgcagaaccctgagcgtgagcagcaagaacatcagcctgcacggcgacggccccctgagactgctgctgctgcccagcatccacctggaggccctggacctgctgagcgccctgatcctggcctgcggcagcagactgctgagattcggcatcctgatcggcagactgctgccccaggtgctgaacagctggagcatcggcagagacagcctgagccccggccaggagagaccctacagcaccgtgagaaccaaggtgtacgccatcctggagctgtgggtgcaggtgtgcggcgccagcgccggcatgctgcagggcggcgccagcggcgaggccctgctgacccacctgctgagcgacatcagcccccccgccgacgccctgaagctgagaagccccagaggcagccccgacggcagcctgcagaccggcaagcccagcgcccccaagaagctgaagctggacgtgggcgaggccatggccccccccagccacagaaagggcgacagcaacgccaacagcgacgtgtgcgccgccgccctgagaggcctgagcagaaccatcctgatgtgcggccccctgatcaaggaggagacccacagaagactgcacgacctggtgctgcccctggtgatgggcgtgcagcagggcgaggtgctgggcagcagcccctacaccagcagcagatgcagaagagagctgtactgcctgctgctggccctgctgctggcccccagccccagatgccccccccccctggcctgcgccctgcaggccttcagcctgggccagagagaggacagcctggaggtgagcagcttctgcagcgaggccctggtgacctgcgccgccctgacccaccccagagtgccccccctgcagcccatgggccccacctgccccacccccgcccccgtgcccccccccgaggcccccagccccttcagagccccccccttccacccccccggccccatgcccagcgtgggcagcatgcccagcgccggccccatgcccagcgccggccccatgcccagcgccggccccgtgcccagcgccagacccggcccccccaccaccgccaaccacctgggcctgagcgtgcccggcctggtgagcgtgccccccagactgctgcccggccccgagaaccacagagccggcagcaacgaggaccccatcctggcccccagcggcacccccccccccaccatcccccccgacgagaccttcggcggcagagtgcccagacccgccttcgtgcactacgacaaggaggaggccagcgacgtggagatcagcctggagagcgacagcgacgacagcgtggtgatcgtgcccgagggcctgccccccctgcccccccccccccccagcggcgccacccccccccccatcgcccccaccggcccccccaccgccagcccccccgtgcccgccaaggaggagcccgaggagctgcccgccgcccccggccccctgcccccccccccccccccccccccccccgtgcccggccccgtgaccctgccccccccccagctggtgcccgagggcacccccggcggcggcggcccccccgccctggaggaggacctgaccgtgatcaacatcaacagcagcgacgaggaggaggaggaggaggaggaggaggaggaggaggaggaggaggaggaggaggaggaggaggacttcgaggaggaggaggaggacgaggaggagtacttcgaggaggaggaggaggaggaggaggagttcgaggaggagttcgaggaggaggagggcgagctggaggaggaggaggaggaggaggacgaggaggaggaggaggagctggaggaggtggaggacctggagttcggcaccgccggcggcgaggtggaggagggcgccccccccccccccaccctgccccccgccctgcccccccccgagagcccccccaaggtgcagcccgagcccgagcccgagcccggcctgctgctggaggtggaggagcccggcaccgaggaggagagaggcgccgacaccgcccccaccctggcccccgaggccctgcccagccagggcgaggtggagagagagggcgagagccccgccgccggcccccccccccaggagctggtggaggaggagcccagcgccccccccaccctgctggaggaggagaccgaggacggcagcgacaaggtgcagcccccccccgagacccccgccgaggaggagatggagaccgagaccgaggccgaggccctgcaggagaaggagcaggacgacaccgccgccatgctggccgacttcatcgactgcccccccgacgacgagaagccccccccccccaccgagcccgacagctag

SEQ ID NO: 23467 - DNA, 1083 bp, Artificial Sequence
  Description of Artificial Sequence: Synthetic coding sequence
atgcccaagttcaagcagagaagaagaaagctgaaggccaaggccgagagactgttcaagaagaaggaggccagccacttccagagcaagctgatcaccccccccccccccccccccagccccgagagagtgggcatcagcagcatcgacatcagccagagcagaagctggctgaccagcagctggaacttcaacttccccaacatcagagacgccatcaagctgtggaccaacagagtgtggagcatctacagctggtgccagaactgcatcacccagagcctggaggtgctgaaggacaccatcttccccagcagaatctgccacagagagctgtacagcgtgaagcagcagttctgcatcctggagagcaagctgtgcaagctgcaggaggccctgaagaccatcagcgagagcagcagctgccccagctgcggccagacctgccacatgagcggcaagctgaccaacgtgcccgcctgcgtgctgatcacccccggcgacagcaaggccgtgctgccccccaccctgccccagcccgccagccacttcccccccccccccccccccccccccctgccccccccccccccccccctggcccccgtgctgctgagaaagcccagcctggccaaggccctgcaggccggccccctgaagaaggacggccccatgcagatcaccgtgaaggacctgctgaccgtgaagctgaagaagacccagagcctggacgagaagagaaagctgatccccagccccaaggccagaaaccccctggtgaccgtgagcgacctgcagcacgtgaccctgaagcccaacagcaaggtgctgagcaccagagtgaccaacgtgctgatcacccccggcaagagccagatggacctgagaaagctgctgagaaaggtggacgtggagagaagccccggcggcacccccctgaccaacaaggagaacatggagaccggcaccggcctgacccccgtgatgacccaggccctgagaagaaagttccagctggcccaccccagaagccccacccccaccctgcccctgagcaccagcagcttcgacgagcagaactag

SEQ ID NO: 23468 - DNA, 3651 bp, Artificial Sequence
  Description of Artificial Sequence: Synthetic coding sequence
atggagcagctgcccggcgtgccccccggccccccccaccccgtgagaccccccccccccaacccccccccccccatgcccctgcagctggaggcccacctgagaagccacggcctggagcccgccgcccccagccccagactgagacccgaggagagcctggacccccccggcgccatgcaggagctgctgggcgccctggagcccctgccccccgcccccggcgacaccggcgtgggcccccccaacagcgagggcaaggaccccgccggcgcctacagaagccccagcccccagggcaccaaggcccccagattcgtgcccctgaccagcatctgcttccccgacagcctgctgcaggacgaggagagaagcttcttccccaccatggaggagatgttcggcggcggcgccgccgacgactacggcaaggccggcccccccgaggacgagggcgaccccaaggccggcgccggccccccccccggcccccccgcctacgacccctacggcccctactgccccggcagagccagcggcgccggccccgagacccccggcctgggcctggaccccaacaagccccccgagctgcccagcaccgtgaacgccgagcccctgggcctgatccagagcggcccccaccaggccgcccccccccccccccccccccccccccccccccccgcccccgccagcgagcccaagggcggcctgaccagccccatcttctgcagcaccaagcccaagaagctgctgaagaccagcagcttccacctgctgagaagaagagacccccccttccagacccccaagaagctgtacgcccaggagtacgagttcgaggccgacgaggacaaggccgacgtgcccgccgacatcagactgaaccccagaagactgcccgacctggtgagcagctgcagaagcagacccgccctgagccccctgggcgacatcgacttctgcccccccaaccccggccccgacggccccagaagaagaggcagaaagcccaccaaggccaagagagacggcccccccagacccagaggcagacccagaatcagacccctggaggtgcccaccaccgccggccccgccagcgccagcacccccaccgacggcgccaagaagcccagaggcagaggcagaggcagaggcagaaaggccgaggaggccggcggcaccagactggagcccctgaagcccctgaagatcaagctgagcgtgcccaaggccggcgagggcctgggcaccagcagcggcgacgccatcagcggcaccgaccacaacagcctggacagcagcctgaccagagagaagatcgaggccaagatcaaggaggtggaggagaagcagcccgagatgaagagcggcttcatggccagcttcctggacttcctgaagagcggcaagagacacccccccctgtaccaggccggcctgaccccccccctgagcccccccaagagcgtgccccccagcgtgcccgccagaggcctgcagccccagccccccgccacccccgccgtgccccaccccccccccagcggcgccttcggcctgggcggcgccctggaggccgccgagagcgagggcctgggcctgggctgccccagcccctgcaagagactggacgaggagctgaagagaaacctggagaccctgcccagcttcagcagcgacgaggaggacagcgtggccaagaacagagacctgcaggagagcatcagcagcgccatcagcgccctggacgacccccccctggccggccccaaggacaccagcacccccgacggcccccccctggcccccgccgccgccgtgcccggccccccccccctgcccggcctgcccagcgccaacagcaacggcacccccgagccccccctgctggaggagaagcccccccccacccccccccccgcccccaccccccagccccagcccccccccccccccccccccccccagcccgccctgcccagccccccccccctggtggcccccacccccagcagccccccccccccccccctgccccccccccccccccccgccatgcccagccccccccccccccccccccccgccgccgcccccctggccgccccccccgaggagcccgccgcccccagccccgaggaccccgagctgcccgacaccagacccctgcacctggccaagaagcaggagaccgccgccgtgtgcggcgagaccgacgaggaggccggcgagagcggcggcgagggcatcttcagagagagagacgagttcgtgatcagagccgaggacatccccagcctgaagctggccctgcagaccggcagagagcccccccccatctggagagtgcagaaggccctgctgcagaagttcacccccgagatcaaggacggccagagacagttctgcgccaccagcaactacctgggctacttcggcgacgccaagaacagataccagagactgtacgtgaagttcctggagaacgtgaacaagaaggactacgtgagagtgtgcgccagaaagccctggcacagaccccccgtgcccgtgagaagaagcggccaggccaagaaccccgtgagcgccggcggcagcagcgcccccccccccaaggcccccgcccccccccccaagcccgagacccccgagaagaccaccagcgagaagccccccgagcagacccccgagaccgccatgcccgagccccccgcccccgagaagcccagcctgctgagacccgtggagaaggagaaggagaaggagaaggtgaccagaggcgagagacccctgagaggcgagagagccaccagcggcagacagaccagacccgagagaagcctggccaccggccagcccgccaccagcagactgcccaaggccagacccaccaaggtgaaggccgagcccccccccaagaagagaaagaagtggctgaaggaggccggcggcaacgccaccgccggcggcggcccccccggcagcagcagcgacagcgagagcagccccggcgcccccagcgaggacgagagagccgtgcccggcagactgctgaagaccagagccatgagagagatgtacagaagctacgtggagatgctggtgagcaccgccctggaccccgacatgatccaggccctggaggacacccacgacgagctgtacctgccccccatgagaaagatcgacggcctgctgaacgagcacaagaagaaggtgctgaagagactgagcctgagccccgccctgcaggacgccctgcacaccttcccccagctgcaggtggagcagagcggcgagggcagccccgaggagggcgccgtgagactgagacccgccggcgagccctacaacagaaagaccctgagcaagctgaagagaagcgtggtgagagcccaggagttcaaggtggagctggagaagagcggctactacaccctgtaccacagcctgcaccactacaagtaccacaccttcctgagatgcagagaccagaccctggccatcgagggcggcgccgaggacctgggccaggaggaggtggtgcagcagtgcatgagaaaccagccctggctggagcagctgttcgacagcttcagcgacctgctggcccaggcccaggcccacagcagatgcggctag

SEQ ID NO: 23469 - DNA, 3435 bp, Artificial Sequence
  Description of Artificial Sequence: Synthetic coding sequence
atggagcagctgcccggcgtgccccccggccccccccaccccgtgagaccccccccccccaacccccccccccccatgcccctgcagctggaggcccacctgagaagccacggcctggagcccgccgcccccagccccagactgagacccgaggagagcctggacccccccggcgccatgcaggagctgctgggcgccctggagcccctgccccccgcccccggcgacaccggcgtgggcccccccaacagcgagggcaaggaccccgccggcgcctacagaagccccagcccccagggcaccaaggcccccagattcgtgcccctgaccagcatctgcttccccgacagcctgctgcaggacgaggagagaagcttcttccccaccatggaggagatgttcggcggcggcgccgccgacgactacggcaaggccggcccccccgaggacgagggcgaccccaaggccggcgccggccccccccccggcccccccgcctacgacccctacggcccctactgccccggcagagccagcggcgccggccccgagacccccggcctgggcctggaccccaacaagccccccgagctgcccagcaccgtgaacgccgagcccctgggcctgatccagagcggcccccaccaggccgcccccccccccccccccccccccccccccccccccgcccccgccagcgagcccaagggcggcctgaccagccccatcttctgcagcaccaagcccaagaagctgctgaagaccagcagcttccacctgctgagaagaagagacccccccttccagacccccaagaagctgtacgcccaggagtacgagttcgaggccgacgaggacaaggccgacgtgcccgccgacatcagactgaaccccagaagactgcccgacctggtgagcagctgcagaagcagacccgccctgagccccctgggcgacatcgacttctgcccccccaaccccggccccgacggccccagaagaagaggcagaaagcccaccaaggccaagagagacggcccccccagacccagaggcagacccagaatcagacccctggaggtgcccaccaccgccggccccgccagcgccagcacccccaccgacggcgccaagaagcccagaggcagaggcagaggcagaggcagaaaggccgaggaggccggcggcaccagactggagcccctgaagcccctgaagatcaagctgagcgtgcccaaggccggcgagggcctgggcaccagcagcggcgacgccatcagcggcaccgaccacaacagcctggacagcagcctgaccagagagaagatcgaggccaagatcaaggaggtggaggagaagcagcccgagatgaagagcggcttcatggccagcttcctggacttcctgaagagcggcaagagacacccccccctgtaccaggccggcctgaccccccccctgagcccccccaagagcgtgccccccagcgtgcccgccagaggcctgcagccccagccccccgccacccccgccgtgccccaccccccccccagcggcgccttcggcctgggcggcgccctggaggccgccgagagcgagggcctgggcctgggctgccccagcccctgcaagagactggacgaggagctgaagagaaacctggagaccctgcccagcttcagcagcgacgaggaggacagcgtggccaagaacagagacctgcaggagagcatcagcagcgccatcagcgccctggacgacccccccctggccggccccaaggacaccagcacccccgacggcccccccctggcccccgccgccgccgtgcccggccccccccccctgcccggcctgcccagcgccaacagcaacggcacccccgagccccccctgctggaggagaagcccccccccacccccccccccgcccccaccccccagccccagcccccccccccccccccccccccccagcccgccctgcccagccccccccccctggtggcccccacccccagcagccccccccccccccccctgccccccccccccccccccgccatgcccagccccccccccccccccccccccgccgccgcccccctggccgccccccccgaggagcccgccgcccccagccccgaggaccccgagctgcccgacaccagacccctgcacctggccaagaagcaggagaccgccgccgtgtgcggcgagaccgacgaggaggccggcgagagcggcggcgagggcatcttcagagagagagacgagttcgtgatcagagccgaggacatccccagcctgaagctggccctgcagaccggcagagagcccccccccatctggagagtgcagaaggccctgctgcagaagttcacccccgagatcaaggacggccagagacagttctgcgccaccagcaactacctgggctacttcggcgacgccaagaacagataccagagactgtacgtgaagttcctggagaacgtgaacaagaaggactacgtgagagtgtgcgccagaaagccctggcacagaccccccgtgcccgtgagaagaagcggccaggccaagaaccccgtgagcgccggcggcagcagcgcccccccccccaaggcccccgcccccccccccaagcccgagacccccgagaagaccaccagcgagaagccccccgagcagacccccgagaccgccatgcccgagccccccgcccccgagaagcccagcctgctgagacccgtggagaaggagaaggagaaggagaaggtgaccagaggcgagagacccctgagaggcgagagagccaccagcggcagacagaccagacccgagagaagcctggccaccggccagcccgccaccagcagactgcccaaggccagacccaccaaggtgaaggccgagcccccccccaagaagagaaagaagtggctgaaggaggccggcggcaacgccaccgccggcggcggcccccccggcagcagcagcgacagcgagagcagccccggcgcccccagcgaggacgagagagccgtgcccggcagactgctgaagaccagagccatgagagagatgtacagaagctacgtggagatgctggtgagcaccgccctggaccccgacatgatccaggccctggaggacacccacgagctgaagagaagcgtggtgagagcccaggagttcaaggtggagctggagaagagcggctactacaccctgtaccacagcctgcaccactacaagtaccacaccttcctgagatgcagagaccagaccctggccatcgagggcggcgccgaggacctgggccaggaggaggtggtgcagcagtgcatgagaaaccagccctggctggagcagctgttcgacagcttcagcgacctgctggcccaggcccaggcccacagcagatgcggctag

SEQ ID NO: 23470 - DNA, 6111 bp, Artificial Sequence
  Description of Artificial Sequence: Synthetic coding sequence
atggacagaaactaccccagcgccggcttcggcgaccccctgggcgccggcgccggctggagctacgagagaagcgccaaggccagcctggtgtacggcagcagcagaaccagccaccccgagaccgacatcctgcacagacaggcctacgccgccccccaccccctgcagagctacgccaccaaccaccaccccgccggcctgagcggcctgttcgacaccggcctgcaccacgccggcagcgccggccccgacgccagcgtgatgaacctgatcagcgccctggagagcagaggcccccagcccggccccagcgccagcagcctgctgagccagttcagaagccccagctggcagaccgccatgcacacccccggccccaccgagctgttcatcagcggcgccctgcccggcagcagcaccttccccagcagcagcgccctgagcgcctaccagcaccccgccagcttcggcagcagacccttccccgtgcccagcagcctgagcctgcaggacccccccttcagcccccccgccaacggcctgctgagcccccacgacgtgctgcacctgaagcccagccaggcccccaccgtgcccagcagcctgggcttcgagagactggccggcggcggcgtgctgggccccgccggcctgggccccgcccagacccccccctacagacccggcccccccgaccccccccccccccccagacacctgcccacccagttcaacctgctggccagcagcagcgccgccgccgccgccgccgagcagagcagcccccagctgtacaacttcagcggcgccgcccccggcccccccccccccgagagagccctgcccagacaggacaccgtgatcaagcactaccagagacccgccagcgcccagcccccccccccccccccccccgcccacgccctgcagcactacctgagctgcggcggcagctaccccagcatgggccacagagccaacctggcctgcagccccctgggcggcggcgagcccagccccggcgccggcgagcccagcaaggccggccccagcggcgccaccgccggcgccagcggcagagccaccggccccgaggccgccggcggcggcggcgccggcggcggcggcggcggctacagacccatcatccagagccccggctacaagaccggcaagggcggctacggcgccgccgccggcggcgccaccagaccccccccccccagaagcaccgccacccccaagtgccagagcctgggcggccccgccgccgcctacgccaccggcaaggccagcggcgccggcggcgccggcggccaggcctacagccccggccagccccagggcctgctgggcccccaggcctacggccagggcttcggcggcggccaggcccaggacctgagcaaggcccccagctacagcggcggccccccccagccccccagcggcccccccccccccggcctggccacctgccagagctacagccccgaccagctgcagggccagctgtacggcgtgcagggcgagccctaccccggccccgccgcccacagccagggcctgcccaccgccagccccagcctgagctacagcaccggccacagccccgccctgagcggccacggcggcggctggggccccagcagcctgggcggcggcggcgaggccagccccagccacatcatcagacccctgcagagcccccccgccaccggcagaccccccggcgtgggcagccccggcgcccccggcaagtacctgagcagcgtgctggccagcgcccccttcctggccccccccggcgccggcagctacgccgccggcgccggcggctacaagggcaagggcgacggcagcgagctgctggccggccccggcggcccccccgccgagagaaccgaggacgaggagttcctgatccagcacctgctgcaggcccccagcccccccagaaccagcggcgccgacggcctggtgggcgaggacggcgccgccgacgccagcaagggcctgggcggcagcggcggcgccggcggcccccccggcaccccctacgagctggccaaggaggacccccagagataccacctgcagagcgtgatcagaaccagcgccagcctggacgagggcgccaccgccgccctggagctgggcctgggcagactgaaggagaagaagaagggccccgagagaggcggcgagacccccgagggcctggccaccagcgtggtgcactacggcgccggcgccaaggagctgggcgccttcctgcagaagagcccccccccccccccccccaccgcccagagcacccagcccaccccccacggcctgctgctggaggccggcggccccgacctgcccctggtgctgccccccccccccccccagctgctgcccagcgtgctgagccacgcccccagccccagccccagcgccagcaaggtgggcgtgcacctgctggagcccgccaccagagacggcgccccccagcccccccccccccccccccccccccccccccccatgcccctgcagctggaggcccacctgagaagccacggcctggagcccgccgcccccagccccagactgagacccgaggagagcctggacccccccggcgccatgcaggagctgctgggcgccctggagcccctgccccccgcccccggcgacaccggcgtgggcccccccaacagcgagggcaaggaccccgccggcgcctacagaagccccagcccccagggcaccaaggcccccagattcgtgcccctgaccagcatctgcttccccgacagcctgctgcaggacgaggagagaagcttcttccccaccatggaggagatgttcggcggcggcgccgccgacgactacggcaaggccggcccccccgaggacgagggcgaccccaaggccggcgccggccccccccccggcccccccgcctacgacccctacggcccctactgccccggcagagccagcggcgccggccccgagacccccggcctgggcctggaccccaacaagccccccgagctgcccagcaccgtgaacgccgagcccctgggcctgatccagagcggcccccaccaggccgcccccccccccccccccccccccccccccccccccgcccccgccagcgagcccaagggcggcctgaccagccccatcttctgcagcaccaagcccaagaagctgctgaagaccagcagcttccacctgctgagaagaagagacccccccttccagacccccaagaagctgtacgcccaggagtacgagttcgaggccgacgaggacaaggccgacgtgcccgccgacatcagactgaaccccagaagactgcccgacctggtgagcagctgcagaagcagacccgccctgagccccctgggcgacatcgacttctgcccccccaaccccggccccgacggccccagaagaagaggcagaaagcccaccaaggccaagagagacggcccccccagacccagaggcagacccagaatcagacccctggaggtgcccaccaccgccggccccgccagcgccagcacccccaccgacggcgccaagaagcccagaggcagaggcagaggcagaggcagaaaggccgaggaggccggcggcaccagactggagcccctgaagcccctgaagatcaagctgagcgtgcccaaggccggcgagggcctgggcaccagcagcggcgacgccatcagcggcaccgaccacaacagcctggacagcagcctgaccagagagaagatcgaggccaagatcaaggaggtggaggagaagcagcccgagatgaagagcggcttcatggccagcttcctggacttcctgaagagcggcaagagacacccccccctgtaccaggccggcctgaccccccccctgagcccccccaagagcgtgccccccagcgtgcccgccagaggcctgcagccccagccccccgccacccccgccgtgccccaccccccccccagcggcgccttcggcctgggcggcgccctggaggccgccgagagcgagggcctgggcctgggctgccccagcccctgcaagagactggacgaggagctgaagagaaacctggagaccctgcccagcttcagcagcgacgaggaggacagcgtggccaagaacagagacctgcaggagagcatcagcagcgccatcagcgccctggacgacccccccctggccggccccaaggacaccagcacccccgacggcccccccctggcccccgccgccgccgtgcccggccccccccccctgcccggcctgcccagcgccaacagcaacggcacccccgagccccccctgctggaggagaagcccccccccacccccccccccgcccccaccccccagccccagcccccccccccccccccccccccccagcccgccctgcccagccccccccccctggtggcccccacccccagcagccccccccccccccccctgccccccccccccccccccgccatgcccagccccccccccccccccccccccgccgccgcccccctggccgccccccccgaggagcccgccgcccccagccccgaggaccccgagctgcccgacaccagacccctgcacctggccaagaagcaggagaccgccgccgtgtgcggcgagaccgacgaggaggccggcgagagcggcggcgagggcatcttcagagagagagacgagttcgtgatcagagccgaggacatccccagcctgaagctggccctgcagaccggcagagagcccccccccatctggagagtgcagaaggccctgctgcagaagttcacccccgagatcaaggacggccagagacagttctgcgccaccagcaactacctgggctacttcggcgacgccaagaacagataccagagactgtacgtgaagttcctggagaacgtgaacaagaaggactacgtgagagtgtgcgccagaaagccctggcacagaccccccgtgcccgtgagaagaagcggccaggccaagaaccccgtgagcgccggcggcagcagcgcccccccccccaaggcccccgcccccccccccaagcccgagacccccgagaagaccaccagcgagaagccccccgagcagacccccgagaccgccatgcccgagccccccgcccccgagaagcccagcctgctgagacccgtggagaaggagaaggagaaggagaaggtgaccagaggcgagagacccctgagaggcgagagagccaccagcggcagacagaccagacccgagagaagcctggccaccggccagcccgccaccagcagactgcccaaggccagacccaccaaggtgaaggccgagcccccccccaagaagagaaagaagtggctgaaggaggccggcggcaacgccaccgccggcggcggcccccccggcagcagcagcgacagcgagagcagccccggcgcccccagcgaggacgagagagccgtgcccggcagactgctgaagaccagagccatgagagagatgtacagaagctacgtggagatgctggtgagcaccgccctggaccccgacatgatccaggccctggaggacacccacgacgagctgtacctgccccccatgagaaagatcgacggcctgctgaacgagcacaagaagaaggtgctgaagagactgagcctgagccccgccctgcaggacgccctgcacaccttcccccagctgcaggtggagcagagcggcgagggcagccccgaggagggcgccgtgagactgagacccgccggcgagccctacaacagaaagaccctgagcaagctgaagagaagcgtggtgagagcccaggagttcaaggtggagctggagaagagcggctactacaccctgtaccacagcctgcaccactacaagtaccacaccttcctgagatgcagagaccagaccctggccatcgagggcggcgccgaggacctgggccaggaggaggtggtgcagcagtgcatgagaaaccagccctggctggagcagctgttcgacagcttcagcgacctgctggcccaggcccaggcccacagcagatgcggctag

SEQ ID NO: 23471 - DNA, 1677 bp, Artificial Sequence
  Description of Artificial Sequence: Synthetic coding sequence
ggcagacccctgggcggcgacgccagaagagagggcgccagcgtgggcggcaccagcagagactggagcgaggagggcatctgcctgaccgtggacccctggggcagcaccctgagcagcgagatgctgcagctgggcccccccctgagcgagagaagcttcgccgccctgaagctgaccggcgagggcaaggccagccccggcagacaggccggctggagcagccaggccagaccccccgaccccctgtgcctgtgcagagagcccctgagcagaatccacagaaccagcagcaccctgagaagaagaagcagaaccacccccggccccgaggagggccccagccagaaggtggacagagccccccagcccaccctggtggtgatgctggaggacatcgccagccccagaccccccgccgagggcttcatcgacgagacccccaacttcatcatccccgcccagagagccgagcccatgagaatcgtgagacagcccacccccccccccggcgacctggagccccccttccagcccagcgccctgcccgccgaccccctggagagcccccccaccgcccccgaccccgccctggagctgcccagcacccccccccccagcagcctgctgagacccagactgagcccctggggcctggcccccctgttcagaagcgtgagaagcaagctggagagcttcgccgacatcttcctgacccccaacaagaccccccagccccccccccccagcccccccatgaagctggagctgaagatcgccatcagcgaggccgagcagagcggcgccgccgagggcaccgccagcgtgagccccagaccccccatcagacagtggagaacccaggaccacaacacccccgccctgctgcccaagcccagcctgggcagaagctacagctgccccgacctgggcccccccggccccggcacctgcacctggccccccgcccccccccagcccagcagacccagacccagaagacacaccgtgggcggcggcgagatggccagagccccccccccccccagaccctgcctgagaaaggaggtgttccccctgggcggcgtgggcgccagccccagcctgaccaccagctgcagcagcaccgccagcaccagcttcagcgagcccgccgagcccagactgggcagcaccaagggcaaggagcccagagccagcaaggaccaggtgctgagcgagcccgagaccaagaccatgggcaaggtgagcagattcagaatcagaagaacccccgccagaccccagctgaacctgacccccatgggcctgcccagacccatcagactgaacaagaaggagttcagcctggaggagatctacaccaacaagaactaccagagccccaccaccagaagaaccttcgagaccatcttcgaggagcccagagagagaaacggcaccctgatcttcaccagcagcagaaagctgagaagagccgtggagttcagagacagcagcctgcccagaagcagaagacccagcagaggcgtgagagccgccggcggcagaaccgtgccccccaacgtggcccccagccccgacgtgggccccctgctgcagcagagactggaggagctggacgccctgctgctggaggaggagaccgtggacagagagcagccccactggacctag

SEQ ID NO: 23472 - DNA, 1758 bp, Artificial Sequence
  Description of Artificial Sequence: Synthetic coding sequence
atggacctgcccggcgacagcagcccccccggccagcccagactgtgcagacagcccctgaccagagccctgtggggcgccagaagccccaagagacccagactgcagctgcccggcgcccccagccccctggagaaggccagcagaagagtgctggccgtggtgctggaggacgtgatggccgtgcacatggtgcccgtggtgcccagcaagcagaccagcatcccccagcaccacagctaccaccaggaccccgtgcacagacagccccccgccagcccccccagacaggccggctggagcagccaggccagaccccccgaccccctgtgcctgtgcagagagcccctgagcagaatccacagaaccagcagcaccctgagaagaagaagcagaaccacccccggccccgaggagggccccagccagaaggtggacagagccccccagcccaccctggtggtgatgctggaggacatcgccagccccagaccccccgccgagggcttcatcgacgagacccccaacttcatcatccccgcccagagagccgagcccatgagaatcgtgagacagcccacccccccccccggcgacctggagccccccttccagcccagcgccctgcccgccgaccccctggagagcccccccaccgcccccgaccccgccctggagctgcccagcacccccccccccagcagcctgctgagacccagactgagcccctggggcctggcccccctgttcagaagcgtgagaagcaagctggagagcttcgccgacatcttcctgacccccaacaagaccccccagccccccccccccagcccccccatgaagctggagctgaagatcgccatcagcgaggccgagcagagcggcgccgccgagggcaccgccagcgtgagccccagaccccccatcagacagtggagaacccaggaccacaacacccccgccctgctgcccaagcccagcctgggcagaagctacagctgccccgacctgggcccccccggccccggcacctgcacctggccccccgcccccccccagcccagcagacccagacccagaagacacaccgtgggcggcggcgagatggccagagccccccccccccccagaccctgcctgagaaaggaggtgttccccctgggcggcgtgggcgccagccccagcctgaccaccagctgcagcagcaccgccagcaccagcttcagcgagcccgccgagcccagactgggcagcaccaagggcaaggagcccagagccagcaaggaccaggtgctgagcgagcccgagaccaagaccatgggcaaggtgagcagattcagaatcagaagaacccccgccagaccccagctgaacctgacccccatgggcctgcccagacccatcagactgaacaagaaggagttcagcctggaggagatctacaccaacaagaactaccagagccccaccaccagaagaaccttcgagaccatcttcgaggagcccagagagagaaacggcaccctgatcttcaccagcagcagaaagctgagaagagccgtggagttcagagacagcagcctgcccagaagcagaagacccagcagaggcgtgagagccgccggcggcagaaccgtgccccccaacgtggcccccagccccgacgtgggccccctgctgcagcagagactggaggagctggacgccctgctgctggaggaggagaccgtggacagagagcagccccactggacctag

SEQ ID NO: 23473 - DNA, 1758 bp, Artificial Sequence; identical to SEQ ID NO: 23472
  Description of Artificial Sequence: Synthetic coding sequence

SEQ ID NO: 23474 - DNA, 6450 bp, Artificial Sequence
  Description of Artificial Sequence: Synthetic coding sequence
atgctgagcagcggcgtggagacccagcccgtgcccctggacagcagcatgagcgccgtggtgcaggagctgtacagcgagctgcccgtgagcgtgagcagagagctgcacgccgaccccgagcccagcgtgatccccgacgtgaagcccggcgccagcagcagcctgctgagccagaacagagccctgcccctggagctgcagagaacccacgtggagagctgctgcgaggagacctacgagaccctggaccacggcagcgagcccggcagatgcggcctggtggacagcaccgccggcggcagcgtggccagcggcatcctggacagagccaagagaagcgagagcatggagcccaaggtgttcagagaccccggcggccaggccggcatcatcagagagcccagcgagggcgccaaggaggacccccaccagcacagcaccgccgccgaggagaagaccagccccagccaggaggacctgctgatgcagagcagcaaggagctgagccacgtggacctgcccgaggacttcctgagaagcaaggagggcaacgtgcagatcaccgccgagaccctgctgaagagcgccgaggtgcagggcatgaaggtgaacggcaccaagaccgacaacaacgagggccacaagaacggcaacgtgagcaaggacctgagcgccggctgcggcgagttccaggaggtggacaagatcatgaccagcgacgaggtgagcgagaccagcaccctggtgacccccgagcccctgaccttcgtggaccccgtgctgaccgaggccacccccaaggagaaggagtgcgaggagctgaagagctgcccctggctgagcctgcccggcaacagcgccatcagcaacgtggacaacggcaaggaggagctgtgcaagcccaacctggtgtgcgaggccgacgacaaccaccagcagctgcacggccaccacaacgagcagcccagcagcacccacgacagccccaccgccaccagccccctgaaggagaacagcgaggtgagctgcttcaccagcgacctgagcggccccgagagcagaaccatcagcctggagaactgcggcttcgagggcggcggcctgctgaagagaagcgccgagaagaccgacagcagctacttctacagaggcgacgaccagggcaagaacctggccagcagagaggagaacgaggagagactgctgatccccagaagcgagagaggcggccccttcctgttcaacgccagagagcccgagaaggagatcagcggcagatgcagcggcgagaaggagcccgtggtgagccccaaggagaacatccacaacaactgcatccaggacagcctgcacaccggcaacagcagcagcctgatgcccaacagcttcaccgaggccaccgaggtgatgctgaacaagaacgacctgaagatcaccgtgcacgtgcagggcaacctgaccaaccccgaggaccacaaggagaccttcaccaacatgagccaccccggcggccacagcgaggagagcagcttcagcagcctgatgcagatcgaggaggccggccagaccacccccgtggagcccaacatcctgagcaagagcttctacaccaaggactgcaacagcctggtgagcatccagagaaacctggagggcaacacccagctgaacgaggccagctgcaacgacttcctgttcgagagaaagagcatcgtgagcctgatgcccgaggaccagatcagccccgtgagcgaggtgctgaagcccaagcagggcaccgccctgctgctgcccagccccgagttcgactacagacccgagagcgagaaggtgatccagaccagccacgacgacatccccctgctggacgagcagagcatcgcctgcgagatgaacgagctgagctgcaccaacgagctggtggtgaacaaggtggagagcgagtgcgtgctgaaccagcaggtgagcctgaacagccaggagcacgccaacctgcccaccgacagcctgctgcacctgaacaaggagatgcccctggccaccggcagagacgcccaccagagccaccacccccccctggagggcagagccgacgtgatcgccgacatccagaccatccccatccagaccaagatcaaggacatcagcccccccggcaaccagacctgcggcgccagcagcaactgccccaccctgaacatcaagcccgtgagcctggagagaaagaaggagatggccgacagcggcaccaaggccctgcacagcagactgagaagcaacaagagagaggccgccggcttcccccaggtggtgagcgtgatcgagtgccacagcgtgcagagccaggacatcagcagctgccacagagtgagaaagaacgtgagccaggagaacatgtgcagcgccagcgccgccttcaagagcagcaagatcagcctgcaggtggacaacagcctgatcaccaagtacgagaacgccttccagcacagagaccactgctgccagggcaccggccacagcgtggagaagagcagctgcaaggtgagctacaccagccaggagagagagctggacggcaaggagaccaacggcagcctgcccggcgacaagatcagaaacaagatggtggccggcctgctgaacagcggcatcagcaacaagaccatccacaccagcagcagcatcaagctgagcgaggagggcctggagggcaaggagcaggacgtgagcaaggagaccgtgttctgcaagtacaacatcagcgaccacgccatccaggagctgaaccagaccgtgaacatccccggccccgagaaggtgctggaccagagccccaccgtgatgttcagcagcttcaagaacgtgaagagcgtggagaccctggaccagaaggccgacgaggtgctggactgccagagcaaccagaacagacccgacgagtgcaagagcgagggccagagcgccaaggagatgctgagcagcgaccagagagagaccgtgaccgagccccacggcgaggtgaaccacaaccagaaggacctgctggtgagcagcggcagcaacaacagcctgccctgcggcagccccaagaagtgcaacctgaagggcgccttcgtgaagatgagcggctgcgacgagagcaccgagggcatggtggacatcgtgtacaccgactgcagcaacaagctggccgagggcgtgctggacgtgaaggccagcaacctgctggactgcggcgccagacaggagaagctggccttccaggaggacagcagaagcaccctgagcagaagagagctggacgccgcccacaccggcaccaccggccaggacagcgacttccccgtgaccgccgccagcaccgtggacttcctgaagatcaagaagagctgcgaggagaacgtgtgcagaagcctgaaggactgcgagatggagaagtgccccgacagctgcgcccacgagatggagagcgtggccgaccacgagcccaacaagagaatcctgggcagagtgaacctgagcctgaacgacagccactacggccagcaggacaagggcaccagcctgagagagacccaggagatgaccgagggcagcagactggagcccaacagcgagttcggcaaggagagcaccttcggcatcagcagcaaggagagcatgagctgccacgacgagagcagcgtgagcctgagaagcctgaagagcatcgagatcatgcccagccaggagaacagcgagaccaacgtgaacagcgaggagaccgacctgaagaacctgtgcaagcccaaggacggcgagatgctgtgcgagaacgtgaaggactgcaccgtgctgcccgagatgaaggagatcgtgagcagagactggagcaacagcagcgacagagacagcgtgtgcacctgcgtggagaagaacgcctgcaaggcctgccacccccacgagaacagcagcgacagacacctgcccctgaccgtgaagaccgacatcaaggtgaagggcgaggagaccgaggagcaccagagaggcagactgggctacctgaccgtgggcgagcagagcgaggagctggtgaccagagagaccggcgacggcgaccccgtgagcaacatcagccagacccacttcaagtgcagaggcatcctgaaccacgccgagaagcagcagagccccgaggtgctggactacatgctgcagaaggaggagaagtacatcagacagcagaaggcccacaccatcagccagcagtgcatcagcagcagcctgctgctggacgacgcccagaaccagaaccagcccaaggccgacaaggacgagagcaccatgatcaacgagatcaccctggccaagctggccaaggacagcatcgtggcccagacccagaagctggaggaccagaaggaggagagactgcaccaccccctgagaaaggacaccgagagctgcaccagcccctgcctgctgggcgcccccagaaaggcccaggaccccagcagcgccggctgcgaccagatccacggcgccttcgccaagaagggcgtgctgcccctgaagaagcagccccacagaacctgcaagaaggtgagctaccaggagcagatcatcgtgggcagaaagatcggcaagatcagaagcagcgccttcctgaagagcagcagcaaccccatccccaccaaggcccacagactgctgagcctgtgcaccctgagcgcccccaccagactggagcccgagaccgcccccaccaagagcctggtgagccacatccccaagcagatgagcaccccctgccaccccctgagaagcctgaacttcagaaagaccaccaaggagagcgccctgctgaacaagctgagcatcctggccagcaagctggcccccgccatgaagacccagaagctgagatacagaagatgcagcagcgagctgctgcccatggccaagagctacaagagactgagatacaagagactgctggacggcttcagcagcagcaccgagcagctgaacccctacctggccgccagcggctgggacaagagacccaacagcaagcccatggccctgtacagcctggagagcatcaagatgaccttcatcgacctgagcaacaagatgcccagcctgctgttcggcagcgagatcttccccgtgagcttccacgtgaagagcagcagcagcgactgcaccaccgagagcagcagaaccttccccgagcactgcgcccccgccagactggccctgggcgaggccctgcagtgccccagccagccccccaagtggaccttcagcttcttcctgagccacggctgccccggcatggccaccttcagagaggacaccggcgtgcacagccagacccacacccaggcccccccccagccccccgcccccctgcaggactacggcggcaccgccatcgtgcagaccagagccgactgcagcgtgctgggcctgcacaccctgctggccctgtgcagccccggctgctacagaatctggaccaagaagagaagcttcagcagccacatgcccaccatgcagagactgttcatgacccagttcacccagggcctgaagggcctgagaagccccgccagcatcgccgacaaggtgttctgcagcctgccctacagcgtgggcagagtgctgagcatctggagccagcacggccccagcgtgtgcagcttcgagatcagcagcctgcacagcccccactgcaagagacagcccagcctgggcaccaccagcagccacaccatgctgccctacgtgcccctgcccggcatggaggccacctacaacaccagcggcagccagaccagactggagccccccttccccgccctggtgcccaagagctgcctggtggccgagagcgccgtgagcaagctgctgctgagcgccagcgagttccaggtgagaggcctggacgagctggacggcgtgaaggccgcctgcccctgcccccagagcagcccccccgagcagaaggaggccgagcccgagaagagacccaagaaggtgagccagatcagaatcagaaagaccatccccagacccgaccccaacctgacccccatgggcctgcccagacccaagagactgaagaagaaggagttcagcctggaggagatctacaccaacaagaactacaagagcccccccgccaacagagacctggacagcagctgccccagcaccgacagcgagaccggccacttcctggtgttcggctacgcccagagacaggcccagccccaccccctgctggccagcagaagactgatcggctgcagcagccccgagggcagaggccaccccagaagctacccctactggagaagactgctggtgctgtgctggtacctgcccggctggagagccggcagagtgacctggctgagactggccacctgggccggcagaggcgacagcagcctgtag

SEQ ID NO: 23475 - DNA, 6021 bp, Artificial Sequence
  Description of Artificial Sequence: Synthetic coding sequence
atgctgagcagcggcgtggagacccagcccgtgcccctggacagcagcatgagcgccgtggtgcaggagctgtacagcgagctgcccgtgagcgtgagcagagagctgcacgccgaccccgagcccagcgtgatccccgacgtgaagcccggcgccagcagcagcctgctgagccagaacagagccctgcccctggagctgcagagaacccacgtggagagctgctgcgaggagacctacgagaccctggaccacggcagcgagcccggcagatgcggcctggtggacagcaccgccggcggcagcgtggccagcggcatcctggacagagccaagagaagcgagagcatggagcccaaggtgttcagagaccccggcggccaggccggcatcatcagagagcccagcgagggcgccaaggaggacccccaccagcacagcaccgccgccgaggagaagaccagccccagccaggaggacctgctgatgcagagcagcaaggagctgagccacgtggacctgcccgaggacttcctgagaagcaaggagggcaacgtgcagatcaccgccgagaccctgctgaagagcgccgaggtgcagggcatgaaggtgaacggcaccaagaccgacaacaacgagggccacaagaacggcaacgtgagcaaggacctgagcgccggctgcggcgagttccaggaggtggacaagatcatgaccagcgacgaggtgagcgagaccagcaccctggtgacccccgagcccctgaccttcgtggaccccgtgctgaccgaggccacccccaaggagaaggagtgcgaggagctgaagagctgcccctggctgagcctgcccggcaacagcgccatcagcaacgtggacaacggcaaggaggagctgtgcaagcccaacctggtgtgcgaggccgacgacaaccaccagcagctgcacggccaccacaacgagcagcccagcagcacccacgacagccccaccgccaccagccccctgaaggagaacagcgaggtgagctgcttcaccagcgacctgagcggccccgagagcagaaccatcagcctggagaactgcggcttcgagggcggcggcctgctgaagagaagcgccgagaagaccgacagcagctacttctacagaggcgacgaccagggcaagaacctggccagcagagaggagaacgaggagagactgctgatccccagaagcgagagaggcggccccttcctgttcaacgccagagagcccgagaaggagatcagcggcagatgcagcggcgagaaggagcccgtggtgagccccaaggagaacatccacaacaactgcatccaggacagcctgcacaccggcaacagcagcagcctgatgcccaacagcttcaccgaggccaccgaggtgatgctgaacaagaacgacctgaagatcaccgtgcacgtgcagggcaacctgaccaaccccgaggaccacaaggagaccttcaccaacatgagccaccccggcggccacagcgaggagagcagcttcagcagcctgatgcagatcgaggaggccggccagaccacccccgtggagcccaacatcctgagcaagagcttctacaccaaggactgcaacagcctggtgagcatccagagaaacctggagggcaacacccagctgaacgaggccagctgcaacgacttcctgttcgagagaaagagcatcgtgagcctgatgcccgaggaccagatcagccccgtgagcgaggtgctgaagcccaagcagggcaccgccctgctgctgcccagccccgagttcgactacagacccgagagcgagaaggtgatccagaccagccacgacgacatccccctgctggacgagcagagcatcgcctgcgagatgaacgagctgagctgcaccaacgagctggtggtgaacaaggtggagagcgagtgcgtgctgaaccagcaggtgagcctgaacagccaggagcacgccaacctgcccaccgacagcctgctgcacctgaacaaggagatgcccctggccaccggcagagacgcccaccagagccaccacccccccctggagggcagagccgacgtgatcgccgacatccagaccatccccatccagaccaagatcaaggacatcagcccccccggcaaccagacctgcggcgccagcagcaactgccccaccctgaacatcaagcccgtgagcctggagagaaagaaggagatggccgacagcggcaccaaggccctgcacagcagactgagaagcaacaagagagaggccgccggcttcccccaggtggtgagcgtgatcgagtgccacagcgtgcagagccaggacatcagcagctgccacagagtgagaaagaacgtgagccaggagaacatgtgcagcgccagcgccgccttcaagagcagcaagatcagcctgcaggtggacaacagcctgatcaccaagtacgagaacgccttccagcacagagaccactgctgccagggcaccggccacagcgtggagaagagcagctgcaaggtgagctacaccagccaggagagagagctggacggcaaggagaccaacggcagcctgcccggcgacaagatcagaaacaagatggtggccggcctgctgaacagcggcatcagcaacaagaccatccacaccagcagcagcatcaagctgagcgaggagggcctggagggcaaggagcaggacgtgagcaaggagaccgtgttctgcaagtacaacatcagcgaccacgccatccaggagctgaaccagaccgtgaacatccccggccccgagaaggtgctggaccagagccccaccgtgatgttcagcagcttcaagaacgtgaagagcgtggagaccctggaccagaaggccgacgaggtgctggactgccagagcaaccagaacagacccgacgagtgcaagagcgagggccagagcgccaaggagatgctgagcagcgaccagagagagaccgtgaccgagccccacggcgaggtgaaccacaaccagaaggacctgctggtgagcagcggcagcaacaacagcctgccctgcggcagccccaagaagtgcaacctgaagggcgccttcgtgaagatgagcggctgcgacgagagcaccgagggcatggtggacatcgtgtacaccgactgcagcaacaagctggccgagggcgtgctggacgtgaaggccagcaacctgctggactgcggcgccagacaggagaagctggccttccaggaggacagcagaagcaccctgagcagaagagagctggacgccgcccacaccggcaccaccggccaggacagcgacttccccgtgaccgccgccagcaccgtggacttcctgaagatcaagaagagctgcgaggagaacgtgtgcagaagcctgaaggactgcgagatggagaagtgccccgacagctgcgcccacgagatggagagcgtggccgaccacgagcccaacaagagaatcctgggcagagtgaacctgagcctgaacgacagccactacggccagcaggacaagggcaccagcctgagagagacccaggagatgaccgagggcagcagactggagcccaacagcgagttcggcaaggagagcaccttcggcatcagcagcaaggagagcatgagctgccacgacgagagcagcgtgagcctgagaagcctgaagagcatcgagatcatgcccagccaggagaacagcgagaccaacgtgaacagcgaggagaccgacctgaagaacctgtgcaagcccaaggacggcgagatgctgtgcgagaacgtgaaggactgcaccgtgctgcccgagatgaaggagatcgtgagcagagactggagcaacagcagcgacagagacagcgtgtgcacctgcgtggagaagaacgcctgcaaggcctgccacccccacgagaacagcagcgacagacacctgcccctgaccgtgaagaccgacatcaaggtgaagggcgaggagaccgaggagcaccagagaggcagactgggctacctgaccgtgggcgagcagagcgaggagctggtgaccagagagaccggcgacggcgaccccgtgagcaacatcagccagacccacttcaagtgcagaggcatcctgaaccacgccgagaagcagcagagccccgaggtgctggactacatgctgcagaaggaggagaagtacatcagacagcagaaggcccacaccatcagccagcagtgcatcagcagcagcctgctgctggacgacgcccagaaccagaaccagcccaaggccgacaaggacgagagcaccatgatcaacgagatcaccctggccaagctggccaaggacagcatcgtggcccagacccagaagctggaggaccagaaggaggagagactgcaccaccccctgagaaaggacaccgagagctgcaccagcccctgcctgctgggcgcccccagaaaggcccaggaccccagcagcgccggctgcgaccagatccacggcgccttcgccaagaagggcgtgctgcccctgaagaagcagccccacagaacctgcaagaaggtgagctaccaggagcagatcatcgtgggcagaaagatcggcaagatcagaagcagcgccttcctgaagagcagcagcaaccccatccccaccaaggcccacagactgctgagcctgtgcaccctgagcgcccccaccagactggagcccgagaccgcccccaccaagagcctggtgagccacatccccaagcagatgagcaccccctgccaccccctgagaagcctgaacttcagaaagaccaccaaggagagcgccctgctgaacaagctgagcatcctggccagcaagctggcccccgccatgaagacccagaagctgagatacagaagatgcagcagcgagctgctgcccatggccaagagctacaagagactgagatacaagagactgctggacggcttcagcagcagcaccgagcagctgaacccctacctggccgccagcggctgggacaagagacccaacagcaagcccatggccctgtacagcctggagagcatcaagatgaccttcatcgacctgagcaacaagatgcccagcctgctgttcggcagcgagatcttccccgtgagcttccacgtgaagagcagcagcagcgactgcaccaccgagagcagcagaaccttccccgagcactgcgcccccgccagactggccctgggcgaggccctgcagtgccccagccagccccccaagtggaccttcagcttcttcctgagccacggctgccccggcatggccaccttcagagaggacaccggcgtgcacagccagacccacacccaggcccccccccagccccccgcccccctgcaggactacggcggcaccgccatcgtgcagaccagagccgactgcagcgtgctgggcctgcacaccctgctggccctgtgcagccccggctgctacagaatctggaccaagaagagaagcttcagcagccacatgcccaccatgcagagactgttcatgacccagttcacccagggcctgaagggcctgagaagccccgccagcatcgccgacaaggtgttctgcagcctgccctacagcgtgggcagagtgctgagcatctggagccagcacggccccagcgtgtgcagcttcgagatcagcagcctgcacagcccccactgcaagagacagcccagcctgggcaccaccagcagccacaccatgctgccctacgtgcccctgcccggcatggaggccacctacaacaccagcggcagccagaccagactggagccccccttccccgccctggtgcccaagagctgcctggtggccgagagcgccgtgagcaagctgctgctgagcgccagcgagttccaggtgagaggcctggacgagctggacggcgtgaaggccgcctgcccctgcccccagagcagcccccccgagcagaaggaggtgaaggaggagggcgtgtag

SEQ ID NO: 23476 - DNA, 6456 bp, Artificial Sequence
  Description of Artificial Sequence: Synthetic coding sequence
atgctgagcagcggcgtggagacccagcccgtgcccctggacagcagcatgagcgccgtggtgcaggagctgtacagcgagctgcccgtgagcgtgagcagagagctgcacgccgaccccgagcccagcgtgatccccgacgtgaagcccggcgccagcagcagcctgctgagccagaacagagccctgcccctggagctgcagagaacccacgtggagagctgctgcgaggagacctacgagaccctggaccacggcagcgagcccggcagatgcggcctggtggacagcaccgccggcggcagcgtggccagcggcatcctggacagagccaagagaagcgagagcatggagcccaaggtgttcagagaccccggcggccaggccggcatcatcagagagcccagcgagggcgccaaggaggacccccaccagcacagcaccgccgccgaggagaagaccagccccagccaggaggacctgctgatgcagagcagcaaggagctgagccacgtggacctgcccgaggacttcctgagaagcaaggagggcaacgtgcagatcaccgccgagaccctgctgaagagcgccgaggtgcagggcatgaaggtgaacggcaccaagaccgacaacaacgagggccacaagaacggcaacgtgagcaaggacctgagcgccggctgcggcgagttccaggaggtggacaagatcatgaccagcgacgaggtgagcgagaccagcaccctggtgacccccgagcccctgaccttcgtggaccccgtgctgaccgaggccacccccaaggagaaggagtgcgaggagctgaagagctgcccctggctgagcctgcccggcaacagcgccatcagcaacgtggacaacggcaaggaggagctgtgcaagcccaacctggtgtgcgaggccgacgacaaccaccagcagctgcacggccaccacaacgagcagcccagcagcacccacgacagccccaccgccaccagccccctgaaggagaacagcgaggtgagctgcttcaccagcgacctgagcggccccgagagcagaaccatcagcctggagaactgcggcttcgagggcggcggcctgctgaagagaagcgccgagaagaccgacagcagctacttctacagaggcgacgaccagggcaagaacctggccagcagagaggagaacgaggagagactgctgatccccagaagcgagagaggcggccccttcctgttcaacgccagagagcccgagaaggagatcagcggcagatgcagcggcgagaaggagcccgtggtgagccccaaggagaacatccacaacaactgcatccaggacagcctgcacaccggcaacagcagcagcctgatgcccaacagcttcaccgaggccaccgaggtgatgctgaacaagaacgacctgaagatcaccgtgcacgtgcagggcaacctgaccaaccccgaggaccacaaggagaccttcaccaacatgagccaccccggcggccacagcgaggagagcagcttcagcagcctgatgcagatcgaggaggccggccagaccacccccgtggagcccaacatcctgagcaagagcttctacaccaaggactgcaacagcctggtgagcatccagagaaacctggagggcaacacccagctgaacgaggccagctgcaacgacttcctgttcgagagaaagagcatcgtgagcctgatgcccgaggaccagatcagccccgtgagcgaggtgctgaagcccaagcagggcaccgccctgctgctgcccagccccgagttcgactacagacccgagagcgagaaggtgatccagaccagccacgacgacatccccctgctggacgagcagagcatcgcctgcgagatgaacgagctgagctgcaccaacgagctggtggtgaacaaggtggagagcgagtgcgtgctgaaccagcaggtgagcctgaacagccaggagcacgccaacctgcccaccgacagcctgctgcacctgaacaaggagatgcccctggccaccggcagagacgcccaccagagccaccacccccccctggagggcagagccgacgtgatcgccgacatccagaccatccccatccagaccaagatcaaggacatcagcccccccggcaaccagacctgcggcgccagcagcaactgccccaccctgaacatcaagcccgtgagcctggagagaaagaaggagatggccgacagcggcaccaaggccctgcacagcagactgagaagcaacaagagagaggccgccggcttcccccaggtggtgagcgtgatcgagtgccacagcgtgcagagccaggacatcagcagctgccacagagtgagaaagaacgtgagccaggagaacatgtgcagcgccagcgccgccttcaagagcagcaagatcagcctgcaggtggacaacagcctgatcaccaagtacgagaacgccttccagcacagagaccactgctgccagggcaccggccacagcgtggagaagagcagctgcaaggtgagctacaccagccaggagagagagctggacggcaaggagaccaacggcagcctgcccggcgacaagatcagaaacaagatggtggccggcctgctgaacagcggcatcagcaacaagaccatccacaccagcagcagcatcaagctgagcgaggagggcctggagggcaaggagcaggacgtgagcaaggagaccgtgttctgcaagtacaacatcagcgaccacgccatccaggagctgaaccagaccgtgaacatccccggccccgagaaggtgctggaccagagccccaccgtgatgttcagcagcttcaagaacgtgaagagcgtggagaccctggaccagaaggccgacgaggtgctggactgccagagcaaccagaacagacccgacgagtgcaagagcgagggccagagcgccaaggagatgctgagcagcgaccagagagagaccgtgaccgagccccacggcgaggtgaaccacaaccagaaggacctgctggtgagcagcggcagcaacaacagcctgccctgcggcagccccaagaagtgcaacctgaagggcgccttcgtgaagatgagcggctgcgacgagagcaccgagggcatggtggacatcgtgtacaccgactgcagcaacaagctggccgagggcgtgctggacgtgaaggccagcaacctgctggactgcggcgccagacaggagaagctggccttccaggaggacagcagaagcaccctgagcagaagagagctggacgccgcccacaccggcaccaccggccaggacagcgacttccccgtgaccgccgccagcaccgtggacttcctgaagatcaagaagagctgcgaggagaacgtgtgcagaagcctgaaggactgcgagatggagaagtgccccgacagctgcgcccacgagatggagagcgtggccgaccacgagcccaacaagagaatcctgggcagagtgaacctgagcctgaacgacagccactacggccagcaggacaagggcaccagcctgagagagacccaggagatgaccgagggcagcagactggagcccaacagcgagttcggcaaggagagcaccttcggcatcagcagcaaggagagcatgagctgccacgacgagagcagcgtgagcctgagaagcctgaagagcatcgagatcatgcccagccaggagaacagcgagaccaacgtgaacagcgaggagaccgacctgaagaacctgtgcaagcccaaggacggcgagatgctgtgcgagaacgtgaaggactgcaccgtgctgcccgagatgaaggagatcgtgagcagagactggagcaacagcagcgacagagacagcgtgtgcacctgcgtggagaagaacgcctgcaaggcctgccacccccacgagaacagcagcgacagacacctgcccctgaccgtgaagaccgacatcaaggtgaagggcgaggagaccgaggagcaccagagaggcagactgggctacctgaccgtgggcgagcagagcgaggagctggtgaccagagagaccggcgacggcgaccccgtgagcaacatcagccagacccacttcaagtgcagaggcatcctgaaccacgccgagaagcagcagagccccgaggtgctggactacatgctgcagaaggaggagaagtacatcagacagcagaaggcccacaccatcagccagcagtgcatcagcagcagcctgctgctggacgacgcccagaaccagaaccagcccaaggccgacaaggacgagagcaccatgatcaacgagatcaccctggccaagctggccaaggacagcatcgtggcccagacccagaagctggaggaccagaaggaggagagactgcaccaccccctgagaaaggacaccgagagctgcaccagcccctgcctgctgggcgcccccagaaaggcccaggaccccagcagcgccggctgcgaccagatccacggcgccttcgccaagaagggcgtgctgcccctgaagaagcagccccacagaacctgcaagaaggtgagctaccaggagcagatcatcgtgggcagaaagatcggcaagatcagaagcagcgccttcctgaagagcagcagcaaccccatccccaccaaggcccacagactgctgagcctgtgcaccctgagcgcccccaccagactggagcccgagaccgcccccaccaagagcctggtgagccacatccccaagcagatgagcaccccctgccaccccctgagaagcctgaacttcagaaagaccaccaaggagagcgccctgctgaacaagctgagcatcctggccagcaagctggcccccgccatgaagacccagaagctgagatacagaagatgcagcagcgagctgctgcccatggccaagagctacaagagactgagatacaagagactgctggacggcttcagcagcagcaccgagcagctgaacccctacctggccgccagcggctgggacaagagacccaacagcaagcccatggccctgtacagcctggagagcatcaagatgaccttcatcgacctgagcaacaagatgcccagcctgctgttcggcagcgagatcttccccgtgagcttccacgtgaagagcagcagcagcgactgcaccaccgagagcagcagaaccttccccgagcactgcgcccccgccagactggccctgggcgaggccctgcagtgccccagccagccccccaagtggaccttcagcttcttcctgagccacggctgccccggcatggccaccttcagagaggacaccggcgtgcacagccagacccacacccaggcccccccccagccccccgcccccctgcaggactacggcggcaccgccatcgtgcagaccagagccgactgcagcgtgctgggcctgcacaccctgctggccctgtgcagccccggctgctacagaatctggaccaagaagagaagcttcagcagccacatgcccaccatgcagagactgttcatgacccagttcacccagggcctgaagggcctgagaagccccgccagcatcgccgacaaggtgttctgcagcctgccctacagcgtgggcagagtgctgagcatctggagccagcacggccccagcgtgtgcagcttcgagatcagcagcctgcacagcccccactgcaagagacagcccagcctgggcaccaccagcagccacaccatgctgccctacgtgcccctgcccggcatggaggccacctacaacaccagcggcagccagaccagactggagccccccttccccgccctggtgcccaagagctgcctggtggccgagagcgccgtgagcaagctgctgctgagcgccagcgagttccaggtgagaggcctggacgagctggacggcgtgaaggccgcctgcccctgcccccagagcagcccccccgagcagaaggaggccgagcccgagaagagacccaagaaggtgagccagatcagaatcagaaagaccatccccagacccgaccccaacctgacccccatgggcctgcccagacccaagagactgaagaagaaggagttcagcctggaggagatctacaccaacaagaactacaagagcccccccgccaacagatgcctggagaccatcttcgaggagcccaaggagagaaacggcaccctgatcagcatcagccagcagaagagaaagagagtgctggagttccaggacttcaccgtgcccagaaagagaagagccagaggcaaggtgaaggtggccggcagcttcaccagagcccagaaggccgccgtgcagagcagagagctggacgccctgctgatccagaagctgatggagctggagaccttcttcgccaaggaggaggagcaggagcagagcagcggctgctag

SEQ ID NO: 23477 - DNA, 390 bp, Artificial Sequence
  Description of Artificial Sequence: Synthetic coding sequence
atggccgacagcggcgacgccggcagcagcggcccctggtggaagagcctgaccaacagcagaaagaagagcaaggaggccgccgtgggcgtgcccccccccgcccagcccgcccccggcgagcccaccccccccgccccccccagccccgactggaccagcagcagcagagagaaccagcaccccaacctgctgggcggcgccggcgagccccccaagcccgacaagctgtacggcgacaagagcggcagcagcagaagaaacctgaagatcagcagaagcggcagattcaaggagaagagaaaggtgagagccaccctgctgcccgaggccggcagaagccccgaggaggccggcttccccggcgacccccacgaggacaagcagtag

SEQ ID NO: 23478 - DNA, 57 bp, Artificial Sequence
  Description of Artificial Sequence: Synthetic coding sequence
atggccgacagcggcgacgccggcagcagcggcccctggtggaagagcctgacctag

SEQ ID NO: 23479 - DNA, 312 bp, Artificial Sequence
  Description of Artificial Sequence: Synthetic coding sequence
atgaccaccgagatcggctggtggaagctgaccttcctgagaaagaagaagagcacccccaaggtgctgtacgagatccccgacacctacgcccagaccgagggcgacgccgagccccccagacccgacgccggcggccccaacagcgacttcaacaccagactggagaagatcgtggacaagagcaccaagggcaagcacgtgaaggtgagcaacagcggcagattcaaggagaagaagaaggtgagagccaccctggccgagaaccccaacctgttcgacgaccacgaggagggcagaagcagcaagtag

SEQ ID NO: 23480 - DNA, 846 bp, Artificial Sequence
  Description of Artificial Sequence: Synthetic coding sequence
atggcccagagcggcctgaccgccaccagcgccagccaggtgcaggccatcctgctgccccagcccgccagcgtgagacactacgcctgggtggtggaccagatcgacaccctgaccagcgacctgcagctggaggacgagatgaccgacagcagcaagaccgacaccctgaacagcagcagcagcggcaccaccgccagcagcctggagaagatcaaggtgcaggccaacgcccccctgatcaagccccccgcccaccccagcgccatcctgaccgtgctgagaaagcccaacccccccccccccccccccagactgacccccgtgaagtgcgaggaccccaagagagtggtgcccaccgccaaccccgtgaagaccaacggcaccctgctgagaaacggcggcctgcccggcggccccaacaagatccccaacggcgacatctgctgcatccccaacagcaacctggacaaggcccccgtgcagctgctgatgcacagacccgagaaggacagatgcccccaggccggccccagagagagagtgagattcaacgagaaggtgcagtaccacggctactgccccgactgcgacaccagatacaacatcaagaacagagaggtgcacctgcacagcgagcccgtgcacccccccggcaagatcccccaccagggcccccccctgccccccaccccccacctgccccccttccccctggagaacggcggcatgggcatcagccacagcaacagcttcccccccatcagacccgccaccgtgcccccccccaccgcccccaagccccagaagaccatcctgagaaagagcaccaccaccaccgtgtag

SEQ ID NO: 23481 - DNA, 915 bp, Artificial Sequence
  Description of Artificial Sequence: Synthetic coding sequence
atgagcgccaagagcaagggcaaccccagcagcagctgccccgccgagggcccccccgccgccagcaagaccaaggtgaaggagcagatcaagatcatcgtggaggacctggagctggtgctgggcgacctgaaggacgtggccaaggagctgaaggaggtggtggaccagatcgacaccctgaccagcgacctgcagctggaggacgagatgaccgacagcagcaagaccgacaccctgaacagcagcagcagcggcaccaccgccagcagcctggagaagatcaaggtgcaggccaacgcccccctgatcaagccccccgcccaccccagcgccatcctgaccgtgctgagaaagcccaacccccccccccccccccccagactgacccccgtgaagtgcgaggaccccaagagagtggtgcccaccgccaaccccgtgaagaccaacggcaccctgctgagaaacggcggcctgcccggcggccccaacaagatccccaacggcgacatctgctgcatccccaacagcaacctggacaaggcccccgtgcagctgctgatgcacagacccgagaaggacagatgcccccaggccggccccagagagagagtgagattcaacgagaaggtgcagtaccacggctactgccccgactgcgacaccagatacaacatcaagaacagagaggtgcacctgcacagcgagcccgtgcacccccccggcaagatcccccaccagggcccccccctgccccccaccccccacctgccccccttccccctggagaacggcggcatgggcatcagccacagcaacagcttcccccccatcagacccgccaccgtgcccccccccaccgcccccaagccccagaagaccatcctgagaaagagcaccaccaccaccgtgtag

SEQ ID NO: 23482 - DNA, 705 bp, Artificial Sequence
  Description of Artificial Sequence: Synthetic coding sequence
atgaccgacagcagcaagaccgacaccctgaacagcagcagcagcggcaccaccgccagcagcctggagaagatcaaggtgcaggccaacgcccccctgatcaagccccccgcccaccccagcgccatcctgaccgtgctgagaaagcccaacccccccccccccccccccagactgacccccgtgaagtgcgaggaccccaagagagtggtgcccaccgccaaccccgtgaagaccaacggcaccctgctgagaaacggcggcctgcccggcggccccaacaagatccccaacggcgacatctgctgcatccccaacagcaacctggacaaggcccccgtgcagctgctgatgcacagacccgagaaggacagatgcccccaggccggccccagagagagagtgagattcaacgagaaggtgcagtaccacggctactgccccgactgcgacaccagatacaacatcaagaacagagaggtgcacctgcacagcgagcccgtgcacccccccggcaagatcccccaccagggcccccccctgccccccaccccccacctgccccccttccccctggagaacggcggcatgggcatcagccacagcaacagcttcccccccatcagacccgccaccgtgcccccccccaccgcccccaagccccagaagaccatcctgagaaagagcaccaccaccaccgtgtag

SEQ ID NO: 23483 - DNA, 705 bp, Artificial Sequence; identical to SEQ ID NO: 23482
  Description of Artificial Sequence: Synthetic coding sequence

SEQ ID NO: 23484 - DNA, 429 bp, Artificial Sequence
  Description of Artificial Sequence: Synthetic coding sequence
atgaccgacagcagcaagaccgacaccctgaacagcagcagcagcggcaccaccgccagcagcctggagaagatcaaggtgcaggccaacgcccccctgatcaagccccccgcccaccccagcgccatcctgaccgtgctgagaaagcccaacccccccccccccccccccagactgacccccgtgaagtgcgaggaccccaagagagtggtgcccaccgccaaccccgtgaagaccaacggcaccctgctgagaaacggcggcctgcccggcggccccaacaagatccccaacggcgacatctgctgcatccccaacagcaacctggacaaggcccccgtgcagctgctgatgcacagacccgagaaggacagatgcccccaggccggccccagagagagagtgagattcaacgagaaggtgcagtag

SEQ ID NO: 23485 - DNA, 1071 bp, Artificial Sequence
  Description of Artificial Sequence: Synthetic coding sequence
atggacacccagggccccgtgagccagcccttccagcagcccgagaagcccggcagagtgagaagaagaaagaccagaagagagagaaacaaggccctggtgggcagcagaagacccctggcccaccacgacccccccgtggccatcagagacccccccgtggtgcccaccgccagcaagctggtggtgatcacccagggcagactgagcagagagcacagaggcctgttcaaccacgaggtgaagagcctggacgtggccagactgctgagcagcggcaccctggtgcccggcagccccaccctgcccgccaagcccagccccagccccggcagagcccaggagcccgcccccagaagcagagacaaggagaaccaggtgcccggcggcagcggccccggcccccccagcagccccgagctgagcggcgtgggccagctgctggccgagctgcagtgccagctgagcctgccccaggccttccccagaagaaacctgatccaggacgccagagacgccatcgtgcacaccctgcaggcctgccacggctgcgtgcccgacctggccctggtgctgagaggctgccagccccccctgcccggcgccaagcccggcgtgagcgagagaaagatgacccccttctggatcaacagccccgaccaggtgcccgagcaggagagacagagaaagcagcagggcaccaaggagttcaccttccccatgccctacaccagcagcatgcccaccgcccacagaggcagcctggccccccccagaggcccctggcccccctacttccccagcctgagcagccccagcggcaccgcctggggcccccccaccgccttcgacctgctgaagagcatctggctggtggccaccccccccccccccagaccctggggcgtgggcctgccccagcccctgccccagcccagcagccccctgctgcccagaaccagcgtgctggactggagccccagcccccccagccccctgcccagcctgagctgggtggtggcccagagcagccccgaggcctggagcttcccccccatgagactgtactag

SEQ ID NO: 23486 - DNA, 1071 bp, Artificial Sequence; identical to SEQ ID NO: 23485
  Description of Artificial Sequence: Synthetic coding sequence

SEQ ID NO: 23487 - DNA, 666 bp, Artificial Sequence
  Description of Artificial Sequence: Synthetic coding sequence
atggaggagcccagacccagcaagagactgagaagcatggcccccaaccaggccagcggcggccccccccccgagcccggctgctgcgtggccgaccccgagggcagcgtggaggccgacggccccgcccagcccgcccagcccgccaagcccatcgcctacgtgaagcccttcagaagacagccccccgccagacccgagagccccccccccgccgagagaggcagaagaagaggcggcagcagaagacccggcagaggcagaggcagaagagccggccccagaggcgacgccggccagagacagggcgccgagggcctgatggcccccgacgtgcacatccagctggaccaccacggcgagcccggccaccagggcgagcccgagatcaccgagaccgccgccttcagcctgagcgagaccggccccccccccggcaccgtgcaggagggccccggccccgacgtggcccagcccgagctgggcttccaggagccccccgccgcccccggcccccaggccgtggactggcagcccgtgctgaccctgtacccctgcatcggcttcagagccctgggcgacagcgccgtgctgcaggtgatccagaccccccagggcacctacgtgcagggcgtgcccgtgttcctgaccgacatcgcctactag

SEQ ID NO: 23488 - DNA, 666 bp, Artificial Sequence; identical to SEQ ID NO: 23487
  Description of Artificial Sequence: Synthetic coding sequence

SEQ ID NO: 23489 - DNA, 666 bp, Artificial Sequence; identical to SEQ ID NO: 23487
  Description of Artificial Sequence: Synthetic coding sequence

SEQ ID NO: 23490 - DNA, 666 bp, Artificial Sequence; identical to SEQ ID NO: 23487
  Description of Artificial Sequence: Synthetic coding sequence

SEQ ID NO: 23491 - DNA, 666 bp, Artificial Sequence; identical to SEQ ID NO: 23487
  Description of Artificial Sequence: Synthetic coding sequence

SEQ ID NO: 23492 - DNA, 666 bp, Artificial Sequence; identical to SEQ ID NO: 23487
  Description of Artificial Sequence: Synthetic coding sequence

SEQ ID NO: 23493 - DNA, 666 bp, Artificial Sequence; identical to SEQ ID NO: 23487
  Description of Artificial Sequence: Synthetic coding sequence

SEQ ID NO: 23494 - DNA, 666 bp, Artificial Sequence; identical to SEQ ID NO: 23487
  Description of Artificial Sequence: Synthetic coding sequence

SEQ ID NO: 23495 - DNA, 666 bp, Artificial Sequence; identical to SEQ ID NO: 23487
  Description of Artificial Sequence: Synthetic coding sequence

SEQ ID NO: 23496 - DNA, 1170 bp, Artificial Sequence
  Description of Artificial Sequence: Synthetic coding sequence
atgcacgcctgcagcagcaccgccctgcaccccagacccttcatccacggcttcagcttcaccaccttcctgcagcagctgttcccccacggcagcagcaccgccctgcacccctggcccttcatccacggcagcagccccatggccctgcaccccagactgttcacccacggccccagcagcaccgccctgcacccctgccccttcacccacggcagcagccccatgagcctgcaccccagactgttcacccacagccccagcagcatgcccctgcaccccagacccttcgtgcacgccagcagccccaccgccctgagaccctgcctgttcacccacggccccagcagcatgcccctgcaccccagacccttcgtgcacgccagcagccccaccgccctgcccccctgcctgttcacccacggccccagcagcatgcccctgcaccccagacccttcctgcacgccagcagccccaccgccctgcccccctgcctgttcacccacggccccagcagcatgcccctgcaccccagacccttcgtgcacgccagcagccccaccgccctgagaccctgcctgttcacccacggccccagcagcatgcccctgcaccccagacccttcgtgcacgccagcagccccaccgccctgcccccctgcctgttcacccacggccccagcagcatgcccctgcaccccagacccttcgtgcacgccagcagccccaccgccctgagaccctgcctgttcacccacggccccagcagcatgcccctgcaccccagacccttcctgcacgccagcagccccaccgccctgagaccctgcctgttcacccacggccccagcagcatgcccctgcaccccagacccttcgtgcacgccagcagccccaccgccctgagaccctgcctgttcacccacggccccagcagcatgcccctgcaccccagacccttcgtgcacgccagcagcagcaccagcctgcaccccagacccttcatccacgccagcagcagcaagagcctgcacctgagactgttcagccacagcagctgcctggtgggcttcagccagcagggcaacgtgctgctgctgagcgccagagccaccttcaacacctgcctgctggtgagcaacatgtacttcctgatcatcagctactag

SEQ ID NO: 23497 - DNA, 1170 bp, Artificial Sequence; identical to SEQ ID NO: 23496
  Description of Artificial Sequence: Synthetic coding sequence

SEQ ID NO: 23498 - DNA, 1269 bp, Artificial Sequence
  Description of Artificial Sequence: Synthetic coding sequence
atgcagcaccccaagcccttctgcgcccccgccgccccccaggagggcttcagcccccagagcctggagggcgccgaggtgctgggcaaccagcccgcccccacctgcgccgagcccccccccgccatgggcagcctgaacctgtaccacccccccgaccccgagaaggaggtgttccccgccccccccgccggcttccagatggccccctgcggctgcttcttcgaccccagaatctacagaatcgagtggaccacccccgacctgggccagagcgccctgtacaagctggccgccagcagcggcggccccgccggcgtgcccagcgcccccggcagctacctgctggagccccagccctacctgaaggcccccggcctgcccccctacccccactaccagcaggcccccggcggcccccagttcctgctgccctacttcccccccgagggccccggccccgaggccctgggcttcgtgggcgacgccggccccgccgccttcgtggagctgcccctgccccccctggaggagggccccgcccccctgcccccccccccccccaaggagaacaagcccccccccgtgctgatcaccctgcccgccgagcccaccctgccccccgacgcctacagccacctgcagggccacctgggccacttccccggccccgagcccctggccttccccgtgaaggagctgcagggcagcggcgccagacccggcgtgcccctgtacccccccggcctgagcgagctgaaggtggccgaggtgaaggagggcgccctgctgggcgccggcaaggccaaggcccccaagaccgccagagccctggccctgcccgacaaggtgctgctggaggacgccatgaagctgttcgactgcctgcccggcgccagcgagcccgagggcaccctgtgcgaggtgcccggccccgccctgcccgacagcagcggcggcaacagcgccgacgacatcagaagcctgtgcctgcccgaggagctgctgagcttcgactacagcgtgcccgagatcctggacaccgtgagcaacgtggactacttcttcaacttcaaggccctggacgaggagcagcccccccaccccggcccccccgccaccaacacccccgcccccatcctgagcggcaagagaaaggccagcaccgccaagaagggcaagcccggcagaaaggccagacagcccgccggccccgccagcgccaccccccccggccccagagaggacctgggcgccaccccccactag

SEQ ID NO: 23499 - DNA, 801 bp, Artificial Sequence
  Description of Artificial Sequence: Synthetic coding sequence
atgggcagcagacccagaagccccagcgccttccccgccccctggtggggccagcagcccggcggccccggccccgccaagagactgagactggaggagcccgccggccccgagcccagagtggcccccagcctggaggaccccgccggcacccccgccgtgggcgccctgaccagcatcgtggtgctggccgccggctgcgccctgagagtgcccctggacgacgtggacctggtgctggagctgccccccaccagcatcctgagagtgagcctggacggccacaccctgatcctgatccccgaggtgctgctgagcagcgtggacgagagaagcggcgcccaggacgacagcagcgccggcctggaggtggacgtgttcctgggcgccctgagagaggacgtggtggtggagcaggaggtgttctgcgccagcgtgcccgagatcgccgcccaggaggaggcctacgaggaggacgccgaccccgagttccccgagctgcagatggacagcgccgccggcagcgccgccggcctgtacagcagcgccagaagcatgttcagcccctacagagagggccccatccccgagccctgcgccctggcccccaaccccagcagcgagggccacagccccggccccttcttcgaccccgagttcagactgctggagcccgtgcccagcagccccctgcagcccctgccccccagccccagagtgggcagccccggcccccacgcccacccccccctgcccaagagacccccctgcaaggccagaagaagactgttccaggagtag

SEQ ID NO: 23500 - DNA, 798 bp, Artificial Sequence
  Description of Artificial Sequence: Synthetic coding sequence
atggtgagcagacccagaagccccagcgccttccccgccccctggtggggccagcagcccggcggccccggccccgccaagagactgagactggaggagcccgccggccccgagcccagagccgcccccagcctggaggaccccgccggcgaccccgccgtggacgccctgaccagcatcgtggtgctggccgccggctgcgccctgagagtgcccctggacgacgtggacctggtgctggagcccgcccccaccagcatcctgagagtgagcctgggcggccacaccctgatcctgatccccgaggtgctgctgagcagcgtggacgagagaagcggcgcccagcacgacagcagcgccggcctggaggtggacgtgttcctgggcgccgtgagagaggacgtggtggtggagctggagttctgcgccagcgtgcccgagatcgccgcccaggaggaggcctacgaggaggacgccgaccccgagttccccgagctgagaatggacagccccaccggcagcgccgccggcctgtaccccagcagcagaagcatgttcatcccctacagagagggccccatccccgagccctgcgccctggcccccaaccccagcagcgagagaagaagccccagacccatcttcgacctggagttcagactgctggagcccgtgcccagcagccccctgcagcccctgccccccagcccctgcgtgggcagccccggcccccacgccagaagccccctgcccgagagacccccctgcaaggccagaagaagactgttccaggcctag

SEQ ID NO: 23501 - DNA, 789 bp, Artificial Sequence
  Description of Artificial Sequence: Synthetic coding sequence
atgggcagcagaccctgcagccccagcgcctgcctggccccctggtggggccagcagcccggcggccccggccccgccaagagaagcagactggaggagcccgccggccccgagagcagagccgcccccagccccgaggaccccgccggcacccccgccgtggacgccctgaccagcatggtggtgctggacgccggctgcgccctgagagtgcccctggaggacgtggacctggtgctggagctggcccccatgagcgtgctgagagtgagcctgggcggccacaccctgatcgtgatccccgaggtgctgctgagcagcgtggacgagtgcagcggcgcccagggcgactggagcgccggcctggaggtggacgtgttcctgggcgcccacggcgaggacgtggtggtggagcaggaggtgtgcgccagcgtgcccgagatcgccgccgaggaggaggcctacgaggaggacgccgacagcgagttccccgagctgtggatggacagcgccgccggcagcgccgccggcctgtaccccagcgccagaagcatgttcagcccctacagagagggccccatcagaggcccctgcgccctggcccccaaccccagcagcgagagaagaagccccagacccatcttcgacctggagttccacctgctggagcccgtgcccagcagccccctgcagcccctgccccccagccccagccccggcccccacgccagacccgagctgcccgagagacccccctgcaaggtgagaagaagactgttccaggagtag

SEQ ID NO: 23502 - DNA, 789 bp, Artificial Sequence; identical to SEQ ID NO: 23501
  Description of Artificial Sequence: Synthetic coding sequence

SEQ ID NO: 23503 - DNA, 429 bp, Artificial Sequence
  Description of Artificial Sequence: Synthetic coding sequence
atgagaggcaccagctgcgtgggcggcggcgccgagagccccggcggcgccggcctgagcgagggccccagaggcagatggctgagactggcccccgtgtgcgcctacttcctgtgcgtgagcctggccgccgtgctgctggccgtgtactacggcctgatctgggtgcccaccagaagccccgccgcccccgccggcccccagcccagcgcccccagccccccctgcgccgccagacccggcgtgccccccgtgcccgcccccgccgccgccagcctgagctgcctgctgggcgtgcccggcggccccagaccccagctgcagctgcccctgagcagaagaagaagatacagcgaccccgacagaagacccagcagacagacccccagagagacccccgaggccgccgagggcagaagacccggctag

SEQ ID NO: 23504 - DNA, 1209 bp, Artificial Sequence
  Description of Artificial Sequence: Synthetic coding sequence
atggccagaaccgaccagaagcccccctgcagaggcggctgctggggccagcccggccaccccaacaccggcggcgccgccgcccaccccacctaccaccccatgggccacagacccagaacctgcatcctgctgagaggcgaccagaccaccggcggccaggcccccagcagagagatcagcctgggcccctgggccgccggcacccacttcctggccatcagcaccaccccctggggcagaaagacccccgcctgcatcagcgagctgcccaccagcagcggcaccgcccagcccctggccaacgccgtgtgcgaggtgcagaccgtgcccggccccggcctgagaccccagggcacccccgccatgagagcccccagccacaagggcaccccccccacccccaacccctggggccccgagcagccccagaacagacacaagcaccccaagaagggcgtgaccggcggccccagcccccccccccccgccgccagcagatacggccagacccccggcagagagcccagagtgcaggcccccggcctgggcccctgcggcagacccgccagcggcagactgctgagcctgcacctggagaagggcgacggcaagggcaccagacagagaatccccctgaccgacgccgccgtgggcggcgacagaaccgacatccccagcgccatcgccgccggccccgccagaacccccgacagacacggcctgcccatccccggcagcacccccacccccatggtgggcagcggcagactgggcgcccccgtgggcagaagcggcggcggcgccagcgccagaagcagcagacccagctgcgccaacgtgctgctgagagccgacgccagcctgggcaccgtgctgagcgtgctgtggaccggccagctgagcagaggctgggccctgctgccccccggcgacgccggcagacacctggagaccagcgtgatcagcgccggcgtggccgccggcatctggctggtggagcccggcgaggccgcccaggaccccgccaccagaagaaccgccccccccagaagaaccgccagccccgagccccccgcccccggcgcccccctgcccgcctgccccggcagaatccccggcgccgccagattcggccccagaagctgccccctgggcagccccgccgtgctggccgtgaccaccggctggagccacagaagcgtgtag

SEQ ID NO: 23505 - DNA, 351 bp, Artificial Sequence
  Description of Artificial Sequence: Synthetic coding sequence
atgagcttcagcgagcagcagtgcaagcagccctgcgtgccccccccctgcctgcccaagacccaggagcagtgccaggccaaggccgaggaggtgtgcctgcccacctgccagcacccctgccaggacaagtgcctggtgcaggcccaggaggtgtgcctgagccagtgccaggagagcagccaggagaagtgcccccagcagggccaggagccctacctgcccccctgccaggaccagtgccccccccagtgcgccgagccctgccaggagctgttccagaccaagtgcgtggaggtgtgcccccagaaggtgcaggagaagtgcagcagccccggcaagggcaagtag

SEQ ID NO: 23506 - DNA, 657 bp, Artificial Sequence
  Description of Artificial Sequence: Synthetic coding sequence
atgggcagagtgttcctgaccggcgagaaggccaacagcatcctgaagagataccccagagccaacggcttcttcgaggagatcagacagggcaacatcgagagagagtgcaaggaggagttctgcaccttcgaggaggccagagaggccttcgagaacaacgagaagaccaaggagttctggagcacctacaccaaggcccagcagggcgagagcaacagaggcagcgactggttccagttctacctgaccttccccctgatcttcggcctgttcatcatcctgctggtgatcttcctgatctggagatgcttcctgagaaacaagaccagaagacagaccgtgaccgagggccacatccccttcccccagcacctgaacatcatcacccccccccccccccccgacgaggtgttcgacagcagcggcctgagccccggcttcctgggctacgtggtgggcagaagcgacagcgtgagcaccagactgagcaactgcgaccccccccccacctacgaggaggccaccggccaggtgaacctgcagagaagcgagaccgagccccacctggaccccccccccgagtacgaggacatcgtgaacagcaacagcgccagcgccatccccatggtgcccgtggtgaccaccatcaagtag

SEQ ID NO: 23507 - DNA, 657 bp, Artificial Sequence; identical to SEQ ID NO: 23506
  Description of Artificial Sequence: Synthetic coding sequence

SEQ ID NO: 23508 - DNA, 657 bp, Artificial Sequence; identical to SEQ ID NO: 23506
  Description of Artificial Sequence: Synthetic coding sequence

SEQ ID NO: 23509 - DNA, 657 bp, Artificial Sequence; identical to SEQ ID NO: 23506
  Description of Artificial Sequence: Synthetic coding sequence

SEQ ID NO: 23510 - DNA, 249 bp, Artificial Sequence
  Description of Artificial Sequence: Synthetic coding sequence
atggaccccggccccaagggccactgccactgcggcggccacggccacccccccggccactgcggccccccccccggccacggccccggcccctgcggcccccccccccaccacggccccggcccctgcggccccccccccggccacggccccggcccctgcggcccccccccccaccacggccccggcccctgcggccccccccccggccacggccccggccaccccccccccggcccccaccactag

SEQ ID NO: 23511 - DNA, 246 bp, Artificial Sequence
  Description of Artificial Sequence: Synthetic coding sequence
atggaccccggcaagggccactgccactgcggcggccacggccacccccccggccactgcggccccccccccggccacggccccggcccctgcggcccccccccccaccacggccccggcccctgcggccccccccccggccacggccccggcccctgcggcccccccccccaccacggccccggcccctgcggccccccccccggccacggccccggccaccccccccccggcccccaccactag

SEQ ID NO: 23512 - DNA, 537 bp, Artificial Sequence
  Description of Artificial Sequence: Synthetic coding sequence
tgaagaagccaggtgtacatgcaccccagcctgagcccccccagcaccatgatcctgagcggcggcaccgccctgaagcccccctacagcgccttccccggcatgcagcccctggagatggtgaagccccagagcggcagcccctaccagcccatgagcggcaaccaggccctggtgtacgagggccagctgagccaggccgccggcctgggcgccagccagatgctggacagccagctgccccagctgaccatgcccctgcccagatacggcagcggccagcagcccctgatcctgccccagagcatccagctgccccccggccagagcctgagcgtgggcgcccccagaagaatccccccccccggcagccagccccccgtgctgaacaccagcagagagcccagccagatggagatgaagggcttccacttcgccgacagcaagcagaacgtgcccagcggcggccccgtgcccagcccccagacctacagacagaacaacgagtggatgagaaaccccgcctgggagccctag

SEQ ID NO: 23513 - DNA, 6690 bp, Artificial Sequence
  Description of Artificial Sequence: Synthetic coding sequence
atgagcgacagactgggccagatcaccaagggcaaggacggcaagagcaagtacagcaccctgagcctgttcgacaagtacaagggcaagagcgtggacgccatcagaagcagcgtgatccccagacacggcctgcagagcctgggcaaggtggccgccgccagaagaatgcccccccccgccaacctgcccagcctgaagagcgagaacaagggcaacgaccccaacatcgtgatcgtgcccaaggacggcaccggctgggccaacaagcaggaccagcaggaccccaagagcagcagcgccaccgccagccagccccccgagagcctgccccagcccggcctgcagaagagcgtgagcaacctgcagaagcccacccagagcatcagccaggagaacaccaacagcgtgcccggcggccccaagagctgggcccagctgaacggcaagcccgtgggccacgagggcggcctgagaggcagcagcagactgctgagcttcagccccgaggagttccccaccctgaaggccgccggcggccaggacaaggccggcaaggagaagggcgtgctggacctgagctacggccccggccccagcctgagaccccagaacgtgaccagctggagagagggcggcggcagacacatcatcagcgccaccagcctgagcaccagccccaccgagctgggcagcagaaacagcagcaccggcgacggcgcccccagcagcgcctgcaccagcgacagcaaggaccccagcctgagacccgcccagcccgtgagaaagggcgccagccagttcatgggcaacgtgtaccacccccccacctaccacgacatgctgcccgccttcatgtgcagccccaagagcagcgagaaccagggcaccgtggagagaggcagcttccccctgccccagctgagactggagcccagagtgcccttcagacagttccagatgaacgaccaggacggcaaggagaacagactgggcctgagcagacccctgagacccctgagacagctggtggagagagcccccagacccaccatcatcaacgccgagaacctgaagggcctggacgacctggacgccgacgccgacgacggctgggccggcctgcacgaggaggtggactacagcgagaagctgaagttcagcgacgacgaggaggaggaggaggtggtgaaggacggcagacccaagtggaacagctgggaccccagaagacagagacagctgagcatgagcagcgccgacagcgccgacgccaagagaaccagagaggagggcaaggactgggccgaggccgtgggcgccagcagagtggtgagaaaggcccccgacccccagcccccccccagaaagctgcacggctgggcccccggccccgactaccagaagagcagcatgggcagcatgttcagacagcagagcatcgaggacaaggaggacaagcccccccccagacagaagttcatccagagcgagatgagcgaggccgtggagagagccagaaagagaagagaggaggaggagagaagagccagagaggagagactggccgcctgcgccgccaagctgaagcagctggaccagaagtgcaagcaggccagaaaggccggcgaggccagaaagcaggccgagaaggaggtgccctggagccccagcgccgagaaggccagcccccaggagaacggccccgccgtgcacaagggcagccccgagttccccgcccaggagacccccaccaccttccccgaggaggcccccaccgtgagccccgccgtggcccagagcaacagcagcgaggaggaggccagagaggccggcagccccgcccaggagttcaagtaccagaagagcctgccccccagattccagagacagcagcagcagcagcagcaggagcagctgtacaagatgcagcactggcagcccgtgtaccccccccccagccacccccagagaaccttctacccccaccacccccagatgctgggcttcgaccccagatggatgatgatgcccagctacatggaccccagaatcacccccaccagaacccccgtggacttctaccccagcgccctgcaccccagcggcctgatgaagcccatgatgccccaggagagcctgaacggcaccggctgcagaagcgaggaccagaactgcgtgccccccctgcaggagagaaaggtgacccccatcgacagcccccccgtgtggagccccgagggctacatggccctgcagagcaagggctaccccctgccccaccccaagagcagcgacaccctggccatggacatgagagtgagaaacgagagcagcttcagcgccagcctgggcagagccggcggcgtgagcgcccagagagacctgttcgaggagagaggcgaggagtacctgagcgccttcgacaagaaggcccaggccgacttcgacagctgcatcagcagccagagaatcggccaggagctgctgttccccccccaggagaacgtgcaggacgccggcgcccccggcggccacacccagaacctgagatgcagccccctggagcccgacttcgtgcccgacgagaagaagcccgagtgcggcagctgggacgtgagccaccagcccgagaccgccgacaccgcccacggcgtggagagagagacccccagagagggcaccgccttcaacatcagcagctgggacaagaacggcagccccaacaagcagcccagcagcgagcccgagtggacccccgagcccagaagcagcagcagccagcaccccgagcagaccggcagaaccagaagaagcggccccatcaagaagcccgtgctgaaggccctgaaggtggaggacaaggagaaggagctggagaagatcaagcaggagctgggcgaggagagcaccagactggccaaggagaaggagcagagccccaccgccgagaaggacgaggacgaggagaacgacgccagcctggccaacagcagcaccaccaccctggaggacaagggccccggccacgccaccttcggcagagaggccaccaagttcgaggaggaggagaagcccgacaaggcctgggaggccagaccccccagagagagcagcgacgtgccccccatgaagagaaacaactggatcttcatcgacgaggagcaggccttcggcgtgagaggccaggccagaggcagaggcagaggcttcagagagttcaccttcagaggcagacccgccggcggcaacggcagcggcctgtgcggcggcggcgtgctgggcgccagaagcatctactgcagcagccagagaagcggcagaggcagaggcctgagagagttcgccagacccgaggactgccccagagccaagcccagaagaagagtggccagcgagacccacagcgagggcagcgagtacgaggagctgcccaagagaagaagacagagaggcagcgagaacggcaacgagggcagcctgctggagagagaggagagcaccctgaagaagggcgactgcagagacagctggagaagcaacaagggctgcagcgaggaccacagcggcctggacgccaagagcagaggccccagagccttcggcagagccctgccccccagactgagcaactgcggctacggcagaagaaccttcgtgagcaaggagagcccccactggcagagcaagagccccggcagcagctggcaggagtacggccccagcgacacctgcggcagcagaagacccaccgacagagactacgtgcccgacagctacagacaccccgacgccttcggcggcagaggcttcgaggacagcagagccgaggacaagagaagcttcttccaggacgagcacgtggccgacagcgagaacgccgagaacagacccttcagaagaagaagaccccccagacaggacaagccccccagattcagaagactgagacaggagagagagagcctgggcctgtggggccccgaggaggagccccacctgctggccggccagtggcccggcagacccaagctgtgcagcggcgacaagagcggcaccgtgggcagaagaagccccgagctgagctaccagaacagcagcgaccacgccaacgaggagtgggagaccgccagcgagagcagcgacttcagcgagagaagagagagaagagagggccccggcagcgagcccgacagccaggtggacggcggcctgagcggcgccagcctgggcgagaagaaggagctggccaagagaagcttcagcagccagagacccgtggtggacagacagagcagaaagctggagcccggcggcttcggcgagaagcccgtgagacccggcggcggcgacaccagccccagatacgagagccagcagaacggcacccccctgaaggtgaagagaagccccgacgaggccctgcccggcggcctgagcggctgcagcagcggcagcggccacagcccctacgccctggagagagccgcccacgccagcgccgacctgcccgaggccagcagcaagaaggccgagaaggaggccaagctggccgcccccagagccggcgagcagggcgaggccatgaagcagttcgacctgaactacggcagcgccatcatcgagaactgcggcagcagccccggcgaggagagcgaggtgggcagcatggtgggcgagggcttcatcgaggtgctgaccaagaagcagagaagactgctggaggaggagagaagaaagaaggagcaggccgtgcaggtgcccgtgaagggcagaggcctgagcagcagaatcccccccagattcgccaagaagcagaacaacctgtgcctggagcagggcgacgtgaccgtgcccggcagcagcctgggcaccgagatctgggagagcagcagccaggccctgcccgtgcaggcccccgccaacgacagctggagaaaggccgtgaccgccttcagcagcaccgagaccggcagcgccgagcagggcttcaagagcagccagggcgacagcggcgtggacctgagcgccgagagcagagagagcagcgccaccagcagccagagaagcagcccctacggcaccctgaagcccgaggagatgagcggccccggcctggccgagcccaaggccgacagccacaaggagcaggcccccaagcccagcgagcagaaggacagcgagcagggcagcggccagagcaaggagcacagacccggccccatcggcaacgagagaagcctgaagaacagaaagggcagcgagggcgccgagagactgcagggcgccgtggtgccccccgtgaacggcgtggagatccacgtggacagcgtgctgcccgtgccccccatcgagttcggcgtgagccccaaggacagcgacttcagcctgccccccggcagcgccagcggccccaccggcagccccgtggtgaagctgcaggacgccctggccagcaacgccggcctgacccagagcatccccatcctgagaagagaccaccacatccagagagccatcggcctgagccccatgagcttccccaccgccgacctgaccctgaagatggagagcgccagaaaggcctgggagaacagccccagcctgcccgagcagagcagccccggcggcgccggcagcggcatccagccccccagcagcgtgggcgccagcagcggcgtgaactacagcagcttcggcggcgtgagcatgccccccatgcccgtggccagcgtggcccccagcgccagcatgcccggcagccacctgccccccctgtacctggacggccacgtgttcgccagccagcccagactggtgccccagaccatcccccagcagcagagctaccagcaggccgccgccgcccagcagatccccatcagcctgcacaccagcctgcaggcccaggcccagctgggcctgagaggcggcctgcccgtgagccagagccaggagatcttcagcagcctgcagcccttcagaagccaggtgtacatgcaccccagcctgagcccccccagcaccatgatcctgagcggcggcaccgccctgaagcccccctacagcgccttccccggcatgcagcccctggagatggtgaagccccagagcggcagcccctaccagcccatgagcggcaaccaggccctggtgtacgagggccagctgagccaggccgccggcctgggcgccagccagatgctggacagccagctgccccagctgaccatgcccctgcccagatacggcagcggccagcagcccctgatcctgccccagagcatccagctgccccccggccagagcctgagcgtgggcgcccccagaagaatccccccccccggcagccagccccccgtgctgaacaccagcagagagcccagccagatggagatgaagggcttccacttcgccgacagcaagcagaacgtgcccagcggcggccccgtgcccagcccccagacctacagacccagcagcgccagccccagcggcaagcccagcggcagcgccgtgaacatgggcagcgtgcagggccactacgtgcagcaggccaagcagagagtggacgagaagcccagcctgggcgccgtgaagctgcaggaggcccccagcgccgccagccagatgaagagaaccggcgccatcaagcccagagccgtgaaggtggaggagagcaaggcctag

SEQ ID NO: 23514 - DNA, 807 bp, Artificial Sequence
  Description of Artificial Sequence: Synthetic coding sequence
atgccccccatgcccgtggccagcgtggcccccagcgccagcatgcccggcagccacctgccccccctgtacctggacggccacgtgttcgccagccagcccagactggtgccccagaccatcccccagcagcagagctaccagcaggccgccgccgcccagcagatccccatcagcctgcacaccagcctgcaggcccaggcccagctgggcctgagaggcggcctgcccgtgagccagagccaggagatcttcagcagcctgcagcccttcagaagccaggtgtacatgcaccccagcctgagcccccccagcaccatgatcctgagcggcggcaccgccctgaagcccccctacagcgccttccccggcatgcagcccctggagatggtgaagccccagagcggcagcccctaccagcccatgagcggcaaccaggccctggtgtacgagggccagctgagccaggccgccggcctgggcgccagccagatgctggacagccagctgccccagctgaccatgcccctgcccagatacggcagcggccagcagcccctgatcctgccccagagcatccagctgccccccggccagagcctgagcgtgggcgcccccagaagaatccccccccccggcagccagccccccgtgctgaacaccagcagagagcccagccagatggagatgaagggcttccacttcgccgacagcaagcagaacgtgcccagcggcggccccgtgcccagcccccagacctacagacagaacaacgagtggatgagaaaccccgcctgggagccctag

SEQ ID NO: 23515 - DNA, 4608 bp, Artificial Sequence
  Description of Artificial Sequence: Synthetic coding sequence
atgagcgacagactgggccagatcaccaagggcaaggacggcaagagcaagtacagcaccctgagcctgttcgacaagtacaagggcaagagcgtggacgccatcagaagcagcgtgatccccagacacggcctgcagagcctgggcaaggtggccgccgccagaagaatgcccccccccgccaacctgcccagcctgaagagcgagaacaagggcaacgaccccaacatcgtgatcgtgcccaaggacggcaccggctgggccaacaagcaggaccagcaggaccccaagagcagcagcgccaccgccagccagccccccgagagcctgccccagcccggcctgcagaagagcgtgagcaacctgcagaagcccacccagagcatcagccaggagaacaccaacagcgtgcccggcggccccaagagctgggcccagctgaacggcaagcccgtgggccacgagggcggcctgagaggcagcagcagactgctgagcttcagccccgaggagttccccaccctgaaggccgccggcggccaggacaaggccggcaaggagaagggcgtgctggacctgagctacggccccggccccagcctgagaccccagaacgtgaccagctggagagagggcggcggcagacacatcatcagcgccaccagcctgagcaccagccccaccgagctgggcagcagaaacagcagcaccggcgacggcgcccccagcagcgcctgcaccagcgacagcaaggaccccagcctgagacccgcccagcccgtgagaaagggcgccagccagttcatgggcaacgtgtaccacccccccacctaccacgacatgctgcccgccttcatgtgcagccccaagagcagcgagaaccagggcaccgtggagagaggcagcttccccctgccccagctgagactggagcccagagtgcccttcagacagttccagatgaacgaccaggacggcaaggagaacagactgggcctgagcagacccctgagacccctgagacagctggtggagagagcccccagacccaccatcatcaacgccgagaacctgaagggcctggacgacctggacgccgacgccgacgacggctgggccggcctgcacgaggaggtggactacagcgagaagctgaagttcagcgacgacgaggaggaggaggaggtggtgaaggacggcagacccaagtggaacagctgggaccccagaagacagagacagctgagcatgagcagcgccgacagcgccgacgccaagagaaccagagaggagggcaaggactgggccgaggccgtgggcgccagcagagtggtgagaaaggcccccgacccccagcccccccccagaaagctgcacggctgggcccccggccccgactaccagaagagcagcatgggcagcatgttcagacagcagagcatcgaggacaaggaggacaagcccccccccagacagaagttcatccagagcgagatgagcgaggccgtggagagagccagaaagagaagagaggaggaggagagaagagccagagaggagagactggccgcctgcgccgccaagctgaagcagctggaccagaagtgcaagcaggccagaaaggccggcgaggccagaaagcaggccgagaaggaggtgccctggagccccagcgccgagaaggccagcccccaggagaacggccccgccgtgcacaagggcagccccgagttccccgcccaggagacccccaccaccttccccgaggaggcccccaccgtgagccccgccgtggcccagagcaacagcagcgaggaggaggccagagaggccggcagccccgcccaggagttcaagtaccagaagagcctgccccccagattccagagacagcagcagcagcagcagcaggagcagctgtacaagatgcagcactggcagcccgtgtaccccccccccagccacccccagagaaccttctacccccaccacccccagatgctgggcttcgaccccagatggatgatgatgcccagctacatggaccccagaatcacccccaccagaacccccgtggacttctaccccagcgccctgcaccccagcggcctgatgaagcccatgatgccccaggagagcctgaacggcaccggctgcagaagcgaggaccagaactgcgtgccccccctgcaggagagaaaggtgacccccatcgacagcccccccgtgtggagccccgagggctacatggccctgcagagcaagggctaccccctgccccaccccaagagcagcgacaccctggccatggacatgagagtgagaagccccgacgaggccctgcccggcggcctgagcggctgcagcagcggcagcggccacagcccctacgccctggagagagccgcccacgccagcgccgacctgcccgaggccagcagcaagaaggccgagaaggaggccaagctggccgcccccagagccggcgagcagggcgaggccatgaagcagttcgacctgaactacggcagcgccatcatcgagaactgcggcagcagccccggcgaggagagcgaggtgggcagcatggtgggcgagggcttcatcgaggtgctgaccaagaagcagagaagactgctggaggaggagagaagaaagaaggagcaggccgtgcaggtgcccgtgaagggcagaggcctgagcagcagaatcccccccagattcgccaagaagcagaacaacctgtgcctggagcagggcgacgtgaccgtgcccggcagcagcctgggcaccgagatctgggagagcagcagccaggccctgcccgtgcaggcccccgccaacgacagctggagaaaggccgtgaccgccttcagcagcaccgagaccggcagcgccgagcagggcttcaagagcagccagggcgacagcggcgtggacctgagcgccgagagcagagagagcagcgccaccagcagccagagaagcagcccctacggcaccctgaagcccgaggagatgagcggccccggcctggccgagcccaaggccgacagccacaaggagcaggcccccaagcccagcgagcagaaggacagcgagcagggcagcggccagagcaaggagcacagacccggccccatcggcaacgagagaagcctgaagaacagaaagggcagcgagggcgccgagagactgcagggcgccgtggtgccccccgtgaacggcgtggagatccacgtggacagcgtgctgcccgtgccccccatcgagttcggcgtgagccccaaggacagcgacttcagcctgccccccggcagcgccagcggccccaccggcagccccgtggtgaagctgcaggacgccctggccagcaacgccggcctgacccagagcatccccatcctgagaagagaccaccacatccagagagccatcggcctgagccccatgagcttccccaccgccgacctgaccctgaagatggagagcgccagaaaggcctgggagaacagccccagcctgcccgagcagagcagccccggcggcgccggcagcggcatccagccccccagcagcgtgggcgccagcagcggcgtgaactacagcagcttcggcggcgtgagcatgccccccatgcccgtggccagcgtggcccccagcgccagcatgcccggcagccacctgccccccctgtacctggacggccacgtgttcgccagccagcccagactggtgccccagaccatcccccagcagcagagctaccagcaggccgccgccgcccagcagatccccatcagcctgcacaccagcctgcaggcccaggcccagctgggcctgagaggcggcctgcccgtgagccagagccaggagatcttcagcagcctgcagcccttcagaagccaggtgtacatgcaccccagcctgagcccccccagcaccatgatcctgagcggcggcaccgccctgaagcccccctacagcgccttccccggcatgcagcccctggagatggtgaagccccagagcggcagcccctaccagcccatgagcggcaaccaggccctggtgtacgagggccagctgagccaggccgccggcctgggcgccagccagatgctggacagccagctgccccagctgaccatgcccctgcccagatacggcagcggccagcagcccctgatcctgccccagagcatccagctgccccccggccagagcctgagcgtgggcgcccccagaagaatccccccccccggcagccagccccccgtgctgaacaccagcagagagcccagccagatggagatgaagggcttccacttcgccgacagcaagcagaacgtgcccagcggcggccccgtgcccagcccccagacctacagacccagcagcgccagccccagcggcaagcccagcggcagcgccgtgaacatgggcagcgtgcagggccactacgtgcagcaggccaagcagagagtggacgagaagcccagcctgggcgccgtgaagctgcaggaggcccccagcgccgccagccagatgaagagaaccggcgccatcaagcccagagccgtgaaggtggaggagagcaaggcctag

SEQ ID NO: 23516 - DNA, 2391 bp, Artificial Sequence
  Description of Artificial Sequence: Synthetic coding sequence
atgaagcccatgatgccccaggagagcctgaacggcaccggctgcagaagcgaggaccagaactgcgtgccccccctgcaggagagaaaggtgacccccatcgacagcccccccgtgtggagccccgagggctacatggccctgcagagcaagggctaccccctgccccaccccaagagcagcgacaccctggccatggacatgagagtgagaaacgagagcagcttcagcgccagcctgggcagagccggcggcgtgagcgcccagagagacctgttcgaggagagaggcgaggagtacctgagcgccttcgacaagaaggcccaggccgacttcgacagctgcatcagcagccagagaatcggccaggagctgctgttccccccccaggagaacgtgcaggacgccggcgcccccggcggccacacccagaacctgagatgcagccccctggagcccgacttcgtgcccgacgagaagaagcccgagtgcggcagctgggacgtgagccaccagcccgagaccgccgacaccgcccacggcgtggagagagagacccccagagagggcaccgccttcaacatcagcagctgggacaagaacggcagccccaacaagcagcccagcagcgagcccgagtggacccccgagcccagaagcagcagcagccagcaccccgagcagaccggcagaaccagaagaagcggccccatcaagaagcccgtgctgaaggccctgaaggtggaggacaaggagaaggagctggagaagatcaagcaggagctgggcgaggagagcaccagactggccaaggagaaggagcagagccccaccgccgagaaggacgaggacgaggagaacgacgccagcctggccaacagcagcaccaccaccctggaggacaagggccccggccacgccaccttcggcagagaggccaccaagttcgaggaggaggagaagcccgacaaggcctgggaggccagaccccccagagagagcagcgacgtgccccccatgaagagaaacaactggatcttcatcgacgaggagcaggccttcggcgtgagaggccaggccagaggcagaggcagaggcttcagagagttcaccttcagaggcagacccgccggcggcaacggcagcggcctgtgcggcggcggcgtgctgggcgccagaagcatctactgcagcagccagagaagcggcagaggcagaggcctgagagagttcgccagacccgaggactgccccagagccaagcccagaagaagagtggccagcgagacccacagcgagggcagcgagtacgaggagctgcccaagagaagaagacagagaggcagcgagaacggcaacgagggcagcctgctggagagagaggagagcaccctgaagaagggcgactgcagagacagctggagaagcaacaagggctgcagcgaggaccacagcggcctggacgccaagagcagaggccccagagccttcggcagagccctgccccccagactgagcaactgcggctacggcagaagaaccttcgtgagcaaggagagcccccactggcagagcaagagccccggcagcagctggcaggagtacggccccagcgacacctgcggcagcagaagacccaccgacagagactacgtgcccgacagctacagacaccccgacgccttcggcggcagaggcttcgaggacagcagagccgaggacaagagaagcttcttccaggacgagcacgtggccgacagcgagaacgccgagaacagacccttcagaagaagaagaccccccagacaggacaagccccccagattcagaagactgagacaggagagagagagcctgggcctgtggggccccgaggaggagccccacctgctggccggccagtggcccggcagacccaagctgtgcagcggcgacaagagcggcaccgtgggcagaagaagccccgagctgagctaccagaacagcagcgaccacgccaacgaggagtgggagaccgccagcgagagcagcgacttcagcgagagaagagagagaagagagggccccggcagcgagcccgacagccaggtggacggcggcctgagcggcgccagcctgggcgagaagaaggagctggccaagagaagcttcagcagccagagacccgtggtggacagacagagcagaaagctggagcccggcggcttcggcgagaagcccgtgagacccggcggcggcgacaccagccccagatacgagagccagcagaacggcacccccctgaaggtgaagagaagccccgacgaggccctgcccggcggcctgagcggctgcagcagcggcagcggccacagcccctgccccggcgccggcagcccctgccagtgctag

SEQ ID NO: 23517 - DNA, 537 bp, Artificial Sequence
  Description of Artificial Sequence: Synthetic coding sequence
tgcgagggcagacaggccaaggtgaagagcagcatgggcagcatgttcagacagcagagcatcgaggacaaggaggacaagcccccccccagacagaagttcatccagagcgagatgagcgaggccgtggagagagccagaaagagaagagaggaggaggagagaagagccagagaggagagactggccgcctgcgccgccaagctgaagcagctggaccagaagtgcaagcaggccagaaaggccggcgaggccagaaagcaggccgagaaggaggtgccctggagccccagcgccgagaaggccagcccccaggagaacggccccgccgtgcacaagggcagccccgagttccccgcccaggagacccccaccaccttccccgaggaggcccccaccgtgagccccgccgtggcccagagcaacagcagcgaggaggaggccagagaggccggcagccccgcccaggagttcaagtaccagaagagcctgccccccagattccagagacagcagcagcagcagcagcaggagtag

SEQ ID NO: 23518 - DNA, 1767 bp, Artificial Sequence
  Description of Artificial Sequence: Synthetic coding sequence
tgaggcagaggcttcgaggacagcagagccgaggacaagagaagcttcttccaggacgagcacgtggccgacagcgagaacgccgagaacagacccttcagaagaagaagaccccccagacaggacaagccccccagattcagaagactgagacaggagagagagagcctgggcctgtggggccccgaggaggagccccacctgctggccggccagtggcccggcagacccaagctgtgcagcggcgacaagagcggcaccgtgggcagaagaagccccgagctgagctaccagaacagcagcgaccacgccaacgaggagtgggagaccgccagcgagagcagcgacttcagcgagagaagagagagaagagagggccccggcagcgagcccgacagccaggtggacggcggcctgagcggcgccagcctgggcgagaagaaggagctggccaagagaagcttcagcagccagagacccgtggtggacagacagagcagaaagctggagcccggcggcttcggcgagaagcccgtgagacccggcggcggcgacaccagccccagatacgagagccagcagaacggcacccccctgaaggtgaagagaagccccgacgaggccctgcccggcggcctgagcggctgcagcagcggcagcggccacagcccctacgccctggagagagccgcccacgccagcgccgacctgcccgaggccagcagcaagaaggccgagaaggaggccaagctggccgcccccagagccggcgagcagggcgaggccatgaagcagttcgacctgaactacggcagcgccatcatcgagaactgcggcagcagccccggcgaggagagcgaggtgggcagcatggtgggcgagggcttcatcgaggtgctgaccaagaagcagagaagactgctggaggaggagagaagaaagaaggagcaggccgtgcaggtgcccgtgaagggcagaggcctgagcagcagaatcccccccagattcgccaagaagcagaacaacctgtgcctggagcagggcgacgtgaccgtgcccggcagcagcctgggcaccgagatctgggagagcagcagccaggccctgcccgtgcaggcccccgccaacgacagctggagaaaggccgtgaccgccttcagcagcaccgagaccggcagcgccgagggcttcaagagcagccagggcgacagcggcgtggacctgagcgccgagagcagagagagcagcgccaccagcagccagagaagcagcccctacggcaccctgaagcccgaggagatgagcggccccggcctggccgagcccaaggccgacagccacaaggagcaggcccccaagcccagcgagcagaaggacagcgagcagggcagcggccagagcaaggagcacagacccggccccatcggcaacgagagaagcctgaagaacagaaagggcagcgagggcgccgagagactgcagggcgccgtggtgccccccgtgaacggcgtggagatccacgtggacagcgtgctgcccgtgccccccatcgagttcggcgtgagccccaaggacagcgacttcagcctgccccccggcagcgccagcggccccaccggcagccccgtggtgaagctgcaggacgccctggccagcaacgccggcctgacccagagcatccccatcctgagaagagaccaccacatccagagagccatcggcctgagccccatgagcttccccaccgccgacctgaccctgaagtag

SEQ ID NO: 23519 - DNA, 528 bp, Artificial Sequence
  Description of Artificial Sequence: Synthetic coding sequence
gagagaaaggtgacccccatcgacagcccccccgtgtggagccccgagggctacatggccctgcagagcaagggctaccccctgccccaccccaagagcagcgacaccctggccatggacatgagagtgagaaacgagagcagcttcagcgccagcctgggcagagccggcggcgtgagcgcccagagagacctgttcgaggagagaggcgaggagtacctgagcgccttcgacaagaaggcccaggccgacttcgacagctgcatcagcagccagagaatcggccaggagctgctgttccccccccaggagaacgtgcaggacgccggcgcccccggcggccacacccagaacctgagatgcagccccctggagcccgacttcgtgcccgacgagaagaagcccgagtgcggcagctgggacgtgagccaccagcccgagaccgccgacaccgcccacggcgtggagagagagacccccagagagggcaccgccttcaacatcagcagctgggacaagaacggctag

SEQ ID NO: 23520 - DNA, 4608 bp, Artificial Sequence; identical to SEQ ID NO: 23515
  Description of Artificial Sequence: Synthetic coding sequence

SEQ ID NO: 23521 - DNA, 981 bp, Artificial Sequence
  Description of Artificial Sequence: Synthetic coding sequence
atgagcgacagactgggccagatcaccaagggcaaggacggcaagagcaagtacagcaccctgagcctgttcgacaagtacaagggcaagagcgtggacgccatcagaagcagcgtgatccccagacacggcctgcagagcctgggcaaggtggccgccgccagaagaatgcccccccccgccaacctgcccagcctgaagagcgagaacaagggcaacgaccccaacatcgtgatcgtgcccaaggacggcaccggctgggccaacaagcaggaccagcaggaccccaagagcagcagcgccaccgccagccagccccccgagagcctgccccagcccggcctgcagaagagcgtgagcaacctgcagaagcccacccagagcatcagccaggagaacaccaacagcgtgcccggcggccccaagagctgggcccagctgaacggcaagcccgtgggccacgagggcggcctgagaggcagcagcagactgctgagcttcagccccgaggagttccccaccctgaaggccgccggcggccaggacaaggccggcaaggagaagggcgtgctggacctgagctacggccccggccccagcctgagaccccagaacgtgaccagctggagagagggcggcggcagacacatcatcagcgccaccagcctgagcaccagccccaccgagctgggcagcagaaacagcagcaccggcgacggcgcccccagcagcgcctgcaccagcgacagcaaggaccccagcctgagacccgcccagcccgtgagaaagggcgccagccagttcatgggcaacgtgtaccacccccccacctaccacgacatgctgcccgccttcatgtgcagccccaagagcagcgagaaccagggcaccgtggagagaggcagcttccccctgccccagctgagactggagcccagagtgcccttcagacagttccagatgaacgaccaggacggctag

SEQ ID NO: 23522 - DNA, 8454 bp, Artificial Sequence
  Description of Artificial Sequence: Synthetic coding sequence
atgagcgagaagagcggccagagcaccaaggccaaggacggcaagaagtacgccaccctgagcctgttcaacacctacaagggcaagagcctggagacccagaagaccaccgccagacacggcctgcagagcctgggcaaggtgggcatcagcagaagaatgcccccccccgccaacctgcccagcctgaaggccgagaacaagggcaacgaccccaacgtgaacatcgtgcccaaggacggcaccggctgggccagcaagcaggagcagcacgaggaggagaagacccccgaggtgccccccgcccagcccaagcccggcgtggccgccccccccgaggtggcccccgcccccaagagctgggccagcaacaagcagggcggccagggcgacggcatccaggtgaacagccagttccagcaggagttccccagcctgcaggccgccggcgaccaggagaagaaggagaaggagaccaacgacgacaactacggccccggccccagcctgagaccccccaacgtggcctgctggagagacggcggcaaggccgccggcagccccagcagcagcgaccaggacgagaagctgcccggccaggacgagagcaccgccggcaccagcgagcagaacgacatcctgaaggtggtggagaagagaatcgcctgcggccccccccaggccaagctgaacggccagcaggccgccctggccagccagtacagagccatgatgcccccctacatgttccagcagtaccccagaatgacctacccccccctgcacggccccatgagattcccccccagcctgagcgagaccaacaagggcctgagaggcagaggccccccccccagctgggccagcgagcccgagagacccagcatcctgagcgccagcgagctgaaggagctggacaagttcgacaacctggacgccgaggccgacgagggctgggccggcgcccagatggaggtggactacaccgagcagctgaacttcagcgacgacgacgagcagggcagcaacagccccaaggagaacaacagcgaggaccagggcagcaaggccagcgagaacaacgagaacaagaaggagaccgacgaggtgagcaacaccaagagcagcagccagatccccgcccagcccagcgtggccaaggtgccctacggcaagggccccagcttcaaccaggagagaggcaccagcagccacctgccccccccccccaagctgctggcccagcagcaccccccccccgacagacaggccgtgcccggcagacccggccccttccccagcaagcagcaggtggccgacgaggacgagatctggaagcagagaagaagacagcagagcgagatcagcgccgccgtggagagagccagaaagagaagagaggaggaggagagaagaatggaggagcagagaaaggccgcctgcgccgagaagctgaagagactggacgagaagctgggcatcctggagaagcagcccagccccgaggagatcagagagagagagagagagaaggagagagagagagagaaggagctggagaaggagcaggagcaggagagagagaaggagagagagaaggacagagagagacagcaggagaaggagaaggagctggagaaggagcaggagaagcagagagagatggagaaggagagaaagcaggagaaggagaaggagctggagagacagaaggagaaggagaaggagctgcagaagatgaaggagcaggagaaggagtgcgagctggagaaggagagagagaagctggaggagaagatcgagcccagagagcccaacctggagcccatggtggagaagcaggagagcgagaacagctgcaacaaggaggaggagcccgtgttcaccagacaggacagcaacagaagcgagaaggaggccacccccgtggtgcacgagaccgagcccgagagcggcagccagcccagacccgccgtgctgagcggctacttcaagcagttccagaagagcctgccccccagattccagagacagcaggagcagatgaagcagcagcagtggcagcagcagcagcagcagggcgtgctgccccagaccgtgcccagccagcccagcagcagcaccgtgcccccccccccccacagacccctgtaccagcccatgcagccccacccccagcacctggccagcatgggcttcgaccccagatggctgatgatgcagagctacatggaccccagaatgatgagcggcagacccgccatggacatcccccccatccaccccggcatgatcccccccaagcccctgatgagaagagaccagatggagggcagccccaacagcagcgagagcttcgagcacatcgccagaagcgccagagaccacgccatcagcctgagcgagcccagaatgctgtggggcagcgacccctacccccacgccgagccccagcaggccaccacccccaaggccaccgaggagcccgaggacgtgagaagcgaggccgccctggaccaggagcagatcaccgccgcctacagcgtggagcacaaccagctggaggcccaccccaaggccgacttcatcagagagagcagcgaggcccaggtgcagaagttcctgagcagaagcgtggaggacgtgagaccccaccacaccgacgccaacaaccagagcgcctgcttcgaggcccccgaccagaagaccctgagcgccccccaggaggagagaatcagcgccgtggagagccagcccagcagaaagagaagcgtgagccacggcagcaaccacacccagaagcccgacgagcagagaagcgagcccagcgccggcatccccaaggtgaccagcagatgcatcgacagcaaggagcccatcgagagacccgaggagaagcccaagaaggagggcttcatcagaagcagcgagggccccaagcccgagaaggtgtacaagagcaagagcgagaccagatggggccccagacccagcagcaacagaagagaggaggtgaacgacagacccgtgagaagaagcggccccatcaagaagcccgtgctgagagacatgaaggaggagagagagcagagaaaggagaaggagggcgagaaggccgagaaggtgaccgagaaggtggtggtgaagcccgagaagaccgagaagaaggacctgccccccccccccccccccccccagccccccgcccccatccagccccagagcgtgcccccccccatccagcccgaggccgagaagttccccagcaccgagaccgccaccctggcccagaagcccagccaggacaccgagaagcccctggagcccgtgagcaccgtgcaggtggagcccgccgtgaagaccgtgaaccagcagaccatggccgcccccgtggtgaaggaggagaagcagcccgagaaggtgatcagcaaggacctggtgatcgagagacccagacccgacagcagacccgccgtgaagaaggagagcaccctgccccccagaacctactggaaggaggccagagagagagactggttccccgaccagggctacagaggcagaggcagaggcgagtactacagcagaggcagaagctacagaggcagctacggcggcagaggcagaggcggcagaggccacaccagagactacccccagtacagagacaacaagcccagagccgagcacatccccagcggccccctgagacagagagaggagagcgagaccagaagcgagagcagcgacttcgaggtggtgcccaagagaagaagacagagaggcagcgagaccgacaccgacagcgagatccacgagagcgccagcgacaaggacagcctgagcaagggcaagctgcccaagagagaggagagacccgagaacaagaagcccgtgaagccccacagcagcttcaagcccgacaaccacgtgagaatcgacaacagactgctggagaagccctacgtgagagacgacgacaaggccaagcccggcttcctgcccaagggcgagcccaccagaagaggcagaggcggcaccttcagaagaggcggcagagaccccggcggcagacccagcagacccagcaccctgagaagacccgcctacagagacaaccagtggaaccccagacagagcgaggtgcccaagcccgaggacggcgagccccccagaagacacgagcagttcatccccatcgccgccgacaagagaccccccaagttcgagagaaagttcgaccccgccagagagagacccagaagacagagacccaccagaccccccagacaggacaagccccccagattcagaagactgagagagagagaggccgccagcaagagcaacgaggtggtggccgtgcccaccaacggcaccgtgaacaacgtggcccaggagcccgtgaacaccctgggcgacatcagcggcaacaagacccccgacctgagcaaccagaacagcagcgaccaggccaacgaggagtgggagaccgccagcgagagcagcgacttcaacgagagaagagagagagacgagaagaagaacgccgacctgaacgcccagaccgtggtgaaggtgggcgagaacgtgctgccccccaagagagagatcgccaagagaagcttcagcagccagagacccgtggacagacagaacagaagaggcaacaacggcccccccaagagcggcagaaacttcagcggccccagaaacgagagaagaagcggcccccccagcaagagcggcaagagaggccccttcgacgaccagcccgccggcaccaccggcgtggacctgatcaacggcagcagcgcccaccaccaggagggcgtgcccaacggcaccggccagaagaacagcaaggacagcaccggcaagaagagagaggaccccaagcccggccccaagaagcccaaggagaaggtggacgccctgagccagttcgacctgaacaactacgccagcgtggtgatcatcgacgaccaccccgaggtgaccgtgatcgaggacccccagagcaacctgaacgacgacggcttcaccgaggtggtgagcaagaagcagcagaagagactgcaggacgaggagagaagaaagaaggaggagcaggtgatccaggtgtggaacaagaagaacgccaacgagaagggcagaagccagaccagcaagctgccccccagattcgccaagaagcaggccaccggcatccagcaggcccagagcagcgccagcgtgccccccctggccagcgcccccctgccccccagcaccagcgccagcgtgcccgccagcaccagcgcccccctgcccgccaccctgacccccgtgcccgccagcaccagcgcccccgtgcccgccagcaccctggcccccgtgctggccagcaccagcgcccccgtgcccgccagccccctggcccccgtgagcgccagcgccagcgtgagcgccagcgtgcccgccagcaccagcgccgccgccatcaccagcagcagcgcccccgccagcgcccccgcccccacccccatcctggccagcgtgagcacccccgccagcgtgaccatcctggccagcgccagcatccccatcctggccagcgccctggccagcaccagcgcccccacccccgcccccgccgccagcagccccgccgcccccgtgatcaccgcccccaccatccccgccagcgcccccaccgccagcgtgcccctggcccccgccagcgccagcgcccccgcccccgcccccacccccgtgagcgcccccaaccccgccccccccgcccccgcccagacccaggcccagacccacaagcccgtgcagaaccccctgcagaccaccagccagagcagcaagcagcccccccccagcatcagactgcccagcgcccagacccccaacggcaccgactacgtggccagcggcaagagcatccagaccccccagagccacggcaccctgaccgccgagctgtgggacaacaaggtggccccccccgccgtgctgaacgacatcagcaagaagctgggccccatcagccccccccagccccccagcgtgagcgcctggaacaagcccctgaccagcttcggcagcgcccccagcagcgagggcgccaagaacggccaggagagcggcctggagatcggcaccgacaccatccagttcggcgcccccgccagcaacggcaacgagaacgaggtggtgcccgtgctgagcgagaagagcgccgacaagatccccgagcccaaggagcagagacagaagcagcccagagccggccccatcaaggcccagaagctgcccgacctgagccccgtggagaacaaggagcacaagcccggccccatcggcaaggagagaagcctgaagaacagaaaggtgaaggacgcccagcaggtggagcccgagggccaggagaagcccagccccgccaccgtgagaagcaccgaccccgtgaccaccaaggagaccaaggccgtgagcgagatgagcaccgagatcggcaccatgatcagcgtgagcagcgccgagtacggcaccaacgccaaggagagcgtgaccgactacaccacccccagcagcagcctgcccaacaccgtggccaccaacaacaccaagatggaggacaccctggtgaacaacgtgcccctgcccaacaccctgcccctgcccaagagagagaccatccagcagagcagcagcctgaccagcgtgccccccaccaccttcagcctgaccttcaagatggagagcgccagaaaggcctgggagaacagccccaacgtgagagagaagggcagccccgtgaccagcaccgccccccccatcgccaccggcgtgagcagcagcgccagcggccccagcaccgccaactacaacagcttcagcagcgccagcatgccccagatccccgtggccagcgtgacccccaccgccagcctgagcggcgccggcacctacaccaccagcagcctgagcaccaagagcaccaccaccagcgacccccccaacatctgcaaggtgaagccccagcagctgcagaccagcagcctgcccagcgccagccacttcagccagctgagctgcatgcccagcctgatcgcccagcagcagcagaacccccaggtgtacgtgagccagagcgccgccgcccagatccccgccttctacatggacaccagccacctgttcaacacccagcacgccagactggccccccccagcctggcccagcagcagggcttccagcccggcctgagccagcccaccagcgtgcagcagatccccatccccatctacgcccccctgcagggccagcaccaggcccagctgagcctgggcgccggccccgccgtgagccaggcccaggagctgttcagcagcagcctgcagccctacagaagccagcccgccttcatgcagagcagcctgagccagcccagcgtggtgctgagcggcaccgccatccacaacttccccaccgtgcagcaccaggagctggccaaggcccagagcggcctggccttccagcagaccagcaacacccagcccatccccatcctgtacgagcaccagctgggccaggccagcggcctgggcggcagccagctgatcgacacccacctgctgcaggccagagccaacctgacccaggccagcaacctgtacagcggccaggtgcagcagcccggccagaccaacttctacaacaccgcccagagccccagcgccctgcagcaggtgaccgtgcccctgcccgccagccagctgagcctgcccaacttcggcagcaccggccagcccctgatcgccctgccccagaccctgcagccccccctgcagcacaccaccccccaggcccaggcccagagcctgagcagacccgcccaggtgagccagcccttcagaggcctgatccccgccggcacccagcacagcatgatcgccaccaccggcaagatgagcgagatggagctgaaggccttcggcagcggcatcgacatcaagcccggcaccccccccatcgccggcagaagcaccacccccaccagcagccccttcagagccaccagcaccagccccaacagccagagcagcaagatgaacagcatcgtgtaccagaagcagttccagagcgcccccgccaccgtgagaatgacccagcccttccccacccagttcgccccccaggccaagcagagagccgaggtgctgcagagcacccagagattcttcagcgagcagcagcagagcaagcagatcggcggcggcaaggcccagaaggtggacagcgacagcagcaagccccccgagaccctgaccgacccccccggcgtgtgccaggagaaggtggaggagaagcccccccccgcccccagcatcgccaccaagcccgtgagaaccggccccatcaagccccaggccatcaagaccgaggagaccaagagctag

SEQ ID NO: 23523 - DNA, 8697 bp, Artificial Sequence
  Description of Artificial Sequence: Synthetic coding sequence
atgagcgagaagagcggccagagcaccaaggccaaggacggcaagaagtacgccaccctgagcctgttcaacacctacaagggcaagagcctggagacccagaagaccaccgtggccgccagacacggcctgcagagcctgggcaaggtgggcatcagcagaagaatgcccccccccgccaacctgcccagcctgaaggccgagaacaagggcaacgaccccaacgtgaacatcgtgcccaaggacggcaccggctgggccagcaagcaggagcagcacgaggaggagaagacccccgaggtgccccccgcccagcccaagcccggcgtggccgccccccccgaggtggcccccgcccccaagagctgggccagcaacaagcagggcggccagggcgacggcatccaggtgaacagccagttccagcaggagttccccagcctgcaggccgccggcgaccaggagaagaaggagaaggagaccaacgacgacaactacggccccggccccagcctgagaccccccaacgtggcctgctggagagacggcggcaaggccgccggcagccccagcagcagcgaccaggacgagaagctgcccggccaggacgagagcaccgccggcaccagcgagcagaacgacatcctgaaggtggtggagaagagaatcgcctgcggccccccccaggccaagctgaacggccagcaggccgccctggccagccagtacagagccatgatgcccccctacatgttccagcagtaccccagaatgacctacccccccctgcacggccccatgagattcccccccagcctgagcgagaccaacaagggcctgagaggcagaggccccccccccagctgggccagcgagcccgagagacccagcatcctgagcgccagcgagctgaaggagctggacaagttcgacaacctggacgccgaggccgacgagggctgggccggcgcccagatggaggtggactacaccgagcagctgaacttcagcgacgacgacgagcagggcagcaacagccccaaggagaacaacagcgaggaccagggcagcaaggccagcgagaacaacgagaacaagaaggagaccgacgaggtgagcaacaccaagagcagcagccagatccccgcccagcccagcgtggccaaggtgccctacggcaagggccccagcttcaaccaggagagaggcaccagcagccacctgccccccccccccaagctgctggcccagcagcaccccccccccgacagacaggccgtgcccggcagacccggccccttccccagcaagcagcaggtggccgacgaggacgagatctggaagcagagaagaagacagcagagcgagatcagcgccgccgtggagagagccagaaagagaagagaggaggaggagagaagaatggaggagcagagaaaggccgcctgcgccgagaagctgaagagactggacgagaagctgggcatcctggagaagcagcccagccccgaggagatcagagagagagagagagagaaggagagagagagagagaaggagctggagaaggagcaggagcaggagagagagaaggagagagagaaggacagagagagacagcaggagaaggagaaggagctggagaaggagcaggagaagcagagagagatggagaaggagagaaagcaggagaaggagaaggagctggagagacagaaggagaaggagaaggagctgcagaagatgaaggagcaggagaaggagtgcgagctggagaaggagagagagaagctggaggagaagatcgagcccagagagcccaacctggagcccatggtggagaagcaggagagcgagaacagctgcaacaaggaggaggagcccgtgttcaccagacaggacagcaacagaagcgagaaggaggccacccccgtggtgcacgagaccgagcccgagagcggcagccagcccagacccgccgtgctgagcggctacttcaagcagttccagaagagcctgccccccagattccagagacagcaggagcagatgaagcagcagcagtggcagcagcagcagcagcagggcgtgctgccccagaccgtgcccagccagcccagcagcagcaccgtgcccccccccccccacagacccctgtaccagcccatgcagccccacccccagcacctggccagcatgggcttcgaccccagatggctgatgatgcagagctacatggaccccagaatgatgagcggcagacccgccatggacatcccccccatccaccccggcatgatcccccccaagcccctgatgagaagagaccagatggagggcagccccaacagcagcgagagcttcgagcacatcgccagaagcgccagagaccacgccatcagcctgagcgagcccagaatgctgtggggcagcgacccctacccccacgccgagccccagcaggccaccacccccaaggccaccgaggagcccgaggacgtgagaagcgaggccgccctggaccaggagcagatcaccgccgcctacagcgtggagcacaaccagctggaggcccaccccaaggccgacttcatcagagagagcagcgaggcccaggtgcagaagttcctgagcagaagcgtggaggacgtgagaccccaccacaccgacgccaacaaccagagcgcctgcttcgaggcccccgaccagaagaccctgagcgccccccaggaggagagaatcagcgccgtggagagccagcccagcagaaagagaagcgtgagccacggcagcaaccacacccagaagcccgacgagcagagaagcgagcccagcgccggcatccccaaggtgaccagcagatgcatcgacagcaaggagcccatcgagagacccgaggagaagcccaagaaggagggcttcatcagaagcagcgagggccccaagcccgagaaggtgtacaagagcaagagcgagaccagatggggccccagacccagcagcaacagaagagaggaggtgaacgacagacccgtgagaagaagcggccccatcaagaagcccgtgctgagagacatgaaggaggagagagagcagagaaaggagaaggagggcgagaaggccgagaaggtgaccgagaaggtggtggtgaagcccgagaagaccgagaagaaggacctgccccccccccccccccccccccagccccccgcccccatccagccccagagcgtgcccccccccatccagcccgaggccgagaagttccccagcaccgagaccgccaccctggcccagaagcccagccaggacaccgagaagcccctggagcccgtgagcaccgtgcaggtggagcccgccgtgaagaccgtgaaccagcagaccatggccgcccccgtggtgaaggaggagaagcagcccgagaaggtgatcagcaaggacctggtgatcgagagacccagacccgacagcagacccgccgtgaagaaggagagcaccctgccccccagaacctactggaaggaggccagagagagagactggttccccgaccagggctacagaggcagaggcagaggcgagtactacagcagaggcagaagctacagaggcagctacggcggcagaggcagaggcggcagaggccacaccagagactacccccagtacagagacaacaagcccagagccgagcacatccccagcggccccctgagacagagagaggagagcgagaccagaagcgagagcagcgacttcgaggtggtgcccaagagaagaagacagagaggcagcgagaccgacaccgacagcgagatccacgagagcgccagcgacaaggacagcctgagcaagggcaagctgcccaagagagaggagagacccgagaacaagaagcccgtgaagccccacagcagcttcaagcccgacaaccacgtgagaatcgacaacagactgctggagaagccctacgtgagagacgacgacaaggccaagcccggcttcctgcccaagggcgagcccaccagaagaggcagaggcggcaccttcagaagaggcggcagagaccccggcggcagacccagcagacccagcaccctgagaagacccgcctacagagacaaccagtggaaccccagacagagcgaggtgcccaagcccgaggacggcgagccccccagaagacacgagcagttcatccccatcgccgccgacaagagaccccccaagttcgagagaaagttcgaccccgccagagagagacccagaagacagagacccaccagaccccccagacaggacaagccccccagattcagaagactgagagagagagaggccgccagcaagagcaacgaggtggtggccgtgcccaccaacggcaccgtgaacaacgtggcccaggagcccgtgaacaccctgggcgacatcagcggcaacaagacccccgacctgagcaaccagaacagcagcgaccaggccaacgaggagtgggagaccgccagcgagagcagcgacttcaacgagagaagagagagagacgagaagaagaacgccgacctgaacgcccagaccgtggtgaaggtgggcgagaacgtgctgccccccaagagagagatcgccaagagaagcttcagcagccagagacccgtggacagacagaacagaagaggcaacaacggcccccccaagagcggcagaaacttcagcggccccagaaacgagagaagaagcggcccccccagcaagagcggcaagagaggccccttcgacgaccagcccgccggcaccaccggcgtggacctgatcaacggcagcagcgcccaccaccaggagggcgtgcccaacggcaccggccagaagaacagcaaggacagcaccggcaagaagagagaggaccccaagcccggccccaagaagcccaaggagaaggtggacgccctgagccagttcgacctgaacaactacgccagcgtggtgatcatcgacgaccaccccgaggtgaccgtgatcgaggacccccagagcaacctgaacgacgacggcttcaccgaggtggtgagcaagaagcagcagaagagactgcaggacgaggagagaagaaagaaggaggagcaggtgatccaggtgtggaacaagaagaacgccaacgagaagggcagaagccagaccagcaagctgccccccagattcgccaagaagcaggccaccggcatccagcaggcccagagcagcgccagcgtgccccccctggccagcgcccccctgccccccagcaccagcgccagcgtgcccgccagcaccagcgcccccctgcccgccaccctgacccccgtgcccgccagcaccagcgcccccgtgcccgccagcaccctggcccccgtgctggccagcaccagcgcccccgtgcccgccagccccctggcccccgtgagcgccagcgccagcgtgagcgccagcgtgcccgccagcaccagcgccgccgccatcaccagcagcagcgcccccgccagcgcccccgcccccacccccatcctggccagcgtgagcacccccgccagcgtgaccatcctggccagcgccagcatccccatcctggccagcgccctggccagcaccagcgcccccacccccgcccccgccgccagcagccccgccgcccccgtgatcaccgcccccaccatccccgccagcgcccccaccgccagcgtgcccctggcccccgccagcgccagcgcccccgcccccgcccccacccccgtgagcgcccccaaccccgccccccccgcccccgcccagacccaggcccagacccacaagcccgtgcagaaccccctgcagaccaccagccagagcagcaagcagcccccccccagcatcagactgcccagcgcccagacccccaacggcaccgactacgtggccagcggcaagagcatccagaccccccagagccacggcaccctgaccgccgagctgtgggacaacaaggtggccccccccgccgtgctgaacgacatcagcaagaagctgggccccatcagccccccccagccccccagcgtgagcgcctggaacaagcccctgaccagcttcggcagcgcccccagcagcgagggcgccaagaacggccaggagagcggcctggagatcggcaccgacaccatccagttcggcgcccccgccagcaacggcaacgagaacgaggtggtgcccgtgctgagcgagaagagcgccgacaagatccccgagcccaaggagcagagacagaagcagcccagagccggccccatcaaggcccagaagctgcccgacctgagccccgtggagaacaaggagcacaagcccggccccatcggcaaggagagaagcctgaagaacagaaaggtgaaggacgcccagcaggtggagcccgagggccaggagaagcccagccccgccaccgtgagaagcaccgaccccgtgaccaccaaggagaccaaggccgtgagcgagatgagcaccgagatcggcaccatgatcagcgtgagcagcgccgagtacggcaccaacgccaaggagagcgtgaccgactacaccacccccagcagcagcctgcccaacaccgtggccaccaacaacaccaagatggaggacaccctggtgaacaacgtgcccctgcccaacaccctgcccctgcccaagagagagaccatccagcagagcagcagcctgaccagcgtgccccccaccaccttcagcctgaccttcaagatggagagcgccagaaaggcctgggagaacagccccaacgtgagagagaagggcagccccgtgaccagcaccgccccccccatcgccaccggcgtgagcagcagcgccagcggccccagcaccgccaactacaacagcttcagcagcgccagcatgccccagatccccgtggccagcgtgacccccaccgccagcctgagcggcgccggcacctacaccaccagcagcctgagcaccaagagcaccaccaccagcgacccccccaacatctgcaaggtgaagccccagcagctgcagaccagcagcctgcccagcgccagccacttcagccagctgagctgcatgcccagcctgatcgcccagcagcagcagaacccccaggtgtacgtgagccagagcgccgccgcccagatccccgccttctacatggacaccagccacctgttcaacacccagcacgccagactggccccccccagcctggcccagcagcagggcttccagcccggcctgagccagcccaccagcgtgcagcagatccccatccccatctacgcccccctgcagggccagcaccaggcccagctgagcctgggcgccggccccgccgtgagccaggcccaggagctgttcagcagcagcctgcagccctacagaagccagcccgccttcatgcagagcagcctgagccagcccagcgtggtgctgagcggcaccgccatccacaacttccccaccgtgcagcaccaggagctggccaaggcccagagcggcctggccttccagcagaccagcaacacccagcccatccccatcctgtacgagcaccagctgggccaggccagcggcctgggcggcagccagctgatcgacacccacctgctgcaggccagagccaacctgacccaggccagcaacctgtacagcggccaggtgcagcagcccggccagaccaacttctacaacaccgcccagagccccagcgccctgcagcaggtgaccgtgcccctgcccgccagccagctgagcctgcccaacttcggcagcaccggccagcccctgatcgccctgccccagaccctgcagccccccctgcagcacaccaccccccaggcccaggcccagagcctgagcagacccgcccaggtgagccagcccttcagaggcctgatccccgccggcacccagcacagcatgatcgccaccaccggcaagatgagcgagatggagctgaaggccttcggcagcggcatcgacatcaagcccggcaccccccccatcgccggcagaagcaccacccccaccagcagccccttcagagccaccagcaccagccccaacagccagagcagcaagatgaacagcatcgtgtaccagaagcagttccagagcgcccccgccaccgtgagaatgacccagcccttccccacccagttcgccccccagatcctgagccagcccaacctggtgccccccctggtgagagccccccacaccaacaccttccccgcccccgtgcagagaccccccatggccctggccagccagatgcccccccccctgaccaccggcctgatgagccacgccagactgccccacgtggccagaggcccctgcggcagcctgagcggcgtgagaggcaaccaggcccaggccgccctgaaggccgagcaggacatgaaggccaagcagagagccgaggtgctgcagagcacccagagattcttcagcgagcagcagcagagcaagcagatcggcggcggcaaggcccagaaggtggacagcgacagcagcaagccccccgagaccctgaccgacccccccggcgtgtgccaggagaaggtggaggagaagcccccccccgcccccagcatcgccaccaagcccgtgagaaccggccccatcaagccccaggccatcaagaccgaggagaccaagagctag

SEQ ID NO: 23524 - DNA, 7962 bp, Artificial Sequence
  Description of Artificial Sequence: Synthetic coding sequence
gtgcccaaccagatgttccagcagtaccccagaatgacctacccccccctgcacggccccatgagattcccccccagcctgagcgagaccaacaagggcctgagaggcagaggccccccccccagctgggccagcgagcccgagagacccagcatcctgagcgccagcgagctgaaggagctggacaagttcgacaacctggacgccgaggccgacgagggctgggccggcgcccagatggaggtggactacaccgagcagctgaacttcagcgacgacgacgagcagggcagcaacagccccaaggagaacaacagcgaggaccagggcagcaaggccagcgagaacaacgagaacaagaaggagaccgacgaggtgagcaacaccaagagcagcagccagatccccgcccagcccagcgtggccaaggtgccctacggcaagggccccagcttcaaccaggagagaggcaccagcagccacctgccccccccccccaagctgctggcccagcagcaccccccccccgacagacaggccgtgcccggcagacccggccccttccccagcaagcagcaggtggccgacgaggacgagatctggaagcagagaagaagacagcagagcgagatcagcgccgccgtggagagagccagaaagagaagagaggaggaggagagaagaatggaggagcagagaaaggccgcctgcgccgagaagctgaagagactggacgagaagctgggcatcctggagaagcagcccagccccgaggagatcagagagagagagagagagaaggagagagagagagagaaggagctggagaaggagcaggagcaggagagagagaaggagagagagaaggacagagagagacagcaggagaaggagaaggagctggagaaggagcaggagaagcagagagagatggagaaggagagaaagcaggagaaggagaaggagctggagagacagaaggagaaggagaaggagctgcagaagatgaaggagcaggagaaggagtgcgagctggagaaggagagagagaagctggaggagaagatcgagcccagagagcccaacctggagcccatggtggagaagcaggagagcgagaacagctgcaacaaggccgaggaggagcccgtgttcaccagacaggacagcaacagaagcgagaaggaggccacccccgtggtgcacgagaccgagcccgagagcggcagccagcccagacccgccgtgctgagcggctacttcaagcagttccagaagagcctgccccccagattccagagacagcaggagcagatgaagcagcagcagtggcagcagcagcagcagcagggcgtgctgccccagaccgtgcccagccagcccagcagcagcaccgtgcccccccccccccacagacccctgtaccagcccatgcagccccacccccagcacctggccagcatgggcttcgaccccagatggctgatgatgcagagctacatggaccccagaatgatgagcggcagacccgccatggacatcccccccatccaccccggcatgatcccccccaagcccctgatgagaagagaccagatggagggcagccccaacagcagcgagagcttcgagcacatcgccagaagcgccagagaccacgccatcagcctgagcgagcccagaatgctgtggggcagcgacccctacccccacgccgagccccagcaggccaccacccccaaggccaccgaggagcccgaggacgtgagaagcgaggccgccctggaccaggagcagatcaccgccgcctacagcgtggagcacaaccagctggaggcccaccccaaggccgacttcatcagagagagcagcgaggcccaggtgcagaagttcctgagcagaagcgtggaggacgtgagaccccaccacaccgacgccaacaaccagagcgcctgcttcgaggcccccgaccagaagaccctgagcgccccccaggaggagagaatcagcgccgtggagagccagcccagcagaaagagaagcgtgagccacggcagcaaccacacccagaagcccgacgagcagagaagcgagcccagcgccggcatccccaaggtgaccagcagatgcatcgacagcaaggagcccatcgagagacccgaggagaagcccaagaaggagggcttcatcagaagcagcgagggccccaagcccgagaaggtgtacaagagcaagagcgagaccagatggggccccagacccagcagcaacagaagagaggaggtgaacgacagacccgtgagaagaagcggccccatcaagaagcccgtgctgagagacatgaaggaggagagagagcagagaaaggagaaggagggcgagaaggccgagaaggtgaccgagaaggtggtggtgaagcccgagaagaccgagaagaaggacctgccccccccccccccccccccccagccccccgcccccatccagccccagagcgtgcccccccccatccagcccgaggccgagaagttccccagcaccgagaccgccaccctggcccagaagcccagccaggacaccgagaagcccctggagcccgtgagcaccgtgcaggtggagcccgccgtgaagaccgtgaaccagcagaccatggccgcccccgtggtgaaggaggagaagcagcccgagaaggtgatcagcaaggacctggtgatcgagagacccagacccgacagcagacccgccgtgaagaaggagagcaccctgccccccagaacctactggaaggaggccagagagagagactggttccccgaccagggctacagaggcagaggcagaggcgagtactacagcagaggcagaagctacagaggcagctacggcggcagaggcagaggcggcagaggccacaccagagactacccccagtacagagacaacaagcccagagccgagcacatccccagcggccccctgagacagagagaggagagcgagaccagaagcgagagcagcgacttcgaggtggtgcccaagagaagaagacagagaggcagcgagaccgacaccgacagcgagatccacgagagcgccagcgacaaggacagcctgagcaagggcaagctgcccaagagagaggagagacccgagaacaagaagcccgtgaagccccacagcagcttcaagcccgacaaccacgtgagaatcgacaacagactgctggagaagccctacgtgagagacgacgacaaggccaagcccggcttcctgcccaagggcgagcccaccagaagaggcagaggcggcaccttcagaagaggcggcagagaccccggcggcagacccagcagacccagcaccctgagaagacccgcctacagagacaaccagtggaaccccagacagagcgaggtgcccaagcccgaggacggcgagccccccagaagacacgagcagttcatccccatcgccgccgacaagagaccccccaagttcgagagaaagttcgaccccgccagagagagacccagaagacagagacccaccagaccccccagacaggacaagccccccagattcagaagactgagagagagagaggccgccagcaagagcaacgaggtggtggccgtgcccaccaacggcaccgtgaacaacgtggcccaggagcccgtgaacaccctgggcgacatcagcggcaacaagacccccgacctgagcaaccagaacagcagcgaccaggccaacgaggagtgggagaccgccagcgagagcagcgacttcaacgagagaagagagagagacgagaagaagaacgccgacctgaacgcccagaccgtggtgaaggtgggcgagaacgtgctgccccccaagagagagatcgccaagagaagcttcagcagccagagacccgtggacagacagaacagaagaggcaacaacggcccccccaagagcggcagaaacttcagcggccccagaaacgagagaagaagcggcccccccagcaagagcggcaagagaggccccttcgacgaccagcccgccggcaccaccggcgtggacctgatcaacggcagcagcgcccaccaccaggagggcgtgcccaacggcaccggccagaagaacagcaaggacagcaccggcaagaagagagaggaccccaagcccggccccaagaagcccaaggagaaggtggacgccctgagccagttcgacctgaacaactacgccagcgtggtgatcatcgacgaccaccccgaggtgaccgtgatcgaggacccccagagcaacctgaacgacgacggcttcaccgaggtggtgagcaagaagcagcagaagagactgcaggacgaggagagaagaaagaaggaggagcaggtgatccaggtgtggaacaagaagaacgccaacgagaagggcagaagccagaccagcaagctgccccccagattcgccaagaagcaggccaccggcatccagcaggcccagagcagcgccagcgtgccccccctggccagcgcccccctgccccccagcaccagcgccagcgtgcccgccagcaccagcgcccccctgcccgccaccctgacccccgtgcccgccagcaccagcgcccccgtgcccgccagcaccctggcccccgtgctggccagcaccagcgcccccgtgcccgccagccccctggcccccgtgagcgccagcgccagcgtgagcgccagcgtgcccgccagcaccagcgccgccgccatcaccagcagcagcgcccccgccagcgcccccgcccccacccccatcctggccagcgtgagcacccccgccagcgtgaccatcctggccagcgccagcatccccatcctggccagcgccctggccagcaccagcgcccccacccccgcccccgccgccagcagccccgccgcccccgtgatcaccgcccccaccatccccgccagcgcccccaccgccagcgtgcccctggcccccgccagcgccagcgcccccgcccccgcccccacccccgtgagcgcccccaaccccgccccccccgcccccgcccagacccaggcccagacccacaagcccgtgcagaaccccctgcagaccaccagccagagcagcaagcagcccccccccagcatcagactgcccagcgcccagacccccaacggcaccgactacgtggccagcggcaagagcatccagaccccccagagccacggcaccctgaccgccgagctgtgggacaacaaggtggccccccccgccgtgctgaacgacatcagcaagaagctgggccccatcagccccccccagccccccagcgtgagcgcctggaacaagcccctgaccagcttcggcagcgcccccagcagcgagggcgccaagaacggccaggagagcggcctggagatcggcaccgacaccatccagttcggcgcccccgccagcaacggcaacgagaacgaggtggtgcccgtgctgagcgagaagagcgccgacaagatccccgagcccaaggagcagagacagaagcagcccagagccggccccatcaaggcccagaagctgcccgacctgagccccgtggagaacaaggagcacaagcccggccccatcggcaaggagagaagcctgaagaacagaaaggtgaaggacgcccagcaggtggagcccgagggccaggagaagcccagccccgccaccgtgagaagcaccgaccccgtgaccaccaaggagaccaaggccgtgagcgagatgagcaccgagatcggcaccatgatcagcgtgagcagcgccgagtacggcaccaacgccaaggagagcgtgaccgactacaccacccccagcagcagcctgcccaacaccgtggccaccaacaacaccaagatggaggacaccctggtgaacaacgtgcccctgcccaacaccctgcccctgcccaagagagagaccatccagcagagcagcagcctgaccagcgtgccccccaccaccttcagcctgaccttcaagatggagagcgccagaaaggcctgggagaacagccccaacgtgagagagaagggcagccccgtgaccagcaccgccccccccatcgccaccggcgtgagcagcagcgccagcggccccagcaccgccaactacaacagcttcagcagcgccagcatgccccagatccccgtggccagcgtgacccccaccgccagcctgagcggcgccggcacctacaccaccagcagcctgagcaccaagagcaccaccaccagcgacccccccaacatctgcaaggtgaagccccagcagctgcagaccagcagcctgcccagcgccagccacttcagccagctgagctgcatgcccagcctgatcgcccagcagcagcagaacccccaggtgtacgtgagccagagcgccgccgcccagatccccgccttctacatggacaccagccacctgttcaacacccagcacgccagactggccccccccagcctggcccagcagcagggcttccagcccggcctgagccagcccaccagcgtgcagcagatccccatccccatctacgcccccctgcagggccagcaccaggcccagctgagcctgggcgccggccccgccgtgagccaggcccaggagctgttcagcagcagcctgcagccctacagaagccagcccgccttcatgcagagcagcctgagccagcccagcgtggtgctgagcggcaccgccatccacaacttccccaccgtgcagcaccaggagctggccaaggcccagagcggcctggccttccagcagaccagcaacacccagcccatccccatcctgtacgagcaccagctgggccaggccagcggcctgggcggcagccagctgatcgacacccacctgctgcaggccagagccaacctgacccaggccagcaacctgtacagcggccaggtgcagcagcccggccagaccaacttctacaacaccgcccagagccccagcgccctgcagcaggtgaccgtgcccctgcccgccagccagctgagcctgcccaacttcggcagcaccggccagcccctgatcgccctgccccagaccctgcagccccccctgcagcacaccaccccccaggcccaggcccagagcctgagcagacccgcccaggtgagccagcccttcagaggcctgatccccgccggcacccagcacagcatgatcgccaccaccggcaagatgagcgagatggagctgaaggccttcggcagcggcatcgacatcaagcccggcaccccccccatcgccggcagaagcaccacccccaccagcagccccttcagagccaccagcaccagccccaacagccagagcagcaagatgaacagcatcgtgtaccagaagcagttccagagcgcccccgccaccgtgagaatgacccagcccttccccacccagttcgccccccagatcctgagccagcccaacctggtgccccccctggtgagagccccccacaccaacaccttccccgcccccgtgcagagaccccccatggccctggccagccagatgcccccccccctgaccaccggcctgatgagccacgccagactgccccacgtggccagaggcccctgcggcagcctgagcggcgtgagaggcaaccaggcccaggccgccctgaaggccgagcaggacatgaaggccaagcagagagccgaggtgctgcagagcacccagagattcttcagcgagcagcagcagagcaagcagatcggcggcggcaaggcccagaaggtggacagcgacagcagcaagccccccgagaccctgaccgacccccccggcgtgtgccaggagaaggtggaggagaagcccccccccgcccccagcatcgccaccaagcccgtgagaaccggccccatcaagccccaggccatcaagaccgaggagaccaagagctag

SEQ ID NO: 23525 - DNA, 813 bp, Artificial Sequence
  Description of Artificial Sequence: Synthetic coding sequence
atgagcaccgagatcggcaccatgatcagcgtgagcagcgccgagtacggcaccaacgccaaggagagcgtgaccgactacaccacccccagcagcagcctgcccaacaccgtggccaccaacaacaccaagatggaggacaccctggtgaacaacgtgcccctgcccaacaccctgcccctgcccaagagagagaccatccagcagagcagcagcctgaccagcgtgccccccaccaccttcagcctgaccttcaagatggagagcgccagaaaggcctgggagaacagccccaacgtgagagagaagggcagccccgtgaccagcaccgccccccccatcgccaccggcgtgagcagcagcgccagcggccccagcaccgccaactacaacagcttcagcagcgccagcatgccccagatccccgtggccagcgtgacccccaccgccagcctgagcggcgccggcacctacaccaccagcagcctgagcaccaagagcaccaccaccagcgacccccccaacatctgcaaggtgaagccccagcagctgcagaccagcagcctgcccagcgccagccacttcagccagctgagctgcatgcccagcctgatcgcccagcagcagcagaacccccaggtgtacgtgagccagagcgccgccgcccagatccccgccttctacatggacaccagccacctgttcaacacccagcacgccagactggccccccccagcctggcccagcagcagggcttccagcccggcctgagccagcccaccagcgtgcagctgctgaccagcaccatctag

SEQ ID NO: 23526 - DNA, 8259 bp, Artificial Sequence
  Description of Artificial Sequence: Synthetic coding sequence
atgagcgagaagagcggccagagcaccaaggccaaggacggcaagaagtacgccaccctgagcctgttcaacacctacaagggcaagagcctggagacccagaagaccaccgccagacacggcctgcagagcctgggcaaggtgggcatcagcagaagaatgcccccccccgccaacctgcccagcctgaaggccgagaacaagggcaacgaccccaacgtgaacatcgtgcccaaggacggcaccggctgggccagcaagcaggagcagcacgaggaggagaagacccccgaggtgccccccgcccagcccaagcccggcgtggccgccccccccgaggtggcccccgcccccaagagctgggccagcaacaagcagggcggccagggcgacggcatccaggtgaacagccagttccagcaggagttccccagcctgcaggccgccggcgaccaggagaagaaggagaaggagaccaacgacgacaactacggccccggccccagcctgagaccccccaacgtggcctgctggagagacggcggcaaggccgccggcagccccagcagcagcgaccaggacgagaagctgcccggccaggacgagagcaccgccggcaccagcgagcagaacgacatcctgaaggtggtggagaagagaatcgcctgcggccccccccaggccaagctgaacggccagcaggccgccctggccagccagtacagagccatgatgcccccctacatgttccagcagtaccccagaatgacctacccccccctgcacggccccatgagattcccccccagcctgagcgagaccaacaagggcctgagaggcagaggccccccccccagctgggccagcgagcccgagagacccagcatcctgagcgccagcgagctgaaggagctggacaagttcgacaacctggacgccgaggccgacgagggctgggccggcgcccagatggaggtggactacaccgagcagctgaacttcagcgacgacgacgagcagggcagcaacagccccaaggagaacaacagcgaggaccagggcagcaaggccagcgagaacaacgagaacaagaaggagaccgacgaggtgagcaacaccaagagcagcagccagatccccgcccagcccagcgtggccaaggtgccctacggcaagggccccagcttcaaccaggagagaggcaccagcagccacctgccccccccccccaagctgctggcccagcagcaccccccccccgacagacaggccgtgcccggcagacccggccccttccccagcaagcagcaggtggccgacgaggacgagatctggaagcagagaagaagacagcagagcgagatcagcgccgccgtggagagagccagaaagagaagagaggaggaggagagaagaatggaggagcagagaaaggccgcctgcgccgagaagctgaagagactggacgagaagctgggcatcctggagaagcagcccagccccgaggagatcagagagagagagagagagaaggagagagagagagagaaggagctggagaaggagcaggagcaggagagagagaaggagagagagaaggacagagagagacagcaggagaaggagaaggagctggagaaggagcaggagaagcagagagagatggagaaggagagaaagcaggagaaggagaaggagctggagagacagaaggagaaggagaaggagctgcagaagatgaaggagcaggagaaggagtgcgagctggagaaggagagagagaagctggaggagaagatcgagcccagagagcccaacctggagcccatggtggagaagcaggagagcgagaacagctgcaacaaggaggaggagcccgtgttcaccagacaggacagcaacagaagcgagaaggaggccacccccgtggtgcacgagaccgagcccgagagcggcagccagcccagacccgccgtgctgagcggctacttcaagcagttccagaagagcctgccccccagattccagagacagcaggagcagatgaagcagcagcagtggcagcagcagcagcagcagggcgtgctgccccagaccgtgcccagccagcccagcagcagcaccgtgcccccccccccccacagacccctgtaccagcccatgcagccccacccccagcacctggccagcatgggcttcgaccccagatggctgatgatgcagagctacatggaccccagaatgatgagcggcagacccgccatggacatcccccccatccaccccggcatgatcccccccaagcccctgatgagaagagaccagatggagggcagccccaacagcagcgagagcttcgagcacatcgccagaagcgccagagaccacgccatcagcctgagcgagcccagaatgctgtggggcagcgacccctacccccacgccgagccccagcaggccaccacccccaaggccaccgaggagcccgaggacgtgagaagcgaggccgccctggaccaggagcagatcaccgccgcctacagcgtggagcacaaccagctggaggcccaccccaaggccgacttcatcagagagagcagcgaggcccaggtgcagaagttcctgagcagaagcgtggaggacgtgagaccccaccacaccgacgccaacaaccagagcgcctgcttcgaggcccccgaccagaagaccctgagcgccccccaggaggagagaatcagcgccgtggagagccagcccagcagaaagagaagcgtgagccacggcagcaaccacacccagaagcccgacgagcagagaagcgagcccagcgccggcatccccaaggtgaccagcagatgcatcgacagcaaggagcccatcgagagacccgaggagaagcccaagaaggagggcttcatcagaagcagcgagggccccaagcccgagaaggtgtacaagagcaagagcgagaccagatggggccccagacccagcagcaacagaagagaggaggtgaacgacagacccgtgagaagaagcggccccatcaagaagcccgtgctgagagacatgaaggaggagagagagcagagaaaggagaaggagggcgagaaggccgagaaggtgaccgagaaggtggtggtgaagcccgagaagaccgagaagaaggacctgccccccccccccccccccccccagccccccgcccccatccagccccagagcgtgcccccccccatccagcccgaggccgagaagttccccagcaccgagaccgccaccctggcccagaagcccagccaggacaccgagaagcccctggagcccgtgagcaccgtgcaggtggagcccgccgtgaagaccgtgaaccagcagaccatggccgcccccgtggtgaaggaggagaagcagcccgagaaggtgatcagcaaggacctggtgatcgagagacccagacccgacagcagacccgccgtgaagaaggagagcaccctgccccccagaacctactggaaggaggccagagagagagactggttccccgaccagggctacagaggcagaggcagaggcgagtactacagcagaggcagaagctacagaggcagctacggcggcagaggcagaggcggcagaggccacaccagagactacccccagtacagagacaacaagcccagagccgagcacatccccagcggccccctgagacagagagaggagagcgagaccagaagcgagagcagcgacttcgaggtggtgcccaagagaagaagacagagaggcagcgagaccgacaccgacagcgagatccacgagagcgccagcgacaaggacagcctgagcaagggcaagctgcccaagagagaggagagacccgagaacaagaagcccgtgaagccccacagcagcttcaagcccgacaaccacgtgagaatcgacaacagactgctggagaagccctacgtgagagacgacgacaaggccaagcccggcttcctgcccaagggcgagcccaccagaagaggcagaggcggcaccttcagaagaggcggcagagaccccggcggcagacccagcagacccagcaccctgagaagacccgcctacagagacaaccagtggaaccccagacagagcgaggtgcccaagcccgaggacggcgagccccccagaagacacgagcagttcatccccatcgccgccgacaagagaccccccaagttcgagagaaagttcgaccccgccagagagagacccagaagacagagacccaccagaccccccagacaggacaagccccccagattcagaagactgagagagagagaggccgccagcaagagcaacgaggtggtggccgtgcccaccaacggcaccgtgaacaacgtggcccaggagcccgtgaacaccctgggcgacatcagcggcaacaagacccccgacctgagcaaccagaacagcagcgaccaggccaacgaggagtgggagaccgccagcgagagcagcgacttcaacgagagaagagagagagacgagaagaagaacgccgacctgaacgcccagaccgtggtgaaggtgggcgagaacgtgctgccccccaagagagagatcgccaagagaagcttcagcagccagagacccgtggacagacagaacagaagaggcaacaacggcccccccaagagcggcagaaacttcagcggccccagaaacgagagaagaagcggcccccccagcaagagcggcaagagaggccccttcgacgaccagcccgccggcaccaccggcgtggacctgatcaacggcagcagcgcccaccaccaggagggcgtgcccaacggcaccggccagaagaacagcaaggacagcaccggcaagaagagagaggaccccaagcccggccccaagaagcccaaggagaaggtggacgccctgagccagttcgacctgaacaactacgccagcgtggtgatcatcgacgaccaccccgaggtgaccgtgatcgaggacccccagagcaacctgaacgacgacggcttcaccgaggtggtgagcaagaagcagcagaagagactgcaggacgaggagagaagaaagaaggaggagcaggtgatccaggtgtggaacaagaagaacgccaacgagaagggcagaagccagaccagcaagctgccccccagattcgccaagaagcaggccaccggcatccagcaggcccagagcagcgccagcgtgccccccctggccagcgcccccctgccccccagcaccagcgccagcgtgcccgccagcaccagcgcccccctgcccgccaccctgacccccgtgcccgccagcaccagcgcccccgtgcccgccagcaccctggcccccgtgctggccagcaccagcgcccccgtgcccgccagccccctggcccccgtgagcgccagcgccagcgtgagcgccagcgtgcccgccagcaccagcgccgccgccatcaccagcagcagcgcccccgccagcgcccccgcccccacccccatcctggccagcgtgagcacccccgccagcgtgaccatcctggccagcgccagcatccccatcctggccagcgccctggccagcaccagcgcccccacccccgcccccgccgccagcagccccgccgcccccgtgatcaccgcccccaccatccccgccagcgcccccaccgccagcgtgcccctggcccccgccagcgccagcgcccccgcccccgcccccacccccgtgagcgcccccaaccccgccccccccgcccccgcccagacccaggcccagacccacaagcccgtgcagaaccccctgcagaccaccagccagagcagcaagcagcccccccccagcatcagactgcccagcgcccagacccccaacggcaccgactacgtggccagcggcaagagcatccagaccccccagagccacggcaccctgaccgccgagctgtgggacaacaaggtggccccccccgccgtgctgaacgacatcagcaagaagctgggccccatcagccccccccagccccccagcgtgagcgcctggaacaagcccctgaccagcttcggcagcgcccccagcagcgagggcgccaagaacggccaggagagcggcctggagatcggcaccgacaccatccagttcggcgcccccgccagcaacggcaacgagaacgaggtggtgcccgtgctgagcgagaagagcgccgacaagatccccgagcccaaggagcagagacagaagcagcccagagccggccccatcaaggcccagaagctgcccgacctgagccccgtggagaacaaggagcacaagcccggccccatcggcaaggagagaagcctgaagaacagaaaggtgaaggacgcccagcaggtggagcccgagggccaggagaagcccagccccgccaccgtgagaagcaccgaccccgtgaccaccaaggagaccaaggccgtgagcgagatgagcaccgagatcggcaccatgatcagcgtgagcagcgccgagtacggcaccaacgccaagatggagagcgccagaaaggcctgggagaacagccccaacgtgagagagaagggcagccccgtgaccagcaccgccccccccatcgccaccggcgtgagcagcagcgccagcggccccagcaccgccaactacaacagcttcagcagcgccagcatgccccagatccccgtggccagcgtgacccccaccgccagcctgagcggcgccggcacctacaccaccagcagcctgagcaccaagagcaccaccaccagcgacccccccaacatctgcaaggtgaagccccagcagctgcagaccagcagcctgcccagcgccagccacttcagccagctgagctgcatgcccagcctgatcgcccagcagcagcagaacccccaggtgtacgtgagccagagcgccgccgcccagatccccgccttctacatggacaccagccacctgttcaacacccagcacgccagactggccccccccagcctggcccagcagcagggcttccagcccggcctgagccagcccaccagcgtgcagcagatccccatccccatctacgcccccctgcagggccagcaccaggcccagctgagcctgggcgccggccccgccgtgagccaggcccaggagctgttcagcagcagcctgcagccctacagaagccagcccgccttcatgcagagcagcctgagccagcccagcgtggtgctgagcggcaccgccatccacaacttccccaccgtgcagcaccaggagctggccaaggcccagagcggcctggccttccagcagaccagcaacacccagcccatccccatcctgtacgagcaccagctgggccaggccagcggcctgggcggcagccagctgatcgacacccacctgctgcaggccagagccaacctgacccaggccagcaacctgtacagcggccaggtgcagcagcccggccagaccaacttctacaacaccgcccagagccccagcgccctgcagcaggtgaccgtgcccctgcccgccagccagctgagcctgcccaacttcggcagcaccggccagcccctgatcgccctgccccagaccctgcagccccccctgcagcacaccaccccccaggcccaggcccagagcctgagcagacccgcccaggtgagccagcccttcagaggcctgatccccgccggcacccagcacagcatgatcgccaccaccggcaagatgagcgagatggagctgaaggccttcggcagcggcatcgacatcaagcccggcaccccccccatcgccggcagaagcaccacccccaccagcagccccttcagagccaccagcaccagccccaacagccagagcagcaagatgaacagcatcgtgtaccagaagcagttccagagcgcccccgccaccgtgagaatgacccagcccttccccacccagttcgccccccaggccaagcagagagccgaggtgctgcagagcacccagagattcttcagcgagcagcagcagagcaagcagatcggcggcggcaaggcccagaaggtggacagcgacagcagcaagccccccgagaccctgaccgacccccccggcgtgtgccaggagaaggtggaggagaagcccccccccgcccccagcatcgccaccaagcccgtgagaaccggccccatcaagccccaggccatcaagaccgaggagaccaagagctag

SEQ ID NO: 23527 - DNA, 8553 bp, Artificial Sequence
  Description of Artificial Sequence: Synthetic coding sequence
atgagcgagaagagcggccagagcaccaaggccaaggacggcaagaagtacgccaccctgagcctgttcaacacctacaagggcaagagcctggagacccagaagaccaccgccagacacggcctgcagagcctgggcaaggtgggcatcagcagaagaatgcccccccccgccaacctgcccagcctgaaggccgagaacaagggcaacgaccccaacgtgaacatcgtgcccaaggacggcaccggctgggccagcaagcaggagcagcacgaggaggagaagacccccgaggtgccccccgcccagcccaagcccggcgtggccgccccccccgaggtggcccccgcccccaagagctgggccagcaacaagcagggcggccagggcgacggcatccaggtgaacagccagttccagcaggagttccccagcctgcaggccgccggcgaccaggagaagaaggagaaggagaccaacgacgacaactacggccccggccccagcctgagaccccccaacgtggcctgctggagagacggcggcaaggccgccggcagccccagcagcagcgaccaggacgagaagctgcccggccaggacgagagcaccgccggcaccagcgagcagaacgacatcctgaaggtggtggagaagagaatcgcctgcggccccccccaggccaagctgaacggccagcaggccgccctggccagccagtacagagccatgatgcccccctacatgttccagcagtaccccagaatgacctacccccccctgcacggccccatgagattcccccccagcctgagcgagaccaacaagggcctgagaggcagaggccccccccccagctgggccagcgagcccgagagacccagcatcctgagcgccagcgagctgaaggagctggacaagttcgacaacctggacgccgaggccgacgagggctgggccggcgcccagatggaggtggactacaccgagcagctgaacttcagcgacgacgacgagcagggcagcaacagccccaaggagaacaacagcgaggaccagggcagcaaggccagcgagaacaacgagaacaagaaggagaccgacgaggtgagcaacaccaagagcagcagccagatccccgcccagcccagcgtggccaaggtgccctacggcaagggccccagcttcaaccaggagagaggcaccagcagccacctgccccccccccccaagctgctggcccagcagcaccccccccccgacagacaggccgtgcccggcagacccggccccttccccagcaagcagcaggtggccgacgaggacgagatctggaagcagagaagaagacagcagagcgagatcagcgccgccgtggagagagccagaaagagaagagaggaggaggagagaagaatggaggagcagagaaaggccgcctgcgccgagaagctgaagagactggacgagaagctgggcatcctggagaagcagcccagccccgaggagatcagagagagagagagagagaaggagagagagagagagaaggagctggagaaggagcaggagcaggagagagagaaggagagagagaaggacagagagagacagcaggagaaggagaaggagctggagaaggagcaggagaagcagagagagatggagaaggagagaaagcaggagaaggagaaggagctggagagacagaaggagaaggagaaggagctgcagaagatgaaggagcaggagaaggagtgcgagctggagaaggagagagagaagctggaggagaagatcgagcccagagagcccaacctggagcccatggtggagaagcaggagagcgagaacagctgcaacaaggccgaggaggagcccgtgttcaccagacaggacagcaacagaagcgagaaggaggccacccccgtggtgcacgagaccgagcccgagagcggcagccagcccagacccgccgtgctgagcggctacttcaagcagttccagaagagcctgccccccagattccagagacagcaggagcagatgaagcagcagcagtggcagcagcagcagcagcagggcgtgctgccccagaccgtgcccagccagcccagcagcagcaccgtgcccccccccccccacagacccctgtaccagcccatgcagccccacccccagcacctggccagcatgggcttcgaccccagatggctgatgatgcagagctacatggaccccagaatgatgagcggcagacccgccatggacatcccccccatccaccccggcatgatcccccccaagcccctgatgagaagagaccagatggagggcagccccaacagcagcgagagcttcgagcacatcgccagaagcgccagagaccacgccatcagcctgagcgagcccagaatgctgtggggcagcgacccctacccccacgccgagccccagcaggccaccacccccaaggccaccgaggagcccgaggacgtgagaagcgaggccgccctggaccaggagcagatcaccgccgcctacagcgtggagcacaaccagctggaggcccaccccaaggccgacttcatcagagagagcagcgaggcccaggtgcagaagttcctgagcagaagcgtggaggacgtgagaccccaccacaccgacgccaacaaccagagcgcctgcttcgaggcccccgaccagaagaccctgagcgccccccaggaggagagaatcagcgccgtggagagccagcccagcagaaagagaagcgtgagccacggcagcaaccacacccagaagcccgacgagcagagaagcgagcccagcgccggcatccccaaggtgaccagcagatgcatcgacagcaaggagcccatcgagagacccgaggagaagcccaagaaggagggcttcatcagaagcagcgagggccccaagcccgagaaggtgtacaagagcaagagcgagaccagatggggccccagacccagcagcaacagaagagaggaggtgaacgacagacccgtgagaagaagcggccccatcaagaagcccgtgctgagagacatgaaggaggagagagagcagagaaaggagaaggagggcgagaaggccgagaaggtgaccgagaaggtggtggtgaagcccgagaagaccgagaagaaggacctgccccccccccccccccccccccagccccccgcccccatccagccccagagcgtgcccccccccatccagcccgaggccgagaagttccccagcaccgagaccgccaccctggcccagaagcccagccaggacaccgagaagcccctggagcccgtgagcaccgtgcaggtggagcccgccgtgaagaccgtgaaccagcagaccatggccgcccccgtggtgaaggaggagaagcagcccgagaaggtgatcagcaaggacctggtgatcgagagacccagacccgacagcagacccgccgtgaagaaggagagcaccctgccccccagaacctactggaaggaggccagagagagagactggttccccgaccagggctacagaggcagaggcagaggcgagtactacagcagaggcagaagctacagaggcagctacggcggcagaggcagaggcggcagaggccacaccagagactacccccagtacagagacaacaagcccagagccgagcacatccccagcggccccctgagacagagagaggagagcgagaccagaagcgagagcagcgacttcgaggtggtgcccaagagaagaagacagagaggcagcgagaccgacaccgacagcgagatccacgagagcgccagcgacaaggacagcctgagcaagggcaagctgcccaagagagaggagagacccgagaacaagaagcccgtgaagccccacagcagcttcaagcccgacaaccacgtgagaatcgacaacagactgctggagaagccctacgtgagagacgacgacaaggccaagcccggcttcctgcccaagggcgagcccaccagaagaggcagaggcggcaccttcagaagaggcggcagagaccccggcggcagacccagcagacccagcaccctgagaagacccgcctacagagacaaccagtggaaccccagacagagcgaggtgcccaagcccgaggacggcgagccccccagaagacacgagcagttcatccccatcgccgccgacaagagaccccccaagttcgagagaaagttcgaccccgccagagagagacccagaagacagagacccaccagaccccccagacaggacaagccccccagattcagaagactgagagagagagaggccgccagcaagagcaacgaggtggtggccgtgcccaccaacggcaccgtgaacaacgtggcccaggagcccgtgaacaccctgggcgacatcagcggcaacaagacccccgacctgagcaaccagaacagcagcgaccaggccaacgaggagtgggagaccgccagcgagagcagcgacttcaacgagagaagagagagagacgagaagaagaacgccgacctgaacgcccagaccgtggtgaaggtgggcgagaacgtgctgccccccaagagagagatcgccaagagaagcttcagcagccagagacccgtggacagacagaacagaagaggcaacaacggcccccccaagagcggcagaaacttcagcggccccagaaacgagagaagaagcggcccccccagcaagagcggcaagagaggccccttcgacgaccagcccgccggcaccaccggcgtggacctgatcaacggcagcagcgcccaccaccaggagggcgtgcccaacggcaccggccagaagaacagcaaggacagcaccggcaagaagagagaggaccccaagcccggccccaagaagcccaaggagaaggtggacgccctgagccagttcgacctgaacaactacgccagcgtggtgatcatcgacgaccaccccgaggtgaccgtgatcgaggacccccagagcaacctgaacgacgacggcttcaccgaggtggtgagcaagaagcagcagaagagactgcaggacgaggagagaagaaagaaggaggagcaggtgatccaggtgtggaacaagaagaacgccaacgagaagggcagaagccagaccagcaagctgccccccagattcgccaagaagcaggccaccggcatccagcaggcccagagcagcgccagcgtgccccccctggccagcgcccccctgccccccagcaccctggcccccgtgagcgccagcgccagcgtgagcgccagcgtgcccgccagcaccagcgccgccgccatcaccagcagcagcgcccccgccagcgcccccgcccccacccccatcctggccagcgtgagcacccccgccagcgtgaccatcctggccagcgccagcatccccatcctggccagcgccctggccagcaccagcgcccccacccccgcccccgccgccagcagccccgccgcccccgtgatcaccgcccccaccatccccgccagcgcccccaccgccagcgtgcccctggcccccgccagcgccagcgcccccgcccccgcccccacccccgtgagcgcccccaaccccgccccccccgcccccgcccagacccaggcccagacccacaagcccgtgcagaaccccctgcagaccaccagccagagcagcaagcagcccccccccagcatcagactgcccagcgcccagacccccaacggcaccgactacgtggccagcggcaagagcatccagaccccccagagccacggcaccctgaccgccgagctgtgggacaacaaggtggccccccccgccgtgctgaacgacatcagcaagaagctgggccccatcagccccccccagccccccagcgtgagcgcctggaacaagcccctgaccagcttcggcagcgcccccagcagcgagggcgccaagaacggccaggagagcggcctggagatcggcaccgacaccatccagttcggcgcccccgccagcaacggcaacgagaacgaggtggtgcccgtgctgagcgagaagagcgccgacaagatccccgagcccaaggagcagagacagaagcagcccagagccggccccatcaaggcccagaagctgcccgacctgagccccgtggagaacaaggagcacaagcccggccccatcggcaaggagagaagcctgaagaacagaaaggtgaaggacgcccagcaggtggagcccgagggccaggagaagcccagccccgccaccgtgagaagcaccgaccccgtgaccaccaaggagaccaaggccgtgagcgagatgagcaccgagatcggcaccatgatcagcgtgagcagcgccgagtacggcaccaacgccaaggagagcgtgaccgactacaccacccccagcagcagcctgcccaacaccgtggccaccaacaacaccaagatggaggacaccctggtgaacaacgtgcccctgcccaacaccctgcccctgcccaagagagagaccatccagcagagcagcagcctgaccagcgtgccccccaccaccttcagcctgaccttcaagatggagagcgccagaaaggcctgggagaacagccccaacgtgagagagaagggcagccccgtgaccagcaccgccccccccatcgccaccggcgtgagcagcagcgccagcggccccagcaccgccaactacaacagcttcagcagcgccagcatgccccagatccccgtggccagcgtgacccccaccgccagcctgagcggcgccggcacctacaccaccagcagcctgagcaccaagagcaccaccaccagcgacccccccaacatctgcaaggtgaagccccagcagctgcagaccagcagcctgcccagcgccagccacttcagccagctgagctgcatgcccagcctgatcgcccagcagcagcagaacccccaggtgtacgtgagccagagcgccgccgcccagatccccgccttctacatggacaccagccacctgttcaacacccagcacgccagactggccccccccagcctggcccagcagcagggcttccagcccggcctgagccagcccaccagcgtgcagcagatccccatccccatctacgcccccctgcagggccagcaccaggcccagctgagcctgggcgccggccccgccgtgagccaggcccaggagctgttcagcagcagcctgcagccctacagaagccagcccgccttcatgcagagcagcctgagccagcccagcgtggtgctgagcggcaccgccatccacaacttccccaccgtgcagcaccaggagctggccaaggcccagagcggcctggccttccagcagaccagcaacacccagcccatccccatcctgtacgagcaccagctgggccaggccagcggcctgggcggcagccagctgatcgacacccacctgctgcaggccagagccaacctgacccaggccagcaacctgtacagcggccaggtgcagcagcccggccagaccaacttctacaacaccgcccagagccccagcgccctgcagcaggtgaccgtgcccctgcccgccagccagctgagcctgcccaacttcggcagcaccggccagcccctgatcgccctgccccagaccctgcagccccccctgcagcacaccaccccccaggcccaggcccagagcctgagcagacccgcccaggtgagccagcccttcagaggcctgatccccgccggcacccagcacagcatgatcgccaccaccggcaagatgagcgagatggagctgaaggccttcggcagcggcatcgacatcaagcccggcaccccccccatcgccggcagaagcaccacccccaccagcagccccttcagagccaccagcaccagccccaacagccagagcagcaagatgaacagcatcgtgtaccagaagcagttccagagcgcccccgccaccgtgagaatgacccagcccttccccacccagttcgccccccagatcctgagccagcccaacctggtgccccccctggtgagagccccccacaccaacaccttccccgcccccgtgcagagaccccccatggccctggccagccagatgcccccccccctgaccaccggcctgatgagccacgccagactgccccacgtggccagaggcccctgcggcagcctgagcggcgtgagaggcaaccaggcccaggccgccctgaaggccgagcaggacatgaaggccaagcagagagccgaggtgctgcagagcacccagagattcttcagcgagcagcagcagagcaagcagatcggcggcggcaaggcccagaaggtggacagcgacagcagcaagccccccgagaccctgaccgacccccccggcgtgtgccaggagaaggtggaggagaagcccccccccgcccccagcatcgccaccaagcccgtgagaaccggccccatcaagccccaggccatcaagaccgaggagaccaagagctag

SEQ ID NO: 23528 - DNA, 2292 bp, Artificial Sequence
  Description of Artificial Sequence: Synthetic coding sequence
atcctgccccccacccagatgttccagcagtaccccagaatgacctacccccccctgcacggccccatgagattcccccccagcctgagcgagaccaacaagggcctgagaggcagaggccccccccccagctgggccagcgagcccgagagacccagcatcctgagcgccagcgagctgaaggagctggacaagttcgacaacctggacgccgaggccgacgagggctgggccggcgcccagatggaggtggactacaccgagcagctgaacttcagcgacgacgacgagcagggcagcaacagccccaaggagaacaacagcgaggaccagggcagcaaggccagcgagaacaacgagaacaagaaggagaccgacgaggtgagcaacaccaagagcagcagccagatccccgcccagcccagcgtggccaaggtgccctacggcaagggccccagcttcaaccaggagagaggcaccagcagccacctgccccccccccccaagctgctggcccagcagcaccccccccccgacagacaggccgtgcccggcagacccggccccttccccagcaagcagcaggtggccgacgaggacgagatctggaagcagagaagaagacagcagagcgagatcagcgccgccgtggagagagccagaaagagaagagaggaggaggagagaagaatggaggagcagagaaaggccgcctgcgccgagaagctgaagagactggacgagaagctgggcatcctggagaagcagcccagccccgaggagatcagagagagagagagagagaaggagagagagagagagaaggagctggagaaggagcaggagcaggagagagagaaggagagagagaaggacagagagagacagcaggagaaggagaaggagctggagaaggagcaggagaagcagagagagatggagaaggagagaaagcaggagaaggagaaggagctggagagacagaaggagaaggagaaggagctgcagaagatgaaggagcaggagaaggagtgcgagctggagaaggagagagagaagctggaggagaagatcgagcccagagagcccaacctggagcccatggtggagaagcaggagagcgagaacagctgcaacaaggccgaggaggagcccgtgttcaccagacaggacagcaacagaagcgagaaggaggccacccccgtggtgcacgagaccgagcccgagagcggcagccagcccagacccgccgtgctgagcggctacttcaagcagttccagaagagcctgccccccagattccagagacagcaggagcagatgaagcagcagcagtggcagcagcagcagcagcagggcgtgctgccccagaccgtgcccagccagcccagcagcagcaccgtgcccccccccccccacagacccctgtaccagcccatgcagccccacccccagcacctggccagcatgggcttcgaccccagatggctgatgatgcagagctacatggaccccagaatgatgagcggcagacccgccatggacatcccccccatccaccccggcatgatcccccccaagcccctgatgagaagagaccagatggagggcagccccaacagcagcgagagcttcgagcacatcgccagaagcgccagagaccacgccatcagcctgagcgagcccagaatgctgtggggcagcgacccctacccccacgccgagccccagcaggccaccacccccaaggccaccgaggagcccgaggacgtgagaagcgaggccgccctggaccaggagcagatcaccgccgcctacagcgtggagcacaaccagctggaggcccaccccaaggccgacttcatcagagagagcagcgaggcccaggtgcagaagttcctgagcagaagcgtggaggacgtgagaccccaccacaccgacgccaacaaccagagcgcctgcttcgaggcccccgaccagaagaccctgagcgccccccaggaggagagaatcagcgccgtggagagccagcccagcagaaagagaagcgtgagccacggcagcaaccacacccagaagcccgacgagcagagaagcgagcccagcgccggcatccccaaggtgaccagcagatgcatcgacagcaaggagcccatcgagagacccgaggagaagcccaagaaggagggcttcatcagaagcagcgagggccccaagcccgagaaggtgtacaagagcaagagcgagaccagatggggccccagacccagcagcaacagaagagaggagtag

SEQ ID NO: 23529 - DNA, 930 bp, Artificial Sequence
  Description of Artificial Sequence: Synthetic coding sequence
atgctgctgatcctgctgagcgtggccctgctggccctgagcagcgcccagagcctgaacgaggacgtgagccaggaggagagccccagcgtgatcagcggcaagcccgagggcagaagaccccagggcggcaaccagccccagagaaccccccccccccccggcaagcccgagggcagacccccccagggcggcaaccagagccagggccccccccccagacccggcaagcccgagggcccccccccccagggcggcaaccagagccagggccccccccccagacccggcaagcccgagggccagcccccccagggcggcaaccagagccagggccccccccccagacccggcaagcccgagggcccccccccccagggcggcaaccagagccagggccccccccccagacccggcaagcccgagggcccccccccccagggcggcaaccagagccagggccccccccccagacccggcaagcccgagggcccccccccccagggcggcaaccagagccagggcccccccccccaccccggcaagcccgagggcccccccccccagggcggcaaccagagccagggccccccccccagacccggcaagcccgagggcccccccccccagggcggcaaccagagccagggccccccccccagacccggcaagcccgagggcccccccagccagggcggcaacaagccccagggcccccccccccaccccggcaagccccagggcccccccccccaggagggcaacaagccccagagaccccccccccccggcagaccccagggcccccccccccccggcggcaacccccagcagcccctgcccccccccgccggcaagccccagggcccccccccccccccccagggcggcagaccccacagacccccccagggccagcccccccagtag

SEQ ID NO: 23530 - DNA, 930 bp, Artificial Sequence
  Description of Artificial Sequence: Synthetic coding sequence
atgctgctgatcctgctgagcgtggccctgctggccctgagcagcgcccagagcctgaacgaggacgtgagccaggaggagagccccagcgtgatcagcggcaagcccgagggcagaagaccccagggcggcaaccagccccagagaaccccccccccccccggcaagcccgagggcagacccccccagggcggcaaccagagccagggccccccccccagacccggcaagcccgagggcccccccccccagggcggcaaccagagccagggccccccccccagacccggcaagcccgagggccagcccccccagggcggcaaccagagccagggccccccccccagacccggcaagcccgagggcccccccccccagggcggcaaccagagccagggccccccccccagacccggcaagcccgagggcccccccccccagggcggcaaccagagccagggcccccccccccaccccggcaagcccgagggcccccccccccagggcggcaaccagagccagggccccccccccagacccggcaagcccgagggcccccccccccagggcggcaaccagagccagggccccccccccagacccggcaagcccgagggcccccccccccagggcggcaaccagagccagggccccccccccagacccggcaagcccgagggcccccccagccagggcggcaacaagccccagggcccccccccccaccccggcaagccccagggcccccccccccaggagggcaacaagccccagagaccccccccccccggcagaccccagggcccccccccccccggcggcaacccccagcagcccctgcccccccccgccggcaagccccagggcccccccccccccccccagggcggcagaccccacagacccccccagggccagcccccccagtag

SEQ ID NO: 23531 - DNA, 501 bp, Artificial Sequence
  Description of Artificial Sequence: Synthetic coding sequence
atgctgctgatcctgctgagcgtggccctgctggccttcagcagcgcccaggacctggacgaggacgtgagccaggaggacgtgcccctggtgatcagcgacggcggcgacagcgagcagttcatcgacgaggagagacagggcccccccctgggcggccagcagagccagcccagcgccggcgacggcaaccagaacgacggcccccagcagggccccccccagcagggcggccagcagcagcagggccccccccccccccagggcaagccccagggccccccccagcagggcggccaccccccccccccccagggcagaccccagggccccccccagcagggcggccaccccagaccccccagaggcagaccccagggccccccccagcagggcggccaccagcagggcccccccccccccccccccggcaagccccagggcccccccccccagggcggcagaccccagggccccccccagggccagagcccccagtag

SEQ ID NO: 23532 - DNA, 501 bp, Artificial Sequence; identical to SEQ ID NO: 23531
  Description of Artificial Sequence: Synthetic coding sequence

SEQ ID NO: 23533 - DNA, 501 bp, Artificial Sequence; identical to SEQ ID NO: 23531
  Description of Artificial Sequence: Synthetic coding sequence

SEQ ID NO: 23534 - DNA, 501 bp, Artificial Sequence; identical to SEQ ID NO: 23531
  Description of Artificial Sequence: Synthetic coding sequence

SEQ ID NO: 23535 - DNA, 486 bp, Artificial Sequence
  Description of Artificial Sequence: Synthetic coding sequence
atgttcagcctgcccctgaactgcagccccgaccacatcagaagaggcagctgctggggcagaccccaggacctgaagatcgccgcccccgcctggaacagcaagtgccaccccggcgccggcgccgccatggccagatgcaagaacgccgacggcgtggagctgtacaacgagatcgagttctacgccaaggtgaacagcaaggacagccaggacaagagaagcagcagaagcatcacctgcttcgtgagaaagtggaaggagaaggtggcctggcccagactgaccaaggaggacatcaagcccgtgtggctgagcgtggacttcgacaactggagagactgggagggcgacgaggagatggagctggcccacgtggagcactacgccgagctgctgaagaaggtgagcaccaagagacccccccccgccatggacgacctggacgacgacagcgacagcgccgacgacgccaccagcaactag

SEQ ID NO: 23536 - DNA, 387 bp, Artificial Sequence
  Description of Artificial Sequence: Synthetic coding sequence
tgacagcacgccagaaccctgtggtacgacagacccagctgcaagaacgccgacggcgtggagctgtacaacgagatcgagttctacgccaaggtgaacagcaaggacagccaggacaagagaagcagcagaagcatcacctgcttcgtgagaaagtggaaggagaaggtggcctggcccagactgaccaaggaggacatcaagcccgtgtggctgagcgtggacttcgacaactggagagactgggagggcgacgaggagatggagctggcccacgtggagcactacgccgagctgctgaagaaggtgagcaccaagagacccccccccgccatggacgacctggacgacgacagcgacagcgccgacgacgccaccagcaactag

SEQ ID NO: 23537 - DNA, 297 bp, Artificial Sequence
  Description of Artificial Sequence: Synthetic coding sequence
atgagaaagatgaacaccctgctgctggtgagcctgagcttcctgtacctgaaggaggtgatgggcctgaagtgcaacacctgcatctacaccgagggctggaagtgcatggccggcagaggcacctgcatcgccaaggagaacgagctgtgcagcaccaccgcctacttcagaggcgacaagcacatgtacagcacccacatgtgcaagtacaagtgcagagaggaggagagcagcaagagaggcctgctgagagtgaccctgtgctgcgacagaaacttctgcaacgtgttctag

SEQ ID NO: 23538 - DNA, 345 bp, Artificial Sequence
  Description of Artificial Sequence: Synthetic coding sequence
atggccggcctggccctgcagcccggcaccgccctgctgtgctacagctgcaaggcccaggtgagcaacgaggactgcctgcaggtggagaactgcacccagctgggcgagcagtgctggaccgccagaatcagagccgtgggcctgctgaccgtgatcagcaagggctgcagcctgaactgcgtggacgacagccaggactactacgtgggcaagaagaacatcacctgctgcgacaccgacctgtgcaacgccagcggcgcccacgccctgcagcccgccgccgccatcctggccctgctgcccgccctgggcctgctgctgtggggccccggccagctgtag

SEQ ID NO: 23539 - DNA, 312 bp, Artificial Sequence
  Description of Artificial Sequence: Synthetic coding sequence
atgggcagcagatgcgccaagctgaacaccggccagagccccggccacagccccggccacagcaccggccacggcagaggccacgagagcagcatgaagaagctgatggcctgcgtgagccaggacaacttcagcctgagcagcgccggcgaggaggaggaggaggaggaggaggagggcgaggaggaggagaaggaggagctgcccgtgcagggcaagctgctgctgctggagcccgagagacaggaggagggccacaaggacaacgccgaggcccagcagagccccgagcccaagagaacccccagctag

SEQ ID NO: 23540 - DNA, 744 bp, Artificial Sequence
  Description of Artificial Sequence: Synthetic coding sequence
atgaacctgctgctgatcctgaccttcgtggccgccgccgtggccgcccccttcgacgacgacgacaagatcgtgggcggctacatctgcgaggagaacagcgtgccctaccaggtgagcctgaacagcggctaccacttctgcggcggcagcctgatcagcgagcagtgggtggtgagcgccggccactgctacaagagcagaatccaggtgagactgggcgagcacaacatcgaggtgctggagggcaacgagcagttcatcaacgccgccaagatcatcagacaccccaagtacaacagcagaaccctggacaacgacatcctgctgatcaagctgagcagccccgccgtgatcaacagcagagtgagcgccatcagcctgcccaccgccccccccgccgccggcaccgagagcctgatcagcggctggggcaacaccctgagcagcggcgccgactaccccgacgagctgcagtgcctggacgcccccgtgctgagccaggccgagtgcgaggccagctaccccggcaagatcaccaacaacatgttctgcgtgggcttcctggagggcggcaaggacagctgccagggcgacagcggcggccccgtggtgagcaacggcgagctgcagggcatcgtgagctggggctacggctgcgcccagaagaacagacccggcgtgtacaccaaggtgtacaactacgtggactggatcaaggacaccatcgccgccaacagctag

SEQ ID NO: 23541 - DNA, 525 bp, Artificial Sequence
  Description of Artificial Sequence: Synthetic coding sequence
atggcctgcggccccggcgacctgcagagcctgaccagccccctgagcagcgccagactggactaccagcccagcatcgagggcccctggctgagagcctgcggccagaccaacgtgagctgcagagtggtgaagggcaagctggtggaggtgggcaagtggccctggcaggtgagcatcctgttcctgggcacctacatctgcagcggcagcctgatccaccaccagtgggtgctgaccgccgcccactgcctgcagagattcaaggacctgagcctgtacagcgtgatggtgggcgtgcaccagagacccgagaacagcacccagctgcccctgaccagaatggtgatccacaaggacttcagcaacctgatgagccaggacatcgccctgctgaagctgagagacagcatcagctggagccccttcgtgcagcccgtgtgcctgcccaacatcaagttcaagcccagcatcggcagcatgtgctgggtgatcggctggggcaccaccggcaagaagggctag

SEQ ID NO: 23542 - DNA, 726 bp, Artificial Sequence
  Description of Artificial Sequence: Synthetic coding sequence
atgaagttcatcctgctgtgggccctgctgaacctgaccgtggccctggccttcaaccccgactacaccgtgagcagcacccccccctacctggtgtacctgaagagcgactacctgccctgcgccggcgtgctgatccaccccctgtgggtgatcaccgccgcccactgcaacctgcccaagctgagagtgatcctgggcgtgaccatccccgccgacagcaacgagaagcacctgcaggtgatcggctacgagaagatgatccaccacccccacttcagcgtgaccagcatcgaccacgacatcatgctgatcaagctgaagaccgaggccgagctgaacgactacgtgaagctggccaacctgccctaccagaccatcagcgagaacaccatgtgcagcgtgagcacctggagctacaacgtgtgcgacatctacaaggagcccgacagcctgcagaccgtgaacatcagcgtgatcagcaagccccagtgcagagacgcctacaagacctacaacatcaccgagaacatgctgtgcgtgggcatcgtgcccggcagaagacagccctgcaaggaggtgagcgccgcccccgccatctgcaacggcatgctgcagggcatcctgagcttcgccgacggctgcgtgctgagagccgacgtgggcatctacgccaagatcttctactacatcccctggatcgagaacgtgatccagaacaactag

SEQ ID NO: 23543 - DNA, 783 bp, Artificial Sequence
  Description of Artificial Sequence: Synthetic coding sequence
atgaccagacactggccctgggaggtgagcctgagaatggagaacgagcacgtgtgcggcggcgccctgatcgaccccagctgggtggtgaccgccgcccactgcatccagggcaccaaggagtacagcgtggtgctgggcaccagcaagctgcagcccatgaacttcagcagagccctgtgggtgcccgtgagagacatcatcatgcaccccaagtactggggcagagccttcatcatgggcgacgtggccctggtgcacctgcagacccccgtgaccttcagcgagtacgtgcagcccatctgcctgcccgagcccaacttcaacctgaaggtgggcacccagtgctgggtgaccggctggagccaggtgaagcagagattcagcgccaacagcatgctgacccccgagctgcaggaggccgaggtgttcatcatggacaacaagagatgcgacagacactacaagaagagcttcttcccccccgtggtgcccctggtgctgggcgacatgatctgcgccaccaactacggcgagaacctgtgctacggcgacagcggcggccccctggcctgcgaggtggagggcagatggatcctggccggcgtgctgagctgggagaaggcctgcgtgaaggcccagaaccccggcgtgtacaccagaatcaccaagtacaccaagtggatcaagaagcagatgagcaacggcgccttcagcggcccctgcgccagcgcctgcctgctgttcctgtgctggctgctgcagccccagatgggcagctag

SEQ ID NO: 23544 - DNA, 687 bp, Artificial Sequence
  Description of Artificial Sequence: Synthetic coding sequence
atgaccagacactggccctgggaggtgagcctgagaatggagaacgagcacgtgtgcggcggcgccctgatcgaccccagctgggtggtgaccgccgcccactgcatccagggcaccaaggagtacagcgtggtgctgggcaccagcaagctgcagcccatgaacttcagcagagccctgtgggtgcccgtgagagacatcatcatgcaccccaagtactggggcagagccttcatcatgggcgacgtggccctggtgcacctgcagacccccgtgaccttcagcagcaccgccaacagcatgctgacccccgagctgcaggaggccgaggtgttcatcatggacaacaagagatgcgacagacactacaagaagagcttcttcccccccgtggtgcccctggtgctgggcgacatgatctgcgccaccaactacggcgagaacctgtgctacggcgacagcggcggccccctggcctgcgaggtggagggcagatggatcctggccggcgtgctgagctgggagaaggcctgcgtgaaggcccagaaccccggcgtgtacaccagaatcaccaagtacaccaagtggatcaagaagcagatgagcaacggcgccttcagcggcccctgcgccagcgcctgcctgctgttcctgtgctggctgctgcagccccagatgggcagctag

SEQ ID NO: 23545 - DNA, 1179 bp, Artificial Sequence
  Description of Artificial Sequence: Synthetic coding sequence
atggccgcccccctgagaatccagagcgactgggcccaggccctgagaaaggacgagggcgaggcctggctgagctgccacccccccggcaagcccagcctgtacggcagcctgacctgccagggcatcggcctggacggcatccccgaggtgaccgccagcgagggcttcaccgtgaacgagatcaacaagaagagcatccacatcagctgccccaaggagaacgccagcagcaagttcctggccccctacaccaccttcagcagaatccacaccaagagcatcacctgcctggacatcagcagcagaggcggcctgggcgtgagcagcagcaccgacggcaccatgaagatctggcaggccagcaacggcgagctgagaagagtgctggagggccacgtgttcgacgtgaactgctgcagattcttccccagcggcctggtggtgctgagcggcggcatggacgcccagctgaagatctggagcgccgaggacgccagctgcgtggtgaccttcaagggccacaagggcggcatcctggacaccgccatcgtggacagaggcagaaacgtggtgagcgccagcagagacggcaccgccagactgtgggactgcggcagaagcgcctgcctgggcgtgctggccgactgcggcagcagcatcaacggcgtggccgtgggcgccgccgacaacagcatcaacctgggcagccccgagcagatgcccagcgagagagaggtgggcaccgaggccaagatgctgctgctggccagagaggacaagaagctgcagtgcctgggcctgcagagcagacagctggtgttcctgttcatcggcagcgacgccttcaactgctgcaccttcctgagcggcttcctgctgctggccggcacccaggacggcaacatctaccagctggacgtgagaagccccagagcccccgtgcaggtgatccacagaagcggcgcccccgtgctgagcctgctgagcgtgagagacggcttcatcgccagccagggcgacggcagctgcttcatcgtgcagcaggacctggactacgtgaccgagctgaccggcgccgactgcgaccccgtgtacaaggtggccacctgggagaagcagatctacacctgctgcagagacggcctggtgagaagataccagctgagcgacctgtag

SEQ ID NO: 23546 - DNA, 1128 bp, Artificial Sequence
  Description of Artificial Sequence: Synthetic coding sequence
atgctggtgccctgcttcctgtacagcctgcagaacagaaagcccagcctgtacggcagcctgacctgccagggcatcggcctggacggcatccccgaggtgaccgccagcgagggcttcaccgtgaacgagatcaacaagaagagcatccacatcagctgccccaaggagaacgccagcagcaagttcctggccccctacaccaccttcagcagaatccacaccaagagcatcacctgcctggacatcagcagcagaggcggcctgggcgtgagcagcagcaccgacggcaccatgaagatctggcaggccagcaacggcgagctgagaagagtgctggagggccacgtgttcgacgtgaactgctgcagattcttccccagcggcctggtggtgctgagcggcggcatggacgcccagctgaagatctggagcgccgaggacgccagctgcgtggtgaccttcaagggccacaagggcggcatcctggacaccgccatcgtggacagaggcagaaacgtggtgagcgccagcagagacggcaccgccagactgtgggactgcggcagaagcgcctgcctgggcgtgctggccgactgcggcagcagcatcaacggcgtggccgtgggcgccgccgacaacagcatcaacctgggcagccccgagcagatgcccagcgagagagaggtgggcaccgaggccaagatgctgctgctggccagagaggacaagaagctgcagtgcctgggcctgcagagcagacagctggtgttcctgttcatcggcagcgacgccttcaactgctgcaccttcctgagcggcttcctgctgctggccggcacccaggacggcaacatctaccagctggacgtgagaagccccagagcccccgtgcaggtgatccacagaagcggcgcccccgtgctgagcctgctgagcgtgagagacggcttcatcgccagccagggcgacggcagctgcttcatcgtgcagcaggacctggactacgtgaccgagctgaccggcgccgactgcgaccccgtgtacaaggtggccacctgggagaagcagatctacacctgctgcagagacggcctggtgagaagataccagctgagcgacctgtag

SEQ ID NO: 23547 - DNA, 714 bp, Artificial Sequence
  Description of Artificial Sequence: Synthetic coding sequence
atgctggtgccctgcttcctgtacagcctgcagaacagaaagcccagcctgtacggcagcctgacctgccagggcatcggcctggacggcatccccgaggtgaccgccagcgagggcttcaccgtgaacgagatcaacaagaagagcatccacatcagctgccccaaggagaacgccagcagcaagttcctggccccctacaccaccttcagcagaatccacaccaagagcatcacctgcctggacatcagcagcagaggcggcctgggcgtgagcagcagcaccgacggcaccatgaagatctggcaggccagcaacggcgagctgagaagagtgctggagggccacgtgttcgacgtgaactgctgcagattcttccccagcggcctggtggtgctgagcggcggcatggacgcccagctgaagatctggagcgccgaggacgccagctgcgtggtgaccttcaagggccacaagggcggcatcctggacaccgccatcgtggacagaggcagaaacgtggtgagcgccagcagagacggcaccgccagactgtgggactgcggcagaagcgcctgcctgggcgtgctggccgactgcggcagcagcatcaacggcgtggccgtgggcgccgccgacaacagcatcaacctgggcagccccgagcagatgcccagcgagagagaggtgggcaccgaggccaagatgctgtag

SEQ ID NO: 23548 - DNA, 1128 bp, Artificial Sequence; identical to SEQ ID NO: 23546
  Description of Artificial Sequence: Synthetic coding sequence

SEQ ID NO: 23549 - DNA, 744 bp, Artificial Sequence
  Description of Artificial Sequence: Synthetic coding sequence
atgctggtgccctgcttcctgtacagcctgcagaacagaaagcccagcctgtacggcagcctgacctgccagggcatcggcctggacggcatccccgaggtgaccgccagcgagggcttcaccgtgaacgagatcaacaagaagagcatccacatcagctgccccaaggagaacgccagcagcaagttcctggccccctacaccaccttcagcagaatccacaccaagagcatcacctgcctggacatcagcagcagaggcggcctgggcgtgagcagcagcaccgacggcaccatgaagatctggcaggccagcaacggcgagctgagaagagtgctggagggccacgtgttcgacgtgaactgctgcagattcttccccagcggcctggtggtgctgagcggcggcatggacgcccagctgaagatctggagcgccgaggacgccagctgcgtggtgaccttcaagggccacaagggcggcatcctggacaccgccatcgtggacagaggcagaaacgtggtgagcgccagcagagacggcaccgccagactgtgggactgcggcagaagcgcctgcctgggcgtgctggccgactgcggcagcagcatcaacggcgtggccgtgggcgccgccgacaacagcatcaacctgggcagccccgagcagatgcccagcgagagagaggtgggcaccgaggccaagatgctgctgctggccagagaggacaagaagctgcagtag

SEQ ID NO: 23550 - DNA, 1128 bp, Artificial Sequence; identical to SEQ ID NO: 23546
  Description of Artificial Sequence: Synthetic coding sequence

SEQ ID NO: 23551 - DNA, 1566 bp, Artificial Sequence
  Description of Artificial Sequence: Synthetic coding sequence
atgaagcaggagggcagcgccagaagaagaggcgccgacaaggccaagcccccccccgaggacgtggagatgaaggaggaggccgccaccggcggcggcagcaccggcgaggccgacggcaagaccgccgccgccgccgccgagcacagccagagagagctggacaccgtgaccctggaggacatcaaggagcacgtgaagcagctggagaaggccgtgagcggcaaggagcccagattcgtgctgagagccctgagaatgctgcccagcaccagcagaagactgaaccactacgtgctgtacaaggccgtgcagggcttcttcaccagcaacaacgccaccagagacttcctgctgcccttcctggaggagcccatggacaccgaggccgacctgcagttcagacccagaaccggcaaggccgccagcacccccctgctgcccgaggtggaggcctacctgcagctgctggtggtgatcttcatgatgaacagcaagagatacaaggaggcccagaagatcagcgacgacctgatgcagaagatcagcacccagaacagaagagccctggacctggtggccgccaagtgctactactaccacgccagagtgtacgagttcctggacaagctggacgtggtgagaagcttcctgcacgccagactgagaaccgccaccctgagacacgacgccgacggccaggccaccctgctgaacctgctgctgagaaactacctgcactacagcctgtacgaccaggccgagaagctggtgagcaagagcgtgttccccgagcaggccaacaacaacgagtgggccagatacctgtactacaccggcagaatcaaggccatccagctggagtacagcgaggccagaagaaccatgaccaacgccctgagaaaggccccccagcacaccgccgtgggcttcaagcagaccgtgcacaagctgctgatcgtggtggagctgctgctgggcgagatccccgacagactgcagttcagacagcccagcctgaagagaagcctgatgccctacttcctgctgacccaggccgtgagaaccggcaacctggccaagttcaaccaggtgctggaccagttcggcgagaagttccaggccgacggcacctacaccctgatcatcagactgagacacaacgtgatcaagaccggcgtgagaatgatcagcctgagctacagcagaatcagcctggccgacatcgcccagaagctgcagctggacagccccgaggacgccgagttcatcgtggccaaggccatcagagacggcgtgatcgaggccagcatcaaccacgagaagggctacgtgcagagcaaggagatgatcgacatctacagcaccagagagccccagctggccttccaccagagaatcagcttctgcctggacatccacaacatgagcgtgaaggccatgagattcccccccaagagctacaacaaggacctggagagcgccgaggagagaagagagagagagcagcaggacctggagttcgccaaggagatggccgaggacgacgacgacagcttcccctag

SEQ ID NO: 23552 - DNA, 348 bp, Artificial Sequence
  Description of Artificial Sequence: Synthetic coding sequence
ctgaccagccccagaagctgcagctggatcgcccccaagatgcagagcagcctgctggcccaggccatcagagacggcgtgatcgaggccagcatcaaccacgagaagggctacgtgcagagcaaggagatgatcgacatctacagcaccagagagccccagctggccttccaccagagaatcagcttctgcctggacatccacaacatgagcgtgaaggccatgagattcccccccaagagctacaacaaggacctggagagcgccgaggagagaagagagagagagcagcaggacctggagttcgccaaggagatggccgaggacgacgacgacagcttcccctag

SEQ ID NO: 23553 - DNA, 1071 bp, Artificial Sequence
  Description of Artificial Sequence: Synthetic coding sequence
atggacaccgaggccgacctgcagttcagacccagaaccggcaaggccgccagcacccccctgctgcccgaggtggaggcctacctgcagctgctggtggtgatcttcatgatgaacagcaagagatacaaggaggcccagaagatcagcgacgacctgatgcagaagatcagcacccagaacagaagagccctggacctggtggccgccaagtgctactactaccacgccagagtgtacgagttcctggacaagctggacgtggtgagaagcttcctgcacgccagactgagaaccgccaccctgagacacgacgccgacggccaggccaccctgctgaacctgctgctgagaaactacctgcactacagcctgtacgaccaggccgagaagctggtgagcaagagcgtgttccccgagcaggccaacaacaacgagtgggccagatacctgtactacaccggcagaatcaaggccatccagctggagtacagcgaggccagaagaaccatgaccaacgccctgagaaaggccccccagcacaccgccgtgggcttcaagcagaccgtgcacaagctgctgatcgtggtggagctgctgctgggcgagatccccgacagactgcagttcagacagcccagcctgaagagaagcctgatgccctacttcctgctgacccaggccgtgagaaccggcaacctggccaagttcaaccaggtgctggaccagttcggcgagaagttccaggccgacggcacctacaccctgatcatcagactgagacacaacgtgatcaagaccggcgtgagaatgatcagcctgagctacagcagaatcagcctggccgacatcgcccagaagctgcagctggacagccccgaggacgccgagttcatcgtggccaaggccatcagagacggcgtgatcgaggccagcatcaaccacgagaagggctacgtgcagagcaaggagatgatcgacatctacagcaccagagagccccagctggccttccaccagagaatcagcttctgcctggacatccacaacatgagcgtgaagggctggtag

SEQ ID NO: 23554 - DNA, 369 bp, Artificial Sequence
  Description of Artificial Sequence: Synthetic coding sequence
atggaggacacccccctggtgatcagcaagcagaagaccgaggtggtgtgcggcgtgcccacccaggtggtgtgcaccgccttcagcagccacatcctggtggtggtgacccagttcggcaagatgggcaccctggtgagcctggagcccagcagcgtggccagcgacgtgagcaagcccgtgctgaccaccaaggtgctgctgggccaggacgagcccctgatccacgtgttcgccaagaacctggtggccttcgtgagccaggaggccggcaacagagccgtgctgctggccgtggccgtgaaggacaagagcatggagggcctgaaggccctgagagaggtgatcagagtgtgccaggtgtggtag

SEQ ID NO: 23555 - DNA, 369 bp, Artificial Sequence; identical to SEQ ID NO: 23554
  Description of Artificial Sequence: Synthetic coding sequence

SEQ ID NO: 23556 - DNA, 369 bp, Artificial Sequence; identical to SEQ ID NO: 23554
  Description of Artificial Sequence: Synthetic coding sequence

SEQ ID NO: 23557 - DNA, 489 bp, Artificial Sequence
  Description of Artificial Sequence: Synthetic coding sequence
atggagggcctggtggtggccgccggcggcgacgtgagcctgcacaacttcagcgccagactgtgggagcagctggtgcacttccacgtgatgagactgaccgacagcctgttcctgtgggtgggcgccaccccccacctgagaaacctggccgtggccatgtgcagcagatacgacagcatccccgtgagcaccagcctgctgggcgacaccagcgacaccaccagcaccggcctggcccagagactgggcctgggcggcaagaccggcctggcctgcgagtgcggcgtggagtggggcctgagcaagggccacgaggccgagtgcagcaccctgcccaccccccagcacaccagctgcggccccgccagaaagaccaacaagcaggtgttcgtgagctacaacctgcagaacaccgacagcaacttcgccctgctggtggagaacagaatcaaggaggagatggaggccttccccgagaagttctag

SEQ ID NO: 23558 - DNA, 372 bp, Artificial Sequence
  Description of Artificial Sequence: Synthetic coding sequence
atggagggcctggtggtggccgccggcggcgacgtgagcctgcacaacttcagcgccagactgtgggagcagctggtgcacttccacgtgatgagactgaccgacagcctgttcctgtgggtgggcgccaccccccacctgagaaacctggccgtggccatgtgcagcagatacgacagcatccccgtgagcaccagcctgctgggcgacaccagcgacaccaccagcaccggcctggcccagagactggccagaaagaccaacaagcaggtgttcgtgagctacaacctgcagaacaccgacagcaacttcgccctgctggtggagaacagaatcaaggaggagatggaggccttccccgagaagttctag

SEQ ID NO: 23559 - DNA, 315 bp, Artificial Sequence
  Description of Artificial Sequence: Synthetic coding sequence
atggagggcctggtggtggccgccggcggcgacgtgagcctgcacaacttcagcgccagactgtgggagcagctggtgcacttccacgtgatgagactgaccgacagcctgttcctgtgggtgggcgccaccccccacctgagaaacctggccgtggccatgtgcagcagatacgacagcatccccgtgagcaccagcctgctgggcgacaccagcgacaccaccagcaccggcctggcccagagactgggcatgtacccccagctggccctgcacggccagcccggcggcgcccacagcctgatggagccctag

SEQ ID NO: 23560 - DNA, 639 bp, Artificial Sequence
  Description of Artificial Sequence: Synthetic coding sequence
atggccagcagatacgacagagccatcaccgtgttcagccccgacggccacctgttccaggtggagtacgcccaggaggccgtgaagaagggcagcaccgccgtgggcatcagaggcctgaccgccgacgccagagtggtgatcaacagagccagagtggagtgccagagccacaagctgaccgtggaggaccccgtgaccgtggagtacatcaccagattcatcgccaccctgaagcagaagtacacccagagcaacggcagaagacccttcggcatcagcgccctgatcgtgggcttcgacgacgacggcatcagcagactgtaccagaccgaccccagcggcacctaccacgcctggaaggccaacgccatcggcagaagcgccaagaccgtgagagagttcctggagaagaactacaccgaggacgccatcgccagcgacagcgaggccatcaagctggccatcaaggccctgctggaggtggtgcagagcggcggcaagaacatcgagctggccatcatcagaagaaaccagcccctgaagatgttcagcgccaaggaggtggagctgtacgtgaccgagatcgagaaggagaaggaggaggccgagaagaagaagagcaagaagagcgtgtag

SEQ ID NO: 23561 - DNA, 753 bp, Artificial Sequence
  Description of Artificial Sequence: Synthetic coding sequence
atggccagcagatacgacagagccatcaccgtgttcagccccgacggccacctgttccaggtggagtacgcccaggaggccgtgaagaagggcagcaccgccgtgggcatcagaggcaccaacatcgtggtgctgggcgtggagaagaagagcgtggccaagctgcaggacgagagaaccgtgagaaagatctgcgccctggacgaccacgtgtgcatggccttcgccggcctgaccgccgacgccagagtggtgatcaacagagccagagtggagtgccagagccacaagctgaccgtggaggaccccgtgaccgtggagtacatcaccagattcatcgccaccctgaagcagaagtacacccagagcaacggcagaagacccttcggcatcagcgccctgatcgtgggcttcgacgacgacggcatcagcagactgtaccagaccgaccccagcggcacctaccacgcctggaaggccaacgccatcggcagaagcgccaagaccgtgagagagttcctggagaagaactacaccgaggacgccatcgccagcgacagcgaggccatcaagctggccatcaaggccctgctggaggtggtgcagagcggcggcaagaacatcgagctggccatcatcagaagaaaccagcccctgaagatgttcagcgccaaggaggtggagctgtacgtgaccgagatcgagaaggagaaggaggaggccgagaagaagaagagcaagaagagcgtgtag

SEQ ID NO: 23562 - DNA, 639 bp, Artificial Sequence
  Description of Artificial Sequence: Synthetic coding sequence
atggccagcagatacgacagagccatcaccgtgttcagccccgacggccacctgttccaggtggagtacgcccaggaggccgtgaagaagggcagcaccgccgtgatcttcatcggcctgaccgccgacgccagagtggtgatcaacagagccagagtggagtgccagagccacaagctgaccgtggaggaccccgtgaccgtggagtacatcaccagattcatcgccaccctgaagcagaagtacacccagagcaacggcagaagacccttcggcatcagcgccctgatcgtgggcttcgacgacgacggcatcagcagactgtaccagaccgaccccagcggcacctaccacgcctggaaggccaacgccatcggcagaagcgccaagaccgtgagagagttcctggagaagaactacaccgaggacgccatcgccagcgacagcgaggccatcaagctggccatcaaggccctgctggaggtggtgcagagcggcggcaagaacatcgagctggccatcatcagaagaaaccagcccctgaagatgttcagcgccaaggaggtggagctgtacgtgaccgagatcgagaaggagaaggaggaggccgagaagaagaagagcaagaagagcgtgtag

SEQ ID NO: 23563 - DNA, 636 bp, Artificial Sequence
  Description of Artificial Sequence: Synthetic coding sequence
atggacgtgtgcaccttcgagaaggtgggcatcagaggcaccaacatcgtggtgctgggcgtggagaagaagagcgtggccaagctgcaggacgagagaaccgtgagaaagatctgcgccctggacgaccacgtgtgcatggccttcgccggcctgaccgccgacgccagagtggtgatcaacagagccagagtggagtgccagagccacaagctgaccgtggaggaccccgtgaccgtggagtacatcaccagattcatcgccaccctgaagcagaagtacacccagagcaacggcagaagacccttcggcatcagcgccctgatcgtgggcttcgacgacgacggcatcagcagactgtaccagaccgaccccagcggcacctaccacgcctggaaggccaacgccatcggcagaagcgccaagaccgtgagagagttcctggagaagaactacaccgaggacgccatcgccagcgacagcgaggccatcaagctggccatcaaggccctgctggaggtggtgcagagcggcggcaagaacatcgagctggccatcatcagaagaaaccagcccctgaagatgttcagcgccaaggaggtggagctgtacgtgaccgagatcgagaaggagtag

SEQ ID NO: 23564 - DNA, 1632 bp, Artificial Sequence
  Description of Artificial Sequence: Synthetic coding sequence
atgaactgcctggagggccccggcaagacctgcggccccctggccagcgaggaggagctggtgagcgcctgccagctggagaaggaggaggagaacgagggcgaggaggaggaggaggaggaggacgaggaggacctggaccccgacctggaccccgacctggaggaggaggagaacgacctgggcgaccccgccgtgctgggcgccgtgcacaacacccagagagccctgctgagcagccccggcgtgaaggcccccggcatgctgggcatgagcctggccagcctgcacttcctgtggcagaccctggactacctgagccccatccccttctggcccaccttccccagcaccagcagccccgcccagcacttcggccccagactgcccagccccgaccccaccctgttctgcagcctgctgaccagctggccccccagattcagccacctgacccagctgcaccccagacaccagagaatcctgcagcagcagcagcacagccagacccccagcccccccgccaagaagccctggagccagcagcccgacccctacgccaacctgatgaccagaaaggagaaggactgggtgatcaaggtgcagatggtgcagctgcagagcgccaagcccagactggacgactactactaccaggagtactaccagaagctggagaagaagcaggccgacgaggagctgctgggcagaagaaacagagtggagagcctgaagctggtgaccccctacatccccaaggccgaggcctacgagagcgtggtgagaatcgagggcagcctgggccaggtggccgtgagcacctgcttcagccccagaagagccatcgacgccgtgccccacggcacccaggagcaggacatcgaggccgccagcagccagagactgagagtgctgtacagaatcgagaagatgttcctgcagctgctggagatcgaggagggctggaagtacagacccccccccccctgcttcagcgagcagcagagcaaccaggtggagaagctgttccagaccctgaagacccaggagcagaacaacctggaggaggccgccgacggcttcctgcaggtgctgagcgtgagaaagggcaaggccctggtggccagactgctgcccttcctgccccaggaccaggccgtgaccatcctgctggccatcacccaccacctgcccctgctggtgagaagagacgtggccgaccaggccctgcagatgctgttcaagcccctgggcaagtgcatcagccacctgaccctgcacgagctgctgcagggcctgcagggcctgaccctgctgccccccggcagcagcgagagacccgtgaccgtggtgctgcagaaccagttcggcatcagcctgctgtacgccctgctgagccacggcgagcagctggtgagcctgcacagcagcctggaggagcccaacagcgaccacaccgcctggaccgacatggtggtgctgatcgcctgggagatcgcccagatgcccaccgccagcctggccgagcccctggccttccccagcaacctgctgcccctgttctgccaccacgtggacaagcagctggtgcagcagctggaggccagaatggagttcgcctggatctactag

SEQ ID NO: 23565 - DNA, 1632 bp, Artificial Sequence; identical to SEQ ID NO: 23564
  Description of Artificial Sequence: Synthetic coding sequence

SEQ ID NO: 23566 - DNA, 6708 bp, Artificial Sequence
  Description of Artificial Sequence: Synthetic coding sequence
atgcccctgttcttcagcgccctgctggtgctgctgctggtggccctgagcgccctgttcctgggcagatggctggtggtgagactggccaccaagtggtgccagagaaagctgcaggccgagctgaagatcggcagcttcagattcttctggatccagaacgtgagcctgaagttccagcagcaccagcagaccgtggagatcgacaacctgtggatcagcagcaagctgctgagccacgacctgccccactacgtggccctgtgcttcggcgaggtgagaatcagaaccgacctgcagaaggtgagcgacctgagcgcccccttcagccagagcgccggcgtggaccagaaggagctgagcttcagccccagcctgctgaagatcttctgccagctgttcagcatccacgtggacgccatcaacatcatggtgctgaaggtggacaccagcgagagcctgtggcacatccagatcagcagaagcagattcctgctggacagcgacggcaagagactgatctgcgaggtgagcctgtgcaagatcaacagcaaggtgctgaagagcggccagctggaggacacctgcctggtggagctgagcctggccctggacctgtgcctgaaggtgggcatcagcagcagacacctgaccgccatcaccgtggacgtgtggaccctgcacgccgagctgcacgagggcctgttccagagccagctgctgtgccagggccccagcctggccagcaagcccgtgccctgcagcgaggtgaccgagaacctggtggagcccaccctgcccggcctgttcctgctgcagcagctgcccgaccaggtgaaggtgaagatggagaacaccagcgtggtgctgagcatgaacagccagaagagacacctgacctggaccctgaagctgctgcagttcctgtaccacagagacgaggaccagctgcccctgagaagcttcaccgccaacagcgacatggcccagatgagcaccgagctgctgctggaggacggcctgctgctgagccagagcagacagagaatcgtgtgcctgaacagcctgaaggccagcgtgcaggtgaccaccatcgacctgagcgccagcctggtgctgaacacctgcatcatccactacagacaccaggagttcagccactggctgcacctgctggccctggagacccagggcagcagcagccccgtgctgaagcagagaaagaagagaaccttcccccagatcctggcccccatcatcttcagcaccagcatcagcaacgtgaacatcagcatccagctgggcgacaccccccccttcgccctgggcttcaacagcatcagcctggactaccagcacctgagaccccagagcatccaccagagaggcgtgctgaccgtggaccacctgtgctggagagtgggcagcgacagccacatccagagagccccccacccccccaacatgcacgtgtggggcgaggccctggtgctggacagcttcaccctgcagggcagctacaaccagcccctgggcctgagcagcacccagagcgacaccctgttcctggactgcaccatcagaggcctgcaggtggaggccagcgacacctgcgcccagtgcctgagcagaatcctgagcctgatgggcccccagagcggcaagagcgccgtgagcagacacagcagcttcggcgagagcgtgagcctgctgtggaaggtggacctgaaggtggaggacatgaacctgttcaccctgagcgccctggtgggcgccagcgaggtgagactggacaccctgaccatcctgggcagcgccgagaccagcaccgtgggcatccagggcctggtgctggccctggtgaagagcgtgaccgagaagatgcagccctgctgcaaggcccccgacatccccacccccgtgctgagcctgagcatgctgagcatcacctaccacagcagcatcagaagcctggaggtgcagtgcggcgccggcctgaccctgctgtggagcccccccgaccacatgtacctgtaccagcacgtgctggccaccctgcagtgcagagacctgctgagagccaccgtgttccccgagaccgtgcccagcctggccctggagaccagcggcaccaccagcgagctggagggcagagcccccgagcccctgccccccaagagactgctgaacctgaccctggaggtgagcaccgccaagctgaccgccttcgtggccgaggacaagttcatcaccctggccgccgagagcgtgagcctgagcagacacggcggcagcctgcaggcctactgccccgagctggccgccggcttcgacggcaacagcatcttcaacttcaaggaggtggaggtgcagctgctgcccgagctggaggagatgatcctgcacagaaaccccttccccgccctgcagaccctgagaaacagagtgtggctgctgagcttcggcagcgtgagcgtggagttcccctaccagtacgacttcagcagaaccctggacgaggccgtgggcgtgcagaagtggctgaagggcctgcaccagggcaccagagcctgggccagccccagccccgtgcccctgccccccgacctgctgctgaaggtggagcacttcagctgggtgttcctggacgacgtgttcgaggtgaagctgcacgacaactacgagctgatgaaggacgagagcaaggagagcgccaagagactgcagctgctggacgccaaggtggccgccctgagaaagcagcacggcgagctgctgcccgccagaaagatcgaggagctgtacgccagcctggagagaaagaacatcgagatctacatccagagaagcagaagactgtacggcaacacccccatgagaagagccctgctgacctggagcctggccggcctggagctggtggccctggccgacgccagcttccacggccccgagcacgtggtggagcaggtgcaggagctggaccccggcagccccttcccccccgagggcctggacctggtgatccagtggtgcagaatgctgaagtgcaacgtgaagagcttcctggtgagaatcagagactaccccagatacctgttcgagatcagagactggagactgatgggcagactggtgggcaccgagcagagcggccagccctgcagcagaagaagacagatcctgcacctgggcctgccctggggcaacgtggccgtggagagaaacatgccccccctgaagttctaccacgacttccacagcgagatcttccagtacaccgtggtgtggggcccctgctgggaccccgcctggaccctgatcggccagtgcgtggacctgctgaccaagcccagcgccgaccccagcccccccctgccctggtgggacaagagcagactgctgttccacggcgactggcacatggacatcgagcaggccaacctgcaccagctggccaccgaggacccctacaacaccaccgagaacatgcactgggagtggagccacctgagcttccactggaagcccggccagttcgtgttcaagggcgacctggacatcaacgtgagaaccgccagcaagtacgacgactgctgcttcctgcacctgcccgacctgtgcatgaccctggacctgcagtggctgtgccacggcaacccccacgaccaccacagcgtgaccctgagagcccccgagttcctgcccgaggtgcccctgggccagctgcacgacagctacagagccttcagaagcgagaacctgaacctgagcatcaagatggacctgaccagacacagcggcaccatcagccagcccagaatcctgctgtacagcagcaccctgagatggatgcagaacttctgggccacctggaccagcgtgaccagacccatctgcagaggcaagctgttcaacaacctgaagcccagcaagaagaagctgggccagcactacaagcagctgagctacaccgccctgttcccccagctgcaggtgcactactgggccagcttcgcccagcagagaggcatccagatcgagtgcagccagggccacgtgttcaccagaggcacccagagactgatcccccaggccggcaccgtgatgagaagactgatcagcgactggagcgtgacccagatggtgagcgacctgagccaggtgaccgtgcacctgatggccagccccaccgaggagaacgccgaccactgcctggaccccctggtgaccaagacccacctgctgagcctgagcagcctgacctaccagagacacagcaacagaaccgccgaggaggagctgagcgccagagacggcgaccccaccttccacacccaccagctgcacctggtggacctgagaatcagctggaccaccaccaacagagacatcgccttcggcctgtacgacggctacaagaaggccgccgtgctgaagagaaacctgagcaccgaggccctgaagggcctgaagatcgacccccagatgcccgccaagaagcccaagagaggcgtgcccaccagcgccagcgccccccccagagtgaacacccccagcttcagcggccagcccgacaagggcagcagcggcggcgcctacatgctgcagaagctgatcgaggagaccgacagattcgtggtgttcaccgaggaggagagcggcatgagcgaccagctgtgcggcatcgccgcctgccagaccgacgacatctacaacagaaactgcctgatcgagctggtgaactgccagatggtgctgagaggcgccgagaccgagggctgcgtgatcgtgagcgccgccaaggcccagctgctgcagtgccagcaccaccccgcctggtacggcgacaccctgaagcagaagaccagctggacctgcctgctggacggcatgcagtacttcgccaccaccgagagcagccccaccgagcaggacggcagacagctgtggctggaggtgaagaacatcgaggagcacagacagagaagcctggacagcgtgcaggagctgatggagagcggccaggccgtgggcggcatggtgaccaccaccaccgactggaaccagcccgccgaggcccagcaggcccagcaggtgcagagaatcatcagcagatgcaactgcagaatgtactacatcagctacagccacgacatcgaccccgagctggccacccagatcaagccccccgaggtgctggagaaccaggagaaggaggacctgctgaagaagcaggagggcgccgtggacaccttcaccctgatccaccacgagctggagatcagcaccaaccccgcccagtacgccatgatcctggacatcgtgaacaacctgctgctgcacgtggagcccaagagaaaggagcacagcgagaagaagcagagagtgagattccagctggagatcagcagcaaccccgaggagcagagaagcagcatcctgcacctgcaggaggccgtgagacagcacgtggcccagatcagacagctggagaagcagatgtacagcatcatgaagagcctgcaggacgacagcaagaacgagaacctgctggacctgaaccagaagctgcagctgcagctgaaccaggagaaggccaacctgcagctggagagcgaggagctgaacatcctgatcagatgcttcaaggacttccagctgcagagagccaacaagatggagctgagaaagcagcaggaggacgtgagcgtggtgagaagaaccgagttctacttcgcccaggccagatggagactgaccgaggaggacggccagctgggcatcgccgagctggagctgcagagattcctgtacagcaaggtgaacaagagcgacgacaccgccgagcacctgctggagctgggctggttcaccatgaacaacctgctgcccaacgccgtgtacaaggtggtgctgagaccccagagcagctgccagagcggcagacagctggccctgagactgttcagcaaggtgagaccccccgtgggcggcatcagcgtgaaggagcacttcgaggtgaacgtggtgcccctgaccatccagctgacccaccagttcttccacagaatgatgggcttcttcttccccggcagaagcgtggaggacgacgaggtgggcgacgaggaggacaagagcaagctggtgaccaccggcatccccgtggtgaagcccagacagctgatcgccaccgacgacgccgtgcccctgggccccggcaagggcgtggcccagggcctgaccagaagcagcggcgtgagaagaagcttcagaaagagccccgagcaccccgtggacgacatcgacaagatgaaggagagagccgccatgaacaacagcttcatctacatcaagatcccccaggtgcccctgtgcgtgagctacaagggcgagaagaacagcgtggactggggcgacctgaacctggtgctgccctgcctggagtaccacaacaacacctggacctggctggacttcgccatggccgtgaagagagacagcagaaaggccctggtggcccaggtgatcaaggagaagctgagactgaagagcgccaccggcagcgaggtgagaggcaagctggagaccaagagcgacctgaacatgcagcagcaggaggaggaggagaaggccagactgctgatcggcctgagcgtgggcgacaagaaccccggcaagaagagcatcttcggcagaagaaagtag

SEQ ID NO: 23567 - DNA, 417 bp, Artificial Sequence
  Description of Artificial Sequence: Synthetic coding sequence
atggaggcctgggagagcagccagcccctgctgagatgcgagatcccctgccccctgcccggcaccgacagagacggcagcgtgagcctgcccggcgaggccgccagctgcgacctggacaccctggagcccgagcacggcaacagaagagtgagcggcaaccccatcagcgtgtgctgggcctacaaggtgaccaaggtgaagtgctggagcgtgagagagagaggcggcagacacatcggcggccccagaaacaccctgaagcaccccgcccaccacggcatgggcaagaacctggccaccagcctgcccaccgccgccagcctgggcctgggcaagggccagctgctggtgagcatcagattcatggacaccaccaagaagagaggccagagcgagaccttcaacatctgctag

SEQ ID NO: 23568 - DNA, 1203 bp, Artificial Sequence
  Description of Artificial Sequence: Synthetic coding sequence
atgggcgtgctgatgagcaagagacagaccgtggagcaggtgcagaaggtgagcctggccgtgagcgccttcaaggacggcctgagagacagacccagcatcagaagaaccggcgagctgcccggcagcagaagaggcaccgtggagggcagcgtgcaggaggtgcaggaggagaaggaggccgaggccggcaccagcgtggtgcaggaggagagcagcgccggcagagccgcctgggagagactgagagacggcagaggcgtggagcccgaggagttcgacagaaccagcagattcaccccccccgccttcatcagacccaccagaaagctggacgacgacaagccccccgagatctgcctggagcccagagagcccgtggtgaacgacgagatgtgcgacgtgtgcgaggtgtggaccgccgagagcctgttcccctgcagagtgtgcaccagagtgttccacgacggctgcctgagaagaatgggctacatccagggcgacagcgccgccgaggtgaccgagatggcccacaccgagaccggctggagctgccactactgcgacaacatcaacctgctgctgaccgaggaggagatgtacagcctgaccgagaccttccagagatgcaaggtgatccccgactgcagcctgaccctggaggacttcctgagatacagacaccaggccgccaagagaggcgacagagacagagccctgagcgaggagcaggaggagcaggccgccagacagttcgccgccctggaccccgagcacagaggccacatcgagtggcccgacttcctgagccacgagagcctgctgctgctgcagcagctgagaccccagaacagcctgctgagactgctgaccgtgaaggagagagagagagccagagccgccttcctggccagaggcagcggcagcaccgtgagcgaggccgagtgcagaagagcccagcacagctggttctgcaagagattccccgaggcccccagctgcagcgtgagcatcagccacgtgggccccatcgccgacagcagccccgccagcagcagcagcaagagccaggacaagaccctgctgcccaccgagcaggagagcagattcgtggactggcccaccttcctgcaggagaacgtgctgtacatcctggccgccagacccaacagcgccgccatccacctgaagccccccggctag

SEQ ID NO: 23569 - DNA, 1230 bp, Artificial Sequence
  Description of Artificial Sequence: Synthetic coding sequence
atgggcagccaggccgccgccgagtggagaaactgggccagctgggaggtgagcagcagcctgagcggctgcagcatgggctgcttcaaggacgacagaatcgtgttctggacctggatgttcagcacctacttcatggagaagtgggcccccagacaggacgacatgctgttctacgtgagaagaaagctggcctacagcggcagcgagagcggcgccgacggcagaaaggccgccgagcccgaggtggaggtggaggtgtacagaagagacagcaagaagctgcccggcctgggcgaccccgacatcgactgggaggagagcgtgtgcctgaacctgatcctgcagaagctggactacatggtgacctgcgccgtgtgcaccagagccgacggcggcgacatccacatccacaagaagaagagccagcaggtgttcgccagccccagcaagcaccccatggacagcaagggcgaggagagcaagatcagctaccccaacatcttcttcatgatcgacagcttcgaggaggtgttcagcgacatgaccgtgggcgagggcgagatggtgtgcgtggagctggtggccagcgacaagaccaacaccttccagggcgtgatcttccagggcagcatcagatacgaggccctgaagaaggtgtacgacaacagagtgagcgtggccgccagaatggcccagaagatgagcttcggcttctacaagtacagcaacatggagttcgtgagaatgaagggcccccagggcaagggccacgccgagatggccgtgagcagagtgagcaccggcgacaccagcccctgcggcaccgaggaggacagcagccccgccagccccatgcacgagagagtgaccagcttcagcaccccccccacccccgagagaaacaacagacccgccttcttcagccccagcctgaagagaaaggtgcccagaaacagaatcgccgagatgaagaagagccacagcgccaacgacagcgaggagttcttcagagaggacgacggcggcgccgacctgcacaacgccaccaacctgagaagcagaagcctgagcggcaccggcagaagcctggtgggcagctggctgaagctgaacagagccgacggcaacttcctgctgtacgcccacctgacctacgtgaccctgcccctgcacagaatcctgaccgacatcctggaggtgagacagaagcccatcctgatgacctag

SEQ ID NO: 23570 - DNA, 333 bp, Artificial Sequence
  Description of Artificial Sequence: Synthetic coding sequence
ggcgccagaagccccggcagcacccaccagggcagcctggccagcggcgtgctgcccatcaagtgcagccacgtggagttcggcatgtggaagggcggcagaagccaccccttcctgccccacagcagcagatgcgccggcagcggcggccagctggacagcatcctgccccaccagagccccgcctggggcccctggggctgcaaggacctgagcagcggcttccccagcttcctgaccagcagcatcctgtggaagagcgccgtggtgagagagccccacatcagcccccaccaggcccccccctacaagaccagcgactgcatcatgtag

SEQ ID NO: 23571 - DNA, 3753 bp, Artificial Sequence
  Description of Artificial Sequence: Synthetic coding sequence
atggccgccatggcccccggcggcagcggcagcggcggcggcgtgaaccccttcctgagcgacagcgacgaggacgacgacgaggtggccgccaccgaggagagaagagccgtgctgagactgggcgccggcagcggcctggaccccggcagcgccggcagcctgagcccccaggaccccgtggccctgggcagcagcgccagacccggcctgcccggcgaggccagcgccgccgccgtggccctgggcggcaccggcgagacccccgccagactgagcatcgacgccatcgccgcccagctgctgagagaccagtacctgctgaccgccctggagctgcacaccgagctgctggagagcggcagagagctgcccagactgagagactacttcagcaaccccggcaacttcgagagacagagcggcaccccccccggcatgggcgcccccggcgtgcccggcgccgccggcgtgggcggcgccggcggcagagagcccagcaccgccagcggcggcggccagctgaacagagccggcagcatcagcaccctggacagcctggacttcgccagatacagcgacgacggcaacagagagaccgacgagaaggtggccgtgctggagttcgagctgagaaaggccaaggagaccatccaggccctgagagccaacctgaccaaggccgccgagcacgaggtgcccctgcaggagagaaagaactacaagagcagccccgagatccaggagcccatcaagcccctggagaagagagccctgaacttcctggtgaacgagttcctgctgaagaacaactacaagctgaccagcatcaccttcagcgacgagaacgacgaccaggacttcgagctgtgggacgacgtgggcctgaacatccccaagccccccgacctgctgcagctgtacagagacttcggcaaccaccaggtgaccggcaaggacctggtggacgtggccagcggcgtggaggaggacgagctggaggccctgacccccatcatcagcaacctgccccccaccctggagaccccccagcccgccgagaacagcatgctggtgcagaagctggaggacaagatcagcctgctgaacagcgagaagtggagcctgatggagcagatcagaagactgaagagcgagatggacttcctgaagaacgagcacttcgccatccccgccgtgtgcgacagcgtgcagccccccctggaccagctgccccacaaggacagcgaggacagcggccagcaccccgacgtgaacagcagcgacaagggcaagaacaccgacatccacctgagcatcagcgacgaggccgacagcaccatccccaaggagaacagccccaacagcttccccagaagagagagagagggcatgccccccagcagcctgagcagcaagaagaccgtgcacttcgacaagcccaacagaaagctgagccccgccttccaccaggccctgctgagcttctgcagaatgagcgccgacagcagactgggctacgaggtgagcagaatcgccgacagcgagaagagcgtgatgctgatgctgggcagatgcctgccccacatcgtgcccaacgtgctgctggccaagagagaggagctgatccccctgatcctgtgcaccgcctgcctgcaccccgagcccaaggagagagaccagctgctgcacatcctgttcaacctgatcaagagacccgacgacgagcagagacagatgatcctgaccggctgcgtggccttcgccagacacgtgggccccaccagagtggaggccgagctgctgccccagtgctgggagcagatcaaccacaagtaccccgagagaagactgctggtggccgagagctgcggcgccctggccccctacctgcccaaggagatcagaagcagcctggtgctgagcatgctgcagcagatgctgatggaggacaaggccgacctggtgagagaggccgtgatcaagagcctgggcatcatcatgggctacatcgacgaccccgacaagtaccaccagggcttcgagctgctgctgagcgccctgggcgaccccagcgagagagtggtgagcgccacccaccaggtgttcctgcccgcctacgccgcctggaccaccgagctgggcaacctgcagagccacctgatcctgaccctgctgaacaagatcgagaagctgctgagagagggcgagcacggcctggacgagcacaagctgcacatgtacctgagcgccctgcagagcctgatccccagcctgttcgccctggtgctgcagaacgcccccttcagcagcaaggccaagctgcacggcgaggtgccccagatcgaggtgaccagattccccagacccatgagccccctgcaggacgtgagcaccatcatcggcagcagagagcagctggccgtgctgctgcagctgtacgactaccagctggagcaggagggcaccaccggctgggagagcctgctgtgggtggtgaaccagctgctgccccagctgatcgagatcgtgggcaagatcaacgtgaccagcaccgcctgcgtgcacgagttcagcagattcttctggagactgtgcagaaccttcggcaagatcttcaccaacaccaaggtgaagccccagttccaggagatcctgagactgagcgaggagaacatcgacagcagcgccggcaacggcgtgctgaccaaggccaccgtgcccatctacgccaccggcgtgctgacctgctacatccagatcaaggagtacctgcacatccacaacgagatcagctgggagtgggaccccagcctgaacaccaagtgcgtgagctacacccactacacccacagcctgaaggaggaggacagaaagctgctggtgggcttcctggaggacgtgatgaccctgctgagcctgagccacgcccccctggacagcctgaaggccagcttcgtggagctgggcgccaaccccgcctaccacgagctgctgctgaccgtgctgtggtacggcgtggtgcacaccagcgccctggtgagatgcaccgccgccagaatgttcgagctgctggtgaagggcgtgaacgagaccctggtggcccagagagtggtgcccgccctgatcaccctgagcagcgaccccgagatcagcgtgagaatcgccaccatccccgccttcggcaccatcatggagaccgtgatccagagagagctgctggagagagtgaagatgcagctggccagcttcctggaggacccccagtaccaggaccagcacagcctgcacaccgagatcatcaagaccttcggcagagtgggccccaacgccgagcccagattcagagacgagttcgtgatcccccacctgcacaagctggccctggtgaacaacctgcagatcgtggacagcaagagactggacatcgccacccacctgttcgaggcctacagcgccctgagctgctgcttcatcagcgaggacctgatggtgaaccacttcctgcccggcctgagatgcctgagaaccgacatggagcacctgagccccgagcacgaggtgatcctgagcagcatgatcaaggagtgcgagcagaaggtggagaacaagaccgtgcaggagccccagggcagcatgagcatcgccgccagcctggtgagcgaggacaccaagaccaagttcctgaacaagatgggccagctgaccaccagcggcgccatgctggccaacgtgttccagagaaagaagtag

SEQ ID NO: 23572 - DNA, 6054 bp, Artificial Sequence
  Description of Artificial Sequence: Synthetic coding sequence
atgaccagcagaaccaagagaagacagaaggtgaagatcagcatcagcaagatcaaccacagcagctacagaaaggagcacagacccttctgggagcaccagccccccccccaccagaactgggccgtgggcggcagatgcggcgccggcgccagacccggcctgagccagagaagaggcagagaggtgagaagagaggcccagggcggcgccagcagcagaagactgagagccagactgtacttcagcgagagcaccagcctgcccctggacagaagaggcagccccggccccctgggccccgccccccacggcctgagaagagccgcccccagaggccccgccagaagaacccccagaagcaccgccctgaccagcagaagaagagcccagagacccagacacggcgacagactgagactgagaagcgaggccagacccagagccgccggcgactggccctgcgccagaggcggcgccgtgagacccggcagaccccacagaccccccagagtggagagcgccagaggcgcccacgccggcagagccgccaccgaccagctggagagagtgttcctgagactgggccacgccgagaccgacgagcagctgcagaacatcatcagcaagttcctgccccccgtgctgctgaagctgagcagcacccaggagggcgtgagaaagaaggtgatggagctgctggtgcacctgaacaagagaatcaagagcagacccaagatccagctgcccgtggagaccctgctggtgcagtaccaggaccccgccgccgtgagcttcgtgaccaacttcaccatcatctacgtgaagatgggctaccccagactgcccgtggagaagcagtgcgagctggcccccaccctgctgaccgccatggagggcaagccccagccccagcaggacagcctgatgcacctgctgatccccaccctgttccacatgaagtaccccgtggagagcagcaagagcgccagccccttcaacctggccgagaagcccaagaccgtgcagctgctgctggacttcatgctggacgtgctgctgatgccctacggctacgtgctgaacgagagccagagcagacagaacagcagcagcgcccagggcagcagcagcaacagcggcggcggcagcggcatcccccagcccccccccggcatgagcttctacgccgccaagagagtgatcggcgacaacccctggacccccgagcagctggagcagtgcaagctgggcatcgtgaagttcatcgaggccgagcaggtgcccgagctggaggccgtgctgcacctggtgatcgccagcagcgacaccagacacagcgtggccaccgccgccgacctggagctgaagagcaagcagagcctgatcgactggaacaaccccgccatcatcaacaagatgtacaaggtgtacctgggcgacatccccctgaagaccaaggagggcgccgtgctgaagcccgagctgaagagagaccccgtgagcaccagagtgaagctgaagatcgtgccccacctgctgagaagcagacaggccgccgagaccttccccgccaacatccaggtggtgtacgacggcctgttcggcaccaacaccaacagcaagctgagaaccctgagcctgcagttcgtgcaccacatctgcatcacctgccccgagatcaagatcaagcccctgggccccatgctgctgaacggcctgaccaagctgatcaacgagtacaaggaggaccccaagctgctgagcatggcctacagcgccgtgggcaagctgagcagcagaatgccccacctgttcaccaaggacatcgccctggtgcagcagctgttcgaggccctgtgcaaggaggagcccgagaccagactggccatccaggaggccctgagcatgatggtgggcgcctacagcaccctggagggcgcccagagaaccctgatggaggccctggtggccagctacctgatcaagcccgaggtgcaggtgagacaggtggccgtgaagttcgccagcaccgtgttccccagcgaccacatccccagcagatacctgctgctgctggccgccggcgaccccagagaggaggtgcacggcgaggcccagagagtgctgagatgcctgcccggcagaaacagaaaggagagcaccagcgagcagatgcccagcttccccgagatggtgtactacatccaggagaaggccagccacagaatgaagacccccgtgaagtacatgaccggcaccaccgtgctgcccttcaaccccgccgccttcggcgagatcgtgctgtacctgagaatgtgcctggcccacagcgccggcgtggtgcccaccagccagagcctggccgacatgcaggaccacgcccccgccatcggcagatacatcagaaccctgatgagcagcggccagatggcccccagcagcagcaacaagagcggcgagaccaaccccgtgcagatctacatcggcctgctgcagcagctgctggccggcgtgggcggcctgcccgtgatgtactgcctgctggaggccgtgagcgtgtaccccgagaagctggccaccaagttcgtggacaagaccgagtggatcaagagcctgatgaacaacagcaaggaggagatgagagagctggccgccctgttctacagcgtggtggtgagcaccgtgagcggcaacgagctgaagagcatgatcgagcagctgatcaagaccaccaaggacaaccacagccccgagatccagcacggcagcctgctggccctgggcttcaccgtgggcagatacctggccaagaagaagatgagaatgagcgagcagcaggacctggagagaaacgccgacaccctgcccgaccaggaggagctgatccagagcgccaccgagaccatcggcagcttcctggacagcaccagccccctgctggccatcgccgcctgcaccgccctgggcgagatcggcagaaacggccccctgcccatccccagcgagggcagcggcttcaccaagctgcacctggtggagagcctgctgagcagaatccccagcagcaaggagaccaacaagatgaaggagagagccatccagaccctgggctacttccccgtgggcgacggcgacttcccccaccagaagctgctgctgcagggcctgatggacagcgtggaggccaagcagatcgagctgcagttcaccatcggcgaggccatcaccagcgccgccatcggcaccagcagcgtggccgccagagacgcctggcagatgaccgaggaggagtacaccccccccgccggcgccaaggtgaacgacgtggtgccctgggtgctggacgtgatcctgaacaagcacatcatcagccccaacccccacgtgagacaggccgcctgcatctggctgctgagcctggtgagaaagctgagcacccacaaggaggtgaagagccacctgaaggagatccagagcgccttcgtgagcgtgctgagcgagaacgacgagctgagccaggacgtggccagcaagggcctgggcctggtgtacgagctgggcaacgagcaggaccagcaggagctggtgagcaccctggtggagaccctgatgaccggcaagagagtgaagcacgaggtgagcggcgagaccgtggtgttccagggcggcgccctgggcaagacccccgacggccagggcctgagcacctacaaggagctgtgcagcctggccagcgacctgagccagcccgacctggtgtacaagttcatgaacctggccaaccaccacgccatgtggaacagcagaaagggcgccgccttcggcttcaacgtgatcgccaccagagccggcgagcagctggcccccttcctgccccagctggtgcccagactgtacagataccagttcgaccccaacctgggcatcagacaggccatgaccagcatctggaacgccctggtgaccgacaagagcatggtggacaagtacctgaaggagatcctgcaggacctggtgaagaacctgaccagcaacatgtggagagtgagagagagcagctgcctggccctgaacgacctgctgagaggcagacccctggacgacatcatcgacaagctgcccgagatctgggagaccctgttcagagtgcaggacgacatcaaggagagcgtgagaaaggccgccgagctggccctgaagaccctgagcaaggtgtgcgtgaagatgtgcgaccccgccaagggcgccgccggccagagaaccatcgccgccctgctgccctgcctgctggacaagggcatgatgagcaccgtgaccgaggtgagagccctgagcatcaacaccctggtgaagatcagcaagagcgccggcgccatgctgaagccccacgcccccaagctgatccccgccctgctggagagcctgagcgtgctggagccccaggtgctgaactacctgagcctgagagccaccgagcaggagaaggccgccatggacagcgccagactgagcgccgccaagagcagccccatgatggagaccatcaacatgtgcctgcagtacctggacgtgagcgtgctgggcgagctggtgcccagactgtgcgagctgatcagaagcggcgtgggcctgggcaccaagggcggctgcgccagcgtgatcgtgagcctgaccacccagtgcccccaggacctgaccccctacagcggcaagctgatgagcgccctgctgagcggcctgaccgacagaaacagcgtgatccagaagagctgcgccttcgccatgggccacctggtgagaaccagcagagacagcagcaccgagaagctgctgcagaagctgaacggctggtacatggagaaggaggagcccatctacaagaccagctgcgccctgaccatccacgccatcggcagatacagccccgacgtgctgaagaaccacgccaaggaggtgctgcccctggccttcctgggcatgcacgagatcgccgacgaggagaagagcgagaaggaggagtgcaacctgtggaccgaggtgtggcaggagaacgtgcccggcagcttcggcggcatcagactgtacctgcaggagctgatcaccatcacccagaaggccctgcagagccagagctggaagatgaaggcccagggcgccatcgccatggccagcatcgccaagcagaccagcagcctggtgcccccctacctgggcatgatcctgaccgccctgctgcagggcctggccggcagaacctgggccggcaaggaggagctgctgaaggccatcgcctgcgtggtgaccgcctgcagcgccgagctggagaagagcgtgcccaaccagcccagcaccaacgagatcctgcaggccgtgctgaaggagtgcagcaaggagaacgtgaagtacaagatcgtggccatcagctgcgccgccgacatcctgaaggccaccaaggaggacagattccaggagttcagcaacatcgtgatccccctgatcaagaagaacagcctggagagcagcggcgtgagaaccaccaagaacgaggaggagaacgagaaggagaaggagctgcagctggagtacctgctgggcgccttcgagagcctgggcaaggcctggcccagaaacgccgagacccagagatgctacagacaggagctgtgcaagctgatgtgcgagagactgaagctgagcacctggaaggtgcagctgggcgtgctgcagagcatgaacgccttcttccagggcctgatgctgctggaggaggagcacgccgaccccgaggccctggccgagatcctgctggagacctgcaagagcatcacctacagcctggagaacaagacctacagcagcgtgagaaccgaggccctgagcgtgatcgagctgctgctgaagaagctggaggagagcaagcagtgggagtgcctgaccagcgagtgcagagtgctgctgatcgagagcctggccaccatggagcccgacagcagacccgagctgcaggagaaggccgccctgctgaagaagaccctggagaacctggagtag

SEQ ID NO: 23573 - DNA, 4857 bp, Artificial Sequence
  Description of Artificial Sequence: Synthetic coding sequence
atggacggccagaccctgagaaaggccgagagaagctggagctgcagcagagagaagaaggagggctacgccaaggacatggtgaccgacttcgacgagaagcacgacgagtacctgatcctgctgcagcagagaaacagaatcctgaagcacctgaagagcaaggaccccgtgcagctgagactggagcacctggagcagggcttcagcgtgtacgtgaacggcgccaacagcgagctgaagagcagccccagaaaggccatccacagcgacttcagcagaagcgccagccacaccgagggcacccacgactacggcagaagaaccctgttcagagaggccgaggaggccctgagaagaagcagcagaaccgcccccagcaaggtgcagagaagaggctggcaccagaagagcgtgcagatcagaaccgaggccggccccagactgcacatcgagccccccgtggactacagcgacgacttcgagctgtgcggcgacgtgaccctgcaggccaacaacaccagcgaggacagaccccaggagctgagaagaagcctggagctgagcgtgaacctgcagagaaagcagaaggactgcagcagcgacgagtacgacagcatcgaggaggacatcctgagcgagcccgagcccgaggaccccgccctggtgggccaccccagacacgacagaccccccagcagcggcgactggacccagaaggacgtgcacggcgagcaggagaccgagggcagaagcagccccggccccgacaccctggtggtgctggagttcaaccccgccagcaagagccacaagagagagagaaacctgagcgccaagagaaaggacaacgccgaggtgttcgtgcccaccaagcccgagcccaacctgaccccccaggcccccgccgtgttccccgaccaggagagaatgtgcagcagacccggcagcagaagagagagacccctgagcgccaccagaaagaccctgtgcgaggccgagtaccccgaggaggacgccagcgccgtgctgcaggccatccaggtggagaacgccgccctgcagagagccctgctgagcagaaaggccgagcagcccgccagccccctgcaggacgccgagggcccccccgccaagccctggaccagcctgctggaggagaaggaggagaccctggagctgctgcccatcaccaccgccaccaccacccaggagcccgccggcgccgccggcggcgccagagccatcaaccaggccatggacagaatcggcctgctgggcagcagacagcagcagaagctgctgaaggtgctgcaggccgtggagagcgacagcgcccacctgggcagagtggtgagccccaccaaggagcaggtgagcgacaccgaggacaagcagagaatgagagccgacgagatcaaggacgccatctacgtgaccatggagatcctgagcaactggggcaacagctggtgggtgggcctgaccgaggtggagttcttcgacctgaacgacaccaagctgtacgtgagcccccacgacgtggacatcagaaacaccgccacccccggcgagctgggcagactggtgaacagaaacctggccggcaagaaggacagcagcccctggacctgccccttccacccccccctgcagctgttcttcgtgatcagaaacaccagacagctgggcgacttccacctggccaagatcaaggtgagaaactactggaccgccgacggcgacctggacatcggcgccaagaacgtgaagctgtacgtgaacagaaacctgatcttcaacggcaagctggacaagggcgacagagaggcccccgccgaccacagcatcctggtggaccagaagaacgagaagagcgagcagctggaggaggccatgaacgcccacagcgaggagagcaagggcacccacgagatggccggcgccagcggcgacaaggagctgggcctgggctgcagcccccccgccgagaccctggccgacgccaagctgagcagccagggcaacgtgagcggcaagagaaagaacagcaccaactgcagaaaggacagcctgagccagctggaggagtacctgagactgagcgccgtgcccaccagcatgggcgacatgcccagcgcccccgccaccagcccccccgtgaagtgcccccccgtgcacgaggagcccagcctgatccagcagctggagaacctgatgggcagaaagatctgcgagccccccggcaagacccccagctggctgcagcccagccccaccggcaaggacagaaagcagggcggcagaaagcccaagcccctgtggctgagccccgagaagcccctggcctggaagggcagactgcccagcgacgacgtgatcggcgagggccccggcgagaccgaggccagagacaagggcctgagacacgagcccggctggggcaccagcagaagcgtgaacaccaaggagagaccccagagagccaccaccaaggtgcacagcgacgacagcgacatcttcaaccagccccccaacagagagagacccgccagcggcagaagaggcagcagaaaggacgccggcagcagcagccacggcgacgaccagcccgccagcagagaggacacctggagcagcagaacccccagcagaagcagatggagaagcgagcaggagcacaccctgcacgagagctggagcagcctgagcgccttcgacagaagccacagaggcagaatcagcaacaccgagctgcccggcgacatcctggacgagctgctgcagcagaagagcagcagacacagcgacctgccccccagcaagaagggcgagcagcccggcctgagcagaggccaggacggctacagcggcgagaccgacgccggcggcgacttcaagatccccgtgctgccctacggccagagactggtgatcgacatcaagagcacctggggcgacagacactacgtgggcctgaacggcatcgagatcttcagcagcaagggcgagcccgtgcagatcagcaacatcaaggccgacccccccgacatcaacatcctgcccgcctacggcaaggaccccagagtggtgaccaacctgatcgacggcgtgaacagaacccaggacgacatgcacgtgtggctggcccccttcaccagaggcagaagccacagcatcaccatcgacttcacccacccctgccacgtggccctgatcagaatctggaactacaacaagagcagaatccacagcttcagaggcgtgaaggacatcaccatgctgctggacacccagtgcatcttcgagggcgagatcgccaaggccagcggcaccctggccggcgcccccgagcacttcggcgacaccatcctgttcaccaccgacgacgacatcctggaggccatcttctacagcgacgagatgttcgacctggacgtgggcagcctggacagcctgcaggacgaggaggccatgagaagacccagcaccgccgacggcgagggcgacgagagacccttcacccaggccggcctgggcgccgacgagagaatccccgagctggagctgcccagcagcagccccgtgccccaggtgaccacccccgagcccggcatctaccacggcatctgcctgcagctgaacttcaccgccagctggggcgacctgcactacctgggcctgaccggcctggaggtggtgggcaaggagggccaggccctgcccatccacctgcaccagatcagcgccagccccagagacctgaacgagctgcccgagtacagcgacgacagcagagccctggacaagctgatcgacggcaccaacatcaccatggaggacgagcacatgtggctgatccccttcagccccggcctggaccacgtggtgaccatcagactggacagagccgagagcatcgccggcctgagattctggaactacaacaagagccccgaggacacctacagaggcgccaagatcgtgcacgtgagcctggacggcctgtgcgtgagcccccccgagggcttcctgatcagaaagggccccggcaactgccacttcgacttcgcccaggagatcctgttcgtggactacctgagagcccagctgctgccccagcccgccagaagactggacatgagaagcctggagtgcgccagcatggactacgaggcccccctgatgccctgcggcttcatcttccagttccagctgctgaccagctggggcgacccctactacatcggcctgaccggcctggagctgtacgacgagagaggcgagaagatccccctgagcgagaacaacatcgccgccttccccgacagcgtgaacagcctggagggcgtgggcggcgacgtgagaacccccgacaagctgatcgaccaggtgaacgacaccagcgacggcagacacatgtggctggcccccatcctgcccggcctggtgaacagagtgtacgtgatcttcgacctgcccaccaccgtgagcatgatcaagctgtggaactacgccaagaccccccacagaggcgtgaaggagttcggcctgctggtggacgacctgctggtgtacaacggcatcctggccatggtgagccacctggtgggcggcatcctgcccacctgcgagcccaccgtgccctaccacaccatcctgttcaccgaggacagagacatcagacaccaggagaagcacaccaccatcagcaaccaggccgaggaccaggacgtgcagatgatgaacgagaaccagatcatcaccaacgccaagagaaagcagagcgtggtggaccccgccctgagacccaagacctgcatcagcgagaaggagaccagaagaagaagatgctag

SEQ ID NO: 23574 - DNA, 3354 bp, Artificial Sequence
  Description of Artificial Sequence: Synthetic coding sequence
atgctggccggcagacccggcaccagaagcgccgtgggcgagctgggcaccgagagcagcgacaacctggacagagcccccctgggccccagagagagcggcggccaccacagacccggcagctacctggacatgaagatccacctggagaagaacctggaggaggagagacagatcctgctgcagcagcagaagatctgcagaaacagagccagaaagtacttcgtggagagcaacagaagaaagaaggccttcgaggagaagagaaaggagcaggaggagaaggagcaccagatcagagagcagatcctgcagcagagaaagcagaagttcgaggaggtgaccgagaagttccagagagcccacgtgcccctgagccagagaagaaaggccgtgagcagaaagcccgtgccccccctggaggaggccctgaagcagatccaggagagcaacctgaagagcgaggtgaacctgcccttcagcagaagacccaccatcaactggagagccatcgacagcgccctgcccagcgccctgagcaagaacgaccacaagcaccagaagcagctgctgagcaagatcaactgcgagaaggagatgaacgagaacatgagagccaccctggccaccagcaagaacgtgttccagctgaagctggaggagacccagaagctgctggaggaccagcacctgagcaacctgcagaagttcggcgacgaggtgaaccagatcaccaacagcgagaccctgagcagcatcgacagcctggaggccaccgagcacgaggagatctacctgaccctgaacaaggagcacagcaccagcatccagagaaacaccatcagcctgaagcccgccaacatgcagagcaccaacctgagctgcttcgacgaggacaagctggccttcagcaagacccagcacatcaacaactggctgaccaacctggacgccagcaacacccagaacgtgaccgccttcagcgacatcctgagcaagagcaacgtgctgcccagctgggagtacttcaacagcaaggagcagaaccccagccccctgaacggcaccgtggagagagccaccaacaccgccaacaacagcgtgcccttcgtgagcagcccccccatgttcgtgctggacaagaagtgcgagaagaccagcgagaccagcaccatgagaaccaccgacagcaccagcggcgccttcaagagagagagacccctggtgaccgagagccccaccttcaagttcagcaagagccagagcaccagcgacagcctgacccaggaggtggccaccttccccgaccaggagaagtacagcgagctgaaccaggagaacggcaccaccagcatccccaccagctgcgtgcccgtggccacccccctggtgctgcccagcaacatccagagcgccagacccagcgccaagaacagcatccacatcaaggagatcgacgccgtgcagtgcagcgacaagctggacgagctgaaggacggcaaggaggaggagatcaagtacttcaactgcaacaaggaggagctgcccctgttcagcgacagcttccaggacgcctacatcccccacaaccccgacagcaaggacgagaagcagaagctggccgagaccagcagcctgagcaacgtgaccagcaactacgacttcgtgggccagcacaagaagatgaagtacaacatccacgagagaaacggcgtgagattcctgaagagcatcctgaagaaggagagcaagtacgagcacggctacctgaaggccctgatcatcaaccagagcttcaagttcggcaaccagaaggccgccgccatcagagacagcatcgagctgaccaaggagaagggcgccgagatccccaagaccatcaagaagctgagatggttcgacgagaccagcaacatcgagaacaacgccgagaacagccacagcctgaagaacaagaccggcaccacccagcagcacagccagcagttccacatccagagcggcgccggcagcaacatcatcagcgtgagcacctgcgccgtgaacagcgccgacaccaagaagagcagagaggacagcatcagcgagaacgtgaccaccctgggcggcagcggcgccgaccacatgcccctgaactgcttcatccccagcggctacaacttcgccaagcacgcctggcccgccagcaagaaggaggagagcaagatccccgtgcacgacgacagcaagaccaagcagggcaagccccagagaggcagagccaagatcatcagaaagcccggcagcgccaaggtgcagagcggcttcatctgcaccaacagaaagggcgccgtgatccagccccagagcgccagcaaggtgaacatcttcacccaggcccagggcaagctgatcatcccctgcccccccccccagagcaccagcaacatcagaagcggcaagaacatccaggtgagccagtgccagcccgtgacccccgagaacccccagaacatcatcacccacaacagcttcaacagcaagcacgtgctgcccaccgagcacagcctgaaccagtggaaccaggagagcagcagccccctgagcaacgcctgcagcgacctggtgaccgtgatccccagcctgcccagctactgcagcagcgagtgccagaccttcgccaagatcaaccacagcaacggcacccaggccgtggccagacaggacgccaccctgtactgcacccagagaagccccgtgtgcgaggagagctaccccagcgtgaccctgagaaccgccgaggaggagagcgtgcccctgtggaagagaggccccaacgtgctgcaccagaacaagagagccaccggcagcaccgtgatgagaagaaagagaatcgccgagaccaagagaagaaacatcctggagcagaagagacagaaccccggcagcgtgggccagaagtacagcgagcagatcaacaacttcggccagagcgtgctgctgagcagcagcgagcccaagcagaccaccagaggcaccagctacatcgaggaggtgagcgacagcaccagcgagttcctgatggccgagaacctggtgaaggccagcgtgcccgaggacgagatcctgaccgtgctgaacagcaagcagatccagaagagcaacctgcccctgaacaagacccagcagttcaacatctgcaccctgagcgccgaggagcagaagatcctggagagcctgaacgacctgagcgagagactgcactacatccaggagagcatctgcaagaaccccagcatcaagaacaccctgcagatcatccccctgctggagaagagagaggacagaaccagcagctgcagagacaagagatag

SEQ ID NO: 23575 - DNA, 2571 bp, Artificial Sequence
  Description of Artificial Sequence: Synthetic coding sequence
atgggcaccaccgccagcaccgcccagcagaccgtgagcgccggcacccccttcgagggcctgcagggcagcggcaccatggacagcagacacagcgtgagcatccacagcttccagagcaccagcctgcacaacagcaaggccaagagcatcatccccaacaaggtggcccccgtggtgatcacctacaactgcaaggaggagttccagatccacgacgagctgctgaaggcccactacaccctgggcagactgagcgacaacacccccgagcactacctggtgcagggcagatacttcctggtgagagacgtgaccgagaagatggacgtgctgggcaccgtgggcagctgcggcgcccccaacttcagacaggtgcagggcggcctgaccgtgttcggcatgggccagcccagcctgagcggcttcagaagagtgctgcagaagctgcagaaggacggccacagagagtgcgtgatcttctgcgtgagagaggagcccgtgctgttcctgagagccgacgaggacttcgtgagctacacccccagagacaagcagaacctgcacgagaacctgcagggcctgggccccggcgtgagagtggagagcctggagctggccatcagaaaggagatccacgacttcgcccagctgagcgagaacacctaccacgtgtaccacaacaccgaggacctgtggggcgagccccacgccgtggccatccacggcgaggacgacctgcacgtgaccgaggaggtgtacaagagacccctgttcctgcagcccacctacagataccacagactgcccctgcccgagcagggcagccccctggaggcccagctggacgccttcgtgagcgtgctgagagagacccccagcctgctgcagctgagagacgcccacggccccccccccgccctggtgttcagctgccagatgggcgtgggcagaaccaacctgggcatggtgctgggcaccctgatcctgctgcacagaagcggcaccaccagccagcccgaggccgcccccacccaggccaagcccctgcccatggagcagttccaggtgatccagagcttcctgagaatggtgccccagggcagaagaatggtggaggaggtggacagagccatcaccgcctgcgccgagctgcacgacctgaaggaggtggtgctggagaaccagaagaagctggagggcatcagacccgagagccccgcccagggcagcggcagcagacacagcgtgtggcagagagccctgtggagcctggagagatacttctacctgatcctgttcaactactacctgcacgagcagtaccccctggccttcgccctgagcttcagcagatggctgtgcgcccaccccgagctgtacagactgcccgtgaccctgagcagcgccggccccgtggcccccagagacctgatcgccagaggcagcctgagagaggacgacctggtgagccccgacgccctgagcaccgtgagagagatggacgtggccaacttcagaagagtgcccagaatgcccatctacggcaccgcccagcccagcgccaaggccctgggcagcatcctggcctacctgaccgacgccaagagaagactgagaaaggtggtgtgggtgagcctgagagaggaggccgtgctggagtgcgacggccacacctacagcctgagatggcccggcccccccgtggcccccgaccagctggagaccctggaggcccagctgaaggcccacctgagcgagcccccccccggcaaggagggccccctgacctacagattccagacctgcctgaccatgcaggaggtgttcagccagcacagaagagcctgccccggcctgacctaccacagaatccccatgcccgacttctgcgcccccagagaggaggacttcgaccagctgctggaggccctgagagccgccctgagcaaggaccccggcaccggcttcgtgttcagctgcctgagcggccagggcagaaccaccaccgccatggtggtggccgtgctggccttctggcacatccagggcttccccgaggtgggcgaggaggagctggtgagcgtgcccgacgccaagttcaccaagggcgagttccaggtggtgatgaaggtggtgcagctgctgcccgacggccacagagtgaagaaggaggtggacgccgccctggacaccgtgagcgagaccatgacccccatgcactaccacctgagagagatcatcatctgcacctacagacaggccaaggccgccaaggaggcccaggagatgagaagactgcagctgagaagcctgcagtacctggagagatacgtgtgcctgatcctgttcaacgcctacctgcacctggagaaggccgacagctggcagagacccttcagcacctggatgcaggaggtggccagcaaggccggcatctacgagatcctgaacgagctgggcttccccgagctggagagcggcgaggaccagcccttcagcagactgagatacagatggcaggagcagagctgcagcctggagcccagcgcccccgaggacctgctgtag

SEQ ID NO: 23576 - DNA, 1230 bp, Artificial Sequence
  Description of Artificial Sequence: Synthetic coding sequence
atgagcctgcacgcctgggagtgggaggaggaccccgccagcatcgagcccatcagcagcatcaccagcttctaccagagcaccagcgagtgcgacgtggaggagcacctgaaggccaaggccagagcccaggagagcgacagcgacagaccctgcagcagcatcgagagcagcagcgagcccgccagcaccttcagcagcgacgtgccccacgtggtgccctgcaagttcaccatcagcctggccttccccgtgaacatgggccagaagggcaagtacgccagcctgatcgagaagtacaagaagcaccccaagaccgacagcagcgtgaccaagatgagaagattctaccacatcgagtacttcctgctgcccgacgacgaggagcccaagaaggtggacatcctgctgttccccatggtggccaaggtgttcctggagagcggcgtgaagaccgtgaagccctggcacgagggcgacaaggcctgggtgagctgggagcagaccttcaacatcaccgtgaccaaggagctgctgaagaagatcaacttccacaagatcaccctgagactgtggaacaccaaggacaagatgagcagaaaggtgagatactacagactgaagaccgccggcttcaccgacgacgtgggcgccttccacaagagcgaggtgagacacctggtgctgaaccagagaaagctgagcgagcagggcatcgagaacaccaacatcgtgagagaggagagcaaccaggagcacccccccggcaagcaggagaagaccgagaagcaccccaagagcctgcagggcagccaccaggccgagcccgagaccagcagcaagaacagcgaggagtacgagaagagcctgaagatggacgacagcagcaccatccagtggagcgtgagcagaacccccaccatcagcctggccggcgccagcatgatggagatcaaggagctgatcgagagcgagagcctgagcagcctgaccaacatcctggacagacagagaagccagatcaagggcaaggacagcgagggcagaagaaagatccagagaagacacaagaagcccctggccgaggaggaggccgaccccaccctgaccggccccagaaagcagagcgccttcagcatccagctggccgtgatgcccctgctggccggcacccactgcctgccctgcagccagcagctgctgctggtgctgtggcccgagagaccctag

SEQ ID NO: 23577 - DNA, 3603 bp, Artificial Sequence
  Description of Artificial Sequence: Synthetic coding sequence
atggacccccccagcctggacaccgccatccagcacgccctggccggcctgtacccccccttcgaggccaccgcccccaccgtgctgggccaggtgttcagactgctggacagcggcttccagggcgacggcctgagcttcctgctggacttcctgatccccgccaagagactgtgcgagcaggtgagagaggccgcctgcgccccctacagccactgcctgttcctgcacgagggctggcccctgtgcctgagagacgaggtggtggtgcacctggcccccctgaaccccctgctgctgagacagggcgacttctacctgcaggtggagccccaggaggagcagagcgtgtgcatcatgatcaagtgcctgagcctggacctgtgcaccgtggacaagaagcccgtgcccgagcccgcctaccccatcctgttcacccaggagtggctggaggccatcaacagcgacttcgagggcaaccccctgcacaactgcctggtggccagcgagaacggcatcgcccccgtgccctggaccaagatcaccagccccgagttcgtggacgacagaccccaggtggtgaacgccctgtgccaggcctggggccccctgcccctggaggccctggacctgagcagcccccaggagctgcaccaggccagcagccccgacaaccaggtgctgcccgcccagagcctggccaagggcaagggcagaacctacggcagcaagtaccccggcctgatcaaggtggagcaggccagatgcggcgaggtggccttcagaatggacgaggtggtgagccaggacttcgagggcgactacgtggccctgctgggcttcagccaggagagcagaggcgagagccccagcagagaggccggcaccagcagcggctgcaccagcggcgccctggaggagatcgccggcaccaaggagacccccctgttccagaagatcctgcccctgagcgaggccaacgagggccccagcctgggcaacagagcctgcaccaagcccgagagcagcgaggagagaccctacaacctgggcttcagaagaaaggtgaacctgaaggcccccacccacaacagcgagagacccccccagggcagctacatgaacgtgctggaggacgccctggactgcgccagcggcctgagagccggcgtgagccaggagcccgccgccagcaagatgcagggccccctgggcaaccccgagaacatggtgcagctgagacccggccccagacaggccagcagccccagactgagccccgccagccccgccgccgccgccagcgagaccaagatcgaggtgaagaccaaggagagaaacggcagactgcccaagcccatgccctgccccagcagaaacaccagcagccccgagccccccacccccggcctgaagttcagcttcctgagaggccagagacagcccagcgtgacccccgagaaggccagcctgcagcacaacggcccctggaaggtgctgtgcagcctgtacagccccaagcccaacagagccaagagcctgggcaaggccggcaccacccagaccaagaccagcggccccgccaccgcccccagccccctgaccgaggagaaggccgccctgcccgaggccagcgccggcagccccgagagaggccccaccctggaggaggagccccccggccccgagcccagaatcggcgccctgggcgtgaaggtgttcagaagcagaatcgcctgcctgcccggcggcagagacagagccggcagacccctgctgctggtgagcaccaccgagggcgcctgggaggccccctggtgcaccgtgagcgaggtgaccaagctgctgagctacctgtgcaccatccccagacccgaggacaaggccaagggcctggccgtgctgatcgacgccagaagacagcccccccagcccggcctggtgagcgccctgcaggccacccaggcccaggtgcccgccagcatcagagccatcctgttcctgggcgagaaggaggccgccctgcagctgcagaccctgcccgacgtgcaggtggaggtgctgaccagcctgaaggccctgagccaccacgtggaccccagccagctgcccgccgtgctggagggccccttcccctactgccacaccgagtgggtgcacttcttccagaagctggaccccttcctggccgacctgcaccaggccagcagcctgctgcaggccagcatcgaggagttcgagaaggccgacccccccggcggcatgcaggaggccaccagatgcctgagcaagagcaaggagctgatggaggccgtgctgagagaccccggcctgctgggcctgcagagagagggcggcgccaccctggccagactgcagcacgacgccagcagactggacttcagccccgacgtgagaagccacctggccgccgccaccgccctgtacagcctggtggacgagcagctgcacgtgctggtgaccgccagcaacagcctgctgggcaagctggagctgagagtgagactgggcagactggaggccgccatccaccaggtgagcgactggatggagcaggagggcagaagatgcctgcagagcctgacccccaaggacggcagcctggagaccgtggagaaggcccacgccgagttcgagaacttcttcctgcaggccgccgcccagtacagaagaggcctggagctgagcaagcaggccgcccagctgggcgccaccgccagaggcgccggcgaggccgagagagccgagttccccgagctggccgccttcgccagcacccagagagccttccaggccgagctgacccacttctacatggccgccgagagacagagaaccgacctggagaccctgctgcacctgcacagattctgcaagagaatgacctggttccacatggactgccaggacctgatggcccagctgagactggacaagaccagcagagtgagccccggcgaccagagaagactgcacagatacctgcagagactggccagcgagttccccgccgagaagctggccgccgtgggcctgcaggtggccagcctgagcagagccggcctgggccaggagctgtgggaggaggccagaatcagacacgaggagatcagaatgctgctggagaaggccctgacccacagcagctgccccgaggcccccgccgcccacagcgccagacccgagagaagaggcgtggccgccaagggccagggcgtgagcgtggaggtgaccagcaagggcagatgggaccagccccccctggacagcctgggcatggaccacctgcccaagagctactggccccccggcccccccagaggcgagcagaacagaaccttccaggccggcagccccccccaggaggccggccaggccgccgaggccgaggacggcaagggcagccacaagctgcccgaccccgccagagagcacctgctggccaccaccttcttcagacagcagccccccagacagagccaggtgcccagactgaccggcggcagcttcagcagcgagggcaccgacagccagaccagcctggaggacagcccccagaccagccccctggccagcctgtag

SEQ ID NO: 23578 - DNA, 1734 bp, Artificial Sequence
  Description of Artificial Sequence: Synthetic coding sequence
atggccgacgtggccggccccagcagacccagcgccgccgccttctggagcagagacttcagcgacgaggagcagagcgtggtgtacgtgcccggcatcagcgccgagggcaacgtgagaagcagacacaagctgatgagccccaaggccgacgtgaagctgaagaccagcagagtgaccgacgccagcatcagcatggagagcctgaagggcaccggcgacagcgtggacgagcagaacagctgcagaggcgagatcaagagcgccagcctgaaggacctgtgcctggaggacaagagaagaatcgccaacctgatcaaggagctggccagagtgagcgaggagaaggaggtgaccgaggagagactgaaggccgagcaggagagcttcgagaagaagatcagacagctggaggagcagaacgagctgatcatcaaggagagagaggccctgcagctgcagtacagagagtgccaggagctgctgagcctgtaccagaagtacctgagcgagcagcaggagaagctgaccatgagcctgagcgagctgggcgccgccagaatgcaggagcagcaggtgagcagcagaaagagcaccctgcagtgcagcagcgtggagctggacggcagctacctgagcatcgccagaccccagacctactaccagaccaagcagagacccaagagcgccgtgcaggacagcgccagcgagagcctgatcgccttcagaaacaacagcctgaagcccgtgaccctgcaccaccccaaggacgacctggacaagatccccagcgagaccaccacctgcaactgcgagagccccggcagaaagcccgccgtgcccaccgagaagatgccccaggaggagctgcacatgaaggagtgcccccacctgaagcccacccccagccagtgctgcggccacagactggccgccgacagagtgcacgacagccaccccaccaacatgaccccccagcaccccaagacccaccccgagagctgcagctactgcagactgagctgggccagcctggtgcacggcggcggcgccctgcagcccatcgagaccctgaagaagcagatcagcgaggacagaaagcagcagctgatgctgcagaagatggagctggagatcgagaaggagagactgcagcacctgctggcccagcaggagaccaagctgctgctgaagcagcagcagctgcaccagagcagactggactacaactgcctgctgaagagcaactgcgacggctggctgctgggcaccagcagcagcatcaagaagcaccaggacccccccaacagcggcgagaacagaaaggagagaaagaccgtgggcttccacagccacatgaaggacgacgcccagtggagctgccagaagaaggacacctgcagaccccagagaggcaccgtgaccggcgtgagaaaggacgccagcaccagccccatgcccaccggcagcctgaaggacttcgtgaccaccgccagccccagcctgcagcacaccaccagcagatacgagaccagcctgctggacctggtgcagagcctgagccccaacagcgcccccaagccccagagataccccagcagagaggccggcgcctggaaccacggcaccttcagactgagccccctgaagagcaccagaaagaagatgggcatgcacagaacccccgaggagctggaggagaaccagatcctggaggacatcttcttcatctag

SEQ ID NO: 23579 - DNA, 1416 bp, Artificial Sequence
  Description of Artificial Sequence: Synthetic coding sequence
atggtgctggacagcggcgcccaggcctacgaccaggccccccccagcccccccaccagcccccccagcctgagacacagactgaagcccagcgacagagacggcccccccctgtacccctggagccagagcctggccctgcccctggccctggccgtgccccccgccctgcagccccagcccgagcagcagcccttcagccagatgctgctgggccacagaggccacatgagaagaagcgagagcacctacagcgtgaacagcaccggcagaagaggcagaggcaccctgggcagacccccccccggcagaggcagaaaccccggcggcggcaccctgagacccgccgccagcctgccccacatcgccaagacccagagagacgccggccacatcgccagcaagagcccctgcatgctggtggccctgagacccaccaacatggacagagagagagacaagttcttccagagccactacacctacaacccccagttcgagtaccaggagcccatgcccaccgccgtgctggagaagtactgcgaggccagcggccagttcatccaccaggccgtgggcatcatcgaggccgtgctggagaagttcggcacctacgagcacttcgaggccgccaccggcggccagctgctgaccaagtgccagatctggagcatcgtgagaaagtacatgcagaaggagggctgcgccggcgaggtggtggtgcagctgagcgaggacctgctgagccaggccgtgatgatggtggagaacagcagacccaccctggccatcaacctgaccggcgccagacagtactggctggagggcatgctgagacacgagatcggcacccactacctgagaggcgtgaacaacgccagacagccctggcacaacgccgagggcagactgagatacggcctgagacccgccaaccccaccgaggagggcctggccagcctgcacagcgtgctgttcagaaagcagcccttcctgtggagagccgccctgctgtactacaccatccacagagccgccagaatgagcttcagacagctgttccaggacctggagagatacgtgcaggacgccgacgtgagatgggagtactgcgtgagagccaagagaggccagaccgacaccagcctgcccggctgcttcagcaaggaccaggtgtacctggacggcatcgtgagaatcctgagacacagacagaccatcgacttccccctgctgaccagcctgggcaaggtgagctacgaggacgtggaccacctgagaccccacggcgtgctggacaacaccagagtgccccacttcatgcaggacctggccagatacagacagcagctggagcacatcatggccaccaacagactggacgaggccgagctgggcagactgctgcccgactag

SEQ ID NO: 23580 - DNA, 432 bp, Artificial Sequence
  Description of Artificial Sequence: Synthetic coding sequence
atggtggtgttcgtgggcagaagactgcccgccctgctgggcctgttcaagaagaagggcagcgccaaggccgagaacgacaagcacctgagcgtgggccccggccagggccccggcagcgccgtggacgagcaccaggacaacgtgttcttccccagcggcagacccccccacctggaggagctgcacacccaggcccaggagggcctgagaagcctgcagcaccaggagaagcagaagctgaacaagggcggctgggaccacggcgacacccagagcatccagagcagcagaaccggccccgacgaggacaacatcagcttctgcagccagaccaccagctacgtggccgagagcagcaccgccgaggacgccctgagcatcagaagcgagatgatccagagaaaggacagccagaaggagctggcctag

SEQ ID NO: 23581 - DNA, 2124 bp, Artificial Sequence
  Description of Artificial Sequence: Synthetic coding sequence
atgagcagaggctacagcgagaacaacaacttcctgaacaacaacaaccagatggtgctggacatgatcctgtaccccctgatcggcatcccccagaccatcaactgggagaccatcgccagactggtgcccggcctgacccccaaggagtgcgccaagagattcgacgagctgaagagcagcggcagcagccccgtggacaaccagtacaacagcctgatggccgccggcgagagccccgtggagaccctggccacctacatcaagagcagcctgctggacatccacggcgagttccaggagacccccgtgggccacgacgccgtgagcaagaccggcagacacagcatcgccagcaccagaaactgcagcagcgagagcgagaactgcaccacccacaacggcggcgagatgaccgaggagagcgagggccccaacatggtgatccacgtgtgcgacgaggccaagaacctgaaggaggacttcacctgccccagagacctgctgatcagcgagatgaagtacttcgccgagtacctgagcatggacgcccagagatgggaggaggtggacatcagcgtgcactgcgacgtgcacatcttcaactggctgatcaagtacatcaagagaaacaccaaggagaacaaggactgcgagatgcccaccctggagcccggcaacgtgatcagcatcctgatcagcagcgagttcctgaagatggacagcctggtggagcagtgcatccagtactgccacaagaacatgaacgccatcgtggccaccccctgcaacatgaactgcatcaacgccaacctgctgaccagaatcgccgacctgttcagccacaacgaggtggacgacctgaaggacaagaaggacaagttcaagagcaagctgttctgcaagaagatcgagagactgttcgaccccgagtacctgaaccccgacagcagaagcaacgccgccaccctgtacagatgctgcctgtgcaagaagctgctgaccaaggagaccgagagaagaatcccctgcatccccggcaagatcaacgtggacagaagaggcaacatcgtgtacatccacatcagagacaagacctgggacgtgcacgagtacctgaacagcctgttcgaggagctgaagagctggagagacgtgtactggagactgtggggcaccatcaactggctgacctgcagcagatgctaccaggccttcctgtgcatcgagttcagccactgccagtaccacagcgagaccgtggtgtaccccaccgccgccagcagcctgaacaccgtgggcaccggcatctacccctgctgcaaccagaaggtgctgagattcgaccccacccagctgaccaagggctgcaaggtgagagaccacatggtgaccctgagagaccagggcgagggcggcgacctgcccagctgccccaccgccagaatgctggacgacctgcacaagtacagagacgtgatcgtggtgcccttcagcaaggacaccgtgagcgacgtgggcgtgggcctgtgcgacgagaagggcatcgagtgcgacgtgctgctggagcccaacaccccctggggccccaagaccggcgagctgaacgccttcctgagcctgaagaactggaccctgcagctgaagcagcagagcctgttcagcgaggaggaggagtacaccaccggcagcgaggtgaccgaggacgaggtgggcgacgaggaggaggtgagcaagaagcagagaaagaaggagaagcccaagaagttcaccagacagcccaagaagcaggtgagcagcccctgcgcccagagaaaggagaaggccctggagaagagcgccagcagagacgtgagccccttcgtgatgagcatgcagaagaacaagtgggacgccaccagaagcctgagattcaaccaggacgcccagagagaggacgaccagagaagaatgaccgagatcaccggccacctgatcaagatgagactgggcgacctggacagagtgaagagcaaggaggccaaggagaccgacaagctgagacccagagacggcaccgtgagcaagagcaacagaaagagcggcctgagcagcgtgctgctgatgaccgtgctgctgtgctag

SEQ ID NO: 23582 - DNA, 2811 bp, Artificial Sequence
  Description of Artificial Sequence: Synthetic coding sequence
atgctgctggccccccagggcagaagcttcagcaagaagagaatgggcctgaacagatggaagagattcaccagaaagcccagccccaagcccaccttcggccccgacagcgtggagcactggatcaagagagtggagaaggccagcgagttcgccgtgagcaacgccttcttcaccagaaacagcgacctgcccagaagcccctggggccagatcaccgacctgaagaccagcgagcagatcgaggaccacgacgagatctacgccgaggcccaggagctggtgaacgactggctggacaccaagctgaagcaggagctggccagcgaggaggagggcgacgccaagaacaccgtgagcagcgtgaccatcatgcccgaggccaacggccacctgaagtacgacaagttcgacgacctgtgcggctacctggaggaggaggaggagagcaccaccgtgcagaagttcatcgaccacctgctgcacaagaacgtggtggacagcgccatgatggaggacctgggcagaaaggagaaccaggacaagaagcagcagaaggaccccagactgaccatggagatgagacacaagcaggtgaaggagaacagactgagaagagagaaggagctggagtaccagagaatcgagaagaccctgaagaagagcgccttcctggaggcccagtgcctggtgcaggaggagaagaagagaaaggccctggaggccaagaaggaggaggaggagatccagagagagatggtgaagctgagaagagagatcatcgagagaagaagaaccgtgaaggccgcctggaagatcgagaagaagagacaggaggagaacagccagaacagcagcgagaaggtgatgttccagagcacccacatcctgcccgacgaggagaagatggtgaaggagagaaagagaaagctgaaggaggtgctgatccagaccttcaaggagaaccagcagtgccagaagagatacttcgccgcctggcacaagctgatcctggaccacagaatcaagctgggcaaggccggcaccctgagcgactggaagatccagctgaaggtgctgagagcctggagagactacaccagattccagaagctggagagagagacccaggccctggagaacgacctgagagaggagaacagaaagcagcagctggccaccgagtacaacagaaagcaggtgctgagacactgcttcaccgagtggcagcactggcacggcgccgagctgctgaagagagagctggccctgaccaaggaggagaccagaaagaagatggacgccctgctgcaggccgccagcctgggcaagctgagcgccaacggcctgagcggcatcagcctgcccgaggaggccaccgccatggtgggcccccccgtgaagaacggccaggagaccgccgtgccccccctgtgggagaagccccccctgggcagcagcggctgcatgctgagcccccccctgggcagaaccaccaccggcaacctgcagggcagcctgcagaacgtgagcctgagcgcccccggcaacaagcagcacaagaccctgggcgccgagcccagccagcagcccggcagcaacgagaccctgagaaccaccagccagaaggccgagcccctgtgcctgggccacttccacaacagacacgtgttccagcagcagctgatcgagaagcagaagaagaagctgcaggagcagcagaagaccatcctggagctgaagaagaacctgcagctggccgaggcccagtgggccgccgagcacgccctggccgtgaccgaggcccagagccacctgctgagcaagcccagagaggaggagcccagaacctgccagatgctggtgaacagccccgtggccagccccggcaccgagggcagaagcgacagcagaaacagcctgagcggcctgagaagaaagcccaagcagctgatgaccccccaccccatcctgaaggccatggaggagagagccatccagagagccgagtgcagaagaatcctggccgagaagaagaagaagcaggaggaggagaagctggcccagctgaaggcccaggaggaggagagacagaagagagaggccgaggagaaggaggcccagctggagagaaagagagaggagaagagactgaagaagatgaaggagctggagaagcagaagagaatcaagagaaaccagcagctggaggccatcgccaaggagcactacgagagagtgctgctgagaaagaagggcctggagccctggaagagactgagaatgcagagcaagcagaacatccaggtggccgaggagcactacagcctgttcctgcagagaaagtacatgctgacctggttccagagaagccaggagagcctggccagaaagatggcccaggccgaccagttctacagccagatcctgctgaagagagtgatccagagctggctgcagtacgtgatcgacctgcaggaggaggtgagaaagttctgcgtgcacttcctgcagaagaagatcttcagagcctggttcaacatggtgagagaggtgaagatcgacagccagggcaagcacgagatcgccgccgagcacagcgacagaagaatcctgtggatcaccctgagaacctggaagaagttcgtgaagttcatgaaggaggagagagtgaaggaggagagaagacagcagctgagaagaaaggtggtggagatcctgcccgacttccaggtgcccggcagataccacgagctgtaccagcagagcgacacctggagcctgagcaagaccagcctggtgaacgagtag

SEQ ID NO: 23583 - DNA, 465 bp, Artificial Sequence
  Description of Artificial Sequence: Synthetic coding sequence
atgagcaagagaaaccaggtgagctacgtgagacccgccgagcccgccttcctggccagattcaaggagagagtgggctacagagagggccccaccgtggagaccaagagaatccagccccagccccccgacgaggacggcgaccacagcgacaaggaggacgagcagccccaggtggtggtgctgaagaagggcgacctgagcgtggaggaggtgatgaagatcaaggccgagatcaaggccgccaaggccgacgaggagcccacccccgccgacggcagaatcatctacagaaagcccgtgaagcaccccagcgacgagaagtacagcggcctgaccgccagcagcaagaagaagaagcccaacgaggacgaggtgaaccaggacagcgtgaagaagaacagccagaagcagatcaagaacagcagcctgctgagcttcgacaacgaggacgagaacgagtag

SEQ ID NO: 23584 - DNA, 495 bp, Artificial Sequence
  Description of Artificial Sequence: Synthetic coding sequence
atggacgaggaggtgagcgaccccaccagcgccgccgcccagctgagacagctgagagaccacctgcccccccccagcagcgccagccccagcagagccctgcccgagccccaggaggcccagaagctggccgccgagagagccagagcccccgtggtgccctacggcgtggacctgcactactggggccaggagctgcccaccgccggcaagatcgtgaagagcgacagccagcacagattctggaagcccagcgaggtggaggaggaggtggtgaacgccgacatcagcgagatgctgagaagcagacacatcaccttcgccggcaagttcgagcccgtgcagcactggtgcagagcccccagacccgacggcagactgtgcgagagacaggacagactgaagaccttccacagctgccccagacccagcggcagcagaggcggcaccgagcccagccccagaccctgcggcagccaggacgccctgctgtag

SEQ ID NO: 23585 - DNA, 6801 bp, Artificial Sequence
  Description of Artificial Sequence: Synthetic coding sequence
atgatgcccggcgagacccacagcgccgcccccggcaccgccgccgacctgagcagatgccagggctgcgccagcctgcagcagaacctgaacgagtacgtggaggccctgatcaccctgaagcagaagatcatcaacaccgacaacctgctgaccgagtaccagaagaagtgcgacgagctgcagttcgccagaagagagaacagcaacctgcaccaccaggtggaggagatgctgcagaagatcagccccctgcagaagtgccaggaggagctgggcagcctgaaggccgagctggaggagaagaagagcagcctgaagctgtaccaggacacccaccaggagtacgccagagtgaaggaggagtgcctgaagagcgacgcccagaagaagaagctggaggccaaggtgaagaagctgcaggaggccgccgtgaagcagacccaggacttcaagcagctgagaaacgagaagaagatcctggagaaggagttcaagaagacccaggagagactggacgagttcagcaagcagaagaacgagaaggagctgagacacatcggcacccagatcagcagcgacagctacggcagcatcgacaagagaaaggtgaagctgctgctgaaggagctgtggctgtgcgtgaacaccacccacagactgcccggcgagggcagcagatgcgtgcccgagaagcccgccaaggccatcaccagcagcagagtgcccggcgaggacggcaccctgccccccacccagggcagccccctgagaaccagcaacgtgcagacctgcctgaccaagctgagcatggagatcaaggaggacttcctgtgccagaacgtggagaagcagagcagcagcggcaccaactgcagcagcgaccacgtgttcaacgagaacggcaacctggaggtgctggtgcagagccacagagacggcggcagcaccgagttcgtggaccacgaccacttcttcgacgaggacctgcaggccgccatcgacttcttcaagctgcccccccccctgctgagccccgtgcccagccccccccccatgagcagcccccaccccggcagcctgcccagcagcttcgcccccgagacctacttcggcgagtacaccgacagcagcgacaacgacagcgtgcagctgagaaacagcgccgagtgcgtgagcgaggacgacaccaccgagagccagaactacttcggcagcctgagaaagaacaagggcagcggcacctgggaggagaagcccaagagccacgaggccatccaggccctgaacacctgggaggtgaacaaggtgaccaccagcggcctggagaccttcaccgccaccctgagagagagcagcgccacccacagcctggtgggcgagaagcactggaccaccgccagcagaagcatgagcgacagaaagagagacatcctgcacgagaccaagacccagatggaggtgagagagatggacaagagcgtgcagaccgagaagaccatccacaagctgaccagaggcctgtgcatcgagagactgagcgccagccccgcccaggagaaggaggccgcccccggcaagagcgagctgtgcagcagccccctgggcaagagacccctgaacgagctgatggagagcgagggcaagaccgtgctgagcaagatgatgggcagccccaagagcgagttcaccaagtggaccagaatcaacgagatcaccagcgagcccgacagaatcaccgtgagcggccacttccacagactgagcagagagctggagaaggagaaggaggacacccagggcttcaccctgggcgagagccccgagagcgaggacgacgacagcggcgacggcatggacgtggccggcctggacatcgagaccagcttcagcagcagcagcaccctggtggccctgagcgtgggcagcaacccccagagcagcagcggcctggactgcggcaacgacaccgacatcaccaccaaggtgttcagcaccgagccccaccacagcgagcacaagctgcagaccaagaccctgaacaccctgcacctgcagagcgagccccccgagtgcagcatcggcggcaacaacctggagaacagcctgtgcgccctgagccccgagctgggcgccagcaacttcaacgaccagaagagcagcggcatcgagtacaccaaggtggtgaagggcctgaccaagatccacagcctgcccagaagcgtgttcatgaaggccaccaaggacggccagtgcgagagccaggaccccagaatcgagctgaccctgaacaagcccgacttcaccagcctgatcggcagccaggccgccctgatcaagagcggcctgggcttcgtgaagagcaccagctggcaccacagcgacctgctgagaaagggcggcgaggagagcctgagagccaagagcgagcacgagcagaagaccagccaccagctgcagaaggccatgcccttcctgcagaacagaggccccacccccaagcccgacctgctgagagagaacaacaaccccgtggagttcaagaccaccgccagcgtgctgcccaaccaggtgagcgtgatcaccaagcagaccagacccgagaaggtgcagagcgccaagctggagcacctgagaccccacagagtggagcccaccctggtgaccgagaacagcggcaacaagaccggcatgagcaccgtggccaagtgcgacggcgagagagacgacaccacccagaacatcaccgaggtggccgccgtgaagagcatcagccccgaggtgagcgccagcagaagaaagctggacttcaacagccccggcggcagcagccccgtggagaacagcgactgcagcaccaacagcagactgagcttcagccccgagaacatcctgatccagaaccaggacatcgtgagagaggccgccgtgcagggcgacggccagaagcagagacagccccaggccaccgacctggacagcagcggcacccacggcagcgagatgctgcccgccaccgaggtgaccgtgagcggcggcttcagcgtggaggagaccagctgcggcgacaccggcagaagcggcggcgaggccctggccgtggccaacgacagcaccagcaccccccagaacgccaacggcctgtggaagctgaagagcaccacccccggcggcgccctgcccgagtgcttcggcaccaccgacaccaccttcagcagcgccttctgcagaaagcacggcgagacccaggacaccagccagagcagcctgcccggcaccctgcactgctacaccggcatcagagagggcggcgacgacaccgaggtggagagcgaggccttcagctgcagcgagggcagcgagcagcaggacgcccccgacgacagccagaagaacctgggcgacaccgacgccgccgtggccgaggtgagacccagcctggaggtgggctacctgaccagcgccctgcaggacttcaacatcagcaccttcagcgagctggacagactgagcaccagcgaggtggtgatgttcctggagagctgccagctgggcgactacagcagcggcgacagcgtgagcgagtgcagcagcaagggcaccctgagcaaggagatgaacaaggagctgaaggccagcgagatcggcgagaagtacagaaagcagccctgcgaggaggagaccctgggcacctgcgaggagtggatcgagagcgaggaggacgactacagcctgaagaacaccagccagctgacccagtgcagcctggagaccctgagcgaggtgctgaccaagatcagacaggagctgcagaccaacagcgaggactgcaacggcaaggacaccggcagcctgctgctgctgaacgtgaacaacaacatgaccaccgagaacctgaaggagaagagccccttcagagagaccaccggcagcagcagccacgccagcgagcccaccccccaggccgccgccctggacaccgagggcagcagccccatcagcggcatgccccagaacgagaacccccagagcagacccgaggccagaagcgacgccggcagacagaccgacggcggcgaggaggacctgcccgagcccgtggagcccagcgccctgtgcagcgacagcgtgatggagcccagcatcgagcagagcagcaactgcgaggccgagaccaccttccagtgccagatcgccaccgtgaccagcgaggtgatcaacgtgctgatcaacaaggaccagaacctggtgatcgagaagggcgacaactggaccatcatcagcggcgtggccgtgctgccccacgtggaccaggtgaccctgtgcgacatccccggcgacatccccatcagccaggaccagggcgagctggaggccggctgcatccccgtgaccagcgccgagaagagccccgaggccagccacaccggccccgccttccaggaggccccctgcggcaacaacctgagctgcccccaggaggacgtgagcagcagcggccagagcaccaacttcgacaagagcagactgagaaacagacccgtgaagcccagcatctggatcagcagccagatctacgaccagaacttcgagacccagatcgtggccagcgaccacacctactacaacagcaagctggagcccagcggcaagaacaagaacagaagcaagatcagcaacaaggaccagagcaacaagcccgtgaagaccagcgccagcagcagagtggagacccaccagagcgaggtggcccagagcttcagcggcgagaaggccaacaccaagacccagagaagccagacccagaccatcctggccaacgccgacaccagcacccccaccgactgcagccccgacaccctgagcaagatcagacaggaggtgggcccccccctgccccccctgctggcccccctgatcgccaccccccccagaaccagccagcccctgagccccctgatcagcagcagcagccccagcagccccgccagccccgtgggccaggtgagccccttcagagagacccccgtgccccccgccatgagcccctggcccgaggaccccagaagagccagcccccccgaccccagccccagccccagcgccgccagcgccagcgagagagtggtgcccagccccctgcagttctgcgccgccacccccaagcacgccctgcccgtgcccggcagactgcccccctgcgccagcggccacgccgccgtgggcggcccccaggagaacagcgtgaagatcctggacaccatgtaccccgagctgagcgccagagccagaaccctgaacatcctgaagggcaacatccagctgaccagaggcccccccgccgactgcaagaacctgcccggccccgccagcgccatgatcggcttcaagaccatcaccagcgccgccaccgccttcgtgaagaccggcagcagcagcggcggcgactgcaaccaggacaagagcagagacctgggcacccagcaggacagcagcggcaagagaaccctgagcaccagcaccctgagaagcgccaagagactgagactggacaccggcagccccgagcccgagaccagaggcgtgaccgccgagggcatccacaagaacctgcccggcaacctgccccccgccgaggtggccaccaccaacgaggagagaagctgcagcagccccgccgtgagcgccgtgagccagctgcccctgagccccaaggagaccgtggagagccacgacaaggccatcgccaacgccctgaagaagatcgccgagttcagcttcgacctgctgcccgtgatcagaagccacgtgtacgtgggcaacatcagcaagaagcccgtgatgagagaccaggagaaggaggtggtgtacgagttcagcaccaccaagaagcacctggccgagtgcctgctgcacagcatcctgagcgagctgaagatccagaagatcagcatggaccacaactacatccacgccctgtgcagagtgtacgtgggcatctgcagacagctgggcgacctggagagagccagactgttctgctacagcctgctgaaggaggacttccccgagagcgagaagctgaccctgttcatcgccaacatgtggcacgacatcttcctgagccagagcgtgatcaacaaggccatgcagctggtggccagacagagagccaagggcgaggtgctgaactgcctgagagccttcctgaactgggagaagaacgcccccgtggacgtgggcttcatggtgagcaagctgctgctgaccatccagctgtgccccaagaccgagttccagcccagcgagaagttcggcgaggacctgagcgacaacacctgggagtacatcttcgccatcgacctgctgtgctgccaccagaagtggatctggacccacgacaacatcatcagcaaggagctgtggcccgtgatggacaagtggatcaagtacagaaagggccacgccaacatcgcctacacccccgacatcatcatcgccagcatcctgagactgatcggcagactgggccagctgggcctgaaggagggcttccccagcgccgtgaagaacatcagcagcgtgatcggcatgttcatccagcacgcccacgacgaggacatcccctggggcatccagctggccgccgtgtacgccctgtgcgacctgagccccagcaaccccgccgagatcagcaagatcctggaggcctggagaagagaggccagcaagagcgtgcccagcgccatcgtgagctgcctggaggaggtgagcgccctgagcaccgaggagctgggctag

SEQ ID NO: 23586 - DNA, 1362 bp, Artificial Sequence
  Description of Artificial Sequence: Synthetic coding sequence
atggaccagttcggcgacatcctggagggcgaggtggaccacagcttcttcgacagcgacttcgaggagggcaagaagtgcgagaccaacagcgtgttcgacaagcagaacgacgaccccaaggagagaatcgacaaggacaccaagaacgtgaacagcaacaccggcatgcagaccaccgagaactacctgaccgagaagggcaacgagagaaacgtgaagttcccccccgagcaccccgtggagaacgacgtgacccagaccgtgagcagcttcagcctgcccgccagcagcagaagcaagaagctgtgcgacgtgaccaccggcctgaagatccacgtgagcatccccaacagaatccccaagatcgtgaaggagggcgaggacgactactacaccgacggcgaggagagcagcgacgacggcaagaagtaccacgtgaagagcaagagcgccaagcccagcaccaacgtgaagaagagcatcagaaagaagtactgcaaggtgagcagcagcagcagcagcagcctgagcagcagcagcagcggcagcggcaccgactgcctggacgccggcagcgacagccacctgagcgacagcagccccagcagcaagagcagcaagaagcacgtgagcggcatcaccctgctgagccccaagcacaagtacaagagcggcatcaagagcaccgagacccagcccagcagcaccacccccaagtgcggccactaccccgaggagagcgaggacaccgtgaccgacgtgagccccctgagcacccccgacatcagccccctgcagagcttcgagctgggcatcgccaacgaccagaaggtgaagatcaagaagcaggagaacgtgagccaggagatctacgaggacgtggaggacctgaagaacaacagcaagtacctgaaggccgccaagaagggcaaggagaagcacgagcccgacgtgagcagcaagagcagcagcgtgctggacagcagcctggaccacagacacaagcagaaggtgctgcacgacaccatggacctgaaccacctgctgaaggccttcctgcagctggacaagaagggcccccagaagcaccacttcgaccagcccagcgtggcccccggcaagaactacagcttcaccagagaggaggtgagacagatcgacagagagaaccagagactgctgaaggagctgagcagacaggccgagaagcccggcagcaagagcaccatccccagaagcgccgaccacccccccaagctgtaccacagcgccctgaacagacagaaggagcagcagagaatcgagagagagaacctgaccatcagcctgtgccaccccggctggagcgccgtgacctag

SEQ ID NO: 23587 - DNA, 342 bp, Artificial Sequence
  Description of Artificial Sequence: Synthetic coding sequence
gaggagagagccgagtacaccgccgacatcatcagcaccaccgtggccgagccctacagaacctgcttcaccgccggcggcagcaagaccagccccgtggagcagcagcccgagcagcagcagccccaggacatcgtgagcctgcccctgccccccctgccccacgccacccccgaccccttcaccctgtacagccacagaaccgagagcgccggcggccacctgttcctgccccaggacctgagatggaagagccccggcctgggcgtgttcgccgtgcagagcgtgtacgagctggccagaagacacaacgtgagccccttctacagcggccccccctag

SEQ ID NO: 23588 - DNA, 1563 bp, Artificial Sequence
  Description of Artificial Sequence: Synthetic coding sequence
atggccggctgcaccagaaagctgacccacctgagaaagagaatccacagacccagaagaagaaccaccagaagatggaagagatggttcaagttcagaaagagaaagggcgagaagagacccagacccaaccacaaggccgtggccagaagagccaagctgaagttcagcaccagcgagaagctgcactggcccgagcaggagctggccaagaagagcatcctgaacgccgaggacagcctgatcatcgacaacaagagaagcatcagccacctgagcagcggcgtgctgaaggacatcttcaccaccggcaccagcagctacaacgtgctgctgcagagcaaggaggagaagaagtaccacagccagaagcagagcagcagcacctacagcaagagatgcagaaagcccagcaagagccccaacaccagcagaagcaaggaccccagaagaatgaaggccctggtgcccgtgaccagcagcggcacctggtactgcctggagagaagacccgccgtgttcgtgaccagcagcgtgagcagccccgtgaagttcacccacgacatcagcgtgaccggcaacggcatcgtgctgccccccaagcccaagagcaaggtgaagtggtgccacttcagcaccctgcccaagcccaagccccagctgagcagaagcttcgagaagggcgacgacttcagcggcaagaagttctgcatcctgaccgccatcaagcccaccaacctggagaaggagaagctgagattcttcaagagcgactacacctacaacccccagttcgagtacgccaaccccgccctgcccagcgtgctggccaagcacagccacgccagcgacagattcctgaagcagatcgtggtgcacctgaccgaggacctgctgagcagagccagcatgaccgtggtgaacggctgccccaccctgaccatcaacgtgagcaccgccagagagcactggctggagggcatgctgagacacgagatcggcacccactacttcagaggcatcaacaacctgcagcagccctggaacagctggaccggcagaaagaagcacgagctgaagcccaacaaccccaccgaggagggcctggccagcatccacagcgtgctgttcagaaaggaccccttcctgtggagagccgccctgctgtactacaccgtgtaccaggccagccagatgagcttctgcgagctgttcaaggacatcggcagattcgtgaaggaccccaacaccagatgggactactgcgtgagagccaagagaggctggaccgacaccagccagcccggctgcttcagcaaggaccaggtgtacctggacggcatcctgcagatcctgagatacagagacaccatcgacttccacctgctgaccgccctgggcaaggtgagctacgaggacgtggacagactgaagggcctggccgtgaccgagaacatgagagtgccccacttcctgcaggaccacggcagatacatggagcacctggagaagatcatggaggtgaacgagctgaccgacagagagctgaaggacctgatctag

SEQ ID NO: 23589 - DNA, 2748 bp, Artificial Sequence
  Description of Artificial Sequence: Synthetic coding sequence
atgcccagaggcagcagagccagaggcagcaagagaaagagaagctggaacaccgagtgccccagcttccccggcgagagacccctgcaggtgagaagagccggcctgagaaccgccggcgccgccgccagcctgagcgaggcctggctgagatgcggcgagggcttccagaacaccagcggcaaccccagcctgaccgccgaggagaagaccatcaccgagaagcacctggagctgtgccccagacccaagcaggagaccaccaccagcaagagcaccagcggcctgaccgacatcacctggagcagcagcggcagcgacctgagcgacgaggacaagaccctgagccagctgcagagagacgagctgcagttcatcgactgggagatcgacagcgacagagccgaggccagcgactgcgacgagttcgaggacgacgagggcgccgtggagatcagcgactgcgccagctgcgccagcaaccagagcctgaccagcgacgagaagctgagcgagctgcccaagcccagcagcatcgagatcctggagtacagcagcgacagcgagaaggaggacgacctggagaacgtgctgctgatcgacagcgagagcccccacaagtaccacgtgcagttcgccagcgacgccagacagatcatggagagactgatcgaccccagaaccaagagcaccgagaccatcctgcacaccccccagaagcccaccgccaagttccccagaacccccgagaacagcgccaagaagaagctgctgagaggcggcctggccgagagactgaacggcctgcagaacagagagagaagcgccatcagcctgtggagacaccagtgcatcagctaccagaagaccctgagcggcagaaagagcggcgtgctgaccgtgaagatcctggagctgcacgaggagtgcgccatgcaggtggccatgtgcgagcagctgctgggcagccccgccaccagcagcagccagagcgtggcccccagacccggcgccggcctgaaggtgctgttcaccaaggagaccgccggctacctgagaggcagaccccaggacaccgtgagaatcttccccccctggcagaagctgatcatccccagcggcagctgccccgtgatcctgaacacctacttctgcgagaaggtggtggccaaggaggacagcgagaagacctgcgaggtgtactgccccgacatccccctgcccagaagaagcatcagcctggcccagatgttcgtgatcaagggcctgaccaacaacagccccgagatccaggtggtgtgcagcggcgtggccaccaccggcaccgcctggacccacggccacaaggaggccaagcagagaatccccaccagcacccccctgagagacagcctgctggacgtggtggagagccagggcgccgccagctggcccggcgccggcgtgagagtggtggtgcagagagtgtacagcctgcccagcagagacagcaccagaggccagcagggcgccagcagcggccacaccgaccccgccggcaccagagcctgcctgctggtgcaggacgcctgcggcatgttcggcgaggtgcacctggagttcaccatgagcaaggccagacagctggagggcaagagctgcagcctggtgggcatgaaggtgctgcagaaggtgaccagaggcagaaccgccggcatcttcagcctgatcgacaccctgtggccccccgccatccccctgaagacccccggcagagaccagccctgcgaggagatcaagacccacctgcccccccccgccctgtgctacatcctgaccgcccaccccaacctgggccagatcgacatcatcgacgaggaccccatctacaagctgtaccagccccccgtgaccagatgcctgagagacatcctgcagatgaacgacctgggcaccagatgcagcttctacgccaccgtgatctaccagaagccccagctgaagagcctgctgctgctggagcagagagagatctggctgctggtgaccgacgtgaccctgcagaccaaggaggagagagaccccagactgcccaagaccctgctggtgtacgtggcccccctgtgcgtgctgggcagcgaggtgctggaggccctggccggcgccgccccccacagcctgttcttcaaggacgccctgagagaccagggcagaatcgtgtgcgccgagagaaccgtgctgctgctgcagaagcccctgctgagcgtggtgagcggcgccagcagctgcgagctgcccggccccgtgatgctggacagcctggacagcgccacccccgtgaacagcatctgcagcgtgcagggcaccgtggtgggcgtggacgagagcaccgccttcagctggcccgtgtgcgacatgtgcggcaacggcagactggagcagagacccgaggacagaggcgccttcagctgcggcgactgcagcagagtggtgaccagccccgtgctgaagagacacctgcaggtgttcctggactgcagaagcagaccccagtgcagagtgaaggtgaagctgctgcagagaagcatcagcagcctgctgagattcgccgccggcgaggacggcagctacgaggtgaagagcgtgctgggcaaggaggtgggcctgctgaactgcttcgtgcagagcgtgaccgcccaccccaccagctgcatcggcctggaggagatcgagctgctgagcgccggcggcgccagcgccgagcactag

SEQ ID NO: 23590 - DNA, 918 bp, Artificial Sequence
  Description of Artificial Sequence: Synthetic coding sequence
atggccagcagacagcccgaggtgcccgccctggaggccagcgcccccctgggcaagatgagcctgcccatcggcatctacagaagagccgtgagctacgacgacaccctggaggaccccgcccccatgacccccccccccagcgacatgggcagcgtgccctggaagcccgtgatccccgagagaaagtaccagcacctggccaaggtggaggagggcgaggccagcctgcccagccccgccatgaccctgagcagcgccatcgacagcgtggacaaggtgcccgtggtgaaggccaaggccacccacgtgatcatgaacagcctgatcaccaagcagacccaggagagcatccagcacttcgagagacaggccggcctgagagacgccggctacaccccccacaagggcctgaccaccgaggagaccaagtacctgagagtggccgaggccctgcacaagctgaagctgcagagcggcgaggtgaccaaggaggagagacagcccgccagcgcccagagcacccccagcaccaccccccacagcagccccaagcagagacccagaggctggttcaccagcggcagcagcaccgccctgcccggccccaaccccagcaccatggacagcggcagcggcgacaaggacagaaacctgagcgacaagtggagcctgttcggccccagaagcctgcagaagtacgacagcggcagcttcgccacccaggcctacagaggcgcccagaagcccagccccctggagctgatcagagcccaggccaacagaatggccgaggaccccgccgccctgaagccccccaagatggacatccccgtgatggagggcaagaagcagccccccagagcccacaacctgaagcccagagacctgaacgtgctgacccccaccggcttctag

SEQ ID NO: 23591 - DNA, 3213 bp, Artificial Sequence
  Description of Artificial Sequence: Synthetic coding sequence
atgtactgctgcagcgcccaggacagcaagatggactacaagagaagattcctgctgggcggcagcaagcagaaggtgcagcagcaccagcagtaccccatgcccgagctgggcagagccctgagcgcccccctggccagcaccgccaccaccgcccccctgggcagcctgaccgccgccggcagctgccaccacgccatgccccacaccacccccatcgccgacatccagcagggcatcagcaagtacctggacgccctgaacgtgttctgcagagccagcaccttcctgaccgacctgttcagcaccgtgttcagaaacagccactacagcaaggccgccacccagctgaaggacgtgcaggagcacgtgatggaggccgccagcagactgaccagcgccatcaagcccgagatcgccaagatgctgatggagctgagcgccggcgccgccaacttcaccgaccagaaggagttcagcctgcaggacatcgaggtgctgggcagatgcttcctgaccgtggtgcaggtgcacttccagttcctgacccacgccctgcagaaggtgcagcccgtggcccacagctgcttcgccgaggtgatcgtgcccgagaagaagaacagcggcagcggcggcggcctgagcggcatgggccacacccccgaggtggaggaggccgtgagaagctggagaggcgccgccgaggccaccagcagactgagagagagaggctgcgacggctgcctggccggcatcgaggtgcagcagctgttctgcagccagagcgccgccatccccgagcaccagctgaaggagctgaacatcaagatcgacagcgccctgcaggcctacaagatcgccctggagagcctgggccactgcgagtacgccatgaaggccggcttccacctgaaccccaaggccatcgaggccagcctgcagggctgctgcagcgaggccgaggcccagcagaccggcagaagacagacccccccccagcccatgcagtgcgagctgcccaccgtgcccgtgcagatcggcagccacttcctgaagggcgtgagcttcaacgagagcgccgccgacaacctgaagctgaagacccacaccatgctgcagctgatgaaggaggccggctgctacaacggcatcaccagcagagacgacttccccgtgaccgaggtgctgaaccaggtgtgccccagcacctggagaggcgcctgcaagaccgccgtgcagctgctgttcggccaggccggcctggtggtggtggacaccgcccagatcgagaacaaggaggcctacgccccccagatcagcctggagggcagcagaatcgtggtgcaggtgcccagcacctggtgcctgaaggaggaccccgccaccatgagcctgctgcagagaagcctggaccccgagaagaccctgggcctggtggacgtgctgtacaccgccgtgctggacctgaacagatggagagccggcagagagcaggccctgccctgcatccagatccagctgcagagagagatctgcgacttcggcaaccaggccgacctgcccagcggcaacggcaacaagagcagcggcggcctgcagaagaccttcagcaagctgaccagcagattcaccaagaaggccagctgcaccagcagcagcagcagcaccaactacagcatccagaacacccccagcaagaacatcttcatcgccggctgcagcgaggagaaggccaagatgcccggcaacatcgacaccagactgcagagcatcctgaacatcggcaacttccccagaaccaccgaccccagccagagcgcccagaacagcagcaacaccgtggccaacggcttcctgatggagagaagagagaacttcctgcacggcgacgacggcaaggacgagaagggcatgaacctgcccaccgaccaggagatgcaggaggtgatcgacttcctgagcggcttcaacatgggccagagccaccagggcagccccctggtgaccagacacaacagcgccgccaccgccatggtgaccgagcagaaggccggcgccatgcagccccagcagcccagcctgcccgtgccccccccccccagagccccccaggccggcgcccacacccccctgaccccccagcccggcctggccccccagcagcagagccccaagcagcagcagccccaggtgcagtactaccagcacctgctgcagcccatcggcccccagcagccccccccccagcccagagcccccggcaagtgggtgcacggcagcagccagcagcccgcccaggccgtgggcgccggcctgagccccctgggccagtggcccggcatcagcgacctgagcagcgacctgtacagcctgggcctggtgagcagctacatggacaacgtgatgagcgaggtgctgggccagaagccccagggccccagaaacaacacctggcccaacagagaccagagcgacggcgtgttcggcatgctgggcgagatcctgcccttcgaccccgccgtgggcagcgaccccgagttcgccagatacgtggccggcgtgagccaggccatgcagcagaagagacaggcccagcacggcagaagacccggcaaccccagaggcaactggccccccatggacgacgcccacagaacctggcccttccccgagttcttcaccgagggcgacggcctgcacggcggctggagcggcgcccagggcgacagcgccagcagcagcgacgagaccagcagcgccaacggcgacagcctgttcagcatgttcagcggccccgacctggtggccgccgtgaagcagagaagaaagcacagcagcggcgagcaggacaccagcaccctgcccagcccccccctgctgaccaccgtggaggacgtgaaccaggacaacaagaccaagacctggccccccaaggccccctggcagcaccccagccccctgcccagcaccctgcccagccccagcgcccccctgtacgccgtgaccagccccggcagccagtggaacgacaccatgcagatgctgcagagccccgtgtgggccgccaccaacgactgcagcgccgccgccttcagctacgtgcagacccccccccagcccccccccccccccgcccacaaggccgcccccaagggcttcaaggccttccccggcaagggcgagagaagacccgcctacctgccccagtactag

SEQ ID NO: 23592 - DNA, 4188 bp, Artificial Sequence
  Description of Artificial Sequence: Synthetic coding sequence
atgtaccccatctgcaccgtggtggtggacggcctgcccagcgagagcagcagcagcagctaccccggccccgtgagcgtgagcgagatgagcctgctgcacgccctgggccccgtgcagacctggctgggccaggagctggagaagtgcggcatcgacgccatgatctacaccagatacgtgctgagcctgctgctgcacgacagctacgactacgacctgcaggagcaggagaacgacatcttcctgggctgggagaagggcgcctacaagaagtggggcaagagcaagaagaagtgcagcgacctgaccctggaggagatgaagaagcaggccgccgtgcagtgcctgagaagcgccagcgacgagagcagcggcatcgagaccctggtggaggagctgtgcagcagactgaaggacctgcagagcaagcaggaggagaagatccacaagaagctggagggcagccccagccccgaggccgagctgagcccccccgccaaggaccaggtggagatgtactacgaggccttcccccccctgagcgagaagcccgtgtgcctgcaggagatcatgaccgtgtggaacaagagcaaggtgtgcagctacagcagcagcagcagcagcagcaccgccccccccgccagcaccgacaccagcagccccaaggactgcaacagcgagagcgaggtgaccaaggagagaagcagcgaggtgcccaccaccgtgcacgagaagacccagagcaagagcaagaacgagaaggagaacaagttcagcaacggcaccatcgaggagaagcccgccctgtacaagaagcagatcagacacaagcccgagggcaagatcagacccagaagctggagcagcggcagcagcgaggccggcagcagcagcagcggcaaccagggcgagctgaaggccagcatgaagtacgtgaaggtgagacacaaggccagagagatcagaaacaagaagggcagaaacggccagagcagactgagcctgaagcacggcgagaaggccgagagaaacatccacaccggcagcagcagcagcagcagcagcggcagcgtgaagcagctgtgcaagagaggcaagagacccctgaaggagatcggcagaaaggaccccggcagcaccgagggcaaggacctgtacatggagaacagaaaggacaccgagtacaaggaggagcccctgtggtacaccgagcccatcgccgagtacttcgtgcccctgagcagaaagagcaagctggagaccacctacagaaacagacaggacaccagcgacctgaccagcgaggccgtggaggagctgagcgagagcgtgcacggcctgtgcatcagcaacaacaacctgcacaagacctacctggccgccggcaccttcatcgacggccacttcgtggagatgcccgccgtgatcaacgaggacatcgacctgaccggcaccagcctgtgcagcctgcccgaggacaacaagtacctggacgacatccacctgagcgagctgacccacttctacgaggtggacatcgaccagagcatgctggaccccggcgccagcgagaccatgcagggcgagagcagaatcctgaacatgatcagacagaagagcaaggagaacaccgacttcgaggccgagtgctgcatcgtgctggacggcatggagctgcagggcgagagagccatctggaccgacagcaccagcagcgtgggcgccgagggcctgttcctgcaggacctgggcaacctggcccagttctgggagtgctgcagcagcagcagcggcgacgccgacggcgagagcttcggcggcgacagccccgtgagactgagccccatcctggacagcaccgtgctgaacagccacctgctggccggcaaccaggagctgttcagcgacatcaacgagggcagcggcatcaacagctgcttcagcgtgttcgaggtgcagtgcagcaacagcgtgctgcccttcagcttcgagaccctgaacctgggcaacgagaacaccgacagcagcgccaacatgctgggcaagacccagagcagactgctgatctggaccaagaacagcgccttcgaggagaacgagcactgcagcaacctgagcaccagaacctgcagcccctggagccacagcgaggagaccagaagcgacaacgagaccctgaacatccagttcgaggagagcacccagttcaacgccgaggacatcaactacgtggtgcccagagtgagcagcaactacgtggacgaggagctgctggacttcctgcaggacgagacctgccagcagaacagcagaaccctgggcgagatccccaccctggtgttcaagaagaccagcaagctggagagcgtgtgcggcatccagctggagcagaagaccgagaacaagaacttcgagaccacccaggtgtgcaacgagagcccccacggcgacggctacagcagcggcgtgatcaaggacatctggaccaagatggccgacaccaacagcgtggccaccgtggagatcgagagaaccgacgccgagctgttcagcgccgacgtgaacaactactgctgctgcctggacgccgaggccgagctggagaccctgcaggagcccgacaaggccgtgagaagaagcgagtaccacctgtgggagggccagaaggagagcctggagaagagagccttcgccagcagcgagctgagcaacgtggacggcggcgactacaccacccccagcaagccctgggacgtggcccaggacaaggagaacaccttcatcctgggcggcgtgtacggcgagctgaagaccttcaacagcgacggcgagtgggccgtggtgccccccagccacaccaagggcagcctgctgcagtgcgccgccagcgacgtggtgaccatcgccggcaccgacgtgttcatgacccccggcaacagcttcgcccccggccacagacagctgtggaagcccttcgtgagcttcgagcagaacgaccagcccaagagcggcgagaacggcctgaacaagggcttcagcttcatcttccacgaggacctgctgggcgcctgcggcaacttccaggtggaggaccccggcctggagtacagcttcagcagcttcgacctgagcaaccccttcagccaggtgctgcacgtggagtgcagcttcgagcccgagggcatcgccagcttcagccccagcttcaagcccaagagcatcctgtgcagcgacagcgacagcgaggtgttccaccccagaatctgcggcgtggacagaacccagtacagagccatcagaatcagccccagaacccacttcagacccatcagcgccagcgagctgagccccggcggcggcagcgagagcgagttcgagagcgagaaggacgaggccaacatccccatccccagccaggtggacatcttcgaggacccccaggccgacctgaagcccctggaggaggacgccgagaaggagggccactactacggcaagagcgagctggagagcggcaagttcctgcccagactgaagaagagcggcatggagaagagcgcccagaccagcctggacagccaggaggagagcaccggcatcctgagcgtgggcaagcagaaccagtgcctggagtgcagcatgaacgagagcctggagatcgacctggagagcagcgaggccaactgcaagatcatggcccagtgcgaggaggagatcaacaacttctgcggctgcaaggccggctgccagttccccgcctacgaggacaaccccgtgagcagcggccagctggaggagttccccgtgctgaacaccgacatccagggcatgaacagaagccaggagaagcagacctggtgggagaaggccctgtacagccccctgttccccgccagcgagtgcgaggagtgctacaccaacgccaagggcgagagcggcctggaggagtaccccgacgccaaggagacccccagcaacgaggagagactgctggacttcaacagagtgagcagcgtgtacgaggccagatgcaccggcgagagagacagcggcgccaagagcgacggcttcagaggcaagatgtgcagcagcgccagcagcaccagcgaggagaccggcagcgagggcggcggcgagtgggtgggccccagcgaggaggagctgttcagcagaacccacctgtag

SEQ ID NO: 23593 - DNA, 5229 bp, Artificial Sequence
  Description of Artificial Sequence: Synthetic coding sequence
atgtggcccgccggcgccggcaccaagctgccctgccccagagacagcgccctgagaagagccgccttcagcggcaacctgaccgccctgcccagccacctggtgcccgccggcagaagcgtgagagtgttcatcagcgccaaccccgaggacaccggcgccgagagacaggccctgagagagaacgtgtaccccaagctgagagagttctgcagagagaactacggcctggagttccaggtgatcgacctgtactggggcgtggaggaggacgagtgggacagccccgagctgcagaagaccagaatgaagctgctggagaactgcctgaagaccagcgccggcccctgcttcgtgggcctgctgggcgagaagtacggcaacatcagaatccccggcgaggtggaggccagcgagttcgagatgatcctggacgccgccatcgaggccaagctggagaccaagctgctggaggagtggtactgcagagacgagaacagcgtgcccgccgcctactacctgagacccaagagcgagatgctgagaagcaacagaaacgccatgcagcccagcaccaacgccgagaacgagaagacctggcaggagatcagcgacgagatcaagaagatcttcaaggccgccgtgaagctgctgcacgagaagggcaagatgaagcacagccaggccaagagatacctgttcagcgccatcgaggacgagttcgacttcgccctgggcaagcagacccccgccttcctgaagaagtgcgtgtgctacatcagaaagatcgccaacatcgagagattcgtgaagatccccgagatgggcaagtacatggacatcaccggcaccgagcccagaatcatcagagaccccgaggcccaggagaagctgatcaagctgagagacgagttcatccccaccatcgtggccagcagcaacctgagagtgtacaccagcgtgacccactgcgacatgaagctgggctacagccaggagatcgagaaccactacatcgagggcctgggcaagcagttctacgaggacatgatcgacatcatccaggccaccatccagcagaacttcgacaccgagaccgacaccctgtacgacgagatcctgcagcacagcagcctgtgcaagacctacgccagcttctacgagtacaagtgcgagagcctgaacatcgtgcacaactacatcctgcccagcaaggccggccacatcaaccccctgatcatctacggcggcccctgcaccggcaagaccctgctgctggccgaggtggccaagaaggcctacggctggctgcacgaggacaccggccccgagagcgaccccgtggtgatcgtgagattcctgggcaccaccgacatgagcagcgacctgagaaccctgctgctgagcgtgtgcgagcagctggccgtgaactacagatgcctggtgcagagctaccccaagaagatccacgacctgtgcgacctgttcatcaacctgctgaacgagagcagcctgcagagacccctggtgatcatcttcgacgccctggagcagctgagcgagaacgacgacgccagaaagctgtggtggctgcccgcccacctgcccagattcgtgagaatcgtgctgagcaccctgcccaacaagcacggcatcctgcagaagctgagatgcctgatccacgaggaggacaactacatcgagctgatccccagagacagaaagatgtgcagccaggtgctgaagcaccagctgctgagagtgaagagaaaggtgaccagcggccagcagatctacgtgaacaacgccctgagcaagtgcaccctgcccatgttcgtgaacctgaccttcagagaggtgagacactggagaagccacaaggacgtggacgagagcagcctgagcgtgaccgtgcacgagagcatcgagcagctgttctggagcctggagaagaagtgcggccagaagctggtgagcagagccctgggctacatcaccatggccaagatgggcctgagcgagatggagctggaggacgtgctggccctggacaacagcgtgatgagcgagctgaaggagaacaccagacccagcaaccccctgagagtgccctacctgtacatcgccagactgaaggagggcctgagcggctacctgatcgagagacacgtgaagaacgtgaccctgctggtgtgggccaacagacacctgcagctgatcgcccagaagctgtacctgcaggacgacaacgacctgagagagatgcacaccatcctggccgactacttcctgggcgtgtggagcggcggcagaagaaaggccttctgcctggaggacccctacctgaacggctgcctggacctggagaacagaagcctgctggaggaggagaagcacttcatggagcaggccagcttcgacagacaggcccccgaccagccctgggtgttccagtgcaaccccctggagcccgacatcttcttcgtgaaccacagaaagatgagcgagctgctgtaccacctgaccagatgcggcaagaccgacgacctgctgtacggcatcatcatgaacttcagctggctgtacaccatgatcaagatcggccagttcgacaaggtgctgagcgacatcgagctggcctacaactacagccaggagaaggagctgaagttcctggccaacaccctgagaagcatcaagaacaaggtgaccgccttccccggcagcctgagcgccgagctgcagcagagactgctgcccgtggtgagcagcctgcccaagctgagacacctgctgctggagtgcgacaaggacggccccaagtactgcagcatcgtgcccctgcacagcagcatggacgtgacctacagccccgagagactgcccctgagcagcagccacctgcacgtgaccgagatcctgcccacctgcaaccccagcaccgtgctgaccgccctggagaacggcagcatcagcacctgggacgtggagaccagacagctgctgagacagatcaccaccgcccagagcgtgatcctgggcatgaagctgaccagcgacgagaagtacctggtggtggccaccaccaacaacaccctgctgatctacgacaacgtgaacagctgcctgctgagcgaggtggagatcaagggcaccaagcacggcagcagcgccacctacatcaacggcttcaccctgagcgccaaccacgccctggcctggctggaggccagcaaggacgtgaccgtgatcgacctgctgtacggctggcccctgtaccagttccactgctggtacgaggtgacctgcgtgcagtgcagcctggacggcctgtacgccttctgcggccagtacctgaacaccaccaccatcttccacctgggcagcggcgagaagctgtgcaccgtgaccagcgagttcagcggcggcttcgtgaagttcctgctgatcctggacaccgcccaggagatggtgatggtggacagcgagggcagcctgagcgtgtggaacaccgaggacatcagcagcccccagctgaccgacgacttcgactgcagaagagaggacagcgaggtggtgagcatcgagctgagcgaggaccagagcgccgtgctgatctgcaaggccctgagcatcgagctgctggacaccggcctgtggaaggtggccgagaagttcagagccaagcacaacgagagattcatcagcgccgtgctgagcaagaacggcgactgcatcatcgccaccatggagaacaccagcgccgtgttcttctggagaagagacaccggccagtgcatggccagcctgcaggagatcagcggcagcatcgtgaagctggtgaagagcagccaccacaacatgctgctgagcctgagcaccagcggcgtgctgagcatctgggacatcgacatcatcaccgccatgagcaacatcgacaagaccggcaagcccatccagagcctgctgctgcccgccagaggcgagatcatctacagcctggacggcagcgactgcgtgcacaagtggaacttcagcagcggcttcatcgaggccgtgttcaagcacgagggcatcgtggagcactgcgtgctgaccagcaccggcgacatcatggtgaccagcgacgacaagagcagccagtacgtgtggcacaccagcagcggcgagaacctgttcagaatcaacggccagagaatcagccagctgctgatcacccacaacgaccagttcgtggtgagcctgtgcgaggagaacgccagcagagtgtggagactggccaccggccacagagtgtgcaacatcctgaccaccctgcagaacgccttcatcaccagcgccaacaccttcgtggtgggcatgaccaagagcaaggtgctggccgtgagcctgtggaccggcagcatcaccaagaagttctgctgcgaggacggcaccaccatcgtgaacttcaagctgatccccgactgccccgacatcatcgtgttcatcaccagcgccgagaccgtgaacatctggagcctgaccgacgaggtgatctgcagaagagtgcagctgcccaacaacttcctgaagaacctggaggacttcgagatcagccccaacggcaagctgggcatcatcgccagaggcgacgagaacatcaacgtgctggacctgtacagcggcaagctgagagtggtgcacgccagcggcatcatctggagacagagactgagcagagacggcagatacctggtgtacatctgcttcagaaacggcgaggaggaggacgagaacggcgccatcttcagcctgatcgtgatgagactggccgacggcaagaacatcggcgcctgcagcctgtacaagacccccaccttcctggccctgagccagagacacctgaacatcatcgtgggcttcgacgacggcagcatcggcatctacaccgtggtggacagagtggacgccgccctgaagatcaagatcgccaccagcaacagcagacagatcttcaacaacgccacccacaccagcagacccaagtgcaacagctactgcttcaagatcagcgtggactgcctgtggagagagagcaccgaggtgttcgccagagacagccccatcaccgtgagcgacagcaccgagagcaacgaggccacccccagcaagaagcacaacagctgctacgagagagtgtgcagcgccctggaggccagaggccacagctacgcccccgacaactag

SEQ ID NO: 23594 - DNA, 348 bp, Artificial Sequence
  Description of Artificial Sequence: Synthetic coding sequence
gtgagcggcggcgtgagactgcccgccagcgagagaagattcctgagctgctgccccctgcccgccagacccctgctgcagagactggccagcagacaccccgccagcctgccctgcagccagcagctgctgtggagaagcagcagagccccccccctgctgcccagcctgcccctgggcgtgctgatcaccgaccccctgaccagacaccccggccaccaccaccccgcccccttccacagcgccgccctgctggtgcccgtgaagccccccaccgcctgggagggcaagagcagactggccagaccctgcctgagccaggccctggaggcctgccagctgacctag

SEQ ID NO: 23595 - DNA, 585 bp, Artificial Sequence
  Description of Artificial Sequence: Synthetic coding sequence
atggccgccaagagcacccaggacagcctgcccagagacaccggcgagcccagcgccctgcccgtgcagggcagagccgagggcagaagcagcgagggcagaaaggagagaaccgccgagtgcgccctgagaggcaagcaggccagcgagcccgccctgagaaagagaaacttcctgcccggccccaacagcgacaccgtgagacccgccgccgagaccgagctggtgccctgcagcctgagacaccccagacaggacctgtgcggcgagcaccccagcttccccgtgatgcagcccagcctggagacccaggccaagcccgagagagacagagccgtgctgatcccccccaagggcccctggccccccgcccagggcctggccatgagaacccactgccccaccggcccccccagcaaggcctactgcagaggcggcagcagcagcaccagcagaaaccaggtggccagcctggcctacagaacccagaacaccgccgccagccagcccagacagcccggcggcagaggcaaggaggacaccgccggctacggcagctgcagccccagaagcctggccgtgtag

SEQ ID NO: 23596 - DNA, 2817 bp, Artificial Sequence
  Description of Artificial Sequence: Synthetic coding sequence
atggactgggacgacgagtacagccacaacagcttcgacctgcactgcctgctgaacagcttccccggcgacctggagttcgagcagatcttcagcgacatcgacgagaagatcgagcagaacgccgccagcatcaagcactgcatcaaggagatccagagcgagatcaacaagcagtgccccggcgtgcagctgcagaccaccaccgactgcttcgagtggctgaccaactacaactacagcaccagcgagagcagcttcatcagccacggcgacctgatcaagttcttcaagaccctgcaggacctgctgaagaacgagcagaaccaggaggagatgaccctggacctgctgtgggacctgagctgccacagcagcgtgagcttccccagcaccctgagcggcaccagcttccacttcctgagcagaaccagcctgcacagcgtggaggacaacagcagcatggacgtgaagagcatgtgggacgacatcagactgcacctgagaagattcctggtgagcaagctgcagagccacaacgagatcaacaacagccagcagaagatcctgctgaagaagcagtgcctgcagcagctgctgttcctgtaccccgagagcgaggtgatcatcaagtaccagaacatccagaacaagctgctggccaacctgctgtggaactgcttccccagctacaacagagacagcaacctggacgtgatcgcccacggctaccagagcaccatgctgaagctgtacagcgtgatcaaggaggacttcaacaccctgtgcgagatcctggcccccagcagcatggtgaagttcatcaaggagacctacctggacaccgtgaccgaggagatggccaagttcctggagaacttctgcgagctgcagttcagagagaacgccgtgagagtggtgaagaccagcaagagcagcagcaagcacagaggcgccgtgcacgccctggtgaccaccgagtgcccccagaagggcagaaacttcagcctgcccctggacaaggtggagttcctgagccagctgatcaagagcttcatgaagctggagaagggcgtgcaggagctgttcgacgagatcctgctgagcctgaagatcaccagagacaccagcggcatcctggagaagagcgacagagaggtggtgatggagaagcccagagccaacgagaccaacatccccagcgagcagagcctgcccggcaaggaggccaccctgctggacttcggctggagaagcgccttcaaggaggtgagcctgcccatggcccactgcgtggtgaccgccatcgagggcttcagcaccaagatcctgcagcaggagcagaacgagagaagcagcgccgtgagctacgccatgaacctggtgaacgtgcagcaggtgtggcaggacagccacatgttccccgaggaggagcagcccaagaagatcggcaagttctgcagcgacatcatggagaagctggacaccatgctgcccctggccctggcctgcagagacgacagcttccaggagatcagagccaacctggtggaggcctgctgcaaggtggccaccgccgtgctgcagagactgcaggagagagccaaggaggtgcccagcaaggcccccctgaagaacctgcacacctacctgagcaccgccgtgtacgtgttccagcacttcaagagatacgacaacctgatgaaggagatgaccaagaagcccatcttcctggtgctggtgcagagataccaggagttcatcaacaccctgcagttccaggtgaccaactactgcgtgagagtgtgcgccaccagcatcctgcaggacgccgagagccaccactgggacgactacaaggccttctacgagggcgagagatgcagcttcagcatccagatgtggcactacttctgctggagcctgcactacgacctgtggaccatcctgccccccaagctggcccaggagatcctggtggaggtgctggagaagagcctgagcctgctggccagcagatacgccagagcccaccccagcagaaagagaaccccccagctgagactggacgtgaccaccatcctgatctgcaccgagaacatgctgtggagcgtgtgcaccagcgtgcagaagctgctgaacccccaccagcacaccgacgacaagatcttcaagatccacacccactgcaacaacctgttcaccaccctggtgatcctgaccagccccctgaccgagctgtacaagaccttccagcacggcctggacgagagcgccagcgacagcctgaagagcttcttcaagcagcccctgtactgggtgagctgcatcagccacttctaccccagcctgctgagaacccccagcgccggcggcctgaaggccgagggccagctgaagctgctgctgagccagcccagatgcaactggaacctgctgctggagaccctgctgcaccacgacggcctgctgctgagaatcctgctgaagagcagcaagagaaccttccaggagcaggtgagcgacaccgagaacaacctgaaccagggccccagcctgatggaggccatcttcaagatcctgtaccactgcagcttcagcccccagaccttcgccaacgtgttcgtgagctacatggaggaggagcagctgtgggacttcctgtacaacatccccggcatgagacacctgctgttcgtgaaggagatgttctacagatacctgtacgtgcccctgaagatgttcagaagctgcatcgacaccggcttcgccgagagcgtggtgggcgagagcctgccctacatcttcagcgtgtag

SEQ ID NO: 23597 - DNA, 480 bp, Artificial Sequence
  Description of Artificial Sequence: Synthetic coding sequence
atgagaaacgccagaagcatcagacccgccagagccgagagctggagactgagcctgtgcttcctgaactggcaggacgccatcatcagcaagccccactgccccgccggcagaacctgccccaccgccgccgccagccacggcagcagaggcgccggccacagcgacaaggaccagggcagaagccccaagcacgtggtgtgccacgtggagcacaagaagcagtgccccgccgagttcaccgacagcagaggcgtgcacaacgccgccgccagcatcagcagccaggtgggcttccccggccacctgaccgccagaaccgccgcccacaagagagaggccctggccgtgagccccacccccaccctgcaggtgaacgcccccggcgccaagctgagagcccccaaggcccccagaacccccgaggccctgggcagaggccccaagagagccggcgagtggaagaccggctgcttctag

SEQ ID NO: 23598 - DNA, 3240 bp, Artificial Sequence
  Description of Artificial Sequence: Synthetic coding sequence
atggacgacgacgacgacagctgcctgctggacctgatcggcgacccccaggccctgaactacttcctgcacggccccagcaacaagagcagcaacgacgacctgaccaacgccggctacagcgccgccaacagcaacagcatcttcgccaacagcagcaacgccgaccccaagagcagcctgaagggcgtgagcaaccagctgggcgagggccccagcgacggcctgcccctgagcagcagcctgcagttcctggaggacgagctggagagcagccccctgcccgacctgaccgaggaccagcccttcgacatcctgcagaagagcctgcaggaggccaacatcaccgagcagaccctggccgaggaggcctacctggacgccagcatcggcagcagccagcagttcgcccaggcccagctgcaccccagcagcagcgccagcttcacccaggccagcaacgtgagcaactacagcggccagaccctgcagcccatcggcgtgacccacgtgcccgtgggcgccagcttcgccagcaacaccgtgggcgtgcagcacggcttcatgcagcacgtgggcatcagcgtgcccagccagcacctgagcaacagcagccagatcagcggcagcggccagatccagctgatcggcagcttcggcaaccaccccagcatgatgaccatcaacaacctggacggcagccagatcatcctgaagggcagcggccagcaggcccccagcaacgtgagcggcggcctgctggtgcacagacagacccccaacggcaacagcctgttcggcaacagcagcagcagccccgtggcccagcccgtgaccgtgcccttcaacagcaccaacttccagaccagcctgcccgtgcacaacatcatcatccagagaggcctggcccccaacagcaacaaggtgcccatcaacatccagcccaagcccatccagatgggccagcagaacacctacaacgtgaacaacctgggcatccagcagcaccacgtgcagcagggcatcagcttcgccagcgccagcagcccccagggcagcgtggtgggcccccacatgagcgtgaacatcgtgaaccagcagaacaccagaaagcccgtgaccagccaggccgtgagcagcaccggcggcagcatcgtgatccacagccccatgggccagccccacgccccccagagccagttcctgatccccaccagcctgagcgtgagcagcaacagcgtgcaccacgtgcagaccatcaacggccagctgctgcagacccagcccagccagctgatcagcggccaggtggccagcgagcacgtgatgctgaacagaaacagcagcaacatgctgagaaccaaccagccctacaccggccccatgctgaacaaccagaacaccgccgtgcacctggtgagcggccagaccttcgccgccagcggcagccccgtgatcgccaaccacgccagcccccagctggtgggcggccagatgcccctgcagcaggccagccccaccgtgctgcacctgagccccggccagagcagcgtgagccagggcagacccggcttcgccaccatgcccagcgtgaccagcatgagcggccccagcagattccccgccgtgagcagcgccagcaccgcccaccccagcctgggcagcgccgtgcagagcggcagcagcggcagcaacttcaccggcgaccagctgacccagcccaacagaacccccgtgcccgtgagcgtgagccacagactgcccgtgagcagcagcaagagcaccagcaccttcagcaacacccccggcaccggcacccagcagcagttcttctgccaggcccagaagaagtgcctgaaccagaccagccccatcagcgcccccaagaccaccgacggcctgagacaggcccagatccccggcctgctgagcaccaccctgcccggccaggacagcggcagcaaggtgatcagcgccagcctgggcaccgcccagccccagcaggagaaggtggtgggcagcagccccggccaccccgccgtgcaggtggagagccacagcggcggccagaagagacccgccgccaagcagctgaccaagggcgccttcatcctgcagcagctgcagagagaccaggcccacaccgtgacccccgacaagagccacttcagaagcctgagcgacgccgtgcagagactgctgagctaccacgtgtgccagggcagcatgcccaccgaggaggacctgagaaaggtggacaacgagttcgagaccgtggccacccagctgctgaagagaacccaggccatgctgaacaagtacagatgcctgctgctggaggacgccatgagaatcaaccccagcgccgagatggtgatgatcgacagaatgttcaaccaggaggagagagccagcctgagcagagacaagagactggccctggtggaccccgagggcttccaggccgacttctgctgcagcttcaagctggacaaggccgcccacgagacccagttcggcagaagcgaccagcacggcagcaaggccagcagcagcctgcagccccccgccaaggcccagggcagagacagagccaagaccggcgtgaccgagcccatgaaccacgaccagttccacctggtgcccaaccacatcgtggtgagcgccgagggcaacatcagcaagaagaccgagtgcctgggcagagccctgaagttcgacaaggtgggcctggtgcagtaccagagcaccagcgaggagaaggccagcagaagagagcccctgaaggccagccagtgcagccccggccccgagggccacagaaagaccagcagcagaagcgaccacggcaccgagagcaagctgagcagcatcctggccgacagccacctggagatgacctgcaacaacagcttccaggacaagagcctgagaaacagccccaagaacgaggtgctgcacaccgacatcatgaagggcagcggcgagccccagcccgacctgcagctgaccaagagcctggagaccaccttcaagaacatcctggagctgaagaaggccggcagacagccccagagcgaccccaccgtgagcggcagcgtggagctggacttccccaacttcagccccatggccagccaggagaactgcctggagaagttcatccccgaccacagcgagggcgtggtggagaccgacagcatcctggaggccgccgtgaacagcatcctggagtgctag

SEQ ID NO: 23599 - DNA, 1566 bp, Artificial Sequence
  Description of Artificial Sequence: Synthetic coding sequence
atggaggccagcgtgctgagccccaccagctgggagaagagaagagcctggctgagacagagcagaaactggcagacccaggtgctggaggaggaggccgccgccgccctgcaggacgtgcccgaccccgagcccagcagcctggacgacgtgttccaggagggcaaccccatcaacaagatcgaggactggctgcaggactgcggctacagcgaggagggcttcagcgaggaggccggccagttcatctacaacggcttctgcagccacggcaccagcttcgaggacgacctgaccctgggcgccgaggccaccctgctggccgccaacggcaagctgttcagcagaagcttcctggagaccgccagaccctgccagctgctggacctgggctgcagcctggccagcagcagcatgaccggcggcaccaacaagaccagcagcagcatcagcgagatcctggacaaggtgcaggaggacgccgaggacgtgctgttcagcctgggcttcggccaggaggaccacaaggacaccagcagaatccccgccagattcttcaccacccccagccaggccaagggcatcgacttccagctgttcctgaagagccaggtgagaagaatcgagatggaggacccctgcctgatgctggccagcagattcaagcaggtgcagaccctggccgtgaccgccgacgccttcttctgcctgtacagctacgtgagcaagacccccgtgcagaagttcacccccagccacatgttctggaactgcaaccaccccaccgacgtgcccagcatcagaatcctgagcagagagcccgagccccagagccccagagacagactgagaaaggccatcagcaagatgtgcctgtacacctgccccagagacagacccccccccccccacaacacccccaagagaaacagcctggaccaggtggtgctggaggtgatggacaaggtgaaggaggagaagcagttcctgcagcaggacagcgacctgggccagttcagccaggaggaccccgtgccccccgccgagggcaagaagctgcccaccagcccctacccctgcgtgttctgctgcgaggaggagacccagcagagaatgagcaccgtgctggcccccagccagaccctggacagcaaccccaaggtgccctgctgcacccacagcctgcccatcgaggacccccagtggagcaccgaccccgcccagatcagaagagagctgtgcagcctgcccgccaccaacaccgagacccaccccgccaaggacgagaccttctggaagagaaagagcagagccagaaagagcctgttccagaagaacctgatgggcagaaaggtgaagagcctggacctgagcatcacccagcagaagtggaagcagagcgtggacagacccgagctgagaagaagcctgagccagcagccccaggacaccttcgacctggaggaggtgcagagcaacagcgaggaggagcagagccagagcagatggcccagcagacccagacacccccaccaccaccagaccttcgccggcaaggacagctag

SEQ ID NO: 23600 - DNA, 372 bp, Artificial Sequence
  Description of Artificial Sequence: Synthetic coding sequence
atgcccgacgccagcctgggcagcctgggcatcacctggtgcttcctggagagccccctggaggtgagcagcggcagattcggcctggccagactgctgggcagccaggaccacggcgacgaccccgccgagagaggcagaaccgccaccgacgcctggggccccagcagatggggccagagccccggcaacggcggcggctactgcgacgccagcccccccagcgccctggcccccggcgacagagcctgggccctgcccgccagccccagcagcggcgcccccgccagccagcactgctgcctggagaaggccggcaccagaaccaaggccagccccgtgtggggcagagacggcaacacctggaactag

SEQ ID NO: 23601 - DNA, 1410 bp, Artificial Sequence
  Description of Artificial Sequence: Synthetic coding sequence
atgctggagagcatcagagtgaccgagaagctgcactggcccgagcaggagctggccaagaagagcatcctgaacgccgaggacagcctgatcatcgacaacaagagaagcatcagccacctgagcagcggcgtgctgaaggacatcttcaccaccggcaccagcagctacaacgtgctgctgcagagcaaggaggagaagaagtaccacagccagaagcagagcagcagcacctacagcaagagatgcagaaagcccagcaagagccccaacaccagcagaagcaaggaccccagaagaatgaaggccctggtgcccgtgaccagcagcggcacctggtactgcctggagagaagacccgccgtgttcgtgaccagcagcgtgagcagccccgtgaagttcacccacgacatcagcgtgaccggcaacggcatcgtgctgccccccaagcccaagagcaaggtgaagtggtgccacttcagcaccctgcccaagcccaagccccagctgagcagaagcttcgagaagggcgacgacttcagcggcaagaagttctgcatcctgaccgccatcaagcccaccaacctggagaaggagaagctgagattcttcaagagcgactacacctacaacccccagttcgagtacgccaaccccgccctgcccagcgtgctggccaagcacagccacgccagcgacagattcctgaagcagatcgtggtgcacctgaccgaggacctgctgagcagagccagcatgaccgtggtgaacggctgccccaccctgaccatcaacgtgagcaccgccagagagcactggctggagggcatgctgagacacgagatcggcacccactacttcagaggcatcaacaacctgcagcagccctggaacagctggaccggcagaaagaagcacgagctgaagcccaacaaccccaccgaggagggcctggccagcatccacagcgtgctgttcagaaaggaccccttcctgtggagagccgccctgctgtactacaccgtgtaccaggccagccagatgagcttctgcgagctgttcaaggacatcggcagattcgtgaaggaccccaacaccagatgggactactgcgtgagagccaagagaggctggaccgacaccagccagcccggctgcttcagcaaggaccaggtgtacctggacggcatcctgcagatcctgagatacagagacaccatcgacttccacctgctgaccgccctgggcaaggtgagctacgaggacgtggacagactgaagggcctggccgtgaccgagaacatgagagtgccccacttcctgcaggaccacggcagatacatggagcacctggagaagatcatggaggtgaacgagctgaccgacagagagctgaaggacctgatctag

SEQ ID NO: 23602 - DNA, 69 bp, Artificial Sequence
  Description of Artificial Sequence: Synthetic coding sequence
cccagcagcacccagtaccacgtgctggcctgcctgcacctgctggtggtgccctgcctggcctggtag

SEQ ID NO: 23603 - DNA, 3933 bp, Artificial Sequence
  Description of Artificial Sequence: Synthetic coding sequence
atgctgctgaacggcgactgccccgagagcctgaagaaggaggccgccgccgccgagccccccagagagaacggcctggacgaggccggccccggcgacgagaccaccggccaggaggtgatcgtgatccaggacaccggcttcagcgtgaagatcctggcccccggcatcgagcccttcagcctgcaggtgagcccccaggagatggtgcaggagatccaccaggtgctgatggacagagaggacacctgccacagaacctgcttcagcctgcacctggacggcaacgtgctggaccacttcagcgagctgagaagcgtggagggcctgcaggagggcagcgtgctgagagtggtggaggagccctacaccgtgagagaggccagaatccacgtgagacacgtgagagacctgctgaagagcctggaccccagcgacgccttcaacggcgtggactgcaacagcctgagcttcctgagcgtgttcaccgacggcgacctgggcgacagcggcaagagaaagaagggcctggagatggaccccatcgactgcaccccccccgagtacatcctgcccggcagcagagagagacccctgtgccccctgcagccccagaacagagactggaagcccctgcagtgcctgaaggtgctgaccatgagcggctggaaccccccccccggcaacagaaagatgcacggcgacctgatgtacctgttcgtgatcaccgccgaggacagacaggtgagcatcaccgccagcaccagaggcttctacctgaaccagagcaccgcctaccacttcaaccccaagcccgccagccccagattcctgagccacagcctggtggagctgctgaaccagatcagccccaccttcaagaagaacttcgccgtgctgcagaagaagagagtgcagagacaccccttcgagagaatcgccacccccttccaggtgtacagctggaccgccccccaggccgagcacgccatggactgcgtgagagccgaggacgcctacaccagcagactgggctacgaggagcacatccccggccagaccagagactggaacgaggagctgcagaccaccagagagctgcccagaaagaacctgcccgagagactgctgagagagagagccatcttcaaggtgcacagcgacttcaccgccgccgccaccagaggcgccatggccgtgatcgacggcaacgtgatggccatcaaccccagcgaggagaccaagatgcagatgttcatctggaacaacatcttcttcagcctgggcttcgacgtgagagaccactacaaggacttcggcggcgacgtggccgcctacgtggcccccaccaacgacctgaacggcgtgagaacctacaacgccgtggacgtggagggcctgtacaccctgggcaccgtggtggtggactacagaggctacagagtgaccgcccagagcatcatccccggcatcctggagagagaccaggagcagagcgtgatctacggcagcatcgacttcggcaagaccgtggtgagccaccccagatacctggagctgctggagagaaccagcagacccctgaagatcctgagacaccaggtgctgaacgacagagacgaggaggtggagctgtgcagcagcgtggagtgcaagggcatcatcggcaacgacggcagacactacatcctggacctgctgagaaccttcccccccgacctgaacttcctgcccgtgcccggcgaggagctgcccgaggagtgcgccagagccggcttccccagagcccacagacacaagctgtgctgcctgagacaggagctggtggacgccttcgtggagcacagatacctgctgttcatgaagctggccgccctgcagctgatgcagcagaacgccagccagctggagacccccagcagcctggagaacggcggccccagcagcctggagagcaagagcgaggacccccccggccaggaggccggcagcgaggaggagggcagcagcgccagcggcctggccaaggtgaaggagctggccgagaccatcgccgccgacgacggcaccgaccccagaagcagagaggtgatcagaaacgcctgcaaggccgtgggcagcatcagcagcaccgccttcgacatcagattcaaccccgacatcttcagccccggcagagtgagattccccgagagctgccaggacgaggtgagagaccagaagcagctgctgaaggacgccgccgccttcctgctgagctgccagatccccggcctggtgaaggactgcatggagcacgccgtgctgcccgtggacggcgccaccctggccgaggtgatgagacagagaggcatcaacatgagatacctgggcaaggtgctggagctggtgctgagaagccccgccagacaccagctggaccacgtgttcaagatcggcatcggcgagctgatcaccagaagcgccaagcacatcttcaagacctacctgcagggcgtggagctgagcggcctgagcgccgccatcagccacttcctgaactgcttcctgagcagctaccccaaccccgtggcccacctgcccgccgacgagctggtgagcaagaagagaaacaagagaagaaagaacagaccccccggcgccgccgacaacaccgcctgggccgtgatgaccccccaggagctgtggaagaacatctgccaggaggccaagaactacttcgacttcgacctggagtgcgagaccgtggaccaggccgtggagacctacggcctgcagaagatcaccctgctgagagagatcagcctgaagaccggcatccaggtgctgctgaaggagtacagcttcgacagcagacacaagcccgccttcaccgaggaggacgtgctgaacatcttccccgtggtgaagcacgtgaaccccaaggccagcgacgccttccacttcttccagagcggccaggccaaggtgcagcagggcttcctgaaggagggctgcgagctgatcaacgaggccctgaacctgttcaacaacgtgtacggcgccatgcacgtggagacctgcgcctgcctgagactgctggccagactgcactacatcatgggcgactacgccgaggccctgagcaaccagcagaaggccgtgctgatgagcgagagagtgatgggcaccgagcaccccaacaccatccaggagtacatgcacctggccctgtactgcttcgccagcagccagctgagcaccgccctgagcctgctgtacagagccagatacctgatgctgctggtgttcggcgaggaccaccccgagatggccctgctggacaacaacatcggcctggtgctgcacggcgtgatggagtacgacctgagcctgagattcctggagaacgccctggccgtgagcaccaagtaccacggccccaaggccctgaaggtggccctgagccaccacctggtggccagagtgtacgagagcaaggccgagttcagaagcgccctgcagcacgagaaggagggctacaccatctacaagacccagctgggcgaggaccacgagaagaccaaggagagcagcgagtacctgaagtgcctgacccagcaggccgtggccctgcagagaaccatgaacgagatctacagaaacggcagcagcgccaacatcccccccctgaagttcaccgcccccagcatggccagcgtgctggagcagctgaacgtgatcaacggcatcctgttcatccccctgagccagaaggacctggagaacctgaaggccgaggtggccagaagacaccagctgcaggaggccagcagaaacagagacagagccgaggagcccatggccaccgagcccgcccccgccggcgcccccggcgacctgggcagccagccccccgccgccaaggaccccagccccagcgtgcagggctag

SEQ ID NO: 23604 - DNA, 1518 bp, Artificial Sequence
  Description of Artificial Sequence: Synthetic coding sequence
atggtgagcaaccactacttcctgctgtgcgtgaacctgcccctgagagagatccacacccccggcgccgtgcaggtgagcagaagaaccatcagcagcaacagcttcagccccgaggtgttcgtgctgcccgtggacgtggagaaggagaacgcccacttctacgtggccgacatgatcatcagcgccatggagaagatgaagtgcaacatcctgagccagcagcagaccgagagctggagcaaggaggtgagcggcctgctgggcagcgaccagcccgacagcgagatgaccttcgacaccaacatcaagcaggagagcggcagcagcaccagcagctacagcggctacgagggctgcgccgtgctgcaggtgagccccgtgaccgagaccagaacctaccacgacgtgaaggagatctgcaagtgcgacgtggacgagttcgtgatcctggagctgggcgacttcaacgacatcaccgagacctgcagctgcagctgcagcagcagcaagagcgtgacctacgagcccgacttcaacagcgccgagctgctggccaaggagctgtacagagtgttccagaagtgctggatcctgagcgtggtgaacagccagctggccggcagcctgagcgccgccggcagcatcgtggtgaacgaggagtgcgtgagaaaggacttcgagagcagcatgaacgtggtgcaggagatcaagttcaagagcagaatcagaggcaccgaggactgggccccccccagattccagatcatcttcaacatccacccccccctgaagagagacctggtggtggccgcccagaacttcttctgcgccggctgcggcacccccgtggagcccaagttcgtgaagagactgagatactgcgagtacctgggcaagtacttctgcgactgctgccacagctacgccgagagctgcatccccgccagaatcctgatgatgtgggacttcaagaagtactacgtgagcaacttcagcaagcagctgctggacagcatctggcaccagcccatcttcaacctgctgagcatcggccagagcctgtacgccaaggccaaggagctggacagagtgaaggagatccaggagcagctgttccacatcaagaagctgctgaagacctgcagattcgccaacagcgccctgaaggagttcgagcaggtgcccggccacctgaccgacgagctgcacctgttcagcctggaggacctggtgagaatcaagaagggcctgctggcccccctgctgaaggacatcctgaaggccagcctggcccacgtggccggctgcgagctgtgccagggcaagggcttcatctgcgagttctgccagaacaccaccgtgatcttccccttccagaccgccacctgcagaagatgcagcgcctgcagagcctgcttccacaagcagtgcttccagagcagcgagtgccccagatgcgccagaatcaccgccagaagaaagctgctggagagcgtggccagcgccgccacctag

SEQ ID NO: 23605 - DNA, 366 bp, Artificial Sequence
  Description of Artificial Sequence: Synthetic coding sequence
atgagaagaagcctgaagaccagccacttcagcgaggagcccagcacctgcctgttcctgaaccacagaaacggcagcaccgaccccaccatcatcctgcacatcagcgagcccatgttcaacggcggcaagagagagatgcacggcaagagaaccccccccttcctgctgagcctgaagttcaaggacgtgtgcttcggcatgcccagcctgctgcccatccacagactgctgaagagcctgatctacagcagacacatgtgcctgctgtgccccaagtgcatcaccttcctgctggtgatggccgacttcggctgcgtgtgcgtgagacacgccgtgaacaacgagatgaaggccatcgcctag

SEQ ID NO: 23606 - DNA, 1518 bp, Artificial Sequence
  Description of Artificial Sequence: Synthetic coding sequence
aagagcgtgcagatcagaaccgaggccggccccagactgcacatcgagccccccgtggactacagcgacgacttcgagctgtgcggcgacgtgaccctgcaggccaacaacaccagcgaggacagaccccaggacaccaagagccccaccagcaccaagccctgcggcttcaacttcagcctgctgaacgcctgcggccacagcgaccccagcagcagcgtggacaaggagagaatcctgctgaccatccaggacgtgatggagctgagaagaagcctggagctgagcgtgaacctgcagagaaagcagaaggactgcagcagcgacgagtacgacagcatcgaggaggacatcctgagcgagcccgagcccgaggaccccgccctggtgggccaccccagacacgacagaccccccagcagcggcgactggacccagaaggacgtgcacggcgagcaggagaccgagggcagaagcagccccggccccgacaccctggtggtgctggagttcaaccccgccagcaagagccacaagagagagagaaacctgagcgccaagagaaaggacaacgccgaggtgttcgtgcccaccaagcccgagcccaacctgaccccccaggcccccgccgtgttccccgaccaggagagaatgtgcagcagacccggcagcagaagagagagacccctgagcgccaccagaaagaccctgtgcgaggccgagtaccccgaggaggacgccagcgccgtgctgcaggccatccaggtggagaacgccgccctgcagagagccctgctgagcagaaaggccgagcagcccgccagccccctgcaggacgccgagggcccccccgccaagccctggaccagcctgctggaggagaaggaggagaccctggagctgctgcccatcaccaccgccaccaccacccaggagcccgccggcgccgccggcggcgccagagccatcaaccaggccatggacagaatcggcctgctgggcagcagacagcagcagaagctgctgaaggtgctgcaggccgtggagagcgacagcgcccacctgggcagagtggtgagccccaccaaggagcaggtgagcgacaccgaggacaagcagagaatgagagccgacgagatcaaggacgccatctacgtgaccatggagatcctgagcaactggggcaacagctggtgggtgggcctgaccgaggtggagttcttcgacctgaacgacaccaagctgtacgtgagcccccacgacgtggacatcagaaacaccgccacccccggcgagctgggcagactggtgaacagaaacctggccggcaagaaggacagcagcccctggacctgccccttccacccccccctgcagctgttcttcgtgatcagaaacaccagacagctgggcgacttccacctggccaagatcaaggtgagaaactactggaccgccgacggcagcctgagcgccgcccaggccggcgtgcagtggagagaccacggcagcctgtag

SEQ ID NO: 23607 - DNA, 612 bp, Artificial Sequence
  Description of Artificial Sequence: Synthetic coding sequence
aagccctacgcctgcaacgagtgcgtgaagagcttctgcgtgaagagcagcctgatcatccaccagagaacccacaccggcgagaagccctacaagtgcaacgagtacggcaagaccttccaccacaagagcaccctgaccgtgcaccagagaacccacggcgagaagccctacaagtgcaacgagtgcagaaagagcttctacatgaagagccacctggccaagcaccacagaaagtacaccaagaagccctacgagtgcaagcagtgcggcaagaccttccagaagagccacctgatcgagcaccagagaacccaccccggcgagatcccccacgagtgcaacaagtgcggcaagagcttctgctacaagagccccctgaccatccaccagagaacccacatcgaggagaagccctacaagtgcagcaagagcgtgacctacttctgcatgaagagccacctgaccgtgcaccagagaccccacaccagaaagaaccccttcgagtgcaacgagtgcagaaagatgttctacgtgaagagcaacctgatcaaccaccagagaacccacaccggcgagaagccctacgagggcaacacctgcggcaagtag

SEQ ID NO: 23608 - DNA, 975 bp, Artificial Sequence
  Description of Artificial Sequence: Synthetic coding sequence
atggactgggacgacgagtacagccacaacagcttcgacctgcactgcctgctgaacagcttccccggcgacctggagttcgagcagatcttcagcgacatcgacgagaagatcgagcagaacgccgccagcatcaagcactgcatcaaggagatccagagcgagatcaacaagcagtgccccggcgtgcagctgcagaccaccaccgactgcttcgagtggctgaccaactacaactacagcaccagcgagagcagcttcatcagccacggcgacctgatcaagttcttcaagaccctgcaggacctgctgaagaacgagcagaaccaggaggagatgaccctggacctgctgtgggacctgagctgccacagcagcgtgagcttccccagcaccctgagcggcaccagcttccacttcctgagcagaaccagcctgcacagcgtggaggacaacagcagcatggacgtgaagagcatgtgggacgacatcagactgcacctgagaagattcctggtgagcaagctgcagagccacaacgagatcaacaacagccagcagaagatcctgctgaagaagcagtgcctgcagcagctgctgttcctgtaccccgagagcgaggtgatcatcaagtaccagaacatccagaacaagctgctggccaacctgctgtggaactgcttccccagctacaacagagacagcaacctggacgtgatcgcccacggctaccagagcaccatgctgaagctgtacagcgtgatcaaggaggacttcaacaccctgtgcgagatcctggcccccagcagcatggtgaagttcatcaaggagacctacctggacaccgtgaccgaggagatggccaagttcctggagaacttctgcgagctgcagttcagagagaacgccgtgagagtggtgaagaccagcaagagcagcagcaagcacagaggcgccgtgcacgccctgggctag

SEQ ID NO: 23609 - DNA, 459 bp, Artificial Sequence
  Description of Artificial Sequence: Synthetic coding sequence
atgcccggcctggtgttcttcaagttcgccaacctgggcggcggctggggcagcagaaagatgctggagcccggcatgtgccccgccgagatgagcctgacccccttcgtgaccagaagcctgaacctgctgtgcttcagcgtgacccacagaggcagaggcaaggacaaccccctgcacttcttcctgcagctgctggcccccagcgccagcgccagcctgggcctgggcagagagaccggccccctgcccagccccggcctgagccccggcctgctgagcgagaccttcgtgagcgagggccccctgctgaccctgcagatcagctggtgcggcaccgagtgcctgatggacggccagggccccctgatccacctgcacagccagaacatcagaatcagcttcggcgccacccagccccccctgctgctggtgtacgagatcagatggaacagatag

SEQ ID NO: 23610 - DNA, 558 bp, Artificial Sequence
  Description of Artificial Sequence: Synthetic coding sequence
atgcacggcctgtgcatggtgcccagcccccacggccaccccggcatcagcggcacctgctgcgcccccggccaggcccccgacagacaccccctgagcctgtgcgcccccacccccggcagaaagagacagcaccacctggtggcctggcagccctgccccgcccccagctgcctgtggccccactggacccagccccccagcagagaggccttcggctgcagagccggcgccggcagagcccaccccgtggccggcggcacccaggagccctggctgcacctgtgcagcagaagaacctgcggccagctgaccctgcagcagggcagcggccccaagagcctgacccacagagtgctgagccccgacagagccgtggacagcttccccttccaccccggcacctgctggcaggagctgcccggcccccaccccggcgccgccacccccgccccccccgccacccccggccacgagaaggtgcagaacagcagcggccccagccacaacttcctggagctgagagacagcttcctgagcaccaacggcgtgagatag

SEQ ID NO: 23611 - DNA, 3003 bp, Artificial Sequence
  Description of Artificial Sequence: Synthetic coding sequence
atgcccggcaagctgaaggtgaagatcgtggccggcagacacctgcccgtgatggacagagccagcgacctgaccgacgccttcgtggaggtgaagttcggcaacaccaccttcaagaccgacgtgtacctgaagagcctgaacccccagtggaacagcgagtggttcaagttcgaggtggacgacgaggacctgcaggacgagcccctgcagatcaccgtgctggaccacgacacctacagcgccaacgacgccatcggcaaggtgtacatcgacatcgaccccctgctgtacagcgaggccgccaccgtgatcagcggctggttccccatctacgacaccatccacggcatcagaggcgagatcaacgtggtggtgaaggtggacctgttcaacgacctgaacagattcagacagagcagctgcggcgtgaagttcttctgcaccaccagcatccccaagtgctacagagccgtgatcatccacggcttcgtggaggagctggtggtgaacgaggaccccgagtaccagtggatcgacagaatcagaacccccagagccagcaacgaggccagacagagactgatcagcctgatgagcggcgagctgcagagaaagatcggcctgaaggtgctggagatgagaggcaacgccgtggtgggctacctgcagtgcttcgacctggagggcgagagcggcctggtggtgagagccatcggcaccgcctgcaccctggacaagctgagcagccccgccgccttcctgcccgcctgcaacagccccagcaaggagatgaaggagatccccttcaacgaggaccccaaccccaacacccacagcagcggccccagcacccccctgaagaaccagacctacagcttcagccccagcaagagctacagcagacagagcagcagcagcgacaccgacctgagcctgacccccaagaccggcatgggcagcggcagcgccggcaaggagggcggccccttcaaggccctgctgagacagcagacccagagcgccctggagcagagagagttccccttcttcaccctgaccgccttcccccccggcttcctggtgcacgtgggcggcgtggtgagcgccagaagcgtgaagctgctggacagaatccacaaccccgacgagcccgagaccagagacgcctggtgggccgagatcagacaggagatcaagagccacgccaaggccctgggctgccacgccgtggtgggctacagcgagagcaccagcatctgcgaggaggtgtgcatcctgagcgccagcggcaccgccgccgtgctgaaccccagattcctgcaggacggcaccgtggagggctgcctggagcagagactggaggagaacctgcccaccagatgcggcttctgccacatcccctacgacgagctgaacatgcccttccccgcccacctgacctactgctacaactgcagaaagcagaaggtgcccgacgtgctgttcaccaccatcgacctgcccaccgacgccaccgtgatcggcaagggctgcctgatccaggccagactgtgcagactgaagaagaaggcccaggccgaggccaacgccaccgccatcagcaacctgctgcccttcatggagtacgaggtgcacacccagctgatgaacaagctgaagctgaagggcatgaacgccctgttcggcctgagaatccagatcaccgtgggcgagaacatgctgatgggcctggccagcgccaccggcgtgtacctggccgccctgcccacccccggcggcatccagatcgccggcaagacccccaacgacggcagctacgagcagcacatcagccacatgcagaagaagatcaacgacaccatcgccaagaacaaggagctgtacgagatcaacccccccgagatcagcgaggagatcatcggcagccccatccccgagcccagacagagaagcagactgctgagaagccagagcgagagcagcgacgaggtgaccgagctggacctgagccacggcaagaaggacgccttcgtgctggagatcgacgacaccgacgccatggaggacgtgcacagcctgctgaccgacgtgcccccccccagcggcttctacagctgcaacaccgagatcatgcccggcatcaacaactggaccagcgagatccagatgttcaccagcgtgagagtgatcagactgagcagcctgaacctgaccaaccaggccctgaacaagaacttcaacgacctgtgcgagaacctgctgaagagcctgtacttcaagctgagaagcatgatcccctgctgcctgtgccacgtgaacttcaccgtgagcctgcccgaggacgagctgatccaggtgaccgtgaccgccgtggccatcaccttcgacaagaaccaggccctgcagaccaccaagacccccgtggagaagagcctgcagagagccagcaccgacaacgaggagctgctgcagttccccctggagctgtgcagcgacagcctgcccagccaccccttcccccccgccaaggccatgaccgtggagaaggccagccccgtgggcgacggcaacttcagaaacagaagcgcccccccctgcgccaacagcaccgtgggcgtggtgaagatgacccccctgagcttcatccccggcgccaagatcaccaagtacctgggcatcatcaacatgttcttcatcagagagaccaccagcctgagagaggagggcggcgtgagcggcttcctgcacgccttcatcgccgaggtgttcgccatggtgagagcccacgtggccgccctgggcggcaacgccgtggtgagctacatcatgaagcagtgcgtgttcatggagaaccccaacaagaaccaggcccagtgcctgatcaacgtgagcggcgacgccgtggtgttcgtgagagagagcgacctggaggtggtgagcagccagcagcccaccaccaactgccagagcagctgcaccgagggcgaggtgaccacctag

SEQ ID NO: 23612 - DNA, 1215 bp, Artificial Sequence
  Description of Artificial Sequence: Synthetic coding sequence
atgctgagagccatcgccgaggagagaggcagactgagcctgagaagagaggtgtgcggcctgggctgcttcaaggacgacagaatcgtgttctggacctggatgttcagcacctacttcatggagaagtgggcccccagacaggacgacatgctgttctacgtgagaagaaagctggcctacagcggcagcgagagcggcgccgacggcagaaaggccgccgagcccgaggtggaggtggaggtgtacagaagagacagcaagaagctgcccggcctgggcgaccccgacatcgactgggaggagagcgtgtgcctgaacctgatcctgcagaagctggactacatggtgacctgcgccgtgtgcaccagagccgacggcggcgacatccacatccacaagaagaagagccagcaggtgttcgccagccccagcaagcaccccatggacagcaagggcgaggagagcaagatcagctaccccaacatcttcttcatgatcgacagcttcgaggaggtgttcagcgacatgaccgtgggcgagggcgagatggtgtgcgtggagctggtggccagcgacaagaccaacaccttccagggcgtgatcttccagggcagcatcagatacgaggccctgaagaaggtgtacgacaacagagtgagcgtggccgccagaatggcccagaagatgagcttcggcttctacaagtacagcaacatggagttcgtgagaatgaagggcccccagggcaagggccacgccgagatggccgtgagcagagtgagcaccggcgacaccagcccctgcggcaccgaggaggacagcagccccgccagccccatgcacgagagagtgaccagcttcagcaccccccccacccccgagagaaacaacagacccgccttcttcagccccagcctgaagagaaaggtgcccagaaacagaatcgccgagatgaagaagagccacagcgccaacgacagcgaggagttcttcagagaggacgacggcggcgccgacctgcacaacgccaccaacctgagaagcagaagcctgagcggcaccggcagaagcctggtgggcagctggctgaagctgaacagagccgacggcaacttcctgctgtacgcccacctgacctacgtgaccctgcccctgcacagaatcctgaccgacatcctggaggtgagacagaagcccatcctgatgacctag

SEQ ID NO: 23613 - DNA, 2151 bp, Artificial Sequence
  Description of Artificial Sequence: Synthetic coding sequence
atggaggactgcctgcacaccagcagcgagaacctgagcaagctggtgagctgggcccacagccacggcaccatctgcagcctgatccccaacctgaagcacctgctgagcgagggcagccacggcaacctgaccgccatgtggggctgcagcgccggccacgcctaccactggcccctgaccgccacctgcagagccggcagccaggagagagtgtgcttccaggacaacagaagcttcaacagcgacagccccagcatcatcggcgtgcccagcgagacccagaccagccccgtggagagataccccggcagacccgtgaaggccaagctggactgcaacagaaccagagacagctgcgacttcagctactgcagcgagcccagcgagctggacgagaccgtggaggagtacgaggacgagaacaccctgttcgacatggtgtgcgagagcagcgtgaccgacgaggacagcgacttcgagccccagacccagagaccccagagcatcgccagaaagagacccggcgtggtgcccagcagcctgcacagcagcagccagacccagatggtggacgagtgcagcaacgacgtgatcatcaagaagatcaagcaggagatccccgaggactactacatcgtggccaacgccgagctgaccggcggcgtggacggccccgccctgagcctgacccagatggccaagcccaagccccagacccacgccggccccagctgcgtgggcagcgccaagctgatcccccacgtgaccagcgccatcagcaccgagctggacccccacggcatgagcgccagccccagcgtgatcagcagacccatcgtgcagaagaccgccagagtgagcctggccagccccaacagaggcccccccggcacccacggcaccaaccagcaggtggccatgcagatgcccgtgagcaccagccaccccaacaagcagatcagcatccccctgagcgccctgcagctgcccggccaggacgagcaggtggccagcgaggagttcctgagccacctgcccagccaggtgagcagctgcgaggtggccctgagccccagcgtgaacaccgagcccgaggtgagcagcagccagcagcagccccccgtggcccccgccatcaccaccgaggccaccgcccagtgcatccccgcctacagcaccaagctgaacaagttccccgtgttcaacatcaacgacgacctgaacgacctgtgcaccagcgccgtgagccccaacaccaccaaggccaccagatacgccctgaacgtgtggagatactggtgcatgaccaacggcctgaaggaccacaccgacatcaccaagatccccgccgtgaagctgaacgagctgctggagaacttctacgtgaccgtgaagaagagcgacggcagcgacttcctggccaccagcctgcacgccatcagaagaggcctggacagaatcctgaagaacgccggcgtgggcttcagcatcaccagcagcaccttcagcagcagcaccaagaagctgaaggagaagctgtgggtgctgagcaaggccggcatgagcggcgccagaagcagaaacatcgtgtacttcagcctgagcgacgaggaggagatgtggcaggccggctgcctgggcgacgacagccccatcaccctgctgagcaccgtggtgaagtacaacagccagtacctgaacatgagaaccctgcaggagcacgccgacctgatgtacggcgacatcgagctgctgaaggacccccagaaccagccctacttcgccagaaccgacagcgtgaagagagagagcagaagcggcagcaccagagtgtgccacggcaagatctaccacgagcacagcagaggccacaagcagtgcccctactgcctgctgtacaagtacatgtacatccacagaccccccacccagatggaggccaagagccccttctacctgaccgccagaaaggaggccaccgacatgggcagcgtgtggtacgaggagcagagaatgggcctgagaagcctgagaggcatcgtgcccaacctggccaagaaggtgaagctggagaactgcgagaacttcaccttcgtgagcttcacccaggtgagcagaagactgggcagccacagctgctgccagtag

SEQ ID NO: 23614 - DNA, 1605 bp, Artificial Sequence
  Description of Artificial Sequence: Synthetic coding sequence
atgagaagacacagcgagaccgacgtggaggagcagacccaggagctgaagaccatcacccagctgcaggagcagtgcagagccctgcagatccagggcgtgaaggagaacatggaccagaacaaggccaccctggccctgctgagaagcaacatcagaagaggcgcccaggactgggccctggccaagaagtacgaccagtggaccatcagcaaggcctgcggcaagaacctgcccctgagactggcccactgcagaagcaccatggaggtggtgagagagaagctgagaaagtacgtgttcgacagagtgaacatgcacaacctgctgatccacctggtgagaagaagaggccagaagctggagagcatgcagctggagctggacagcctgagaagccagcccgacgccagcaaggaggagctgagactgctgcagatcatcagacagctggagaacaacatcgagaagaccatgatcaagatcatcaccagccagaacatccacctgctgtacctggacctgctggactacctgaagaccgtgctggccggctaccccatcgagctggacaagctgcagaacctggtggtgaactactgcagcgagctgagcgacatgaagatcatgagccaggacgccatgatgatcaccgacgaggtgaagagaaacatgagacagagagaggccagcttcatcgaggagagaagagccagagagaacagactgaaccagcagaagaagctgatcgacaagatccacaccaaggagaccagcgagaagtacagaagaggccagatggacctggacttccccagcaacctgatgagcaccgagaccctgaagctgagaagaaaggagaccagcaccgccgagatggagtaccagagcggcgtgaccgccgtggtggagaaggtgaagagcgccgtgagatgcagccacgtgtgggacatcaccagcagattcctggcccagagaaacaccgaggagaacctggagctgcagatggaggactgcgaggagtggagagtgcagctgaaggccctggtgaagcagctggagctggaggaggccgtgctgaagttcagacagaagcccagcagcatcagcttcaagagcgtggagaagaagatgaccgacatgctgaaggaggaggaggagagactgcagctggcccacagcaacatgaccaagggccaggagctgctgctgaccatccagatgggcatcgacaacctgtacgtgagactgatgggcatcaacctgcccgccacccagagagaggtggtgctgagcaacaccctggacctgaacagcaagctggcctactgcgagggcaagctgacctacctggccgacagagtgcagatggtgagcagaaccgaggagggcgacaccaaggtgagagacaccctggagagcagcaccctgatggagaagtacaacaccagaatcagcttcgagaacagagaggaggacatgatcgacaccttccagttccccgacatggaccacagctacgtgcccagcagagccgagatcaagagacaggcccagagactgatcgagggcaagctgaaggccgccaagaagaagaagaagtag

SEQ ID NO: 23615 - DNA, 5520 bp, Artificial Sequence
  Description of Artificial Sequence: Synthetic coding sequence
atgtaccacatcgactgcagagaccagctggagagagtgttcctgagactgggccacgccgagaccgacgagcagctgcagaacatcatcagcaagttcctgccccccgtgctgctgaagctgagcagcacccaggagggcgtgagaaagaaggtgatggagctgctggtgcacctgaacaagagaatcaagagcagacccaagatccagctgcccgtggagaccctgctggtgcagtaccaggaccccgccgccgtgagcttcgtgaccaacttcaccatcatctacgtgaagatgggctaccccagactgcccgtggagaagcagtgcgagctggcccccaccctgctgaccgccatggagggcaagccccagccccagcaggacagcctgatgcacctgctgatccccaccctgttccacatgaagtaccccgtggagagcagcaagagcgccagccccttcaacctggccgagaagcccaagaccgtgcagctgctgctggacttcatgctggacgtgctgctgatgccctacggctacgtgctgaacgagagccagagcagacagaacagcagcagcgcccagggcagcagcagcaacagcggcggcggcagcggcatcccccagcccccccccggcatgagcttctacgccgccaagagagtgatcggcgacaacccctggacccccgagcagctggagcagtgcaagctgggcatcgtgaagttcatcgaggccgagcaggtgcccgagctggaggccgtgctgcacctggtgatcgccagcagcgacaccagacacagcgtggccaccgccgccgacctggagctgaagagcaagcagagcctgatcgactggaacaaccccgccatcatcaacaagatgtacaaggtgtacctgggcgacatccccctgaagaccaaggagggcgccgtgctgaagcccgagctgaagagagaccccgtgagcaccagagtgaagctgaagatcgtgccccacctgctgagaagcagacaggccgccgagaccttccccgccaacatccaggtggtgtacgacggcctgttcggcaccaacaccaacagcaagctgagaaccctgagcctgcagttcgtgcaccacatctgcatcacctgccccgagatcaagatcaagcccctgggccccatgctgctgaacggcctgaccaagctgatcaacgagtacaaggaggaccccaagctgctgagcatggcctacagcgccgtgggcaagctgagcagcagaatgccccacctgttcaccaaggacatcgccctggtgcagcagctgttcgaggccctgtgcaaggaggagcccgagaccagactggccatccaggaggccctgagcatgatggtgggcgcctacagcaccctggagggcgcccagagaaccctgatggaggccctggtggccagctacctgatcaagcccgaggtgcaggtgagacaggtggccgtgaagttcgccagcaccgtgttccccagcgaccacatccccagcagatacctgctgctgctggccgccggcgaccccagagaggaggtgcacggcgaggcccagagagtgctgagatgcctgcccggcagaaacagaaaggagagcaccagcgagcagatgcccagcttccccgagatggtgtactacatccaggagaaggccagccacagaatgaagacccccgtgaagtacatgaccggcaccaccgtgctgcccttcaaccccgccgccttcggcgagatcgtgctgtacctgagaatgtgcctggcccacagcgccggcgtggtgcccaccagccagagcctggccgacatgcaggaccacgcccccgccatcggcagatacatcagaaccctgatgagcagcggccagatggcccccagcagcagcaacaagagcggcgagaccaaccccgtgcagatctacatcggcctgctgcagcagctgctggccggcgtgggcggcctgcccgtgatgtactgcctgctggaggccgtgagcgtgtaccccgagaagctggccaccaagttcgtggacaagaccgagtggatcaagagcctgatgaacaacagcaaggaggagatgagagagctggccgccctgttctacagcgtggtggtgagcaccgtgagcggcaacgagctgaagagcatgatcgagcagctgatcaagaccaccaaggacaaccacagccccgagatccagcacggcagcctgctggccctgggcttcaccgtgggcagatacctggccaagaagaagatgagaatgagcgagcagcaggacctggagagaaacgccgacaccctgcccgaccaggaggagctgatccagagcgccaccgagaccatcggcagcttcctggacagcaccagccccctgctggccatcgccgcctgcaccgccctgggcgagatcggcagaaacggccccctgcccatccccagcgagggcagcggcttcaccaagctgcacctggtggagagcctgctgagcagaatccccagcagcaaggagaccaacaagatgaaggagagagccatccagaccctgggctacttccccgtgggcgacggcgacttcccccaccagaagctgctgctgcagggcctgatggacagcgtggaggccaagcagatcgagctgcagttcaccatcggcgaggccatcaccagcgccgccatcggcaccagcagcgtggccgccagagacgcctggcagatgaccgaggaggagtacaccccccccgccggcgccaaggtgaacgacgtggtgccctgggtgctggacgtgatcctgaacaagcacatcatcagccccaacccccacgtgagacaggccgcctgcatctggctgctgagcctggtgagaaagctgagcacccacaaggaggtgaagagccacctgaaggagatccagagcgccttcgtgagcgtgctgagcgagaacgacgagctgagccaggacgtggccagcaagggcctgggcctggtgtacgagctgggcaacgagcaggaccagcaggagctggtgagcaccctggtggagaccctgatgaccggcaagagagtgaagcacgaggtgagcggcgagaccgtggtgttccagggcggcgccctgggcaagacccccgacggccagggcctgagcacctacaaggagctgtgcagcctggccagcgacctgagccagcccgacctggtgtacaagttcatgaacctggccaaccaccacgccatgtggaacagcagaaagggcgccgccttcggcttcaacgtgatcgccaccagagccggcgagcagctggcccccttcctgccccagctggtgcccagactgtacagataccagttcgaccccaacctgggcatcagacaggccatgaccagcatctggaacgccctggtgaccgacaagagcatggtggacaagtacctgaaggagatcctgcaggacctggtgaagaacctgaccagcaacatgtggagagtgagagagagcagctgcctggccctgaacgacctgctgagaggcagacccctggacgacatcatcgacaagctgcccgagatctgggagaccctgttcagagtgcaggacgacatcaaggagagcgtgagaaaggccgccgagctggccctgaagaccctgagcaaggtgtgcgtgaagatgtgcgaccccgccaagggcgccgccggccagagaaccatcgccgccctgctgccctgcctgctggacaagggcatgatgagcaccgtgaccgaggtgagagccctgagcatcaacaccctggtgaagatcagcaagagcgccggcgccatgctgaagccccacgcccccaagctgatccccgccctgctggagagcctgagcgtgctggagccccaggtgctgaactacctgagcctgagagccaccgagcaggagaaggccgccatggacagcgccagactgagcgccgccaagagcagccccatgatggagaccatcaacatgtgcctgcagtacctggacgtgagcgtgctgggcgagctggtgcccagactgtgcgagctgatcagaagcggcgtgggcctgggcaccaagggcggctgcgccagcgtgatcgtgagcctgaccacccagtgcccccaggacctgaccccctacagcggcaagctgatgagcgccctgctgagcggcctgaccgacagaaacagcgtgatccagaagagctgcgccttcgccatgggccacctggtgagaaccagcagagacagcagcaccgagaagctgctgcagaagctgaacggctggtacatggagaaggaggagcccatctacaagaccagctgcgccctgaccatccacgccatcggcagatacagccccgacgtgctgaagaaccacgccaaggaggtgctgcccctggccttcctgggcatgcacgagatcgccgacgaggagaagagcgagaaggaggagtgcaacctgtggaccgaggtgtggcaggagaacgtgcccggcagcttcggcggcatcagactgtacctgcaggagctgatcaccatcacccagaaggccctgcagagccagagctggaagatgaaggcccagggcgccatcgccatggccagcatcgccaagcagaccagcagcctggtgcccccctacctgggcatgatcctgaccgccctgctgcagggcctggccggcagaacctgggccggcaaggaggagctgctgaaggccatcgcctgcgtggtgaccgcctgcagcgccgagctggagaagagcgtgcccaaccagcccagcaccaacgagatcctgcaggccgtgctgaaggagtgcagcaaggagaacgtgaagtacaagatcgtggccatcagctgcgccgccgacatcctgaaggccaccaaggaggacagattccaggagttcagcaacatcgtgatccccctgatcaagaagaacagcctggagagcagcggcgtgagaaccaccaagaacgaggaggagaacgagaaggagaaggagctgcagctggagtacctgctgggcgccttcgagagcctgggcaaggcctggcccagaaacgccgagacccagagatgctacagacaggagctgtgcaagctgatgtgcgagagactgaagctgagcacctggaaggtgcagctgggcgtgctgcagagcatgaacgccttcttccagggcctgatgctgctggaggaggagcacgccgaccccgaggccctggccgagatcctgctggagacctgcaagagcatcacctacagcctggagaacaagacctacagcagcgtgagaaccgaggccctgagcgtgatcgagctgctgctgaagaagctggaggagagcaagcagtgggagtgcctgaccagcgagtgcagagtgctgctgatcgagagcctggccaccatggagcccgacagcagacccgagctgcaggagaaggccgccctgctgaagaagaccctggagaacctggagtag

SEQ ID NO: 23616 - DNA, 1524 bp, Artificial Sequence
  Description of Artificial Sequence: Synthetic coding sequence
atggtggccaccggctgggccagaagaagcggcctgcaccccgcccccagacccctgagaggcgcccaggaggccctggccaagaacctgtggagagaggagagaaacagacccctgatcctgagcagcctgatcatcaagaagctgcactggcccgagcaggagctggccaagaagagcatcctgaacgccgaggacagcctgatcatcgacaacaagagaagcatcagccacctgagcagcggcgtgctgaaggacatcttcaccaccggcaccagcagctacaacgtgctgctgcagagcaaggaggagaagaagtaccacagccagaagcagagcagcagcacctacagcaagagatgcagaaagcccagcaagagccccaacaccagcagaagcaaggaccccagaagaatgaaggccctggtgcccgtgaccagcagcggcacctggtactgcctggagagaagacccgccgtgttcgtgaccagcagcgtgagcagccccgtgaagttcacccacgacatcagcgtgaccggcaacggcatcgtgctgccccccaagcccaagagcaaggtgaagtggtgccacttcagcaccctgcccaagcccaagccccagctgagcagaagcttcgagaagggcgacgacttcagcggcaagaagttctgcatcctgaccgccatcaagcccaccaacctggagaaggagaagctgagattcttcaagagcgactacacctacaacccccagttcgagtacgccaaccccgccctgcccagcgtgctggccaagcacagccacgccagcgacagattcctgaagcagatcgtggtgcacctgaccgaggacctgctgagcagagccagcatgaccgtggtgaacggctgccccaccctgaccatcaacgtgagcaccgccagagagcactggctggagggcatgctgagacacgagatcggcacccactacttcagaggcatcaacaacctgcagcagccctggaacagctggaccggcagaaagaagcacgagctgaagcccaacaaccccaccgaggagggcctggccagcatccacagcgtgctgttcagaaaggaccccttcctgtggagagccgccctgctgtactacaccgtgtaccaggccagccagatgagcttctgcgagctgttcaaggacatcggcagattcgtgaaggaccccaacaccagatgggactactgcgtgagagccaagagaggctggaccgacaccagccagcccggctgcttcagcaaggaccaggtgtacctggacggcatcctgcagatcctgagatacagagacaccatcgacttccacctgctgaccgccctgggcaaggtgagctacgaggacgtggacagactgaagggcctggccgtgaccgagaacatgagagtgccccacttcctgcaggaccacggcagatacatggagcacctggagaagatcatggaggtgaacgagctgaccgacagagagctgaaggacctgatctag

SEQ ID NO: 23617 - DNA, 576 bp, Artificial Sequence
  Description of Artificial Sequence: Synthetic coding sequence
cagagcggcttcatggacctgcccaaggagaaggtgggcagaaaggagcaggtggagaagctggagctgggcttcatccagctgagcggcgccaccgacggcatgagagagtacatcaccgagtacgagagccagggcgccgtgcccaacaccagacaccaggagaaggaggacatcatcagactggcccagaaggaggaggagatgaaggtgaagctgctggagctgcaggagctggtgctgcccctggtgggcgaccacgagggccacggcaagttcctgaccgccgcccagaaccccgccgacgagcccgcccccggcgcccccgccccccaggagctgggcgccgccgacgagcagggcgacttctacgaggtgagcctggacgacagcgaggagcccgcccccggcgccgccggcgagggcagcccccacgacaaccccaccgcccagcagatcgtgcagctgccccccgtgatgcaggacacccaggagcaccccggcctgcccggcaacccctgcgtgagcttcttctaccaggccgccgagaacagagagatcaacatcatcatctag

SEQ ID NO: 23618 - DNA, 375 bp, Artificial Sequence
  Description of Artificial Sequence: Synthetic coding sequence
atggagcacatgctgctggccaaccacaccgacaaggccaccttcaccggcacccagagacagagaagctgcagcggcgccagcgtgagccagcccagacccctgagaggcaagctggtgggctactgggacccccacagcagactgctgagcagaggcagagccctgggcagcgtgagcgcccccagcacccccagaggcagaggctggaaggccaccttcgacggctgcatcctgcacgacgacctgctgaccaaggtgcacggcttccagagcctgatcggcctgcagcagcacctggcctgcggcgacagcggcagcctgatgaagaactgccacgacggcaacagaaacaaccagagaaagctgccctag

SEQ ID NO: 23619 - DNA, 1371 bp, Artificial Sequence
  Description of Artificial Sequence: Synthetic coding sequence
atgggcaacagcagaagcagagtgggcagaagcttctgcagccagttcctgcccgaggagcaggccgagatcgaccagctgttcgacgccctgagcagcgacaagaacagccccaacgtgagcagcaagagcttcagcctgaaggccctgcagaaccacgtgggcgaggccctgccccccgagatggtgaccagactgtacgacggcatgagaagagtggacctgaccggcaaggccaagggccccagcgagaacgtgagccaggagcagttcaccgccagcatgagccacctgctgaagggcaacagcgaggagaagagcctgatgatcatgaagatgatcagcgccaccgagggccccgtgaaggccagagaggtgcagaagttcaccgaggacctggtgggcagcgtggtgcacgtgctgagccacagacaggagctgagaggctggaccggcaaggaggcccccggccccaaccccagagtgcaggtgctggccgcccagctgctgagcgacatgaagctgcaggacggcaagagactgctgggcccccagtggctggactacgactgcgacagagccgtgatcgaggactgggtgttcagagtgccccacgtggccatcttcctgagcgtggtgatctgcaagggcttcctgatcctgtgcagcagcctggacctgaccaccctggtgcccgagagacaggtggaccagggcagaggcttcgagagcatcctggacgtgctgagcgtgatgtacatcaacgcccagctgcccagagagcagagacacagatggtgcctgctgttcagcagcgagctgcacggccacagcttcagccagctgtgcggccacatcacccacagaggcccctgcgtggccgtgctggaggaccacgacaagcacgtgttcggcggcttcgccagctgcagctgggaggtgaagccccagttccagggcgacaacagatgcttcctgttcagcatctgccccagcatggccgtgtacacccacaccggctacaacgaccactacatgtacctgaaccacggccagcagaccatccccaacggcctgggcatgggcggccagcacaactacttcggcctgtgggtggacgtggacttcggcaagggccacagcagagccaagcccacctgcaccacctacaacagcccccagctgagcgcccaggagaacttccagttcgacaagatggaggtgtgggccgtgggcgaccccagcgaggagcagctggccaagggcaacaagagcatcctggacgccgaccccgaggcccaggccctgctggagatcagcggccacagcagacacagcgagggcctgagagaggtgcccgacgacgagtag

SEQ ID NO: 23620 - DNA, 438 bp, Artificial Sequence
  Description of Artificial Sequence: Synthetic coding sequence
atgggcccctggcccagagactggctgggcaagggctggagactgggcagctgcgaggccagagccggcgccaaggaggtgagcgtgatcagacacggcgcccccaaccccgcccagagccacctgcacgtgcaggccagagcccaggtgcacagcgaggacggccacagcctgccccccgtggtggacggcgaggacgaggtgctgagcctgctggtgttcgtgcaggacagccaggagtgctgcagacaggccgtgcagggcagacagggcagaggcgtgacctggggcctgggcctgcccagctaccacctgagaaccctgctgagccccgtgtgcgtgcccgccagagaccagagagcccccagaaagtgctgcgaggccgtgctggcctgccccctggtggagaccctggtgaccaccctgctgaccagatag

SEQ ID NO: 23621 - DNA, 1653 bp, Artificial Sequence
  Description of Artificial Sequence: Synthetic coding sequence
atgggctggagcgacctgcagcccgccatgggcggcgaggccgagagattccaggcccagctggaggtgaagctggtgaccggcggcagccccgtggtgttcaccggcaacctgaccagacaggtgggcagcaagctggccttcagcgccagcctgagccacctgctgagcgaccaggccaacgtgaccgccctgctggagagaaaggaggagaacggcagaagagtggccgccctgggcgccgagctgttcgtgcccggcctggtgggcctgagagccctgggcctgctgcagcagagaggccagctgtggaccaacagcctgagaatccagtacagcctgctgggccaggccaagcaggccgcccacgagtgcagcaccagccagaagctgagagccgacagcggcagcgacggcgcctacagactggagctgagacacgagctgcactgcacccagatcctggccttcagccacaaggtgcagctgtggcacgaggaggacagcggccacctgcacagccagctggaggtgagctacggcaagcactgggacaagaacagcaacaagagacacctgagagtgagccagaccttcaagaacgacagcggccccgccctgagcaaccacttcatggagttcgtgctgcaggtgcccgagagacaggtggactgcagagtgcagctgtaccacctgagcctgagactgccctacgtggagagcagcagccacctgaaggtgcagtacaacggcagacccctgttcgtggccggcggccagtggaaggacaccagcagagccaccctgtggaagtgggagggcgccctgaacctggacagcccctggctgatggtgagcgccgcccacagactgtactggccccacagagccgtgttccaggccgtgctggagctgaccctgggcaaggcctggaccctgaaggacctggtggtgagcgtgggctgcagaagccagggccccaacagagagggcaagatccaggtgtacaccgccgccaccacctacctgagagtgagcaccgtgaccgtgctggcccagagcctgttccacagctggagcgagctggagagcgcctggaacgccgccgtgcagggcgagatccacgccgagaacagcagagacagaaagatcctgaactgctggctgaagggcccccagcaggagctgaacctgaccgccgcctacagacacctggagtggcccagaaagacccaggtgagcctgaccgccgtgagaatcggcgcccagggccagcccagaggcctgcagctggagggcgagctggaggagctgagacaggacagaaccctgtacagaaagagaggcgccctgctgctgagacaccccctgcacctgcccatcccccagagcctgctgctgcaggagaccttcaccgccgacagaagacaccagagatacagcctggagaccagagtggtgctgaacggcagagaggagaccctgcagaccatggtgctgggctgccaggccggccacccctacgtgtgcgccggcctgatgcacccctacgacggcaaggtgatccccagaaacaccgagggctgcctggtgacctggaaccagcacaccagcctgaccctgctgagcagactggagagcggcgtgcagtag

SEQ ID NO: 23622 - DNA, 411 bp, Artificial Sequence
  Description of Artificial Sequence: Synthetic coding sequence
agaagcagaaccggccccgtgagcctgcagggcgaccccaagcaggccccctggagcagcagccagagcaacagcagcagaaagaccctgttcctgagcctgtgcccccccttccccacccagccccagatccacctgcacttcaccgagcacagagccagcagccaccagggcggccccttcaagctgcagatctgcctgagcagcctgtacagcaacctgctgctgcactgccactacagagaggtgcaccacatgagcggccacagaaccgagagcgccggcggccacctgttcctgccccaggacctgagatggaagagccccggcctgggcgtgttcgccgtgcagagcgtgtacgagctggccagaagacacaacgtgagccccttctacagcggccccccctag

SEQ ID NO: 23623 - DNA, 372 bp, Artificial Sequence
  Description of Artificial Sequence: Synthetic coding sequence
atggccctgctggccagcaacggctgcttcatcagatgcaacgaggccggcgacatcgaggccaagagcaagaccgccggcgaggaggagatgatcaagatcagaagctgcgccgagagagagaccaagaagaaggacgacatccccgaggaggacaagggcaacgtgaagcagtgcgagatcaactacgtgaagaagttccagagcttccaggagcacaagctgaagatcagcaaggaggacagcaagatcctgaagaaggcccagaaggacggcttcctgcaggagaccctgctggacagcctgggctacgagcacagatggaagagatggctgctgtactggatcaaggacatgagcagagacggctag

SEQ ID NO: 23624 - DNA, 291 bp, Artificial Sequence
  Description of Artificial Sequence: Synthetic coding sequence
gaggtgcagctggtggagagcggcggcggcctggtgcagcccggcggcagcctgagactgagctgcgccgccagcggcttcaccttcagcaaccactacaccagctgggtgagacaggcccccggcaagggcctggagtgggtgagctacagcagcggcaacagcggctacaccaactacgccgacagcgtgaagggcagattcaccatcagcagagacaacgccaagaacagcctgtacctgcagatgaacagcctgagagccgaggacaccgccgtgtactactgctag

SEQ ID NO: 23625 - DNA, 438 bp, Artificial Sequence
  Description of Artificial Sequence: Synthetic coding sequence
ggcgagagcgaggacgtgacccagttcctgcagagccacaagaagaccctgaccaacgagaagctgttcctgatggacggcaagagaacctggttcctggagatggagagcacccccggcgaggacgccatgaacaccgtgaagatgaccaccaaggacctgaagtacgacagaagcctgatcgacaaggccggcttcgagagaaccgacagcaacttcgagagaagccacaccgtgggcaagatgctgagcaacagcatcatgtgctacagagacatcttctacgagagagagagccagctgatgcagcagaccagcctgctgagctacgagatcgccatcgccacccccaccttcagcaactactaccccgactggagcgcccccatcaacatcgtggccagacccagcaccagcaagaagatcatgacctgctag

SEQ ID NO: 23626 - DNA, 396 bp, Artificial Sequence
  Description of Artificial Sequence: Synthetic coding sequence
atgagaaagcccagaagagccggctgggagaccctgagcagaaaggcccccggccccagcgccggcctgagacccagccccgccacctgcgacacctgccacttccccatcctgggcgacggcaaggccaccctgcccttcgcccccggcaagaccagcagagtgcccagcgacagcggcgtgttcagcagcgaccccagagccaactggagcagcatcagaaacttccccagcgccaagtgcgtgggcatcgagctgcacgagagcctgagcaccagcgccgagtggctgctgagaggcagaggcggcgccctgccctggatcgtgagatgcctggccgccaccgacctgctgctgcccggcaagaagggcgtggagagctgccccgtgggctag

SEQ ID NO: 23627 - DNA, 291 bp, Artificial Sequence
  Description of Artificial Sequence: Synthetic coding sequence
gaggtgcagctggtggagagcggcggcggcctggtgcagcccggcggcagcctgagactgagctgcgccgccagcggcttcaccttcagcaacagaagcacccactgggtgagacaggcccccggcaagggcctggagtgggtgggccacagcgtgagcaagaagaagaagaagaagaagaagaagaagaagaagggcagattcaccatcagcagagacgacagcaagaacaccctgtacctgcagatgaacagcctgaagaccgaggacaccgccgtgtactactgctag

SEQ ID NO: 23628 - DNA, 387 bp, Artificial Sequence
  Description of Artificial Sequence: Synthetic coding sequence
atgtactgccaggacagcaacatctgcgccgtgttcgccgtgcagggcggcaaggtgggcagaaagcacggcatcaagagaggcagaagacccagcatcagaagccccgcccagagagccagaggcccctggatccacgagagcaagcaccccgccttcgccaagcagcagatcaacctggagatgcccaacagcagagccaccaccgagctggcctgggtgtgcagcagcaccagcagaaagaagaagtgggccagaagcctgaccctgagcaccgcccccctgagccccccccccagcctggtgcactgcgaggactgcagctgcctgcccggctgccacagcggcgacctgtacaacctggcccccgccgagagaacctgctag

SEQ ID NO: 23629 - DNA, 2157 bp, Artificial Sequence
  Description of Artificial Sequence: Synthetic coding sequence
atgagcagaggctacagcgagaacaacaacttcctgaacaacaacaaccagatggtgctggacatgatcctgtaccccctgatcggcatcccccagaccatcaactgggagaccatcgccagactggtgcccggcctgacccccaaggagtgcgccaagagattcgacgagctgaagagcagcggcagcagccccgtggacaaccagtacaacagcctgatggccgccggcgagagccccgtggagaccctggccacctacatcaagagcagcctgctggacatccacggcgagttccaggagacccccgtgggccacgacgccgtgagcaagaccggcagacacagcatcgccagcaccagaaactgcagcagcgagagcgagaactgcaccacccacaacggcggcgagatgaccgaggagagcgagggccccaacatggtgatccacgtgtgcgacgaggccaagaacctgaaggaggacttcacctgccccagagacctgctgatcagcgagatgaagtacttcgccgagtacctgagcatggacgcccagagatgggaggaggtggacatcagcgtgcactgcgacgtgcacatcttcaactggctgatcaagtacatcaagagaaacaccaaggagaacaaggactgcgagatgcccaccctggagcccggcaacgtgatcagcatcctgatcagcagcgagttcctgaagatggacagcctggtggagcagtgcatccagtactgccacaagaacatgaacgccatcgtggccaccccctgcaacatgaactgcatcaacgccaacctgctgaccagaatcgccgacctgttcagccacaacgaggtggacgacctgaaggacaagaaggacaagttcaagagcaagctgttctgcaagaagatcgagagactgttcgaccccgagtacctgaaccccgacagcagaagcaacgccgccaccctgtacagatgctgcctgtgcaagaagctgctgaccaaggagaccgagagaagaatcccctgcatccccggcaagatcaacgtggacagaagaggcaacatcgtgtacatccacatcagagacaagacctgggacgtgcacgagtacctgaacagcctgttcgaggagctgaagagctggagagacgtgtactggagactgtggggcaccatcaactggctgacctgcagcagatgctaccaggccttcctgtgcatcgagttcagccactgccagtaccacagcgagaccgtggtgtaccccaccgccgccagcagcctgaacaccgtgggcaccggcatctacccctgctgcaaccagaaggtgctgagattcgaccccacccagctgaccaagggctgcaaggtgagagaccacatggtgaccctgagagaccagggcgagggcggcgacctgcccagctgccccaccgccagaatgctggacgacctgcacaagtacagagacgtgatcgtggtgcccttcagcaaggacaccgtgagcgacgtgggcgtgggcctgtgcgacgagaagggcatcgagtgcgacgtgctgctggagcccaacaccccctggggccccaagaccggcgagctgaacgccttcctgagcctgaagaactggaccctgcagctgaagcagcagagcctgttcagcgaggaggaggagtacaccaccggcagcgaggtgaccgaggacgaggtgggcgacgaggaggaggtgagcaagaagcagagaaagaaggagaagcccaagaagttcaccagacagcccaagaagcaggtgagcagcccctgcgcccagagaaaggagaaggccctggagaagagcgccagcagagacgtgagccccttcgtgatgagcatgcagaagaacaagtgggacgccaccagaagcctgagattcaaccaggacgcccagagagaggacgaccagagaagaatgaccgagatcaccggccacctgatcaagatgagactgggcgacctggacagagtgaagagcaaggaggccaaggagttcgccggcggcatctacagcagactggaggcccagatcaaggccagcgtgcccgtgagcgccagacagagcagcagcgagaagaacaccagaagcaagagcagattcggccagggcagacccgcctag

SEQ ID NO: 23630 - DNA, 942 bp, Artificial Sequence
  Description of Artificial Sequence: Synthetic coding sequence
atgcaggaggccgacgccagcatcaagaccgccgagaccaagggcagaacctggaagtaccagaacatcgagcccggcggcggcccccagaccagcggcaagggcggcttcggcagcctggtgctggtgttcctgggccagagagtgggctgcaacgagaccggcagcatgaacctggagaagctgcagaccagacccaacatgaccatcttcaccagaaacaacatcgccaccaacttcagcagcagcagcagcagcagctacttcagccccccccccccccccgtgctgctgcccctgctgctgctgctgccccagctgttcagcagcagcagcagcagcttcttcttcagcttcagccccagcaccagccccctggtgagcccctgcttcttcagcagcagcagcagcttctgcttcagcgtgagcctgctgcccagcagcagccccaccagcatgaccaagttccccaaggccgtgaccaccaagatcaagaccgacaagagagacctgatcaagctgaagggcttctgcaccgccaaggagaccatcaacagaaccaacagacagcccatcgagtgggagaagatcttcaccaactacgccagcaacaagggcctgatcagcagaatctacaaggagctgggccagagcgacaagcagagacccaacaaccccatcaagaagtgggccaaggacatgaacagacacttcagcaaggaggacatccaggtggccaacaagcacgagaagatgctgagcaccagcctgatcatcggcaagatgcagatcaagaccaccgtgagataccacctgatgcccgccagaaaggccaccatcaagaagagcgagaacaacagatgctggcagggctgcagaggcaagggcaccttcacccactgctggagcaagtgcaagctgaagtgcaagtgcaagatgtag

SEQ ID NO: 23631 - DNA, 864 bp, Artificial Sequence
  Description of Artificial Sequence: Synthetic coding sequence
gtgttcttcctgaccggcatccccggcctggagaccagacagatctggaccagcatccccttctgctgcctgtacgtgatcgccatcagcggcaacggcatgatcctgttcgtgatcatcaccgagagcagcctgcacgagcccatgtaccacttcctgagcatgctgagcttcatggacctgggcctgtgcctgagcaccctgaccaccatgctgggcatcttctggttcaacgccagagagatcagcttcgacgcctgcatcggccagatgttcttcatccacggcttcaccttcatggagagcagcgtgctgctggccatggccttcgacagattcatcgccgtgtgcaaccccctgagatacgccaccatcctgaccaacagcagaatcatcaaggtgggcttcgccatcgtgctgagaggcaccaccgccctggtgcccctgctgctgctgctgaagagactgagcttctgcagaagccacgtgctgcaccacagctactgcttccaccccgacgccatgaagctgagctgcaccgacacctggatcaacagcgccttcggcctggccatcgtgatcagcaccgccggcctggacagcgtgctgatcctgatcagctacgtgctgatcgtgagaagcgtgctgtgcatcgccagccccgaggagcagaagaaggccttcggcacctgcgtgagccacatcagcgccgtggccatcttctacatccccatgatcagcctgagccccgtgcacagattcggcaagcacgccccccccctggtgcacatgctgatcgccaacgtgtacctgctgatcccccccgtgatgaaccccatcatctacagcgtgaagaccaagtag

SEQ ID NO: 23632 - DNA, 396 bp, Artificial Sequence
  Description of Artificial Sequence: Synthetic coding sequence
atgagaaagcccagaagagccggctgggagaccctgagcagaaaggcccccggccccagcgccggcctgagacccagccccgccacctgcgacacctgccacttccccatcctgggcgacggcaacgccaccctgcccttcgcccccggcaagaccagcagagtgcccagcgacagcggcgtgttcagcagcgaccccagagccaactggagcagcatcagaaacttccccagcgccaagtgcgtgggcatcgagctgcacgccagcctgagcaccagcgccgagtggctgctgagaggcagaggcggcgccctgccctggatcgtgagatgcctggccgccaccgacctgctgctgcccggcaagaagggcgtggagagctgccccgtgggctag

SEQ ID NO: 23633 - DNA, 5421 bp, Artificial Sequence
  Description of Artificial Sequence: Synthetic coding sequence
atggccaccagagtggaggtgggcagcatcacccccctgaccgccgtgcccggcctgggcgagatgggcaaggaggagaccctgaccagaacctacttcctgcaggccggcgaggccagcggcgccccccccgccagaatcctggaggccaagagccccctgagaagccccgccagactgctgcccctgcccagactggcccccaagcccttcagcaaggagcaggacgtgaagagccccgtgcccagcctgagacccagcagcaccggccccagccccagcggcggcctgagcgaggagcccgccgccaaggacctggacaacagaatgcccggcctggtgggccaggaggtgggcagcggcgagggccccagaaccagcagccccctgttcaacaaggccgtgttcctgagacccagcagcagcaccatgatcctgttcgagaccaccaagagcggccccgccctgggcaaggccgtgagcgagggcgccgaggaggccaagctgggcgtgagcggcagcagacccgaggtggccgccaagcccgccctgcccacccagaagcccgccggcaccctgcccagaagcgcccccctgagccaggacaccaagccccccgtgccccaggaggaggccggccaggaccacccccccagcaaggccagcagcgtggaggacaccgccagacccctggtggagcccagacccagactgaagagaagacccgtgagcgccatcttcaccgagagcatccagccccagaagcccggccccggcgccgccgccaccgtgggcaaggtgccccccaccccccccgagaagacctgggtgagaaagcccagacccctgagcatggacctgaccgccagattcgagaacaaggaggccctgctgagaaaggtggccgacgagggcagcggccccaccgccggcgacatggccggcctggagagacccagagccgccagcaagctggacagagactgcctggtgaaggccgaggcccccctgcacgaccccgacctggacttcctggaggtggccaagaagatcagagagagaaaggagaagatgctgagcaagcccgagatgggcagccccagagccctggtgggcggcagcagcggcgtgacccccagcaacgaccagagcccctgggaggagaaggccaagctggaccccgagcccgagaaggccgccgagagccccagccccagactgggcagaggcctggagctggccgaggtgaagagcagagtggccgacggcgaggccgccgccggcggcgagtgggccagcagaagaagcgtgagaaagtgcatcagcctgttcagagaggacagcaccctggccctggccgtgggcagcgagagccccctggccacccccgccagccccagcgccgcccccgagcccgagaagggcgtggtgagcgtgcaggagagaatcagaggctggaccgccgagagcagcgaggccaagcccgaggtgagaagaagaaccttccaggccagacccctgagcgccgacctgaccaagctgttcagcagcagcgccagcagcaacgaggtgaagtacgagaagagcgccgagctgagcggcgagttccccaaggagcccagagagaagcagaaggagggccacagcctggacggcgcctgcatccccagaagcccctggaagcccggcaccctgagagacaagagcagacagaccgagcagaaggtgagcagcaaccaggaccccgacagctgcagaggcggcagcagcgtggaggccccctgccccagcgacgtgacccccgaggacgacagaagcttccagaccgtgtgggccaccgtgttcgagcaccacgtggagagacacaccgtggccgaccagagcggcagatgcctgagcaccaccccccccggcgacatggcccacgccagagtgagcgagcccagacccagacccgagatgggcagctggctgggcagagacccccccgacatgaccaagctgaagaaggagaacagcagaggcttcgacaaccccgagaccgagaagctgggccccaccaccctgctgaacggcgagctgagaccctaccacacccccctgagagacaagtaccccctgagcgagaaccacaacaacaacaccttcctgaagcacctggagaacccccccaccagccagagaatcgagcccagatacgacatcgtgcacgccgtgggcgagagagtgcacagcgaggccatcagccccgcccccgaggagaaggccgtgaccctgagaagcctgagaagctggctgagcctgaaggacagacagctgagccaggaggtgacccccgccgacctggagtgcggcctggagggccaggccggcagcgtgcagagagccagcctgatctgggaggccagaggcatgcccgaggccagcggccccaagttcggcggcaactgccccttccccaagtggaccggcggcgccgtggtgagcagccacaaggccaccgtggccgtgagcgaggagcactgcgcccccggcgccaccagcgtgagagccatcaaggccgccatctgggagagccagcacgagggccccgagggcgccagaagcaagcccggcgtgggcgccagaggccccccccagggctgccccctggaccccctgagcagagccaccaacggccccagcgacagccaggccagaacccaccccgacgccttcgccgtgcagaagggccccttcatcgtggccgccagagagggcgaccccggccccgcccaggtgccccagcccgccgtgagaatgagaaaggccggcgccatggaccagagaatggacagatggagaagaagaaccctgccccccaacgtgaagttcgacaccttcagcagcctggtgcccgaggacagcccccacgtgggccacagaagaaccgactacgtgagccccaccgccagcgccctgagaaagccccagctgagccactacagagtggagacccaggaggtgaaccccggcgccagcagagaccagaccagccccgccgtgaagcagggcagccccgtggagcccaaggccaccttcttcgccgtgacctaccagatccccaacacccagaaggccaagggcgtggtgctgagcggcgccgagagcctgctggagcacagcagaaagatcaccccccccagcagcccccacagcctgaccagcaccctggtgagcctgggccacgaggaggccctggagatggccggcagcaagaactggatgaagggcagagagcacgagaacgccagcatcctgaagaccctgaagcccaccgacagacccagcagcctgggcgcctggagcctggaccccttcaacggcagaatcatcgacgtggacgccctgtggagccacagaggcagcgaggacggccccagaccccagagcaactggaaggagagcgccaacaagatgagccccagcggcggcgccccccagaccacccccaccctgagaagcagacccaaggacctgcccgtgagaagaaagaccgacgtgatcagcgacaccttccccggcaagatcagagacggctacagaagcagcgtgctggacatcgacgccctgatggccgagtaccaggagctgagcctgaaggtgcccggcgaggcccaggagagaagaagccccaccgtggagcccagcaccctgcccagagagagacccgtgcagctgggcggcgtggagcagagaagaagaagcctgaaggagatgcccgacaccggcggcctgtggaagcccgccagcagcgccgagatcaaccacagcttcacccccggcctgggcaagcagctggccgagaccctggagaccgccatgggcaccaagagcagcccccccttctgggccctgccccccagcgcccccagcgagagataccccggcggcagccccatccccgccgaccccagaaagaagaccggcttcgccgaggacgacagaaaggccttcgccagcaagcaccacgtggccaagtgccagaactacctggccgagagcaagcccagcggcagagaggaccccggcagcggcgtgagagtgagccccaagagcccccccaccgaccagaagaagggcacccccagaaagagcaccggcagaggcgaggaggacagcgtggcccagtggggcgaccaccccagagactgcggcagagtgcccctggacatcaagagagcctacagcgagaagggcccccccgccaacatcagagagggcctgagcatcatgcacgaggccagagagagaagaagagagcagcccaagggcagacccagcctgaccggcgagaacctggaggccaagatgggcccctgctggtgggagagcggcaccggcgacagccacaaggtgctgcccagagacctggagaaggaggacgccccccaggagaaggagagacccctgcagcaggtgagccccgtggccagcgtgccctggagaagccacagcttctgcaaggacagaagaagcggccccttcgtggaccagctgaagcagtgcttcagcagacagcccaccgagcccaaggacaccgacaccctggtgcacgaggccggcagccagtacggcacctggaccgagcagtgccagagcggcgagagcctggccaccgagagccccgacagcagcgccaccagcaccagaaagcagccccccagcagcagactgagcagcctgagcagccagaccgagcccaccagcgccggcgaccagtacgactgcagcagagaccagagaagcaccagcgtggaccacagcagcaccgacctggagagcaccgacggcatggagggcccccccccccccgacgcctgccccgagaagagagtggacgacttcagcttcatcgaccagaccagcgtgctggacagcagcgccctgaagaccagagtgcagctgagcaagagaagcagaagaagagcccccatcagccacagcctgagaagaagcagattcagcgagagcgagagcagaagccccctggaggacgagaccgacaacacctggatgttcaaggacagcaccgaggagaagagccccagaaaggaggagagcgacgaggaggagaccgccagcaaggccgagagaacccccgtgagccacccccagagaatgcccgccttccccggcatggaccccgccgtgctgaaggcccagctgcacaagagacccgaggtggacagccccggcgagacccccagctgggccccccagcccaagagccccaagagccccttccagcccggcgtgctgggcagcagagtgctgcccagcagcatggacaaggacgagagaagcgacgagcccagcccccagtggctgaaggagctgaagagcaagaagagacagagcctgtacgagaaccaggtgtag

SEQ ID NO: 23634 - DNA, 741 bp, Artificial Sequence
  Description of Artificial Sequence: Synthetic coding sequence
atggccatcctgcccaaggtgatctacagattcaacgccatccccatcaagctgcccatgaccttcttcaccgagctggagaagaccaccctgaagttcatctggaaccagaagagagcctgcatcaccaagagcatcctgagacagaagaagaaggccggcggcatcaccctgcccgacttcaagctgtactacaccgccaccgtgaccaagaccgcctggtactggtaccagaacagagacatcgaccagtggaacagaaccgagcccagcgagatcatgccccacatctacaactacctgatcttcgacaagcccgacaagaacaagcagtggggcaaggacagcctgagcaacaagtggtgctgggagaactggctggccatctgcaagaagctgaagctggaccccttcctgaccccctacaccaagatcaacagcagatggatcaaggacctgaacatcagacccaagaccatcaagaccctggaggagaacctgggcatcaccatccaggacatcggcatgggcaagcacttcatgagcaagacccccaaggccatggccaccaaggccaagatcgacaagtgggacctgatcaagctgaagagcttctgcaccgccaaggagaccaccatcagagtgaacagacagcccaccgagtgggagaagatcttcaccacctacagcagcgacaagggcctgatcagcagaatctacaacgagctgaagcagatctag

SEQ ID NO: 23635 - DNA, 63 bp, Artificial Sequence
  Description of Artificial Sequence: Synthetic coding sequence
atcatgcccctgtacagcagcagcggcgacagaacccccatcagcaagaaccccaccaagtag

SEQ ID NO: 23636 - DNA, 867 bp, Artificial Sequence
  Description of Artificial Sequence: Synthetic coding sequence
atgtacgtgttccagctgttcgactactacagcgccagcggcaccaccctgctgtggcaggccttctgggagtgcgtggtggtggcctgggtgtacggcgccgacagattcaccgacgacatcgcctgcatgatcggctacagaccctgcccctggatgaagtggtgctggagcttcttcacccccctggtgtgcatgggcatcttcatcttcaacgtggtgtactacgagcccctggtgtacaacaacaccaacgtgtacccctggtggggcgaggccatgggctgggccttcgtgctgagcagcatgctgtgcatgcccctgcacctgctgggctgcctgctgagagccaagggcaccatggccgagtgctggaagcacctgacccagcccatctggggcctgcaccacctggagtacagagcccaggacgccgacgtgagaggcctgaccaccctgacccccgtgagcgagagcagcaaggtggtggtggtggagagcgtgatgggccagctgagcagccaccaccagctgaccagcggcctgtggggcaagagactgcagtacagcatcctgggcgtgtgggccgccaacctggcctgcagcggcttccccccctgcgccctgggctgggcccagccccaggagggcacccccgacaccgcccccaccagcagactgaaggccgacgccctgcccgccccccccgtgttctgcgtggccgccctgacccacgtgtgcctgagcagacccgtgcccagaagactgagcgaccccaagaagggcttccccgacaccagaaccgaggccggcggcctgggcctgagagagggcggcggccccgccggcaccttcctgctgtgctag

SEQ ID NO: 23637 - DNA, 666 bp, Artificial Sequence
  Description of Artificial Sequence: Synthetic coding sequence
gccagaagaagaggcgccgccgccgccctgagcagagccagagtgtggggcagactgtacccccagcccaagctgcaggaggccgcccccctgcccagaagaggctgggacggcggcggccacgtgggcggcggcggcgacgccagaggccccagactggagggcgagagcctgccccaccccagactggcccccgccgcccccagcgccagccccgccctggcccaccccctggtggcccaccccgccagactggacagcagcagaaaccccggcaccggcatctacttcggcggcagcgccgcctggagacccggcctgagcagagtgagccaggacagaagccccaacagcagcagacccctgagcctgagcggcatccccgccgacgtgagcccccccgccaagaccagagaggagaagagagagcccgccctgtggagcagagagaaggaggagggcgccaccgccctgcaggaccacggctgggagaaggagtggagaggcttcagaaccttcagcgtgagactgcacgtgcccgtgttcatcagcggcagccaggccctgggcagctgggccagaatcacctgctgcccccccctgtggagcagaggctgcttctgcaaggagagcagcggcagagagagcatggcctgcctgacctag

SEQ ID NO: 23638 - DNA, 1023 bp, Artificial Sequence
  Description of Artificial Sequence: Synthetic coding sequence
atggccagagacctgatcggccccgccctgccccccggcttcaaggccagaggcaccgccgaggacgaggagagagaccccagccccgtggccggccccgccctgccccccaactacaagagcagcagcagcgacagcagcgacagcgacgaggacagcagcagcctgtacgaggagggcaaccaggagagcgaggaggacgacagcggccccaccgccagaaagcagagaaagaaccaggacgacgacgacgacgacgacgacggcttcttcggccccgccctgccccccggcttcaagaagcaggacgacagcccccccagacccatcatcggccccgccctgccccccggcttcatcaagagcacccagaagagcgacaagggcagagacgaccccggccagcaggagaccgacagcagcgaggacgaggacatcatcggccccatgcccgccaagggccccgtgaactacaacgtgaccaccgagttcgagaagagagcccagagaatgaaggagaagctgaccaagggcgacgacgacagcagcaagcccatcgtgagagagagctggatgaccgagctgccccccgagatgaaggacttcggcctgggccccagaaccttcaagagaagagccgacgacaccagcggcgacagaagcatctggaccgacacccccgccgacagagagagaaaggccaaggagacccaggaggccagaaagagcagcagcaagaaggacgaggagcacatcctgagcggcagagacaagagactggccgagcaggtgagcagctacaacgagagcaagagaagcgagagcctgatggacatccaccacaagaagctgaagagcaaggccgccgaggacaagaacaagccccaggagagaatccccttcgacagagacaaggacctgaaggtgaacagattcgacgaggcccagaagaaggccctgatcaagaagagcagagagctgaacaccagattcagccacggcaagggcaacatgttcctgtag

SEQ ID NO: 23639 - DNA, 1200 bp, Artificial Sequence
  Description of Artificial Sequence: Synthetic coding sequence
atggagagaaagaaccccagcagagagagccccagaagactgagcgccaaggtgggcaagggcaccgagatgaagaaggtggccagacagctgggcatggccgccgccgagagcgacaaggacagcggcttcagcgacggcagcagcgagtgcctgagcagcgccgagcagatggagagcgaggacatgctgagcgccctgggctggagcagagaggacagacccagacagaacagcaagaccgccaagaacgccttccccaccctgagccccatggtggtgatgaagaacgtgctggtgaagcagggcagcagcagcagccagctgcagagctggaccgtgcagcccagcttcgaggtgatcagcgcccagccccagctgctgttcctgcacccccccgtgcccagccccgtgagcccctgccacaccggcgagaagaagagcgacagcagaaactacctgcccatcctgaacagctacaccaagatcgccccccaccccggcaagagaggcctgagcctgggccccgaggagaagggcaccagcggcgtgcagaagaagatctgcaccgagagactgggccccagcctgagcagcagcgagcccaccaaggccggcgccgtgcccagcagccccagcacccccgccccccccagcgccaagctggccgaggacagcgccctgcagggcgtgcccagcctggtggccggcggcagcccccagaccctgcagcccgtgagcagcagccacgtggccaaggcccccagcctgaccttcgccagccccgccagccccgtgtgcgccagcgacagcaccctgcacggcctggagagcaacagccccctgagccccctgagcgccaactacagcagccccctgtgggccgccgagcacctgtgcagaagccccgacatcttcagcgagcagagacagagcaagcacagaagattccagaacaccctggtggtgctgcacaagagcggcctgctggagatcaccctgaagaccaaggagctgatcagacagaaccaggccacccaggtggagctggaccagctgaaggagcagacccagctgttcatcgaggccaccaagagcagagccccccaggcctgggccaagctgcaggccagcctgacccccggcagcagcaacaccggcagcgacctggaggccttcagcgaccaccccgccatctag

SEQ ID NO: 23640 - DNA, 315 bp, Artificial Sequence
  Description of Artificial Sequence: Synthetic coding sequence
acctgcatcagcttcttcctgttcctgaagaagagcctggccctgctgcccagactggagtacagcggcaccatcctggcccactgcaacctgtgcctgctgggcagcagcaacagccacgccagcgccagccaggtggccggcatcaccggcatgtgccaccacgtgtggctgatcttcgtgttcctggtggagaccggcttccaccacgtggcccaggccggcctggagctgctggtgagcagcagcagccccgccctggccagccagagcaccgagatcaccggcatgagccagtgcgcctggcccctgtag

SEQ ID NO: 23641 - DNA, 303 bp, Artificial Sequence
  Description of Artificial Sequence: Synthetic coding sequence
tgcgagacccccagactgcccgagatcgccctgagagccctgcccagacccggcgtgagcagcctgggcaccatcctgtgcgtgcccagcgtgcccgtgggccccatcgtgctgaccagcgccacccccgagagcagcagattcaccagacccgcccccagcaccgtgcccgaggcccacagacacagcagaatcctgagactggcccccgtgccctgcagatgctacagaccccccgcccccgcccacaccagcagaagcaccagcctgttctacgagagccccagcaccttcaacgtgtag

SEQ ID NO: 23642 - DNA, 201 bp, Artificial Sequence
  Description of Artificial Sequence: Synthetic coding sequence
accagaaacctgtgggtgttcttcttcttcttcttcgagaccgagagctgcagcgtggcccaggccggcgtgcagtgggcccagagcagactgaccaccgccagccccggctgcaagcagttcagctgcctgagcctgctgagcagctgggactacagacacgcccccccccaccccgccaactactgcatcttcgtgtag

SEQ ID NO: 23643 - DNA, 261 bp, Artificial Sequence
  Description of Artificial Sequence: Synthetic coding sequence
gtgatctgccccccctggccccccaaggtgctgggcctgcaggccaagtaccacctgcacaaccacaagttcttcgtgctgagaagaagcctggccctgctgcccagactggagtgcagcggcgccgtgctggcccactgcaacctgtgcctgcccagcagcagcaacagccccgccagcgccagcagagtggccggcatcaccggcagctgccaccacaccagactgatcttctgcatcttcagcagagagggcgtgtag

SEQ ID NO: 23644 - DNA, 252 bp, Artificial Sequence
  Description of Artificial Sequence: Synthetic coding sequence
atcagcgcccactgcaacctgtgcctgcccggcagcagcgacagcagcgccagcgccagcagaatcgccggcatcaccggcgcccaccaccacaccagactgatcttcgtgttcctggtggagaccgagttccaccacgtgggccaggccggcctgaagtggccccaggtgatccaccccccctggccccccaagtgctgggactacagaagagagccccccagacccgccctgttcttcaacttcctgtag

SEQ ID NO: 23645 - DNA, 318 bp, Artificial Sequence
  Description of Artificial Sequence: Synthetic coding sequence
ctgctgcccagactggactgcagcggcaccatcagcgcccactgcaacctgcccagattcaagagattcagctgcctgagactgcccaccggcatcaccggcgcctaccaccacacctggatcatcttcgccttcctggtggagaccggcttccaccacgtgggccaggccggcctgaagctgctgaccagcgagcagctgggcaacaccaagagcagaagcagaccccccggctggagcgccatggcccccagctggctgaccgccagcagcgccagcagagtgcacgtgatcctgctgccccagccccccgagtag

SEQ ID NO: 23646 - DNA, 348 bp, Artificial Sequence
  Description of Artificial Sequence: Synthetic coding sequence
atgagcaagtgctgcgcccagagcctgaacgtgccccaccccagcgagggcagcgagaacatcacccaggactacctggagaagaactggtacctgcagagaaacacccagaacaccgagatcaagggccccggcggcaaggtgaacaaccccccccaccccagactgaccttccccggcgtggtgagcgagccccccgagggcggcagagtgcccaaggtgctgaagctggcccccagcgccaagaacctggtgaaggccaccaagagcctgaccatccccatgatcagcatcaagcacccccccggcgtgagactgtggagctggggcagaagattcatcacctag

SEQ ID NO: 23647 - DNA, 2436 bp, Artificial Sequence
  Description of Artificial Sequence: Synthetic coding sequence
atgaaggccagaaccagacccctgagagccagccacgacatcgtgcccaccatcacccagggcagcagagacggccacagaagccccgccagagaccccagaaccacccccgcctgcagagacagcctgcagaacggccacaccagcgacagcagcagcggcgagagcagcggcggccacagacccagaagaggccccagccccagccacgtgagattcgaggacgagagcgccagagaggccgagttcagacacctggagagactgcagcagagacagagacaggtgctgagcaccgtgctgcaggccgccgaccagggccccctgagaagcaagcccgacctggccgactacatcaacggcgcccccagactgagagacgccggccagggcaccttccacagactggtgggcagcctggacagaagaggccaccccgccccccccgcccccggcagcgagagaagatgccaggcctgcggcagctgcatcgacgaccccagacccgcccagggcaaggccccccccgtgcccagaaccctgcaggagctgcaggccgcctgcggcatggagagagtgctgggcggcctgagcagccccctgagactgctgcccgccgagcccagactgcacatggagtggatcagagagacccacatcggcgacaccgtgtgccccgccgaggtggacagcgccctggacagcaccgacaacagcgacaactgcagaaccgacagcgaggaggccggcaccagccaggccggctgggcctgcggcagaacccagggcagcagccccagactgagactgagaggcagcagacccagaggccacagatggagcaagaaggccgaggccgagctgccctggggcctgcaggcccagcagcacctgcccagagccgacgacgtggaggtggagaacgaggtgaaggagggcagaggccacacccccgagggcaccctgttcctgagagaggacgccaagccccccgacctggagctgaagagagtgagcctgggcccccagtggcagcccggccccggcctgggcagccaccagccccaccccctggacagcagaaccccctgcagaaccgcctacgccaccaccgcccccatgacccccgagagcagcggccccggcggccaggcccaggtgaccgagagccacgagagcctggagatcgtgagccccagcagcctgcagcagagccacgccgagcccagcgccccccaccaggcctggcagcccaccgccagcctgtgccccgagggctgggcccccacccccccccccagcagaaagaccaccagccccgtgagccacagaaaggccgccctggccggcctgctgagactgggcgaccagaccgagcccgtgggcatccccagaccccccagcagaagcgccgtgctgagaacctgcgagctgccccccagccagacccagcccagcagaccccaggtgagacaccccctgctggccctgagcaccaacaactgcaacaacagcgcccccagaggcctgcaggagccctacggcggcgccgtgcacgagggcagagtggagagaggcccctgcagcagagagcccgagccccccctggagaacagcagagacggcggcccccagggcttcctgggcagcgccgacgtggccaccatcaacagcaccggcatcaccctgagcctgagcagcgaggagagcgagagcagcaaggagagcgagggcagcctgcagagaaccggcagcggcagcggcggccacgtgctgagcagagccagcgccggcgccggcaccggccccggcagccccagcgccgcccccctggaccagaacaagaagagaagcagcagcatcgccagcaccctgggcctgaagaagctgttcagcgccctgggccagagcagcagacccaagctgggcaagagcagaagctacagcgtggagcagctgcagcccgccccccccggcctgaccagccagagcagagcccccagcctgcagagcctgcaccccgtgagccccagccaccagagaagaaaggccgccagcttccagaacctgcacagcctgctgagcagcaagggcaacagaagcagcctgtacctggtggccggccccggcgaccacagcgccgccggcagacccgccaagaccagccccagaagagccctgagcgtggaggacgtgggcgcccccagcctggccagaaccgtgggcagactggtggaggtgttccccgacggcaccagccagctgcagctgcagagaagccccggcggcaccttcggcttctgcgtggccagcggcaacggcagacccgacagcggcatgcccagccccctgccccagccccacggctggggcggcctgagcaagcagggcagagccttctggctgtggagcgaggccttcctggtgttcggctag

SEQ ID NO: 23648 - DNA, 3573 bp, Artificial Sequence
  Description of Artificial Sequence: Synthetic coding sequence
atggagggcaccgaggccgccgccgccaagcccgccggcggcagcccccagggccccaagaccggcagcggcaccgccagccccgtggagggcaccagcgccgtggagtggagcggccccgagccccagctggacaacggccacccccccagaccctggccctgcccccaggagaacagaaccagcagcctgatggccccccagccccccagagtgtggggcgtgcagctgcagggccccagcgtgctggagagcaaggtgagagccctgaaggagaagatgaccgtggccaagcagggcgtgagcccctgcagcgccagccaggagtggagcagccccaagaagccccagtgcagaagaggcaaggccggcagagccggcacccccagcgagggcagcttcctgcccggcgccgtggtggcccccagaacccagaacctgcccgacggccagctggacggcagcatcaacgaggagcagcccgccagagacggcggccccagactgcccagaccccccgcccccggcagagagtactgcaacagaggcagcccctggccccccgaggccgagtggaccctgcccgaccacgacagaggccccctgctgggccccagcagcctgcagcagagccccatccacggcgtgacccccggcagacccggcggccccggccactgcaacaagatcatccacatccccagccccagaaccggcagaagctaccccttccccgacggcgtggtgaccgaggccgacctggacagcaccagcctgaccagcgaggaggtgttcgtgcccagaaccgccctgctgggcgagagatggagagccggcgacctggaggccctgggcgccggcagcagcgtgctgagcctgagcgacagagtggagagaaacagactgctgctgcaggagatgctgaacgtgagcggccagagccccagaaaggtgggcacccccgcctggacccccagctgggacaccgccgcccccgagagacccgtgggcgacgtggactgggccagcggcaccagcctgcaggacagcggccagaacagaaccgtgggccccaaccccgagcccgtgctgagccccagacacgaggaggccacccacctgctgcagagagccagaatgaaggccagaaccagacccctgagagccagccacgacatcgtgcccaccatcacccagggcagcagagacggccacagaagccccgccagagaccccagaaccacccccgcctgcagagacagcctgcagaacggccacaccagcgacagcagcagcggcgagagcagcggcggccacagacccagaagaggccccagccccagccacgtgagattcgaggacgagagcgccagagaggccgagttcagacacctggagagactgcagcagagacagagacaggtgctgagcaccgtgctgcaggccgccgaccagggccccctgagaagcaagcccgacctggccgactacatcaacggcgcccccagactgagagacgccggccagggcaccttccacagactggtgggcagcctggacagaagaggccaccccgccccccccgcccccggcagcgagagaagatgccaggcctgcggcagctgcatcgacgaccccagacccgcccagggcaaggccccccccgtgcccagaaccctgcaggagctgcaggccgcctgcggcatggagagagtgctgggcggcctgagcagccccctgagactgctgcccgccgagcccagactgcacatggagtggatcagagagacccacatcggcgacaccgtgtgccccgccgaggtggacagcgccctggacagcaccgacaacagcgacaactgcagaaccgacagcgaggaggccggcaccagccaggccggctgggcctgcggcagaacccagggcagcagccccagactgagactgagaggcagcagacccagaggccacagatggagcaagaaggccgaggccgagctgccctggggcctgcaggcccagcagcacctgcccagagccgacgacgtggaggtggagaacgaggtgaaggagggcagaggccacacccccgagggcaccctgttcctgagagaggacgccaagccccccgacctggagctgaagagagtgagcctgggcccccagtggcagcccggccccggcctgggcagccaccagccccaccccctggacagcagaaccccctgcagaaccgcctacgccaccaccgcccccatgacccccgagagcagcggccccggcggccaggcccaggtgaccgagagccacgagagcctggagatcgtgagccccagcagcctgcagcagagccacgccgagcccagcgccccccaccaggcctggcagcccaccgccagcctgtgccccgagggctgggcccccacccccccccccagcagaaagaccaccagccccgtgagccacagaaaggccgccctggccggcctgctgagactgggcgaccagaccgagcccgtgggcatccccagaccccccagcagaagcgccgtgctgagaacctgcgagctgccccccagccagacccagcccagcagaccccaggtgagacaccccctgctggccctgagcaccaacaactgcaacaacagcgcccccagaggcctgcaggagccctacggcggcgccgtgcacgagggcagagtggagagaggcccctgcagcagagagcccgagccccccctggagaacagcagagacggcggcccccagggcttcctgggcagcgccgacgtggccaccatcaacagcaccggcatcaccctgagcctgagcagcgaggagagcgagagcagcaaggagagcgagggcagcctgcagagaaccggcagcggcagcggcggccacgtgctgagcagagccagcgccggcgccggcaccggccccggcagccccagcgccgcccccctggaccagaacaagaagagaagcagcagcatcgccagcaccctgggcctgaagaagctgttcagcgccctgggccagagcagcagacccaagctgggcaagagcagaagctacagcgtggagcagctgcagcccgccccccccggcctgaccagccagagcagagcccccagcctgcagagcctgcaccccgtgagccccagccaccagagaagaaaggccgccagcttccagaacctgcacagcctgctgagcagcaagggcaacagaagcagcctgtacctggtggccggccccggcgaccacagcgccgccggcagacccgccaagaccagccccagaagagccctgagcgtggaggacgtgggcgcccccagcctggccagaaccgtgggcagactggtggaggtgttccccgacggcaccagccagctgcagctgcagagaagccccggcggcaccttcggcttctgcgtggccagcggcaacggcagacccgacagcggcatgcccagccccctgccccagccccacggctggggcggcctgagcaagcagggcagagccttctggctgtggagcgaggccttcctggtgttcggctag

SEQ ID NO: 23649 - DNA, 405 bp, Artificial Sequence
  Description of Artificial Sequence: Synthetic coding sequence
atgatccccgtgagaggcctgtggtactgctacctgcaggtgaagaaggtgagactgagagaggccgagagactgggccccaagagccagtgccccgccgagtgcggcgccgccagctggatcagctgggtgctgcagcaccagcagctgctggccagcgagtgggccaccaaggacggcagaggcacctggggcagcaagcccagctgcaccgtgcccgccctgagcgccaccagccagctgctgcagctgggcagactgaacagcgacctgcagttcgtgagacagagagccaagaagagcgtgagcagccccagcctgctgcagttctggtgctgcctgagcagactgagcttccacgccctgaaccagaagatcaacagcaccaacatcaacatcacctag

SEQ ID NO: 23650 - DNA, 1155 bp, Artificial Sequence
  Description of Artificial Sequence: Synthetic coding sequence
atgagcgccggcagcgccacccaccccggcgccggcggcagaagaagcaagtgggaccagcccgcccccgcccccctgctgttcctgccccccgccgcccccggcggcgaggtgaccagcagcggcggcagccccggcggcaccaccgccgcccccagcggcgccctggacgccgccgccgccgtggccgccaagatcaacgccatgctgatggccaagggcaagctgaagcccacccagaacgccagcgagaagctgcaggcccccggcaagggcctgaccagcaacaagagcaaggacgacctggtggtggccgaggtggagatcaacgacgtgcccctgacctgcagaaacctgctgaccagaggccagacccaggacgagatcagcagactgagcggcgccgccgtgagcaccagaggcagattcatgaccaccgaggagaaggccaaggtgggccccggcgacagacccctgtacctgcacgtgcagggccagaccagagagctggtggacagagccgtgaacagaatcaaggagatcatcaccaacggcgtggtgaaggccgccaccggcaccagccccaccttcaacggcgccaccgtgaccgtgtaccaccagcccgcccccatcgcccagctgagccccgccgtgagccagaagccccccttccagagcggcatgcactacgtgcaggacaagctgttcgtgggcctggagcacgccgtgcccaccttcaacgtgaaggagaaggtggagggccccggctgcagctacctgcagcacatccagatcgagaccggcgccaaggtgttcctgagaggcaagggcagcggctgcatcgagcccgccagcggcagagaggccttcgagcccatgtacatctacatcagccaccccaagcccgagggcctggccgccgccaagaagctgtgcgagaacctgctgcagaccgtgcacgccgagtacagcagattcgtgaaccagatcaacaccgccgtgcccctgcccgccgccagcagcaccagcctgagaagcaccaagcacagcgccaccagctgcttcatcagcacctggagcctggccggcatcacctactggagccccacctgcgccaacaccatccccgacaacaccagcgccgccagcagctag

SEQ ID NO: 23651 - DNA, 1695 bp, Artificial Sequence
  Description of Artificial Sequence: Synthetic coding sequence
atgagcgccggcagcgccacccaccccggcgccggcggcagaagaagcaagtgggaccagcccgcccccgcccccctgctgttcctgccccccgccgcccccggcggcgaggtgaccagcagcggcggcagccccggcggcaccaccgccgcccccagcggcgccctggacgccgccgccgccgtggccgccaagatcaacgccatgctgatggccaagggcaagctgaagcccacccagaacgccagcgagaagctgcaggcccccggcaagggcctgaccagcaacaagagcaaggacgacctggtggtggccgaggtggagatcaacgacgtgcccctgacctgcagaaacctgctgaccagaggccagacccaggacgagatcagcagactgagcggcgccgccgtgagcaccagaggcagattcatgaccaccgaggagaaggccaaggtgggccccggcgacagacccctgtacctgcacgtgcagggccagaccagagagctggtggacagagccgtgaacagaatcaaggagatcatcaccaacggcgtggtgaaggccgccaccggcaccagccccaccttcaacggcgccaccgtgaccgtgtaccaccagcccgcccccatcgcccagctgagccccgccgtgagccagaagccccccttccagagcggcatgcactacgtgcaggacaagctgttcgtgggcctggagcacgccgtgcccaccttcaacgtgaaggagaaggtggagggccccggctgcagctacctgcagcacatccagatcgagaccggcgccaaggtgttcctgagaggcaagggcagcggctgcatcgagcccgccagcggcagagaggccttcgagcccatgtacatctacatcagccaccccaagcccgagggcctggccgccgccaagaagctgtgcgagaacctgctgcagaccgtgcacgccgagtacagcagattcgtgaaccagatcaacaccgccgtgcccctgcccggctacacccagcccagcgccatcagcagcgtgcccccccagcccccctactaccccagcaacggctaccagagcggctaccccgtggtgccccccccccagcagcccgtgcagcccccctacggcgtgcccagcatcgtgccccccgccgtgagcctggcccccggcgtgctgcccgccctgcccaccggcgtgccccccgtgcccacccagtaccccatcacccaggtgcagccccccgccagcaccggccagagccccatgggcggccccttcatccccgccgcccccgtgaagaccgccctgcccgccggcccccagccccagccccagccccagccccccctgcccagccagccccaggcccagaagagaagattcaccgaggagctgcccgacgagagagagagcggcctgctgggctaccagcacggccccatccacatgaccaacctgggcaccggcttcagcagccagaacgagatcgagggcgccggcagcaagcccgccagcagcagcggcaaggagagagagagagacagacagctgatgcccccccccgccttccccgtgaccggcatcaagaccgagagcgacgagagaaacggcagcggcaccctgaccggcagccacggcgagtgcgacatcgccggcggcaccggcgagtggctgagactggtgtag

SEQ ID NO: 23652 - DNA, 1845 bp, Artificial Sequence
  Description of Artificial Sequence: Synthetic coding sequence
atgagcgccggcagcgccacccaccccggcgccggcggcagaagaagcaagtgggaccagcccgcccccgcccccctgctgttcctgccccccgccgcccccggcggcgaggtgaccagcagcggcggcagccccggcggcaccaccgccgcccccagcggcgccctggacgccgccgccgccgtggccgccaagatcaacgccatgctgatggccaagggcaagctgaagcccacccagaacgccagcgagaagctgcaggcccccggcaagggcctgaccagcaacaagagcaaggacgacctggtggtggccgaggtggagatcaacgacgtgcccctgacctgcagaaacctgctgaccagaggccagacccaggacgagatcagcagactgagcggcgccgccgtgagcaccagaggcagattcatgaccaccgaggagaaggccaaggtgggccccggcgacagacccctgtacctgcacgtgcagggccagaccagagagctggtggacagagccgtgaacagaatcaaggagatcatcaccaacggcgtggtgaaggccgccaccggcaccagccccaccttcaacggcgccaccgtgaccgtgtaccaccagcccgcccccatcgcccagctgagccccgccgtgagccagaagccccccttccagagcggcatgcactacgtgcaggacaagctgttcgtgggcctggagcacgccgtgcccaccttcaacgtgaaggagaaggtggagggccccggctgcagctacctgcagcacatccagatcgagaccggcgccaaggtgttcctgagaggcaagggcagcggctgcatcgagcccgccagcggcagagaggccttcgagcccatgtacatctacatcagccaccccaagcccgagggcctggccgccgccaagaagctgtgcgagaacctgctgcagaccgtgcacgccgagtacagcagattcgtgaaccagatcaacaccgccgtgcccctgcccggctacacccagcccagcgccatcagcagcgtgcccccccagcccccctactaccccagcaacggctaccagagcggctaccccgtggtgccccccccccagcagcccgtgcagcccccctacggcgtgcccagcatcgtgccccccgccgtgagcctggcccccggcgtgctgcccgccctgcccaccggcgtgccccccgtgcccacccagtaccccatcacccaggtgcagccccccgccagcaccggccagagccccatgggcggccccttcatccccgccgcccccgtgaagaccgccctgcccgccggcccccagccccagccccagccccagccccccctgcccagccagccccaggcccagaagagaagattcaccgaggagctgcccgacgagagagagagcggcctgctgggctaccagcacggccccatccacatgaccaacctgggcaccggcttcagcagccagaacgagatcgagggcgccggcagcaagcccgccagcagcagcggcaaggagagagagagagacagacagctgatgcccccccccgccttccccgtgaccggcatcaagaccgagagcgacgagagaaacggcagcggcaccctgaccggcagccacgactaccccgccaagaagatgaagaccaccgagaagggcttcggcctggtggcctacgccgccgacagcagcgacgaggaggaggagcacggcggccacaagaacgccagcagcttcccccagggctggagcctgggctaccagtaccccagcagccagcccagagccaagcagcagatgcccttctggatggccccctag

SEQ ID NO: 23653 - DNA, 1581 bp, Artificial Sequence
  Description of Artificial Sequence: Synthetic coding sequence
atgatccagagccagatcagcttcgaggacgtggccgtggacttcaccctggaggagtggcagctgctgaaccccacccagaagaacctgtacagagacgtgatgctggagaactacagcaacctggtgttcctggaggtgtggctggacaaccccaagatgtggctgagagacaaccaggacaacctgaagagcatggagagaggccacaagtacgacgtgttcggcaagatcttcaacagcagcatcaacatcgtgcacgtgggcctgagaagccacaagtgcggcaccggcgagaagagcctgaagtgccccttcgacctgctgatccccaagaacaactgcgagagaaagaagatcgacgagctgaacaagaagctgctgttctgcatcaagcccggcagaacccacggcggcatcaagtactgcgactgcagcacctgcagaaagagcagcaacgaggagccctggctgaccgccaaccacatcacccacaccggcgtgtacctgtgcatggagtgcggcagattcttcaacaagaagagccagctggtgatccaccagagaacccacaccggcgagaagccctaccagtgcagcgagtgcggcaaggccttcagccagaagagcctgctgaccgtgcaccagagaacccacagcggcgagaagccccacggctgcagcgagtgccagaaggccttcagcagaaagagcctgctgatcctgcaccagagaatccacaccggcgagaagccctacggctgcagcgagtgcggcaaggccttcagcagaaagagccagctgaagagacaccagatcacccacaccatcgagaagccctacagctgcagcgagtgcggcaaggccttcagccagaagctgaagctgatcacccaccagagagcccacaccggcgagaagccctacccctgcagccactgcggcaaggccttcttctggaagagccagctgatcacccaccagagaacccacaccggcaagaagccctacggctgcggcgagtgccagaaggccttcagcagaaacagcctgctgatcagacaccagagaatccacaccggcgagaagccctacgagtgcaacgagtgcggcgaggccttcatcagaaagccccagctgatcaagcaccagatcacccacaccggcgagaagaactacagatgcagcgactgcgaggaggccttcttcaagaagagcgagctgatcagacaccagaagatccacctgggcgagaagccctacggctgcatccagtgcggcaagaccttcttcggcaagagccagctgctgacccaccacagaacccacaccggcgagaagccctacgagtgcagcgagtgcggcaaggccttcacccagaagagcagcctgatcagccaccagagaacccacaccggcgagaagccctacgagtgcagcgagtgcagaaagaccttcagcgagaagagcagcctgatccaccaccagagaacccacaccggcgagaagcccttcgagtgcagcgagtgcagaaaggccttcgcctggaagccccagctgctgagacaccagagaatctag

SEQ ID NO: 23654 - DNA, 4065 bp, Artificial Sequence
  Description of Artificial Sequence: Synthetic coding sequence
atgagcagcaccgccgacctgctggacaccatcctgaaggccatcgaggagaacatcaccaccgagaacagctgcagcctgctgatggccctggacaccctgctgaacagcgacagcaccaaggagatgggcttcacctgcaagatccaggccctgagagacaagctgtggatcttcctggtgcagagcttctacgccgtgagacacaccgagagctggaagctgatgagcaccgacgaccagcagaagatccaggccgccgccttcgacaagggcgacgacagaagactgggcaagaagcccatcttcagcagcagccagcagagaaagcaggtgagcgacagcggcgacatcaagatcaagagctggagaggcaacaacaagaaggagtgctggagctacctgagcaccaacaagaagatgaagagcgacggcctgggcgccagcggccacagcagcagcaccaacagaaacagcatcaacaagaccctgaagcaggacgacgtgaaggagaaggacggcaccaagatcgccagcaagatcaccaaggagctgaagaccggcggcaagaacgtgagcggcaagcccaagaccgtgaccaagagcaagaccgagaacggcgacaaggccagactggagaacatgagccccagacaggtggtggagagaagcgccaccgccgccgccgccgccaccggccagaagaacctgctgaacggcaagggcgtgagaaaccaggagggccagatcagcggcgccagacccaaggtgctgaccggcaacctgaacgtgcaggccaaggccaagcccctgaagaaggccaccggcaaggacagcccctgcctgagcatcgccggccccagcagcagaagcaccgacagcagcatggagttcagcatcagcaccgagtgcctggacgagcccaaggagaacggcagcaccgaggaggagaagcccagcggccacaagctgagcttctgcgacagccccggccagatgatgaagaacagcgtggacagcgtgaagaacagcaccgtggccatcaagagcagacccgtgagcagagtgaccaacggcaccagcaacaagaagagcatccacgagcaggacaccaacgtgaacaacagcgtgctgaagaaggtgagcggcaagggctgcagcgagcccgtgccccaggccatcctgaagaagagaggcaccagcaacggctgcaccgccgcccagcagagaaccaagagcacccccagcaacctgaccaagacccagggcagccagggcgagagccccaacagcgtgaagagcagcgtgagcagcagacagagcgacgagaacgtggccaagctggaccacaacaccaccaccgagaagcaggcccccaagagaaagatggtgaagcaggtgcacaccgccctgcccaaggtgaacgccaagatcgtggccatgcccaagaacctgaaccagagcaagaagggcgagaccctgaacaacaaggacagcaagcagaagatgccccccggccaggtgatcagcaagacccagcccagcagccagagacccctgaagcacgagaccagcaccgtgcagaagagcatgttccacgacgtgagagacaacaacaacaaggacagcgtgagcgagcagaagccccacaagcccctgatcaacctggccagcgagatcagcgacgccgaggccctgcagagcagctgcagacccgacccccagaagcccctgaacgaccaggagaaggagaagctggccctggagtgccagaacatcagcaagctggacaagagcctgaagcacgagctggagagcaagcagatctgcctggacaagagcgagaccaagttccccaaccacaaggagaccgacgactgcgacgccgccaacatctgctgccacagcgtgggcagcgacaacgtgaacagcaagttctacagcaccaccgccctgaagtacatggtgagcaaccccaacgagaacagcctgaacagcaaccccgtgtgcgacctggacagcaccagcgccggccagatccacctgatcagcgacagagagaaccaggtgggcagaaaggacaccaacaagcagagcagcatcaagtgcgtggaggacgtgagcctgtgcaaccccgagagaaccaacggcaccctgaacagcgcccaggaggacaagaagagcaaggtgcccgtggagggcctgaccatccccagcaagctgagcgacgagagcgccatggacgaggacaagcacgccaccgccgacagcgacgtgagcagcaagtgcttcagcggccagctgagcgagaagaacagccccaagaacatggagaccagcgagagccccgagagccacgagacccccgagacccccttcgtgggccactggaacctgagcaccggcgtgctgcaccagagagagagccccgagagcgacaccggcagcgccaccaccagcagcgacgacatcaagcccagaagcgaggactacgacgccggcggcagccaggacgacgacggcagcaacgacagaggcatcagcaagtgcggcaccatgctgtgccacgacttcctgggcagaagcagcagcgacaccagcacccccgaggagctgaagatctacgacagcaacctgagaatcgaggtgaagatgaagaagcagagcaacaacgacctgttccaggtgaacagcaccagcgacgacgagatccccagaaagagacccgagatctggagcagaagcgccatcgtgcacagcagagagagagagaacatccccagaggcagcgtgcagttcgcccaggagatcgaccaggtgagcagcagcgccgacgagaccgaggacgagagaagcgaggccgagaacgtggccgagaacttcagcatcagcaaccccgccccccagcagttccagggcatcatcaacctggccttcgaggacgccaccgagaacgagtgcagagagttcagcgccaccaagaagttcaagagaagcgtgctgctgagcgtggacgagtgcgaggagctgggcagcgacgagggcgaggtgcacacccccttccaggccagcgtggacagcttcagccccagcgacgtgttcgacggcatcagccacgagcaccacggcagaacctgctacagcagattcagcagagagagcgaggacaacatcctggagtgcaagcagaacaagggcaacagcgtgtgcaagaacgagagcaccgtgctggacctgagcagcatcgacagcagcagaaagaacaagcagagcgtgagcgccaccgagaagaagaacaccatcgacgtgctgagcagcagaagcagacagctgctgagagaggacaagaaggtgaacaacggcagcaacgtggagaacgacatccagcagagaagcaagttcctggacagcgacgtgaagagccaggagagaccctgccacctggacctgcaccagagagagcccaacagcgacatccccaagaacagcagcaccaagagcctggacagcttcagaagccaggtgctgccccaggagggccccgtgaaggagagccacagcaccaccaccgagaaggccaacatcgccctgagcgccggcgacatcgacgactgcgacaccctggcccagaccagaatgtacgaccacagacccagcaagaccctgagccccatctacgagatggacgtgatcgaggccttcgagcagaaggtggagagcgagacccacgtgaccgacatggacttcgaggacgaccagcacttcgccaagcaggactggaccctgctgaagcagctgctgagcgagcaggacagcaacctggacgtgaccaacagcgtgcccgaggacctgagcctggcccagtacctgatcaaccagaccctgctgctggccagagacagcagcaagccccagggcatcacccacatcgacaccctgaacagatggagcgagctgaccagccccctggacagcagcgccagcatcaccatggccagcttcagcagcgaggactgcagcccccagggcgagtggaccatcctggagctggagacccagcactag

SEQ ID NO: 23655 - DNA, 2364 bp, Artificial Sequence
  Description of Artificial Sequence: Synthetic coding sequence
atgggcgaccccggcagcgagatcatcgagagcgtgccccccgccggccccgaggccagcgagagcaccaccgacgagaacgaggacgacatccagttcgtgagcgagggccccagcagacccgtgctggagtacatcgacctggtgtgcggcgacgacgagaaccccagcgcctactacagcgacatcctgttccccaagatgcccaagagacagggcgacttcctgcacttcctgaacgtgaagaaggtgaagaccgacaccgagaacaacgaggtgagcaagaaccactgcagactgagcaaggccaaggagccccacttcgagtacatcgagcagcccatcatcgaggagaagcccagcctgagcagcaagaaggagatcgacaacctggtgctgcccgactgctggaacgagaagcaggccttcatgttcaccgagcagtacaagtggctggagatcaaggagggcaagctgggctgcaaggactgcagcgccgtgagacacctgggcagcaaggccgagaagcacgtgcacgtgagcaaggagtggatcgcctacctggtgacccccaacggcagcaacaagaccaccagacaggccagcctgagaaagaagatcagagagcacgacgtgagcaaggcccacggcaagatccaggacctgctgaaggagagcaccaacgacagcatctgcaacctggtgcacaagcagaacaacaagaacatcgacgccaccgtgaaggtgttcaacaccgtgtacagcctggtgaagcacaacagacccctgagcgacatcgagggcgccagagagctgcaggagaagaacggcgaggtgaactgcctgaacaccagatacagcgccaccagaatcgccgagcacatcgccaaggagatgaagatgaagatcttcaagaacatcatcgaggagaacgccaagatctgcatcatcatcgacgaggccagcaccgtgagcaagaagaccaccctggtgatctacctgcagtgcaccatccagagcgcccccgcccccgtgatgctgttcgtggccctgaaggagctggtgagcaccatcgccgagtgcatcgtgaacaccctgctgaccaccctgaacgactgcggcttcaccaacgagtacctgaaggccaacctgatcgccttctgcagcgacggcgccaacaccatcctgggcagaaagagcggcgtggccaccaagctgctggagaacttccccgagatcatcatctggaactgcctgaaccacagactgcagctgagcctggacgacagcatcagcgagatcaagcagatcaaccacctgaagatcttcatcgacaagatctacagcatctaccaccagcccaacaagaaccagaccaagctgctgggcaccgtggccaaggagctggagaccgagatcatcaagatcggcagagtgatgggccccagatgggccgcctgcagcctgcaggccgccaccgccgtgtggcacgcctaccccatcctgtacatgcacttcagccacagctacagcggcctggccaagagactggccaacatcaacttcctgcaggacctggccctgatgatcgacatcctggaggagttcagcgtgctgagcaccgccctgcagagcagaagcaccaacatcaagaaggcccagaagctgatcaagagaaccatcagagccctggagaacctgaagatcggcaccggcaagtacgagagccagatcgaggacctgatcaagagcgacaagttcaaggacatccccttcaacaagaacaacaagttcaacgccctgcccagaagcatcctgctggacaacatcatccagcacatgaacctgagactgctgagcgacagaaaccacgaggacatcttcaactacttcgacctgctggagcccagcacctggccctacgaggagatcaccagcccctggatcgccggcgagaagaccctgttccacctgtgcaagatcctgaagtacgaggtggacctgaacgacttcagagagttcgtgaacaacaacatcaagagcaacaacgtgagcatccccaccaccatctacaaggccaagaagatcgtgagcaccatcgccatcaacagcgccgaggccgagagaggcttcaacctgatgaacatcatctgcaccagagtgagaaacagcctgaccatcgaccacgtgagcgacctgatgaccatcaacctgctgggcaaggagctggccgactgggacgccacccccttcgtgaagagctggagcaactgcaaccacagactggccaccgacaccagagtgagacagaagagcaccaaggtgttccacgagaaccagctggccatctggaacctgaagtag

SEQ ID NO: 23656 - DNA, 636 bp, Artificial Sequence
  Description of Artificial Sequence: Synthetic coding sequence
atgcagctgggcgagcacacccacccccagaagaaccccaagagcctggccggctgcctgctgcccaacccccacccccagctgcagctgagaggcaagagagccgccggcctgctgctgagaagaaacccctggagacacccccaggcccccggcggcagcagcacctgggcccccagcctgccccccatcctggccccccaggcctacctgaacttcgccccccccacccccgtgcccggcggcagccccggcaccgaggcccagcccgtggcccccgccaacgccctgggcagcagaagcaagctgaacctgacccagcccagctgcctgagcagcggcagccacctgcccctgcccttccccgccggcatgtgcccccaccccgccaaccccacctgggccctgagaaagggcgccgaggtgccccagggcccccccctgagccacaccagaaaggccctgtgcctggccgccagcggcgtgggcgccctgctgctggaggtgcccagacaccccggctggggccagcagagcgccgccggcttccagcaggtgttccaggagggcgccggcacccacttccccagcgtgagagtgcagcccggcagaggcaagctgcagggccagagatag

SEQ ID NO: 23657 - DNA, 1488 bp, Artificial Sequence
  Description of Artificial Sequence: Synthetic coding sequence
atgaagaagagaaaggagctgaacgccctgatcggcctggccggcgacagcagaagaaagaagcccaagaagggccccagcagccacagactgctgagaaccgagccccccgacagcgacagcgagagcagcagcgaggaggaggaggagttcggcgtggtgggcaacagaagcagattcgccaagggcgactacctgagatgctgcaagatctgctaccccctgtgcggcttcgtgatcctggccgcctgcgtggtggcctgcgtgggcctggtgtggatgcaggtggccctgaaggaggacctggacgccctgaaggagaagttcagaaccatggagagcaaccagaagagcagcttccaggagatccccaagctgaacgaggagctgctgagcaagcagaagcagctggagaagatcgagagcggcgagatgggcctgaacaaggtgtggatcaacatcaccgagatgaacaagcagatcagcctgctgaccagcgccgtgaaccacctgaaggccaacgtgaagagcgccgccgacctgatcagcctgcccaccaccgtggagggcctgcagaagagcgtggccagcatcggcaacaccctgaacagcgtgcacctggccgtggaggccctgcagaagaccgtggacgagcacaagaagaccatggagctgctgcagagcgacatgaaccagcacttcctgaaggagacccccggcagcaaccagatcatccccagccccagcgccaccagcgagctggacaacaagacccacagcgagaacctgaagcaggacatcctgtacctgcacaacagcctggaggaggtgaacagcgccctggtgggctaccagagacagaacgacctgaagctggagggcatgaacgagaccgtgagcaacctgacccagagagtgaacctgatcgagagcgacgtggtggccatgagcaaggtggagaagaaggccaacctgagcttcagcatgatgggcgacagaagcgccaccctgaagagacagagcctggaccaggtgaccaacagaaccgacaccgtgaagatccagagcatcaagaaggaggacagcagcaacagccaggtgagcaagctgagagagaagctgcagctgatcagcgccctgaccaacaagcccgagagcaacagaccccccgagaccgccgacgaggagcaggtggagagcttcaccagcaagcccagcgccctgcccaagttcagccagttcctgggcgaccccgtggagaaggccgcccagctgagacccatcagcctgcccggcgtgagcagcaccgaggacctgcaggacctgttcagaaagaccggccaggacgtggacggcaagctgacctaccaggagatctggaccagcctgggcagcgccatgcccgagcccgagagcctgagagccttcgacagcgacggcgacggcagatacagcttcctggagctgagagtggccctgggcatctag

SEQ ID NO: 23658 - DNA, 345 bp, Artificial Sequence
  Description of Artificial Sequence: Synthetic coding sequence
atgtgcggctgggaggacagccagaagcccagcgtgcccagccacggccccaagacccccagctgcaagggcgtgaaggccccccacagcagcagacccagagcctggaagcaggacctggagcagagcctggccgccgcctacgtgcccgtggtggtggacagcaagggccagaaccccgacaagctgagattcaacttctacaccagccagtacagcaacagcctgaaccccttctacaccctgcagaagcccacctgcggctacctgtacagaagagacaccgaccacaccagaaagagattcgacgtgccccccgccaacctggtgctgtggagaagctag

SEQ ID NO: 23659 - DNA, 324 bp, Artificial Sequence
  Description of Artificial Sequence: Synthetic coding sequence
atgtggctgagcccctggagcacctgccccccccaccccctgcccagctgcctgaccgcctgctgcagccccgcccaccagcccgtgagaggcagcgcccagccccccgccagcgacctgtgcacctgcgtgacctgctgcagcggcccccaccccaactacccccccgcccacctgctgcccaccagcagcctgcccatctgccccggcctgatctgctgcctgctgacctgcctgctggtggactgcttcagcgccctgctgagcgcctgcgagaccagagacctgagcccctggaaggccagaagagtgctgctgagatag

SEQ ID NO: 23660 - DNA, 2499 bp, Artificial Sequence
  Description of Artificial Sequence: Synthetic coding sequence
atgggcaccaccgccagcaccgcccagcagaccgtgagcgccggcacccccttcgagggcctgcagggcagcggcaccatggacagcagacacagcgtgagcatccacagcttccagagcaccagcctgcacaacagcaaggccaagagcatcatccccaacaaggtggcccccgtggtgatcacctacaactgcaaggaggagttccagatccacgacgagctgctgaaggcccactacaccctgggcagactgagcgacaacacccccgagcactacctggtgcagggcagatacttcctggtgagagacgtgaccgagaagatggacgtgctgggcaccgtgggcagctgcggcgcccccaacttcagacaggtgcagggcggcctgaccgtgttcggcatgggccagcccagcctgagcggcttcagaagagtgctgcagaagctgcagaaggacggccacagagagtgcgtgatcttctgcgtgagagaggagcccgtgctgttcctgagagccgacgaggacttcgtgagctacacccccagagacaagcagaacctgcacgagaacctgcagggcctgggccccggcgtgagagtggagagcctggagctggccatcagaaaggagatccacgacttcgcccagctgagcgagaacacctaccacgtgtaccacaacaccgaggacctgtggggcgagccccacgccgtggccatccacggcgaggacgacctgcacgtgaccgaggaggtgtacaagagacccctgttcctgcagcccacctacagataccacagactgcccctgcccgagcagggcagccccctggaggcccagctggacgccttcgtgagcgtgctgagagagacccccagcctgctgcagctgagagacgcccacggccccccccccgccctggtgttcagctgccagatgggcgtgggcagaaccaacctgggcatggtgctgggcaccctgatcctgctgcacagaagcggcaccaccagccagcccgaggccgcccccacccaggccaagcccctgcccatggagcagttccaggtgatccagagcttcctgagaatggtgccccagggcagaagaatggtggaggaggtggacagagccatcaccgcctgcgccgagctgcacgacctgaaggaggtggtgctggagaaccagaagaagctggagggcatcagacccgagagccccgcccagggcagcggcagcagacacagcgtgtggcagagagccctgtggagcctggagagatacttctacctgatcctgttcaactactacctgcacgagcagtaccccctggccttcgccctgagcttcagcagatggctgtgcgcccaccccgagctgtacagactgcccgtgaccctgagcagcgccggccccgtggcccccagagacctgatcgccagaggcagcctgagagaggacgacctggtgagccccgacgccctgagcaccgtgagagagatggacgtggccaacttcagaagagtgcccagaatgcccatctacggcaccgcccagcccagcgccaaggccctgggcagcatcctggcctacctgaccgacgccaagagaagactgagaaaggtggtgtgggtgagcctgagagaggaggccgtgctggagtgcgacggccacacctacagcctgagatggcccggcccccccgtggcccccgaccagctggagaccctggaggcccagctgaaggcccacctgagcgagcccccccccggcaaggagggccccctgacctacagattccagacctgcctgaccatgcaggaggtgttcagccagcacagaagagcctgccccggcctgacctaccacagaatccccatgcccgacttctgcgcccccagagaggaggacttcgaccagctgctggaggccctgagagccgccctgagcaaggaccccggcaccggcttcgtgttcagctgcctgagcggccagggcagaaccaccaccgccatggtggtggccgtgctggccttctggcacatccaggtggtgatgaaggtggtgcagctgctgcccgacggccacagagtgaagaaggaggtggacgccgccctggacaccgtgagcgagaccatgacccccatgcactaccacctgagagagatcatcatctgcacctacagacaggccaaggccgccaaggaggcccaggagatgagaagactgcagctgagaagcctgcagtacctggagagatacgtgtgcctgatcctgttcaacgcctacctgcacctggagaaggccgacagctggcagagacccttcagcacctggatgcaggaggtggccagcaaggccggcatctacgagatcctgaacgagctgggcttccccgagctggagagcggcgaggaccagcccttcagcagactgagatacagatggcaggagcagagctgcagcctggagcccagcgcccccgaggacctgctgtag

SEQ ID NO: 23661 - DNA, 1428 bp, Artificial Sequence
  Description of Artificial Sequence: Synthetic coding sequence
atgccctgccccagcagaaacaccagcagccccgagccccccacccccggcctgaagttcagcttcctgagaggccagagacagcccagcgtgacccccgagaaggccagcctgcagcacaacggcccctggaaggtgctgtgcagcctgtacagccccaagcccaacagagccaagagcctgggcaaggccggcaccacccagaccaagaccagcggccccgccaccgcccccagccccctgaccgaggagaaggccgccctgcccgaggccagcgccggcagccccgagagaggccccaccctggaggaggagccccccggccccgagcccagaatcggcgccctgggcgtgaaggtgttcagaagcagaatcgcctgcctgcccggcggcagagacagagccggcagacccctgctgctggtgagcaccaccgagggcgcctgggaggccccctggtgcaccgtgagcgaggtgaccaagctgctgagctacctgtgcaccatccccagacccgaggacaaggccaagggcctggccgtgctgatcgacgccagaagacagcccccccagcccggcctggtgagcgccctgcaggccacccaggcccaggtgcccgccagcatcagagccatcctgttcctgggcgagaaggaggccgccctgcagctgcagaccctgcccgacgtgcagaagctggaccccttcctggccgacctgcaccaggccagcagcctgctgcaggccagcatcgaggagttcgagaaggccgacccccccggcggcatgcaggaggccaccagatgcctgagcaagagcaaggagctgatggaggccgtgctgagagaccccggcctgctgggcctgcagagagagggcggcgccaccctggccagactgcagcacgacgccagcagactggacttcagccccgacgtgagaagccacctggccgccgccaccgccctgtacagcctggtggacgagcagctgcacgtgctggtgaccgccagcaacagcctgctgggcaagctggagctgagagtgagactgggcagactggaggccgccatccaccaggtgagcgactggatggagcaggagggcagaagatgcctgcagagcctgacccccaaggacggcagcctggagaccgtggagaaggcccacgccgagttcgagaacttcttcctgcaggccgccgcccagtacagaagaggcctggagctgagcaagcaggccgcccagctgggcgccaccgccagaggcgccggcgaggccgagagagccgagttccccgagctggccgccttcgccagcacccagagagccttccaggccgagctgacccacttctacatggccgccgagagacagagaaccgacctggagaccctgctgcacctgcacagattctgcaagagatag

SEQ ID NO: 23662 - DNA, 480 bp, Artificial Sequence
  Description of Artificial Sequence: Synthetic coding sequence
atgcaccagacccacgccatccagagactggaggtgctgcccagcttcagcaacgagagccccaccagcagagagaccagcgagagctggaccaaccaggacgacatcttctacgcctacgccagcatgagccccggcgccgagcacagaggcaccacccagctgctgagattccagctggcccccatcaagaagctggagggcagcctgcagacccacttcctgctgagcagcctgcaccccagaatgaccttccccggcagagccggcggcggcgaggccggcagcagaccccccagaagaccctgggccggcatcctgatcctgcagctgcccagcaccagaggcggcagaagaagcggccacggcgccgtgagaagctggggcccctggaaggtggtggccgagcagcccgtgggcggcaccgacccccccgcccacggcggcagaggcagacccagccccaacgagaacacctag

SEQ ID NO: 23663 - DNA, 3108 bp, Artificial Sequence
  Description of Artificial Sequence: Synthetic coding sequence
atggtggtgttcgtgggcagaagactgcccgccctgctgggcctgttcaagaagaagggcagcgccaaggccgagaacgacaagcacctgagcgtgggccccggccagggccccggcagcgccgtggacgagcaccaggacaacgtgttcttccccagcggcagacccccccacctggaggagctgcacacccaggcccaggagggcctgagaagcctgcagcaccaggagaagcagaagctgaacaagggcggctgggaccacggcgacacccagagcatccagagcagcagaaccggccccgacgaggacaacatcagcttctgcagccagaccaccagctacgtggccgagagcagcaccgccgaggacgccctgagcatcagaagcgagatgatccagagaaagggcagcaccttcagaccccacgacagcttccccaagagcggcaagagcggcagaagaagaagagagagaagaagcaccgtgctgggcctgccccagcacgtgcagaaggagctgggcctgagaaacgagagagaggcccccggcacccccagagcccccggcgccagagacgccgtgagaatccccaccgtggacggcagacccagaggcaccagcggcatgggcgccagagtgagcctgcaggccctggaggccgaggccgaggccggcgccgagaccgaggccatgctgcagagacacatcgacagagtgtacagagacgacaccttcgtgggcagaagcaccggcaccagagccccccccctgaccagacccatgagcctggccgtgcccggcctgaccggcggcgccggccccgccgagcccctgagccccgccatgagcatcagcccccaggccacctacctgagcaagctgatcccccacgccgtgctgccccccaccgtggacgtggtggccctgggcagatgcagcctgagaaccctgagcagatgcagcctgcacagcgccagccccgccagcgtgagaagcctgggcagattcagcagcgtgagcagcccccagcccagaagcagacaccccagcagcagcagcgacacctggagccacagccagagcagcgacaccatcgtgagcgacggcagcaccctgagcagcaagggcggcagcgagggccagcccgagagcagcaccgccagcaacagcgtggtgccccccccccagggcggcagcggcagaggcagccccagcggcggcagcaccgccgaggccagcgacaccctgagcatcagaagcagcggccagctgagcggcagaagcgtgagcctgagaaagctgaagagacccccccccccccccagaagaacccacagcctgcaccagagaggcctggccgtgcccgacggccccctgggcctgccccccaagcccgagagaaagcagcagccccagctgcccagaccccccaccaccggcggcagcgagggcgccggcgccgccccctgcccccccaaccccgccaacagctgggtgcccggcctgagccccggcggcagcagaagaccccccagaagccccgagagaaccctgagccccagcagcggctacagcagccagagcggcacccccaccctgccccccaagggcctggccggcccccccgccagccccggcaaggcccagccccccaagcccgagagagtgaccagcctgagaagccccggcgccagcgtgagcagcagcctgaccagcctgtgcagcagcagcagcgaccccgcccccagcgacagaagcggcccccagatcctgacccccctgggcgacagattcgtgatccccccccaccccaaggtgcccgcccccttcagccccccccccagcaagcccagaagccccaaccccgccgcccccgccctggccgcccccgccgtggtgcccggccccgtgagcaccaccgacgccagcccccagagcccccccaccccccagaccaccctgacccccctgcaggagagccccgtgatcagcaaggaccagagccccccccccagccccccccccagctaccaccccccccccccccccaccaagaagcccgaggtggtggtggaggcccccagcgccagcgagaccgccgaggagcccctgcaggaccccaactggccccccccccccccccccgcccccgaggagcaggacctgagcatggccgacttccccccccccgaggaggccttcttcagcgtggccagccccgagcccgccggccccagcggcagccccgagctggtgagcagccccgccgccagcagcagcagcgccaccgccctgcagatccagccccccggcagccccgaccccccccccgccccccccgcccccgcccccgccagcagcgcccccggccacgtggccaagctgccccagaaggagcccgtgggctgcagcaagggcggcggcccccccagagaggacgtgggcgcccccctggtgacccccagcctgctgcagatggtgagactgagaagcgtgggcgcccccggcggcgcccccacccccgccctgggccccagcgccccccagaagcccctgagaagagccctgagcggcagagccagccccgtgcccgcccccagcagcggcctgcacgccgccgtgagactgaaggcctgcagcctggccgccagcgagggcctgagcagcgcccagcccaacggcccccccgaggccgagcccagacccccccagagccccgccagcaccgccagcttcatcttcagcaagggcagcagaaagctgcagctggagagacccgtgagccccgagacccaggccgacctgcagagaaacctggtggccgagctgagaagcatcagcgagcagagacccccccaggcccccaagaagagccccaaggcccccccccccgtggccagaaagcccagcgtgggcgtgcccccccccgccagccccagctaccccagagccgagcccctgaccgccccccccaccaacggcctgccccacacccaggacagaaccaagagagagctggccgagaacggcggcgtgctgcagctggtgggccccgaggagaagatgggcctgcccggcagcgacagccagaaggagctggcctag

SEQ ID NO: 23664 - DNA, 240 bp, Artificial Sequence
  Description of Artificial Sequence: Synthetic coding sequence
atgatcttcacccccttcctgccccccgccgacctgagcgtgttccagaacgtgaagggcctgcagaacgaccccgaggagtgggtggccgtgagcgacgccaccgaggaccccagcggcggcaccggcctgcccagagagcccgccctgctgagaggcagctggagaagcagattccagagagccctggcctgcttcaccaagtgcttcagaggcggctacagagccctgggcatctag

SEQ ID NO: 23665 - DNA, 228 bp, Artificial Sequence
  Description of Artificial Sequence: Synthetic coding sequence
atgatcttcacccccttcctgccccccgccgacctgaacgtgaagggcctgcagaacgaccccgaggagtgggtggccgtgagcgacgccaccgaggaccccagcggcggcaccggcctgcccagagagcccgccctgctgagaggcagctggagaagcagattccagagagccctggcctgcttcaccaagtgcttcagaggcggctacagagccctgggcatctag

SEQ ID NO: 23666 - DNA, 2217 bp, Artificial Sequence
  Description of Artificial Sequence: Synthetic coding sequence
atggaggactgcctgcacaccagcagcgagaacctgagcaagctggtgagctgggcccacagccacggcaccatctgcagcctgatccccaacctgaagcacctgctgagcgagggcagccacggcaacctgaccgccatgtggggctgcagcgccggccacgcctaccactggcccctgaccgccacctgcagagccggcagccaggagagagtgtgcttccaggacaacagaagcttcaacagcgacagccccagcatcatcggcgtgcccagcgagacccagaccagccccgtggagagataccccggcagacccgtgaaggccaagctggactgcaacagaaccagagacagctgcgacttcagctactgcagcgagcccagcgagctggacgagaccgtggaggagtacgaggacgagaacaccctgttcgacatggtgtgcgagagcagcgtgaccgacgaggacagcgacttcgagccccagacccagagaccccagagcatcgccagaaagagacccggcgtggtgcccagcagcctgcacagcagcagccagacccagatggtggacgagtgcagcaacgacgtgatcatcaagaagatcaagcaggagatccccgaggactactacatcgtggccaacgccgagctgaccggcggcgtggacggccccgccctgagcctgacccagatggccaagcccaagccccagacccacgccggccccagctgcgtgggcagcgccaagctgatcccccacgtgaccagcgccatcagcaccgagctggacccccacggcatgagcgccagccccagcgtgatcagcagacccatcgtgcagaagaccgccagagtgagcctggccagccccaacagaggcccccccggcacccacggcaccaaccagcaggtggccatgcagatgcccgtgagcaccagccaccccaacaagcagatcagcatccccctgagcgccctgcagctgcccggccaggacgagcaggtggccagcgaggagttcctgagccacctgcccagccaggtgagcagctgcgaggtggccctgagccccagcgtgaacaccgagcccgaggtgagcagcagccagcagcagccccccgtggcccccgccatcaccaccgaggccaccgcccagtgcatccccgaccaggacgagagagccgccgagctgagcagagagcagaacgagaagaccatcagaagcacccagaccgccctgagaaacttcagagagttcctgatcagcaagtaccccagcgagaccagagagatctacgtgatcccctgcaaggagctggacgcctacctggccagcttcttcgtggacgccagacagaaggacggcagcgagtacgagcccaacagcctggccaactaccagtgcggcctggagagatacctgaaggagcacagatacggctacagcatcaccagagacaaggagttcaagagaagccaggaggccctgaagcagaagcagatcgagctgagatgcaagggcaagggcaacaagccccacaagagcatgaagctgaccttcgccgacgagctgatcctgagaaagagaggcctgctgagcagatacaaccccgagggcctgctgaacctggtgtggctgaacaacaccaaggccttcggccactgcaccggcttccacggcagcaccctgaagtggggcgacatcagactgagagtgaccgagaccggcctggagtacctggagtggatgggccaggacaccggcgacctgaacgccaagaccaagagaggcggcaccgacagcagagtgtacgccacccagcacgccccccagacctgccccgtgcaggactacaaggagtacgcccagagaagaccccccgccatgagatacgaggacgcccccttctacctgagcatcaagcccgtggtgaacctggccgccctgcactggtacaactgccaggccctgggcaagaacaagctggccaagatggtgaagaccatgtgcgagaagggcaacatccccggcagaaagaccaacttcagcgtgtaccagagctgcagcaccctgagcgaggcccagagcaaccagctggtgctgatctgcaacaacctgagccagcaggccgcccagagcgtggccggccacagcaacaacggcaacttcatcgtgagcgccagctacgacagcagcagcgacaccgcctag

SEQ ID NO: 23667 - DNA, 390 bp, Artificial Sequence
  Description of Artificial Sequence: Synthetic coding sequence
atgaaggcccagggcgccatcgccatggccagcatcgccaagcagaccagcagcctggtgcccccctacctgggcatgatcctgaccgccctgctgcagggcctggccggcagaacctgggccggcaaggaggagctgctgaaggccatcgcctgcgtggtgaccgcctgcagcgccgagctggagaagagcgtgcccaaccagcccagcaccaacgagatcctgcaggccgtgctgaaggagtgcagcaaggagaacgtgaagtacaagatcgtggccatcagctgcgccgccgacatcctgaaggccaccaaggaggacagattccaggagttcagcaacatcgtgatccccctgatcaagaagaagaccctggagaacctggagtag

SEQ ID NO: 23668 - DNA, 390 bp, Artificial Sequence; identical to SEQ ID NO: 23667
  Description of Artificial Sequence: Synthetic coding sequence

SEQ ID NO: 23669 - DNA, 465 bp, Artificial Sequence
  Description of Artificial Sequence: Synthetic coding sequence
atgtgcaccgtggcccacacctgcatcgagcacatgtgcacctacatgagactgcaccccctggcccacccccacacctgcgccctggcccccatctgcacccacgtgcacaccctggcccacatgtgcatctgcagaaacgcccccctgcacctgtgcgacacccccgcccacctgcacacccccatctgcatccaggcccagacccacagccacaccttcgcccacaccgccaccaacctgcacaagcagcacctgtacaccgacacctaccccttcgtgcccatccagtgcaccctgacccacctgcacaccgccgtgctggcccacaccttcgcccacacccacctgcacacctgcacccacaccacccacctgagcgtgcagcacacctacctgtgcgcctacatgcacatctgcacctgcacccagcagtggcacaccctgctgtaccacagcccctag

SEQ ID NO: 23670 - DNA, 126 bp, Artificial Sequence
  Description of Artificial Sequence: Synthetic coding sequence
agaaagaacggccagcagcagcccagaggcagacccggcagcgccagaccccccgcccagccccccgagtgcggcgccgaccagagagtgaccctgctgaccggcgaccccgtgagcgccgcctag

SEQ ID NO: 23671 - DNA, 372 bp, Artificial Sequence
  Description of Artificial Sequence: Synthetic coding sequence
atggtggacggcagaaccagaaccatcatcaacgacatcttcttcaccgagcccacccccgagatgagcagcctgcccgtgagaagccacagcagcctgagcctgaacctggtgagcctgatggtgatctgcagaggcatcatcaagctggtgatccacttcagaatgtactgcccccccagactgaaggccaagcacatcgagcccaccctgagacccgtgcccctgaaggagctgagaatcagccactggcccaacgagtgcatcagacacagcgccagcgtgcccatggccaccggcgccaacggcctggagaccaaggacgagaccaagagaaacgccgagaagtgcgcctgcagcgtgttcctgtag

SEQ ID NO: 23672 - DNA, 372 bp, Artificial Sequence; identical to SEQ ID NO: 23671
  Description of Artificial Sequence: Synthetic coding sequence

SEQ ID NO: 23673 - DNA, 423 bp, Artificial Sequence
  Description of Artificial Sequence: Synthetic coding sequence
atggactgcaagagccccaagagagccaacatctgcccccacctgcccggcggcggcctgttcagcaccccccccagccaggccgcctggagaaccctgctgaccgccctgtgcttccccggccccacctgcaccggccccatgagagagggccccagagccgtgtacaacccccccagagcccacagaaacagcagcgacaactgcgtgatgaagcacctgctgtgcgccggcgacaagaacggcaccagaagacacgccctgcccagccccctggagggcagcttccagcccggcagacagatcccccccccccagacccccagcaccgacccccagaccctgcccctgagcttcagaagcctgctgagatgccaccagctgtgcgccgccagcctgccccccagcctgaagctgccctag

SEQ ID NO: 23674 - DNA, 423 bp, Artificial Sequence; identical to SEQ ID NO: 23673
  Description of Artificial Sequence: Synthetic coding sequence

SEQ ID NO: 23675 - DNA, 651 bp, Artificial Sequence
  Description of Artificial Sequence: Synthetic coding sequence
gcctggaccgtgagcggcctgctgagcgccgccttcgagcccgaggtgcccgccagcctgagccagaagagcgaccacagaagcagcctgcccagcagccccagcctgcccctgagcaagaccctggccgtggcctacgaccccgaggacagcagcgccgccaactggtgcttcggcctgtgcgccgtgcccggccccgccagcctggacctgggcagaccctggcccgtggaggaggcccaggtgaaggccggcggctgctgctggctgagcagcctgctgctggaggtgagcgccagcctgagaatgggcagaaccgaccccctgaccggcctgcagagcctggagggcagcatcggccagggcaacggcggccacgtgaccagctgcagagccccctgccacagacccaaggagcagctgtgccccctgagcgtgggcggccccggcggcgaggtggacagacacctgccccccaccggcatctggcagcaggagcccggcctgctgtgcaagaagggcagacccaagggcgagcagtggcccatcaagaccctggagaacaagcaccccttccccagatggctgcagatcatcaccagctgcaagagcacccccggcgagcagctgaccttcatcagcctgagctag

SEQ ID NO: 23676 - DNA, 720 bp, Artificial Sequence
  Description of Artificial Sequence: Synthetic coding sequence
ccccagatgagcgccgtgtacaccccccccagcgtgagcacccaccagatgcccagaaaccccaacccccagcagagaccccagatgagcgccgtgtacacccccagaagcgcccccaccagatgcccccagatgagcgccgtgtacaccccccccagcgcccccaccgaccagatgcccagaaaccccaacgcccagcagagaccccagatgagcgccgtgtacaccccccccagcgcccccaccgaccagatgcccagaaaccccaacccccagcagagaccccagatgagcgccgtgtacaccccccccagcgcccccaccgaccagatgcccagaaaccccaacccccagcagagaccccagatgagcgccgtgtacaccccccccagcgcccccaccgaccagatgcccagaaaccccaacccccagcagagaccccagatgagcgccgtgtacgccccccccagcgcccccaccgaccagatgcccagaaaccccaacccccagcagagaccccagatgagcgccgtgtacgccccccccagcgcccccaccgaccagatgcccagaaaccccaacccccagcagagactgcagatgagcgccgtgtacgccccccccagcgcccccaccgaccagatgcccagaaaccccaacccccagcagagaccccagatcagcgcccccagatgccagctgagcatcagacacagatag

SEQ ID NO: 23677 - DNA, 240 bp, Artificial Sequence
  Description of Artificial Sequence: Synthetic coding sequence
atgaagctggccaagaccgccgtgctggaccccgccacctacaccagcttcagccccggcctgagcacctgcagcagcagccagccccccggcgacagaagaaagggcctgctgggctgcgtgggcagcggccactgccccctgcccacccccgcccagttccccaaggtgcagagaccccccaccctgctgggcggcaagaacaccagcacccagaccaccctgcaccccgtgatctag

SEQ ID NO: 23678 - DNA, 369 bp, Artificial Sequence
  Description of Artificial Sequence: Synthetic coding sequence
gaccccggcagcctgagatgccccgtgtgcctgagcatggagggctgcctggagggcaccaccgaggagatctgccccaagggcaccacccactgctacgacggcctgctgagactgagaggcggcggcatcttcagcaacctgagagtgcagggctgcatgccccagcccgtgtgcaacctgctgaacggcacccaggagatcggccccgtgggcatgaccgagaactgcgacatgaaggacttcctgcagctgaagcccgtgggcctgctggaggagcacaacgtgggcgagaaggagagaggccagggccagcaccagtgcgtgcagctggactggcagaagagagccgccaccggcgtgagctag

SEQ ID NO: 23679 - DNA, 456 bp, Artificial Sequence
  Description of Artificial Sequence: Synthetic coding sequence
atgcacgccggcaagagaagccccctgacccagagcatcagctgcgtgtgcctgcccgagctgggcgccctgtgggagatcgagagcgccagagtgaacctgagagtgagcggcagagaggccagcagagagatggagagcagccccagaccccacagaatcgccggcgtgaagagattcctgaagcacgccggcaagtggagcctgagatggttcctgagccccagatggatcctgcagttcagaagatgggccagaaagtggagcagattcaccagaagcagcttccaggtgagatgggccgccgtgcccgccggcaagtgcagccagcaccagggcctgagcgccgtggccaccgccagccccggcgtgttctgggagatggagttcgacgtgagcagccccctgaccgagggcgccggcagccccatgagcagcaagcacgccggcgagtag

SEQ ID NO: 23680 - DNA, 366 bp, Artificial Sequence
  Description of Artificial Sequence: Synthetic coding sequence
atgatcgacagccccagaaaggagggcgccctgagcccccccctgggcggctggagactgggcgacagaagatgcgccggcggcaagagaaccgagagaagaacccccgagaagctgtggggcatcagaggcgagaaggagggcgtgaagagagagggcagactgagcagaggcggcggcgccggcgccggcgccggcgccggcggcgtgaccgcccccagaccccccctgcccgccctgcacagcgccgcccccggcctgccccccccccccccccccccccccccccccccccccctgccccccccccccggcgtggccggctgcggccagaacagaagccccaacagagccgccggcgagtag

SEQ ID NO: 23681 - DNA, 726 bp, Artificial Sequence
  Description of Artificial Sequence: Synthetic coding sequence
atggcccccgccaccgacaccgcctggctgcccccccaccccgagatccagctgagactgctgtgccccggcgagacctacggcaagctgatgggcggcagccccagcgccggccccaccacccagagccagccccacgccctgagacccggcctgagaggcagaggcggctggtggccccagcccttctggatccacagcccccccctgacccacagcgtgggcaccttcatctgcctggacggcctggtgtgcgccctgaccgcccccggcctgggcgtgggcctgacccccgccccctggagaccccccggccagagcagaatgctggagggccacggcccctggcccacccccggcagcagacccggccccacctgcgtgtgcctgctgacccccgccagcagcagcctgagaccctgcctgagcgacagaggcacctgccccggcgccccccagggcgccgtgggcacctgcagagccagcccccagagcccctgccacagacaccccagcctgagaagcggcctggagtggacccagccccccgaccaggaccagggcctgctgacccccggcagcccccccctggtgagcggcgtgacccagaccccctggaccagccccttctgcccccccagacccaccccctgggtgggcgccgccttcaccgccgccaacccctgcccccccgcccccaccgccagcagcgtgaccggcctgtag

SEQ ID NO: 23682 - DNA, 714 bp, Artificial Sequence
  Description of Artificial Sequence: Synthetic coding sequence
atgcccgtgcaccccgcctggctgggcagcgcctgcctgccccacgccagccacggccccgccccccagagcagcgtgggcggcctgctggtgagcgtgaagagcccccccggcgacgtgcacgccgccagagcctgcgcccccggcagacacagcggcgagggccccccccagggcaacctgagccccagctgccccgccgaggccggccacggctgcgccagcaccggcagacaggtgggcgtgagcggcgccggcagcagccccagcggccccgccccctgcgtgaagtgcagcgcctgggtgggcacctgcttccccctgagcctgctgcaggccgccggcggccccgccggcagccccaacggcttctgccccgagccctgggcccccgaccacgcccccaccctgcacggcctgaacaagagcctgtgccagggccccagaagcggcggcgcccagagaaagcccagagcccacaccggcgagggcgtgagcggcctgggcctgacccagcccagactgagcagcagcctgagaatcagctggcacctgctggcctgcgtggccacccaggtgggctgcgcctgcagactgagagagaagaccctgggcgaggactacgtgagcgccttcctgcccagcaccggccccagctgggcccactgcgaccagaccatgtgcaagagcaccagagagagcggcagaagctag

SEQ ID NO: 23683 - DNA, 966 bp, Artificial Sequence
  Description of Artificial Sequence: Synthetic coding sequence
atggtgagccagagcaccgtgagacaggacagccccgtggagccctgggagggcatcagcgaccacagcggcatcatcgacggcagccccagactgctgaacaccgaccaccccccctgccagctggacatcagactgatgagacacaaggccgtgtggatcaacccccaggacgtgcagcagcagccccaggacctgcagagccaggtgcccgccgccggcaacagcggcacccacttcgtgaccgacgccgccagccccagcggccccagccccagctgcctgggcgacagcctggccgagaccaccctgagcgaggacaccaccgacagcgtgggcagcgccagcccccacggcagcagcgagaagagcagcagcttcagcctgagcagcaccgaggtgcacatggtgagacccggctacagccacagagtgagcctgcccaccagccccggcatcctggccaccagcccctaccccgagaccgacagcgccttcttcgagcccagccacctgaccagcgccgccgacgagggcgccgtgcaggtgagcagaagaaccatcagcagcaacagcttcagccccgaggtgttcgtgctgcccgtggacgtggagaaggagaacgcccacttctacgtggccgacatgatcatcagcgccatggagaagatgaagtgcaacatcctgagccagcagcagaccgagagctggagcaaggaggtgagcggcctgctgggcagcgaccagcccgacagcgagatgaccttcgacaccaacatcaagcaggagagcggcagcagcaccagcagctacagcggctacgagggctgcgccgtgctgcaggtgagccccgtgaccgagaccagaacctaccacgacgtgaaggagatctgcaagtgcgacgtggacgagttcgtgatcctggtgagcctgatgagccagaccagcatcctgcagaactactag

SEQ ID NO: 23684 - DNA, 1788 bp, Artificial Sequence
  Description of Artificial Sequence: Synthetic coding sequence
atggtgagcaaccactacttcctgctgtgcgtgaacctgcccctgagagagatccacacccccggccccagccccagctgcctgggcgacagcctggccgagaccaccctgagcgaggacaccaccgacagcgtgggcagcgccagcccccacggcagcagcgagaagagcagcagcttcagcctgagcagcaccgaggtgcacatggtgagacccggctacagccacagagtgagcctgcccaccagccccggcatcctggccaccagcccctaccccgagaccgacagcgccttcttcgagcccagccacctgaccagcgccgccgacgagggcgccgtgcaggtgagcagaagaaccatcagcagcaacagcttcagccccgaggtgttcgtgctgcccgtggacgtggagaaggagaacgcccacttctacgtggccgacatgatcatcagcgccatggagaagatgaagtgcaacatcctgagccagcagcagaccgagagctggagcaaggaggtgagcggcctgctgggcagcgaccagcccgacagcgagatgaccttcgacaccaacatcaagcaggagagcggcagcagcaccagcagctacagcggctacgagggctgcgccgtgctgcaggtgagccccgtgaccgagaccagaacctaccacgacgtgaaggagatctgcaagtgcgacgtggacgagttcgtgatcctggagctgggcgacttcaacgacatcaccgagacctgcagctgcagctgcagcagcagcaagagcgtgacctacgagcccgacttcaacagcgccgagctgctggccaaggagctgtacagagtgttccagaagtgctggatcctgagcgtggtgaacagccagctggccggcagcctgagcgccgccggcagcatcgtggtgaacgaggagtgcgtgagaaaggacttcgagagcagcatgaacgtggtgcaggagatcaagttcaagagcagaatcagaggcaccgaggactgggccccccccagattccagatcatcttcaacatccacccccccctgaagagagacctggtggtggccgcccagaacttcttctgcgccggctgcggcacccccgtggagcccaagttcgtgaagagactgagatactgcgagtacctgggcaagtacttctgcgactgctgccacagctacgccgagagctgcatccccgccagaatcctgatgatgtgggacttcaagaagtactacgtgagcaacttcagcaagcagctgctggacagcatctggcaccagcccatcttcaacctgctgagcatcggccagagcctgtacgccaaggccaaggagctggacagagtgaaggagatccaggagcagctgttccacatcaagaagctgctgaagacctgcagattcgccaacagcgccctgaaggagttcgagcaggtgcccggccacctgaccgacgagctgcacctgttcagcctggaggacctggtgagaatcaagaagggcctgctggcccccctgctgaaggacatcctgaaggccagcctggcccacgtggccggctgcgagctgtgccagggcaagggcttcatctgcgagttctgccagaacaccaccgtgatcttccccttccagaccgccacctgcagaagatgcagcgcctgcagagcctgcttccacaagcagtgcttccagagcagcgagtgccccagatgcgccagaatcaccgccagaagaaagctgctggagagcgtggccagcgccgccacctag

SEQ ID NO: 23685 - DNA, 1908 bp, Artificial Sequence
  Description of Artificial Sequence: Synthetic coding sequence
atggtgagccagagcaccgtgagacaggacagccccgtggagccctgggagggcatcagcgaccacagcggcatcatcgacggcagccccagactgctgaacaccgaccaccccccctgccagctggacatcagactgatgagacacaaggccgtgtggatcaacccccaggacgtgcagcagcagccccaggacctgcagagccaggtgcccgccgccggcaacagcggcacccacttcgtgaccgacgccgccagccccagcggccccagccccagctgcctgggcgacagcctggccgagaccaccctgagcgaggacaccaccgacagcgtgggcagcgccagcccccacggcagcagcgagaagagcagcagcttcagcctgagcagcaccgaggtgcacatggtgagacccggctacagccacagagtgagcctgcccaccagccccggcatcctggccaccagcccctaccccgagaccgacagcgccttcttcgagcccagccacctgaccagcgccgccgacgagggcgccgtgcaggtgagcagaagaaccatcagcagcaacagcttcagccccgaggtgttcgtgctgcccgtggacgtggagaaggagaacgcccacttctacgtggccgacatgatcatcagcgccatggagaagatgaagtgcaacatcctgagccagcagcagaccgagagctggagcaaggaggtgagcggcctgctgggcagcgaccagcccgacagcgagatgaccttcgacaccaacatcaagcaggagagcggcagcagcaccagcagctacagcggctacgagggctgcgccgtgctgcaggtgagccccgtgaccgagaccagaacctaccacgacgtgaaggagatctgcaagtgcgacgtggacgagttcgtgatcctggagctgggcgacttcaacgacatcaccgagacctgcagctgcagctgcagcagcagcaagagcgtgacctacgagcccgacttcaacagcgccgagctgctggccaaggagctgtacagagtgttccagaagtgctggatcctgagcgtggtgaacagccagctggccggcagcctgagcgccgccggcagcatcgtggtgaacgaggagtgcgtgagaaaggacttcgagagcagcatgaacgtggtgcaggagatcaagttcaagagcagaatcagaggcaccgaggactgggccccccccagattccagatcatcttcaacatccacccccccctgaagagagacctggtggtggccgcccagaacttcttctgcgccggctgcggcacccccgtggagcccaagttcgtgaagagactgagatactgcgagtacctgggcaagtacttctgcgactgctgccacagctacgccgagagctgcatccccgccagaatcctgatgatgtgggacttcaagaagtactacgtgagcaacttcagcaagcagctgctggacagcatctggcaccagcccatcttcaacctgctgagcatcggccagagcctgtacgccaaggccaaggagctggacagagtgaaggagatccaggagcagctgttccacatcaagaagctgctgaagacctgcagattcgccaacagctgcgtgaaggagagagccctgttcgtgaacttcgccagaatcagactgagcagcagccacttcagacagcagcacgtggaggacgtgcagagagccggcctggccttcaccaacagcgccagcagcccccccagcgcccccggcgtgagaggcagccagagaggcgagaacttctggaaggtgtggcccctgcagcagcacgacgcccccgagtactgcgagaaggactgcagcacctgcctgatgatcacccccatctgcgtgtactactggtag

SEQ ID NO: 23686 - DNA, 1908 bp, Artificial Sequence; identical to SEQ ID NO: 23685
  Description of Artificial Sequence: Synthetic coding sequence

SEQ ID NO: 23687 - DNA, 396 bp, Artificial Sequence
  Description of Artificial Sequence: Synthetic coding sequence
atggacagcacccacccccagcactgcgcctgcaacagccagatcagacccagatgggactgcgtggcccactgcttcctgtgggcccccggcctgcccagcagagacgaccccggcgccgacaagggcgaggccagcggcggcgtgggcaccgtgagcctgaccctgagccagcccagagagagaagcctgcaggtgaagaaggtgttcgtgaagggcatgaagaaggagagagccctgggcgagggcgccgcctggtggcagagccagagactggtgagccccggcaagcacgacagagtgagcacccacagaaagagccagagcgtgttcaccggcgtgagcgccggcgacaagcagttcaccaccaccttcagcatcgtgttcaccatctag

SEQ ID NO: 23688 - DNA, 1023 bp, Artificial Sequence; identical to SEQ ID NO: 23638
  Description of Artificial Sequence: Synthetic coding sequence

SEQ ID NO: 23689 - DNA, 423 bp, Artificial Sequence
  Description of Artificial Sequence: Synthetic coding sequence
atgtggcccttcagactgagatgccccatctacttcaagaccagactgctgtacagcagcagccaggacggcttcctgagcagcagcaccaactactacaaccacagaacctaccccggcctggtgaactggctgttcgtgctgaccgagcccgagctgaccggcgagctgggcgacgacgacagaaagggcatgcacaccggcggcatcatcagatggctgggcagacccagcagccagctgaagcccatcttccacgccgaggagagaagagtgccccccccccccgagagactggtgggcagagccagccccagagagcaggccaccgtgttcaagagaatctgcgcccccctgcacgccgaggtgttctgcagagccggcctgtgcgcctgccaccccgactgcaccgccgccggctag

SEQ ID NO: 23690 - DNA, 408 bp, Artificial Sequence
  Description of Artificial Sequence: Synthetic coding sequence
atggtggccacctggggcggcagacagctgctgccccagtgcagcggcccccccctgacccccggcagccccgcccccagcgtggcccaggccagcagacccgccccccccagccccagaaagaccagccccggccccccccagcccagcgccagccccagcctgcccttcagccccctgctggccggctgcagcagactgctgcccgtgctggcccccagcctgagcagcgtgcacagatgccccctgggcgccagagccagcagactgccctggaagctggaggccggcaccagcagcagcggcgacagacccctgtgcctgcacagcggccagagaggcgcctgcctgaccgacgagcagggcagcaccctgagccccagacagagaagaggccccggcaagtag

SEQ ID NO: 23691 - DNA, 474 bp, Artificial Sequence
  Description of Artificial Sequence: Synthetic coding sequence
atgctgagcgtgagcagaccctgcttcagccagggcgccttcctgggcagaaccctgggcagcgtgtgggcccagggcggcagcagactgcccctgtgcttctggtacagaatcagatgcggcagacccgccgtggtgcacatcggcggcgagggcgccagatgggagaagggcgccagaggcagaaaggagcacagactgagaagaagcgacctgggcagcagacccgtgcccttcctggcccagggcatccccgacatcgtgatcagactgctgtgcctgagcgccggcagcgccagcagccaccaggccagcgaccccctgagcagcgccgccgccaccctggccgccgagctggactgggccctggtgagccagaagagcagcgaggacctggccccccccagcctgctgctgaactgcatcagcttcctgatcacccagtgcccccaccccagatggctgcccggctag

SEQ ID NO: 23692 - DNA, 627 bp, Artificial Sequence
  Description of Artificial Sequence: Synthetic coding sequence
atgagccccaccaaggacagccaccccagcccccacttccccagagacagcggcatccacgcccccaccccccccgacagcggcgccctgaccctgagcccccccgtgagccagggccccggcgtgggccccagaaccggcagaggcaacagactgtgcagaccccccggcagaagcgccgccagaagcttctgcctgctgcccggcccccccctgggcaccggcgccctgggcagccccagagccgcccagggcctgggcttcagaggcagcggccagagagccagacacaacagcttcaccagccccagcccccccggcgcccaccaccccctgggcacccacaccagagccctgcccccccccctggccagatgcccctgcgccgccctgctggccggcagagagtgccacggcggccccagccccgccgcccccagacccctgcccggcaccagcctgacctggcccagcagagcccccctgcccagacccccccccagagagagacagggccccggcgacagaagccccagccccagcgcccccagctgccccggcgtgggcgccagcagccccagaagaagaaagcccagagaggccgccggcctgacccccgacggctag

SEQ ID NO: 23693 - DNA, 1248 bp, Artificial Sequence
  Description of Artificial Sequence: Synthetic coding sequence
tacgacgccgtgcccatccagagcagcgtggtgctgtgcagctgccccagccccagcatggtgagaacccagaccgagagcagcaccccccccggcatccccggcggcagcagacagggccccgccatggacggcaccgccgccgagcccagacccggcgccggcagcctgcagcacgcccagccccccccccagcccagaaagaagagacccgaggacttcaagttcggcaagatcctgggcgagggcagcttcagcaccgtggtgctggccagagagctggccaccagcagagagtacgccatcaagatcctggagaagagacacatcatcaaggagaacaaggtgccctacgtgaccagagagagagacgtgatgagcagactggaccaccccttcttcgtgaagctgtacttcaccttccaggacgacgagaagctgtacttcggcctgagctacgccaagaacggcgagctgctgaagtacatcagaaagatcggcagcttcgacgagacctgcaccagattctacaccgccgagatcgtgagcgccctggagtacctgcacggcaagggcatcatccacagagacctgaagcccgagaacatcctgctgaacgaggacatgcacatccagatcaccgacttcggcaccgccaaggtgctgagccccgagagcaagcaggccagagccaacagcttcgtgggcaccgcccagtacgtgagccccgagctgctgaccgagaagagcgcctgcaagagcagcgacctgtgggccctgggctgcatcatctaccagctggtggccggcctgccccccttcagagccggcaacgagtacctgatcttccagaagatcatcaagctggagtacgacttccccgagaagttcttccccaaggccagagacctggtggagaagctgctggtgctggacgccaccaagagactgggctgcgaggagatggagggctacggccccctgaaggcccaccccttcttcgagagcgtgacctgggagaacctgcaccagcagaccccccccaagctgaccgcctacctgcccgccatgagcgaggacgacgaggactgctacggcaacgtgagctggcccggctggagagccagacaggtggccctgggccccccctgcaccggcctgcacgccagagcccccgaccccagagtgatctgcagcagaaagggcagagtgagcgtgcccctgagacaggcctgctggtggctgtag

SEQ ID NO: 23694 - DNA, 1734 bp, Artificial Sequence
  Description of Artificial Sequence: Synthetic coding sequence
atggccgacgtggccggccccagcagacccagcgccgccgccttctggagcagagacttcagcgacgaggagcagagcgtggtgtacgtgcccggcatcagcgccgagggcaacgtgagaagcagacacaagctgatgagccccaaggccgacgtgaagctgaagaccagcagagtgaccgacgccagcatcagcatggagagcctgaagggcaccggcgacagcgtggacgagcagaacagctgcagaggcgagatcaagagcgccagcctgaaggacctgtgcctggaggacaagagaagaatcgccaacctgatcaaggagctggccagagtgagcgaggagaaggaggtgaccgaggagagactgaaggccgagcaggagagcttcgagaagaagatcagacagctggaggagcagaacgagctgatcatcaaggagagagaggccatcaagctgcagtacagagagtgccaggagctgctgagcctgtaccagaagtacctgagcgagcagcaggagaagctgaccatgagcctgagcgagctgggcgccgccagaatgcaggagcagcaggtgagcagcagaaagagcaccctgcagtgcagcagcgtggagctggacggcagctacctgagcatcgccagaccccagacctactaccagaccaagcagagacccaagagcgccgtgcaggacagcgccagcgagagcctgatcgccttcagaaacaacagcctgaagcccgtgaccctgcaccaccccaaggacgacctggacaagatccccagcgagaccaccacctgcaactgcgagagccccggcagaaagcccgccgtgcccaccgagaagatgccccaggaggagctgcacatgaaggagtgcccccacctgaagcccacccccagccagtgctgcggccacagactggccgccgacagagtgcacgacagccaccccaccaacatgaccccccagcaccccaagacccaccccgagagctgcagctactgcagactgagctgggccagcctggtgcacggcggcggcgccctgcagcccatcgagaccctgaagaagcagatcagcgaggacagaaagcagcagctgatgctgcagaagatggagctggagatcgagaaggagagactgcagcacctgctggcccagcaggagaccaagctgctgctgaagcagcagcagctgcaccagagcagactggactacaactgcctgctgaagagcaactgcgacggctggctgctgggcaccagcagcagcatcaagaagcaccaggacccccccaacagcggcgagaacagaaaggagagaaagaccgtgggcttccacagccacatgaaggacgacgcccagtggagctgccagaagaaggacacctgcagaccccagagaggcaccgtgaccggcgtgagaaaggacgccagcaccagccccatgcccaccggcagcctgaaggacttcgtgaccaccgccagccccagcctgcagcacaccaccagcagatacgagaccagcctgctggacctggtgcagagcctgagccccaacagcgcccccaagccccagagataccccagcagagaggccggcgcctggaaccacggcaccttcagactgagccccctgaagagcaccagaaagaagatgggcatgcacagaacccccgaggagctggaggagaaccagatcctggaggacatcttcttcatctag

SEQ ID NO: 23695 - DNA, 600 bp, Artificial Sequence
  Description of Artificial Sequence: Synthetic coding sequence
atgctgcccgtgcagagaagaaagctggaccccctgctgaagaagtacagacaccacaagaaggccaccagaaccaagagaagaagaaaggagaagatggaggcccagtgcagccccgtgccccccacccccagcacccccccccagagcgaggaggacgaggccgtggacaagaagcccaccctgctgagcgcccaggaggacacccccgacctgctgcacgaggacagactgcagtacctgcaggaggagggcagcggcgtgatgcaccaggagtgccagatccagagctgcgagctgagcgtggcccagaagcccagacccagcagccccgccgtgaccagcctggccagcccccccctgtgcttcggcagcttcctgagctgcgtgtgccagaccttcagcagaagcagaaagcagaagccccccagaagaaagggcaacaaccaggccgaggccggcggcgacgccgaggtgctgagacccggccccgccaagcccgagctgagcctgagcaagacctgcagccacctgaagagcatcgagctgagcttcgtgttcagcttcatcgtgctgagcgtgtgccactgcagcagctag

SEQ ID NO: 23696 - DNA, 6618 bp, Artificial Sequence
  Description of Artificial Sequence: Synthetic coding sequence
atgcccctgttcttcagcgccctgctggtgctgctgctggtggccctgagcgccctgttcctgggcagatggctggtggtgagactggccaccaagtggtgccagagaaagctgcaggccgagctgaagatcggcagcttcagattcttctggatccagaacgtgagcctgaagttccagcagcaccagcagaccgtggagatcgacaacctgtggatcagcagcaagctgctgagccacgacctgccccactacgtggccctgtgcttcggcgaggtgagaatcagaaccgacctgcagaaggtgagcgacctgagcgcccccttcagccagagcgccggcgtggaccagaaggagctgagcttcagccccagcctgctgaagatcttctgccagctgttcagcatccacgtggacgccatcaacatcatggtgctgaaggtggacaccagcgagagcctgtggcacatccagatcagcagaagcagattcctgctggacagcgacggcaagagactgatctgcgaggtgagcctgtgcaagatcaacagcaaggtgctgaagagcggccagctggaggacacctgcctggtggagctgagcctggccctggacctgtgcctgaaggtgggcatcagcagcagacacctgaccgccatcaccgtggacgtgtggaccctgcacgccgagctgcacgagggcctgttccagagccagctgctgtgccagggccccagcctggccagcaagcccgtgccctgcagcgaggtgaccgagaacctggtggagcccaccctgcccggcctgttcctgctgcagcagctgcccgaccaggtgaaggtgaagatggagaacaccagcgtggtgctgagcatgaacagccagaagagacacctgacctggaccctgaagctgctgcagttcctgtaccacagagacgaggaccagctgcccctgagaagcttcaccgccaacagcgacatggcccagatgagcaccgagctgctgctggaggacggcctgctgctgagccagagcagacagagaatcgtgtgcctgaacagcctgaaggccagcgtgcaggtgaccaccatcgacctgagcgccagcctggtgctgaacacctgcatcatccactacagacaccaggagttcagccactggctgcacctgctggccctggagacccagggcagcagcagccccgtgctgaagcagagaaagaagagaaccttcccccagatcctggcccccatcatcttcagcaccagcatcagcaacgtgaacatcagcatccagctgggcgacaccccccccttcgccctgggcttcaacagcatcagcctggactaccagcacctgagaccccagagcatccaccagagaggcgtgctgaccgtggaccacctgtgctggagagtgggcagcgacagccacatccagagagccccccacccccccaacatgcacgtgtggggcgaggccctggtgctggacagcttcaccctgcagggcagctacaaccagcccctgggcctgagcagcacccagagcgacaccctgttcctggactgcaccatcagaggcctgcaggtggaggccagcgacacctgcgcccagtgcctgagcagaatcctgagcctgatgggcccccagagcggcaagagcgccgtgagcagacacagcagcttcggcgagagcgtgagcctgctgtggaaggtggacctgaaggtggaggacatgaacctgttcaccctgagcgccctggtgggcgccagcgaggtgagactggacaccctgaccatcctgggcagcgccgagaccagcaccgtgggcatccagggcctggtgctggccctggtgaagagcgtgaccgagaagatgcagccctgctgcaaggcccccgacatccccacccccgtgctgagcctgagcatgctgagcatcacctaccacagcagcatcagaagcctggaggtgcagtgcggcgccggcctgaccctgctgtggagcccccccgaccacatgtacctgtaccagcacgtgctggccaccctgcagtgcagagacctgctgagagccaccgtgttccccgagaccgtgcccagcctggccctggagaccagcggcaccaccagcgagctggagggcagagcccccgagcccctgccccccaagagactgctgaacctgaccctggaggtgagcaccgccaagctgaccgccttcgtggccgaggacaagttcatcaccctggccgccgagagcgtgagcctgagcagacacggcggcagcctgcaggcctactgccccgagctggccgccggcttcgacggcaacagcatcttcaacttcaaggaggtggaggtgcagctgctgcccgaggtggagttcccctaccagtacgacttcagcagaaccctggacgaggccgtgggcgtgcagaagtggctgaagggcctgcaccagggcaccagagcctgggccagccccagccccgtgcccctgccccccgacctgctgctgaaggtggagcacttcagctgggtgttcctggacgacgtgttcgaggtgaagctgcacgacaactacgagctgatgaaggacgagagcaaggagagcgccaagagactgcagctgctggacgccaaggtggccgccctgagaaagcagcacggcgagctgctgcccgccagaaagatcgaggagctgtacgccagcctggagagaaagaacatcgagatctacatccagagaagcagaagactgtacggcaacacccccatgagaagagccctgctgacctggagcctggccggcctggagctggtggccctggccgacgccagcttccacggccccgagcacgtggtggagcaggtgcaggagctggaccccggcagccccttcccccccgagggcctggacctggtgatccagtggtgcagaatgctgaagtgcaacgtgaagagcttcctggtgagaatcagagactaccccagatacctgttcgagatcagagactggagactgatgggcagactggtgggcaccgagcagagcggccagccctgcagcagaagaagacagatcctgcacctgggcctgccctggggcaacgtggccgtggagagaaacatgccccccctgaagttctaccacgacttccacagcgagatcttccagtacaccgtggtgtggggcccctgctgggaccccgcctggaccctgatcggccagtgcgtggacctgctgaccaagcccagcgccgaccccagcccccccctgccctggtgggacaagagcagactgctgttccacggcgactggcacatggacatcgagcaggccaacctgcaccagctggccaccgaggacccctacaacaccaccgagaacatgcactgggagtggagccacctgagcttccactggaagcccggccagttcgtgttcaagggcgacctggacatcaacgtgagaaccgccagcaagtacgacgactgctgcttcctgcacctgcccgacctgtgcatgaccctggacctgcagtggctgtgccacggcaacccccacgaccaccacagcgtgaccctgagagcccccgagttcctgcccgaggtgcccctgggccagctgcacgacagctacagagccttcagaagcgagaacctgaacctgagcatcaagatggacctgaccagacacagcggcaccatcagccagcccagaatcctgctgtacagcagcaccctgagatggatgcagaacttctgggccacctggaccagcgtgaccagacccatctgcagaggcaagctgttcaacaacctgaagcccagcaagaagaagctgggccagcactacaagcagctgagctacaccgccctgttcccccagctgcaggtgcactactgggccagcttcgcccagcagagaggcatccagatcgagtgcagccagggccacgtgttcaccagaggcacccagagactgatcccccaggccggcaccgtgatgagaagactgatcagcgactggagcgtgacccagatggtgagcgacctgagccaggtgaccgtgcacctgatggccagccccaccgaggagaacgccgaccactgcctggaccccctggtgaccaagacccacctgctgagcctgagcagcctgacctaccagagacacagcaacagaaccgccgaggaggagctgagcgccagagacggcgaccccaccttccacacccaccagctgcacctggtggacctgagaatcagctggaccaccaccaacagagacatcgccttcggcctgtacgacggctacaagaaggccgccgtgctgaagagaaacctgagcaccgaggccctgaagggcctgaagatcgacccccagatgcccgccaagaagcccaagagaggcgtgcccaccagcgccagcgccccccccagagtgaacacccccagcttcagcggccagcccgacaagggcagcagcggcggcgcctacatgctgcagaagctgatcgaggagaccgacagattcgtggtgttcaccgaggaggagagcggcatgagcgaccagctgtgcggcatcgccgcctgccagaccgacgacatctacaacagaaactgcctgatcgagctggtgaactgccagatggtgctgagaggcgccgagaccgagggctgcgtgatcgtgagcgccgccaaggcccagctgctgcagtgccagcaccaccccgcctggtacggcgacaccctgaagcagaagaccagctggacctgcctgctggacggcatgcagtacttcgccaccaccgagagcagccccaccgagcaggacggcagacagctgtggctggaggtgaagaacatcgaggagcacagacagagaagcctggacagcgtgcaggagctgatggagagcggccaggccgtgggcggcatggtgaccaccaccaccgactggaaccagcccgccgaggcccagcaggcccagcaggtgcagagaatcatcagcagatgcaactgcagaatgtactacatcagctacagccacgacatcgaccccgagctggccacccagatcaagccccccgaggtgctggagaaccaggagaaggaggacctgctgaagaagcaggagggcgccgtggacaccttcaccctgatccaccacgagctggagatcagcaccaaccccgcccagtacgccatgatcctggacatcgtgaacaacctgctgctgcacgtggagcccaagagaaaggagcacagcgagaagaagcagagagtgagattccagctggagatcagcagcaaccccgaggagcagagaagcagcatcctgcacctgcaggaggccgtgagacagcacgtggcccagatcagacagctggagaagcagatgtacagcatcatgaagagcctgcaggacgacagcaagaacgagaacctgctggacctgaaccagaagctgcagctgcagctgaaccaggagaaggccaacctgcagctggagagcgaggagctgaacatcctgatcagatgcttcaaggacttccagctgcagagagccaacaagatggagctgagaaagcagcaggaggacgtgagcgtggtgagaagaaccgagttctacttcgcccaggccagatggagactgaccgaggaggacggccagctgggcatcgccgagctggagctgcagagattcctgtacagcaaggtgaacaagagcgacgacaccgccgagcacctgctggagctgggctggttcaccatgaacaacctgctgcccaacgccgtgtacaaggtggtgctgagaccccagagcagctgccagagcggcagacagctggccctgagactgttcagcaaggtgagaccccccgtgggcggcatcagcgtgaaggagcacttcgaggtgaacgtggtgcccctgaccatccagctgacccaccagttcttccacagaatgatgggcttcttcttccccggcagaagcgtggaggacgacgaggtgggcgacgaggaggacaagagcaagctggtgaccaccggcatccccgtggtgaagcccagacagctgatcgccaccgacgacgccgtgcccctgggccccggcaagggcgtggcccagggcctgaccagaagcagcggcgtgagaagaagcttcagaaagagccccgagcaccccgtggacgacatcgacaagatgaaggagagagccgccatgaacaacagcttcatctacatcaagatcccccaggtgcccctgtgcgtgagctacaagggcgagaagaacagcgtggactggggcgacctgaacctggtgctgccctgcctggagtaccacaacaacacctggacctggctggacttcgccatggccgtgaagagagacagcagaaaggccctggtggcccaggtgatcaaggagaagctgagactgaagagcgccaccggcagcgaggtgagaggcaagctggagaccaagagcgacctgaacatgcagcagcaggaggaggaggagaaggccagactgctgatcggcctgagcgtgggcgacaagaaccccggcaagaagagcatcttcggcagaagaaagtag

SEQ ID NO: 23697 - DNA, 2130 bp, Artificial Sequence
  Description of Artificial Sequence: Synthetic coding sequence
atggaccagaagctgagcaagctggtggaggagctgaccaccagcggcgagcccagactgaaccccgagaagatgaaggagctgaagaagatctgcaagagcagcgaggagcagctgagcagagcctacagactgctgatcgcccagctgacccaggagcacgccgagatcagactgagcgccttccagatcgtggaggagctgttcgtgagaagccaccagttcagaatgctggtggtgagcaacttccaggagttcctggagctgaccctgggcaccgaccccgcccagcccctgcccccccccagagaggccgcccagagactgagacaggccaccaccagagccgtggagggctggaacgagaagttcggcgaggcctacaagaagctggccctgggctaccacttcctgagacacaacaagaaggtggacttccaggacaccaacgccagaagcctggccgagagaaagagagaggaggagaagcagaagcacctggacaagatctaccaggagagagccagccaggccgagagagagatgcaggagatgagcggcgagatcgagagctgcctgaccgaggtggagagctgcttcagactgctggtgcccttcgacttcgaccccaaccccgagaccgagagcctgggcatggccagcggcatgagcgacgccctgagaagcagctgcgccggccaggtgggcccctgcagaagcggcacccccgaccccagagacggcgagcagccctgctgcagcagagacctgcccgccagcgccggccaccccagagccggcggcggcgcccagcccagccagaccgccaccggcgaccccagcgacgaggacgaggacagcgacctggaggagttcgtgagaagccacggcctgggcagccacaagtacaccctggacgtggagctgtgcagcgagggcctgaaggtgcaggagaacgaggacaacctggccctgatccacgccgccagagacaccctgaagctgatcagaaacaagttcctgcccgccgtgtgcagctggatccagagattcaccagagtgggcacccacggcggctgcctgaagagagccatcgacctgaaggccgagctggagctggtgctgagaaagtacaaggagctggacatcgagcccgagggcggcgagagaagaagaaccgaggccctgggcgacgccgaggaggacgaggacgacgaggacttcgtggaggtgcccgagaaggagggctacgagccccacatccccgaccacctgagacccgagtacggcctggaggccgcccccgagaaggacaccgtggtgagatgcctgagaaccagaaccagaatggacgaggaggtgagcgaccccaccagcgccgccgcccagctgagacagctgagagaccacctgcccccccccagcagcgccagccccagcagagccctgcccgagccccaggaggcccagaagctggccgccgagagagccagagcccccgtggtgccctacggcgtggacctgcactactggggccaggagctgcccaccgccggcaagatcgtgaagagcgacagccagcacagattctggaagcccagcgaggtggaggaggaggtggtgaacgccgacatcagcgagatgctgagaagcagacacatcaccttcgccggcaagttcgagcccgtgcagcactggtgcagagcccccagacccgacggcagactgtgcgagagacaggacagactgaagtgccccttccacggcaagatcgtgcccagagacgacgagggcagacccctggaccccgaggacagagccagagagcagagaagacagctgcagaagcaggagagacccgagtggcaggaccccgagctgatgagagacgtggaggccgccaccggccaggacctgggcagcagcagatacagcggcaagggcagaggcaagaagagaagataccccagcctgaccaacctgaaggcccaggccgacaccgccagagccagaatcggcagaaaggtgttcgccaaggccgccgtgagaagagtggtggccgccatgaacagaatggaccagaagaagcacgagaagttcagcaaccagttcaactacgccctgaactag

SEQ ID NO: 23698 - DNA, 1989 bp, Artificial Sequence
  Description of Artificial Sequence: Synthetic coding sequence
atggtgagccagagcaccgtgagacaggacagccccgtggagccctgggagggcatcagcgaccacagcggcatcatcgacggcagccccagactgctgaacaccgaccaccccccctgccagctggacatcagactgatgagacacaaggccgtgtggatcaacccccaggacgtgcagcagcagccccaggacctgcagagccaggtgcccgccgccggcaacagcggcacccacttcgtgaccgacgccgccagccccagcggccccagccccagctgcctgggcgacagcctggccgagaccaccctgagcgaggacaccaccgacagcgtgggcagcgccagcccccacggcagcagcgagaagagcagcagcttcagcctgagcagcaccgaggtgcacatggtgagacccggctacagccacagagtgagcctgcccaccagccccggcatcctggccaccagcccctaccccgagaccgacagcgccttcttcgagcccagccacctgaccagcgccgccgacgagggcgccgtgcaggtgagcagaagaaccatcagcagcaacagcttcagccccgaggtgttcgtgctgcccgtggacgtggagaaggagaacgcccacttctacgtggccgacatgatcatcagcgccatggagaagatgaagtgcaacatcctgagccagcagcagaccgagagctggagcaaggaggtgagcggcctgctgggcagcgaccagcccgacagcgagatgaccttcgacaccaacatcaagcaggagagcggcagcagcaccagcagctacagcggctacgagggctgcgccgtgctgcaggtgagccccgtgaccgagaccagaacctaccacgacgtgaaggagatctgcaagtgcgacgtggacgagttcgtgatcctggagctgggcgacttcaacgacatcaccgagacctgcagctgcagctgcagcagcagcaagagcgtgacctacgagcccgacttcaacagcgccgagctgctggccaaggagctgtacagagtgttccagaagtgctggatcctgagcgtggtgaacagccagctggccggcagcctgagcgccgccggcagcatcgtggtgaacgaggagtgcgtgagaaaggacttcgagagcagcatgaacgtggtgcaggagatcaagttcaagagcagaatcagaggcaccgaggactgggccccccccagattccagatcatcttcaacatccacccccccctgaagagagacctggtggtggccgcccagaacttcttctgcgccggctgcggcacccccgtggagcccaagttcgtgaagagactgagatactgcgagtacctgggcaagtacttctgcgactgctgccacagctacgccgagagctgcatccccgccagaatcctgatgatgtgggacttcaagaagtactacgtgagcaacttcagcaagcagctgctggacagcatctggcaccagcccatcttcaacctgctgagcatcggccagagcctgtacgccaaggccaaggagctggacagagtgaaggagatccaggagcagctgttccacatcaagaagctgctgaagacctgcagattcgccaacagcgccctgaaggagttcgagcaggtgcccggccacctgaccgacgagctgcacctgttcagcctggaggacctggtgagaatcaagaagggcctgctggcccccctgctgaaggacatcctgaaggccagcctggcccacgtggccggctgcgagctgtgccagggcaagggcttcatctgcgagttctgccagaacaccaccgtgatcttccccttccagaccgccacctgcagaagatgcagcgcctgcagagcctgcttccacaagcagtgcttccagagcagcgagtgccccagatgcgccagaatcaccgccagaagaaagctgctggagagcgtggccagcgccgccacctag

SEQ ID NO: 23699 - DNA, 552 bp, Artificial Sequence
  Description of Artificial Sequence: Synthetic coding sequence
aacatgaacagatacagcttcatgctgagcggcaaccacctgctgttccacctgctgctgtggcccgcccagaccgccagactgctgaagcacatcttccccaccggcagctgcaagctgagagacgtggccgagcacctgctgcagtgcccccagaccggccacgagtgctgcaaggcccagaacagagccaacctggtggagggctggttcagccagaacacccagagaggccccagccacgacggcgtggccgagttccacatgagcctgaccgtgagctgccccgaccccacccccagcaccgacccccagggcagacacaacagagagcccatcctgggcagagacgacgacttcatgtgcaagcaggtgaagttcagaatgtgcgtggtgggcagagacggcaacgcccagagcagcgtgagatacaccggccccctgtacagaagaaagatcagaaccgagttcctgttcgtggtgttcctgctggagaccagagagctgaagccccaggtgaacaagaacgtgcagggcaccagacccagctag

SEQ ID NO: 23700 - DNA, 171 bp, Artificial Sequence
  Description of Artificial Sequence: Synthetic coding sequence
atggccatcctgaagatgggccccaagatcgtgctggagtggagcggcggccaccccagcaaggaccccagcagctactacctgatcatcctgcacaaggacaccagcagcaccctggtggactgccacttccagcaccacaacctgcacaaggtgggcttcctgtactag

SEQ ID NO: 23701 - DNA, 600 bp, Artificial Sequence
  Description of Artificial Sequence: Synthetic coding sequence
ggcagagccgccagaagacaccacgacagctgcgaggacgccgccctgcccggcagaagcgacctgtgcagagccctgcaccccgccagacccgccgccagaggcggcagacccgccgacggcggctgccccgccgtgcccgccgagggcctgtggagacacctgcagcaggtgggcgccgccacccacccccacctgatgagaggccccagcctgagctgggccatccccgccacccaccccctgggcgccgcccccctgggcaaccccggccccggcgagcccatctggctgccctgcgtgggcggcgccgaggtgagagcccagctgggcagcttctacagctgggagagcaagagcagcctgcccagcacccccctgagcctgctggtgagctgcggcggcagcgccctgaccacccacgccttcccccccatcggcggccccatccccagcagattccccgccgccaacaagtacctgcccagcagcgccagagtgcagggcagcgtgggcatcagcatctaccccgccaccgacaaggccacctacctgagcacctggagcgcccacagcggcagaagagagagacccaagtag

SEQ ID NO: 23702 - DNA, 216 bp, Artificial Sequence
  Description of Artificial Sequence: Synthetic coding sequence
atgaagatcgtgcacgtgaacgtgatgggcgtgggcggctggggcgccgtgttcctggacatgtggcacgtgacccaggagagcaagagacccatcatcagcaagatgcccgcctggatcttcccctgccaccccctggacgagcagacctaccacatggccctgaacgccgccaccttccccaagaacgccacctggatcggccccctgtggtag

SEQ ID NO: 23703 - DNA, 147 bp, Artificial Sequence
  Description of Artificial Sequence: Synthetic coding sequence
atgagcgacttccccgtgcacagcaagtacttcctgatcagcagcctgcaggtgctgaagatgcacaagaaggacttcaccagccaggtgctgctgagaatctacttcgacctgatctgcatgctggtgaagctgcacgtgctgtag

SEQ ID NO: 23704 - DNA, 861 bp, Artificial Sequence
  Description of Artificial Sequence: Synthetic coding sequence
atgagcctgcccatcggcatctacagaagagccgtgagctacgacgacaccctggaggaccccgcccccatgacccccccccccagcgacatgggcagcgtgccctggaagcccgtgatccccgagagaaagtaccagcacctggccaaggtggaggagggcgaggccagcctgcccagccccgccatgaccctgagcagcgccatcgacagcgtggacaaggtgcccgtggtgaaggccaaggccacccacgtgatcatgaacagcctgatcaccaagcagacccaggagagcatccagcacttcgagagacaggccggcctgagagacgccggctacaccccccacaagggcctgaccaccgaggagaccaagtacctgagagtggccgaggccctgcacaagctgaagctgcagagcggcgaggtgaccaaggaggagagacagcccgccagcgcccagagcacccccagcaccaccccccacagcagccccaagcagagacccagaggctggttcaccagcggcagcagcaccgccctgcccggccccaaccccagcaccatggacagcggcagcggcgacaaggacagaaacctgagcgacaagtggagcctgttcggccccagaagcctgcagaagtacgacagcggcagcttcgccacccaggcctacagaggcgcccagaagcccagccccctggagctgatcagagcccaggccaacagaatggccgaggaccccgccgccctgaagccccccaagatggacatccccgtgatggagggcaagaagcagccccccagagcccacaacctgaagcccagagacctgaacgtgctgacccccaccggcttctag

SEQ ID NO: 23705 - DNA, 3240 bp, Artificial Sequence; identical to SEQ ID NO: 23598
  Description of Artificial Sequence: Synthetic coding sequence

SEQ ID NO: 23706 - DNA, 3240 bp, Artificial Sequence; identical to SEQ ID NO: 23598
  Description of Artificial Sequence: Synthetic coding sequence

SEQ ID NO: 23707 - DNA, 792 bp, Artificial Sequence
  Description of Artificial Sequence: Synthetic coding sequence
atgtggccccagccctgcctgcccccccaccccaccatgctggaggagacccagcagagcaagctggccgccgccaagaagaagctgaaggagtaccagcagagaaacagccccggcgtgcccgccggcgtgaagatgaagaagaagaacaccggcagcagccccgagaccgccaccttcggcggctgccacagccccggcgccagcagataccaggagctggagctggccctggacagcagcagcgccatcatcaaccagctgaacgagaacatcgagagcctgaagcagcagaagaagcaggtggagcaccagctggaggaggagaagaagaccaacagcgagatccacaaggcccagatggagcagctggaggccatcgacatcctgaccctggagaaggccgacctgaagaccaccctgtaccacaccaagagagccgccagacacttcgaggaggagagcaaggacctggccggcagactgcagtacagcctgcagagaatccaggagctggagagagccctgagcgccgtgagcacccagcagcaggaggaggacagaagcagcagctgcagagaggccgtgctgcagtggagactgcagcagaccatcaaggagcaggccctgctgaacgcccacgtgacccaggtgaccgagagcctgaagcaggtgcagctggagagagacgagtacgcccagcacatcaaggaggagagagccagatggcaggagagaatgtggaagatgagcgtgggcctgagcccccaccccagacacccccagcagtag

SEQ ID NO: 23708 - DNA, 60 bp, Artificial Sequence
  Description of Artificial Sequence: Synthetic coding sequence
tggatcttcatcttcaagtgcagcgtgatgtacgtgcacttcttcttcgccttcttctag

SEQ ID NO: 23709 - DNA, 618 bp, Artificial Sequence
  Description of Artificial Sequence: Synthetic coding sequence
atgaacagctggccctggctgttcgacagcaacttctgcagcgccgtggagatcatcctggagcccgagaagaagatccccaacagcaccctgcacttctgcgaggagctggtgcccaacagcggcagcctgttcggcaagaacatctgctgcggcaagcagtgctgcatctgcgacctgaagagcctgctggagctggacagagacggcgagttccagcccgagagacccaagaacagctgccccgccctgctgaacgccatcagcagaagaaccagcatcttccccccccccaccagcctgctgctgcccgtgaccctggccagcagccagtgctgctgggccaccagcggcagcgccggcggcagaggcatcgcccccacccccggcggccagccctgcggcagcagcagaaagagcggcagcagctgcgcctggagatggagccccagcggcggcagcccctggccctgcagcagagccggcggcgcctggagaagactgggcaccagcctggacacccaccccgccggcagcagagcctgcagagccgtgcaccagctggccggcgagagccccacccccagacaggccagaagaccccccttccccacctag

SEQ ID NO: 23710 - DNA, 219 bp, Artificial Sequence
  Description of Artificial Sequence: Synthetic coding sequence
atggagaagtggaagctgggcagacagatccagcccccctggcccctggcccacgccagaggcagctggatggccctgcccagaagcgagcagctgggcaccggcggcgaccaggactggcagctgcagggccacaccagagccaccgagaccaaggagaacttccagaaggagagcatggtgaagagcctgagaatgcagagaagacagggcgagtag

SEQ ID NO: 23711 - DNA, 312 bp, Artificial Sequence
  Description of Artificial Sequence: Synthetic coding sequence
atgaagctgaagagcctgttcggcgagatcaccttcaccttcggcatcagcaaggagaagctgaagatcctggacgacctgaccctgctgcccctgctggtgaagcagtacaagatgctgtggagctacaagctgcccggcagcggcatcgtgatctggagcaccttccacgccgtgatggacagcgagtggagaagacagaacgccgagctgaacctgatcaccaacaagcacttcctgaagaacctgcagagcaagcacctggacgtgaagatcctgaagaccaagaacaagctggtggagggcatctag

SEQ ID NO: 23712 - DNA, 69 bp, Artificial Sequence
  Description of Artificial Sequence: Synthetic coding sequence
gacggcaagatcatgctgcacgtgtgctgcatcagcctgtgcagcgtgctggtgtggaagttcccctag

SEQ ID NO: 23713 - DNA, 237 bp, Artificial Sequence
  Description of Artificial Sequence: Synthetic coding sequence
gtgctgctgttcatcttctacctgctgatcttcatgttcagcttcttcgagaccagaagccacagcgtgacccaggccggcgtgcagtggcacgaccacagcagcctgcagccccagctgcccggcctgaagcagagccccaccagcgccagccagagcagctgggaccacggctgcgcccccagacaccccatccacctgccccagacccccaaggtgctgggcctgcaggtgtag

SEQ ID NO: 23714 - DNA, 297 bp, Artificial Sequence
  Description of Artificial Sequence: Synthetic coding sequence
ctggagtgcagcggcaccgtgctggcccactgcaacctgtgcctgctggccagccaggccgccggcatcaccggcaccagccaccacgcccagctgatcttcgtgttcctggtggagacctggttccaccacgtgggccaggccggcctggagctgctgaccagcggcgacccccccgccagcgtgagcgagaacgccggcatcaccggcgtgagccacagagcctggcccggcccccagttcttcaacctggagcagggcttcagcatgctggtgagactggtgagcaacagctag

SEQ ID NO: 23715 - DNA, 453 bp, Artificial Sequence
  Description of Artificial Sequence: Synthetic coding sequence
agaaacagaatccagtacaaccagagccagaaggacatcctgcagagctggttccagcacgaccccttccccgacaaggccgccagagagcagctggccaaggagatcggcgtgcccgagagcaacatccaggtgtggttcaagaactacagagtgaagcagagaaagctggactacaagtgcttcagcgagaaggaccagacccagggccacgaccagagccagcacctgacccaggagtacctgcccaaggaggccagacagaagcagaccttcatcacctggacccagaagaacagactggtgcaggccttcgagagaaaccccttccccgacatcgccaccagaaagaagctggccgagcagaccggcctgcaggagagcagaatccagatgtggttccagaagcagagaagcctgtacctgaagaagagcagaatggagcccatgtag

SEQ ID NO: 23716 - DNA, 3651 bp, Artificial Sequence
  Description of Artificial Sequence: Synthetic coding sequence
atggccgccatggcccccggcggcagcggcagcggcggcggcgtgaaccccttcctgagcgacagcgacgaggacgacgacgaggtggccgccaccgaggagagaagagccgtgctgagactgggcgccggcagcggcctggaccccggcagcgccggcagcctgagcccccaggaccccgtggccctgggcagcagcgccagacccggcctgcccggcgaggccagcgccgccgccgtggccctgggcggcaccggcgagacccccgccagactgagcatcgacgccatcgccgcccagctgctgagagaccagtacctgctgaccgccctggagctgcacaccgagctgctggagagcggcagagagctgcccagactgagagactacttcagcaaccccggcaacttcgagagacagagcggcaccccccccggcatgggcgcccccggcgtgcccggcgccgccggcgtgggcggcgccggcggcagagagcccagcaccgccagcggcggcggccagctgaacagagccggcagcatcagcaccctggacagcctggacttcgccagatacagcgacgacggcaacagagagaccgacgagaaggtggccgtgctggagttcgagctgagaaaggccaaggagaccatccaggccctgagagccaacctgaccaaggccgccgagcacgaggtgcccctgcaggagagaaagaactacaagagcagccccgagatccaggagcccatcaagcccctggagaagagagccctgaacttcctggtgaacgagttcctgctgaagaacaactacaagctgaccagcatcaccttcagcgacgagaacgacgaccaggacttcgagctgtgggacgacgtgggcctgaacatccccaagccccccgacctgctgcagctgtacagagacttcggcaaccaccaggtgaccggcaaggacctggtggacgtggccagcggcgtggaggaggacgagctggaggccctgacccccatcatcagcaacctgccccccaccctggagaccccccagcccgccgagaacagcatgctggtgcagaagctggaggacaagatcagcctgctgaacagcgagaagtggagcctgatggagcagatcagaagactgaagagcgagatggacttcctgaagaacgagcacttcgccatccccgccgtgtgcgacagcgtgcagccccccctggaccagctgccccacaaggacagcgaggacagcggccagcaccccgacgtgaacagcagcgacaagggcaagaacaccgacatccacctgagcatcagcgacgaggccgacagcaccatccccaaggagaacagccccaacagcttccccagaagagagagagagggcatgccccccagcagcctgagcagcaagaagaccgtgcacttcgacaagcccaacagaaagctgagccccgccttccaccaggccctgctgagcttctgcagaatgagcgccgacagcagactgggctacgaggtgagcagaatcgccgacagcgagaagagcgtgatgctgatgctgggcagatgcctgccccacatcgtgcccaacgtgctgctggccaagagagaggagctgatccccctgatcctgtgcaccgcctgcctgcaccccgagcccaaggagagagaccagctgctgcacatcctgttcaacctgatcaagagacccgacgacgagcagagacagatgatcctgaccggctgcgtggccttcgccagacacgtgggccccaccagagtggaggccgagctgctgccccagtgctgggagcagatcaaccacaagtaccccgagagaagactgctggtggccgagagctgcggcgccctggccccctacctgcccaaggagatcagaagcagcctggtgctgagcatgctgcagcagatgctgatggaggacaaggccgacctggtgagagaggccgtgatcaagagcctgggcatcatcatgggctacatcgacgaccccgacaagtaccaccagggcttcgagctgctgctgagcgccctgggcgaccccagcgagagagtggtgagcgccacccaccaggtgttcctgcccgcctacgccgcctggaccaccgagctgggcaacctgcagagccacctgatcctgaccctgctgaacaagatcgagaagctgctgagagagggcgagcacggcctggacgagcacaagctgcacatgtacctgagcgccctgcagagcctgatccccagcctgttcgccctggtgctgcagaacgcccccttcagcagcaaggccaagctgcacggcgaggtgccccagatcgaggtgaccagattccccagacccatgagccccctgcaggacgtgagcaccatcatcggcagcagagagcagctggccgtgctgctgcagctgtacgactaccagctggagcaggagggcaccaccggctgggagagcctgctgtgggtggtgaaccagctgctgccccagctgatcgagatcgtgggcaagatcaacgtgaccagcaccgcctgcgtgcacgagttcagcagattcttctggagactgtgcagaaccttcggcaagatcttcaccaacaccaaggtgaagccccagttccaggagatcctgagactgagcgaggagaacatcgacagcagcgccggcaacggcgtgctgaccaaggccaccgtgcccatctacgccaccggcgtgctgacctgctacatccaggaggaggacagaaagctgctggtgggcttcctggaggacgtgatgaccctgctgagcctgagccacgcccccctggacagcctgaaggccagcttcgtggagctgggcgccaaccccgcctaccacgagctgctgctgaccgtgctgtggtacggcgtggtgcacaccagcgccctggtgagatgcaccgccgccagaatgttcgagctgaccctgagaggcatgagcgaggccctggtggacaagagagtggcccccgccctggtgaccctgagcagcgaccccgagttcagcgtgagaatcgccaccatccccgccttcggcaccatcatggagaccgtgatccagagagagctgctggagagagtgaagatgcagctggccagcttcctggaggacccccagtaccaggaccagcacagcctgcacaccgagatcatcaagaccttcggcagagtgggccccaacgccgagcccagattcagagacgagttcgtgatcccccacctgcacaagctggccctggtgaacaacctgcagatcgtggacagcaagagactggacatcgccacccacctgttcgaggcctacagcgccctgagctgctgcttcatcagcgaggacctgatggtgaaccacttcctgcccggcctgagatgcctgagaaccgacatggagcacctgagccccgagcacgaggtgatcctgagcagcatgatcaaggagtgcgagcagaaggtggagaacaagaccgtgcaggagccccagggcagcatgagcatcgccgccagcctggtgagcgaggacaccaagaccaagttcctgaacaagatgggccagctgaccaccagcggcgccatgctggccaacgtgttccagagaaagaagtag

SEQ ID NO: 23717 - DNA, 435 bp, Artificial Sequence
  Description of Artificial Sequence: Synthetic coding sequence
atggagagagccagcggcctgagccccggcggcggcctgggcgccaccagcagacagatgagccccggcacccagctggccaacccccccgaccacggcgacaaggactgcctgggcagaatcagccccggcagcggcaagcagatccaggccgccggccagctgcccggcccccccaccagcctggcccccgcccagggcagactgagaagcctgaccccctggggcctgcagacccccgagcacagcgagcccgagggcatcggccacctgcaggccgccaccgaggccgtgctgccccacagcacccagaacctgatcaccaagagaaacctgatggtgcaggccagagtgcagtggagagacctgggcagcctgaagccccccccccccagattcaagcagttcagctgcttcagcctgcccagcagctag

SEQ ID NO: 23718 - DNA, 177 bp, Artificial Sequence
  Description of Artificial Sequence: Synthetic coding sequence
cccggcggcgccgccgccgccgccagcgtgatggcccccagaagaggcagatgcttctgcaccagcatctgcggcggcagaggcgccagaccccagctgcccagaacctgcggcgacggcacccagcactgcggcagaggcaagcccgccctggccgccgccgaggagtggccctag

SEQ ID NO: 23719 - DNA, 294 bp, Artificial Sequence
  Description of Artificial Sequence: Synthetic coding sequence
atgggcagcatccccagcaagccctgcaacaaccccgagggccccctgctgcagggcatggaggccgccgactggaccggcatcggcgtgtgcctgccccccggcggcgccagaggccacatctactgctgcaccagactgtgccaccagagagccgccagcgcccacagaagcctgctgctgcccagaaccgtgcagaccggcggcaccgagagagagaagcccggccccggccagagaaagagaggcgcccactgcagcgcctgcaagagaagcagcaccagacccagctag

SEQ ID NO: 23720 - DNA, 504 bp, Artificial Sequence
  Description of Artificial Sequence: Synthetic coding sequence
atggacctgatcaaggtgctgtacgtgaagaagcccctgatcttccccatgtacctgatctacaagcacgagaacctgatcctggagagaaaccccctggacgtgagaagcgtggtgatggtgagcgtgatccccctgaccttcgacatcatgagagagctgaccctggagaagaaccccatgaacgtgaagaacgtggtgaagcccagcgacatcgtggtgccctacgagaacatgaccgagctgatcctggagagaaaccccatgagcgtgagaatcatcggcaagtgcctggtgatgcccatcatcttcgtggccatcaaggagctgacccccgagagaaaccccatcagcaaggactgcggcaaggccttcagaagcagcagcttctgccagcagcacaagagcacccacaccggcgagaagccctacgagtgcaagaagtgcggcaagaccttcagattctacagcagcctgcccaagcacaagagaacccacacctag

SEQ ID NO: 23721 - DNA, 408 bp, Artificial Sequence; identical to SEQ ID NO: 23690
  Description of Artificial Sequence: Synthetic coding sequence

SEQ ID NO: 23722 - DNA, 5529 bp, Artificial Sequence
  Description of Artificial Sequence: Synthetic coding sequence
atggagctgatgttcgccgagtgggaggacggcgagagattcagcttcgaggacagcgacagattcgaggaggacagcctgtgcagcttcatcagcgaggccgagagcctgtgccagaactggagaggctggagaaagcagagcgccggccccaacagccccaccggcggcggcggcggcggcggcagcggcggcaccagaatgagagacggcctggtgatccccctggtggagctgagcgccaagcaggtggccttccacatccccttcgaggtggtggagaaggtgtacccccccgtgcccgagcagctgcagctgagaatcgccttctggagcttccccgagaacgaggaggacatcagactgtacagctgcctggccaacggcagcgccgacgagttccagagaggcgaccagctgttcagaatgagagccgtgaaggaccccctgcagatcggcttccacctgagcgccaccgtggtgcccccccagatggtgccccccaagggcgcctacaacgtggccgtgatgttcgacagatgcagagtgaccagctgcagctgcacctgcggcgccggcgccaagtggtgcacccacgtggtggccctgtgcctgttcagaatccacaacgccagcgccgtgtgcctgagagcccccgtgagcgagagcctgagcagactgcagagagaccagctgcagaagttcgcccagtacctgatcagcgagctgccccagcagatcctgcccaccgcccagagactgctggacgagctgctgagcagccagagcaccgccatcaacaccgtgtgcggcgcccccgaccccaccgccggccccagcgccagcgaccagagcacctggtacctggacgagagcaccctgaccgacaacatcaagaagaccctgcacaagttctgcggccccagccccgtggtgttcagcgacgtgaacagcatgtacctgagcagcaccgagccccccgccgccgccgagtgggcctgcctgctgagacccctgagaggcagagagcccgagggcgtgtggaacctgctgagcatcgtgagagagatgttcaagagaagagacagcaacgccgcccccctgctggagatcctgaccgaccagtgcctgacctacgagcagatcaccggctggtggtacagcgtgagaaccagcgccagccacagcagcgccagcggccacaccggcagaagcaacggccagagcgaggtggccgcccacgcctgcgccagcatgtgcgacgagatggtgaccctgtggagactggccgtgctggaccccgccctgagcccccagagaagaagagagctgtgcacccagctgagacagtggcagctgaaggtgatcgagaacgtgaagagaggccagcacaagaagaccctggagagactgttccccggcttcagacccgccgtggaggcctgctacttcaactgggaggaggcctaccccctgcccggcgtgacctacagcggcaccgacagaaagctggccctgtgctgggccagagccctgcccagcagacccggcgccagcagaagcggcggcctggaggagagcagagacagacccagacccctgcccaccgagcccgccgtgagacccaaggagcccggcaccaagagaaagggcctgggcgagggcgtgcccagcagccagagaggccccagaagactgagcgccgagggcggcgacaaggccctgcacaagatgggccccggcggcggcaaggccaaggccctgggcggcgccggcagcggcagcaagggcagcgccggcggcggcagcaagagaagactgagcagcgaggacagcagcctggagcccgacctggccgagatgagcctggacgacagcagcctggccctgggcgccgaggccagcaccttcggcggcttccccgagagcccccccccctgccccctgcacggcggcagcagaggccccagcaccttcctgcccgagccccccgacacctacgaggaggacggcggcgtgtacttcagcgagggccccgagccccccaccgccagcgtgggcccccccggcctgctgcccggcgacgtgtgcacccaggacgacctgcccagcaccgacgagagcggcaacggcctgcccaagaccaaggaggccgcccccgccgtgggcgaggaggacgacgactaccaggcctactacctgaacgcccaggacggcgccggcggcgaggaggagaaggccgagggcggcgccggcgaggagcacgacctgttcgccggcctgaagcccctggagcaggagagcagaatggaggtgctgttcgcctgcgccgaggccctgcacgcccacggctacagcagcgaggccagcagactgaccgtggagctggcccaggacctgctggccaacccccccgacctgaaggtggagcccccccccgccaagggcaagaagaacaaggtgagcaccagcagacagacctgggtggccaccaacaccctgagcaaggccgccttcctgctgaccgtgctgagcgagagacccgagcaccacaacctggccttcagagtgggcatgttcgccctggagctgcagagaccccccgccagcaccaaggccctggaggtgaagctggcctaccaggagagcgaggtggccgccctgctgaagaagatccccctgggccccagcgagatgagcaccatgagatgcagagccgaggagctgagagagggcaccctgtgcgactacagacccgtgctgcccctgatgctggccagcttcatcttcgacgtgctgtgcgcccccgtggtgagccccaccggcagcagaccccccagcagaaactggaacagcgagacccccggcgacgaggagctgggcttcgaggccgccgtggccgccctgggcatgaagaccaccgtgagcgaggccgagcaccccctgctgtgcgagggcaccagaagagagaagggcgacctggccctggccctgatgatcacctacaaggacgaccaggccaagctgaagaagatcctggacaagctgctggacagagagagccagacccacaagccccagaccctgagcagcttctacagcagcagcagacccaccaccgccagccagagaagccccagcaagcacggcggccccagcgcccccggcgccctgcagcccctgaccagcggcagcgccggccccgcccagcccggcagcgtggccggcgccggccccggccccaccgagggcttcaccgagaagaacgtgcccgagagcagcccccacagcccctgcgagggcctgcccagcgaggccgccctgacccccagacccgagggcaaggtgcccagcagactggccctgggcagcagaggcggctacaacggcagaggctggggcagccccggcagacccaagaagaagcacaccggcatggccagcatcgacagcagcgcccccgagaccaccagcgacagcagccccaccctgagcagaagacccctgagaggcggctgggcccccaccagctggggcagaggccaggacagcgacagcatcagcagcagcagcagcgacagcctgggcagcagcagcagcagcggcagcagaagagccagcgccagcggcggcgccagagccaagaccgtggaggtgggcagatacaagggcagaagacccgagagccacgccccccacgtgcccaaccagcccagcgaggccgccgcccacttctacttcgagctggccaagaccgtgctgatcaaggccggcggcaacagcagcaccagcatcttcacccaccccagcagcagcggcggccaccagggcccccacagaaacctgcacctgtgcgccttcgagatcggcctgtacgccctgggcctgcacaacttcgtgagccccaactggctgagcagaacctacagcagccacgtgagctggatcaccggccaggccatggagatcggcagcgccgccctgaccatcctggtggagtgctgggacggccacctgaccccccccgaggtggccagcctggccgacagagccagcagagccagagacagcaacatggtgagagccgccgccgagctggccctgagctgcctgccccacgcccacgccctgaaccccaacgagatccagagagccctggtgcagtgcaaggagcaggacaacctgatgctggagaaggcctgcatggccgtggaggaggccgccaagggcggcggcgtgtaccccgaggtgctgttcgaggtggcccaccagtggttctggctgtacgagcagaccgccggcggcagcagcaccgccagagagggcgccaccagctgcagcgccagcggcatcagagccggcggcgaggccggcagaggcatgcccgagggcagaggcggccccggcaccgagcccgtgaccgtggccgccgccgccgtgaccgccgccgccaccgtggtgcccgtgatcagcgtgggcagcagcctgtaccccggccccggcctgggccacggccacagccccggcctgcacccctacaccgccctgcagccccacctgccctgcagcccccagtacctgacccaccccgcccaccccgcccaccccatgccccacatgcccagacccgccgtgttccccgtgcccagcagcgcctacccccagggcgtgcaccccgccttcctgggcgcccagtacccctacagcgtgaccccccccagcctggccgccaccgccgtgagcttccccgtgcccagcatggcccccatcaccgtgcacccctaccacaccgagcccggcctgcccctgcccaccagcgtggcctgcgagctgtggggccagggcaccgtgagcagcgtgcaccccgccagcaccttccccgccatccagggcgccagcctgcccgccctgaccacccagcccagccccctggtgagcggcggcttccccccccccgaggaggagacccacagccagcccgtgaacccccacagcctgcaccacctgcacgccgcctacagagtgggcatgctggccctggagatgctgggcagaagagcccacaacgaccaccccaacaacttcagcagaagccccccctacaccgacgacgtgaagtggctgctgggcctggccgccaagctgggcgtgaactacgtgcaccagttctgcgtgggcgccgccaagggcgtgctgagccccttcgtgctgcaggagatcgtgatggagaccctgcagagactgagccccgcccacgcccacaaccacctgagagcccccgccttccaccagctggtgcagagatgccagcaggcctacatgcagtacatccaccacagactgatccacctgacccccgccgactacgacgacttcgtgaacgccatcagaagcgccagaagcgccttctgcctgacccccatgggcatgatgcagttcaacgacatcctgcagaacctgaagagaagcaagcagaccaaggagctgtggcagagagtgagcctggagatggccaccttcagcccctag

SEQ ID NO: 23723 - DNA, 87 bp, Artificial Sequence
  Description of Artificial Sequence: Synthetic coding sequence
gacgccgtgatcctgttcagcgtgtggagactgaagaagaagagcagagtgctgttcttcatctacatcatcgccatcagcgtgtag

SEQ ID NO: 23724 - DNA, 111 bp, Artificial Sequence
  Description of Artificial Sequence: Synthetic coding sequence
atggaggagaccgagagcggcagcggcagaaaggagagaagatggctgggcgccgtggcccacgtgtgcaaccccagcaccctgggcggccaggtgggcagaatcatctag

SEQ ID NO: 23725 - DNA, 495 bp, Artificial Sequence
  Description of Artificial Sequence: Synthetic coding sequence
atgggccagaagaagaccatgggcaccgagagaagcagaggcggcaagagaggcccccagcccggcgccgagagacccgaggagcccggcgccaccttcagcaagaagccccccgagggcgccagagcccccagatgcctgagcagacccaccgcccccaagagcggcgcctgcctggccagaagaagaccccccggcagcccctgcagcatcagagacgcccccttccacaccggcgacgacagattcctggccagagagaacttccccaacgtgctgcagcccctgcccagaatgttcgccgtgcagcaggccgccgacttcgagagccagtgccccagaagatgggacagcagaaagagacccagcgagggcctgcccagcgccggctggggcagatggagaggcagacccatccacctgggcctgtgggtgagcggcagcgtgagaagaaaggtgagcggcagccacgtgagcagaagcctgcacctgtag

SEQ ID NO: 23726 - DNA, 1143 bp, Artificial Sequence
  Description of Artificial Sequence: Synthetic coding sequence
gtgcaccaggagatccacaccatcgagaagaccttcgagtgcagccacggcaagaagagcttctgccaggagagccacttcaccgagcaccacagaacctgcaccagagagaagccctgcgagagcagcgactgcaagaagagattctgccacagcagcgtgctgagagtgcaccagagaacccacaccggcgagaagccctacgagtgcaaggagtgcagaaagagcttccacgtgaagcccaacctgaccaagcaccagaagacccacatcggcgagaagcccttcaagtgcaccgcctgcggcagaaccttcttccagcagagcaccctgaacgtgcaccagagaacccacaccggcgagaagccctgcggctgcaacgagtgcgagaagagcttctacaacaaggacgccctgatcatccaccagagaacccacaccggcgagaagccctacaagtgcaacgagtgcgagaagagctacctgaagaagagccacctgaacatccacctgagaaaccacaccggcaagagaccccacgtgtgcaacgagtgcggcaaggccttcagcatgaagagcaccctgaccgtgcaccagagaacccacggcgagaagccctacaagtgcaacgagtgcagaaagagcttctacatgaagagcgccctgagccagcaccagagaatccacatctgggaggagcactgcgagtgcaaggagtgcggcaagacctaccagagaagccacctggccaagcaccacagaaagtacaccaagaagccctacgagtgcaagcagtgcggcaagaccttccagaagagccacctgatcgagcaccagagaacccaccccggcgagatcccccacgagtgcaacaagtgcggcaagagcttctgctacaagagccccctgaccatccaccagagaacccacatcgaggagaagccctacaagtgcagcaagagcgtgacctacttctgcatgaagagccacctgaccgtgcaccagagaccccacaccagaaagaaccccttcgagtgcaacgagtgcagaaagatgttctacgtgaagagcaacctgatcaaccaccagagaacccacaccggcgagaagccctacgagggcaacacctgcggcaagagctag

SEQ ID NO: 23727 - DNA, 585 bp, Artificial Sequence
  Description of Artificial Sequence: Synthetic coding sequence
atgcccgcccccagattcctgtacagcctgagaaactacgagcccatgaagcccctgttcttcatcaactaccccgtgagcgacatggagctgcccgtgagaagcagcaccgtgaccctgctgcccgcccccctgcccagaagaggcagcgtgaagaccttcctggcccccagcaagagctacttccccgaggaggagagagccctgctgaagagcagccacgccttctgcaccggcctgtggccctggagaagagacttccagctgccccagtgccacctggccctgggcctgctgcccggcgagagaagcgtgagactgcccagattcctggccgtgctgaaggagctgagcgccaccgccagcttcaccctggccagcgaggccatccccttcctgagcagcttccccttcccctggaacctgctgctgcccagcgtgttccaggccctgccccagaagtggcagttcaaggccgacttcctgctggagtgcaccctgagcgtgaaggaggccttccaccaggagtgcggcgccggcgtgagcctggccaacggcctgaacaagggcctgagaaccggctag

SEQ ID NO: 23728 - DNA, 6312 bp, Artificial Sequence
  Description of Artificial Sequence: Synthetic coding sequence
atgagcgtgcccggcacccccggcgccatggagcccgccggcgaggaggagagacccccccccgccgccgagggcgaggacgacgaggaggaggtggccgccgccgcccagaccagcggccccgcccacggcagaagcgccagcagcctggaggacgccgacgaccaggaggaggagatggaggccatggtgatcggcggcggctgctgcaaggagcaggagctgacctacgagctgcagcagggctacagaatcctgggcgagttcctgcaggagaagcacagaggcctgaccgcccccttcctgcagcccctgggcggcgtggccaccgccgaggaggaggtggccgagggccccagaagcggcggcagaggcggcagagccttcccccagcagcccggccagggcatgtgcctgctgcagatggaggagaagttcgccagcggccagtacggcggcatcaccgagttcgtggccgacttcagactgatgctggagacctgctacagactgcacggcgtggaccactggatcagcaagcagggccagaagctggagatgatgctggagcagaagctggccctgctgagcagacacctgagagagaagaccaccatcgccgtgaccagcagaggctactacggcctggaggacgagaagggcaccgcctgcaccagcaccagaagaagaagcacccccagaagcctggccggcctgaccagcggcgtgttcgagagcatcatggtgcaggtgctgagacaggaggagcagctgagagccaaggaggagaagagactgagagagcaggagagaaaggaggccgaggaggccagccagaaggagatcgaggagtgggagagaaagctgctggcccaggccgcccccacctgcatggagaccatgtgggagatccccgccatcggccacttcctgtgcctggcccagcagatcctgaacctgcccgagatcgtgttctacgagctggagagatgcctgctgatgccccagtgcaacgccttcctgagcaagatcatgaccagcctgctgagccccccccacagaagacccaccctgcacagaagacccaccctgccctacagaacctgggaggccgccctgagacagaaggtgcagcagtggtacaccgccgtgggccagaccgagaaccccgacaactgcgccgagaagctgggcctgtgcccccagttcttcaaggtgctgggcgaggtgaaccccctggaggagaagcccttccacgagctgcccttctaccagaaggtgtggctgctgaagggcctgtgcgacttcgtgtacgagacccagaaggaggtgcaggacgccgtgctgggccagcccatccacgagtgcagagaggtgatcctgggctacgactacctggagaacgcctacgtgcacttcccccagttctgcggcgccgacgtgagaatctacaagcagagacccttccaggcccccgagttccccatcccccccatcaagatccagagagtgcccagaatcaagctggagaagctgaagtgcgactacgtgagcaccagcaacggcgagcacagatgcagcagagacagcctgcccagcagcttcaagaaggagcaggagaacaacttcgaccccgcctgctgccccgccaagatgatcctggacaaccacgacatcagcgtggagatgggcgtgaagagcaactacgagatcagaatcagaagaccctgcgagatcaagaagaccgactgctgcaaggagaacctggagaagcccagaagccccggcgaggtgaccggcttcggcgagcccctgagccccggcgagatcagattcatcgagaaccaggagaagtacggcgaggccagcagaatcaagatcgagcccagccccctgaaggagaacaccctgaagagctgccagatccacgtgaacggcagccacagcgaccaccccgagatcaactgccacaaggtggtgagagacatcctgctggagcagagcctgcagagccacaagaagctgaagctgaccaagatgagagccaagaagaagaagaagaagaagaagaagctgaaggacgtgctgaacgagaacctgcagagaaagagagagggcctgcacagcctggccttcaagagctacaagcccgagatccagaacaagctgctgatcatcaagaagaaggccaagcacaagaagcacaagagcggcaagaagagcgtgagcaagaaggccatcaccaagaagagaaagaccgtgatcaagagccccaccgtgcccgagttccagctgatctgcaccaacctggacgagctgagagagctgatcaccaagatcgagaacgagctgaaggacctggagaacagcagaaagaagagcggcaagtggtaccacagaagacaggccgtgaaggagctgcacagcaccctgatcagactgctgaacgagctgctgccctgggagcccaagctgatgaaggccttccagagaaacagaagcagactgaagaaggactacgacgacttcagaagacagcccgaccacgacaccttcaacagagagctgtggaccaccgacgagggcgagggcgacctgggcaaggacagccccaagggcgagatcagcaagagcatcgacagcaccgagcccctggacatcctggagaaggaccacttcgacagcgacgacatgaagctgagcgagatcgacttccccatggccagaagcaagctgctgaagaaggagctgcccagcaaggacctgcccaagaccctgctgaagaccctgaagagacagagcaagcagaccgactacgtggacgacagcaccaaggagctgagccccagaaagaaggccaagctgagcaccaacgagaccaccgtggagaacctggagagcgacgtgcagatcgactgcttcagcgagagcaagcacaccgagcccagcttccccgagagcttcgccagcctggacagcgtgcccgtgagcaccctgcagaagggcaccaagcccatccaggccctgctggccaagaacatcggcaacaaggtgaccctgaccaaccagctgccccccagcaccggcagaaacgccctggccgtggagaagcccgtgctgagcccccccgaggccagccccatcaagcccgccctgacctgccacaccaacaccaagggccccctgcagatggtgtacaagatgccctgcggccagtggctgcccatcgacctgcagaacagcagcgtgaagatccaggtgcagcccatggtggaccccaagaccggcgagaagatcatgcagcaggtgctgatcctgcccaagaacttcgtgatccagcacaaggagggcaaggccgtggccaaggaggtgccccccctgcagcagaagggcaccgagcagcactgcagcagcttcccccagaccaccaacatcaacagcagcctggccagcgtgttcgtgaacagccccggcaccgtgagcacccagctgcccaacaccgccttcaacaagaccatcacccccctgagcaacatcagcagcgccagaccccagcccctgagccccgtgaccagcgtgagcaacctgctgacccccagcgtgaagaccagccagagcgaggccggcaaggccaagaacgccgtgagcgccgccaccttcagcctgcccagcgccagccccaccatcagcagcaccggccagcccctgagcagcaccaccaccctgaacggcagcaccaaccccggcagcagcttcaactgcttcgcccagcagaccgccgacagcagcgaggccaagcaggagctgaagaccgtgtgcatcagagacagccagagcatcctggtgagaaccagaggcggcaacaccggcgtggtgaaggtgcagaccaaccccgaccagaacagccccaacaccgtgagcagcagcagcgtgttcaccttcgccccccagctgcaggccttcctggtgcccaagagcaccaccagcagcagcgccttcagccccgtggccggcaccaccaccaccagcagcctgagccccttcagccagacccccaccagcgtgagcatccccgccagcttcgcccccagcatgggcaagaacctgaagctgaccctgggccacaccaccggcagcggcgacctgggccacgtgatcgacaagaccagccacatgcccagcagccccctgaagagcagcatctgcagcagcaccctgctgcccagcaccaccagcagcagcgtgagcgtgatcagcatcagcgccgccaacttcggccagaacaacgccaacatcatccacacccccaccaagcagcagcaggtggactacatcaccaagagctaccccgtgaccagaagcgaggccaccgccgccaccaacggcgacgtgatcagcggcacccccgtgcagaagctgatgctggtgagcgcccccagcatcctgagcagcggcaacggcaccgccatcaacatgacccccgccctgaccagcaccggcgtgagcgcccagaagctggtgttcatcaacgcccccgtgcccagcggcaccagcacccccaccctggtggccgagagcctgaagcagaccctgcccccccccctgcacaaggcctacgtgaagacccccgagcagccccagatcgtgctgatccccagcaccgtgggcacccccatcaagatcaacagcagccccgccgtgagccagatcaaggacgtgaagatcggcctgaacatcggccaggccatcgtgaacaccagcggcaccgtgcccgccatccccagcatcaacatcctgcagaacgtgacccccaagggcgaggacaagagcagcaagggctacatcctgcccctgagcaccagcggcaacagcgtgcccgtgagcagcaacttcgtgagccagaacatcacccccgtgaacgagagcgtggtgagcagcgccagagccgtgaacgtgctgagcgtgaccggcgccaacctgagcctgggcagcttccccgtgaccagcgccagcgccagcgccggcgcccagccccccgtgctggtgagcggcaacgacaccagcagcagaatcatgcccatcctgagcaacagactgtgcagcagcagcctgggcaacaccgtggccatcagcaccgtgaagaccggccacctggccagcagcgtgctgatcagcaccacccagcccgtggtgagccccaagtgcctgaccagcgccctgcagatccccgtgaccgtggccctgcccacccccgccaccaccagccccaagatcatcaacaccgtgccccacagcgccgccgtgcccggcgccaccagaagcgtgagcatcagcaagagacagagcagaaccagcctgcagttccacagccccggcatcagcaccaccgtgcccaccaacgtgaacaccaacaagccccagaccgagctgagcagcctgagcaccagccccggcaagatcaccaacaccagcaacttcgccagcctgcccaaccagcaggccctggtgaagacccccagctacagcagcgcccccggcggcaccaccatccacaccgccagcgcccccagcaacgtgaccagcctggtgggcagccagttcagcgagccctgcatccagcagaagatcgtgatcaacaccagcacccccctggcccccggcacccagatcatgatcaacggcaccagattcatcgtgcccccccagggcctgggcgccggcagccacgtgctgctgatcagcaccaaccccaagtacggcgcccccctggtgctgaacagcggccagggcatccagagcacccccatcgacaacagcgcccagaagatcaccctggccagcaacaacagcctgagcggccagcccctgcagcaccccctgagaagccccaccaagttcatcaacagcttcggcaacgccagcagcatccccaccgtgcacaccagcccccagctgatcaacaccaccgccaaggtgcccgtgcccccccccgtgcccaccgtgagcctgaccagcgtgatcaagagccccgccaccctgctggccaagaccagcctggtgagcgccatctgccccagcaacccccccctgcccagcagcaccagcgtgttccacctggacccccccgtgaagaagctgctggtgagccccgagggcgccatcctgaacaccatcaacacccccgccagcaaggtgagcagcctgagccccagcctgagccagatcgtggtgagcgccagcagaagccccgccagcgtgttccccgccttccagagcagcggcctggagaagcccgacagagccgccagctag

SEQ ID NO: 23729 - DNA, 342 bp, Artificial Sequence
  Description of Artificial Sequence: Synthetic coding sequence
atgcacaccgtgccctggggcgtggacttcgccctgatcgccatgaagaacttcatcagccagtggagcagcttcttcagaagcggcatgggcaagagccagaccggctacctgcccagagtgcccagagagcagcccttcgccgccggcctgtggggcctggccgccgccctgagccacctggccgtgaacgccttcagcctgctgtgcccccccctgcccaagaccagctgcagcctgaacccccacggcgacgtggagagcagaaaggtgcacgccaccgtggagaacgtgtacatcagcgccctgaacctgccctgggtgagagtgaagtggtgctag

SEQ ID NO: 23730 - DNA, 66 bp, Artificial Sequence
  Description of Artificial Sequence: Synthetic coding sequence
agaggcgccgacagagagagattcgccagatgcgtgatcctggtgacccaggaggccgacgcctag

SEQ ID NO: 23731 - DNA, 243 bp, Artificial Sequence
  Description of Artificial Sequence: Synthetic coding sequence
atgtgcctgatcagcctgtgcgtgagcttcaccagcgtgaacaagagagagcagaacaagcccaagatcctgatcctgctgaagaagagactgagcggctgcttcatcaaggaggccagaggcaccagactgaagggcaaccagctggccgtgaccaaggccagagacgacggcggcctggccgaggacggcgacagcggcggcggcaaggtgatcagattctggatctacttcgagggctag

SEQ ID NO: 23732 - DNA, 417 bp, Artificial Sequence
  Description of Artificial Sequence: Synthetic coding sequence
gccggcggcagaccccaccagcccgccagcctgccccccggcaacccccagctggccgccctgagcctggagcagctgaagagccaggcccccatggacaccaagcccgcctaccagaaccccagaagaaaggccgagcacagcgtgagcgtgcacctggacgagcaggactggaaccccaccatgcacaagagcctgctgggcaacgaccagacccagagcgaggtgcagagcggcaccctggaggccggcgtggacagagtgatcagccagaccgtggaccccaagctgaaccacatcctgagaccccccgtggagggcgccatccacgagttcctggaggccagaaagaagagcagcagcgccagcagccccaccagagcccagagagccagaaccctgcagctgtacccctag

SEQ ID NO: 23733 - DNA, 84 bp, Artificial Sequence
  Description of Artificial Sequence: Synthetic coding sequence
tgctggggcttctactacatcctgtacctgctgtacatcatctacctgtacaacatctacatcctgaagaccagaagctactag

SEQ ID NO: 23734 - DNA, 108 bp, Artificial Sequence
  Description of Artificial Sequence: Synthetic coding sequence
atcgtgctgctgctgttcatctgcttcctgagcaagctgaacttcaccgtgctggagaagttccccaagagcaccttcctgtgcaagatccagcacgagagcctgtag

SEQ ID NO: 23735 - DNA, 570 bp, Artificial Sequence
  Description of Artificial Sequence: Synthetic coding sequence
atgtgcgccaagagactgagaggccccttcagaatcttcctgcccctgagaaagtacagcttcttccccagccaggtggcccagcccttcgccagcgccgccgtggcccaggccctgctgagcagccccggcaccaacctgcagcagaccctggtgggcggcctgagactgagacacggcagcgtgggcggcgcccagtgggtggtgaaggccgcctgcccctgggagccccaggacgtggcctgctgcggcggcttcaccgtgaccgccagaatcgccgcctgcgtgctgctgtgcctgtgcgagcacatgtacacccccagcgcccacgccagaatgaccttcggcaccgagcacctgctgctgtggcccgcccagagaagagccgaccccagaaccgccgcccccatcagactgcaccagggccagctggaccccagcagagaccccgagaacctgagagcctgggccgtgggcagctgcagagccggcgtggagctgcacggcagccccgtgcacctgcacatgagagccggccagcacatcagcatgttcgccggcgtggcctag

SEQ ID NO: 23736 - DNA, 3285 bp, Artificial Sequence
  Description of Artificial Sequence: Synthetic coding sequence
atggccgccagagccccccccgccgcccccgccgccgaggagcccggcaaccccggcggcccccccagaagaaagaagagcagaagcggcgccagcggcctgagaagagccttcagctggctgagaggcaagagaagaaagaagaaggccgccggcgccgagggcgccgagcccgccgcccccagagccaagaaggccgaggacaaggccaagagagccaagggcaagggcagaggcagcgccaaggccgagaacgacaagcacctgagcgtgggccccggccagggccccggcagcgccgtggacgagcaccaggacaacgtgttcttccccagcggcagacccccccacctggaggagctgcacacccaggcccaggagggcctgagaagcctgcagcaccaggagaagcagaagctgaacaagggcggctgggaccacggcgacacccagagcatccagagcagcagaaccggccccgacgaggacaacatcagcttctgcagccagaccaccagctacgtggccgagagcagcaccgccgaggacgccctgagcatcagaagcgagatgatccagagaaagggcagcaccttcagaccccacgacagcttccccaagagcggcaagagcggcagaagaagaagagagagaagaagcaccgtgctgggcctgccccagcacgtgcagaaggagctgggcctgagaaacgagagagaggcccccggcacccccagagcccccggcgccagagacgccgtgagaatccccaccgtggacggcagacccagaggcaccagcggcatgggcgccagagtgagcctgcaggccctggaggccgaggccgaggccggcgccgagaccgaggccatgctgcagagacacatcgacagagtgtacagagacgacaccttcgtgggcagaagcaccggcaccagagccccccccctgaccagacccatgagcctggccgtgcccggcctgaccggcggcgccggccccgccgagcccctgagccccgccatgagcatcagcccccaggccacctacctgagcaagctgatcccccacgccgtgctgccccccaccgtggacgtggtggccctgggcagatgcagcctgagaaccctgagcagatgcagcctgcacagcgccagccccgccagcgtgagaagcctgggcagattcagcagcgtgagcagcccccagcccagaagcagacaccccagcagcagcagcgacacctggagccacagccagagcagcgacaccatcgtgagcgacggcagcaccctgagcagcaagggcggcagcgagggccagcccgagagcagcaccgccagcaacagcgtggtgccccccccccagggcggcagcggcagaggcagccccagcggcggcagcaccgccgaggccagcgacaccctgagcatcagaagcagcggccagctgagcggcagaagcgtgagcctgagaaagctgaagagacccccccccccccccagaagaacccacagcctgcaccagagaggcctggccgtgcccgacggccccctgggcctgccccccaagcccgagagaaagcagcagccccagctgcccagaccccccaccaccggcggcagcgagggcgccggcgccgccccctgcccccccaaccccgccaacagctgggtgcccggcctgagccccggcggcagcagaagaccccccagaagccccgagagaaccctgagccccagcagcggctacagcagccagagcggcacccccaccctgccccccaagggcctggccggcccccccgccagccccggcaaggcccagccccccaagcccgagagagtgaccagcctgagaagccccggcgccagcgtgagcagcagcctgaccagcctgtgcagcagcagcagcgaccccgcccccagcgacagaagcggcccccagatcctgacccccctgggcgacagattcgtgatccccccccaccccaaggtgcccgcccccttcagccccccccccagcaagcccagaagccccaaccccgccgcccccgccctggccgcccccgccgtggtgcccggccccgtgagcaccaccgacgccagcccccagagcccccccaccccccagaccaccctgacccccctgcaggagagccccgtgatcagcaaggaccagagccccccccccagccccccccccagctaccaccccccccccccccccaccaagaagcccgaggtggtggtggaggcccccagcgccagcgagaccgccgaggagcccctgcaggaccccaactggccccccccccccccccccgcccccgaggagcaggacctgagcatggccgacttccccccccccgaggaggccttcttcagcgtggccagccccgagcccgccggccccagcggcagccccgagctggtgagcagccccgccgccagcagcagcagcgccaccgccctgcagatccagccccccggcagccccgaccccccccccgccccccccgcccccgcccccgccagcagcgcccccggccacgtggccaagctgccccagaaggagcccgtgggctgcagcaagggcggcggcccccccagagaggacgtgggcgcccccctggtgacccccagcctgctgcagatggtgagactgagaagcgtgggcgcccccggcggcgcccccacccccgccctgggccccagcgccccccagaagcccctgagaagagccctgagcggcagagccagccccgtgcccgcccccagcagcggcctgcacgccgccgtgagactgaaggcctgcagcctggccgccagcgagggcctgagcagcgcccagcccaacggcccccccgaggccgagcccagacccccccagagccccgccagcaccgccagcttcatcttcagcaagggcagcagaaagctgcagctggagagacccgtgagccccgagacccaggccgacctgcagagaaacctggtggccgagctgagaagcatcagcgagcagagacccccccaggcccccaagaagagccccaaggcccccccccccgtggccagaaagcccagcgtgggcgtgcccccccccgccagccccagctaccccagagccgagcccctgaccgccccccccaccaacggcctgccccacacccaggacagaaccaagagagagctggccgagaacggcggcgtgctgcagctggtgggccccgaggagaagatgggcctgcccggcagcgacagccagaaggagctggcctag

SEQ ID NO: 23737 - DNA, 942 bp, Artificial Sequence
  Description of Artificial Sequence: Synthetic coding sequence
atggagtactactactgccccagcctgctgaagctgctgagatacctgtgggaccagctgaagcagtgcttcagcagacagcccaccgagcccaaggacaccgacaccctggtgcacgaggccggcagccagtacggcacctggaccgagcagtgccagagcggcgagagcctggccaccgagagccccgacagcagcgccaccagcaccagaaagcagccccccagcagcagactgagcagcctgagcagccagaccgagcccaccagcgccggcgaccagtacgactgcagcagagaccagagaagcaccagcgtggaccacagcagcaccgacctggagagcaccgacggcatggagggcccccccccccccgacgcctgccccgagaagagagtggacgacttcagcttcatcgaccagaccagcgtgctggacagcagcgccctgaagaccagagtgcagctgagcaagagaagcagaagaagagcccccatcagccacagcctgagaagaagcagattcagcgagagcgagagcagaagccccctggaggacgagaccgacaacacctggatgttcaaggacagcaccgaggagaagagccccagaaaggaggagagcgacgaggaggagaccgccagcaaggccgagagaacccccgtgagccacccccagagaatgcccgccttccccggcatggaccccgccgtgctgaaggcccagctgcacaagagacccgaggtggacagccccggcgagacccccagctgggccccccagcccaagagccccaagagccccttccagcccggcgtgctgggcagcagagtgctgcccagcagcatggacaaggacgagagaagcgacgagcccagcccccagtggctgaaggagctgaagagcaagaagagacagagcctgtacgagaaccaggtgtag

SEQ ID NO: 23738 - DNA, 1170 bp, Artificial Sequence
  Description of Artificial Sequence: Synthetic coding sequence
tgcgagaagagcaccttcttcaagcaccagaagagaacccacaccgtggagaagaccttcgagtgcagccacggcaagaagagcttctgccaggagagccacttcaccgagcaccacagaacctgcaccagagagaagccctgcgagagcaacaagtacggcaagaccttccaccagaagagaagcttcatccaccaccagagaacccacaccggcgagaagccctacgagtgcaaggagtgcagaaagagcttccacgtgaagcccaacctgaccaagcaccagaagacccacatcggcgagaagcccttcaagtgcaccgcctgcggcagaaccttcttccagcagagcaccctgaacgtgcaccagggcaagcacaccgaggagaagccctacaagtacaccgagtgcgagaagagcttctacaagagcgtgctgatcatccacgagagaacccacaccggcgagaagccctgcggctgcaacgagtgcgagaagagcttcgaggtgctgaccaccctggtgatccaccagagaacccacaccggcgagaagccctacaagtgcaacgagtgcgagaagagctacctgaacctgaagagccacctgaacatccacctgagaaaccacaccggcaagagaccccacgtgtgcaacgagtgcggcaaggccttcagcatgaagagcaccctgaccgtgcaccagagaacccacatgggcaagccctacaagtgcaacgagtgcagaaagagcttctacatgaagagcgccctgagccagcaccagagaatccacatctacaagaagccctacgagtgcaagcagtgcggcaagaccttccagaagagccacctgatcgagcaccagagaacccaccccggcgagatcccccacgagtgcaacaagtgcggcaagagcttctgctacaagagccccctgaccatccaccagagaacccacatcgaggagaagccctacaagtgcagcaagagcgtgacctacttctgcatgaagagccacctgaccgtgcaccagagaccccacaccagaaagaaccccttcgagtgcaacgagtgcagaaagatgttctacgtgaagagcaacctgatcaaccaccagagaacccacaccggcgagaagccctacgagggcaacacctgcggcaagtag

SEQ ID NO: 23739 - DNA, 96 bp, Artificial Sequence
  Description of Artificial Sequence: Synthetic coding sequence
atgagcgagaagaccggcgagcccgccgccgagaacagagacaaggaggccagcgtggccggcgcccagatcaccctgcagacccagaccccctag

SEQ ID NO: 23740 - DNA, 2157 bp, Artificial Sequence; identical to SEQ ID NO: 23629
  Description of Artificial Sequence: Synthetic coding sequence

SEQ ID NO: 23741 - DNA, 5130 bp, Artificial Sequence
  Description of Artificial Sequence: Synthetic coding sequence
atgagagccggctggacccccagaggcttcagcgccttccacgccagcctgctgcccggcagacacccctacctggcccacctgggccccagagacagaggcgccagaatcggcagcagagcctacagccagggctgctgcagctgcctgtggctgacctacaagggcaagaaggagggcagcaccaagggcgagctgggccccgccgccgtgaccgacctggagatccccagctacagcagaggcttcctgccctgcacccccagattccccaccacctggtgcagaggccccggctgcttctgcggcaccgccgtgatcgccggcaacctgggcgacctggccagaatcgtgggccccagccaccacgccagccagctgctgctgctgcaggagcaggacagcggcaaccaccccaccatggccgagagcctgagcgagatcagcgacagcctggacgtgctggaggccggcgacgagggcaagaagaagtgcaagttcaaggccctgaagagcttcttcgtgaagaagaaggagaaggaggccgaggacacccaggaggaggagatgctggagctgagcctgagcagcagcaacatcaacatcagcagcctgcagcccgtgagagagaaccagcccaccaaggccagagccaagagcagcatgggcagcaaggccctgagccacgacagcatcttcatgctgggccccgagcccgagagaagcgccagcaagatgttccccagcatggacccccagagaggcagaccccagcagagaagccacatcagcagaaccctgcccaagcccagaagcaaggtgcccggcgtggtgagcggcgccatgagcggcgccgtgctgcagaacgtgcccaccagcgccgtgtgggtggccggccccaagatcaccgagaacccccccagcagaagaagaagactgagcatcatcccccccgtgatccagcccgagatcatcagcaagaacctggtggagatcagcctggacgacgagagccccaagaacccccagaagaaggccctgccccacaagagcctgaccgccacccagagcttcagcgagctgagcagcggccccgactgcagccagagcctgaccgccttcgccaccctggccagcaccagcagcacccagctgcccatcggcttcagcacccccgccaccacccagggctgcctggacagcagcgccgccagacacaagatgaccctgaaccccagaaagcagaagaagaacctgcaggtgatcatcagaggcctgcccgtgtggttcagccacttccagggcatcctggagggcagcctgcagtgcgtgacccagaccctggagacccccaacctggacgagcccctgcccgtggagcccaaggaggaggagcccaacctgcccctggtgagcgaggaggagaagagcatcaccaagcccaaggagatcaacgagaagaagctgggcatggacagcgccgacagcagcagccagaagcagaacaacaagaccgagatgtacgacaagaagaccaccgaccaggcccccaacaccgacgccagcagaagccagggctaccccatgagcgccgcctacggcagaagatggagaagaaagggcgccagcgtgagcggcctgagcggctgcgagttcaagggcagaagcctgaagcagagcagcgagggctacggcctgggcgacagagccggcagcagccccaccaacaagaccgccagaaacgtgcccttcagccacctgagcctggagaaggacaacatggagcagcccaccaccagccagcccgagaccaccaccccccagggcctgctgagcgacaaggacgacatgggcagaagaaacgccggcatcgacttcggcagcagaaaggccagcgccgcccagcccatccccgagaacatggacaacagcatggtgagcgacccccagccctaccacgaggacgccgccagcggcgccgagaagaccgaggccagagccagcctgagcctgatggtggagagcctgagcaccacccaggaggaggccatcctgagcgtggccgccgaggcccaggtgttcatgaaccccagccacatccagctggaggaccaggaggccttcagcttcgacctgcagaaggcccagagcaagatggagagcgcccaggacgtgcagaccatctgcaaggagaagcccagcggcaacgtgcaccagaccttcaccgccagcgtgctgggcatgaccagcaccaccgccaagggcgacgtgtacgccaagaccctgccccccagaagcctgttccagagcagcagaaagcccgacgccgaggaggtgagcagcgacagcgagaacatccccgaggagggcgacggcagcgaggagctggcccacggccacagcagccagagcctgggcaagttcgaggacgagcaggaggtgttcagcgagagcaagagcttcgtggaggacctgagcagcagcgaggaggagctggacctgagatgcctgagccaggccctggaggagcccgaggacgccgaggtgttcaccgagagcagcagctacgtggagaagtacaacaccagcgacgactgcagcagcagcgaggaggacctgcccctgagacaccccgcccaggccctgggcaagcccaagaaccagcaggaggtgagcagcgccagcaacaacacccccgaggagcagaacgacttcatgcagcagctgcccagcagatgccccagccagcccatcatgaaccccaccgtgcagcagcaggtgcccaccagcagcgtgggcaccagcatcaagcagagcgacagcgtggagcccatcccccccagacaccccttccagccctgggtgaaccccaaggtggagcaggaggtgagcagcagccccaagagcatggccgtggaggagagcatcagcatgaagcccctgccccccaagctgctgtgccagcccctgatgaaccccaaggtgcagcagaacatgttcagcggcagcgaggacatcgccgtggagagagtgatcagcgtggagcccctgctgcccagatacagcccccagagcctgaccgacccccagatcagacagatcagcgagagcaccgccgtggaggagggcacctacgtggagcccctgccccccagatgcctgagccagcccagcgagagacccaagttcctggacagcatgagcaccagcgccgagtggagcagccccgtggcccccacccccagcaagtacaccagccccccctgggtgacccccaagttcgaggagctgtaccagctgagcgcccaccccgagagcaccaccgtggaggaggacatcagcaaggagcagctgctgcccagacacctgagccagctgaccgtgggcaacaaggtgcagcagctgagcagcaacttcgagagagccgccatcgaggccgacatcagcggcagccccctgcccccccagtacgccacccagttcctgaagagaagcaaggtgcaggagatgaccagcagactggagaagatggccgtggagggcaccagcaacaagagccccatccccagaagacccacccagagcttcgtgaagttcatggcccagcagatcttcagcgagagcagcgccctgaagagaggcagcgacgtggcccccctgccccccaacctgcccagcaagagcctgagcaagcccgaggtgaagcaccaggtgttcagcgacagcggcagcgccaaccccaagggcggcatcagcagcaagatgctgcccatgaagcaccccctgcagagcctgggcagacccgaggacccccagaaggtgttcagctacagcgagagagcccccggcaagtgcagcagcttcaaggagcagctgagccccagacagctgagccaggccctgagaaagcccgagtacgagcagaaggtgagccccgtgagcgccagcagccccaaggagtggagaaacagcaagaagcagctgccccccaagcacagcagccaggccagcgacagaagcaagttccagccccagatgagcagcaagggccccgtgaacgtgcccgtgaagcagagcagcggcgagaagcacctgcccagcagcagccccttccagcagcaggtgcacagcagcagcgtgaacgccgccgccagaagaagcgtgttcgagagcaacagcgacaactggttcctgggcagagacgaggccttcgccatcaagaccaagaagttcagccagggcagcaagaaccccatcaagagcatccccgcccccgccaccaagcccggcaagttcaccatcgcccccgtgagacagaccagcaccagcggcggcatctacagcaagaaggaggacctggagagcggcgacggcaacaacaaccagcacgccaacctgagcaaccaggacgacgtggagaagctgttcggcgtgagactgaagagagccccccccagccagaagtacaagagcgagaagcaggacaacttcacccagctggccagcgtgcccagcggccccatcagcagcagcgtgggcagaggccacaagatcagaagcaccagccagggcctgctggacgccgccggcaacctgaccaagatcagctacgtggccgacaagcagcagagcagacccaagagcgagagcatggccaagaagcagcccgcctgcaagacccccggcaagcccgccggccagcagagcgactacgccgtgagcgagcccgtgtggatcaccatggccaagcagaagcagaagagcttcaaggcccacatcagcgtgaaggagctgaagaccaagagcaacgccggcgccgacgccgagaccaaggagcccaagtacgagggcgccggcagcgccaacgagaaccagcccaagaagatgttcaccagcagcgtgcacaagcaggagaagaccgcccagatgaagccccccaagcccaccaagagcgtgggcttcgaggcccagaagatcctgcaggtgcccgccatggagaaggagaccaagagaagcagcaccctgcccgccaagttccagaaccccgtggagcccatcgagcccgtgtggttcagcctggccagaaagaaggccaaggcctggagccacatggccgagatcacccagtag

SEQ ID NO: 23742 - DNA, 5421 bp, Artificial Sequence; identical to SEQ ID NO: 23633
  Description of Artificial Sequence: Synthetic coding sequence

SEQ ID NO: 23743 - DNA, 4230 bp, Artificial Sequence
  Description of Artificial Sequence: Synthetic coding sequence
atggagagcgacagactgatcatcagcctgcccagagtgaagtggaccgaggccgccctgaccatggccagccagctgcaggagaagtgcatcgccttcatcgtggacaacttcagcaagatcatccagagcgagaacttcgccctgctgctgcagagccaggccatgagcagcaccgccgacctgctggacaccatcctgaaggccatcgaggagaacatcaccaccgagaacagctgcagcctgctgatggccctggacaccctgctgaacagcgacagcaccaaggagatgggcttcacctgcaagatccaggccctgagagacaagctgtggatcttcctggtgcagagcttctacgccgtgagacacaccgagagctggaagctgatgagcaccgacgaccagcagaagatccaggccgccgccttcgacaagggcgacgacagaagactgggcaagaagcccatcttcagcagcagccagcagagaaagcaggtgagcgacagcggcgacatcaagatcaagagctggagaggcaacaacaagaaggagtgctggagctacctgagcaccaacaagaagatgaagagcgacggcctgggcgccagcggccacagcagcagcaccaacagaaacagcatcaacaagaccctgaagcaggacgacgtgaaggagaaggacggcaccaagatcgccagcaagatcaccaaggagctgaagaccggcggcaagaacgtgagcggcaagcccaagaccgtgaccaagagcaagaccgagaacggcgacaaggccagactggagaacatgagccccagacaggtggtggagagaagcgccaccgccgccgccgccgccaccggccagaagaacctgctgaacggcaagggcgtgagaaaccaggagggccagatcagcggcgccagacccaaggtgctgaccggcaacctgaacgtgcaggccaaggccaagcccctgaagaaggccaccggcaaggacagcccctgcctgagcatcgccggccccagcagcagaagcaccgacagcagcatggagttcagcatcagcaccgagtgcctggacgagcccaaggagaacggcagcaccgaggaggagaagcccagcggccacaagctgagcttctgcgacagccccggccagatgatgaagaacagcgtggacagcgtgaagaacagcaccgtggccatcaagagcagacccgtgagcagagtgaccaacggcaccagcaacaagaagagcatccacgagcaggacaccaacgtgaacaacagcgtgctgaagaaggtgagcggcaagggctgcagcgagcccgtgccccaggccatcctgaagaagagaggcaccagcaacggctgcaccgccgcccagcagagaaccaagagcacccccagcaacctgaccaagacccagggcagccagggcgagagccccaacagcgtgaagagcagcgtgagcagcagacagagcgacgagaacgtggccaagctggaccacaacaccaccaccgagaagcaggcccccaagagaaagatggtgaagcaggtgcacaccgccctgcccaaggtgaacgccaagatcgtggccatgcccaagaacctgaaccagagcaagaagggcgagaccctgaacaacaaggacagcaagcagaagatgccccccggccaggtgatcagcaagacccagcccagcagccagagacccctgaagcacgagaccagcaccgtgcagaagagcatgttccacgacgtgagagacaacaacaacaaggacagcgtgagcgagcagaagccccacaagcccctgatcaacctggccagcgagatcagcgacgccgaggccctgcagagcagctgcagacccgacccccagaagcccctgaacgaccaggagaaggagaagctggccctggagtgccagaacatcagcaagctggacaagagcctgaagcacgagctggagagcaagcagatctgcctggacaagagcgagaccaagttccccaaccacaaggagaccgacgactgcgacgccgccaacatctgctgccacagcgtgggcagcgacaacgtgaacagcaagttctacagcaccaccgccctgaagtacatggtgagcaaccccaacgagaacagcctgaacagcaaccccgtgtgcgacctggacagcaccagcgccggccagatccacctgatcagcgacagagagaaccaggtgggcagaaaggacaccaacaagcagagcagcatcaagtgcgtggaggacgtgagcctgtgcaaccccgagagaaccaacggcaccctgaacagcgcccaggaggacaagaagagcaaggtgcccgtggagggcctgaccatccccagcaagctgagcgacgagagcgccatggacgaggacaagcacgccaccgccgacagcgacgtgagcagcaagtgcttcagcggccagctgagcgagaagaacagccccaagaacatggagaccagcgagagccccgagagccacgagacccccgagacccccttcgtgggccactggaacctgagcaccggcgtgctgcaccagagagagagccccgagagcgacaccggcagcgccaccaccagcagcgacgacatcaagcccagaagcgaggactacgacgccggcggcagccaggacgacgacggcagcaacgacagaggcatcagcaagtgcggcaccatgctgtgccacgacttcctgggcagaagcagcagcgacaccagcacccccgaggagctgaagatctacgacagcaacctgagaatcgaggtgaagatgaagaagcagagcaacaacgacctgttccaggtgaacagcaccagcgacgacgagatccccagaaagagacccgagatctggagcagaagcgccatcgtgcacagcagagagagagagaacatccccagaggcagcgtgcagttcgcccaggagatcgaccaggtgagcagcagcgccgacgagaccgaggacgagagaagcgaggccgagaacgtggccgagaacttcagcatcagcaaccccgccccccagcagttccagggcatcatcaacctggccttcgaggacgccaccgagaacgagtgcagagagttcagcgccaccaagaagttcaagagaagcgtgctgctgagcgtggacgagtgcgaggagctgggcagcgacgagggcgaggtgcacacccccttccaggccagcgtggacagcttcagccccagcgacgtgttcgacggcatcagccacgagcaccacggcagaacctgctacagcagattcagcagagagagcgaggacaacatcctggagtgcaagcagaacaagggcaacagcgtgtgcaagaacgagagcaccgtgctggacctgagcagcatcgacagcagcagaaagaacaagcagagcgtgagcgccaccgagaagaagaacaccatcgacgtgctgagcagcagaagcagacagctgctgagagaggacaagaaggtgaacaacggcagcaacgtggagaacgacatccagcagagaagcaagttcctggacagcgacgtgaagagccaggagagaccctgccacctggacctgcaccagagagagcccaacagcgacatccccaagaacagcagcaccaagagcctggacagcttcagaagccaggtgctgccccaggagggccccgtgaaggagagccacagcaccaccaccgagaaggccaacatcgccctgagcgccggcgacatcgacgactgcgacaccctggcccagaccagaatgtacgaccacagacccagcaagaccctgagccccatctacgagatggacgtgatcgaggccttcgagcagaaggtggagagcgagacccacgtgaccgacatggacttcgaggacgaccagcacttcgccaagcaggactggaccctgctgaagcagctgctgagcgagcaggacagcaacctggacgtgaccaacagcgtgcccgaggacctgagcctggcccagtacctgatcaaccagaccctgctgctggccagagacagcagcaagccccagggcatcacccacatcgacaccctgaacagatggagcgagctgaccagccccctggacagcagcgccagcatcaccatggccagcttcagcagcgaggactgcagcccccagggcgagtggaccatcctggagctggagacccagcactag

SEQ ID NO: 23744 - DNA, 369 bp, Artificial Sequence
  Description of Artificial Sequence: Synthetic coding sequence
agccacatcatgctgaacaacggcaccaagaccgacatgctgggcctgggcacctggaagagcccccccggccaggtggccgaggccgtgaaggtggccatcaacaccgtgtacagacacatcgactgcagccacgtgcaccagaacaaggaccaggagcagctgaaggagcaggtggtgagaagagagtggctgttcatcatcagcaagccctggggcatctgccacagaaagtgcctggtgagaggcagctgcagaaaggtgctgagcggcctggagctggactacctggacctgcacctgatccactggcccaccggctgccaccccggcaaggagttcagcttcctggacgagagcggcaactag

SEQ ID NO: 23745 - DNA, 3339 bp, Artificial Sequence
  Description of Artificial Sequence: Synthetic coding sequence
tgatactacctgaacgcccaggacggcgccggcggcgaggaggagaaggccgagggcggcgccggcgaggagcacgacctgttcgccggcctgaagcccctggagcaggagagcagaatggaggtgctgttcgcctgcgccgaggccctgcacgcccacggctacagcagcgaggccagcagactgaccgtggagctggcccaggacctgctggccaacccccccgacctgaaggtggagcccccccccgccaagggcaagaagaacaaggtgagcaccagcagacagacctgggtggccaccaacaccctgagcaaggccgccttcctgctgaccgtgctgagcgagagacccgagcaccacaacctggccttcagagtgggcatgttcgccctggagctgcagagaccccccgccagcaccaaggccctggaggtgaagctggcctaccaggagagcgaggtggccgccctgctgaagaagatccccctgggccccagcgagatgagcaccatgagatgcagagccgaggagctgagagagggcaccctgtgcgactacagacccgtgctgcccctgatgctggccagcttcatcttcgacgtgctgtgcgcccccgtggtgagccccaccggcagcagaccccccagcagaaactggaacagcgagacccccggcgacgaggagctgggcttcgaggccgccgtggccgccctgggcatgaagaccaccgtgagcgaggccgagcaccccctgctgtgcgagggcaccagaagagagaagggcgacctggccctggccctgatgatcacctacaaggacgaccaggccaagctgaagaagatcctggacaagctgctggacagagagagccagacccacaagccccagaccctgagcagcttctacagcagcagcagacccaccaccgccagccagagaagccccagcaagcacggcggccccagcgcccccggcgccctgcagcccctgaccagcggcagcgccggccccgcccagcccggcagcgtggccggcgccggccccggccccaccgagggcttcaccgagaagaacgtgcccgagagcagcccccacagcccctgcgagggcctgcccagcgaggccgccctgacccccagacccgagggcaaggtgcccagcagactggccctgggcagcagaggcggctacaacggcagaggctggggcagccccggcagacccaagaagaagcacaccggcatggccagcatcgacagcagcgcccccgagaccaccagcgacagcagccccaccctgagcagaagacccctgagaggcggctgggcccccaccagctggggcagaggccaggacagcgacagcatcagcagcagcagcagcgacagcctgggcagcagcagcagcagcggcagcagaagagccagcgccagcggcggcgccagagccaagaccgtggaggtgggcagatacaagggcagaagacccgagagccacgccccccacgtgcccaaccagcccagcgaggccgccgcccacttctacttcgagctggccaagaccgtgctgatcaaggccggcggcaacagcagcaccagcatcttcacccaccccagcagcagcggcggccaccagggcccccacagaaacctgcacctgtgcgccttcgagatcggcctgtacgccctgggcctgcacaacttcgtgagccccaactggctgagcagaacctacagcagccacgtgagctggatcaccggccaggccatggagatcggcagcgccgccctgaccatcctggtggagtgctgggacggccacctgaccccccccgaggtggccagcctggccgacagagccagcagagccagagacagcaacatggtgagagccgccgccgagctggccctgagctgcctgccccacgcccacgccctgaaccccaacgagatccagagagccctggtgcagtgcaaggagcaggacaacctgatgctggagaaggcctgcatggccgtggaggaggccgccaagggcggcggcgtgtaccccgaggtgctgttcgaggtggcccaccagtggttctggctgtacgagcagaccgccggcggcagcagcaccgccagagagggcgccaccagctgcagcgccagcggcatcagagccggcggcgaggccggcagaggcatgcccgagggcagaggcggccccggcaccgagcccgtgaccgtggccgccgccgccgtgaccgccgccgccaccgtggtgcccgtgatcagcgtgggcagcagcctgtaccccggccccggcctgggccacggccacagccccggcctgcacccctacaccgccctgcagccccacctgccctgcagcccccagtacctgacccaccccgcccaccccgcccaccccatgccccacatgcccagacccgccgtgttccccgtgcccagcagcgcctacccccagggcgtgcaccccgccttcctgggcgcccagtacccctacagcgtgaccccccccagcctggccgccaccgccgtgagcttccccgtgcccagcatggcccccatcaccgtgcacccctaccacaccgagcccggcctgcccctgcccaccagcgtggcctgcgagctgtggggccagggcaccgtgagcagcgtgcaccccgccagcaccttccccgccatccagggcgccagcctgcccgccctgaccacccagcccagccccctggtgagcggcggcttccccccccccgaggaggagacccacagccagcccgtgaacccccacagcctgcaccacctgcacgccgcctacagagtgggcatgctggccctggagatgctgggcagaagagcccacaacgaccaccccaacaacttcagcagaagccccccctacaccgacgacgtgaagtggctgctgggcctggccgccaagctgggcgtgaactacgtgcaccagttctgcgtgggcgccgccaagggcgtgctgagccccttcgtgctgcaggagatcgtgatggagaccctgcagagactgagccccgcccacgcccacaaccacctgagagcccccgccttccaccagctggtgcagagatgccagcaggcctacatgcagtacatccaccacagactgatccacctgacccccgccgactacgacgacttcgtgaacgccatcagaagcgccagaagcgccttctgcctgacccccatgggcatgatgcagttcaacgacatcctgcagaacctgaagagaagcaagcagaccaaggagctgtggcagagagtgagcctggagatggccaccttcagcccctag

SEQ ID NO: 23746 - DNA, 660 bp, Artificial Sequence
  Description of Artificial Sequence: Synthetic coding sequence
ctggagaaggaggagaagaaccccaacaccgagttctacctgaagaacctggtgctgaccaccctgaacctgttcgtgggcggcaccgagaccgtgagcaccaccctgcactacggcttcctgctgctgatgaagcaccccgaggtggaggccaaggtgcacgagatcgacagagtgatcggcaagaaccagcagcccaagttcgaggacagagccaagaccctgtacaccgaggccgtgatccacgagatccagagattcggcgacctgctgcccatgggcgtgagcagaagagtgaagaaggacaccaagttcagagacttcttcctgagcaagggcatcgaggtgttccccatgctgggcagcgtgctgagagacctgagattcttcagcaaccccagagacttcaacccccagcacttcctgggcgagaagggccagttcaagaagagagacgccttcgtgcccttcagcatcagaagaagaaactgcttcagagagggcctggccagaatggagctgttcctgtacctgaccaccatcatgcagaacttcagattcaagagcagacagagccccaaggacatcgtggtgagccccaagcacgtgggcttcgtgaccatccccagaaactacaccaagtgctacctgccctgctag

SEQ ID NO: 23747 - DNA, 132 bp, Artificial Sequence
  Description of Artificial Sequence: Synthetic coding sequence
accgacttcctgagaacccagcccaccagaaccagagtgaacaagcagcccctgctgctgaccctgagcctgttcaagctgagcctgcagctggacgccagaatcaccttcggcgccgagagccccggctag

SEQ ID NO: 23748 - DNA, 375 bp, Artificial Sequence
  Description of Artificial Sequence: Synthetic coding sequence
atgaccctgaacgagcacgccgccttcaagcacctgttcaacaaggcccacctggccccccccctgatccacctgaccctgagcggccacagcacctgcttcagagagcacagagtgggcggcaaggtgaccgaccagcaggaccccaaggccgaggagttcttcctggtgcagaacaagatgaagagcctgccctgcctgcccctgagcacccagacccagcagcccagcgacttcagcatcttcagcccccccttcccccccttctacagcaccaagccccccctgagcagctggcccgtgctgaacgagctgctgggcaccccccccagatggggcggcggcagagccgagggcctgctgaccagccagtag

SEQ ID NO: 23749 - DNA, 621 bp, Artificial Sequence
  Description of Artificial Sequence: Synthetic coding sequence
ctgggcatcagcctgggcatcgaccaggacagcgccgccttcctgctgagcaccatggccatcgccgaggtgttcagaagaatcggcgccggcttcgtgctgaacagagagcccatcagagtgatctacatcgagctgatctgcgtgatcctgctgaccgtgagcctgttcgccttcaccttcgccagagagttctggggcctgatgagctgcagcgtgttcttcggcttcatggtgggcaccaccggcggcacccacatccccctgctggccgaggacgacgtggtgggcatcgagaagatgagcagcgccgccggcgtgtacatcttcatccagagcatcgccggcctggccggcccccccctggccggcctgctggtggaccagagcaagatctacagcagagccttctacagctgcgccgccggcatggccctggccgccgtgtgcctggccctggtgagaccctgcaagatgggcctgtgccagcaccaccacagcggcgagaccaaggtggtgagccacagaggcaagaccctgcaggacatccccgaggacttcctggagatggacctggccaagaacgagcacagagtgcacgtgcagatggagcccgtgtag

SEQ ID NO: 23750 - DNA, 582 bp, Artificial Sequence
  Description of Artificial Sequence: Synthetic coding sequence
atgaacatcttcatgaccttcgtgatcaacgtgctgagaaagaacctgttccacggcttcatggtgatcacccaggcccccgtgagaatcctgcccagccaggagagaatcagaaccccctgccacagccccgccatcctgctgagcagctgcagagtgctgagcggcaacaactgcatcatggccgccctgaccagcgtgatcaagagaaacctgctgttcttcagactggacctgttccccctgtggctgatcttcctgtacatcgtgaagatgggcgacttccccagcgcccccacccacctgaacaccgccgccatctgcacctgcctgctgcccatccccctgggcacccacagcgacctgctgagcgtgagctgcagctggttccacctgttcgagaagggcccccccctgagctacaagcacctggtgagacaggtgcaccccctgatgaacgccgacaccgccgccggcggcttcgtgtacacctgcaaggacaagctgagaagcctgctgttcggcgaggtgaaggaggacggcaacggctgcttcatctgcatgagcctggagcagtgctag

SEQ ID NO: 23751 - DNA, 99 bp, Artificial Sequence
  Description of Artificial Sequence: Synthetic coding sequence
gacaccgagaacagccccggcgagctgagcctgagcagaaagaccgaggcccagagaggcgaggccatccacccccagagccacagcagagacggctag

SEQ ID NO: 23752 - DNA, 915 bp, Artificial Sequence
  Description of Artificial Sequence: Synthetic coding sequence
atggtggccaccggctgggccagaagaagcggcctgcaccccgcccccagacccctgagaggcgcccaggaggccctggccaagaacctgtggagagaggagagaaacagacccctgatcctgagcagcctgatcatcaagaagctgcactggcccgagcaggagctggccaagaagagcatcctgaacgccgaggacagcctgatcatcgacaacaagagaagcatcagccacctgagcagcggcgtgctgaaggacatcttcaccaccggcaccagcagctacaacgtgctgctgcagagcaaggaggagaagaagtaccacagccagaagcagagcagcagcacctacagcaagagatgcagaaagcccagcaagagccccaacaccagcagaagcaaggaccccagaagaatgaaggccctggtgcccgtgaccagcagcggcacctggtactgcctggagagaagacccgccgtgttcgtgaccagcagcgtgagcagccccgtgaagttcacccacgacatcagcgtgaccggcaacggcatcgtgctgccccccaagcccaagagcaaggtgaagtggtgccacttcagcaccctgcccaagcccaagccccagctgagcagaagcttcgagaagggcgacgacttcagcggcaagaagttctgcatcctgaccgccatcaagcccaccaacctggagaaggagaagctgagattcttcaagagcgactacacctacaacccccagttcgagtacgccaaccccgccctgcccagcgtgctggccaagcacagccacgccagcgacagattcctgaagcaggtgaagtgccacttcaacagcggcagcagcttcctgtgcaccaagaccatcatctgcgacctgatcagcaagaacaaggacatctag

SEQ ID NO: 23753 - DNA, 402 bp, Artificial Sequence
  Description of Artificial Sequence: Synthetic coding sequence
atgggccaggacgccggcagactgcagagaagaagcagagtgggcttcggcgagaacggcgcctgcagaaaggagagacagaagctggccctggagggcagcaagaagggcccctggaagggcagaagcggcgacagaaagggcaacagcaagggccaggaggagctgggcagaggcgccagagtgaacaccgagtggcccatgcccagaatgagagactggaaggagagaagaggccccagcagagaggaggcccacaagagcctgggcagacagggcatgggcctgcagagaggcgagggcgtgagagccgtggccgccagagtgctgtgccacccctgccccctgagcagaggcctgcagcacaacagaggcgacagattcgtgtggggccaggtgtag

SEQ ID NO: 23754 - DNA, 255 bp, Artificial Sequence
  Description of Artificial Sequence: Synthetic coding sequence
atggtgctggccagcttcacccagaacatgaacatcaagtgctgcgagttcgtgtgccaggtggtgcagaagtacatcatcaacaacctggtgaagaagagaaactgcgagcccagctggagcgtgtacagcatcctgtgcctgtacgtgatcttcagcagcaacagattcatcatcatcggcttcaccaagagaagcagaaagaagagcgagggcgagatcgccagcaccgccctgcaggccaccagcggctag

SEQ ID NO: 23755 - DNA, 156 bp, Artificial Sequence
  Description of Artificial Sequence: Synthetic coding sequence
ctgaagcccggcttcttcctgagcttcttcatcagcatgacctacctgttcagcttcttcttcttcggcaagagcttcagaagcctgctgggcgagggcttcagcctgtgcctgagcctgagcctgacccacacccacacccacacccacagctag

SEQ ID NO: 23756 - DNA, 438 bp, Artificial Sequence; identical to SEQ ID NO: 23625
  Description of Artificial Sequence: Synthetic coding sequence

SEQ ID NO: 23757 - DNA, 3144 bp, Artificial Sequence
  Description of Artificial Sequence: Synthetic coding sequence
atggcccactgcggccagctgaccaactggctgtgcctggcctgggagagaaaggagagccccgacttcctgagcatcttcctgagatacatcgacctgacccccaagctgcacaagatctgcagcgacaagaccatcacccagaagacccactgcctgctgcccctgatcagcagcgccctgagcagcatcgtgctgatccagggctggtggcagaagaccgcccacaagtacgcctacaagggcgccaagcacatcgagcagcagaacccccagagcagacacagacccagacccgccggcgccctgccccagatcagcagagacagcagacagagatgcctgctgctgagattcctggtgagacccagaggcttcagcttcagcttcgccgagcccgccgccgccttccccggcgccaccgccatggccgccagcctgagcgagagactgttcagcctggagctgctggtggactgggtgagactggaggccagactgctgcccagccccgccgccgccgtggagcaggaggaggaggaggaggagaaggagcagggcgaggccagcagccccagaggcctgtgccccgccgtggccttcagactgctggacttccccaccctgctggtgtacccccccgacggccccggcgcccccgccgccgagccctggcccggcgtgatcagattcggcagaggcaagagctgcctgttcagactgcagcccgccaccctgcactgcagactgctgagaacccccctggccaccctgctgctgcagctgccccccggcagacccacccccaccccccagctgctgggcgcctgcgacatcagcctggccaccgccgcccacagagtggtgggccccgccgccagcggctgcagccacagacacagaggcagattccccctgcacaacagagtgggcgagagaaccggcgacatcgccctggcctacagactgaccgacctgggcagcagactgctgagccagctggagagacccctgaccttcaccagaaccggcggcggcgccgaggtgagcccccagacccagcaggagagacagcagctgcagcagcccgccagccagcccagccccaaggaggccgacaagcccctgggcgagctggagatccccgaggcccagaaggacctgaaggagatggtgaagagcaaggccgagtgcgacaacgtgggcagcgtggagaacggcaagaccaacagcgtggtgacctgcagcggcgccggcaacggcagaaacgtgagcagcctgaacgaggaggtgaccgagctggacatggagaccaacatcttctgccccccccccctgtactacaccaacctgacccaggagaagcccccccccgcccaggccaagatcaccatcgagccccagatgaacgcccccgaggagatggacgacgccagccccgagaagaagagagtgaacccccccgcccacagaagctgcctgaagcaccccagcagcgccgcccacgagcacccccccatgctggtgaaccccccccacatccagaacatcggcgccaccaaccagacctgccagaccgagcagaacagaatcaacaccatcagacagctgcccctgctgaacgccctgctggtggagctgagcctgctgtacgaccagcccgtgaccagccccgcccacatccacccccacctggcctggctgtacagaaccgaggacaagaagagccccgagagcagcgccaagagcacctgcagaagcgaggccaagaaggacaagagaagcgtgggcggctgcgagaagagcgtgagcctgcagtacaagaagaaccagatcgagaactacaaggaggacaagtacagcgagaagagcagcggcgccctgcacaagagagtgcccaagggcagactgctgtacggcctgaccaacaccctgagactgagactgaagctgaccaaccccgacatgctggtggtgcacgagaagagagagctgtacagaaagagacagagccagatgctgggcaccaagttcagaatccccagcagcaaggtgaagctgctgagcagcgccgagcagagccagaagccccagctgcccgaggacaagtacctggacagcgacgccagcttcaccgagaacagcgacaccagcagacagatcagcggcgtgttcgacgagcccagcaccagcaaggagaccaagctgaagtacgccaccgagaagaagaccgtggactgcagcaagaacagaatcaacaacgtgagcctggaggaggtggtgagccccgccaacagcatcatccccgagagactgacccccaccaacatcctgggcggcaacgtggagatgaagatccagagcccctgcgtgttccagcaggacgccgtggtggacagaatcgtggacaaggagatcgacatcagacaggtgaagaccaccgacaacgacatcctgatggccgacatcagcgacaagagaaccggcaagaacagctgctacgagaacatcagcgagctgaagtacagcgacgacctgagcagcccctgctacagcgaggacttctgcaccagcgaggacaccagcagaagcttcaaggcccacgacagcagcagcagaaccgagaaccccaagcacagccagtacaccagcaagagcagcgacaccggcgtgagcaagaagaagaacagcagcgacagaagcagcatcctgagcccccccttcagcgccggcagccccgtgcacagctacagaaagttccacatcagcaagacccaggacaagagcctggaggaggccagcagcatcagcgccagcgacctgagcagcacccactggaccgagcagaaggagaaccagatcgaccagaacagcatgcacaacagcgagatcaccaagagagcccaggacatcagcgtgaagaccagaagcagctggaagagcctggagaagagccagagcccccagaccagccaggtgagcagctacctgcccagcaacgtgagcgagctgaacgtgctggacagcagcaccagcgaccacttcgaggagggcaacgacgacgtgggcagcctgaacatcagcaagcagtgcaaggacatctgcgagctggtgatcaacaagctgcccggctacaccatgtag

SEQ ID NO: 23758 - DNA, 561 bp, Artificial Sequence
  Description of Artificial Sequence: Synthetic coding sequence
agaagcctgctgaaggagctggagaacaccaaggaccacaccctgctgctggagaagagactgaagaagctgagcagagagggcagcagccaccacctgcccagacaggtgagacccggccccgtgtacaagcccgcccccgccagaaaccacagacccagaggcggcagaggcaaggccagccccaccagcttccacgtgagccccagagcccccctggcccccctggccagcatgcccagcagcgtgcccaagaccagcatcgagagcctgggcagccccagcagcctgagcagcagccaggccagcgagcccctgtgccccctgaagcaccccagccacagaccccccgccagcaccctgagccccaacctgaccagcagcaccgagagcctgggcctgctgagcagagagaccccccacgccggcagaagaagacagggcagcagattcccccagcccggctgcgccaacgccgccggcagaaccagacaccagaaccccagacacagccacggccacagaatcagcgacatccacgagcagctgggcatcagctag

SEQ ID NO: 23759 - DNA, 405 bp, Artificial Sequence
  Description of Artificial Sequence: Synthetic coding sequence
atgagagagcccatctacatccacagcaccatggtgttcctgccctgggagctgcacaccaagaagggcaagatggccctgctggccagcaacggctgcttcatcagatgcaacgaggccggcgacatcgaggccaagagcaagaccgccggcgaggaggagatgatcaagatcagaagctgcgccgagagagagaccaagaagaaggacgacatccccgaggaggacaagggcaacgtgaagcagtgcgagatcaactacgtgaagaagttccagagcttccaggagcacaagctgaagatcagcaaggaggacagcaagatcctgaagaaggcccagaaggacggcttcctgcaggagaccctgctggacagagtggccgtgatcgcctgcctgcacctgtag

SEQ ID NO: 23760 - DNA, 447 bp, Artificial Sequence
  Description of Artificial Sequence: Synthetic coding sequence
atggagcacatgctgctggccaaccacaccgacaaggccaccttcaccggcacccagagacagagaagctgcagcggcgccagcgtgagccagcccagacccctgagaggcaagctggtgggctactgggacccccacagcagactgctgagcagaggcagagccctgggcagcgtgagcgcccccagcacccccagaggcagaggctggaaggccaccttcgacggctgcatcctgcacgacgacctgctgaccaaggtgcacggcttccagagcctgatcggcctgcagcagcacctggcctgcggcgacagcggcagcctgatgaagaactgccacgacgtgagaaagagcctgagcgagagaggctggggcgccgcctgctggggcggcggcggcgtggccagcagagagaagctgcaccccctggccgagagcggcacctag

SEQ ID NO: 23761 - DNA, 1296 bp, Artificial Sequence
  Description of Artificial Sequence: Synthetic coding sequence
atgtggccccagccccacctgcccacccacccccacctgcccacccacccccacctgcccacccacccccacctgcccacccaccccatgatgagcaaggagaccagacagagcaagctggccgaggccaaggagcagctgaccgaccaccacccccagaccaaccccagcgtgggcaccgccgccagcgacaccaagaagaagaagatcaacaacggcaccaaccccgagaccaccaccagcggcggctgccacagccccgaggacgagcagaaggccagccaccagcaccaggaggccctgagaagagagctggaggcccaggtgcacaccatcagaatcctgacctgccagaagaccgagctgcagatggccctgtactacagccagcacgccgtgaagcagctggagggcgaggccagagacctgatcagcagactgcacgacagctggaagttcgccggcgagctggagcaggccctgagcgccgtggccacccagaagaagaaggccgacagatacatcgaggagctgaccaaggagagagacgccctgagcctggagctgtacagaaacaccatcaccgacgaggagctgaaggagaagaacgccaagctgcaggagaagctgcagctggtggagagcgagaagagcgagatccagctgaacgtgaaggagctgaagagaaagctggagagagccaagctgctgctgccccagcagcagctgcaggccgaggccgaccacctgggcaaggagctgcagagcgtgagcgccaagctgcaggcccaggtggaggagaacgagctgtggaacagactgaaccagcagcaggaggagaagatgtggagacaggaggagaagatccaggagagagaggagaagatccaggagcaggaggagaagatcagagagcaggaggagaagatcagagagcaggaggagatgatgcaggagcaggaggagaagatgggcgagcaggaggagaagatgcaggagcaggagaagatgagaagacaggaggagaagatcagagagcaggaggagaagatcagagagcagaaggagaagatcagagagcaggaggagaagatctgggagcaggaggagaagatcagagagcaggaggagatgatgcaggagcaggaggagaagatgtgggagcaggaggagaagatgtgcgagcaggaggagaagatgcaggagcaggaggagaagatgagaagacaggaggagaagatgagagagcaggaggtgagactgagacagcaggaggagaagatgcaggagcactag

SEQ ID NO: 23762 - DNA, 1701 bp, Artificial Sequence
  Description of Artificial Sequence: Synthetic coding sequence
atgaagatgcagaagggcaacgtgctgctgatgttcggcctgctgctgcacctggaggccgccaccaacagcaacgagaccagcaccagcgccaacaccggcagcagcgtgatcagcagcggcgccagcaccgccaccaacagcggcagcagcgtgaccagcagcggcgtgagcaccgccaccatcagcggcagcagcgtgaccagcaacggcgtgagcatcgtgaccaacagcgagttccacaccaccagcagcggcatcagcaccgccaccaacagcgagttcagcaccgtgagcagcggcatcagcatcgccaccaacagcgagagcagcaccaccagcagcggcgccagcaccgccaccaacagcgagagcagcacccccagcagcggcgccagcaccgccaccaacagcgacagcagcaccaccagcagcggcgccagcaccgccaccaacagcgacagcagcaccaccagcagcgaggccagcaccgccaccaacagcgagagcagcaccaccagcagcggcgccagcaccgtgaccaacagcgagagcagcaccgtgagcagcagagccagcaccgccaccaacagcgagagcagcaccaccagcagcggcgccagcaccgccaccaacagcgagagcagaaccaccagcaacggcgccggcaccgccaccaacagcgagagcagcaccaccagcagcggcgccagcaccgccaccaacagcgagagcagcacccccagcagcggcgccggcaccgccaccaacagcgagagcagcaccaccagcagcggcgccggcaccgccaccaacagcgagagcagcaccgtgagcagcggcatcagcaccgtgaccaacagcgagagcagcacccccagcagcggcgccaacaccgccaccaacagcgagagcagcaccaccagcagcggcgccaacaccgccaccaacagcgacagcagcaccaccagcagcggcgccagcaccgccaccaacagcgagagcagcaccaccagcagcggcgccagcaccgccaccaacagcgagagcagcaccaccagcagcggcgccagcaccgccaccaacagcggcagcagcaccaccagcagcggcaccagcaccgccaccaacagcgagagcagcaccgtgagcagcggcgccagcaccgccaccaccagcgagagcagcaccaccagcagcggcgccagcaccgccaccaacagcgagagcagcaccgtgagcagcggcgccagcaccgccaccaacagcgagagcagcaccaccagcagcggcgccaacaccgccaccaacagcggcagcagcgtgaccagcgccggcagcggcaccgccgccctgaccggcatgcacaccaccagccacagcgccagcaccgccgtgagcgaggccaagcccggcggcagcctggtgccctgggagatcttcctgatcaccctggtgagcgtggtggccgccgtgggcctgttcgccggcctgttcttctgcgtgagaaacagcctgagcctgagaaacaccttcaacaccgccgtgtaccacccccacggcctgaaccacggcctgggccccggccccggcggcaaccacggcgccccccacagacccagatggagccccaactggttctggagaagacccgtgagcagcatcgccatggagatgagcggcagaaacagcggcccctag

SEQ ID NO: 23763 - DNA, 183 bp, Artificial Sequence
  Description of Artificial Sequence: Synthetic coding sequence
aagggctgggtgagccacctgttcctggcccccaccaacttcgaggagttcaccgcccccgccacccccccccactgcagccagtgcctgagaagcaactgcagcacctgggccaccgccgccatcatcgagagaagcctgcaggtgcccttcctgtacctgagcacccccggcggccactag

SEQ ID NO: 23764 - DNA, 399 bp, Artificial Sequence
  Description of Artificial Sequence: Synthetic coding sequence
atgagccagccctggctgtacagccagtgcatcatcagcggcaagcccagcgaggaggccgccggcgagaacggcagcatcagcgccgccctgagacccctgctgctggtggccgacgtgcccgtgctgggctacctgtgccccagcagcgtgagcagcggcgtgtgcgaggccaagctgctgggctggggcctgggcggcgtgagcgccgcccccgaggccaagaccaaggccgaggccgaggccgaggccgaggccaccctggtgagaagaaagctgcaggtggagaagctggtggacagagacctggacctgaccgtgatcctgatggtgcccatgcccagcgccagaagaccccccgccctggccaccaccggcagctgcagcccccccggctag

SEQ ID NO: 23765 - DNA, 1395 bp, Artificial Sequence
  Description of Artificial Sequence: Synthetic coding sequence
atgagaagacacagcgagaccgacgtggaggagcagacccaggagctgaagaccatcacccagctgcaggagcagtgcagagccctgcagatccagggcgtgaaggagaacatggaccagaacaaggccaccctggccctgctgagaagcaacatcagaagaggcgcccaggactgggccctggccaagaagtacgaccagtggaccatcagcaaggcctgcggcaagaacctgcccctgagactggcccactgcagaagcaccatggaggtggtgagagagaagctgagaaagtacgtgttcgacagagtgaacatgcacaacctgctgatccacctggtgagaagaagaggccagaagctggagagcatgcagctggagctggacagcctgagaagccagcccgacgccagcaaggaggagctgagactgctgcagatcatcagacagctggagaacaacatcgagaagaccatgatcaagatcatcaccagccagaacatccacctgctgtacctggacctgctggactacctgaagaccgtgctggccggctaccccatcgagctggacaagctgcagaacctggtggtgaactactgcagcgagctgagcgacatgaagatcatgagccaggacgccatgatgatcaccgacgaggtgaagagaaacatgagacagagagaggccagcttcatcgaggagagaagagccagagagaacagactgaaccagcagaagaagctgatcgacaagatccacaccaaggagaccagcgagaagtacagaagaggccagatggacctggacttccccagcaacctgatgagcaccgagaccctgaagctgagaagaaaggagaccagcaccgccgagatggagtaccagagcggcgtgaccgccgtggtggagaaggtgaagagcgccgtgagatgcagccacgtgtgggacatcaccagcagattcctggcccagagaaacaccgaggagaacctggagctgcagatggaggactgcgaggagtggagagtgcagctgaaggccctggtgaagcagctggagctggaggaggccgtgctgaagttcagacagaagcccagcagcatcagcttcaagagcgtggagaagaagatgaccgacatgctgaaggaggaggaggagagactgcagctggcccacagcaacatgaccaagggccaggagctgctgctgaccatccagatgggcatcgacaacctgtacgtgagactgatgggcatcaacctgcccgccacccaggtgcccggcgtgagactgagctgccacacccccggcccctgggccggccccgagggcagacaggcccagagactgatcgagggcaagctgaaggccgccaagaagaagaagaagtag

SEQ ID NO: 23766 - DNA, 381 bp, Artificial Sequence
  Description of Artificial Sequence: Synthetic coding sequence
agcggcagccccgccggcctgctgaagggcgacagcaagaagcccagccagagaagagtgaagagacagccctacagcaccaccaaggtgaccagcggcagcaccttcaacgagaacaccagaagatacgccgtgcacaccaaccagtgcagaagaccccacggcagcagagtgaagaagaagagatacccccaggaggacgacttccaccacaccgtgttcagcaacctggagagactggacaagctgcagcccaccctggaggccagcgaggagagcctggtgcacaaggacagaggcgacggcgagagacccgtgaacgccagagtggtgcaggtggcccccctgagactggagagcagaatcagcatcggcgagtag

SEQ ID NO: 23767 - DNA, 1314 bp, Artificial Sequence
  Description of Artificial Sequence: Synthetic coding sequence
atgtggccccagccccacctgcccacccacccccacctgcccacccacccccacctgcccacccacccccacctgcccacccacccccacctgcccacccaccccatgatgagcaaggagaccagacagagcaagctggccgaggccaaggagcagctgaccgaccaccacccccagaccaaccccagcgtgggcaccgccgccagcgacaccaagaagaagaagatcaacaacggcaccaaccccgagaccaccaccagcggcggctgccacagccccgaggacgagcagaaggccagccaccagcaccaggaggccctgagaagagagctggaggcccaggtgcagaccatcagaatcctgacctgccagaagaccgagctgcagatggccctgtactacagccagcacgccgtgaagcagctggagggcgaggccagagacctgatcagcagactgcacgacagctggaagttcgccggcgagctggagcaggccctgagcgccgtggccacccagaagaagaaggccgacagatacatcgaggagctgaccaaggagagagacgccctgagcctggagctgtacagaaacaccatcaccgacgaggagctgaaggagaagaacgccaagctgcaggagaagctgcagctggtggagagcgagaagagcgagatccagctgaacgtgaaggagctgaagagaaagctggagagagccaagctgctgctgccccagcagcagctgcaggccgaggccgaccacctgggcaaggagctgcagagcgtgagcgccaagctgcaggcccaggtggaggagaacgagctgtggaacagactgaaccagcagcaggaggagaagatgtggagacaggaggagaagatccaggagagagaggagaagatccaggagcaggaggagaagatcagagagcaggaggagaagatcagagagcaggaggagatgatgcaggagcaggaggagaagatgggcgagcaggaggagaagatgcaggagcaggagaagatgagaagacaggaggagaagatcagagagcaggaggagaagatcagagagcagaaggagaagatcagagagcaggaggagaagatctgggagcaggaggagaagatcagagagcaggaggagatgatgcaggagcaggaggagaagatgtgggagcaggaggagaagatgtgcgagcaggaggagaagatgcaggagcaggaggagaagatgagaagacaggaggagaagatgagagagcaggaggtgagactgagacagcaggaggagaagatgcaggagcactag

SEQ ID NO: 23768 - DNA, 597 bp, Artificial Sequence
  Description of Artificial Sequence: Synthetic coding sequence
tgaaccagcagacagacctgggtggccaccaacaccctgagcaaggccgccttcctgctgaccgtgctgagcgagagacccgagcaccacaacctggccttcagagtgggcatgttcgccctggagctgcagagaccccccgccagcaccaaggccctggaggtgaagctggcctaccaggagagcgaggtggccgccctgctgaagaagatccccctgggccccagcgagatgagcaccatgagatgcagagccgaggagctgagagagggcaccctgtgcgactacagacccgtgctgcccctgatgctggccagcttcatcttcgacgtgctgtgcgcccccggcagcagaccccccagcagaaactggaacagcgagacccccggcgacgaggagctgggcttcgaggccgccgtggccgccctgggcatgaagaccaccgtgagcgaggccgagcaccccctgctgtgcgagggcaccagaagagagaagggcgacctggccctggccctgatgatcacctacaaggacgaccaggccaagctgaagaagcccggccagcagagcgagaccctgagcctgaagaagaagtag

SEQ ID NO: 23769 - DNA, 4188 bp, Artificial Sequence; identical to SEQ ID NO: 23592
  Description of Artificial Sequence: Synthetic coding sequence

SEQ ID NO: 23770 - DNA, 366 bp, Artificial Sequence
  Description of Artificial Sequence: Synthetic coding sequence
atggagttcgtgctgagctgggtgttcctggtggccatcctgaagggcgtgcagtgcgaggtgcagctggtgcagagcggcggcggcctggtgcaccccggcggcagcctgagactgagctgcgccggcagcggcttcaccttcagcagctacgccatgcactgggtgagacaggcccccggcaagggcctggagtgggtgagcgccatcggcaccggcggcggcacctactacgccgacagcgtgaagggcagattcaccatcagcagagacaacgccaagaacagcctgtacctgcagatgaacagcctgagagccgaggacatggccgtgtactactgcgccagagacaccgtgagaggctag

SEQ ID NO: 23771 - DNA, 777 bp, Artificial Sequence
  Description of Artificial Sequence: Synthetic coding sequence
agaagcctgctgaaggagctggagaacaccaaggaccacaccctgctgctggagaagagactgaagaagctgagcagagagggcagcagccaccacctgcccagacaggtgagacccggccccgtgtacaagcccgcccccgccagaaaccacagacccagaggcggcagaggcaaggccagccccaccagcttccacgtgagccccagagcccccctggcccccctggccagcatgcccagcagcgtgcccaagaccagcatcgagagcctgggcagccccagcagcctgagcagcagccaggccagcgagcccctgtgccccctgaagcaccccagccacagaccccccgccagcaccctgagccccaacctgaccagcagcaccgagagcctgggctacctgagcagcctgagcagcagccagccccccgagcccctgagacccctggagtgccccagccacaagccctgcggcagaagcctgcccagaagaagaaaccccggctgggtgagctggagcgacagcatgcaggccgacagcgagaccgacgccatcatctgccccatgtgcaaggcccccgagagaagctgcccccacacctggtgggtgcccagcagccccagagtgatcagaggcgtgggcagatgcagcgaccccaacctgggcctgagctggagacaggaggccgccagagcctggtgccactgcaccagcagccagtaccccttcaagcaccccaacctgcccacccacctgcccaaggccagcttctag

SEQ ID NO: 23772 - DNA, 2253 bp, Artificial Sequence
  Description of Artificial Sequence: Synthetic coding sequence
gactacgcccacaccctgacctgcgtgaccgagagagagaagttcatcgtgcccatcaaggccagaggcgccagagccatcctggacttccccgacaagctgaacttcagcacctgccccgtgaagtacagcacccagaagatcctgctggtgagaaacatcggcaacaagaacgccgtgttccacatcaagacctgcagacccttcagcatcgagcccgccatcggcaccctgaacgtgggcgagagcatgcagctggaggtggagttcgagccccagagcgtgggcgaccacagcggcagactgatcgtgtgctacgacaccggcgagaaggtgttcgtgagcctgtacggcgccgccatcgacatgaacatcagactggacaagaacagcctgaccatcgagaagacctacatcagcctggccaaccagagaaccatcaccatccacaacagaagcaacatcatcgcccacttcctgtggaaggtgttcgccacccagcaggaggaggacagagagaagtacagagcctgcgacgacctgatcaaggaggagaaggacgagaccgacgagttcttcgaggagtgcatcaccgaccccctgctgagagagcacctgagcgtgctgagcagaaccttcgccaaccagagaagactggtgcagggcgacagcaagctgttcttcaacaacgtgttcaccgtggagcccctggagggcgacgtgtggcccaacagcagcgccgagatcaccgtgtacttcaaccccctggaggccaagctgtaccagcagaccatctactgcgacatcctgggcagagagatcagactgcccctgagaatcaagggcgagggcatgggccccaagatccacttcaacttcgagctgctggacatcggcaaggtgttcaccggcagcgcccactgctacgaggccatcctgtacaacaaggacagcatcgacgccctgttcaacatgaccccccccaccagcgccctgggcgcctgcttcgtgttcagccccaaggagggcatcatcgagcccagcggcgtgcaggccatccagatcagcttcagcagcaccatcctgggcaacttcgaggaggagttcctggtgaacgtgaacggcagccccgagcccgtgaagctgaccatcagaggctgcgtgatcggccccaccttccacttcaacgtgcccgccctgcacttcggcgacgtgagcttcggcttcccccacaccctgatctgcagcctgaacaacaccagcctgatccccatgacctacaagctgagaatccccggcgacggcctgggccacaagagcatcagctactgcgagcagcacgtggactacaagagacccagctggaccaaggaggagatcagcagcatgaagcccaaggagttcaccatcagccccgactgcggcaccatcagaccccagggcttcgccgccatcagagtgaccctgtgcagcaacaccgtgcagaagtacgagctggccctggtggtggacgtggagggcatcggcgaggaggtgctggccctgctgatcgccgccagatgcgtggtgcccgccctgcacctggtgaacaccgaggtggacttcggccactgcttcctgaagtacccctacgagaagaccctgcagctggccgaccaggacgacctgcccggcttctacgaggtgcagccccaggtgtgcgaggaggtgcccaccgtgctgttcagcagccccacccccagcggcgtgatcagccccagcagcaccatccacatccccctggtgctggagacccaggtgaccggcgagcacagaagcaccgtgtacatcagcatcttcggcagccaggacccccccctggtgtgccacctgaagagcgccggcgagggccccgtgatctacgtgcaccccaaccaggtggacttcggcaacatctacgtgctgaaggacagcagcagaatcctgaacctgtgcaaccagagcttcatccccgccttcttccaggcccacatggcccacaagaagagcctgtggaccatcgagcccaacgagggcatggtgccccccgagaccgacgtgcagctggccctgaccgccaacctgaacgacaccctgaccttcaaggactgcgtgatcctggacatcgagaacagcagcacctacagaatccccgtgcaggccagcggcaccggcagcaccatcgtgagcgacaagcccttcgcccccgagctgaacctgggcgcccacttctag

SEQ ID NO: 23773 - DNA, 294 bp, Artificial Sequence
  Description of Artificial Sequence: Synthetic coding sequence
gaggtgcagctggtgcagagcggcggcggcctggtgcagcccggcggcagcctgagactgagctgcgccggcagcggcttcaccttcagcagctacgccatgcactgggtgagacaggcccccggcaagggcctggagtgggtgagcgccatcggcaccggcggcggcacctactacgccgacagcgtgaagggcagattcaccatcagcagagacaacgccaagaacagcctgtacctgcagatgaacagcctgagagccgaggacatggccgtgtactactgcgccagatag

SEQ ID NO: 23774 - DNA, 714 bp, Artificial Sequence
  Description of Artificial Sequence: Synthetic coding sequence
tgaacctaccacagaatccccatgcccgacttctgcgcccccagagaggaggacttcgaccagctgctggaggccctgagagccgccctgagcaaggaccccggcaccggcttcgtgttcagctgcctgagcggccagggcagaaccaccaccgccatggtggtggccgtgctggccttctggcacatccagggcttccccgaggtgggcgaggaggagctggtgagcgtgcccgacgccaagttcaccaagggcgagttccaggtggtgatgaaggtggtgcagctgctgcccgacggccacagagtgaagaaggaggtggacgccgccctggacaccgtgagcgagaccatgacccccatgcactaccacctgagagagatcatcatctgcacctacagacaggccaaggccgccaaggaggcccaggagatgagaagactgcagctgagaagcctgcagtacctggagagatacgtgtgcctgatcctgttcaacgcctacctgcacctggagaaggccgacagctggcagagacccttcagcacctggatgcaggaggtggccagcaaggccggcatctacgagatcctgaacgagctgggcttccccgagctggagagcggcgaggaccagcccttcagcagactgagatacagatggcaggagcagagctgcagcctggagcccagcgcccccgaggacctgctgtag

SEQ ID NO: 23775 - DNA, 648 bp, Artificial Sequence
  Description of Artificial Sequence: Synthetic coding sequence
tacggcgtgtgcagcgtgggcctggagtggctggcctacctgctggtgccctacagcctgggcgccagcgccaccagcctgctgggcctgctgggcctgtggctgcccagacccgtgcccctggtggccggcgccggcgtgcacctgctgctgaccttcatcctgttcttctgggcccccgtgcccagagtgctgcagcacagctggatcctgtacgtggccgccgccctgtgggtggtgggcagcagcctgaacaagaccggcctgagcaccctgctgggcatcctgtacgaggacaaggagagacaggacttcatcttcaccatctaccactggtggcaggccgtggccatcttcaccgtgtacctgggcagcagcctgcacatgaaggccaagctggccctgctgctggtgaccctggtggccgccaccgtgagctacctgagaatggagcagaagctgagaagaggcgtggcccccagacagcccagaatccccagaccccagcacaaggtgagaggctacagatacctggaggaggacaacagcgacgagagcgacgccgagggcgacctgggcgacggcgaggaggccgaggccgaggccccccccgccggccccagacccggccccgagcccgccggctag

SEQ ID NO: 23776 - DNA, 3828 bp, Artificial Sequence
  Description of Artificial Sequence: Synthetic coding sequence
atggactgggacgacgagtacagccacaacagcttcgacctgcactgcctgctgaacagcttccccggcgacctggagttcgagcagatcttcagcgacatcgacgagaagatcgagcagaacgccgccagcatcaagcactgcatcaaggagatccagagcgagatcaacaagcagtgccccggcgtgcagctgcagaccaccaccgactgcttcgagtggctgaccaactacaactacagcaccagcgagagcagcttcatcagccacggcgacctgatcaagttcttcaagaccctgcaggacctgctgaagaacgagcagaaccaggaggagatgaccctggacctgctgtgggacctgagctgccacagcagcgtgagcttccccagcaccctgagcggcaccagcttccacttcctgagcagaaccagcctgcacagcgtggaggacaacagcagcatggacgtgaagagcatgtgggacgacatcagactgcacctgagaagattcctggtgagcaagctgcagagccacaacgagatcaacaacagccagcagaagatcctgctgaagaagcagtgcctgcagcagctgctgttcctgtaccccgagagcgaggtgatcatcaagtaccagaacatccagaacaagctgctggccaacctgctgtggaactgcttccccagctacaacagagacagcaacctggacgtgatcgcccacggctaccagagcaccatgctgaagctgtacagcgtgatcaaggaggacttcaacaccctgtgcgagatcctggcccccagcagcatggtgaagttcatcaaggagacctacctggacaccgtgaccgaggagatggccaagttcctggagaacttctgcgagctgcagttcagagagaacgccgtgagagtggtgaagaccagcaagagcagcagcaagcacagaggcgccgtgcacgccctggtgaccaccgagtgcccccagaagggcagaaacttcagcctgcccctggacaaggtggagttcctgagccagctgatcaagagcttcatgaagctggagaagggcgtgcaggagctgttcgacgagatcctgctgagcctgaagatcaccagagacaccagcggcatcctggagaagagcgacagagaggtggtgatggagaagcccagagccaacgagaccaacatccccagcgagcagagcctgcccggcaaggaggccaccctgctggacttcggctggagaagcgccttcaaggaggtgagcctgcccatggcccactgcgtggtgaccgccatcgagggcttcagcaccaagatcctgcagcaggagcagaacgagagaagcagcgccgtgagctacgccatgaacctggtgaacgtgcagcaggtgtggcaggacagccacatgttccccgaggaggagcagcccaagaagatcggcaagttctgcagcgacatcatggagaagctggacaccatgctgcccctggccctggcctgcagagacgacagcttccaggagatcagagccaacctggtggaggcctgctgcaaggtggccaccgccgtgctgcagagactgcaggagagagccaaggaggtgcccagcaaggcccccctgaagaacctgcacacctacctgagcaccgccgtgtacgtgttccagcacttcaagagatacgacaacctgatgaaggagatgaccaagaagcccatcttcctggtgctggtgcagagataccaggagttcatcaacaccctgcagttccaggtgaccaactactgcgtgagagtgtgcgccaccagcatcctgcaggacgccgagagccaccactgggacgactacaaggccttctacgagggcgagagatgcagcttcagcatccagatgtggcactacttctgctggagcctgcactacgacctgtggaccatcctgccccccaagctggcccaggagatcctggtggaggtgctggagaagagcctgagcctgctggccagcagatacgccagagcccaccccagcagaaagagaaccccccagctgagactggacgtgaccaccatcctgatctgcaccgagaacatgctgtggagcgtgtgcaccagcgtgcagaagctgctgaacccccaccagcacaccgacgacaagatcttcaagatccacacccactgcaacaacctgttcaccaccctggtgatcctgaccagccccctgaccgagctgtacaagaccttccagcacggcctggacgagagcgccagcgacagcctgaagagcttcttcaagcagcccctgtactgggtgagctgcatcagccacttctaccccagcctgctgagaacccccagcgccggcggcctgaaggccgagggccagctgaagctgctgctgagccagcccagatgcaactggaacctgctgctggagaccctgctgcaccacgacggcctgctgctgagaatcctgctgaagagcagcaagcaggtgagcgacaccgagaacaacctgaaccagggccccagcctgatggaggccatcttcaagatcctgtaccactgcagcttcagcccccagaccttcgccaacgtgttcgtgagctacatggaggaggagcagctgtgggacttcctgtacaacatccccgtgagcacctgcgtggagtacgagctggaggtgatcagatgcctgagactggccctgaccgacgccatcaaggacaccgtgcagcagatcgtgagcgtgatgagcagcagaagaaactgcgagaccaacctgaacaagcacatcgtgcccgactgcctgctggagagcatgcccaaggagtggaactacagccccaaggagaccaacagaaaggagagctgcaagagcttcaccagactgaccgcccaggccgtgagcatcgtgatcagcaagctgcccaccgtgatcgcctgcctgcccccccccgtgaagtacttcttcttcctgagcgagagaaagatgagcaagaagttcgtggagctgaagaaggccggcctgctggtgtggaacctgatcgtgatcatctgcagaatcttcgaggacggcaacaccgtggagctgctgaccggcgccagcctggacagatggagcaaggagaagctgggcctgatctgcatgtgcctgaagagcatcatgggcgaccagaccagcatccacaaccagatgatccagaaggtgatccagagcatcgagcagcagaagcccaactggatcgagagacagctgctgaaggccagaaagctgagcaccgagtgcgccttcatgaccatcgagaagagcaccgccctgcaggagggcgacgtggccctggagctgaccgagcagaagatcaacaccatggtgctggacctgtgccacaagcccggcggcagagagtacctgagacagatctaccacatcatgcagctgaacgaggagtacctgaaggagcagctgttcagcatgaacagcagcgaggagaagcccctgcccatcagacccctgaagaccaccctgagaagcatcgaggaccagcccagcgccttcaaccccttccacgtgtacaaggccttcagcgagaacatgctggaccagagcgccatcaccaagtggaactggaactgggccaagctgctgcccaactacctgagactggacaagatgaccttcagcgtgctgctgaagaacagatgggagatgaagaaggacgagaccctggaggaggaggagaaggccatcctggagcacctgaagcagatctgcaccccccagaacagcagcgccagcgacaacatcgaggagcagtag

SEQ ID NO: 23777 - DNA, 132 bp, Artificial Sequence
  Description of Artificial Sequence: Synthetic coding sequence
agactgagaagcagaccccaggccggcggcgccggcagcgccgccgcctgcggccccggccagggcagattcagaagagccgcccccagacccagcagcagcagagtgtgcggccagagaaccagcagatag

SEQ ID NO: 23778 - DNA, 585 bp, Artificial Sequence
  Description of Artificial Sequence: Synthetic coding sequence
atggtgacctggagccacagcaacagcaacaaggagctgaagcaggagaacagcgccctggccgagcagctgcaggtggtgctgatcgacaaggccggcatgcagtgcgacctggaggagctgaagaagaagctggagctgaccgagctgaccctgcagcagctgagcagctggtgcgaggcccccgacgccaaccagcagctgcagcagcccaccgacgagagagcccagctggaggcccacctgggccaggtgatggagtggctgaagtacctgcagatggagagagagcagtacgccgagtacctgcacggcgagagcgccatgtggtggcagagaatgagagagatgagcgagcaggtgcacaccctgagagaggagagagtgcacagcatgagcagagtgcaggagctggagaccatcctggccgagctgagaaaccagctgaacccctgccccagaagcctgcagcagggcccccccaagtggagcagaagctacaagcagagactgagcacctgcggcagaagctggagaatctggcaggacagcttcaagcccaagtggaagaagatgagagcctag

SEQ ID NO: 23779 - DNA, 879 bp, Artificial Sequence
  Description of Artificial Sequence: Synthetic coding sequence
atgatgttctactggctgctgagcatcgtgggcagacagagagccagccccggctggcagaactggagcagcgccagaaacagcgccagcgccgccgaggccagaagcatggccctgcccacccaggcccaggtggtggtgtgcggcggcggcatcaccggcaccagcgtggcccaccaccagagcaagatgggctggaaggacatcgtgctgctggagcagggcagactggccgccggcagcaccagattctgcgccggcatcctgagcaccgccagacacctgaccatcgagcagaagatggccgactacagcaacaagctgtaccaccagctggagcaggagaccggcatcagaaccggctacaccagaaccggcagcatcttcctggcccagacccaggacagactgatcagcctgaagagaatcaacgccggcctgaacgtgatcggcatccccagcgagatcatcagccccaagaaggtggccgagctgcaccacctgctgaacgtgcacgacctggtgggcgccatgcacgtgcccgaggacgccgtggtgagcagcgccgacgtggccctggccctggccagcgccgccagccagaacggcgtgcagatctacgacagaaccagcgtgctgcaggtgatgggcaagaagggccaggtgaccggcgtggagaccgacaagggccagatcgagtgccagtacttcgtgaactgcgccggccagctgctgtggatgctgatggaggagttcatcttcggcaccggcagagtggccagctgcctgggcgccctgagaagaacccagaaccagttcagcctgagagccagaaccagctggagattcagaatctacagaggcctgggcagcctgtag

SEQ ID NO: 23780 - DNA, 1989 bp, Artificial Sequence; identical to SEQ ID NO: 23698
  Description of Artificial Sequence: Synthetic coding sequence

SEQ ID NO: 23781 - DNA, 297 bp, Artificial Sequence
  Description of Artificial Sequence: Synthetic coding sequence
gtgtgcggcagcacccaggagaagaccgtgttcagactggaggccatgctggagagaaccgccggcgtgcagagcaaggaggccgccctggaggaggaggccgtgctgaaggtggaggacatcatggccgaggtggaggtggtggtggaggtggaggtggtggtggaggtggagcccgacgtgggctggcagaaggagggccagagagcccagcccggccccggccccagcacccccggccccagcatggacagcctggaggtgctgcacctggagctgggcagcgtgaacgcctag

SEQ ID NO: 23782 - DNA, 459 bp, Artificial Sequence
  Description of Artificial Sequence: Synthetic coding sequence
atgctgttcagcttcgagcacaaggccgtggccctgagcgccaccagaagagccacccccagaccccagccctgggtgctgggcctgcagggcagaggcggcgagggcgacgccagaacctgcggcgccggcagagagagaggcctgcccggccccgccctggacaccgagcccagatgggaccccagaagactgtgcgaggccctgagagcccccggcagaagactggagggcgccggccagccccccgccaccagcggcggccccgccaccagcggcagaagcaaggagccctggggccacatcagcggctgcggcgacccccccggcgccttcagaggcagcggcagaatctgccagggcaccagcggcgccagaccctgcttctgcagagcccccggctacccctggatggccgccctgtgccccagaagaagacccggcagacacagcggctag

SEQ ID NO: 23783 - DNA, 441 bp, Artificial Sequence
  Description of Artificial Sequence: Synthetic coding sequence
cccggcccccccggcagacccggcaagcccggcttccccaagcccggcggccccggcggccccgccatccccggcgcccccggcagacccttcgtgcccggcatccccggctggcccggcgcccccgccgcccccggcttccccatgcccagcggccccagaagccccggcggcccctggggccccggcggccccatcggccccatcagccccggccccggcatccccggcggccccggcggccccagaggccccggcagacccgccggccccaccagccccttcggcccctacggccccctgagccccggcttccccggcagccccggcacccccggcttccccaccgccgacggccccggcggccccggcaaccccggcagcccctggagccccggcctgccctaccccagaggccccgccggccccggcggcccctag

SEQ ID NO: 23784 - DNA, 84 bp, Artificial Sequence
  Description of Artificial Sequence: Synthetic coding sequence
gtgccccccctgcacagcagcctgggcgacagagccagattcctgagaccctgcctgaagaagaagaccaagaagaagagatag

SEQ ID NO: 23785 - DNA, 3063 bp, Artificial Sequence
  Description of Artificial Sequence: Synthetic coding sequence
cagctgagaagaagcgagctggagcacagcgtggacctggaggaggccctgggcagactggaggccgccgaggagagaagcaccggcctgtgccaggtgaacgccctgctgagagagcagctggagcacatgaagaaggccaacgacgccctgggcagagagctggccggcatgaccggcagcgtgcagagactgcagggcgagctggagctgagaagatgggcccagagacaggagcccagcagaaccagaagcggcggcctgggccagcccagagacctgctgctgctgtggagacaggccgtggtgctgggcaccgacctggccgagctgagagtggccaccgagagaggcctggccgacctgcaggccgacaccgccagaaccgccagaagactgcacaccgcctgcctgaacctggacagcaacctgagactgagcgccagcagcaccgccagcaccctgggccagcagctgagagacaaggccggcgagatgctgcagctgcagggcagatgggacgccgagaaggtggccctgcaggccagactgagcgagcagaccctgctggtggagaagctgaccgagcagaacgagcagaaggccaagaccatcgccgccctgagaaccgacctgcagaacctggtgggcggccaggacggcggcggctgcgtggccggcgtgtgccacccctgcagcggcgtgagccccgccaccggcagcctggtggcccaggaggacgccagatgcctggagctggccggcagcagcatcaccgagctgggcgagcccagaagacccctgagaagcccccagagagccaccagcccccaccagggcgccagccccccccacatctgcagccccgccaccctggaccccgccctgcaggccatgagagccgccatcgagagaagatggagaagagagcaggagctgtgcctgcagctgaagagcagccaggccctggtggccagcctgcaggagcagctgagcgagagcagaagagagctgtgggccgcccagaagctgcagcaggagagagccagagagcaggccagagagagagaggccctgagaggccagctggaggcccagagactggaggtgcagcagtgcagagccagctgcaagctgctgggcagagagaaggccgccctggagatggtggtggaggagctgaagggcaaggccgacgccgccgacgccgagaagcagggcctggaggccgaggccgccgagctgcagagaagcctgctgctgcaggccgagagaagagaggagctggccctgagaagagagagaagctgcagagccctggagaccagccagggcagactgcagcagctggaggagaaggtgagcggcctgagagaggagctggccagcgtgagagaggccctgagcaccgcccagctgcagagagacgtggtggagagcgagagagagggcctgagaagcgccctggccagagccgagtgcagcaacgccgacctggagctgctggtgagaagactgaagagcgagggcgtggagcagagagacagcctggccgccatggccgccctgatggagggcctggcccaggacaagagcgccctgaaccacctggccctgcagctggagcaggagagagaccagctgagagagcagagaaagaccctggagcaggagagagccagagccggcgagcagctggcccaggccgagcagcagctggccctggagagagccgagagaagaggcctgcagcaggcctgcggcagactggagcagagacaggagcagctggagggccaggccgccctgctgggcagagagaaggcccagctgcaggagcaggtgggccaggtgacctgccagaagcaggccctggaggagcagctggcccagagcctgcaggaccaggaggcccagatgggcaccctgcagcaggccctgcagggcaaggacgccctgagcgaggagagagcccagctgctggccaagcaggaggccctggagagacagggcagactggccgccgaggaggccgccgacctgagagtggagagagacagcctggagagcagcctgctggaggcccagcagctggccaccaagctgcaggagcagctggaggaggaggccagaagcgccggcctggccagacaggccctgcaggtggagatggagcagctgcagagcgactgggaggtgcaggagatgaagctgagacaggacaccgtgagactgcagagacaggtggcccagcaggagagagaggcccagagagccctggagagccaggccctggcccacagagaggccctggcccagctgcagagagagaaggagaccctgagcctgaccctggccgaggagaaggaggtggccagatgccagctggagcaggagaaggagctggtgaccaagagcgccgccgagagagaggccctgaagggcgagatccagagcctgaagcaggagagagacgagagcctgctgcagctggagcacaagatgcagcaggccctgagcctgaaggagaccgagagaagcctgctgagcgaggagctgagcagagccagaagaaccctggagagagtgcagcaggaggcccagagccagcaggagcaggcccaggccaccatcagcgccaccaccgaggagctgaaggccctgcaggcccagttcgaggacgccatcaccgcccaccagagagagaccaccgccctgagagagagcctgcaggacctggccgccgagagaggcgacgtggagagagaggccgagagactgagagcccagctgaccgtggcccaggagggcctggccgccctgagacaggagctgcagggcgtggaggagagcagagagggcctgcacagagaggcccaggaggccagaagagccctgagcgacgaggccagagagaaggacgtgctgctgctgttcaacagcgagctgagagccaccatctgcagagccgagcaggagaaggccagcttcaagagaagcaaggaggagaaggagcagaagctgctgatcctggaggaggcccaggccgccctgcagcagtag

SEQ ID NO: 23786 - DNA, 1395 bp, Artificial Sequence
  Description of Artificial Sequence: Synthetic coding sequence
tgagccctgtgctgggccagagccctgcccagcagacccggcgccagcagaagcggcggcctggaggagagcagagacagacccagacccctgcccaccgagcccgccgtgagacccaaggagcccggcaccaagagaaagggcctgggcgagggcgtgcccagcagccagagaggccccagaagactgagcgccgagggcggcgacaaggccctgcacaagatgggccccggcggcggcaaggccaaggccctgggcggcgccggcagcggcagcaagggcagcgccggcggcggcagcaagagaagactgagcagcgaggacagcagcctggagcccgacctggccgagatgagcctggacgacagcagcctggccctgggcgccgaggccagcaccttcggcggcttccccgagagcccccccccctgccccctgcacggcggcagcagaggccccagcaccttcctgcccgagccccccgacacctacgaggaggacggcggcgtgtacttcagcgagggccccgagccccccaccgccagcgtgggcccccccggcctgctgcccggcgacgtgtgcacccaggacgacctgcccagcaccgacgagagcggcaacggcctgcccaagaccaaggaggccgcccccgccgtgggcgaggaggacgacgactaccaggcctactacctgaacgcccaggacggcgccggcggcgaggaggagaaggccgagggcggcgccggcgaggagcacgacctgttcgccggcctgaagcccctggagcaggagagcagaatggaggtgctgttcgcctgcgccgaggccctgcacgcccacggctacagcagcgaggccagcagactgaccgtggagctggcccaggacctgctggccaacccccccgacctgaaggtggagcccccccccgccaagggcaagaagaacaaggtgagcaccagcagacagacctgggtggccaccaacaccctgagcaaggccgccttcctgctgaccgtgctgagcgagagacccgagcaccacaacctggccttcagagtgggcatgttcgccctggagctgcagagaccccccgccagcaccaaggccctggaggtgaagctggcctaccaggagagcgaggtggccgccctgctgaagaagatccccctgggccccagcgagatgagcaccatgagatgcagagccgaggagctgagagagggcaccctgtgcgactacagacccgtgctgcccctgatgctggccagcttcatcttcgacgtgctgtgcgcccccggcagcagaccccccagcagaaactggaacagcgagacccccggcgacgaggagctgggcttcgaggccgccgtggccgccctgggcgagagctag

SEQ ID NO: 23787 - DNA, 3909 bp, Artificial Sequence
  Description of Artificial Sequence: Synthetic coding sequence
tgacccagcgccagcgaccagagcacctggtacctggacgagagcaccctgaccgacaacatcaagaagaccctgcacaagttctgcggccccagccccgtggtgttcagcgacgtgaacagcatgtacctgagcagcaccgagccccccgccgccgccgagtgggcctgcctgctgagacccctgagaggcagagagcccgagggcgtgtggaacctgctgagcatcgtgagagagatgttcaagagaagagacagcaacgccgcccccctgctggagatcctgaccgaccagtgcctgacctacgagcagatcaccggctggtggtacagcgtgagaaccagcgccagccacagcagcgccagcggccacaccggcagaagcaacggccagagcgaggtggccgcccacgcctgcgccagcatgtgcgacgagatggtgaccctgtggagactggccgtgctggaccccgccctgagcccccagagaagaagagagctgtgcacccagctgagacagtggcagctgaaggtgatcgagaacgtgaagagaggccagcacaagaagaccctggagagactgttccccggcttcagacccgccgtggaggcctgctacttcaactgggaggaggcctaccccctgcccggcgtgacctacagcggcaccgacagaaagctggccctgtgctgggccagagccctgcccagcagacccggcgccagcagaagcggcggcctggaggagagcagagacagacccagacccctgcccaccgagcccgccgtgagacccaaggagcccggcaccaagagaaagggcctgggcgagggcgtgcccagcagccagagaggccccagaagactgagcgccgagggcggcgacaaggccctgcacaagatgggccccggcggcggcaaggccaaggccctgggcggcgccggcagcggcagcaagggcagcgccggcggcggcagcaagagaagactgagcagcgaggacagcagcctggagcccgacctggccgagatgagcctggacgacagcagcctggccctgggcgccgaggccagcaccttcggcggcttccccgagagcccccccccctgccccctgcacggcggcagcagaggccccagcaccttcctgcccgagccccccgacacctacgaggaggacggcggcgtgtacttcagcgagggccccgagccccccaccgccagcgtgggcccccccggcctgctgcccggcgacgtgtgcacccaggacgacctgcccagcaccgacgagagcggcaacggcctgcccaagaccaaggaggccgcccccgccgtgggcgaggaggacgacgactaccaggcctactacctgaacgcccaggacggcgccggcggcgaggaggagaaggccgagggcggcgccggcgaggagcacgacctgttcgccggcctgaagcccctggagcaggagagcagaatggaggtgctgttcgcctgcgccgaggccctgcacgcccacggctacagcagcgaggccagcagactgaccgtggagctggcccaggacctgctggccaacccccccgacctgaagggcaagaagaacaaggtgagcaccagcagacagacctgggtggccaccaacaccctgagcaaggccgccttcctgctgaccgtgctgagcgagagacccgagcaccacaacctggccttcagagtgggcatgttcgccctggagctgcagagaccccccgccagcaccaaggccctggaggtgaagctggcctaccaggagagcgaggtggccgccctgctgaagaagatccccctgggccccagcgagatgagcaccatgagatgcagagccgaggagctgagagagggcaccctgtgcgactacagacccgtgctgcccctgatgctggccagcttcatcttcgacgtgctgtgcgcccccggcagcagaccccccagcagaaactggaacagcgagacccccggcgacgaggagctgggcttcgaggccgccgtggccgccctgggcatgaagaccaccgtgagcgaggccgagcaccccctgctgtgcgagggcaccagaagagagaagggcgacctggccctggccctgatgatcacctacaaggacgaccaggccaagctgaagaagatcctggacaagctgctggacagagagagccagacccacaagccccagaccctgagcagcttctacagcagcagcagacccaccaccgccagccagagaagccccagcaagcacggcggccccagcgcccccggcgccctgcagcccctgaccagcggcagcgccggccccgcccagcccggcagcgtggccggcgccggccccggccccaccgagggcttcaccgagaagaacgtgcccgagagcagcccccacagcccctgcgagggcctgcccagcgaggccgccctgacccccagacccgagggcaaggtgcccagcagactggccctgggcagcagaggcggctacaacggcagaggctggggcagccccggcagacccaagaagaagcacaccggcatggccagcatcgacagcagcgcccccgagaccaccagcgacagcagccccaccctgagcagaagacccctgagaggcggctgggcccccaccagctggggcagaggccaggacagcgacagcatcagcagcagcagcagcgacagcctgggcagcagcagcagcagcggcagcagaagagccagcgccagcggcggcgccagagccaagaccgtggaggtgggcagatacaagggcagaagacccgagagccacgccccccacgtgcccaaccagcccagcgaggccgccgcccacttctacttcgagctggccaagaccgtgctgatcaaggccggcggcaacagcagcaccagcatcttcacccaccccagcagcagcggcggccaccagggcccccacagaaacctgcacctgtgcgccttcgagatcggcctgtacgccctgggcctgcacaacttcgtgagccccaactggctgagcagaacctacagcagccacgtgagctggatcaccggccaggccatggagatcggcagcgccgccctgaccatcctggtggagtgctgggacggccacctgaccccccccgaggtggccagcctggccgacagagccagcagagccagagacagcaacatggtgagagccgccgccgagctggccctgagctgcctgccccacgcccacgccctgaaccccaacgagatccagagagccctggtgcagtgcaaggagcaggacaacctgatgctggagaaggcctgcatggccgtggaggaggccgccaagggcggcggcgtgtaccccgaggtgctgttcgaggtggcccaccagtggttctggctgtacgagcagaccgccggcggcagcagcaccgccagagagggcgccaccagctgcagcgccagcggcatcagagccggcggcgaggccggcagaggcatgcccgagggcagaggcggccccggcaccgagcccgtgaccgtggccgccgccgccgtgaccgccgccgccaccgtggtgcccgtgatcagcgtgggcagcagcctgtaccccggccccggcctgggccacggccacagccccggcctgcacccctacaccgccctgcagccccacctgccctgcagcccccagtacctgacccaccccgcccaccccgcccaccccatgccccacatgcccagacccgccgtgttccccgtgcccagcagcgcctacccccaggtgagacccgtgttctgctggggcgtgagacacggcaagatcctgggcatccacagaggcctggagtgggtgctgtgggagtacaactggagcgtgggcgagagctggtag

SEQ ID NO: 23788 - DNA, 327 bp, Artificial Sequence
  Description of Artificial Sequence: Synthetic coding sequence
cccagctgcgtgcccgtgctgaagggcgcccacgccgccgacagcagcagaagcaagtggcccgccctgatgggcaccggcagaaagagcttcggcgccttcctgttccaccacagcttcagctggggctggaagctgatcagcatcagcttcggcgacctgaaccccttccccgtgagacagatcagaaacagaagagcctaccacctggagaaggtgagactggagctgaccgagctggaggccatcagagaggacttcctgcacgagagagacaccagccccgacaagggcgagctggtgagcgacgaggaggaggacacctag

SEQ ID NO: 23789 - DNA, 3930 bp, Artificial Sequence
  Description of Artificial Sequence: Synthetic coding sequence
atgctgctgaacggcgactgccccgagagcctgaagaaggaggccgccgccgccgagccccccagagagaacggcctggacgaggccggccccggcgacgagaccaccggccaggaggtgatcgtgatccaggacaccggcttcagcgtgaagatcctggcccccggcatcgagcccttcagcctgcaggtgagcccccaggagatggtgcaggagatccaccaggtgctgatggacagagaggacacctgccacagaacctgcttcagcctgcacctggacggcaacgtgctggaccacttcagcgagctgagaagcgtggagggcctgcaggagggcagcgtgctgagagtggtggaggagccctacaccgtgagagaggccagaatccacgtgagacacgtgagagacctgctgaagagcctggaccccagcgacgccttcaacggcgtggactgcaacagcctgagcttcctgagcgtgttcaccgacggcgacctgggcgacagcggcaagagaaagaagggcctggagatggaccccatcgactgcaccccccccgagtacatcctgcccggcagcagagagagacccctgtgccccctgcagccccagaacagagactggaagcccctgcagtgcctgaaggtgctgaccatgagcggctggaaccccccccccggcaacagaaagatgcacggcgacctgatgtacctgttcgtgatcaccgccgaggacagacaggtgagcatcaccgccagcaccagaggcttctacctgaaccagagcaccgcctaccacttcaaccccaagcccgccagccccagattcctgagccacagcctggtggagctgctgaaccagatcagccccaccttcaagaagaacttcgccgtgctgcagaagaagagagtgcagagacaccccttcgagagaatcgccacccccttccaggtgtacagctggaccgccccccaggccgagcacgccatggactgcgtgagagccgaggacgcctacaccagcagactgggctacgaggagcacatccccggccagaccagagactggaacgaggagctgcagaccaccagagagctgcccagaaagaacctgcccgagagactgctgagagagagagccatcttcaaggtgcacagcgacttcaccgccgccgccaccagaggcgccatggccgtgatcgacggcaacgtgatggccatcaaccccagcgaggagaccaagatgcagatgttcatctggaacaacatcttcttcagcctgggcttcgacgtgagagaccactacaaggacttcggcggcgacgtggccgcctacgtggcccccaccaacgacctgaacggcgtgagaacctacaacgccgtggacgtggagggcctgtacaccctgggcaccgtggtggtggactacagaggctacagagtgaccgcccagagcatcatccccggcatcctggagagagaccaggagcagagcgtgatctacggcagcatcgacttcggcaagaccgtggtgagccaccccagatacctggagctgctggagagaaccagcagacccctgaagatcctgagacaccaggtgctgaacgacagagacgaggaggtggagctgtgcagcagcgtggagtgcaagggcatcatcggcaacgacggcagacactacatcctggacctgctgagaaccttcccccccgacctgaacttcctgcccgtgcccggcgaggagctgcccgaggagtgcgccagagccggcttccccagagcccacagacacaagctgtgctgcctgagacaggagctggtggacgccttcgtggagcacagatacctgctgttcatgaagctggccgccctgcagctgatgcagcagaacgccagccagctggagacccccagcagcctggagaacggcggccccagcagcctggagagcaagagcgaggacccccccggccaggaggccggcagcgaggaggagggcagcagcgccagcggcctggccaaggtgaaggagctggccgagaccatcgccgccgacgacggcaccgaccccagaagcagagaggtgatcagaaacgcctgcaaggccgtgggcagcatcagcagcaccgccttcgacatcagattcaaccccgacatcttcagccccggcgtgagattccccgagagctgccaggacgaggtgagagaccagaagcagctgctgaaggacgccgccgccttcctgctgagctgccagatccccggcctggtgaaggactgcatggagcacgccgtgctgcccgtggacggcgccaccctggccgaggtgatgagacagagaggcatcaacatgagatacctgggcaaggtgctggagctggtgctgagaagccccgccagacaccagctggaccacgtgttcaagatcggcatcggcgagctgatcaccagaagcgccaagcacatcttcaagacctacctgcagggcgtggagctgagcggcctgagcgccgccatcagccacttcctgaactgcttcctgagcagctaccccaaccccgtggcccacctgcccgccgacgagctggtgagcaagaagagaaacaagagaagaaagaacagaccccccggcgccgccgacaacaccgcctgggccgtgatgaccccccaggagctgtggaagaacatctgccaggaggccaagaactacttcgacttcgacctggagtgcgagaccgtggaccaggccgtggagacctacggcctgcagaagatcaccctgctgagagagatcagcctgaagaccggcatccaggtgctgctgaaggagtacagcttcgacagcagacacaagcccgccttcaccgaggaggacgtgctgaacatcttccccgtggtgaagcacgtgaaccccaaggccagcgacgccttccacttcttccagagcggccaggccaaggtgcagcagggcttcctgaaggagggctgcgagctgatcaacgaggccctgaacctgttcaacaacgtgtacggcgccatgcacgtggagacctgcgcctgcctgagactgctggccagactgcactacatcatgggcgactacgccgaggccctgagcaaccagcagaaggccgtgctgatgagcgagagagtgatgggcaccgagcaccccaacaccatccaggagtacatgcacctggccctgtactgcttcgccagcagccagctgagcaccgccctgagcctgctgtacagagccagatacctgatgctgctggtgttcggcgaggaccaccccgagatggccctgctggacaacaacatcggcctggtgctgcacggcgtgatggagtacgacctgagcctgagattcctggagaacgccctggccgtgagcaccaagtaccacggccccaaggccctgaaggtggccctgagccaccacctggtggccagagtgtacgagagcaaggccgagttcagaagcgccctgcagcacgagaaggagggctacaccatctacaagacccagctgggcgaggaccacgagaagaccaaggagagcagcgagtacctgaagtgcctgacccagcaggccgtggccctgcagagaaccatgaacgagatctacagaaacggcagcagcgccaacatcccccccctgaagttcaccgcccccagcatggccagcgtgctggagcagctgaacgtgatcaacggcatcctgttcatccccctgagccagaaggacctggagaacctgaaggccgaggtggccagaagacaccagctgcaggaggccagcagaaacagagacagagccgaggagcccatggccaccgagcccgcccccgccggcgcccccggcgacctgggcagccagccccccgccgccaaggaccccagccccagcgtgcagggctag

SEQ ID NO: 23790 - DNA, 459 bp, Artificial Sequence
  Description of Artificial Sequence: Synthetic coding sequence
gagggcagcatggacagcctgtacgagcccatccccgagcagcaggccaaccaggagaacatgagcagcagaaccgacagccccatcccccccttcggcgagagcgagcagacccccaacaacctgttcgtgggcgtgagcaacctggagaacgccaagcccaagaagagaaagctgttcagaagattcatgagcgagaacaagatcttcgagggcaagaccgtgaacgacaagatctggcaggagcacagcaagcacaagaacgacagccacatcagaagaccctgccagctgaaggacctgaacgagaacgacttcctgagcaacaacatccacacctaccagggcaagaccctgcagggcaccagctaccaggtgaccagcgagtgctggagccccttccactaccagagacacgtggagaccaccgtggacgagctggcccaggagttcatgtag

SEQ ID NO: 23791 - DNA, 840 bp, Artificial Sequence
  Description of Artificial Sequence: Synthetic coding sequence
atgccccaggaggagctgcacatgaaggagtgcccccacctgaagcccacccccagccagtgctgcggccacagactggccgccgacagagtgcacgacagccaccccaccaacatgaccccccagcaccccaagacccaccccgagagctgcagctactgcagactgagctgggccagcctggtgcacggcggcggcgccctgcagcccatcgagaccctgaagaagcagatcagcgaggacagaaagcagcagctgatgctgcagaagatggagctggagatcgagaaggagagactgcagcacctgctggcccagcaggagaccaagctgctgctgaagcagcagcagctgcaccagagcagactggactacaactggctgaaggcccaggccctgttcaagagcagagagctggtggccgagaagcagctgaccaagccccaggagctgaagctggacatgaacggcagcgacagcggccccagcctgctgaagagcaactgcgacggctggctgctgggcaccagcagcagcatcaagaagcaccaggacccccccaacagcggcgagaacagaaaggagagaaagaccgtgggcttccacagccacatgaaggacgacgcccagtggagctgccagaagaaggacacctgcagaccccagagaggcaccgtgaccggcgtgagaaaggacgccagcaccagccccatgcccaccggcagcctgaaggacttcgtgaccaccgccagccccagcctgcagcacaccaccagcagacccggcatcagcaccaagatctgcttcctgagcaaccacttcttcatcctgttcagctag

SEQ ID NO: 23792 - DNA, 399 bp, Artificial Sequence
  Description of Artificial Sequence: Synthetic coding sequence
atgagcttcgagtacagacactacaagagagaggccaagatctgcacctgcagaggcggctgggcccacgtgctgctgtgcatcggcgtgagccagggcgcctgcgccgagcacctgccccacagacccgccgtggagaaggacgtgcccggcgccggcgaggtgctgttcatgtgcagctggagaatcttccccgtggccagcgccagccccagcagcagcatcagcggcctggccggccacagcgtgttcctggtgcccggcctggccgcccaccccggcagccacagcgaccagccccccggcgtgcccagcagaagaaagagcagactggagagatggagccccagcgtgagcagaagcaccagcccccccaccgaggcccccttctgcctgtag

SEQ ID NO: 23793 - DNA, 1254 bp, Artificial Sequence
  Description of Artificial Sequence: Synthetic coding sequence
atgaaggccctggtgcccgtgaccagcagcggcacctggtactgcctggagagaagacccgccgtgttcgtgaccagcagcgtgagcagccccgtgaagttcacccacgacatcagcgtgaccggcaacggcatcgtgctgccccccaagcccaagagcaaggtgaagtggtgccacttcagcaccctgcccaagcccaagccccagctgagcagaagcttcgagaagggcgacgacttcagcggcaagaagttctgcatcctgaccgccatcaagcccaccaacctggagaaggagaagctgagattcttcaagagcgactacacctacaacccccagttcgagtacgccaaccccgccctgcccagcgtgctggccaagcacagccacgccagcgacagattcctgaagcagagcatcaacatcatggagctgaccctgcagaagtacggcagctacgagaagttcgagcaggccaccggcggcagcctgctgagcaagaccagaatctggagccacgtgagaaagtacatgatgaaggagggctgcctgggcgagatcgtggtgcacctgaccgaggacctgctgagcagagccagcatgaccgtggtgaacggctgccccaccctgaccatcaacgtgagcaccgccagagagcactggctggagggcatgctgagacacgagatcggcacccactacttcagaggcatcaacaacctgcagcagccctggaacagctggaccggcagaaagaagcacgagctgaagcccaacaaccccaccgaggagggcctggccagcatccacagcgtgctgttcagaaaggaccccttcctgtggagagccgccctgctgtactacaccgtgtaccaggccagccagatgagcttctgcgagctgttcaaggacatcggcagattcgtgaaggaccccaacaccagatgggactactgcgtgagagccaagagaggctggaccgacaccagccagcccggctgcttcagcaaggaccaggtgtacctggacggcatcctgcagatcctgagatacagagacaccatcgacttccacctgctgaccgccctgggcaaggtgagctacgaggacgtggacagactgaagggcctggccgtgaccgagaacatgagagtgccccacttcctgcaggaccacggcagatacatggagcacctggagaagatcatggaggtgaacgagctgaccgacagagagctgaaggacctgatctag

SEQ ID NO: 23794 - DNA, 627 bp, Artificial Sequence
  Description of Artificial Sequence: Synthetic coding sequence
atcacccccacccccccccccccccccagaagcagagagaaggagagccccagagtggccgccagagtggtggtgcccgtgagaagcagagagagagtgctgaccagcatgggcctgaccggcgtggagggcagaggctgcagatacagcggctgcaagatgtggcccgtgagagccgtgagcatcttcagcaccctgatcggcagaagactggcctggagaagaggcagcgagggcggcaccgcctgcaccaagggcctggtgctgcccgccggcgacgagcccggccccggccccgagctgttccccgagagcgccctggtgcaggccggcagcgcccccccccccccccccccccccccccccccccccctgtgcctgctgctgctgagagccgagagcgagggcgccgtgctgatgacccaccccagagcctgggagcagagaggcggcggcctgagagaggccagaggcggcctgggcgccgccagaagccccagagagcaggagcagagagaggaggaggagctggccagaagacccagagcccccagcgcccccagcagaagactggagcccgacgccagcaaccccggctggcccgccgccgagccctggcccggctag

SEQ ID NO: 23795 - DNA, 537 bp, Artificial Sequence
  Description of Artificial Sequence: Synthetic coding sequence
atggtgagccagagcaccgtgagacaggacagccccgtggagccctgggagggcatcagcgaccacagcggcatcatcgacggcagccccagactgctgaacaccgaccaccccccctgccagctggacatcagactgatgagacacaaggccgtgtggatcaacccccaggacgtgcagcagcagccccaggacctgcagagccaggtgcccgccgccggcaacagcggcacccacttcgtgaccgacgccgccagccccagcggccccagccccagctgcctgggcgacagcctggccgagaccaccctgagcgaggacaccaccgacagcgtgggcagcgccagcccccacggcagcagcgagaagagcagcagcttcagcctgagcagcaccgaggtgcacatggtgagacccggctacagccacagagtgagcctgcccaccagccccggcatcctggccaccagcccctaccccgagaccgacagcgccttcttcgagcccagccacctgaccagcgccgccgacgagtag

SEQ ID NO: 23796 - DNA, 207 bp, Artificial Sequence
  Description of Artificial Sequence: Synthetic coding sequence
gtggccgccgtgaccgagagaaccagcggcaacctgagcgccagcagcgtgaagtgcgaccacaagtacagagtgcccggcagcgccagagacagaagccactacgtggacagagccggcctgaagctgctggccagcagcagcccccccgccgccaccagccagcagcactggaacgacagaagaacccccctgaacatccactag

SEQ ID NO: 23797 - DNA, 1554 bp, Artificial Sequence
  Description of Artificial Sequence: Synthetic coding sequence
atgctggagagcatcagagtgaccgagaagctgcactggcccgagcaggagctggccaagaagagcatcctgaacgccgaggacagcctgatcatcgacaacaagagaagcatcagccacctgagcagcggcgtgctgaaggacatcttcaccaccggcaccagcagctacaacgtgctgctgcagagcaaggaggagaagaagtaccacagccagaagcagagcagcagcacctacagcaagagatgcagaaagcccagcaagagccccaacaccagcagaagcaaggaccccagaagaatgaaggccctggtgcccgtgaccagcagcggcacctggtactgcctggagagaagacccgccgtgttcgtgaccagcagcgtgagcagccccgtgaagttcacccacgacatcagcgtgaccggcaacggcatcgtgctgccccccaagcccaagagcaaggtgaagtggtgccacttcagcaccctgcccaagcccaagccccagctgagcagaagcttcgagaagggcgacgacttcagcggcaagaagttctgcatcctgaccgccatcaagcccaccaacctggagaaggagaagctgagattcttcaagagcgactacacctacaacccccagttcgagtacgccaaccccgccctgcccagcgtgctggccaagcacagccacgccagcgacagattcctgaagcagagcatcaacatcatggagctgaccctgcagaagtacggcagctacgagaagttcgagcaggccaccggcggcagcctgctgagcaagaccagaatctggagccacgtgagaaagtacatgatgaaggagggctgcctgggcgagatcgtggtgcacctgaccgaggacctgctgagcagagccagcatgaccgtggtgaacggctgccccaccctgaccatcaacgtgagcaccgccagagagcactggctggagggcatgctgagacacgagatcggcacccactacttcagaggcatcaacaacctgcagcagccctggaacagctggaccggcagaaagaagcacgagctgaagcccaacaaccccaccgaggagggcctggccagcatccacagcgtgctgttcagaaaggaccccttcctgtggagagccgccctgctgtactacaccgtgtaccaggccagccagatgagcttctgcgagctgttcaaggacatcggcagattcgtgaaggaccccaacaccagatgggactactgcgtgagagccaagagaggctggaccgacaccagccagcccggctgcttcagcaaggaccaggtgtacctggacggcatcctgcagatcctgagatacagagacaccatcgacttccacctgctgaccgccctgggcaaggtgagctacgaggacgtggacagactgaagggcctggccgtgaccgagaacatgagagtgccccacttcctgcaggaccacggcagatacatggagcacctggagaagatcatggaggtgaacgagctgaccgacagagagctgaaggacctgatctag

SEQ ID NO: 23798 - DNA, 438 bp, Artificial Sequence; identical to SEQ ID NO: 23625
  Description of Artificial Sequence: Synthetic coding sequence

SEQ ID NO: 23799 - DNA, 1695 bp, Artificial Sequence
  Description of Artificial Sequence: Synthetic coding sequence
atgctgatgtggccccagccccacctgcccacccacccccacctgcccacccacccccacctgcccacccacccccacctgcccacccaccccatgatgagcaaggagaccagacagagcaagctggccgaggccaaggagcagctgaccgaccaccacccccagaccaaccccagcgtgggcaccgccgccagcgacaccaagaagaagaagatcaacaacggcaccaaccccgagaccaccaccagcggcggctgccacagccccgaggacgagcagaaggccagccaccagcaccaggaggccctgagaagagagctggaggcccaggtgcacaccatcagaatcctgacctgccagaagaccgagctgcagatggccctgtactacagccagcacgccgtgaagcagctggagggcgaggccagagacctgatcagcagactgcacgacagctggaagttcgccggcgagctggagcaggccctgagcgccgtggccacccagaagaagaaggccgacagatacatcgaggagctgaccaaggagagagacgccctgagcctggagctgtacagaaacaccatcaccgacgaggagctgaaggagaagaacgccaagctgcaggagaagctgcagctggtggagagcgagaagagcgagatccagctgaacgtgaaggagctgaagagaaagctggagagagccaagctgctgctgccccagcagcagctgcaggccgaggccgaccacctgggcaaggagctgcagagcgtgagcgccaagctgcaggcccaggtggaggagaacgagctgtggaacagactgaaccagcagcaggaggagaagatgtggagacaggaggagaagatccaggagagagaggagaagatccaggagcaggaggagaagatcagagagcaggaggagaagatgagaagacaggaggagatgatgtgggagaaggaggagaagatgagaagacaggaggagatgatgtgggagaaggaggagaagatcagagagctggaggagaagatgcacgagcaggagaagatcagagagcaggaggagaagagacaggaggaggagaagatcagagagcaggagaagagacaggagcaggaggccaagatgtggagacaggaggagaagatcagagagcaggaggagaagatcagagagcaggaggagatgatgcaggagcaggaggagaagatgggcgagcaggaggagaagatgtgggagcaggaggaggagatgcaggagcaggaggagaagatgagaagacaggaggagaagatcagagagcaggagaagaagatcagagagcaggaggagaagatcagagagcaggaggagatgatgcaggagcaggaggagaagatgggcgagcaggagggcaagatgtgcgagcaggaggccaagatgcaggagcaggaggagaagatgagaagacaggaggagaagatcagagagcaggagaagaagatcagagagcaggaggagaagatcagagagcaggaggagatgatgcaggagcaggaggagaagatgtgggagcaggaggagaagatgtgcgagcaggaggagaagatgcaggagcaggaggagaagatgagaagacaggaggagaagatgagagagcaggaggtgagactgagacagcaggaggagaagatgcaggagcactag

SEQ ID NO: 23800 - DNA, 744 bp, Artificial Sequence
  Description of Artificial Sequence: Synthetic coding sequence
ggcatcgtgggcggccacaacgccccccccggcaagtggccctggcaggtgagcctgagagtgtacagctaccactgggccagctgggcccacatctgcggcggcagcctgatccacccccagtgggtgctgaccgccgcccactgcatcttctggaaggacaccgaccccagcatctacagaatccacgccggcgacgtgtacctgtacggcggcagaggcctgctgaacgtgagcagaatcatcgtgcaccccaactacgtgaccgccggcctgggcgccgacgtggccctgctgcagctggagccccacgacctgagcaacgtgagaaccgtgaagctgagccccgtgagcctggagctgacccccaaggaccagtgctgggtgaccggctggggcgccatcagaatgaaggagagcctgccccccccctacagactgcagcaggccagcgtgcaggtgctggagaacgccgtgtgcgagcagccctacagaaacgccagcggccacaccggcgacagacagctgatcctggacgacatgctgtgcgccggcagcgagggcagagacagctgctacggcgacagcggcggccccctggtgtgcagactgagaggcagctggagactggtgggcgtggtgagctggggctacggctgcaccctgagagacttccccggcgtgtacacccacgtgcagatctacgtgctgtggatcctgcagcaggtgggcgagctgccctag

SEQ ID NO: 23801 - DNA, 540 bp, Artificial Sequence
  Description of Artificial Sequence: Synthetic coding sequence
atgggcagctggcactgggagtggtacggcgcccccaccagcaccctgagcctgggctgcctgctgctgcccggcgagaagtggaccttcctgatcctgcccagccactacggcaccaccacccacgcccacagcctgcagggctgcgtggagagacagtggcaggacagcaagcagctggccatcagccccggccccaccctgctgagaagcgagtacgtgggcagcctgagccccgtgtgcagcagcctgacccaggtgcacagagtgccctggggccagcacagagcctgccccgtgatgctgctggtgttcaccaagtggctgcagagatacctgcacttcgagaagcccgccgagcccgccagcgtgggccaggaccccgacttcttcggcaagagcgagggcgagagagccacctgcctgctgagcagaagctgcctgtacctggccagcgtgtgcaacctgagagagaacgacagctgcatgggcagaagcggcggcaccggcaagagcgacctgcccggcagctgcagatag

SEQ ID NO: 23802 - DNA, 84 bp, Artificial Sequence
  Description of Artificial Sequence: Synthetic coding sequence
ttccccagcttcgacatcagcttcttcctgttcatctacctgttcaacagcagccacagccccgacagagtgagcctgtgctag

SEQ ID NO: 23803 - DNA, 1161 bp, Artificial Sequence
  Description of Artificial Sequence: Synthetic coding sequence
atgggcgtgggctgcttcaaggacgacagaatcgtgttctggacctggatgttcagcacctacttcatggagaagtgggcccccagacaggacgacatgctgttctacgtgagaagaaagctggcctacagcggcagcgagagcggcgccgacggcagaaaggccgccgagcccgaggtggaggtggaggtgtacagaagagacagcaagaagctgcccggcctgggcgaccccgacatcgactgggaggagagcgtgtgcctgaacctgatcctgcagaagctggactacatggtgacctgcgccgtgtgcaccagagccgacggcggcgacatccacatccacaagaagaagagccagcaggtgttcgccagccccagcaagcaccccatggacagcaagggcgaggagagcaagatcagctaccccaacatcttcttcatgatcgacagcttcgaggaggtgttcagcgacatgaccgtgggcgagggcgagatggtgtgcgtggagctggtggccagcgacaagaccaacaccttccagggcgtgatcttccagggcagcatcagatacgaggccctgaagaaggtgtacgacaacagagtgagcgtggccgccagaatggcccagaagatgagcttcggcttctacaagtacagcaacatggagttcgtgagaatgaagggcccccagggcaagggccacgccgagatggccgtgagcagagtgagcaccggcgacaccagcccctgcggcaccgaggaggacagcagccccgccagccccatgcacgagagagtgaccagcttcagcaccccccccacccccgagagaaacaacagacccgccttcttcagccccagcctgaagagaaaggtgcccagaaacagaatcgccgagatgaagaagagccacagcgccaacgacagcgaggagttcttcagagaggacgacggcggcgccgacctgcacaacgccaccaacctgagaagcagaagcctgagcggcaccggcagaagcctggtgggcagctggctgaagctgaacagagccgacggcaacttcctgctgtacgcccacctgacctacgtgaccctgcccctgcacagaatcctgaccgacatcctggaggtgagacagaagcccatcctgatgacctag

SEQ ID NO: 23804 - DNA, 393 bp, Artificial Sequence
  Description of Artificial Sequence: Synthetic coding sequence
tggaagccccagcacagcttcttcttcctgctgctgctgtggctgcccgacaccaccggcgagatcgtgatgacccagagccccgccaccctgagcctgagccccggcgagagagccaccctgagctgcagagccagccagagcgtgagcagcagctacctgagctggtaccagcagaagcccggccaggcccccagactgctgatctacggcgccagcaccagagccaccggcatccccgccagattcagcggcagcggcagcggcaccgacttcaccctgaccatcagcagcctgcagcccgaggacttcgccgtgtactactgccagcaggactacaacctgccccccaccgtgatccagcacgagaccaagaccagcaccagaccctag

SEQ ID NO: 23805 - DNA, 696 bp, Artificial Sequence
  Description of Artificial Sequence: Synthetic coding sequence
atggccaagtgggtgcccgccctgctgctgagaagagtgcccctgttcagcctgagattcagacccgccagcagcaccttcctgcccgtgctggccgccaccgagcccgccgtgagcgtgcccagcggcgacctgagcatgcccgtgaagaccagagccgagggcgaggacgacggcttcggcgaggccggcgaccccagaagactgctggagagaccctggagattcagaggctgcctgcccggcaagggcaacagagacgtgggcttcgagggcaccgagggccccaccagcaccagacccgagtgggtgtggagctgcagatgctgcctgggctgcagagccagcaccagagagagagtgaccagccccgtgagagccgccggcccccagcccagattcaccgacagagagaccgaggccgccgccggcaccctggcccacatgggcttcgccccccccaccagcttcagccacttcaccgaccaggagctgagagactgcagcagcctggagtgcctgggcgtggtggagggcgacccccacgtgctgtgcagcaccctgagcctgagcagacccagccccagcgccaccctgaccctgctgctggccagcagctgcctgctggcccccgccccccccagcttcatcctgctgctgttcaccctgatcgcccccgacctgccccacagctag

SEQ ID NO: 23806 - DNA, 276 bp, Artificial Sequence
  Description of Artificial Sequence: Synthetic coding sequence
atggagatcgcccactacgccaaggtgttcaccgccgacggccacctgggctgctacatcctggccaccatgaactaccacagcgccaagcactgcggcagctgcctgcagagccagctgtgcaagagactgaagcaggaggacagactgagccccggcttccagggccagctgggccagcacagcgagaccagcagcctgaagaccgtgatcggccccctggcccccagctgccacctggccgacatgaagaactggagatggcagcagtggtag

SEQ ID NO: 23807 - DNA, 492 bp, Artificial Sequence
  Description of Artificial Sequence: Synthetic coding sequence
atgtgcaccgtgggcggcaacgtgagcgaggacgcctgctacggcgagcccctggagttccccgagaacaccaagaacagagccaccctgggcagcagcagccccaccgccggccacaccccccagagaaaggagatcagaatcagcaagatgtacctgcacatccccatccactgcagcaccacctacaacggcagagacctggagagcaccagcgtgcccatcaacagaagaaccgacaagaagaacgtggtgagaagacacagcggctactgcagcgccagagaggagagaaaccccgtgatcagcgccgcctggatgagcctggaggagctgggcaagagcgccagatgcagaaagaccaacacccccggcagccacaccagcgtgggcgccaagaaggccgagctgaaggccgtggtgatggactgctggctgcccgagagcggcgagggcgtgagagtgagagccagaagagagaacaagctgtag

SEQ ID NO: 23808 - DNA, 489 bp, Artificial Sequence
  Description of Artificial Sequence: Synthetic coding sequence
cacaagaacacctacatcagaacctacatccacatctgcgtgtacatcagaacctacatccacatctgcgtgtacgcctacgtgtacacctacatgtgcgtgtgcgtgagaatctacatctacgtgtgcatgagaacctacatccacatctgcgtgtacgcctacgtgtacaagtacatgtgcgtgtgcgtgagaatctacatccacacctgcatgtacatctacacctacatctgcatgtacatcatgtgcatctacgtgagaacctacatctacgtgtacatctgcacctgcatccacatctgcgtgtacatgtacgtgcacatctacggctacatctgcacctacatccacagatacggctacatctgcacctacatccacatctacgtgtacacctgcaagtacatccacatctacggctacacctgcatgtacatccacatctacggctacacctacatgtacatgtacgtgtgcatcttctag

SEQ ID NO: 23809 - DNA, 345 bp, Artificial Sequence
  Description of Artificial Sequence: Synthetic coding sequence
gtgctgtgcctgttcttcttcttcttcctgagaagaagcctggccctgctgcccagactggagtgcagcggcgccatctgggcccactgcaagctgtgcctgcccggcagcagacacagccccgccagccccagcagagtggccggcaccaccggcacctgccaccacgcccagctgatcttcgtgttcctggtggagaccggcttccaccacatcggccaggccggcctggagctgctgaccagcggcgacccccccgccctggccagccagagcgccggcatcaccggcatgagccacagagcccagcccatgtgggacctgagcggcctgatcagactgtag

SEQ ID NO: 23810 - DNA, 273 bp, Artificial Sequence
  Description of Artificial Sequence: Synthetic coding sequence
ggcggcgccaaggaggagcccaagagaagaagcgccagactgagcgccaagccccccgccaaggtggaggccaagcccaagaaggccgccgccaaggacaagagcagcgacaagaaggtgcagaccaagggcaagagaggcgccaagggcaagcagaccgaggtggccaaccaggagaccaaggaggacctgcccgccgagaacggcgagaccaagaccgaggagagccccgccagcgacgaggccggcgagaaggaggccaagagcgactag

SEQ ID NO: 23811 - DNA, 1026 bp, Artificial Sequence
  Description of Artificial Sequence: Synthetic coding sequence
tgagccgagagattcgtgcccgccctgagcctgggcgactggcccagaagccccctggcccccagatgctgggccagacccggccccgtgagcttccccggcctgagattcagccccggcaccgccgccctgagcgcccccgccacccccagccccggcagccccctgagacccagagccagcccccagccccccgccggcggccccggccccggcagcgccggcggcgaccccgcccccggcggcgccggccccatggagctgatgttcgccgagtgggaggacggcgagagattcagcttcgaggacagcgacagattcgaggaggacagcctgtgcagcttcatcagcgaggccgagagcctgtgccagaactggagaggctggagaaagcagagcgccggccccaacagccccaccggcggcggcggcggcggcggcagcggcggcaccagaatgagagacggcctggtgatccccctggtggagctgagcgccaagcaggtggccttccacatccccttcgaggtggtggagaaggtgtacccccccgtgcccgagcagctgcagctgagaatcgccttctggagcttccccgagaacgaggaggacatcagactgtacagctgcctggccaacggcagcgccgacgagttccagagaggcgaccagctgttcagaatgagagccgtgaaggaccccctgcagatcggcttccacctgagcgccaccgtggtgcccccccagatggtgccccccaagggcgcctacaacgtggccgtgatgttcgacagatgcagagtgaccagctgcagctgcacctgcggcgccggcgccaagtggtgcacccacgtggtggccctgtgcctgttcagaatccacaacgccagcgccgtgtgcctgagagcccccgtgagcgagagcctgagcagactgcagagagaccagctgcagaagttcgcccagtacctgatcagcgagctgccccagcaggtgggcgaggtgggcacccccagctgcaactag

SEQ ID NO: 23812 - DNA, 426 bp, Artificial Sequence
  Description of Artificial Sequence: Synthetic coding sequence
atgctgcacagcatgagattcctgagaaccgacagcgccagcgccgaccccggcaacctgaagtacagcagcagcagagacagaggcggcagcagcagctacggcctgcagcccagcaacagcgccgtggtgagcagacagagacacgacgacaccagagtgcacgccgacatccagaacgacgagaagggcggctacagcgtgaacggcggcagcggcgagaacacctacggcagaaagagcctgggccaggagctgagagtgaacaacgtgaccagccccgagttcaccagcgtgcagcacggcagcagagccctggccaccaaggacatgagaaagagccaggagagaagcatgagctactgcgacgagagcagactgagcaacctgctgagaagaatcaccagagaggacgacagagactag

SEQ ID NO: 23813 - DNA, 321 bp, Artificial Sequence
  Description of Artificial Sequence: Synthetic coding sequence
ctggagtgcagcggcagaatcagcgcccactgcaacctgcacctgctgggcagcagcgacagccccaccagcgccagccaggtggtggagatcaccggcacctaccaccacgtgagcctgaacttcgtgttcctggtgcagatgggcttcaaccacgtggtgcaggccggcctggagctgctgaccagcggcaacccccccagcagcgccagccagagcgccggcatcaccggcgtgagccaccacgcctggcccttccccttcaacttcgccgagagacagggcctgaccatgctgcccagactggtgagcaacagctag

SEQ ID NO: 23814 - DNA, 324 bp, Artificial Sequence
  Description of Artificial Sequence: Synthetic coding sequence
atgggcagagacgccaccagaatcggcgagagactgcagggcgagggcaacttccagctgaacttcgtgaccatcagcagcaagctgaaggtgagctggaccgagagcggcaagggcgtgacccaggagagaagatacagcaccgagaccggcgccggcggcgaggcccagatcctgaaggccgcctgcttcctgagcggcgaggcctggagcctgagacaggtgttcagccccgcccacagactgcccggcaacaagctgagcgccatcggcgtgcacagcgagagcgagaccagcctgagcggctgcgtgggcgccggctag

SEQ ID NO: 23815 - DNA, 354 bp, Artificial Sequence
  Description of Artificial Sequence: Synthetic coding sequence
tgagccggcagaagaggcagaaccaccccccagaccctggagttccccggcgcccagaccctggccatcagcagaggctgcagatgcgccagccccagaagaggcagaggcggctggtggagcctgaccgccagagtgctgtacatcaccaacaaggccggcaccttccccttcctgctgggcaagtacctggaggagaagctgctgggcaactgggtggagaccagattcagacacatcgactgggccggcctggagctgctgagcagcagcaacagacccagcctgaccagccagagcgccagaatcaccggcgtgaaccacagagccagaccctacttcctgagcaagtag

SEQ ID NO: 23816 - DNA, 240 bp, Artificial Sequence; identical to SEQ ID NO: 23677
  Description of Artificial Sequence: Synthetic coding sequence

SEQ ID NO: 23817 - DNA, 783 bp, Artificial Sequence
  Description of Artificial Sequence: Synthetic coding sequence
gtgtgcggcagcacccaggagaagaccgtgttcagactggaggccatgctggagagaaccgccggcgtgcagagcaaggaggccgccctggaggaggaggccgtgctgaaggtggaggacatcatggccgaggtggaggtggtggtggaggtggagcccgacgtgggctggcagaaggagggccagagagcccagcccggccccggccccagcacccccggccccagcatggacagcctggaggtgctgcacctggagctgggcagcgtgaacgcccccggccacagagccaccaacaagcagaagaagaagaaggagagaaaggagaaccccaacctgtggaagcccggcagcaccctgcagaagcccccccagctgtggagatgcctgctggccagacagaacgagatgagcgcctgggtgggcaagcacgccgaggtgctgctgtgctacgtgatggacctgcaggtggaggagctgagccaccccggctacagatggcagatgatcagcttccaccccaacctgtacttccacagcgagatcatcatgaaggagcactgcgtgggcatcctgggctacagagtgagccacagcaccgccgtgcagagattctgggaccacgagggccaggccagcagctgcagacagtacaccagctacctgagcagcttcagctgcctggccgagcacgactgccccggcttcggcagaatcgccgagagcaccagaagcagcgccagagcctgcggcagcatcttctgcagcaccacccagggctag

SEQ ID NO: 23818 - DNA, 288 bp, Artificial Sequence
  Description of Artificial Sequence: Synthetic coding sequence
agcctgcccgaggccctggtgcagcccggcggcagcctgagactgagctgcgccgccagcggcttcacctgcagcaacgcctggatgagctgggtgagacaggcccccggcaagggcctggagtgggtgggcagaatcaagagcaaggccaacggcggcaccaccgactacgccgcccccgtgaagggcagattcaccatcagcagagtggacagcaagaacaccctgtacctgcagatgaacagcctgaagaccgaggacaccgccgtgtactactgcaccacctag

SEQ ID NO: 23819 - DNA, 657 bp, Artificial Sequence
  Description of Artificial Sequence: Synthetic coding sequence
tgacacgtggtggccctgtgcctgttcagaatccacaacgccagcgccgtgtgcctgagagcccccgtgagcgagagcctgagcagactgcagagagaccagctgcagaagttcgcccagtacctgatcagcgagctgccccagcagatcctgcccaccgcccagagactgctggacgagctgctgagcagccagagcaccgccatcaacaccgtgtgcggcgcccccgaccccaccgccggccccagcgccagcgaccagagcacctggtacctggacgagagcaccctgaccgacaacatcaagaagaccctgcacaagttctgcggccccagccccgtggtgttcagcgacgtgaacagcatgtacctgagcagcaccgagccccccgccgccgccgagtgggcctgcctgctgagacccctgagaggcagagagcccgagggcgtgtggaacctgctgagcatcgtgagagagatgttcaagagaagagacagcaacgccgcccccctgctggagatcctgaccgaccagtgcctgacctacgagcagatcaccggctggtggtacagcgtgagaaccagcgccagccacagcagcgccagcggccacaccggcagaagcaacggccagagcgaggtggccgcccacgcctag

SEQ ID NO: 23820 - DNA, 120 bp, Artificial Sequence
  Description of Artificial Sequence: Synthetic coding sequence
cagaagggcggcgtggagggcaagtggcaggccgacgccgtgctgagctggtgccccctggccttcgccgtggtgcccagcaagcagctgagcgagctgtggtacatctgcagcgactag

SEQ ID NO: 23821 - DNA, 2157 bp, Artificial Sequence; identical to SEQ ID NO: 23629
  Description of Artificial Sequence: Synthetic coding sequence

SEQ ID NO: 23822 - DNA, 537 bp, Artificial Sequence
  Description of Artificial Sequence: Synthetic coding sequence
gagctgagcagccagaagaccggcggcaacctggacagacacaccgccagcaagcccaccgccctgctgcagcccggccccggctggcagagaggcgccgcctgctgcctgcagatcctgcccgagagcagagtgtgcttccccaccggcctgcccctggccagaaaggtgaccaagctgagctgggtgggctacaagctgcagggcagagagctgcagtggcccgtgtacagagaggagctggagctggagagactgctgtggagaagaagacccggcgacagagacctgagaagaaccggcgacctgagactgggcgagagagacctgctgctgatcagaggcggcgacctgagacacatcggcggcggcggcaacatcctgctgggcggcctgaacctgctgggcggcggcctgggccagggcgccagcaccgccgtggccgtgatcagctggcccagcatctgccccccccccagcatgtgcttcagcgccttcagcgccagcagcggcttcagcaacagcacctacgcctag

SEQ ID NO: 23823 - DNA, 1713 bp, Artificial Sequence
  Description of Artificial Sequence: Synthetic coding sequence
atgctgatgtggccccagccccacctgcccacccacccccacctgcccacccacccccacctgcccacccacccccacctgcccacccacccccacctgcccacccaccccatgatgagcaaggagaccagacagagcaagctggccgaggccaaggagcagctgaccgaccaccacccccagaccaaccccagcgtgggcaccgccgccagcgacaccaagaagaagaagatcaacaacggcaccaaccccgagaccaccaccagcggcggctgccacagccccgaggacgagcagaaggccagccaccagcaccaggaggccctgagaagagagctggaggcccaggtgcagaccatcagaatcctgacctgccagaagaccgagctgcagatggccctgtactacagccagcacgccgtgaagcagctggagggcgaggccagagacctgatcagcagactgcacgacagctggaagttcgccggcgagctggagcaggccctgagcgccgtggccacccagaagaagaaggccgacagatacatcgaggagctgaccaaggagagagacgccctgagcctggagctgtacagaaacaccatcaccgacgaggagctgaaggagaagaacgccaagctgcaggagaagctgcagctggtggagagcgagaagagcgagatccagctgaacgtgaaggagctgaagagaaagctggagagagccaagctgctgctgccccagcagcagctgcaggccgaggccgaccacctgggcaaggagctgcagagcgtgagcgccaagctgcaggcccaggtggaggagaacgagctgtggaacagactgaaccagcagcaggaggagaagatgtggagacaggaggagaagatccaggagagagaggagaagatccaggagcaggaggagaagatcagagagcaggaggagaagatgagaagacaggaggagatgatgtgggagaaggaggagaagatgagaagacaggaggagatgatgtgggagaaggaggagaagatcagagagctggaggagaagatgcacgagcaggagaagatcagagagcaggaggagaagagacaggaggaggagaagatcagagagcaggagaagagacaggagcaggaggccaagatgtggagacaggaggagaagatcagagagcaggaggagaagatcagagagcaggaggagatgatgcaggagcaggaggagaagatgggcgagcaggaggagaagatgtgggagcaggaggaggagatgcaggagcaggaggagaagatgagaagacaggaggagaagatcagagagcaggagaagaagatcagagagcaggaggagaagatcagagagcaggaggagatgatgcaggagcaggaggagaagatgggcgagcaggagggcaagatgtgcgagcaggaggccaagatgcaggagcaggaggagaagatgagaagacaggaggagaagatcagagagcaggagaagaagatcagagagcaggaggagaagatcagagagcaggaggagatgatgcaggagcaggaggagaagatgtgggagcaggaggagaagatgtgcgagcaggaggagaagatgcaggagcaggaggagaagatgagaagacaggaggagaagatgagagagcaggaggtgagactgagacagcaggaggagaagatgcaggagcactag

SEQ ID NO: 23824 - DNA, 399 bp, Artificial Sequence
  Description of Artificial Sequence: Synthetic coding sequence
ttcacccagacctacagaagaagcagacagcacgagcagctgcccggccagagacacatggacctgctgaccggctacagcaagctgatccagagcagactgaagctgctgctgcacctgggcagccagccccccgtgggcaagaccttcttcttcagctgctggtgccaccccctgttccacggcagcaagaccacccccaacgtgtggtacaagttcagcgagaccgccctgagcatcctgaacagctgccaggccagccagctgggcgtgagaaagatgcccggcgacatgagcagcagccccagagtgagagagttcagcgccctggtggccatcaaggagaagatccacatcctgcccaccaacgccaaggtgggcagcaagttcggcagctag

SEQ ID NO: 23825 - DNA, 447 bp, Artificial Sequence
  Description of Artificial Sequence: Synthetic coding sequence
atgaacttcaccctgatggtgagcatggagcacaccaccaccatggccagcgccacccccgccccctggccccacagaagccagagatgcagacaggccgtgcccggccaccccgccagcggctgctgcggcaccggcaccttcagaacccagagaagacccggcgacaagagcagaagagccggcagcagaggcagaggcgccggccccggcagacacgacagagacagcgcccacgccggcagcatgagaggcgccagactggtgcccgccctggtgagactgcagctgagaccccccgccctgagaggcgagagaacccccatcagcatgccccccgccagaccccccgccggcgtggccttccccggcgccagcgccggccccagcagaaccagaagaggcgtggccaccgccggcggcagaagagcccccgccgtgatctag

SEQ ID NO: 23826 - DNA, 1599 bp, Artificial Sequence
  Description of Artificial Sequence: Synthetic coding sequence
atggaccagttcggcgacatcctggagggcgaggtggaccacagcttcttcgacagcgacttcgaggagggcaagaagtgcgagaccaacagcgtgttcgacaagcagaacgacgaccccaaggagagaatcgacaaggacaccaagaacgtgaacagcaacaccggcatgcagaccaccgagaactacctgaccgagaagggcaacgagagaaacgtgaagttcccccccgagcaccccgtggagaacgacgtgacccagaccgtgagcagcttcagcctgcccgccagcagcagaagcaagaagctgtgcgacgtgaccaccggcctgaagatccacgtgagcatccccaacagaatccccaagatcgtgaaggagggcgaggacgactactacaccgacggcgaggagagcagcgacgacggcaagaagtaccacgtgaagagcaagagcgccaagcccagcaccaacgtgaagaagagcatcagaaagaagtactgcaaggtgagcagcagcagcagcagcagcctgagcagcagcagcagcggcagcggcaccgactgcctggacgccggcagcgacagccacctgagcgacagcagccccagcagcaagagcagcaagaagcacgtgagcggcatcaccctgctgagccccaagcacaagtacaagagcggcatcaagagcaccgagacccagcccagcagcaccacccccaagtgcggccactaccccgaggagagcgaggacaccgtgaccgacgtgagccccctgagcacccccgacatcagccccctgcagagcttcgagctgggcatcgccaacgaccagaaggtgaagatcaagaagcaggagaacgtgagccaggagatctacgaggacgtggaggacctgaagaacaacagcaagtacctgaaggccgccaagaagggcaaggagaagcacgagcccgacgtgagcagcaagagcagcagcgtgctggacagcagcctggaccacagacacaagcagaaggtgctgcacgacaccatggacctgaaccacctgctgaaggccttcctgcagctggacaagaagggcccccagaagcaccacttcgaccagcccagcgtggcccccggcaagaactacagcttcaccagagaggaggtgagacagatcgacagagagaaccagagactgctgaaggagctgagcagacaggccgagaagcccggcagcaagagcaccatccccagaagcgccgaccacccccccaagctgtaccacagcgccctgaacagacagaaggagcagcagagaatcgagagagagaacctggccctgctgaagagactggaggccgtgaagcccaccgtgggcatgaagagaagcgagcagctgatggactaccacagaaacatgggctacctgaacagcagccccctgagcagaagagccagaagcaccctgggccagtacagccccctgagagccagcagaaccagcagcgccaccagcggcctgagctgcagaagcgagagaagcgccgtggaccccagcagcggccaccccagaagaagacccaagccccccaacgtgagaaccgcctggctgtag

SEQ ID NO: 23827 - DNA, 2085 bp, Artificial Sequence
  Description of Artificial Sequence: Synthetic coding sequence
atggacctgcacaagcagtgggagaacaccgagaccaactggcacaaggagaagatggagctgctggaccagttcgacaacgagagaaaggagtgggagagccagtggaagatcatgcagaagaagatcgaggagctgtgcagagaggtgaagctgtggagaaagatcaacatcaacgagagcgccaagatcatcgacctgtaccacgagaagaccatccccgagaaggtgatcgagagcagccccaactaccccgacctgggccagagcgagttcatcagaaccaaccacaaggacggcctgagaaaggagaacaagagagagcagagcctggtgagcggcggcaaccagatgtgcaaggagcagaaggccaccaagaagagcaaggtgggcttcctggaccccctggccaccgacaaccagaaggagtgcgaggcctggcccgacctgagaaccagcgaggaggacagcaagagctgcagcggcgccctgagcaccgccctggaggagctggccaaggtgagcgaggagctgtgcagcttccaggaggagatcagaaagagaagcaaccacagaagaatgaagagcgacagcttcctgcaggagatgcccaacgtgaccaacatcccccacggcgaccccatgatcaacaacgaccagtgcatcctgcccatcagcctggagaaggagaagcagaagaacagaaagaacctgagctgcaccaacgtgctgcagagcaacagcaccaagaagtgcggcatcgacaccatcgacctgaagagaaacgagaccccccccgtgcccccccccagaagcaccagcagaaacttccccagcagcgacagcgagcaggcctacgagagatggaaggagagactggaccacaacagctgggtgccccacgagggcagaagcaagagaaactacaacccccacttccccctgagacagcaggagatgagcatgctgtaccccaacgagggcaagaccagcaaggacggcatcatcttcagcagcctggtgcccgaggtgaagatcgacagcaagccccccagcaacgaggacgtgggcctgagcatgtggagctgcgacatcggcatcggcgccaagagaagccccagcaccagctggttccagaagacctgcagcacccccagcaaccccaagtacgagatggtgatccccgaccaccccgccaagagccaccccgacctgcacgtgagcaacgactgcagcagcagcgtggccgagagcagcagccccctgagaaacttcagctgcggcttcgagagaaccaccagaaacgagaagctggccgccaagaccgacgagttcaacagaaccgtgttcagaaccgacagaaactgccaggccatccagcagaaccacagctgcagcaagagcagcgaggacctgaagccctgcgacaccagcagcacccacaccggcagcatcagccagagcaacgacgtgagcggcatctggaagaccaacgcccacatgcccgtgcccatggagaacgtgcccgacaaccccaccaagaagagcaccaccggcctggtgagacagatgcagggccacctgagccccagaagctacagaaacatgctgcacgagcacgactggagacccagcaacctgagcggcagacccagaagcgccgaccccagaagcaactacggcgtggtggagaagctgctgaagacctacgagaccgccaccgagagcgccctgcagaacagcaagtgcttccaggacaactggaccaagtgcaacagcgacgtgagcggcggcgccaccctgagccagcacctggagatgctgcagatggagcagcagttccagcagaagaccgccgtgtggggcggccaggaggtgaagcagggcatcgaccccaagaagatcaccgaggagagcatgagcgtgaacgccagccacggcaagggcttcagcagacccgccagacccgccaacagaagactgcccagcagatgggccagcagaagccccagcgccccccccgccctgagaagaaccacccacaactacaccatcagcctgagaagcgaggccctgatggtgtag

SEQ ID NO: 23828 - DNA, 447 bp, Artificial Sequence
  Description of Artificial Sequence: Synthetic coding sequence
atgagcgtgcccaagctggtgaaccacggctgggagaccgagccctgcaaccccgaccccgccctgctgctgaccggcgccgtgcccggcgagggcgagaccaccctggagagagccctgcccagagtggtgggcgagcaggagctgggcagctggagagagagagccaacagcacccccgagagaagactgagccccgccctgaagcacgtgagcgccagacccaccagcatccccgagacccccggcgagagaggcgccagaaccagaagagacagagccggcagagccagaaagggcgagggcgccgccgccagcaccctgagcagcctgagaggcgccgcccccgaggccggcagaggcgccgaggcccccgagtggagcgtgagcggcggcgccgacgccgtgcccctggagggcgcccccgccgtgagaagcaagagctag

SEQ ID NO: 23829 - DNA, 306 bp, Artificial Sequence
  Description of Artificial Sequence: Synthetic coding sequence
atgctggtgggcaacagagccagagagagagagctgaagcaggacagaagaggcctggagatcgcctgggacctgatgaagagacaggactgcttcagagaggccgcccacggcagcgccagcgagcaggtggccctggagcccatcctgtgctgcgacgaggtggccagccaggagcaccacgagggcggcaagggcagccccagaagagagagcaccgtgcaggtgcccggcggcgaccacggcaccctggagctgccctggtgcgtgtacttccagatcgtgagcggcatcaccctgagatag

SEQ ID NO: 23830 - DNA, 213 bp, Artificial Sequence
  Description of Artificial Sequence: Synthetic coding sequence
atgagcctgcccatcggcatctacagaagagccgtgagctacgacgacaccctggaggaccccgcccccatgacccccccccccagcgacatgggcagcgtgccctggaagcccgtgatccccgagagaaagtaccagcacctggccaaggtggaggagggcgaggccagcctgcccagccccgccatgaccctgagcagcgccatcgactag

SEQ ID NO: 23831 - DNA, 3702 bp, Artificial Sequence
  Description of Artificial Sequence: Synthetic coding sequence
atgggcaccagagccttcagccacgacagcatcttcatccccgacggcggcgccgagagcgagcagaccgtgcaggccatgagccaggacaacatcctgggcaaggtgaagaccctgcagcagcagctgggcaagaacatcaagttcggccagagaagccccaacgccatccccatgaacaaggccaacagcggcgaggccagcctggaggaggacctgttcctgaccagccccatggagatcgtgacccagcaggacatcgtgctgagcgacgccgagaacaagagcagcgacacccccagcagcctgagccccctgaacctgcccggcgccggcagcgagatggaggagaaggtggcccccgtgaagcccagcagacccaagagacacttcagcagcgccggcaccatcgagagcgtgaacctggacgccatccccctggccatcgccagactggacaacagcgccgccaagcacaagctggccgtgaagcccaagaagcagagagtgagcaagaagcacagaagactggcccaggacccccagcacgagcagggcggcctggagagcagaccctgcctggaccagaacggccaccccggcgaggacaagcccacctggcacgaggaggagcccaaccccctggacagcgaggaggagagaagaagacaggaggactactggagagagctggaggccaagtgcaagagacagaaggccgaggccgccgagaagagaagactggaggagcagagactgcaggccctggagagaagactgtgggaggagaacagaagacaggagctgctggaggaggagggcgagggccaggagccccccctggaggccgagagagcccccagagaggagcagcagagaagcctggaggcccccggctgggaggacgccgagagaagagagagagaggagagagagagactggaggccgaggaggagagaagaagactgcaggcccaggcccaggccgaggagagaagaagactggaggaggacgccagactggaggagagaagaagacaggaggaggaggagggcagatgcgccgaggagctgaagagacaggaggaggaggaggccgagggctgggaggagctggagcagcaggaggccgaggtgcagggcccccccgaggccctggaggagaccggcgagggcagaagaggcgccgaggaggaggacctgggcgaggaggaggaggagggccaggcccacctggaggactggagaggccagctgagcgagctgctgaacgacttcgaggagagactggaggaccaggagagactgaagcccgagggccagagagagcacagcgaggagcccggcatctgcgaggagcagaaccccgaggccgagagaagaagagagcagcagggcagaagcggcgacttccagggcgccgacagacccggccccgaggagaagagagaggagggcgacaccgagcccctgctgaagcaggagggccccgtggaggccgcccagccccccgtggagagaaaggaggccgccgccctggagcagggcagaaaggtggaggagctgagatggcaggaggtggacgagagacagaccatgcccagaccctacaccttccaggtgagcagcggcggcaagcagatcctgttccccaaggtgaacctgagccccgtgacccccgccaaggacaccggcctgaccgccgccccccaggagcccaaggcccccaaggccagccccgtgcagcacgccctgcccagcagcctgagcgtgccccacaccgccatcctggtgaccggcgcccagctgtgcggccccgccgtgaacctgagccagatcaaggacaccgcctgcaagagcctgctgggcctggaggagaagaagcacgccgaggcccccgccggcgagaacccccccagaggccccggcgacgccagagccggcagcggcaaggccaagcccagacaggagagccccagcagcgccagcgccctggccgagtgggccagcatcagaagcagaatcctgaagaacgccgagagcgaccccagaagcagcgagagagaccagctgagacccggcgacgagagcacccccagaggcagatgcgacagcagaggcaaccagagaaagaccccccccgtgaacgccaagttcagcatcatgcccgcctggcagaagttcagcgacggcggcaccgagaccagcaagcagagcaccgaggccgagagcatcagaaagagacccatgctgggccccagcgaggagaccgccccccagcccccccccgccggcgtgagagagctgggcaagggccccgagaagagcgagatgcacagagagcccgccgacaccaccgagggctgcaagttcgccaaggacctgcccagcttcctggtgcccagcctgccctaccccccccagaaggtggtggcccacaccgagttcaccaccagcagcgacagcgagaccgccaacggcatcgccaagcccgaccccgtgatgcccggcggcgaggagaaggccagccccttcggcatcaagctgagaagaaccaactacagcctgagattcaactgcgaccagcaggccgagcagaagaagaagaagagacacagcagcaccggcgacagcgccgacgccggcccccccgccgccggcagcgccagaggcgagaaggagatggagggcgtggccctgaagcacggccccagcctgccccaggagagaaagcaggcccccagcaccagaagagacagcgccgagcccagcagcagcagaagcgtgcccgtggcccaccccggccccccccccgccagcagccagacccccgcccccgagcacgacaaggccgccaacaagatgcccctggcccagaagcccgccctggcccccaagcccaccagccagaccccccccgccagccccctgagcaagctgagcagaccctacctggtggagctgctgagcagaagagccggcagacccgaccccgagcccagcgagcccagcaaggaggaccaggagagcagcgacagaagaccccccagcccccccggccccgaggagagaaagggccagaagagagacgaggaggaggaggccaccgagagaaagcccgccagcccccccctgcccgccacccagcaggagaagcccagccagacccccgaggccggcagaaaggagaagcccatgctgcagagcagacacagcctggacggcagcaagctgaccgagaaggtggagaccgcccagcccctgtggatcaccctggccctgcagaagcagaagggcttcagagagcagcaggccaccagagaggagagaaagcaggccagagaggccaagcaggccgagaagctgagcaaggagaacgtgagcgtgagcgtgcagcccggcagcagcagcgtgagcagagccggcagcctgcacaagagcaccgccctgcccgaggagaagagacccgagaccgccgtgagcagactggagagaagagagcagctgaagaaggccaacaccctgcccaccagcgtgaccgtggagatcagcgacagcgccccccccgcccccctggtgaaggaggtgaccaagagattcagcacccccgacgccgcccccgtgagcaccgagcccgcctggctggccctggccaagagaaaggccaaggcctggagcgactgcccccagatcatcaagtag

SEQ ID NO: 23832 - DNA, 198 bp, Artificial Sequence
  Description of Artificial Sequence: Synthetic coding sequence
atgagcctgcccatcggcatctacagaagagccgtgagctacgacgacaccctggaggaccccgcccccatgacccccccccccagcgacatgggcagcgtgccctggaagcccgtgatccccgagagaaagtaccagcacctggccaaggtggaggagggcgaggccagcctgcccagccccgccatgaccctgtag

SEQ ID NO: 23833 - DNA, 288 bp, Artificial Sequence
  Description of Artificial Sequence: Synthetic coding sequence
atgagcctgcccatcggcatctacagaagagccgtgagctacgacgacaccctggaggaccccgcccccatgacccccccccccagcgacatgggcagcgtgccctggaagcccgtgatccccgagagaaagtaccagcacctggccaaggtggaggagggcgaggccagcctgcccagccccgccatgaccctgagcagcgccatcgacagcgtggacaaggtgcccgtggtgaaggccaaggccacccacgtgatcatgaacagcctgatcaccaagcagacctag

SEQ ID NO: 23834 - DNA, 2130 bp, Artificial Sequence; identical to SEQ ID NO: 23697
  Description of Artificial Sequence: Synthetic coding sequence

SEQ ID NO: 23835 - DNA, 168 bp, Artificial Sequence
  Description of Artificial Sequence: Synthetic coding sequence
gaggtgagcaaccccttcgacggcctggaggagctgggcaagaccctggaggactacaccagagagttcatcaacagaatcacccagagcgagctgcccgccaagatgtgggactggttcagcgagaccttcagaaaggtgaaggagaagctgaagaccgacagctag

SEQ ID NO: 23836 - DNA, 228 bp, Artificial Sequence
  Description of Artificial Sequence: Synthetic coding sequence
atgtaccccatctgcaccgtggtggtggacggcctgcccagcgagagcagcagcagcagctaccccggccccgtgagcgtgagcgagatgagcctgctgcacgccctgggccccgtgcagacctggctgggccaggagctggagaagtgcggcatcgacgccatgatctacaccagatacgtgctgagcctgctgctgcacgacagctacgactacgacctgcagtag

SEQ ID NO: 23837 - DNA, 918 bp, Artificial Sequence; identical to SEQ ID NO: 23590
  Description of Artificial Sequence: Synthetic coding sequence

SEQ ID NO: 23838 - DNA, 2130 bp, Artificial Sequence; identical to SEQ ID NO: 23697
  Description of Artificial Sequence: Synthetic coding sequence

SEQ ID NO: 23839 - DNA, 783 bp, Artificial Sequence
  Description of Artificial Sequence: Synthetic coding sequence
atggacgaggaggtgagcgaccccaccagcgccgccgcccagctgagacagctgagagaccacctgcccccccccagcagcgccagccccagcagagccctgcccgagccccaggaggcccagaagctggccgccgagagagccagagcccccgtggtgccctacggcgtggacctgcactactggggccaggagctgcccaccgccggcaagatcgtgaagagcgacagccagcacagattctggaagcccagcgaggtggaggaggaggtggtgaacgccgacatcagcgagatgctgagaagcagacacatcaccttcgccggcaagttcgagcccgtgcagcactggtgcagagcccccagacccgacggcagactgtgcgagagacaggacagactgaagtgccccttccacggcaagatcgtgcccagagacgacgagggcagacccctggaccccgaggacagagccagagagcagagaagacagctgcagaagcaggagagacccgagtggcaggaccccgagctgatgagagacgtggaggccgccaccggccaggacctgggcagcagcagatacagcggcaagggcagaggcaagaagagaagataccccagcctgaccaacctgaaggcccaggccgacaccgccagagccagaatcggcagaaaggtgttcgccaaggccgccgtgagaagagtggtggccgccatgaacagaatggaccagaagaagcacgagaagttcagcaaccagttcaactacgccctgaactag

SEQ ID NO: 23840 - DNA, 783 bp, Artificial Sequence; identical to SEQ ID NO: 23839
  Description of Artificial Sequence: Synthetic coding sequence

SEQ ID NO: 23841 - DNA, 3828 bp, Artificial Sequence; identical to SEQ ID NO: 23776
  Description of Artificial Sequence: Synthetic coding sequence

SEQ ID NO: 23842 - DNA, 288 bp, Artificial Sequence
  Description of Artificial Sequence: Synthetic coding sequence
atggccagcagccactggaacgagaccaccaccagcgtgtaccagtacctgggcttccaggtgcagaagatctaccccttccacgacaactggaacaccgcctgcttcgtgatcctgctgctgttcatcttcaccgtggtgagcctggtggtgctggccttcctgtacgaggtgctggactgctgctgctgcgtgaagaacaagaccgtgaaggacctgaagagcgagcccaaccccctgagaagcatgatggacaacatcagaaagagagagaccgaggtggtgtag

SEQ ID NO: 23843 - DNA, 354 bp, Artificial Sequence
  Description of Artificial Sequence: Synthetic coding sequence
atggagaccaagaagctgatcggcaagcccctgcagcccgccagacccgtgagacacctgaccagcccccccggcgccgtgttccccttcaacttccagaacgagtacccctgcaacacccagtgcatccagagcggcgtgagcagatgcaagaccaacggcatgcaggccttcagccagggcctgaacgagcagcagcagcagcagagccccgtgaagaaggagagaatcaagtacagcagagacttcctgctgaagctgagcagcgtgagcatctgcagaaagaagcccgacttcctgcccgaccaccccatcgtgctgcagaagcccgagaacaaccagagcttcaagtag

SEQ ID NO: 23844 - DNA, 339 bp, Artificial Sequence
  Description of Artificial Sequence: Synthetic coding sequence
ctgcaggacagaatcgccaccttcttcttccccaagggcatgatgctgaccaccgccgccctgatgctgttcttcctgcacctgggcatcttcatcagagacgtgcacaacttctgcatcacctaccactacgaccacatgagcttccactacaccgtggtgctgatgttcagccaggtgatcagcatctgctgggccgccatgggcagcctgtacgccgagatgaccgagaacaacgcccagagaagccacgtgctgcagccccccgtgctgggcgtgagcggccacagagtgcccggcggcgcccccctgagacccggcgagagcgagcagggctag

SEQ ID NO: 23845 - DNA, 6708 bp, Artificial Sequence
  Description of Artificial Sequence: Synthetic coding sequence
atgcccctgttcttcagcgccctgctggtgctgctgctggtggccctgagcgccctgttcctgggcagatggctggtggtgagactggccaccaagtggtgccagagaaagctgcaggccgagctgaagatcggcagcttcagattcttctggatccagaacgtgagcctgaagttccagcagcaccagcagaccgtggagatcgacaacctgtggatcagcagcaagctgctgagccacgacctgccccactacgtggccctgtgcttcggcgaggtgagaatcagaaccgacctgcagaaggtgagcgacctgagcgcccccttcagccagagcgccggcgtggaccagaaggagctgagcttcagccccagcctgctgaagatcttctgccagctgttcagcatccacgtggacgccatcaacatcatggtgctgaaggtggacaccagcgagagcctgtggcacatccagatcagcagaagcagattcctgctggacagcgacggcaagagactgatctgcgaggtgagcctgtgcaagatcaacagcaaggtgctgaagagcggccagctggaggacacctgcctggtggagctgagcctggccctggacctgtgcctgaaggtgggcatcagcagcagacacctgaccgccatcaccgtggacgtgtggaccctgcacgccgagctgcacgagggcctgttccagagccagctgctgtgccagggccccagcctggccagcaagcccgtgccctgcagcgaggtgaccgagaacctggtggagcccaccctgcccggcctgttcctgctgcagcagctgcccgaccaggtgaaggtgaagatggagaacaccagcgtggtgctgagcatgaacagccagaagagacacctgacctggaccctgaagctgctgcagttcctgtaccacagagacgaggaccagctgcccctgagaagcttcaccgccaacagcgacatggcccagatgagcaccgagctgctgctggaggacggcctgctgctgagccagagcagacagagaatcgtgtgcctgaacagcctgaaggccagcgtgcaggtgaccaccatcgacctgagcgccagcctggtgctgaacacctgcatcatccactacagacaccaggagttcagccactggctgcacctgctggccctggagacccagggcagcagcagccccgtgctgaagcagagaaagaagagaaccttcccccagatcctggcccccatcatcttcagcaccagcatcagcaacgtgaacatcagcatccagctgggcgacaccccccccttcgccctgggcttcaacagcatcagcctggactaccagcacctgagaccccagagcatccaccagagaggcgtgctgaccgtggaccacctgtgctggagagtgggcagcgacagccacatccagagagccccccacccccccaacatgcacgtgtggggcgaggccctggtgctggacagcttcaccctgcagggcagctacaaccagcccctgggcctgagcagcacccagagcgacaccctgttcctggactgcaccatcagaggcctgcaggtggaggccagcgacacctgcgcccagtgcctgagcagaatcctgagcctgatgggcccccagagcggcaagagcgccgtgagcagacacagcagcttcggcgagagcgtgagcctgctgtggaaggtggacctgaaggtggaggacatgaacctgttcaccctgagcgccctggtgggcgccagcgaggtgagactggacaccctgaccatcctgggcagcgccgagaccagcaccgtgggcatccagggcctggtgctggccctggtgaagagcgtgaccgagaagatgcagccctgctgcaaggcccccgacatccccacccccgtgctgagcctgagcatgctgagcatcacctaccacagcagcatcagaagcctggaggtgcagtgcggcgccggcctgaccctgctgtggagcccccccgaccacatgtacctgtaccagcacgtgctggccaccctgcagtgcagagacctgctgagagccaccgtgttccccgagaccgtgcccagcctggccctggagaccagcggcaccaccagcgagctggagggcagagcccccgagcccctgccccccaagagactgctgaacctgaccctggaggtgagcaccgccaagctgaccgccttcgtggccgaggacaagttcatcaccctggccgccgagagcgtgagcctgagcagacacggcggcagcctgcaggcctactgccccgagctggccgccggcttcgacggcaacagcatcttcaacttcaaggaggtggaggtgcagctgctgcccgagctggaggagatgatcctgcacagaaaccccttccccgccctgcagaccctgagaaacagagtgtggctgctgagcttcggcagcgtgagcgtggagttcccctaccagtacgacttcagcagaaccctggacgaggccgtgggcgtgcagaagtggctgaagggcctgcaccagggcaccagagcctgggccagccccagccccgtgcccctgccccccgacctgctgctgaaggtggagcacttcagctgggtgttcctggacgacgtgttcgaggtgaagctgcacgacaactacgagctgatgaaggacgagagcaaggagagcgccaagagactgcagctgctggacgccaaggtggccgccctgagaaagcagcacggcgagctgctgcccgccagaaagatcgaggagctgtacgccagcctggagagaaagaacatcgagatctacatccagagaagcagaagactgtacggcaacacccccatgagaagagccctgctgacctggagcctggccggcctggagctggtggccctggccgacgccagcttccacggccccgagcacgtggtggagcaggtgcaggagctggaccccggcagccccttcccccccgagggcctggacctggtgatccagtggtgcagaatgctgaagtgcaacgtgaagagcttcctggtgagaatcagagactaccccagatacctgttcgagatcagagactggagactgatgggcagactggtgggcaccgagcagagcggccagccctgcagcagaagaagacagatcctgcacctgggcctgccctggggcaacgtggccgtggagagaaacatgccccccctgaagttctaccacgacttccacagcgagatcttccagtacaccgtggtgtggggcccctgctgggaccccgcctggaccctgatcggccagtgcgtggacctgctgaccaagcccagcgccgaccccagcccccccctgccctggtgggacaagagcagactgctgttccacggcgactggcacatggacatcgagcaggccaacctgcaccagctggccaccgaggacccctacaacaccaccgagaacatgcactgggagtggagccacctgagcttccactggaagcccggccagttcgtgttcaagggcgacctggacatcaacgtgagaaccgccagcaagtacgacgactgctgcttcctgcacctgcccgacctgtgcatgaccctggacctgcagtggctgtgccacggcaacccccacgaccaccacagcgtgaccctgagagcccccgagttcctgcccgaggtgcccctgggccagctgcacgacagctacagagccttcagaagcgagaacctgaacctgagcatcaagatggacctgaccagacacagcggcaccatcagccagcccagaatcctgctgtacagcagcaccctgagatggatgcagaacttctgggccacctggaccagcgtgaccagacccatctgcagaggcaagctgttcaacaacctgaagcccagcaagaagaagctgggccagcactacaagcagctgagctacaccgccctgttcccccagctgcaggtgcactactgggccagcttcgcccagcagagaggcatccagatcgagtgcagccagggccacgtgttcaccagaggcacccagagactgatcccccaggccggcaccgtgatgagaagactgatcagcgactggagcgtgacccagatggtgagcgacctgagccaggtgaccgtgcacctgatggccagccccaccgaggagaacgccgaccactgcctggaccccctggtgaccaagacccacctgctgagcctgagcagcctgacctaccagagacacagcaacagaaccgccgaggaggagctgagcgccagagacggcgaccccaccttccacacccaccagctgcacctggtggacctgagaatcagctggaccaccaccaacagagacatcgccttcggcctgtacgacggctacaagaaggccgccgtgctgaagagaaacctgagcaccgaggccctgaagggcctgaagatcgacccccagatgcccgccaagaagcccaagagaggcgtgcccaccagcgccagcgccccccccagagtgaacacccccagcttcagcggccagcccgacaagggcagcagcggcggcgcctacatgctgcagaagctgatcgaggagaccgacagattcgtggtgttcaccgaggaggagagcggcatgagcgaccagctgtgcggcatcgccgcctgccagaccgacgacatctacaacagaaactgcctgatcgagctggtgaactgccagatggtgctgagaggcgccgagaccgagggctgcgtgatcgtgagcgccgccaaggcccagctgctgcagtgccagcaccaccccgcctggtacggcgacaccctgaagcagaagaccagctggacctgcctgctggacggcatgcagtacttcgccaccaccgagagcagccccaccgagcaggacggcagacagctgtggctggaggtgaagaacatcgaggagcacagacagagaagcctggacagcgtgcaggagctgatggagagcggccaggccgtgggcggcatggtgaccaccaccaccgactggaaccagcccgccgaggcccagcaggcccagcaggtgcagagaatcatcagcagatgcaactgcagaatgtactacatcagctacagccacgacatcgaccccgagctggccacccagatcaagccccccgaggtgctggagaaccaggagaaggaggacctgctgaagaagcaggagggcgccgtggacaccttcaccctgatccaccacgagctggagatcagcaccaaccccgcccagtacgccatgatcctggacatcgtgaacaacctgctgctgcacgtggagcccaagagaaaggagcacagcgagaagaagcagagagtgagattccagctggagatcagcagcaaccccgaggagcagagaagcagcatcctgcacctgcaggaggccgtgagacagcacgtggcccagatcagacagctggagaagcagatgtacagcatcatgaagagcctgcaggacgacagcaagaacgagaacctgctggacctgaaccagaagctgcagctgcagctgaaccaggagaaggccaacctgcagctggagagcgaggagctgaacatcctgatcagatgcttcaaggacttccagctgcagagagccaacaagatggagctgagaaagcagcaggaggacgtgagcgtggtgagaagaaccgagttctacttcgcccaggccagatggagactgaccgaggaggacggccagctgggcatcgccgagctggagctgcagagattcctgtacagcaaggtgaacaagagcgacgacaccgccgagcacctgctggagctgggctggttcaccatgaacaacctgctgcccaacgccgtgtacaaggccatcctgagaccccagagcagctgccagagcggcagacagctggccctgagactgttcagcaaggtgagaccccccgtgggcggcatcagcgtgaaggagcacttcgaggtgaacgtggtgcccctgaccatccagctgacccaccagttcttccacagaatgatgggcttcttcttccccggcagaagcgtggaggacgacgaggtgggcgacgaggaggacaagagcaagctggtgaccaccggcatccccgtggtgaagcccagacagctgatcgccaccgacgacgccgtgcccctgggccccggcaagggcgtggcccagggcctgaccagaagcagcggcgtgagaagaagcttcagaaagagccccgagcaccccgtggacgacatcgacaagatgaaggagagagccgccatgaacaacagcttcatctacatcaagatcccccaggtgcccctgtgcgtgagctacaagggcgagaagaacagcgtggactggggcgacctgaacctggtgctgccctgcctggagtaccacaacaacacctggacctggctggacttcgccatggccgtgaagagagacagcagaaaggccctggtggcccaggtgatcaaggagaagctgagactgaagagcgccaccggcagcgaggtgagaggcaagctggagaccaagagcgacctgaacatgcagcagcaggaggaggaggagaaggccagactgctgatcggcctgagcgtgggcgacaagaaccccggcaagaagagcatcttcggcagaagaaagtag

SEQ ID NO: 23846 - DNA, 3876 bp, Artificial Sequence
  Description of Artificial Sequence: Synthetic coding sequence
atgccccccaacttccccgagttcgccgagagaatcgaggccagcctgagcgaggtgagcgaggccggcgccagcaaccccagcctgcaggagaagaaggagagcagcagcgccctgaccgagagcagcggccacctggaccacagagagccccagagcgagagcgtgaccctggagcacgtgagcaagagcatcggcatccccgaggtgcaggacttcaagaacctgagcggcgactgccaggacttcagattccagcagcacagcgccaaccccccccacgagttccagcccgtggagagcgaggccgtggccaccagcggcaacaccgacgtgatgcaggagagcagattcagcagcgccacctggcccagagccaccaagagcctggccaagggcggcttcagcgagaagcagcaccccctgggcgacaccgcctgcaccgtggagatgccccccctgagcccctgcctgagcgaggagctgctggaccccgagctgcacgtgctgatcacccccagcctgagagagaagaccgagagcgagctgaagttcgaggaggacgagagatggatcatgatggaggccgagggcgagtgggaggaggagaagctgagcgacagagagaagaccttcctgatggccgacgagaagaacagcctggccgacatcttcgaggagagagagcaggccaacaccgccgtggtggaggacggcagcgactgcctggccgccgtgctgagaaccttcggccacctgagcctgggccagatctgctgccccgacgacccccagcccgccaaggaccagctggccaccgtgcccaaggacatccccctggactgcgactgcgtgctgaccggcgaggacatcctgggcgaggtggccaacagaaccgcccagggcctggagggcctggtgagcgacagcgcctgcaccgtgggcaccatcgacgccgagcagctgagcgacaccgacagcgtgcagatgttcctggagctggagaaggagtgcctgtgcgaggagggcgtgacccccctggtggagctgcagaaccagatcagcagcgagggcctggccgccagccaggacgccgagaacctgctggtgatcagccacttcagcggcgccgccctggagaaggagcagcacctgggcctgctgcacgtgagagccaaggactacgacaccagactggactgcggctacttcaacaccctggacagcagccaggtgcccaacgccgtggagctgatcgcccacgtggacatcatgagagacaccagcaccgtgagcaaggaggagtgcgagaaggtgcccttcagccccagaaccgccgagttcaagagcagacagcccgccgacctggacagcctggagaagctggaccccggcggcctgctgaacagcgaccacagagtgagccacgaggagaagctgagcggcttcatcgccagcgagctggccaaggacaacggcagcctgagccagggcgactgcagccagaccgagggcaacggcgaggagtgcatcgagagagtgaccttcagcttcgccttcaaccacgagctgaccgacgtgaccagcggccccgaggtggaggtgctgtacgagagcaacctgctgaccgacgagatccacctggagagcggcaacgtgaccgtgaaccaggagaacaacagcctgaccagcatgggcaacgtggtgacctgcgagctgagcgtggagaaggtgtgcgacgaggacggcgaggccaaggagctggactaccaggccaccctgctggaggaccaggcccccgcccacttccacagaaacttccccgagcaggtgttccaggacctgcagagaaagagccccgagagcgagatcctgagcctgcacctgctggtggaggagctgagactgaaccccgacggcgtggagaccgtgaacgacaccaagcccgagctgaacgtggccagcagcgagggcggcgagatggagagaagagacagcgacagcttcctgaacatcttccccgagaagcaggtgaccaaggccggcaacaccgagcccgtgctggaggagtggatccccgtgctgcagagacccagcagaaccgccgccgtgcccaccgtgaaggacgccctggacgccgccctgcccagccccgaggagggcaccagcatcgccgccgtgcccgcccccgagggcaccgccgtggtggccgccctggtgcccttcccccacgaggacatcctggtggccagcatcgtgagcctggaggaggaggacgtgaccgccgccgccgtgagcgcccccgagagagccaccgtgcccgccgtgaccgtgagcgtgcccgagggcaccgccgccgtggccgccgtgagcagccccgaggagaccgcccccgccgtggccgccgccatcacccaggagggcatgagcgccgtggccggcttcagccccgagtgggccgccctggccatcaccgtgcccatcaccgaggaggacggcacccccgagggccccgtgacccccgccaccaccgtgcacgcccccgaggagcccgacaccgccgccgtgagagtgagcacccccgaggagcccgccagccccgccgccgccgtgcccacccccgaggagcccaccagccccgccgccgccgtgcccacccccgaggagcccaccagccccgccgccgccgtgcccccccccgaggagcccaccagccccgccgccgccgtgcccacccccgaggagcccaccagccccgccgccgccgtgcccacccccgaggagcccaccagccccgccgccgccgtgcccacccccgaggagcccaccagccccgccgccgccgtgcccacccccgaggagcccaccagccccgccgccgccgtgcccacccccgaggagcccaccagccccgccgccgccgtgcccacccccgaggagcccgccagccccgccgccgccgtgcccacccccgaggagcccgccagccccgccgccgccgtgcccacccccgaggagcccgccttccccgcccccgccgtgcccacccccgaggagagcgccagcgccgccgtggccgtgcccacccccgaggagagcgccagccccgccgccgccgtgcccacccccgccgagagcgccagcttcgccgccgtggtggccaccctggaggagcccaccagccccgccgccagcgtgcccacccccgccgccatggtggccaccctggaggagttcaccagccccgccgccagcgtgcccaccagcgaggagcccgccagcctggccgccgccgtgagcaaccccgaggagcccaccagccccgccgccgccgtgcccaccctggaggagcccaccagcagcgccgccgccgtgctgacccccgaggagctgagcagccccgccgccagcgtgcccacccccgaggagcccgccagccccgccgccgccgtgagcaacctggaggagcccgccagccccgccgccgccgtgcccacccccgaggtggccgccatccccgccgccagcgtgcccacccccgaggtgcccgccatccccgccgccgccgtgccccccatggaggaggtgagccccatcggcgtgcccttcctgggcgtgagcgcccacaccgacagcgtgcccatcagcgaggagggcacccccgtgctggaggaggccagcagcaccggcatgtggatcaaggaggacctggacagcctggtgttcggcatcaaggaggtgaccagcaccgtgctgcacggcaaggtgcccctggccgccaccgccggcctgaacagcgacgaggtgatcgtgcacttcgacagcggcaagggcctgaagagcaaggtgagattcgccggcctgacctggtggtag

SEQ ID NO: 23847 - DNA, 207 bp, Artificial Sequence
  Description of Artificial Sequence: Synthetic coding sequence
atgtgcctgtactgctgggacatcgagcccagccaggtgaaccccgagggccccagacagcaccaccccagcgaggtgaccgagagacagctggccaacaagagaatccagaacatgcagcacctgaagaaggagaagagaagactgaacaagagattcagcagacccagccccatccccgagcccggcctgctgtggagcagctag

SEQ ID NO: 23848 - DNA, 1584 bp, Artificial Sequence
  Description of Artificial Sequence: Synthetic coding sequence
atggtgagacccggctacagccacagagtgagcctgcccaccagccccggcatcctggccaccagcccctaccccgagaccgacagcgccttcttcgagcccagccacctgaccagcgccgccgacgagggcgccgtgcaggtgagcagaagaaccatcagcagcaacagcttcagccccgaggtgttcgtgctgcccgtggacgtggagaaggagaacgcccacttctacgtggccgacatgatcatcagcgccatggagaagatgaagtgcaacatcctgagccagcagcagaccgagagctggagcaaggaggtgagcggcctgctgggcagcgaccagcccgacagcgagatgaccttcgacaccaacatcaagcaggagagcggcagcagcaccagcagctacagcggctacgagggctgcgccgtgctgcaggtgagccccgtgaccgagaccagaacctaccacgacgtgaaggagatctgcaagtgcgacgtggacgagttcgtgatcctggagctgggcgacttcaacgacatcaccgagacctgcagctgcagctgcagcagcagcaagagcgtgacctacgagcccgacttcaacagcgccgagctgctggccaaggagctgtacagagtgttccagaagtgctggatcctgagcgtggtgaacagccagctggccggcagcctgagcgccgccggcagcatcgtggtgaacgaggagtgcgtgagaaaggacttcgagagcagcatgaacgtggtgcaggagatcaagttcaagagcagaatcagaggcaccgaggactgggccccccccagattccagatcatcttcaacatccacccccccctgaagagagacctggtggtggccgcccagaacttcttctgcgccggctgcggcacccccgtggagcccaagttcgtgaagagactgagatactgcgagtacctgggcaagtacttctgcgactgctgccacagctacgccgagagctgcatccccgccagaatcctgatgatgtgggacttcaagaagtactacgtgagcaacttcagcaagcagctgctggacagcatctggcaccagcccatcttcaacctgctgagcatcggccagagcctgtacgccaaggccaaggagctggacagagtgaaggagatccaggagcagctgttccacatcaagaagctgctgaagacctgcagattcgccaacagcgccctgaaggagttcgagcaggtgcccggccacctgaccgacgagctgcacctgttcagcctggaggacctggtgagaatcaagaagggcctgctggcccccctgctgaaggacatcctgaaggccagcctggcccacgtggccggctgcgagctgtgccagggcaagggcttcatctgcgagttctgccagaacaccaccgtgatcttccccttccagaccgccacctgcagaagatgcagcgcctgcagagcctgcttccacaagcagtgcttccagagcagcgagtgccccagatgcgccagaatcaccgccagaagaaagctgctggagagcgtggccagcgccgccacctag

SEQ ID NO: 23849 - DNA, 462 bp, Artificial Sequence
  Description of Artificial Sequence: Synthetic coding sequence
gtgagaggcgccagcgccagaccccccctgctgggcagcgaggagcccctgagccccgccagccaccccgtgagagagggcggcggcggcgtgagccccccccccggccagcccccctgccccggcggcagatggggcggccagcccagcgccagacccgccgcccccagcggcagagaggtgggcgtgagcgcccccagacccgccagcagacccgtgagagaggtgagaggcgccagcgccagaccccccctgctgggcagcgaggagcccctgtgccccgccagcagacccgtgagagagggcggcggcggcgtgagccccccccccggccagccccccagacccggcggcagaggcgccagcgccagaccccccctgctgggcagcgaggagcccctgtgcgccgccaccacccccagcggcagatgcgcccagcagctgatcgagaacggcccctag

SEQ ID NO: 23850 - DNA, 1290 bp, Artificial Sequence
  Description of Artificial Sequence: Synthetic coding sequence
atgggcctgcccagctggaccagaagaagcagaaaccacgacgtgagcggcgcccccctgcccctggagtgcaaccacgtgggcgaggccctgccccccgagatggtgaccagactgtacgacggcatgagaagagtggacctgaccggcaaggccaagggccccagcgagaacgtgagccaggagcagttcaccgccagcatgagccacctgctgaagggcaacagcgaggagaagagcctgatgatcatgaagatgatcagcgccaccgagggccccgtgaaggccagagaggtgcagaagttcaccgaggacctggtgggcagcgtggtgcacgtgctgagccacagacaggagctgagaggctggaccggcaaggaggcccccggccccaaccccagagtgcaggtgctggccgcccagctgctgagcgacatgaagctgcaggacggcaagagactgctgggcccccagtggctggactacgactgcgacagagccgtgatcgaggactgggtgttcagagtgccccacgtggccatcttcctgagcgtggtgatctgcaagggcttcctgatcctgtgcagcagcctggacctgaccaccctggtgcccgagagacaggtggaccagggcagaggcttcgagagcatcctggacgtgctgagcgtgatgtacatcaacgcccagctgcccagagagcagagacacagatggtgcctgctgttcagcagcgagctgcacggccacagcttcagccagctgtgcggccacatcacccacagaggcccctgcgtggccgtgctggaggaccacgacaagcacgtgttcggcggcttcgccagctgcagctgggaggtgaagccccagttccagggcgacaacagatgcttcctgttcagcatctgccccagcatggccgtgtacacccacaccggctacaacgaccactacatgtacctgaaccacggccagcagaccatccccaacggcctgggcatgggcggccagcacaactacttcggcctgtgggtggacgtggacttcggcaagggccacagcagagccaagcccacctgcaccacctacaacagcccccagctgagcgcccaggagaacttccagttcgacaagatggaggtgtgggccgtgggcgaccccagcgaggagcagctggccaagggcaacaagagcatcctggacgccgaccccgaggcccaggccctgctggagatcagcggccacagcagacacagcgagggcctgagagaggtgcccgacgacgagtag

SEQ ID NO: 23851 - DNA, 2493 bp, Artificial Sequence
  Description of Artificial Sequence: Synthetic coding sequence
atggacgacgacgacgacagctgcctgctggacctgatcggcgacccccaggccctgaactacttcctgcacggccccagcaacaagagcagcaacgacgacctgaccaacgccggctacagcgccgccaacagcaacagcatcttcgccaacagcagcaacgccgaccccaagagcagcctgaagggcgtgagcaaccagctgggcgagggccccagcgacggcctgcccctgagcagcagcctgcagttcctggaggacgagctggagagcagccccctgcccgacctgaccgaggaccagcccttcgacatcctgcagaagagcctgcaggaggccaacatcaccgagcagaccctggccgaggaggcctacctggacgccagcatcggcagcagccagcagttcgcccaggcccagctgcaccccagcagcagcgccagcttcacccaggccagcaacgtgagcaactacagcggccagaccctgcagcccatcggcgtgacccacgtgcccgtgggcgccagcttcgccagcaacaccgtgggcgtgcagcacggcttcatgcagcacgtgggcatcagcgtgcccagccagcacctgagcaacagcagccagatcagcggcagcggccagatccagctgatcggcagcttcggcaaccaccccagcatgatgaccatcaacaacctggacggcagccagatcatcctgaagggcagcggccagcaggcccccagcaacgtgagcggcggcctgctggtgcacagacagacccccaacggcaacagcctgttcggcaacagcagcagcagccccgtggcccagcccgtgaccgtgcccttcaacagcaccaacttccagaccagcctgcccgtgcacaacatcatcatccagagaggcctggcccccaacagcaacaaggtgcccatcaacatccagcccaagcccatccagatgggccagcagaacacctacaacgtgaacaacctgggcatccagcagcaccacgtgcagcagggcatcagcttcgccagcgccagcagcccccagggcagcgtggtgggcccccacatgagcgtgaacatcgtgaaccagcagaacaccagaaagcccgtgaccagccaggccgtgagcagcaccggcggcagcatcgtgatccacagccccatgggccagccccacgccccccagagccagttcctgatccccaccagcctgagcgtgagcagcaacagcgtgcaccacgtgcagaccatcaacggccagctgctgcagacccagcccagccagctgatcagcggccaggtggccagcgagcacgtgatgctgaacagaaacagcagcaacatgctgagaaccaaccagccctacaccggccccatgctgaacaaccagaacaccgccgtgcacctggtgagcggccagaccttcgccgccagcggcagccccgtgatcgccaaccacgccagcccccagctggtgggcggccagatgcccctgcagcaggccagccccaccgtgctgcacctgagccccggccagagcagcgtgagccagggcagacccggcttcgccaccatgcccagcgtgaccagcatgagcggccccagcagattccccgccgtgagcagcgccagcaccgcccaccccagcctgggcagcgccgtgcagagcggcagcagcggcagcaacttcaccggcgaccagctgacccagcccaacagaacccccgtgcccgtgagcgtgagccacagactgcccgtgagcagcagcaagagcaccagcaccttcagcaacacccccggcaccggcacccagcagcagttcttctgccaggcccagaagaagtgcctgaaccagaccagccccatcagcgcccccaagaccaccgacggcctgagacaggcccagatccccggcctgctgagcaccaccctgcccggccaggacagcggcagcaaggtgatcagcgccagcctgggcaccgcccagccccagcaggagaaggtggtgggcagcagccccggccaccccgccgtgcaggtggagagccacagcggcggccagaagagacccgccgccaagcagctgaccaagggcgccttcatcctgcagcagctgcagagagaccaggcccacaccgtgacccccgacaagagccacttcagaagcctgagcgacgccgtgcagagactgctgagctaccacgtgtgccagggcagcatgcccaccgaggaggacctgagaaaggtggacaacgagttcgagaccgtggccacccagctgctgaagagaacccaggccatgctgaacaagtacagatgcctgctgctggaggacgccatgagaatcaaccccagcgccgagatggtgatgatcgacagaatgttcaaccaggaggagagagccagcctgagcagagacaagagactggccctggtggaccccgagggcttccaggccgacttctgctgctacctgtacagctag

SEQ ID NO: 23852 - DNA, 1368 bp, Artificial Sequence
  Description of Artificial Sequence: Synthetic coding sequence
atggtggagcagggcgacgccgcccccctgctgagatgggccgagggccccgccgtgagcctgccccaggccccccagccccaggccggcggctggggcagaggcggcggcggcggcgccagacccgccgccgagccccccagaagaagagagcccgaggagcccgccgcccccgaggtgctgctgcagcccggcagactggagctgggcgacgtggaggaggaccaggtggtggccgtgttcgtggtgaccttcgaccccagaagcggcaacatggtggagtggtgcctgccccaggacatcgacctggagggcgtggagttcaagagcatggccagcggcagccacaagatccagagcgacttcatctacttcagaaagggccccttcttcggcctggcctgcttcgccaacatgcccgtggagagcgagctggagagaggcgccagaatgaagagcgtgggcatcctgagccccagctacaccctgctgtacagatacatgcacttcctggagaaccaggtgagacaccagctggagatgcccggccactacagccacctggccgccttctacgaggacaagaagggcgtgctgcacgccggccccggcagaggcagcagcctgccccccgtgtactggctgcccagcatccacagatacatgtaccccgagatgaagatcacccaccccgccggctgcatgagccagttcatcaagttcttcggcgagcagatcctgatcctgtggaagttcgccctgctgagaaagagaatcctgatcttcagccccccccccgtgggcgtggtgtgctacagagtgtactgctgctgctgcctggccaacgtgagcctgcccggcatcggcggcaccatccccgagagcaagcccttcttctacgtgaacgtggccgacatcgagagcctggaggtggaggtgagctacgtggcctgcaccaccgagaagatcttcgaggagaagagagagctgtacgacgtgtacgtggacaaccagaacgtgaagacccaccacgaccacctgcagcccctgctgaagatcaacagcgccgacagagagaagtacagaagactgaacgagcagagacagatgctgctgtacagccaggaggtggaggaggactacaacccctgcgaggaggacctgttcgtgctgttcttcctggagcagaacaacagaatcttccagaccctgctggaggtgagcgccagccaggacaagaccctgaccgccgagcacgccagaggcatgggcctggacccccagggcgacagaagcttcctgctggacctgctggaggcctacggcatcgacgtgatgctggtgatcgacaacccctgctgcccctag

SEQ ID NO: 23853 - DNA, 2235 bp, Artificial Sequence
  Description of Artificial Sequence: Synthetic coding sequence
atggaggactgcctgcacaccagcagcgagaacctgagcaagctggtgagctgggcccacagccacggcaccatctgcagcctgatccccaacctgaagcacctgctgagcgagggcagccacggcaacctgaccgccatgtggggctgcagcgccggccacgcctaccactggcccctgaccgccacctgcagagccggcagccaggagagagtgtgcttccaggacaacagaagcttcaacagcgacagccccagcatcatcggcgtgcccagcgagacccagaccagccccgtggagagataccccggcagacccgtgaaggccaagctggactgcaacagaaccagagacagctgcgacttcagctactgcagcgagcccagcgagctggacgagaccgtggaggagtacgaggacgagaacaccctgttcgacatggtgtgcgagagcagcgtgaccgacgaggacagcgacttcgagccccagacccagagaccccagagcatcgccagaaagagacccggcgtggtgcccagcagcctgcacagcagcagccagacccagatggtggacgagtgcagcaacgacgtgatcatcaagaagatcaagcaggagatccccgaggactactacatcgtggccaacgccgagctgaccggcggcgtggacggccccgccctgagcctgacccagatggccaagcccaagccccagacccacgccggccccagctgcgtgggcagcgccaagctgatcccccacgtgaccagcgccatcagcaccgagctggacccccacggcatgagcgccagccccagcgtgatcagcagacccatcgtgcagaagaccgccagagtgagcctggccagccccaacagaggcccccccggcacccacggcaccaaccagcaggtggccatgcagatgcccgtgagcaccagccaccccaacaagcagatcagcatccccctgagcgccctgcagctgcccggccaggacgagcaggtggccagcgaggagttcctgagccacctgcccagccaggtgagcagctgcgaggtggccctgagccccagcgtgaacaccgagcccgaggtgagcagcagccagcagcagccccccgtggcccccgccatcaccaccgaggccaccgcccagtgcatccccgaccaggacgagagagccgccgagctgagcagagagcagaacgagaagaccatcagaagcacccagaccgccctgagaaacttcccctacagcaccaagctgaacaagttccccgtgttcaacatcaacgacgacctgaacgacctgtgcaccagcgccgtgagccccaacaccaccaaggccaccagatacgccctgaacgtgtggagatactggtgcatgaccaacggcctgaaggaccacaccgacatcaccaagatccccgccgtgaagctgaacgagctgctggagaacttctacgtgaccgtgaagaagagcgacggcagcgacttcctggccaccagcctgcacgccatcagaagaggcctggacagaatcctgaagaacgccggcgtgggcttcagcatcaccagcagcaccttcagcagcagcaccaagaagctgaaggagaagctgtgggtgctgagcaaggccggcatgagcggcgccagaagcagaaacatcgtgtacttcagcctgagcgacgaggaggagatgtggcaggccggctgcctgggcgacgacagccccatcaccctgctgagcaccgtggtgaagtacaacagccagtacctgaacatgagaaccctgcaggagcacgccgacctgatgtacggcgacatcgagctgctgaaggacccccagaaccagccctacttcgccagaaccgacagcgtgaagagagagagcagaagcggcagcaccagagtgtgccacggcaagatctaccacgagcacagcagaggccacaagcagtgcccctactgcctgctgtacaagtacatgtacatccacagaccccccacccagatggaggccaagagccccttctacctgaccgccagaaaggaggccaccgacatgggcagcgtgtggtacgaggagcagagaatgggcctgagaagcctgagaggcatcgtgcccaacctggccaagaaggtgaagctggagaactgcgagaacttcaccttcgtgagcttcacccaggtgagcagaagactgggcagccacagctgctgccagtag

SEQ ID NO: 23854 - DNA, 111 bp, Artificial Sequence
  Description of Artificial Sequence: Synthetic coding sequence
aaggagaagaaggaggagagaaagaaggagagaaagaaggaggagagaaagaaggagagaaagaaggagagaaagaaggagaaggagagaaagaaggagaaggagagatag

SEQ ID NO: 23855 - DNA, 462 bp, Artificial Sequence
  Description of Artificial Sequence: Synthetic coding sequence
gtgagaggcgccagcgccagaccccccctgctgggcagcgaggagcccctgtgccccgccagcagacccgtgagagagggcggcggcggcgtgagccccccccccggccagccccccagacccggcggcagatggggcggccagccccccgccagacccgccgcccccagcggcagagaggtgggcggcggccagcccccctgccccgccagcagacccgtgagagaggtgagaggcgccagcgccagaccccccctgctgggcagcgaggagcccctgtgccccgccagcagacccgtgagagagggcggcggcggcgtgagccccccccccggccagccccccagacccggcagaggcgccagcgccagaccccccctgctgggcagcgaggagcccctgtgccccgccaccacccccagcggcagatgcgcccagcagctgatcgagaacggcccctag

SEQ ID NO: 23856 - DNA, 267 bp, Artificial Sequence
  Description of Artificial Sequence: Synthetic coding sequence
atgcccggcgtggtgagcgccgccggcacccaggtgagaagactggacgaggtgcccgccagcctgagactgcagcaccacctgcagctgagagagggcctggccgtgcccctgccccccctggtgatccagagccccgccgcccaccacgtggccggcggcagcttcagcgacttcaccctggacatcgccctgggcgccagaagaatcagactggccctggtgagacaggtgacccaggacggccccgtggccttcctggcctag

SEQ ID NO: 23857 - DNA, 456 bp, Artificial Sequence
  Description of Artificial Sequence: Synthetic coding sequence
atgctgagatggttcgtgcagcagcccaccagctgcagccacgcccagcccctgccccccccccacggcaccgccagcctgagccccctggtgcccagctgcggcagcgccgcctggcccagcctgcactacctgggcagccccgccgacagcggctgcagcagaggccagagagccctgcccgccgtgtggccccccagctgctacagccagtgcccccagggcagacccccccaccccgtgcccagaagccccagaagaggcagcagagacctgggcaaggagcccggcgaggaggccgccccctggcccagcccctgcgacagcagactgcacagacaccccatgcccagaacccccctgagcgccagcgccggctgcgaccccagcctgatccagcccagcccccaccccacccccccccagcagggctgcgtgacccccttccacagatag

SEQ ID NO: 23858 - DNA, 2757 bp, Artificial Sequence
  Description of Artificial Sequence: Synthetic coding sequence
atgaacgagaacatgagagccaccctggccaccagcaagaacgtgttccagctgaagctggaggagacccagaagctgctggaggaccagcacctgagcaacctgcagaagttcggcgacgaggtgaaccagatcaccaacagcgagaccctgagcagcatcgacagcctggaggccaccgagcacgaggagatctacctgaccctgaacaaggagcacagcaccagcatccagagaaacaccatcagcctgaagcccgccaacatgcagagcaccaacctgagctgcttcgacgaggacaagctggccttcagcaagacccagcacatcaacaactggctgaccaacctggacgccagcaacacccagaacgtgaccgccttcagcgacatcctgagcaagagcaacgtgctgcccagctgggagtacttcaacagcaaggagcagaaccccagccccctgaacggcaccgtggagagagccaccaacaccgccaacaacagcgtgcccttcgtgagcagcccccccatgttcgtgctggacaagaagtgcgagaagaccagcgagaccagcaccatgagaaccaccgacagcaccagcggcgccttcaagagagagagacccctggtgaccgagagccccaccttcaagttcagcaagagccagagcaccagcgacagcctgacccaggaggtggccaccttccccgaccaggagaagtacagcgagctgaaccaggagaacggcaccaccagcatccccaccagctgcgtgcccgtggccacccccctggtgctgcccagcaacatccagagcgccagacccagcgccaagaacagcatccacatcaaggagatcgacgccgtgcagtgcagcgacaagctggacgagctgaaggacggcaaggaggaggagatcaagtacttcaactgcaacaaggaggagctgcccctgttcagcgacagcttccaggacgcctacatcccccacaaccccgacagcaaggacgagaagcagaagctggccgagaccagcagcctgagcaacgtgaccagcaactacgacttcgtgggccagcacaagaagatgaagtacaacatccacgagagaaacggcgtgagattcctgaagagcatcctgaagaaggagagcaagtacgagcacggctacctgaaggccctgatcatcaaccagagcttcaagttcggcaaccagaaggccgccgccatcagagacagcatcgagctgaccaaggagaagggcgccgagatccccaagaccatcaagaagctgagatggttcgacgagaccagcaacatcgagaacaacgccgagaacagccacagcctgaagaacaagaccggcaccacccagcagcacagccagcagttccacatccagagcggcgccggcagcaacatcatcagcgtgagcacctgcgccgtgaacagcgccgacaccaagaagagcagagaggacagcatcagcgagaacgtgaccaccctgggcggcagcggcgccgaccacatgcccctgaactgcttcatccccagcggctacaacttcgccaagcacgcctggcccgccagcaagaaggaggagagcaagatccccgtgcacgacgacagcaagaccaagcagggcaagccccagagaggcagagccaagatcatcagaaagcccggcagcgccaaggtgcagagcggcttcatctgcaccaacagaaagggcgccgtgatccagccccagagcgccagcaaggtgaacatcttcacccaggcccagggcaagctgatcatcccctgcccccccccccagagcaccagcaacatcagaagcggcaagaacatccaggtgagccagtgccagcccgtgacccccgagaacccccagaacatcatcacccacaacagcttcaacagcaagcacgtgctgcccaccgagcacagcctgaaccagtggaaccaggagagcagcagccccctgagcaacgcctgcagcgacctggtgaccgtgatccccagcctgcccagctactgcagcagcgagtgccagaccttcgccaagatcaaccacagcaacggcacccaggccgtggccagacaggacgccaccctgtactgcacccagagaagccccgtgtgcgaggagagctaccccagcgtgaccctgagaaccgccgaggaggagagcgtgcccctgtggaagagaggccccaacgtgctgcaccagaacaagagagccaccggcagcaccgtgatgagaagaaagagaatcgccgagaccaagagaagaaacatcctggagcagaagagacagaaccccggcagcgtgggccagaagtacagcgagcagatcaacaacttcggccagagcgtgctgctgagcagcagcgagcccaagcagaccaccagaggcaccagctacatcgaggaggtgagcgacagcaccagcgagttcctgatggccgagaacctggtgaaggccagcgtgcccgaggacgagatcctgaccgtgctgaacagcaagcagatccagaagagcaacctgcccctgaacaagacccagcagttcaacatctgcaccctgagcgccgaggagcagaagatcctggagagcctgaacgacctgagcgagagactgcactacatccaggagagcatctgcaagaaccccagcatcaagaacaccctgcagatcatccccctgctggagaagagagaggacagaaccagcagctgcagagacaagagatag

SEQ ID NO: 23859 - DNA, 459 bp, Artificial Sequence
  Description of Artificial Sequence: Synthetic coding sequence
ctgcccctgttctgcagcagcggcatcctgcagaaggagttctggagaaacagaatccagtacaaccagagccagaaggacatcctgcagagctggttccagcacgaccccttccccgacaaggccgccagagagcagctggccaaggagatcggcgtgcccgagagcaacatccaggtgtggttcaagaactacagagtgaagcagagaaagctggactacaagtgcttcagcgagaaggaccagacccagggccacgaccagagccagcacctgacccaggagtacctgcccaaggaggccagacagaagcagaccttcatcacctggacccagaagaacagactggtgcaggccttcgagagaaaccccttccccgacatcgccaccagaaagaagctggccgagcagaccggcctgcaggagagcagaatccaggtgagcagcatgtgcgtgtag

SEQ ID NO: 23860 - DNA, 3930 bp, Artificial Sequence; identical to SEQ ID NO: 23789
  Description of Artificial Sequence: Synthetic coding sequence

SEQ ID NO: 23861 - DNA, 3681 bp, Artificial Sequence
  Description of Artificial Sequence: Synthetic coding sequence
atgggcgagcagaaggtgagcagacagttcaagcagtgccacagaaccaccagctgggccaagagcaagctgttcagcagactgagcagcatgttcctgcagcagctgggcaagaacatcaagttcggccagagaagccccaacgccatccccatgaacaaggccaacagcggcgaggccagcctggaggaggacctgttcctgaccagccccatggagatcgtgacccagcaggacatcgtgctgagcgacgccgagaacaagagcagcgacacccccagcagcctgagccccctgaacctgcccggcgccggcagcgagatggaggagaaggtggcccccgtgaagcccagcagacccaagagacacttcagcagcgccggcaccatcgagagcgtgaacctggacgccatccccctggccatcgccagactggacaacagcgccgccaagcacaagctggccgtgaagcccaagaagcagagagtgagcaagaagcacagaagactggcccaggacccccagcacgagcagggcggcctggagagcagaccctgcctggaccagaacggccaccccggcgaggacaagcccacctggcacgaggaggagcccaaccccctggacagcgaggaggagagaagaagacaggaggactactggagagagctggaggccaagtgcaagagacagaaggccgaggccgccgagaagagaagactggaggagcagagactgcaggccctggagagaagactgtgggaggagaacagaagacaggagctgctggaggaggagggcgagggccaggagccccccctggaggccgagagagcccccagagaggagcagcagagaagcctggaggcccccggctgggaggacgccgagagaagagagagagaggagagagagagactggaggccgaggaggagagaagaagactgcaggcccaggcccaggccgaggagagaagaagactggaggaggacgccagactggaggagagaagaagacaggaggaggaggagggcagatgcgccgaggagctgaagagacaggaggaggaggaggccgagggctgggaggagctggagcagcaggaggccgaggtgcagggcccccccgaggccctggaggagaccggcgagggcagaagaggcgccgaggaggaggacctgggcgaggaggaggaggagggccaggcccacctggaggactggagaggccagctgagcgagctgctgaacgacttcgaggagagactggaggaccaggagagactgaagcccgagggccagagagagcacagcgaggagcccggcatctgcgaggagcagaaccccgaggccgagagaagaagagagcagcagggcagaagcggcgacttccagggcgccgacagacccggccccgaggagaagagagaggagggcgacaccgagcccctgctgaagcaggagggccccgtggaggccgcccagccccccgtggagagaaaggaggccgccgccctggagcagggcagaaaggtggaggagctgagatggcaggaggtggacgagagacagaccatgcccagaccctacaccttccaggtgagcagcggcggcaagcagatcctgttccccaaggtgaacctgagccccgtgacccccgccaaggacaccggcctgaccgccgccccccaggagcccaaggcccccaaggccagccccgtgcagcacgccctgcccagcagcctgagcgtgccccacaccgccatcctggtgaccggcgcccagctgtgcggccccgccgtgaacctgagccagatcaaggacaccgcctgcaagagcctgctgggcctggaggagaagaagcacgccgaggcccccgccggcgagaacccccccagaggccccggcgacgccagagccggcagcggcaaggccaagcccagacaggagagccccagcagcgccagcgccctggccgagtgggccagcatcagaagcagaatcctgaagaacgccgagagcgaccccagaagcagcgagagagaccagctgagacccggcgacgagagcacccccagaggcagatgcgacagcagaggcaaccagagaaagaccccccccgtgaacgccaagttcagcatcatgcccgcctggcagaagttcagcgacggcggcaccgagaccagcaagcagagcaccgaggccgagagcatcagaaagagacccatgctgggccccagcgaggagaccgccccccagcccccccccgccggcgtgagagagctgggcaagggccccgagaagagcgagatgcacagagagcccgccgacaccaccgagggctgcaagttcgccaaggacctgcccagcttcctggtgcccagcctgccctaccccccccagaaggtggtggcccacaccgagttcaccaccagcagcgacagcgagaccgccaacggcatcgccaagcccgaccccgtgatgcccggcggcgaggagaaggccagccccttcggcatcaagctgagaagaaccaactacagcctgagattcaactgcgaccagcaggccgagcagaagaagaagaagagacacagcagcaccggcgacagcgccgacgccggcccccccgccgccggcagcgccagaggcgagaaggagatggagggcgtggccctgaagcacggccccagcctgccccaggagagaaagcaggcccccagcaccagaagagacagcgccgagcccagcagcagcagaagcgtgcccgtggcccaccccggccccccccccgccagcagccagacccccgcccccgagcacgacaaggccgccaacaagatgcccctggcccagaagcccgccctggcccccaagcccaccagccagaccccccccgccagccccctgagcaagctgagcagaccctacctggtggagctgctgagcagaagagccggcagacccgaccccgagcccagcgagcccagcaaggaggaccaggagagcagcgacagaagaccccccagcccccccggccccgaggagagaaagggccagaagagagacgaggaggaggaggccaccgagagaaagcccgccagcccccccctgcccgccacccagcaggagaagcccagccagacccccgaggccggcagaaaggagaagcccatgctgcagagcagacacagcctggacggcagcaagctgaccgagaaggtggagaccgcccagcccctgtggatcaccctggccctgcagaagcagaagggcttcagagagcagcaggccaccagagaggagagaaagcaggccagagaggccaagcaggccgagaagctgagcaaggagaacgtgagcgtgagcgtgcagcccggcagcagcagcgtgagcagagccggcagcctgcacaagagcaccgccctgcccgaggagaagagacccgagaccgccgtgagcagactggagagaagagagcagctgaagaaggccaacaccctgcccaccagcgtgaccgtggagatcagcgacagcgccccccccgcccccctggtgaaggaggtgaccaagagattcagcacccccgacgccgcccccgtgagcaccgagcccgcctggctggccctggccaagagaaaggccaaggcctggagcgactgcccccagatcatcaagtag

SEQ ID NO: 23862 - DNA, 2538 bp, Artificial Sequence
  Description of Artificial Sequence: Synthetic coding sequence
atggcccaggtgtggagaagagtgagcgagcacttctgggagagcgagaccaccaccagcaagagcaccagcggcctgaccgacatcacctggagcagcagcggcagcgacctgagcgacgaggacaagaccctgagccagctgcagagagacgagctgcagttcatcgactgggagatcgacagcgacagagccgaggccagcgactgcgacgagttcgaggacgacgagggcgccgtggagatcagcgactgcgccagctgcgccagcaaccagagcctgaccagcgacgagaagctgagcgagctgcccaagcccagcagcatcgagatcctggagtacagcagcgacagcgagaaggaggacgacctggagaacgtgctgctgatcgacagcgagagcccccacaagtaccacgtgcagttcgccagcgacgccagacagatcatggagagactgatcgaccccagaaccaagagcaccgagaccatcctgcacaccccccagaagcccaccgccaagttccccagaacccccgagaacagcgccaagaagaagctgctgagaggcggcctggccgagagactgaacggcctgcagaacagagagagaagcgccatcagcctgtggagacaccagtgcatcagctaccagaagaccctgagcggcagaaagagcggcgtgctgaccgtgaagatcctggagctgcacgaggagtgcgccatgcaggtggccatgtgcgagcagctgctgggcagccccgccaccagcagcagccagagcgtggcccccagacccggcgccggcctgaaggtgctgttcaccaaggagaccgccggctacctgagaggcagaccccaggacaccgtgagaatcttccccccctggcagaagctgatcatccccagcggcagctgccccgtgatcctgaacacctacttctgcgagaaggtggtggccaaggaggacagcgagaagacctgcgaggtgtactgccccgacatccccctgcccagaagaagcatcagcctggcccagatgttcgtgatcaagggcctgaccaacaacagccccgagatccaggtggtgtgcagcggcgtggccaccaccggcaccgcctggacccacggccacaaggaggccaagcagagaatccccaccagcacccccctgagagacagcctgctggacgtggtggagagccagggcgccgccagctggcccggcgccggcgtgagagtggtggtgcagagagtgtacagcctgcccagcagagacagcaccagaggccagcagggcgccagcagcggccacaccgaccccgccggcaccagagcctgcctgctggtgcaggacgcctgcggcatgttcggcgaggtgcacctggagttcaccatgagcaaggccagacagctggagggcaagagctgcagcctggtgggcatgaaggtgctgcagaaggtgaccagaggcagaaccgccggcatcttcagcctgatcgacaccctgtggccccccgccatccccctgaagacccccggcagagaccagccctgcgaggagatcaagacccacctgcccccccccgccctgtgctacatcctgaccgcccaccccaacctgggccagatcgacatcatcgacgaggaccccatctacaagctgtaccagccccccgtgaccagatgcctgagagacatcctgcagatgaacgacctgggcaccagatgcagcttctacgccaccgtgatctaccagaagccccagctgaagagcctgctgctgctggagcagagagagatctggctgctggtgaccgacgtgaccctgcagaccaaggaggagagagaccccagactgcccaagaccctgctggtgtacgtggcccccctgtgcgtgctgggcagcgaggtgctggaggccctggccggcgccgccccccacagcctgttcttcaaggacgccctgagagaccagggcagaatcgtgtgcgccgagagaaccgtgctgctgctgcagaagcccctgctgagcgtggtgagcggcgccagcagctgcgagctgcccggccccgtgatgctggacagcctggacagcgccacccccgtgaacagcatctgcagcgtgcagggcaccgtggtgggcgtggacgagagcaccgccttcagctggcccgtgtgcgacatgtgcggcaacggcagactggagcagagacccgaggacagaggcgccttcagctgcggcgactgcagcagagtggtgaccagccccgtgctgaagagacacctgcaggtgttcctggactgcagaagcagaccccagtgcagagtgaaggtgaagctgctgcagagaagcatcagcagcctgctgagattcgccgccggcgaggacggcagctacgaggtgaagagcgtgctgggcaaggaggtgggcctgctgaactgcttcgtgcagagcgtgaccgcccaccccaccagctgcatcggcctggaggagatcgagctgctgagcgccggcggcgccagcgccgagcactag

SEQ ID NO: 23863 - DNA, 324 bp, Artificial Sequence
  Description of Artificial Sequence: Synthetic coding sequence
atgctgagcaagggcagaagccccagaagaaagcaggtgcagacccagagaaaggccgccctggtgctgagcgtgacccccatggtgcccgtgggcagcgtgtggctggccatgagcagcgtgctgagcgccttcatgagagagctgcccggctggttcctgttcttcggcgtgttcctgcccgtgaccctgctgctgctgctgctgatcgcctacttcagaatcaagctgatcgaggtgaacgaggagctgagccagaactgcgacagacagcacaaccccaaggacggcagcagcctgtaccagagaatgaagtggacctag

SEQ ID NO: 23864 - DNA, 876 bp, Artificial Sequence
  Description of Artificial Sequence: Synthetic coding sequence
atcagacccttcagcagcgtgaacagcctggtgctgaacgaggccagcaccctggccaagagactgagcaccttcaccaccttcatcagacccttcagcagcatgaagagccccgtgctgaacgaggccagagccctgagcaagagattcgccaccttcaccgccctgatcagaagctgcgccagcatgaacagccccgtgctgaacgaggtgagattcgccggcaagggcttcagcaccttcaccgccttcatcagaagcttcagcagcgtgaacagcctggtgctgaaccaggacaagttcgccgccaagggcttcctgaccttcaccgccctgatcagacccatcaccagcgtgaacgccgccgtgagcaacgaggtgagagagctgagcaagggcttccccaccttcagcgccttcatcagaagcttcagcaccgtgaacagcctggtgctgaacgagttcagattcgccgccaagagattccccaccatcaccgccctgatcagacacttcagcagcgtgaacagcagcatgagcaacgagatcgaggacctgagcaagggcttccccaccctgaccgccctgatcagacccttcagcagagtgaacagcctggtgagcaagaaggccagagccctgagcaagggcttccccgccctggccaccttcatcagacccttcagcagcgtgaacagcctggtgttcaacgaggtgagattcgtggccaagggcttccccaccttcaccaccctgatgacccacagcagcagcgtgaccagcctggtggtgaacgagttcagattcatggacaagggcttcctgaccatcaccgccttcatcagacccttcagcagcgtgaactacctggtgtag

SEQ ID NO: 23865 - DNA, 672 bp, Artificial Sequence
  Description of Artificial Sequence: Synthetic coding sequence
aagccctacgcctgcaacgagtgcgtgaagagcttctgcgtgaagagcagcctgatcatccaccagagaacccacaccggcgagaagccctacaagtgcaacgagtacggcaagaccttccaccacaagagcaccctgaccgtgcaccagagaacccacggcgagaagccctacaagtgcaacgagtgcagaaagagcttctacatgaagagcgccctgagccagcaccagagaatccacatctgggaggagcactgcgagtgcaaggagtgcggcaagacctaccagagaagccacctggccaagcaccacagaaagtacaccaagaagccctacgagtgcaagcagtgcggcaagaccttccagaagagccacctgatcgagcaccagagaacccaccccggcgagatcccccacgagtgcaacaagtgcggcaagagcttctgctacaagagccccctgaccatccaccagagaacccacatcgaggagaagccctacaagtgcagcaagagcgtgacctacttctgcatgaagagccacctgaccgtgcaccagagaccccacaccagaaagaaccccttcgagtgcaacgagtgcagaaagatgttctacgtgaagagcaacctgatcaaccaccagagaacccacaccggcgagaagccctactag

SEQ ID NO: 23866 - DNA, 621 bp, Artificial Sequence
  Description of Artificial Sequence: Synthetic coding sequence
atgaaggccggcttccacctgaaccccaaggccatcgaggccagcctgcagggctgctgcagcgaggccgaggcccagcagaccggcagaagacagacccccccccagcccatgcagtgcgagctgcccaccgtgcccgtgcagatcggcagccacttcctgaagggcgtgagcttcaacgagagcgccgccgacaacctgaagctgaagacccacaccatgctgcagctgatgaaggaggccggctgctacaacggcatcaccagcagagacgacttccccgtgaccgaggtgctgaaccaggtgtgccccagcacctggagaggcgcctgcaagaccgccgtgcagctgctgttcggccaggccggcctggtggtggtggacaccgcccagatcgagaacaaggaggcctacgccccccagatcagcctggagggcagcagaatcgtggtgcaggtgcccagcacctggtgcctgaaggaggaccccgccaccatgagcctgctgcagagaagcctggaccccgagaagaccctgggcctggtggacgtgctgtacaccgccgtgctggacctgaacagatggagagccggcagactggtgtacctgagcttcttctag

SEQ ID NO: 23867 - DNA, 3945 bp, Artificial Sequence
  Description of Artificial Sequence: Synthetic coding sequence
atggagaagcacaacgccctgagatgcctgcccggcagaaacagaaaggagagcaccagcgagcagatgcccagcttccccgagatggtgtactacatccaggagaaggccagccacagaatgaagacccccgtgaagtacatgaccggcaccaccgtgctgcccttcaaccccgccgccttcggcgagatcgtgctgtacctgagaatgtgcctggcccacagcgccggcgtggtgcccaccagccagagcctggccgacatgcaggaccacgcccccgccatcggcagatacatcagaaccctgatgagcagcggccagatggcccccagcagcagcaacaagagcggcgagaccaaccccgtgcagatctacatcggcctgctgcagcagctgctggccggcgtgggcggcctgcccgtgatgtactgcctgctggaggccgtgagcgtgtaccccgagaagctggccaccaagttcgtggacaagaccgagtggatcaagagcctgatgaacaacagcaaggaggagatgagagagctggccgccctgttctacagcgtggtggtgagcaccgtgagcggcaacgagctgaagagcatgatcgagcagctgatcaagaccaccaaggacaaccacagccccgagatccagcacggcagcctgctggccctgggcttcaccgtgggcagatacctggccaagaagaagatgagaatgagcgagcagcaggacctggagagaaacgccgacaccctgcccgaccaggaggagctgatccagagcgccaccgagaccatcggcagcttcctggacagcaccagccccctgctggccatcgccgcctgcaccgccctgggcgagatcggcagaaacggccccctgcccatccccagcgagggcagcggcttcaccaagctgcacctggtggagagcctgctgagcagaatccccagcagcaaggagaccaacaagatgaaggagagagccatccagaccctgggctacttccccgtgggcgacggcgacttcccccaccagaagctgctgctgcagggcctgatggacagcgtggaggccaagcagatcgagctgcagttcaccatcggcgaggccatcaccagcgccgccatcggcaccagcagcgtggccgccagagacgcctggcagatgaccgaggaggagtacaccccccccgccggcgccaaggtgaacgacgtggtgccctgggtgctggacgtgatcctgaacaagcacatcatcagccccaacccccacgtgagacaggccgcctgcatctggctgctgagcctggtgagaaagctgagcacccacaaggaggtgaagagccacctgaaggagatccagagcgccttcgtgagcgtgctgagcgagaacgacgagctgagccaggacgtggccagcaagggcctgggcctggtgtacgagctgggcaacgagcaggaccagcaggagctggtgagcaccctggtggagaccctgatgaccggcaagagagtgaagcacgaggtgagcggcgagaccgtggtgttccagggcggcgccctgggcaagacccccgacggccagggcctgagcacctacaaggagctgtgcagcctggccagcgacctgagccagcccgacctggtgtacaagttcatgaacctggccaaccaccacgccatgtggaacagcagaaagggcgccgccttcggcttcaacgtgatcgccaccagagccggcgagcagctggcccccttcctgccccagctggtgcccagactgtacagataccagttcgaccccaacctgggcatcagacaggccatgaccagcatctggaacgccctggtgaccgacaagagcatggtggacaagtacctgaaggagatcctgcaggacctggtgaagaacctgaccagcaacatgtggagagtgagagagagcagctgcctggccctgaacgacctgctgagaggcagacccctggacgacatcatcgacaagctgcccgagatctgggagaccctgttcagagtgcaggacgacatcaaggagagcgtgagaaaggccgccgagctggccctgaagaccctgagcaaggtgtgcgtgaagatgtgcgaccccgccaagggcgccgccggccagagaaccatcgccgccctgctgccctgcctgctggacaagggcatgatgagcaccgtgaccgaggtgagagccctgagcatcaacaccctggtgaagatcagcaagagcgccggcgccatgctgaagccccacgcccccaagctgatccccgccctgctggagagcctgagcgtgctggagccccaggtgctgaactacctgagcctgagagccaccgagcaggagaaggccgccatggacagcgccagactgagcgccgccaagagcagccccatgatggagaccatcaacatgtgcctgcagtacctggacgtgagcgtgctgggcgagctggtgcccagactgtgcgagctgatcagaagcggcgtgggcctgggcaccaagggcggctgcgccagcgtgatcgtgagcctgaccacccagtgcccccaggacctgaccccctacagcggcaagctgatgagcgccctgctgagcggcctgaccgacagaaacagcgtgatccagaagagctgcgccttcgccatgggccacctggtgagaaccagcagagacagcagcaccgagaagctgctgcagaagctgaacggctggtacatggagaaggaggagcccatctacaagaccagctgcgccctgaccatccacgccatcggcagatacagccccgacgtgctgaagaaccacgccaaggaggtgctgcccctggccttcctgggcatgcacgagatcgccgacgaggagaagagcgagaaggaggagtgcaacctgtggaccgaggtgtggcaggagaacgtgcccggcagcttcggcggcatcagactgtacctgcaggagctgatcaccatcacccagaaggccctgcagagccagagctggaagatgaaggcccagggcgccatcgccatggccagcatcgccaagcagaccagcagcctggtgcccccctacctgggcatgatcctgaccgccctgctgcagggcctggccggcagaacctgggccggcaaggaggagctgctgaaggccatcgcctgcgtggtgaccgcctgcagcgccgagctggagaagagcgtgcccaaccagcccagcaccaacgagatcctgcaggccgtgctgaaggagtgcagcaaggagaacgtgaagtacaagatcgtggccatcagctgcgccgccgacatcctgaaggccaccaaggaggacagattccaggagttcagcaacatcgtgatccccctgatcaagaagaacagcctggagagcagcggcgtgagaaccaccaagaacgaggaggagaacgagaaggagaaggagctgcagctggagtacctgctgggcgccttcgagagcctgggcaaggcctggcccagaaacgccgagacccagagatgctacagacaggagctgtgcaagctgatgtgcgagagactgaagctgagcacctggaaggtgcagctgggcgtgctgcagagcatgaacgccttcttccagggcctgatgctgctggaggaggagcacgccgaccccgaggccctggccgagatcctgctggagacctgcaagagcatcacctacagcctggagaacaagacctacagcagcgtgagaaccgaggccctgagcgtgatcgagctgctgctgaagaagctggaggagagcaagcagtgggagtgcctgaccagcgagtgcagagtgctgctgatcgagagcctggccaccatggagcccgacagcagacccgagctgcaggagaaggccgccctgctgaagaagaccctggagaacctggagtag

SEQ ID NO: 23868 - DNA, 618 bp, Artificial Sequence
  Description of Artificial Sequence: Synthetic coding sequence
atggaggacggcggccagagagaggaggagaccagaagaaacgccacctgcggcgccgccgccaagagcgagaacagaggcaagagacacgccagcgccggcaagaagggcgccggcggcaccagccccaccgcccccagcaccaagagacccctgcccggcctgagcgcccccctgggcgccggcagcgccagcagcccccccctgagagcccccgtgcccagaagcgagtgccccggcagaagaagacccgtgctggccgccagaagcgacgccctggagagcagccccatcagcctgcccgccacccccgtgagaagacccctgctgagctacagcgcccccacccacctgggcacccccggcggcgccagaggccacctgcagggcgagggcctgagaggccagggcaagccccccgtgtggagagtgagaagagccctgccccccggctggacccagcaggccgaggcccaggagcagggcagcgccaccagagccggcctgggcgccagaagaggcgtgggcaccgccagctggggctggacctgggccacctgcggcagaaagggcgccagaaacagaaagagaagcgacgagagacccagacccccctag

SEQ ID NO: 23869 - DNA, 1353 bp, Artificial Sequence
  Description of Artificial Sequence: Synthetic coding sequence
atgaacagagtgagcgaggagaaggaggtgaccgaggagagactgaaggccgagcaggagagcttcgagaagaagatcagacagctggaggagcagaacgagctgatcatcaaggagagagaggccctgcagctgcagtacagagagtgccaggagctgctgagcctgtaccagaagtacctgagcgagcagcaggagaagctgaccatgagcctgagcgagctgggcgccgccagaatgcaggagcagcaggtgagcagcagaaagagcaccctgcagtgcagcagcgtggagctggacggcagctacctgagcatcgccagaccccagacctactaccagaccaagcagagacccaagagcgccgtgcaggacagcgccagcgagagcctgatcgccttcagaaacaacagcctgaagcccgtgaccctgcaccaccccaaggacgacctggacaagatccccagcgagaccaccacctgcaactgcgagagccccggcagaaagcccgccgtgcccaccgagaagatgccccaggaggagctgcacatgaaggagtgcccccacctgaagcccacccccagccagtgctgcggccacagactggccgccgacagagtgcacgacagccaccccaccaacatgaccccccagcaccccaagacccaccccgagagctgcagctactgcagactgagctgggccagcctggtgcacggcggcggcgccctgcagcccatcgagaccctgaagaagcagatcagcgaggacagaaagcagcagctgatgctgcagaagatggagctggagatcgagaaggagagactgcagcacctgctggcccagcaggagaccaagctgctgctgaagcagcagcagctgcaccagagcagactggactacaactgcctgctgaagagcaactgcgacggctggctgctgggcaccagcagcagcatcaagaagcaccaggacccccccaacagcggcgagaacagaaaggagagaaagaccgtgggcttccacagccacatgaaggacgacgcccagtggagctgccagaagaaggacacctgcagaccccagagaggcaccgtgaccggcgtgagaaaggacgccagcaccagccccatgcccaccggcagcctgaaggacttcgtgaccaccgccagccccagcctgcagcacaccaccagcagatacgagaccagcctgctggacctggtgcagagcctgagccccaacagcgcccccaagccccagagataccccagcagagaggccggcgcctggaaccacgtgaacctgcaggaggtgagcagccccagcagaagaggcggcctgcacctgtag

SEQ ID NO: 23870 - DNA, 1257 bp, Artificial Sequence
  Description of Artificial Sequence: Synthetic coding sequence
atgaagaagagaaaggagctgaacgccctgatcggcctggccggcgacagcagaagaaagaagcccaagaagggccccagcagccacagactgctgagaaccgagccccccgacagcgacagcgagagcagcagcgaggaggaggaggagttcggcgtggtgggcaacagaagcagattcgccaagggcgactacctgagatgctgcaagatctgctaccccctgtgcggcttcgtgatcctggccgcctgcgtggtggcctgcgtgggcctggtgtggatgcaggtggccctgaaggaggacctggacgccctgaaggagaagttcagaaccatggagagcaaccagaagagcagcttccaggagatccccaagctgaacgaggagctgctgagcaagcagaagcagctggagaagatcgagagcggcgagatgggcctgaacaaggtgtggatcaacatcaccgagatgaacaagcagatcagcctgctgaccagcgccgtgaaccacctgaaggccaacgtgaagagcgccgccgacctgatcagcctgcccaccaccgtggagggcctgcagaagagcgtggccagcatcggcaacaccctgaacagcgtgcacctggccgtggaggccctgcagaagaccgtggacgagcacaagaagaccatggagctgctgcagagcgacatgaaccagcacttcctgaaggagacccccggcagcaaccagatcatccccagccccagcgccaccagcgagctggacaacaagacccacagcgagaacctgaagcagatgggcgacagaagcgccaccctgaagagacagagcctggaccaggtgaccaacagaaccgacaccgtgaagatccagagcatcaagaaggaggacagcagcaacagccaggtgagcaagctgagagagaagctgcagctgatcagcgccctgaccaacaagcccgagagcaacagaccccccgagaccgccgacgaggagcaggtggagagcttcaccagcaagcccagcgccctgcccaagttcagccagttcctgggcgaccccgtggagaaggccgcccagctgagacccatcagcctgcccggcgtgagcagcaccgagggccagacccagctgctgctgagccccgcctggagaaacgccgtgaacttcggcagcagccagtggggcatccccggcaaggtgatcctgagcaacgtgtggaacagaagacagatgccctggggcaacagcctgtag

SEQ ID NO: 23871 - DNA, 1203 bp, Artificial Sequence; identical to SEQ ID NO: 23568
  Description of Artificial Sequence: Synthetic coding sequence

SEQ ID NO: 23872 - DNA, 210 bp, Artificial Sequence
  Description of Artificial Sequence: Synthetic coding sequence
atgatggtgctgacccccttctggctgggcagagactgccccagcagaggccagcccaccctgagagagggcaagggcctgagcgtgcccttcacctgcaagctgaacaacccccagagatacctgctgtacctgacccacacccccagaagacagtacagccccgcctggtacctgcccggcaagctgggcatcaccctgaccgtgtag

SEQ ID NO: 23873 - DNA, 1173 bp, Artificial Sequence
  Description of Artificial Sequence: Synthetic coding sequence
tgcgagaagagcaccttcttcaagcaccagaagagaacccacaccgtggagaagaccttcgagtgcagccacggcaagaagagcttctgccaggagagccacttcaccgagcaccacagaacctgcaccagagagaagccctgcgagagcaacaagtacggcaagaccttccaccagaagagaagcttcatccaccaccagagaacccacaccggcgagaagccctacgagtgcaaggagtgcagaaagagcttccacgtgaagcccaacctgaccaagcaccagaagacccacatcggcgagaagcccttcaagtgcaccgcctgcggcagaaccttcttccagcagagcaccctgaacgtgcaccagggcaagcacaccgaggagaagccctacaagtacaccgagtgcgagaagagcttctacaagagcgtgctgatcatccacgagagaacccacaccggcgagaagccctgcggctgcaacgagtgcgagaagagcttcgaggtgctgaccaccctggtgatccaccagagaacccacaccggcgagaagccctacaagtgcaacgagtgcgagaagagctacctgaacctgaagagccacctgaacatccacctgagaaaccacaccggcaagagaccccacgtgtgcaacgagtgcggcaaggccttcagcatgaagagcaacttcaccgaccaccagagaacccactgcggcgagaagccctacaagtgcaacgagtgcagaaagagcttctacatgaagagcgccctgagccagcaccagagaatccacatctacaagaagccctacgagtgcaagcagtgcggcaagaccttccagaagagccacctgatcgagcaccagagaacccaccccggcgagatcccccacgagtgcaacaagtgcggcaagagcttctgctacaagagccccctgaccatccaccagagaacccacatcgaggagaagccctacaagtgcagcaagagcgtgacctacttctgcatgaagagccacctgaccgtgcaccagagaccccacaccagaaagaaccccttcgagtgcaacgagtgcagaaagatgttctacgtgaagagcaacctgatcaaccaccagagaacccacaccggcgagaagccctacgagggcaacacctgcggcaagtag

SEQ ID NO: 23874 - DNA, 6279 bp, Artificial Sequence
  Description of Artificial Sequence: Synthetic coding sequence
atggtgctgaaggtggacaccagcgagagcctgtggcacatccagatcagcagaagcagattcctgctggacagcgacggcaagagactgatctgcgaggtgagcctgtgcaagatcaacagcaaggtgctgaagagcggccagctggaggacacctgcctggtggagctgagcctggccctggacctgtgcctgaaggtgggcatcagcagcagacacctgaccgccatcaccgtggacgtgtggaccctgcacgccgagctgcacgagggcctgttccagagccagctgctgtgccagggccccagcctggccagcaagcccgtgccctgcagcgaggtgaccgagaacctggtggagcccaccctgcccggcctgttcctgctgcagcagctgcccgaccaggtgaaggtgaagatggagaacaccagcgtggtgctgagcatgaacagccagaagagacacctgacctggaccctgaagctgctgcagttcctgtaccacagagacgaggaccagctgcccctgagaagcttcaccgccaacagcgacatggcccagatgagcaccgagctgctgctggaggacggcctgctgctgagccagagcagacagagaatcgtgtgcctgaacagcctgaaggccagcgtgcaggtgaccaccatcgacctgagcgccagcctggtgctgaacacctgcatcatccactacagacaccaggagttcagccactggctgcacctgctggccctggagacccagggcagcagcagccccgtgctgaagcagagaaagaagagaaccttcccccagatcctggcccccatcatcttcagcaccagcatcagcaacgtgaacatcagcatccagctgggcgacaccccccccttcgccctgggcttcaacagcatcagcctggactaccagcacctgagaccccagagcatccaccagagaggcgtgctgaccgtggaccacctgtgctggagagtgggcagcgacagccacatccagagagccccccacccccccaacatgcacgtgtggggcgaggccctggtgctggacagcttcaccctgcagggcagctacaaccagcccctgggcctgagcagcacccagagcgacaccctgttcctggactgcaccatcagaggcctgcaggtggaggccagcgacacctgcgcccagtgcctgagcagaatcctgagcctgatgggcccccagagcggcaagagcgccgtgagcagacacagcagcttcggcgagagcgtgagcctgctgtggaaggtggacctgaaggtggaggacatgaacctgttcaccctgagcgccctggtgggcgccagcgaggtgagactggacaccctgaccatcctgggcagcgccgagaccagcaccgtgggcatccagggcctggtgctggccctggtgaagagcgtgaccgagaagatgcagccctgctgcaaggcccccgacatccccacccccgtgctgagcctgagcatgctgagcatcacctaccacagcagcatcagaagcctggaggtgcagtgcggcgccggcctgaccctgctgtggagcccccccgaccacatgtacctgtaccagcacgtgctggccaccctgcagtgcagagacctgctgagagccaccgtgttccccgagaccgtgcccagcctggccctggagaccagcggcaccaccagcgagctggagggcagagcccccgagcccctgccccccaagagactgctgaacctgaccctggaggtgagcaccgccaagctgaccgccttcgtggccgaggacaagttcatcaccctggccgccgagagcgtgagcctgagcagacacggcggcagcctgcaggcctactgccccgagctggccgccggcttcgacggcaacagcatcttcaacttcaaggaggtggaggtgcagctgctgcccgagctggaggagatgatcctgcacagaaaccccttccccgccctgcagaccctgagaaacagagtgtggctgctgagcttcggcagcgtgagcgtggagttcccctaccagtacgacttcagcagaaccctggacgaggccgtgggcgtgcagaagtggctgaagggcctgcaccagggcaccagagcctgggccagccccagccccgtgcccctgccccccgacctgctgctgaaggtggagcacttcagctgggtgttcctggacgacgtgttcgaggtgaagctgcacgacaactacgagctgatgaaggacgagagcaaggagagcgccaagagactgcagctgctggacgccaaggtggccgccctgagaaagcagcacggcgagctgctgcccgccagaaagatcgaggagctgtacgccagcctggagagaaagaacatcgagatctacatccagagaagcagaagactgtacggcaacacccccatgagaagagccctgctgacctggagcctggccggcctggagctggtggccctggccgacgccagcttccacggccccgagcacgtggtggagcaggtgcaggagctggaccccggcagccccttcccccccgagggcctggacctggtgatccagtggtgcagaatgctgaagtgcaacgtgaagagcttcctggtgagaatcagagactaccccagatacctgttcgagatcagagactggagactgatgggcagactggtgggcaccgagcagagcggccagccctgcagcagaagaagacagatcctgcacctgggcctgccctggggcaacgtggccgtggagagaaacatgccccccctgaagttctaccacgacttccacagcgagatcttccagtacaccgtggtgtggggcccctgctgggaccccgcctggaccctgatcggccagtgcgtggacctgctgaccaagcccagcgccgaccccagcccccccctgccctggtgggacaagagcagactgctgttccacggcgactggcacatggacatcgagcaggccaacctgcaccagctggccaccgaggacccctacaacaccaccgagaacatgcactgggagtggagccacctgagcttccactggaagcccggccagttcgtgttcaagggcgacctggacatcaacgtgagaaccgccagcaagtacgacgactgctgcttcctgcacctgcccgacctgtgcatgaccctggacctgcagtggctgtgccacggcaacccccacgaccaccacagcgtgaccctgagagcccccgagttcctgcccgaggtgcccctgggccagctgcacgacagctacagagccttcagaagcgagaacctgaacctgagcatcaagatggacctgaccagacacagcggcaccatcagccagcccagaatcctgctgtacagcagcaccctgagatggatgcagaacttctgggccacctggaccagcgtgaccagacccatctgcagaggcaagctgttcaacaacctgaagcccagcaagaagaagctgggccagcactacaagcagctgagctacaccgccctgttcccccagctgcaggtgcactactgggccagcttcgcccagcagagaggcatccagatcgagtgcagccagggccacgtgttcaccagaggcacccagagactgatcccccaggccggcaccgtgatgagaagactgatcagcgactggagcgtgacccagatggtgagcgacctgagccaggtgaccgtgcacctgatggccagccccaccgaggagaacgccgaccactgcctggaccccctggtgaccaagacccacctgctgagcctgagcagcctgacctaccagagacacagcaacagaaccgccgaggaggagctgagcgccagagacggcgaccccaccttccacacccaccagctgcacctggtggacctgagaatcagctggaccaccaccaacagagacatcgccttcggcctgtacgacggctacaagaaggccgccgtgctgaagagaaacctgagcaccgaggccctgaagggcctgaagatcgacccccagatgcccgccaagaagcccaagagaggcgtgcccaccagcgccagcgccccccccagagtgaacacccccagcttcagcggccagcccgacaagggcagcagcggcggcgcctacatgctgcagaagctgatcgaggagaccgacagattcgtggtgttcaccgaggaggagagcggcatgagcgaccagctgtgcggcatcgccgcctgccagaccgacgacatctacaacagaaactgcctgatcgagctggtgaactgccagatggtgctgagaggcgccgagaccgagggctgcgtgatcgtgagcgccgccaaggcccagctgctgcagtgccagcaccaccccgcctggtacggcgacaccctgaagcagaagaccagctggacctgcctgctggacggcatgcagtacttcgccaccaccgagagcagccccaccgagcaggacggcagacagctgtggctggaggtgaagaacatcgaggagcacagacagagaagcctggacagcgtgcaggagctgatggagagcggccaggccgtgggcggcatggtgaccaccaccaccgactggaaccagcccgccgaggcccagcaggcccagcaggtgcagagaatcatcagcagatgcaactgcagaatgtactacatcagctacagccacgacatcgaccccgagctggccacccagatcaagccccccgaggtgctggagaaccaggagaaggaggacctgctgaagaagcaggagggcgccgtggacaccttcaccctgatccaccacgagctggagatcagcaccaaccccgcccagtacgccatgatcctggacatcgtgaacaacctgctgctgcacgtggagcccaagagaaaggagcacagcgagaagaagcagagagtgagattccagctggagatcagcagcaaccccgaggagcagagaagcagcatcctgcacctgcaggaggccgtgagacagcacgtggcccagatcagacagctggagaagcagatgtacagcatcatgaagagcctgcaggacgacagcaagaacgagaacctgctggacctgaaccagaagctgcagctgcagctgaaccaggagaaggccaacctgcagctggagagcgaggagctgaacatcctgatcagatgcttcaaggacttccagctgcagagagccaacaagatggagctgagaaagcagcaggaggacgtgagcgtggtgagaagaaccgagttctacttcgcccaggccagatggagactgaccgaggaggacggccagctgggcatcgccgagctggagctgcagagattcctgtacagcaaggtgaacaagagcgacgacaccgccgagcacctgctggagctgggctggttcaccatgaacaacctgctgcccaacgccgtgtacaaggtggtgctgagaccccagagcagctgccagagcggcagacagctggccctgagactgttcagcaaggtgagaccccccgtgggcggcatcagcgtgaaggagcacttcgaggtgaacgtggtgcccctgaccatccagctgacccaccagttcttccacagaatgatgggcttcttcttccccggcagaagcgtggaggacgacgaggtgggcgacgaggaggacaagagcaagctggtgaccaccggcatccccgtggtgaagcccagacagctgatcgccaccgacgacgccgtgcccctgggccccggcaagggcgtggcccagggcctgaccagaagcagcggcgtgagaagaagcttcagaaagagccccgagcaccccgtggacgacatcgacaagatgaaggagagagccgccatgaacaacagcttcatctacatcaagatcccccaggtgcccctgtgcgtgagctacaagggcgagaagaacagcgtggactggggcgacctgaacctggtgctgccctgcctggagtaccacaacaacacctggacctggctggacttcgccatggccgtgaagagagacagcagaaaggccctggtggcccaggtgatcaaggagaagctgagactgaagagcgccaccggcagcgaggtgagaggcaagctggagaccaagagcgacctgaacatgcagcagcaggaggaggaggagaaggccagactgctgatcggcctgagcgtgggcgacaagaaccccggcaagaagagcatcttcggcagaagaaagtag

SEQ ID NO: 23875 - DNA, 2571 bp, Artificial Sequence
  Description of Artificial Sequence: Synthetic coding sequence
atgagcggcgagctgcagagaaagatcggcctgaaggtgctggagatgagaggcaacgccgtggtgggctacctgcagtgcttcgacctggagggcgagagcggcctggtggtgagagccatcggcaccgcctgcaccctggacaagctgagcagccccgccgccttcctgcccgcctgcaacagccccagcaaggagatgaaggagagccccctggtgcacccccccagccacggctgcagaagcacccacaacagccccatccacaccgccaccggcagcagactgacccagaacttcagcgtgagcgtgcccaccctgatctacaccggcatgggcagcggcagcgccggcaaggagggcggccccttcaaggccctgctgagacagcagacccagagcgccctggagcagagagagttccccttcttcaccctgaccgccttcccccccggcttcctggtgcacgtgggcggcgtggtgagcgccagaagcgtgaagctgctggacagaatccacaaccccgccttcgtgggcatcatgggcaacaccagaagctacaagctgctggactggaacagcttcaacagcgacgagcccgagaccagagacgcctggtgggccgagatcagacaggagatcaagagccacgccaaggccctgggctgccacgccgtggtgggctacagcgagagcaccagcatctgcgaggaggtgtgcatcctgagcgccagcggcaccgccgccgtgctgaaccccagattcctgcaggacggcaccgtggagggctgcctggagcagagactggaggagaacctgcccaccagatgcggcttctgccacatcccctacgacgagctgaacatgcccttccccgcccacctgacctactgctacaactgcagaaagcagaaggtgcccgacgtgctgttcaccaccatcgacctgcccaccgacgccaccgtgatcggcaagggctgcctgatccaggccagactgtgcagactgaagaagaaggcccaggccgaggccaacgccaccgccatcagcaacctgctgcccttcatggagtacgaggtgcacacccagctgatgaacaagctgaagctgaagggcatgaacgccctgttcggcctgagaatccagatcaccgtgggcgagaacatgctgatgggcctggccagcgccaccggcgtgtacctggccgccctgcccacccccggcggcatccagatcgccggcaagacccccaacgacggcagctacgagcagcacatcagccacatgcagaagaagatcaacgacaccatcgccaagaacaaggagctgtacgagatcaacccccccgagatcagcgaggagatcatcggcagccccatccccgagcccagacagagaagcagactgctgagaagccagagcgagagcagcgacgaggtgaccgagctggacctgagccacggcaagaaggacgccttcgtgctggagatcgacgacaccgacgccatggaggacgtgcacagcctgctgaccgacgtgcccccccccagcggcttctacagctgcaacaccgagatcatgcccggcatcaacaactggaccagcgagatccagatgttcaccagcgtgagagtgatcagactgagcagcctgaacctgaccaaccaggccctgaacaagaacttcaacgacctgtgcgagaacctgctgaagagcctgtacttcaagctgagaagcatgatcccctgctgcctgtgccacgtgaacttcaccgtgagcctgcccgaggacgagctgatccaggtgaccgtgaccgccgtggccatcaccttcgacaagaaccaggccctgcagaccaccaagacccccgtggagaagagcctgcagagagccagcaccgacaacgaggagctgctgcagttccccctggagctgtgcagcgacagcctgcccagccaccccttcccccccgccaaggagcacctggagagcgccagcagcaacagcggcatccccgccgcccagagagacagatgcagcagctggatcgagctgatcaagctgaaggcccagaccatcagaagaggcagcatcaagaccaccatgaccgtggagaaggccagccccgtgggcgacggcaacttcagaaacagaagcgcccccccctgcgccaacagcaccgtgggcgtggtgaagatgacccccctgagcttcatccccggcgccaagatcaccaagtacctgggcatcatcaacatgttcttcatcagagagaccaccagcctgagagaggagggcggcgtgagcggcttcctgcacgccttcatcgccgaggtgttcgccatggtgagagcccacgtggccgccctgggcggcaacgccgtggtgagctacatcatgaagcagtgcgtgttcatggagaaccccaacaagaaccaggcccagtgcctgatcaacgtgagcggcgacgccgtggtgttcgtgagagagagcgacctggaggtggtgagcagccagcagcccaccaccaactgccagagcagctgcaccgagggcgaggtgaccacctag

SEQ ID NO: 23876 - DNA, 1545 bp, Artificial Sequence
  Description of Artificial Sequence: Synthetic coding sequence
atgatggaggacctgggcagaaaggagaaccaggacaagaagcagcagaaggaccccagactgaccatggagatgagacacaagcaggtgaaggagaacagactgagaagagagaaggagctggagtaccagagaatcgagaagaccctgaagaagagcgccttcctggaggcccagtgcctggtgcaggaggagaagaagagaaaggccctggaggccaagaaggaggaggaggagatccagagagagatggtgaagctgagaagagagatcatcgagagaagaagaaccgtgaaggccgcctggaagatcgagaagaagagacaggaggagaacagccagaacagcagcgagaaggtgatgttccagagcacccacatcctgcccgacgaggagaagatggtgaaggagagaaagagaaagctgaaggaggtgctgatccagaccttcaaggagaaccagcagtgccagaagagatacttcgccgcctggcacaagctgatcctggaccacagaatcaagctgggcaaggccggcaccctgagcgactggaagatccagctgaaggtgctgagagcctggagagactacaccagattccagaagctggagagagagacccaggccctggagaacgacctgagagaggagaacagaaagcagcagctggccaccgagtacaacagaaagcaggtgctgagacactgcttcaccgagtggcagcactggcacggcgccgagctgctgaagagagagctggccctgaccaaggaggagaccagaaagaagatggacgccctgctgcaggccgccagcctgggcaagctgagcgccaacggcctgagcggcatcagcctgcccgaggaggccaccgccatggtgggcccccccgtgaagaacggccaggagaccgccgtgccccccctgtgggagaagccccccctgggcagcagcggctgcatgctgagcccccccctgggcagaaccaccaccggcaacctgcagggcagcctgcagaacgtgagcctgagcgcccccggcaacaagcagcacaagaccctgggcgccgagcccagccagcagcccggcagcaacgagaccctgagaaccaccagccagaaggccgagcccctgtgcctgggccacttccacaacagacacgtgttccagcagcagctgatcgagaagcagaagaagaagctgcaggagcagcagaagaccatcctggagctgaagaagaacctgcagctggccgaggcccagtgggccgccgagcacgccctggccgtgaccgaggcccagagccacctgctgagcaagcccagagaggaggagcccagaacctgccagatgctggtgaacagccccgtggccagccccggcaccgagggcagaagcgacagcagaaacagcctgagcggcctgagaagaaagcccaagcagctgatgaccccccaccccatcctgaagggcagagccgtgagcgtggtggccctggtggtggtgatcttcagccccagagtggagtgcgtgcactgggactag

SEQ ID NO: 23877 - DNA, 2283 bp, Artificial Sequence
  Description of Artificial Sequence: Synthetic coding sequence
atgggcgaccccggcagcgagatcatcgagagcgtgccccccgccggccccgaggccagcgagagcaccaccgacgagaacgaggacgacatccagttcgtgagcatcctgttccccaagatgcccaagagacagggcgacttcctgcacttcctgaacgtgaagaaggtgaagaccgacaccgagaacaacgaggtgagcaagaaccactgcagactgagcaaggccaaggagccccacttcgagtacatcgagcagcccatcatcgaggagaagcccagcctgagcagcaagaaggagatcgacaacctggtgctgcccgactgctggaacgagaagcaggccttcatgttcaccgagcagtacaagtggctggagatcaaggagggcaagctgggctgcaaggactgcagcgccgtgagacacctgggcagcaaggccgagaagcacgtgcacgtgagcaaggagtggatcgcctacctggtgacccccaacggcagcaacaagaccaccagacaggccagcctgagaaagaagatcagagagcacgacgtgagcaaggcccacggcaagatccaggacctgctgaaggagagcaccaacgacagcatctgcaacctggtgcacaagcagaacaacaagaacatcgacgccaccgtgaaggtgttcaacaccgtgtacagcctggtgaagcacaacagacccctgagcgacatcgagggcgccagagagctgcaggagaagaacggcgaggtgaactgcctgaacaccagatacagcgccaccagaatcgccgagcacatcgccaaggagatgaagatgaagatcttcaagaacatcatcgaggagaacgccaagatctgcatcatcatcgacgaggccagcaccgtgagcaagaagaccaccctggtgatctacctgcagtgcaccatccagagcgcccccgcccccgtgatgctgttcgtggccctgaaggagctggtgagcaccatcgccgagtgcatcgtgaacaccctgctgaccaccctgaacgactgcggcttcaccaacgagtacctgaaggccaacctgatcgccttctgcagcgacggcgccaacaccatcctgggcagaaagagcggcgtggccaccaagctgctggagaacttccccgagatcatcatctggaactgcctgaaccacagactgcagctgagcctggacgacagcatcagcgagatcaagcagatcaaccacctgaagatcttcatcgacaagatctacagcatctaccaccagcccaacaagaaccagaccaagctgctgggcaccgtggccaaggagctggagaccgagatcatcaagatcggcagagtgatgggccccagatgggccgcctgcagcctgcaggccgccaccgccgtgtggcacgcctaccccatcctgtacatgcacttcagccacagctacagcggcctggccaagagactggccaacatcaacttcctgcaggacctggccctgatgatcgacatcctggaggagttcagcgtgctgagcaccgccctgcagagcagaagcaccaacatcaagaaggcccagaagctgatcaagagaaccatcagagccctggagaacctgaagatcggcaccggcaagtacgagagccagatcgaggacctgatcaagagcgacaagttcaaggacatccccttcaacaagaacaacaagttcaacgccctgcccagaagcatcctgctggacaacatcatccagcacatgaacctgagactgctgagcgacagaaaccacgaggacatcttcaactacttcgacctgctggagcccagcacctggccctacgaggagatcaccagcccctggatcgccggcgagaagaccctgttccacctgtgcaagatcctgaagtacgaggtggacctgaacgacttcagagagttcgtgaacaacaacatcaagagcaacaacgtgagcatccccaccaccatctacaaggccaagaagatcgtgagcaccatcgccatcaacagcgccgaggccgagagaggcttcaacctgatgaacatcatctgcaccagagtgagaaacagcctgaccatcgaccacgtgagcgacctgatgaccatcaacctgctgggcaaggagctggccgactgggacgccacccccttcgtgaagagctggagcaactgcaaccacagactggccaccgacaccagagtgagacagaagagcaccaaggtgttccacgagaaccagctggccatctggaacctgaagtag

SEQ ID NO: 23878 - DNA, 1230 bp, Artificial Sequence
  Description of Artificial Sequence: Synthetic coding sequence
atgaccctgagcagaggcaaggtggacttcgccaccatccagtgcggccagtgcctgatggagaccatccagctgagcaaccacctgcaggtgccctgcgagtggttcgtgcagagccagaagcccgtggacaagctggagaagcacatgcccaagtacctgagacagaagctgagagccgagctgaagcccaagaccagaatcttcgagatccagcccatcagcggcgtgctggaccccggcgagaagagcaacgtgcaggtgaagttcatgcccaaggaggagaagttctacagccagaccctggtgttccagatcgcccagagcgcccagaagctgaccctgctggccagaggccagggcctggagcccagactggagttcagccccagcgtgctggacctgggccccctgctgctgtgcgcccccggcgacgaggccgaggtgatcgtgaagaacccctgcaacttccccatcgagttctacagcctggagttcgaccagcagtacctgatcgaggagaagatcctgagaaagctgaagggctacgacagctacaacaccctgctgctgccccccagaaaccccggcgagaagctgccccccgagctgtacgagtacttcaaggagatcaagaagagcaaggaggagcagatgagagccaagtacctggagaacctggcccaggagaacgaggaggaggacatcaccagcagcgaccagggcaccagcaacagcaccaagagaaccagcctgagcagaggcatcagcgtgaccagcaacctggaggagtggcacgccctgctggtggagagcaagacctacctggaggaggaggaggacgaggagagcctggagaagatcatcttccagaccgacaagctgcagagcatcgacagccacagcatggaggaggtgggcgaggtggagaacaaccccgtgagcaaggccatcgccagacacctgggcatcgacatcagcgccgagggcagactggccaagaacagaaagggcatcgccatcatcatccacggcacccccctgagcggcaagagcgccaacgccgtgagcgtggccaagtactacaacgccgcctgcctgagcatcgacagcatcgtgctggaggccgtggccaacagcaacaacatccccggcatcagagcctgcgagctgtgcatcagagccgccatcgagcagagcatgaaggagggcgaggaggccgccgagtag

SEQ ID NO: 23879 - DNA, 375 bp, Artificial Sequence
  Description of Artificial Sequence: Synthetic coding sequence
atggccgtgtacacccacaccggctacaacgaccactacatgtacctgaaccacggccagcagaccatccccaacggcctgggcatgggcggccagcacaactacttcggcctgtgggtggacgtggacttcggcaagggccacagcagagccaagcccacctgcaccacctacaacagcccccagctgagcgcccaggagaacttccagttcgacaagatggaggtgtgggccgtgggcgaccccagcgaggagcagctggccaagggcaacaagagcatcctggacgccgaccccgaggcccaggccctgctggagatcagcggccacagcagacacagcgagggcctgagagaggtgcccgacgacgagtag

SEQ ID NO: 23880 - DNA, 2607 bp, Artificial Sequence
  Description of Artificial Sequence: Synthetic coding sequence
atgggcatcaccgagagcagcgacacccccagcagcctgagccccctgaacctgcccggcgccggcagcgagatggaggagaaggtggcccccgtgaagcccagcagacccaagagacacttcagcagcgccggcaccatcgagagcgtgaacctggacgccatccccctggccatcgccagactggacaacagcgccgccaagcacaagctggccgtgaagcccaagaagcagagagtgagcaagaagcacagaagactggcccaggacccccagcacgagcagggcggcctggagagcagaccctgcctggaccagaacggccaccccggcgaggacaagcccacctggcacgaggaggagcccaaccccctggacagcgaggaggagagaagaagacaggaggactactggagagagctggaggccaagtgcaagagacagaaggccgaggccgccgagaagagaagactggaggagcagagactgcaggccctggagagaagactgtgggaggagaacagaagacaggagctgctggaggaggagggcgagggccaggagccccccctggaggccgagagagcccccagagaggagcagcagagaagcctggaggcccccggctgggaggacgccgagagaagagagagagaggagagagagagactggaggccgaggaggagagaagaagactgcaggcccaggcccaggccgaggagagaagaagactggaggaggacgccagactggaggagagaagaagacaggaggaggaggagggcagatgcgccgaggagctgaagagacaggaggaggaggaggccgagggctgggaggagctggagcagcaggaggccgaggtgcagggcccccccgaggccctggaggagaccggcgagggcagaagaggcgccgaggaggaggacctgggcgaggaggaggaggagggccaggcccacctggaggactggagaggccagctgagcgagctgctgaacgacttcgaggagagactggaggaccaggagagactgaagcccgagggccagagagagcacagcgaggagcccggcatctgcgaggagcagaaccccgaggccgagagaagaagagagcagcagggcagaagcggcgacttccagggcgccgacagacccggccccgaggagaagagagaggagggcgacaccgagcccctgctgaagcaggagggccccgtggaggccgcccagccccccgtggagagaaaggaggccgccgccctggagcagggcagaaaggtggaggagctgagatggcaggaggtggacgagagacagaccatgcccagaccctacaccttccaggtgagcagcggcggcaagcagatcctgttccccaaggtgaacctgagccccgtgacccccgccaaggacaccggcctgaccgccgccccccaggagcccaaggcccccaaggccagccccgtgcagcacgccctgcccagcagcctgagcgtgccccacaccgccatcctggtgaccggcgcccagctgtgcggccccgccgtgaacctgagccagatcaaggacaccgcctgcaagagcctgctgggcctggaggagaagaagcacgccgaggcccccgccggcgagaacccccccagaggccccggcgacgccagagccggcagcggcaaggccaagcccagacaggagagccccagcagcgccagcgccctggccgagtgggccagcatcagaagcagaatcctgaagaacgccgagagcgaccccagaagcagcgagagagaccagctgagacccggcgacgagagcacccccagaggcagatgcgacagcagaggcaaccagagaaagaccccccccgtgaacgccaagttcagcatcatgcccgcctggcagaagttcagcgacggcggcaccgagaccagcaagcagagcaccgaggccgagagcatcagaaagagacccatgctgggccccagcgaggagaccgccccccagcccccccccgccggcgtgagagagctgggcaagggccccgagaagagcgagatgcacagagagcccgccgacaccaccgagggctgcaagttcgccaaggacctgcccagcttcctggtgcccagcctgccctaccccccccagaaggtggtggcccacaccgagttcaccaccagcagcgacagcgagaccgccaacggcatcgccaagcccgaccccgtgatgcccggcggcgaggagaaggccagccccttcggcatcaagctgagaagaaccaactacagcctgagattcaactgcgaccagcaggccgagcagaagaagaagaagagacacagcagcaccggcgacagcgccgacgccggcccccccgccgccggcagcgccagaggcgagaaggagatggagggcgtggccctgaagcacggccccagcctgccccaggagagaaagcaggcccccagcaccagaagagacagcgccgagcccagcagcagcagaagcgtgcccgtggcccaccccggccccccccccgccagcagccagacccccggcccccccgtgagaccccaccagcacccccacttccccaactag

SEQ ID NO: 23881 - DNA, 309 bp, Artificial Sequence
  Description of Artificial Sequence: Synthetic coding sequence
gtgctgctgtgctgccccggctggagcgccgtggtgagaagctggctgaccgccaccagcgccagctggcagctggccggcatcaccggcatgtgccaccacgcccagctgatcttcgtgttcttcatcgagaccgagttccaccacgtgggccaggccggccccgagctgctgaccagcggcgaccccagcgccagcgccagccagagcgccggcatcaccggcgccagccaccccagaagagccaacttctgcatcttcggcagagacggcgtgagcccctgctggcccggctggagcagcacctag

SEQ ID NO: 23882 - DNA, 396 bp, Artificial Sequence
  Description of Artificial Sequence: Synthetic coding sequence
agcgcctgcatgtgcgtgtgcgtgtgcgtgtgcatgtacatctacatctacatctacatcttcttcttcttcttcttcttcttcttcctgaacatcttcaagcaggccccccccagacagaaccaggtgagaagacccggcgccgtggcccacacctgcaaccccagcaccgtgggcggccacggcggccagatcaccagaggccaggagttcgagaccagcctggccaacatgggcgagacccccagcctgctgaagatccagacctggcccggcgtggtggcccacgcctgcaaccccagctacagcggcggcagactgagacaggagaactgcctgaacctgggcggcggcggctgcggcgagatcgccctgcagcccggccagcaggagtag

SEQ ID NO: 23883 - DNA, 309 bp, Artificial Sequence
  Description of Artificial Sequence: Synthetic coding sequence
gaggtgggcagatggctggagcccggcaagcagagactgcagtgcgccgagatggcccccctgcacagcagcctgggcgacaaggccagaccctgcctgaccaagaagaagaagatgctggacatgaaccccaccctggtgtgctacagacagggcctggccctgctgcccagactgggctgcagcggcgccatcctggcccactgcaacctgagactgctgggcagcagcgacagccccgccagcgccagcagagtggccggcatcaccggcgccagacaccacgcccagctgatcttcgtgttctag

SEQ ID NO: 23884 - DNA, 288 bp, Artificial Sequence
  Description of Artificial Sequence: Synthetic coding sequence
ttcttcttcttcctgagatggagcctggccctgctgcccagagtggagtgcagcggcatgatcagcgcccactacaacctgcacctgcccggcagcagcgacagccccgccagcgccagcagagtggccggcaccaccggcgtgcaccaccacgcctggctgatcttctgcatcttcagcagagacggcgtgctgctgtgctgccccggctggagccccacccccggcctgaagagaagcagctgcctgggcttcagaaagtgctgggactacagacacgagccctag

SEQ ID NO: 23885 - DNA, 345 bp, Artificial Sequence
  Description of Artificial Sequence: Synthetic coding sequence
tggtgcacccccctgatccccgccaccgaggtggagaccggcagatgggtggagcccagaagcagcagactgggcttcttcctggtggagctgctgagcttcgacctgggcaacagagccagactgcacctgaagaagaagaagaagaagaagagcctgggcaagatctacttcttcctgagatggagcctggccctgctgcccagactgggctgcagcggcgccatcagcgcccactgcaagctgcacctgctgggcagccaccacagccccgccagcgccagcagagtggccggcatcaccggcgccagacaccacaccagactgatcttcttcttcctgtag

SEQ ID NO: 23886 - DNA, 396 bp, Artificial Sequence
  Description of Artificial Sequence: Synthetic coding sequence
agcgcctgcatgtgcgtgtgcgtgtgcgtgtgcatctacatctacatctacatctacatcttcttcttcttcttcttcgagttcctgaccaagctgatcaagcagctggtgatgatcaagaaccaggtgagaagacccggcgccgtggcccacacctgcaacgccagcaccgtgggcggccacggcggccagatcaccagaggccaggagttcgagaccagcctggccaacatgggcgagacccccagcctgctgaagatccagacctggcccggcgtggtggcccacgcctgcaaccccagctacagcggcggcagactgagacaggagaactgcctgaacctgggcggcggcggctgcggcgagatcgccctgcagcccggccagcaggagtag

SEQ ID NO: 23887 - DNA, 384 bp, Artificial Sequence
  Description of Artificial Sequence: Synthetic coding sequence
atcctggcccactgcaacctgcacctgcccaacagcagcgacagccccgccagcgccagccaggtggccggcatcaccggcacctgctaccacacccagctgatcttcgtgttcctggtggagaccggcttccaccacgtgggccaggacggcctggagctgctgaccagcggcgacctgcccgccagcgccagccagagcgccggcatcaccggcgtgacccactgcgcccagcccagcagcctgctgaccagcgagggcagaaaggagaccgtgagcaccttcttcttcttcttcctgcacgagaccgtgagccacagcgtggcccaggccagagtgcagtggcacaacctgagcagcctgcagcccccccccagcagatag

SEQ ID NO: 23888 - DNA, 288 bp, Artificial Sequence; identical to SEQ ID NO: 23884
  Description of Artificial Sequence: Synthetic coding sequence

SEQ ID NO: 23889 - DNA, 96 bp, Artificial Sequence
  Description of Artificial Sequence: Synthetic coding sequence
gccaagcccagactgcaccagcccggccagagcggcgagacccccagcctgctgaagatccagaagctggccagaagaggcggcgtgcacctgtag

SEQ ID NO: 23890 - DNA, 264 bp, Artificial Sequence
  Description of Artificial Sequence: Synthetic coding sequence
agcgtggcccaggccggcgtgcagtggcacaacctgggcagcctgcagccccccccccccagattcaacagattcagctgcctgagcatccccagcagctgggactacagacacagcccccccctgctggccgacttctgcatctacctggtggagaccggcttccaccacgtgggccaggccggcctggagctgctgaccagcagcgacctgcccaccagcgccagccagagcgccagaatcaccggcgtgagccacagatag

SEQ ID NO: 23891 - DNA, 195 bp, Artificial Sequence
  Description of Artificial Sequence: Synthetic coding sequence
cccagaagatggagcctgcaggtgtaccccaccgcccccaagagacagagacccagcagaatgggccacgacgacaacggcagcttcgtggagaagaagagaggcaagtgcggcgagaagaaggagagaagcgactgctactacgtgtgcgtggagagaagcagacacagaagactgcacttcgtgctgtactag

SEQ ID NO: 23892 - DNA, 456 bp, Artificial Sequence
  Description of Artificial Sequence: Synthetic coding sequence
agattctacatcggctgcgacctgtgcaccaactgctactacggcgagtgcgtgggcatcgccgagaaggaggccaagaagatggacgtgtacatctgcaacgactgcaagtgggcccaggagggcagcagcgaggagctgtactgcatctgcagaacccccgccggcagctgcagattcttcatcggccacgacagatgccagaactggtaccacggctgctgcatcggcatcctgcagagcgaggccgagctgatcgacgagtacgtgtgcccccagtgccagagcaccgaggacgccatggccgtgctgacccccctgaccgagaaggacgacgaggagctgaagagagtgctgtgcagcctgcagacccacaagatggcccagcccttcctggagcccgtggaccccaacgacgcccccgactactacggcgtgatcaaggagcccatgtag

SEQ ID NO: 23893 - DNA, 411 bp, Artificial Sequence
  Description of Artificial Sequence: Synthetic coding sequence
ggcaccatcagcgcccactgcaacctgtgcctgctggacagcagcgacagccccgccagcgccagcagagtggccggcatcatcggcgcccaccaccacgcccagctgatcttcgtgttcctggtggagatgggcttccaccacgtgggccaggccggcctgaagctgctgaccagcgacccccccgccagcgccagccagagcgccggcatcaccggcgtgagccaccacaactggctgcacggcggccccgacagagtgaagagaccccccgtgttcttcttctggttcttcttcttcgagatggagagctacagcgtggcccaggccggcgtgcagtggagagacctgagcagcctgcagccccccccccccagacacaccatcctgctgccccagccccccgagtag

SEQ ID NO: 23894 - DNA, 279 bp, Artificial Sequence
  Description of Artificial Sequence: Synthetic coding sequence
ctgacccccgacggcttcttcttcagagtgcacatgctggtgctggacagcagcagctgcaacaagccctgccccgagttcaagcccggcagcagatacatcgtgatgggccacatctaccacaagagaggccagctgcccaccgccctgctgcaggtgctgagaggccacctgtgccccggcgacggcctgctgagaagcagcagcagctacgtgaagagattcaaccccaagagagagggccagatccagggcgccatccacacccagtgcatctag

SEQ ID NO: 23895 - DNA, 378 bp, Artificial Sequence
  Description of Artificial Sequence: Synthetic coding sequence
agcttcttcttcttcctgagacagagcctgagcctgagcgccagactggagtgcagcggcaccatcagcgcccactgcaagctgagactgctgggcagccaccacagccccgccagcgtgagcagaatcaccagaagcggcgtgcaggaccagagaggccagcacagcgagaccctgagcctgctgaagatccagaagctggccggccacggcggcagacacctgcagagccagctgctgggcagagtgagacaggagaacagactgaaccccggcggcaagggctgcagcgagcccagaccctgccactgcaccagcgcctggaccaccagcagaaagatcaagaagaagaagagaaagagaaagaagaagaagtag

SEQ ID NO: 23896 - DNA, 399 bp, Artificial Sequence
  Description of Artificial Sequence: Synthetic coding sequence
tgcatgtgcgtgtgcgtgtgcgtgtgcatctacatctacatctacatctacatcagccagcccatctacatcttcctgctgctgctgctgctgctgttcctgagacagagcctgatgatcaagaaccaggtgagaagacccggcgccgtggcccacacctgcaaccccagcaccgtgggcggccacggcggccagatcaccagaggccaggagttcgagaccagcctggccaacatgggcgagacccccagcctgctgaagatccagacctggcccggcgtggtggcccacgcctgcaaccccagctacagcggcggcagactgagacaggagaactgcctgaacctgggcggcggcggctgcggcgagatcgccctgcagcccggccagcaggagtag

SEQ ID NO: 23897 - DNA, 111 bp, Artificial Sequence
  Description of Artificial Sequence: Synthetic coding sequence
ggcagagacgactggcaggccgccccccccgccgcccccgtgagagaccccctgggcgaggccagctgggcccccgagtgcggcggcgacctggagaacctgtacgtgtag

SEQ ID NO: 23898 - DNA, 321 bp, Artificial Sequence
  Description of Artificial Sequence: Synthetic coding sequence
ttcttcctgagcttcctgcacagcttcttcctgagacagagcttcgccctggtggcccaggccggcgtgcagtggcacaacctgggcagcctgcagccccccccccccggcttcaagcagttcagctgcctgagcctgctgagcagctgggactacagacacgtgcccccctgccccgccaacttcgtgttcctggtggagatgggcttcctgcacgtgggccaggccggcctggagctgagaaccagcggcgacccccccaccctggccagccagagcgccggcatcaccggcgtgagccacagagcccagcccagctag

SEQ ID NO: 23899 - DNA, 276 bp, Artificial Sequence
  Description of Artificial Sequence: Synthetic coding sequence
ttcttcctgagatggagcctgaccctgagcagcagactggagtgcagcggcgccaccagcgcccactgcaacgtgagactgcccggcagcagacacagccccaccagcgccagcagagtggccggcaccaccggcgccagacacctgagcagactgatcttcatcttcagcagagacggcgtgagcccctggagcagaagccccgacctggccatcagaccccccagaccccccaagaagctgggcctgcaggcccccgccaccatgcccggctag

SEQ ID NO: 23900 - DNA, 381 bp, Artificial Sequence
  Description of Artificial Sequence: Synthetic coding sequence
agacaccaggcccagctgatcttcctgtacgacctgttcctgtacgtgtacttcctgaaggacagagtgctgctgtgccaccccggctggagcgccatgaccagaagcagactgaccgccaccagcgccagccaggtggccggcaccatcggcatgtgccaccacgccagactgatcttcttcttcttcttcgtgttcctggtggagaccggcttccactgcgtgagccagcacggcctggagctgctgaccctggacccccccgccagcgccagccagagcgccagaatcatcggcctgaaccactgcacccagcccaccttctgcatcttcagcagagacggcgacagcccctgctggcccgactggagcagaacctag

SEQ ID NO: 23901 - DNA, 327 bp, Artificial Sequence
  Description of Artificial Sequence: Synthetic coding sequence
cagatcaagagcaagttcttcttcttcctgagaagaagcctggccctgagccccagactggagtgcagcggcggcatcagcgcccactgcaagctgagactgcccggcagcagacacagccccgccagcgccagccaggtggccggcaccaccggcgccagacactacgccagactgatcttcctgttcctgatcgagaccggcttccactacgtgggccaggccggcctggagctgctgaccagcggcgacctgcccaccagcgccagccagagcgccggcatcaccggcgtgagccactgcacccagcccgaggacatcttctag

SEQ ID NO: 23902 - DNA, 369 bp, Artificial Sequence
  Description of Artificial Sequence: Synthetic coding sequence
tgggactacagcttcttcttcttcctgagacagagccacagcgtgccccaggccggcgtgcagtggtgcaacctgagcagcctgcagcccccccccagcagattcaagagattcagctgcctgagcctgctgagcagctgggactacagacacacccccccctgccccgccaacttctgcatcttcagaaccttcttcttcttcctgagatggagcttcgccctgagccccagactggagtgcagcggcgccatcctggtgcactgcaacctgtgcctgcccggcagcagcgacagctgcctgagcctgcccatcagctgggactacagatgcgcccccccctgcctggccaacttctgcatcttctag

SEQ ID NO: 23903 - DNA, 372 bp, Artificial Sequence
  Description of Artificial Sequence: Synthetic coding sequence
tgggactacagcttcttcttcttcctgagacagagccacagcgtgccccaggccggcgtgcagtggtgcaacctgagcagcctgcagcccccccccagcagattcaagagattcagctgcctgagcctgctgagcagctgggactacagacacacccccccctgccccgccaacttcctgtacaccttcgagctgttcttcttcttcctgagatggagcttcgccctgagccccagactggagtgcagcggcgccatcctggtgcactgcaacctgtgcctgcccggcagcagcgacagctgcctgagcctgcccatcagctgggactacagatgcgcccccccctgcctggccaacttctgcatcttctag

SEQ ID NO: 23904 - DNA, 372 bp, Artificial Sequence; identical to SEQ ID NO: 23903
  Description of Artificial Sequence: Synthetic coding sequence

SEQ ID NO: 23905 - DNA, 81 bp, Artificial Sequence
  Description of Artificial Sequence: Synthetic coding sequence
ttcctgatggacaagagcagcctgaccggcgccctgtgcagcatcaccctggccagcccctgcggcacccccggcatctag

SEQ ID NO: 23906 - DNA, 318 bp, Artificial Sequence
  Description of Artificial Sequence: Synthetic coding sequence
gagaccggcagatgggtggagcccagaagcagcagactgggcttcttcctggtggagctgctgagcttcgacctgggcaacagagccagactgcacctgaagaagaagaagaagaagaagatccccggcaagcactgcgtgtgcttcatgagatggagcctggccctgctgcccagactgggctgcagcggcgccatcagcgcccactgcaagctgcacctgctgggcagccaccacagccccgccagcgccagcagagtggccggcatcaccggcgccagacaccacaccagactgatcttcttcttcttcgtgtag

SEQ ID NO: 23907 - DNA, 228 bp, Artificial Sequence
  Description of Artificial Sequence: Synthetic coding sequence
tgcttcagccacagcttcttcttcttcttcttcttcctgagatggagcctggccctgagccccagactggagtgcagcggcgccatcagcgcccactgcaagctgagactgctgggcagcagacacagccccgccagcgccagcagagtggccggcaccaccggcgcctgccaccacgccagactgttcttctgcatcttcagcagagacggcgtgagcccctgctag

SEQ ID NO: 23908 - DNA, 324 bp, Artificial Sequence
  Description of Artificial Sequence: Synthetic coding sequence
gtgctgaacggcgcccaggccggcgtgcagtggagagacctgggcagcctgcagccccccccccccagccacctgcccagacccagcaaggtgcccagagtgcagcccctgcccggcagacaccccgtgtgggaggtgagaggcgtgagcgcctggccccccatcgtgtgggacgtgagaagccccagcgcctggctgcccagcctggagagcgaggagagactgtgccccgccgccatccccagcagaaagtggggcgcccccgtgcccagaagacccatctgggacgtgagaagcgtgagcgcccagccccccagactgtag

SEQ ID NO: 23909 - DNA, 288 bp, Artificial Sequence; identical to SEQ ID NO: 23884
  Description of Artificial Sequence: Synthetic coding sequence

SEQ ID NO: 23910 - DNA, 399 bp, Artificial Sequence
  Description of Artificial Sequence: Synthetic coding sequence
tgcatgtgcgtgtgcgtgtgcgtgtgcatgtacatctacatctacatctacatcagccagcccatctacatcttcctgctgctgctgctgctgctgttcctgagacagagcctgatgatcaagaaccaggtgagaagacccggcgccgtggcccacacctgcaaccccagcaccgtgggcggccacggcggccagatcaccagaggccaggagttcgagaccagcctggccaacatgggcgagacccccagcctgctgaagatccagacctggcccggcgtggtggcccacgcctgcaaccccagctacagcggcggcagactgagacaggagaactgcctgaacctgggcggcggcggctgcggcgagatcgccctgcagcccggccagcaggagtag

SEQ ID NO: 23911 - DNA, 282 bp, Artificial Sequence
  Description of Artificial Sequence: Synthetic coding sequence
agcgtggcccaggccggcgtgcagtggcacaacctgggcagcctgcagccccccccccccagattcaacagattcagctgcctgagcatccccagcagctgggactacagacacagcccccccagactggccgacttcctgttcctggtggagaccgagttctgccacgtgggccaggccgccctggagctgctgaccagcggcgacctgcccaccagcgccagccagagcgccagaatcaccggcgtgagccacagaaccagacccagcctgttctactag

SEQ ID NO: 23912 - DNA, 423 bp, Artificial Sequence
  Description of Artificial Sequence: Synthetic coding sequence
ggcaccatcagcgcccactgcaacctgtgcctgctggacagcagcgacagccccgccagcgccagcagagtggccggcatcatcggcgcccaccaccacgcccagctgatcttcgtgttcctggtggagatgggcttccaccacgtgggccaggccggcctgaagctgctgaccagcgacccccccgtgagcgccagccagagcgccggcatcaccggcgtgagccaccacagagagccccagcaccccttcctgctgagcgtggagagcagagacagacccttcttcttcttcggcttcttcttcttcgagatggagagctacagcgtggcccaggccggcgtgcagtggagagacctgagcagcctgcagccccccccccccagagcccaggccatcctgcccccccagccccccaagtag

SEQ ID NO: 23913 - DNA, 396 bp, Artificial Sequence
  Description of Artificial Sequence: Synthetic coding sequence
tgcaacctgtgcctgctgggcagcagcgacagccccgccagcgccagccagatcgccggcatcaccggcgcccaccaccacacctggctgttcagcgtgttcctggtggagagcggcttccaccacgtgggccaggccggcctggagctgctgaccagcggcgaccccgccagcgccagccacagcgccggcatcaccggcgtgagccactgcgcctggcccagactggaggccaccagcgtgcccaacttcttcttcttcttcttcttcttcttcttcttcctgagaagaagcctggccgtggcccaggccggcgtgcagtggagaaacctgggcagcctgcaggcccccccccccggcgtgcacgccatcctgctgccccagccccccgagtag

SEQ ID NO: 23914 - DNA, 153 bp, Artificial Sequence
  Description of Artificial Sequence: Synthetic coding sequence
cccagcttcctgctgttcttcctgcccagcttcctgcccttcagcctgagcagcctgagcttcctgcccttcctgctgagcttcctgaccggcagccacctgttcagcatcacccacacccacacccacacccacacccacacccacacctag

SEQ ID NO: 23915 - DNA, 423 bp, Artificial Sequence; identical to SEQ ID NO: 23912
  Description of Artificial Sequence: Synthetic coding sequence

SEQ ID NO: 23916 - DNA, 396 bp, Artificial Sequence; identical to SEQ ID NO: 23913
  Description of Artificial Sequence: Synthetic coding sequence

SEQ ID NO: 23917 - DNA, 279 bp, Artificial Sequence
  Description of Artificial Sequence: Synthetic coding sequence
ttcttcttcttcttcttcgagaccgactgcagaagcgtgaccagactggagtgcagcggcatcatcagcgcccactgcaagctgtgcctgcccggcagcagcgacagccccgccagcgccagccaggccgccagaaccatcggcacctgccaccacacccagctgatcttcgtgttcttcgtggagaccggcttccaccacgtgggccaggacggcctgaacctgagcctggtgatccacccccccagaccccccaaggtgctgggcctgcaggtgtag

SEQ ID NO: 23918 - DNA, 228 bp, Artificial Sequence; identical to SEQ ID NO: 23907
  Description of Artificial Sequence: Synthetic coding sequence

SEQ ID NO: 23919 - DNA, 177 bp, Artificial Sequence
  Description of Artificial Sequence: Synthetic coding sequence
cccggcggcgccgccgccgccgccagcgtgatggcccccagaagaagcagatgcttctgcaccagcatctgcggcggcagaggcgccagaccccagctgcccagaacctgcggcgacggcacccagcactgcggcagaggcaagcccgccctggccgccgccgaggagtggccctag

SEQ ID NO: 23920 - DNA, 372 bp, Artificial Sequence
  Description of Artificial Sequence: Synthetic coding sequence
gtgtgcgtgtgcgtgtgcgtgtgcgtgtgcgtgtgcctgttcatctacttcagcgtgttctggagcttcctgtacctgttcgtgttcctgctgaagatctacgagaagagaccctgcgccgtggcccacgcctgcaacccccccggcgtggtggcccacgcctgcaaccccagcaccctgggcggcagaggcggccagatcagctggagccaggagttcgagaccagcctggccaacatgagcaagacccccagcagaaagaagagaaagggctggagcggcgtggtggcccacgcctgcaaccacagctacagcggcctgagacaggagaactgcctgaaccccgtgggcggcggctgcgtgcagccctag

SEQ ID NO: 23921 - DNA, 288 bp, Artificial Sequence; identical to SEQ ID NO: 23884
  Description of Artificial Sequence: Synthetic coding sequence

SEQ ID NO: 23922 - DNA, 261 bp, Artificial Sequence
  Description of Artificial Sequence: Synthetic coding sequence
ggcaccatcagcgcccactgcaacctgtgcctgctgggcagcagcgacagccccgccagcgccagccaggtggccgccggcatcaccggcgcctgccacctggcccagctgatcttcatcttcctgatcgagaccggcttccaccacgccgtgcaggccggcctgaagctgctgaccctgagcgacctgcccgccagcgccagccagagcgtgggcatcaccggcgccagccacagagccgaccccaaggtgttcctgtag

SEQ ID NO: 23923 - DNA, 66 bp, Artificial Sequence
  Description of Artificial Sequence: Synthetic coding sequence
aacagaaagaaggagggcaagaagaaccagagccccccccccaccgtgagccccctggccacctag

SEQ ID NO: 23924 - DNA, 303 bp, Artificial Sequence
  Description of Artificial Sequence: Synthetic coding sequence
ttcctgagaagaagcctggccctgagccccagacagtggcacgacctgggcagcctgcagccccccccccccggcttcaagcccttcagctgcctgagcctgctgagcagctgggactacagatgcgcccccccctgccccgccaacttctgcatcctggtggagatgggcttccaccacgtgggccaggccggcctggagctgctgaccagcgacctgcccaccagcgccagccagagagccggcatcaccggcgtgaaccaccacgcctggcccagagacgccttcagcatcagctactag

SEQ ID NO: 23925 - DNA, 282 bp, Artificial Sequence
  Description of Artificial Sequence: Synthetic coding sequence
agcgtggcccaggccggcgtgcagtggcacaacctgggcagcctgcagccccccccccccagattcaacagattcagctgcctgagcatccccagcagctgggactacagacacagcccccccctgctggccgacttcctgttcctggtggagaccgagttctgccacgtgggccaggccgccctggagctgctgaccagcggcgacctgcccaccagcgccagccagagcgccagaatcaccggcgtgagccacagaaccagacccagcctgttctactag

SEQ ID NO: 23926 - DNA, 111 bp, Artificial Sequence
  Description of Artificial Sequence: Synthetic coding sequence
aagagaaagaagaaggagagaaagaaggagagaaagaagaaggagagaaagaaggagagaaagaaggagagaaagaaggagaaggagagaaagaaggagaaggagagatag

SEQ ID NO: 23927 - DNA, 234 bp, Artificial Sequence
  Description of Artificial Sequence: Synthetic coding sequence
atcaactgctacagcttctacagcctgttcctgttcgtgtgcatcaccgacggcgtgagcctgagccccagacccgagtgcagcggcgccatcagcgcccactgcagactgagacccagaggcagcagacacagccccgccagcgccagcagagtggccggcaccaccggcgccagacacctggcccagctgatcttctgcatcttcagcagagacggcgtgagcctgtgctag

SEQ ID NO: 23928 - DNA, 222 bp, Artificial Sequence
  Description of Artificial Sequence: Synthetic coding sequence
agaagagagagacccctgcccgagccccacagccagttcttcttcttcttcttcttctactacaccctgagcttcagagtgcacgtgcacatcgtgcaggtgagctacatctgcatccacgtgccctgctggtgcgccgcccccaccaacgtgagcagcagcatcagatacatcagccagtgctaccccagccccctgcccagaccccaccacagcccctag

SEQ ID NO: 23929 - DNA, 123 bp, Artificial Sequence
  Description of Artificial Sequence: Synthetic coding sequence
agcccccccccccccggcggcggcgagaagcccctggcccccccccccggctgggtggagccccccaagtggctgggcctgcagggccccagcggcggccccggcgccggccccggcctgtag

SEQ ID NO: 23930 - DNA, 318 bp, Artificial Sequence
  Description of Artificial Sequence: Synthetic coding sequence
tacttctacttcctgagacagagcctgaccctgagccccagactggagtgcagcggcaccatcagcgcccactgcaacctgtgcctgcccggcagcagcaacagccccgccagcgccagccaggtggccggcatcaccggcgtgtgccaccacacccagctgatcttcgtgttcctggtggagatgggcttctgccacgtgggccaggccggcctggagctgctgaccagcggcaacccccccgccctggccttccagagcgccggcatcaccggcatgagccaccacgcctggcccggccacatgttcttcaagtag

SEQ ID NO: 23931 - DNA, 216 bp, Artificial Sequence; identical to SEQ ID NO: 21554
  Description of Artificial Sequence: Synthetic coding sequence

SEQ ID NO: 23932 - DNA, 168 bp, Artificial Sequence
  Description of Artificial Sequence: Synthetic coding sequence
gtgatcggctgggtgtggtggctgacccccgtgatccccgccctgtgggaggccgaggccggcggcagccccgagatcagaagcagcagacccgcctggcccacctggggcaaccccagcctgctgaagatccagaagctggccagaagaggcggcgcccacctgtag

SEQ ID NO: 23933 - DNA, 366 bp, Artificial Sequence
  Description of Artificial Sequence: Synthetic coding sequence
ctgccccccgccgacctgttcatcttcatcttcatcgacaaggtgagcctgctgagccccagactggagtgcaacggcaccatcagcgcccactacaagctgcacctgcccttcaagagattcagctgcctgagcctgctgaagaccggcttccaccacgtgggccagctgatcttcgtgttcctggtggagatggccttccaccacgtgggccaggccggcctggagctgctgaccagcggcgacctgttcgaggtggagttccacagctgctgcctgggctggagcgccatggccagaagcagactgaccgccaccagcgccagcagagtgcaggccatcctgctgccccagccccccgagtag

SEQ ID NO: 23934 - DNA, 420 bp, Artificial Sequence
  Description of Artificial Sequence: Synthetic coding sequence
atctgccaccacacccagctgatcttcgtgttcctgggcttctacctgttcatctacctgttcatcgacggcgtgctgctgtgctgccccggctggagcgccgtggtgcagagctggctgaccgccaccagcgccagccaggtggccggcatcaccggcatgcaccaccacgcccagctgatcttcgtgttcctggtggagatgggcttccaccacgtgggccaggccggcctggagctgctgaccagcggcgacccccccgccagcgccagccagagcaccggcatcaccggcgtgagccactgcaccagacccaacttctgcatcttcagcagagacggcgtgagcccctgctggcccggctggagcagaacccccgacctggtgatcagcgcccacctgggcctgcccaagtgctag

SEQ ID NO: 23935 - DNA, 228 bp, Artificial Sequence; identical to SEQ ID NO: 23907
  Description of Artificial Sequence: Synthetic coding sequence

SEQ ID NO: 23936 - DNA, 303 bp, Artificial Sequence
  Description of Artificial Sequence: Synthetic coding sequence
ttcctgagaagaagcctggccctgagccccagacagtggcacgacctgggcagcctgcagccccccgcccccggcttcaagcccttcagctgcctgagcctgctgagcagctgggactacagatgcgcccccccctgccccgccaacttctgcatcctggtggagatgggcttccaccacgtgggccaggccggcctggagctgctgaccagcgacctgcccgccagcgccagccagagagccggcatcaccggcgtgaaccaccacgcctggcccagagacgccttcagcatcagctactag

SEQ ID NO: 23937 - DNA, 1251 bp, Artificial Sequence
  Description of Artificial Sequence: Synthetic coding sequence
atgaagatgcagaagggcaacgtgctgctgatgttcggcctgctgctgcacctggaggccgccaccaacagcaacgagaccagcaccagcgccaacaccggcagcagcgtgatcagcagcggcgccagcaccgccaccaacagcggcagcagcgtgaccagcagcggcgtgagcaccgccaccatcagcggcagcagcgtgaccagcaacggcgtgagcatcgtgaccaacagcgagttccacaccaccagcagcggcatcagcaccgccaccaacagcgagttcagcaccgtgagcagcggcatcagcatcgccaccaacagcgagagcagcaccaccagcagcggcgccagcaccgccaccaacagcgagagcagcacccccagcagcggcgccagcaccgccaccaacagcgacagcagcaccaccagcagcggcgccagcaccgccaccaacagcgacagcagcaccaccagcagcgaggccagcaccgccaccaacagcgagagcagcaccaccagcagcggcgccagcaccgccaccaacagcgagagcagcaccaccagcagcggcgccagcaccgccaccaacagcgagagcagcaccaccagcagcggcgccagcaccgccaccaacagcggcagcagcaccaccagcagcggcaccagcaccgccaccaacagcgagagcagcaccgtgagcagcggcgccagcaccgccaccaccagcgagagcagcaccaccagcagcggcgccagcaccgccaccaacagcgagagcagcaccgtgagcagcggcgccagcaccgccaccaacagcgagagcagcaccaccagcagcggcgccaacaccgccaccaacagcggcagcagcgtgaccagcgccggcagcggcaccgccgccctgaccggcatgcacaccaccagccacagcgccagcaccgccgtgagcgaggccaagcccggcggcagcctggtgccctgggagatcttcctgatcaccctggtgagcgtggtggccgccgtgggcctgttcgccggcctgttcttctgcgtgagaaacagcctgagcctgagaaacaccttcaacaccgccgtgtaccacccccacggcctgaaccacggcctgggccccggccccggcggcaaccacggcgccccccacagacccagatggagccccaactggttctggagaagacccgtgagcagcatcgccatggagatgagcggcagaaacagcggcccctag

SEQ ID NO: 23938 - DNA, 372 bp, Artificial Sequence; identical to SEQ ID NO: 23903
  Description of Artificial Sequence: Synthetic coding sequence

SEQ ID NO: 23939 - DNA, 309 bp, Artificial Sequence
  Description of Artificial Sequence: Synthetic coding sequence
gtgctgctgtgctgccccggctggagcgccgtggtgagaagctggctgaccgccaccagcgccagctggcagctggccggcatcaccggcgtgtgccaccacgcccagctgatcttcgtgttcttcatcgagaccgagttccaccacgtgggccaggccggccccgagctgctgaccagcggcgaccccagcgccagcgccagccagagcgccggcatcaccggcgccagccaccccagaagagccaacttctgcatcttcggcagagacggcgtgagcccctgctggcccggctggagcagcacctag

SEQ ID NO: 23940 - DNA, 381 bp, Artificial Sequence
  Description of Artificial Sequence: Synthetic coding sequence
agacaccaggcccagctgatcttcctgtacgacctgttcctgtacgtgtacttcctgaaggacagagtgctgctgtgccaccccggctggagcgccatgaccagaagcagactgaccgccaccagcgccagccaggtggccggcaccatcggcatgtgccaccacgccagactgatcttcttcttcttcttcgtgttcctggtggagatgggcttccactgcgtgagccagcacggcctggagctgctgaccctggacccccccgccagcgccagccagagcgccagaatcatcggcctgaaccactgcacccagcccaccttctgcatcttcagcagagacggcgacagcccctgctggcccgactggagcagaacctag

SEQ ID NO: 23941 - DNA, 153 bp, Artificial Sequence
  Description of Artificial Sequence: Synthetic coding sequence
cccagcttcctgctgttcttcctgcccagcttcctgcccttcagcctgagcagcctgagcttcctgcccttcctgctgagcttcctgaccggcagcttcggccaggacaaggtgttcagcatcacccacacccacacccacacccacacctag

SEQ ID NO: 23942 - DNA, 372 bp, Artificial Sequence
  Description of Artificial Sequence: Synthetic coding sequence
tgcgtgtgcgtgtgcgtgtgcgtgtgcgtgtgcctgttcatctacttcagcgtgttctggagcttcctgtacctgttcgtgttcctgctgaagatctacgagaagagaccctgcgccgtggcccacgcctgcaacccccccggcgtggtggcccacgcctgcaaccccagcaccctgggcggcagaggcggccagatcagctggagccaggagttcgagaccagcctggccaacatgagcaagacccccagcagaaagaagagaaagggctggagcggcgtggtggcccacgcctgcaaccacagctacagcggcctgagacaggagaactgcctgaaccccgtgggcggcggctgcgtgcagcccagatag

SEQ ID NO: 23943 - DNA, 279 bp, Artificial Sequence; identical to SEQ ID NO: 23917
  Description of Artificial Sequence: Synthetic coding sequence

SEQ ID NO: 23944 - DNA, 384 bp, Artificial Sequence
  Description of Artificial Sequence: Synthetic coding sequence
atcttcttcttcctgagacagggcctgctgctgagccccagactgctggagtgcaacggcaccatcagcacccactgcaacctgcacatccccggcagcagcgacagccccgccagcgccagccaggtggccggcatctacagaagcagagaccagcccgaccagcacggcgagacccccagcctgctgaagatccagaagctggtgggcagaggcggcttccacttcttcagccagctgctgggcagacccagacaggagaacggcgtgaaccccggcggcagagcctgcagcgagctgagactgagacactgcacccccgcctgggccaccgaggccagactgtgcctgaagaagaagaagaagaagaagaagaagaagtag

SEQ ID NO: 23945 - DNA, 312 bp, Artificial Sequence
  Description of Artificial Sequence: Synthetic coding sequence
ttcttcttcttcctgagaagaagcctggccctgagccccagactggagtgcagcggcggcatcagcgcccactgcaagctgagactgctgggcagcagacacagccccgccagcgccagccaggtggccggcaccaccggcgccagacactacgccagactgatcttcctgttcctgatcgagaccggcttccactacgtgggccaggccggcctggagctgctgaccagcggcgacctgcccaccagcgccagccagagcgccggcatcaccggcgtgagccactgcacccagcccgaggacatcttctag

SEQ ID NO: 23946 - DNA, 243 bp, Artificial Sequence
  Description of Artificial Sequence: Synthetic coding sequence
gcccaccacctgagaagcggcgccggcgaccagcccggccagcacggcgagacccccagcctgctgaagatcgagaagctggccgagcacggcggcagctgcttcagcttccaggtgctgggcagactgagacaggagaactgcctgaaccccggcggcggcggctgcagcgagcccagactgtgccactgcacccccgcctgggccaccgagcagggcagcgtgagcagaaagaaggagtag

SEQ ID NO: 23947 - DNA, 420 bp, Artificial Sequence; identical to SEQ ID NO: 23934
  Description of Artificial Sequence: Synthetic coding sequence

SEQ ID NO: 23948 - DNA, 318 bp, Artificial Sequence
  Description of Artificial Sequence: Synthetic coding sequence
tacttctacttcctgagacagagcctgaccctgagccccagactggagtgcagcggcatgatcagcgcccactgcaacctgtgcctgcccggcagcagcaacagccccgccagcgccagccaggtggccggcatcaccggcgtgtgccaccacacccagctgatcttcgtgttcctggtggagatgggcttctgccacgtgggccaggccagcctggagctgctgaccagcggcaacccccccgccctggccttccagagcgccggcatcaccggcatgagccaccacgcctggcccggccacatgttcttcaagtag

SEQ ID NO: 23949 - DNA, 462 bp, Artificial Sequence
  Description of Artificial Sequence: Synthetic coding sequence
gtgagaggcgccagcgccagaccccccctgctgggcagcgaggagcccctgagccccgccagcagacccgtgagagagggcggcggcggcgtgagccccccccccggccagcccccctgccccggcggcagatggggcggccagcccagcgccagacccgccgcccccagcggcagagaggtgggcgtgagcgcccccagacccgccagcagacccgtgagagaggtgagaggcgccagcgccagaccccccctgctgggcagcgaggagcccctgtgccccgccagcagacccgtgagagagggcggcggcggcgtgagccccccccccggccagccccccagacccggcggcagaggcgccagcgccagaccccccctgctgggcagcgaggagcccctgtgcgccgccaccacccccagcggcagatgcgcccagcagctgatcgagaacggcccctag

SEQ ID NO: 23950 - DNA, 348 bp, Artificial Sequence
  Description of Artificial Sequence: Synthetic coding sequence
atgaacgtgtgctgcagcagccaccccgtgaacgagaaggtgtggaagcccagcagcagaaagtggagcagcaaggtgtggagcatggacgagttcgacctgcagaccgcctgctactggttcatgaccagatgccagaaggaggccggcaagttcggcacccacagaggcaagcccatgtgcttcgtgagaagcctgctgagagtgcagctgctgcccagaaccttccccgccaacagcttcgtgatcagcttcttccccagcctgatctaccccctgcaggtgtaccagctgcacttcgagagcagcgacaagcagagagccatgcagttcgtgaccgagggctag

SEQ ID NO: 23951 - DNA, 318 bp, Artificial Sequence; identical to SEQ ID NO: 23930
  Description of Artificial Sequence: Synthetic coding sequence

SEQ ID NO: 23952 - DNA, 111 bp, Artificial Sequence; identical to SEQ ID NO: 23926
  Description of Artificial Sequence: Synthetic coding sequence

SEQ ID NO: 23953 - DNA, 420 bp, Artificial Sequence; identical to SEQ ID NO: 23934
  Description of Artificial Sequence: Synthetic coding sequence

SEQ ID NO: 23954 - DNA, 111 bp, Artificial Sequence; identical to SEQ ID NO: 23926
  Description of Artificial Sequence: Synthetic coding sequence

SEQ ID NO: 23955 - DNA, 108 bp, Artificial Sequence
  Description of Artificial Sequence: Synthetic coding sequence
agccccaacaagctgctgttcgaccccagagtgggcggcagagtgagccacgtgttcttcctgttcccccccttcgtgctgctgcccggcccccccggcctgccctag

SEQ ID NO: 23956 - DNA, 303 bp, Artificial Sequence; identical to SEQ ID NO: 23936
  Description of Artificial Sequence: Synthetic coding sequence

SEQ ID NO: 23957 - DNA, 399 bp, Artificial Sequence; identical to SEQ ID NO: 23896
  Description of Artificial Sequence: Synthetic coding sequence

SEQ ID NO: 23958 - DNA, 111 bp, Artificial Sequence; identical to SEQ ID NO: 23897
  Description of Artificial Sequence: Synthetic coding sequence

SEQ ID NO: 23959 - DNA, 228 bp, Artificial Sequence; identical to SEQ ID NO: 23907
  Description of Artificial Sequence: Synthetic coding sequence

SEQ ID NO: 23960 - DNA, 336 bp, Artificial Sequence
  Description of Artificial Sequence: Synthetic coding sequence
ttcttcttcttcttcttcctgagacacaccctggccctgctgcccagactggagtgcagcggcgccatcctggcccactgcaacatccccctgagcagcagcagcaacagccccgccagcgccagccaggtggccggcatcaccggcgtgtgccaccacgcccagctgatcttcgtgttcttcatcgagaccgagttccaccacgtgggccaggccggccccgagctgctgaccagcggcgaccccagcgccagcgccagccagagcgccggcatcaccggcgccagccacagagcccagcccctgagcatcctgttcttcttcttcgaggcctag

SEQ ID NO: 23961 - DNA, 462 bp, Artificial Sequence; identical to SEQ ID NO: 23949
  Description of Artificial Sequence: Synthetic coding sequence

SEQ ID NO: 23962 - DNA, 273 bp, Artificial Sequence
  Description of Artificial Sequence: Synthetic coding sequence
cagtggagcgacctgggcagcctgcagccccccccccccggcttcaagagattcagctgcctgaacctgcccaccagctgggactacagacacgtgccccccagacccgccaacttctgcttcttcatcgagatgggcttcctgcacgtgggccagaccggcctggagctgcccaccagcggcgacccccccgccagcgccagccagagcgccggcatcaccggcgtgagccaccacgcctggccccacttcatcatcctgctgatgatctag

SEQ ID NO: 23963 - DNA, 387 bp, Artificial Sequence
  Description of Artificial Sequence: Synthetic coding sequence
tggagagcccccgtgatccccgccaccagagaggccgaggccggcgagtggtgcgagcccagaagcaccagaatccaggagaaggacatcgccttcctggccttcagcctgggcgacagagtgagactgtacctgcagaagaagaagaagaagaagaagaagaaccagagcagactgttcctgagactgagcctggccctgagccccagactggagtgcagcggcgccatcagcgcccactgcaacctgcaccacctgggcagcagcgacagccccgccagcgccagcagagtggccggcatcaccggcgccagacaccacaccagattcatcttcgtgttcctggtggagaccagctgctggaacctgctggtgagcaacagctag

SEQ ID NO: 23964 - DNA, 357 bp, Artificial Sequence
  Description of Artificial Sequence: Synthetic coding sequence
tggtgcgcccccgtggcccccgccaccagagaggtggaggtgggcggcagcctggagcccaacagaagcagactgcagagcgccaagatcgcccccctgcactacagcctgggcaacagaaccagactgtgcctgaagaagaagaagaagaagagcctgttcaacaaggtgtgcctgttcctgagaagaagcctgaccctgagccccagactggagcacagcggcatgatcagcgcccactgcaacctgagactgcccggcagcagctacagccccgtgagcgccagccaggtggccggcatcaccggcgcctgccaccacacccagctgatcttcgtgttcctggtggagacctag

SEQ ID NO: 23965 - DNA, 318 bp, Artificial Sequence; identical to SEQ ID NO: 23930
  Description of Artificial Sequence: Synthetic coding sequence

SEQ ID NO: 23966 - DNA, 354 bp, Artificial Sequence
  Description of Artificial Sequence: Synthetic coding sequence
gacagagtgctgctgtgccaccccggctggagcgccatgaccagaagcagactgaccgccaccagcgccagccagctggccggcatcaccggcacccaccaccacgtgtggctgagcttcgtgttcctggtggagatgggcatccaccacgtgggccagaccggcctggagctgcccaccagcggcgacctgcccaccagcgccacccagagcgccggcatcaccggcgtgggccactgcagcagacccgaggaggtgctgttcttcagagacggcgtgagcccctgctggagcggctggagccagacccccggcctgaagcccagcagccacctgggcctgcccaagtgctag

SEQ ID NO: 23967 - DNA, 111 bp, Artificial Sequence
  Description of Artificial Sequence: Synthetic coding sequence
aaggagaagaaggaggagagaaagaaggagagaaagaagaaggagagaaagaaggagagaaagaaggagagaaagagagagaaggagagaaagaaggagaaggagagatag

SEQ ID NO: 23968 - DNA, 306 bp, Artificial Sequence
  Description of Artificial Sequence: Synthetic coding sequence
ttccacctgttcctgttcatctgcttcttcctgttcctgagaagaagcctggccctgagccccagactggagtacagcggcaccatcagcgcccactgcaagctgagactgcccggcagcagatacagcgccagcgccagcagagtggccggcaccaccggcgccagacaccacgccagactgatcttctgcatcttctacagagacggcgtgagcccctgctggagcagaatccccgacctgatctgcctgccctggccccccaaggtgctgggcctgcaggcccccgccaccatccccggctag

SEQ ID NO: 23969 - DNA, 423 bp, Artificial Sequence; identical to SEQ ID NO: 23912
  Description of Artificial Sequence: Synthetic coding sequence

SEQ ID NO: 23970 - DNA, 387 bp, Artificial Sequence
  Description of Artificial Sequence: Synthetic coding sequence
tggagagcccccgtgatccccgccaccagagaggccgaggccggcgagtggtgcgagcccagaagcaccagaatccaggagaaggacatcgccttcctggccttcagcctgggcgacagagtgagactgtacctgcagaagaagaagaagaagagcaagaacaacaagaccagcctgttcctgagactgagcctggccctgagccccagactggagtgcagcggcgccatcagcgcccactgcaacctgcaccacctgggcagcagcgacagccccgccagcgccagcagagtggccggcatcaccggcgccagacaccacaccagattcatcttcgtgttcctggtggagaccagctgctggaacctgctggtgagcaacagctag

SEQ ID NO: 23971 - DNA, 306 bp, Artificial Sequence; identical to SEQ ID NO: 23968
  Description of Artificial Sequence: Synthetic coding sequence

SEQ ID NO: 23972 - DNA, 111 bp, Artificial Sequence
  Description of Artificial Sequence: Synthetic coding sequence
aagagaaagaagaaggagagaaagaaggagagaagaaagaaggagagaaagaaggagagaaagaaggagagaaagaaggagaaggagagaaagaaggagaaggagagatag

SEQ ID NO: 23973 - DNA, 279 bp, Artificial Sequence; identical to SEQ ID NO: 23917
  Description of Artificial Sequence: Synthetic coding sequence

SEQ ID NO: 23974 - DNA, 111 bp, Artificial Sequence; identical to SEQ ID NO: 23926
  Description of Artificial Sequence: Synthetic coding sequence

SEQ ID NO: 23975 - DNA, 333 bp, Artificial Sequence
  Description of Artificial Sequence: Synthetic coding sequence
tgcaccagatacttctacttctacctgttctgcttcatcttcatctacctgttcttcttcctgagatggagcctggccctgagccccagactggagtgcagcggcgccatcagcgcccactgcaagctgcacctgcccggcagctgccactaccccgccagcgccagcagagtggccggcaccaccggcgccagacaccacgcctggctgatcttctgcatgttcagcaaggacagagtgagcagatggagccagagccccgacatcgccatctgcctgccctggccccccaaggtgctgggcctgcaggcccccgccaccacccccggctag

SEQ ID NO: 23976 - DNA, 357 bp, Artificial Sequence
  Description of Artificial Sequence: Synthetic coding sequence
tggtgcgcccccgtggcccccgccaccagagaggtggaggtgggcggcagcctggagcccaacagaagcagactgcagagccccaagatcgcccccctgcactacagcctgggcaacagaaccagactgtgcctgaagaagaagaagaagaagaagaagatcaacaaggtgtgcctgttcctgagaagaagcctgaccctgagccccagactggagcacagcggcatgatcagcgcccactgcaacctgagactgcccggcagcagctacagccccgtgagcgccagccaggtggccggcatcaccggcgcctgccaccacacccagctgatcttcgtgttcctggtggagacctag

SEQ ID NO: 23977 - DNA, 177 bp, Artificial Sequence; identical to SEQ ID NO: 23718
  Description of Artificial Sequence: Synthetic coding sequence

SEQ ID NO: 23978 - DNA, 129 bp, Artificial Sequence
  Description of Artificial Sequence: Synthetic coding sequence
aaggaggagaacgaggaggagaaggtgaaggagaaggagaagaacaagaagagaaagaagagaaagaagagccagagcagaagagtgtaccaccaggagaagacccacatcctgtgggtgagcacctag

SEQ ID NO: 23979 - DNA, 309 bp, Artificial Sequence; identical to SEQ ID NO: 23939
  Description of Artificial Sequence: Synthetic coding sequence

SEQ ID NO: 23980 - DNA, 333 bp, Artificial Sequence
  Description of Artificial Sequence: Synthetic coding sequence
ttcttcttcttcttcggcaacggcgtgtggctgtgccaccccggctggagcgccgtggtgcagagcagactgaccgccaccagcgccagctggcagctggccggcatcaccggcgtgtgccaccacgcccagctgatcttcgtgttcttcatcgagaccgagttccaccacgtgggccaggccggccccgagctgctgaccagcggcgaccccagcgccagcgccagccagagcgccggcatcaccggcgccagccaccccagaagagccaacttctgcatcttcggcagagacggcgtgagcccctgctggcccggctggagcagcacctag

SEQ ID NO: 23981 - DNA, 75 bp, Artificial Sequence
  Description of Artificial Sequence: Synthetic coding sequence
agagagaccgagagaaccatcaccgacgacggctggatggacggctggatggacggctggatggacggctggtag

SEQ ID NO: 23982 - DNA, 372 bp, Artificial Sequence
  Description of Artificial Sequence: Synthetic coding sequence
ttcatcttcctgagatggagcctgagcctgagccccagactggagtgcagcggcaccatcagcgcccactgcaacctgtgcctgcccggcagcagccacagcagcgccagcgccagccaggtggccagaatcaccgacgtgggctacgcccccggccagcacggcgagacccccagcctgctgaagatccagaagctggccggctacggcgtggccaacgtgtacagccagctgctgggcagactgagacaggagaacggcgtgaaccccggcggcggcacctgcagcgagcccagaagcagacactgcacccccgcctgggccaccgccagactgagactgaagaagaagaagaagaagaagaagaagtag

SEQ ID NO: 23983 - DNA, 459 bp, Artificial Sequence
  Description of Artificial Sequence: Synthetic coding sequence
agcagattctacatcggctgcgacctgtgcaccaactgctactacggcgagtgcgtgggcatcgccgagaaggaggccaagaagatggacgtgtacatctgcaacgactgcaagtgggcccaggagggcagcagcgaggagctgtactgcatctgcagaacccccgccggcagctgcagattcttcatcggccacgacagatgccagaactggtaccacggctgctgcatcggcatcctgcagagcgaggccgagctgatcgacgagtacgtgtgcccccagtgccagagcaccgaggacgtgatgaccgtgctgacccccctgaccgagaaggacgacgaggagctgaagagagtgctgagaagcctgcaggcccacaagatggccagacccttcctggagcccgtggaccccaacgacgcccccgactactacggcgtgatcaaggagcccgtgtag

SEQ ID NO: 23984 - DNA, 123 bp, Artificial Sequence; identical to SEQ ID NO: 23929
  Description of Artificial Sequence: Synthetic coding sequence

SEQ ID NO: 23985 - DNA, 96 bp, Artificial Sequence; identical to SEQ ID NO: 23889
  Description of Artificial Sequence: Synthetic coding sequence

SEQ ID NO: 23986 - DNA, 417 bp, Artificial Sequence
  Description of Artificial Sequence: Synthetic coding sequence
ggcaccatcagcgcccactgcaacctgtgcctgctggacagcagcgacagccccgccagcgccagcagagtggccggcatcatcggcgcccaccaccacgcccagctgatcttcgtgttcctggtggagatgggcttccaccacgtgggccaggccggcctgaagctgctgaccagcgacccccccgccagcgccagccagagcgccggcatcaccggcgtgagccaccacaactggctgttcttcagcatcttcctgaagaacagccaggagaccgccagattcttcttctggttcttcttcttcgagatggagagctacagcgtggcccaggccggcgtgcagtggagagacctgagcagcctgcagccccccccccccagacacaccatcctgctgccccagccccccgagtag

SEQ ID NO: 23987 - DNA, 108 bp, Artificial Sequence; identical to SEQ ID NO: 23955
  Description of Artificial Sequence: Synthetic coding sequence

SEQ ID NO: 23988 - DNA, 369 bp, Artificial Sequence
  Description of Artificial Sequence: Synthetic coding sequence
ttcatcttcctgagatggagcctgagcctgagccccagactggagtgcagcggcaccatcagcgcccactgcaacctgtgcctgcccggcagcagccacagcagcgccagcgccagccaggtggccagaatcaccgacgtgggctacgcccccggccagcacggcgagacccccagcctgctgaagatccagaagctggccggctacggcgtggccaacgtgtacagccagctgctgggcagactgagacaggagaacggcgtgaaccccggcggcggcacctgcagcgagcccagaagcagacactgcacccccgcctgggccaccgccagactgagactgaagaagaagaagaagaagaagaagtag

SEQ ID NO: 23989 - DNA, 462 bp, Artificial Sequence; identical to SEQ ID NO: 23949
  Description of Artificial Sequence: Synthetic coding sequence

SEQ ID NO: 23990 - DNA, 213 bp, Artificial Sequence
  Description of Artificial Sequence: Synthetic coding sequence
atcagcgcccactgcaacctgtgcctgctgggcagcagcaacagcctggccagcgccagccaggtggccggcatcaccggcgcccaccaccaggcccagctgatcttcgtgttcctggtggagaccgagttccaccacgtgggccaggccggcctgaagctgctgaccaacgagtggctgcccgtgtgcctgcccaagtgctgggactactag

SEQ ID NO: 23991 - DNA, 366 bp, Artificial Sequence
  Description of Artificial Sequence: Synthetic coding sequence
tgcgtgtgcgtgtgcgtgtgcgtgtgcgtgtgcgtgttcatctacttcagcgtgttctggagcttcctgtacctgttcgtgttcctgatctgggccaaggagcaggacagcgtgagcaagaagaagaagaagaagcccggcgtggtggcccacgcctgcaaccccagcaccctgggcggcagaggcggccagatcaccaagcaggagttcgagaccagcctgagcaacatggccaagccccccaaggtgctgggcctgcagaactggcccggcatggtggccagcacctgcaaccccagctacggcagactgaagcaggagaaccacctgatcagaggcggcagaggctgcagcgagcccagatag

SEQ ID NO: 23992 - DNA, 276 bp, Artificial Sequence
  Description of Artificial Sequence: Synthetic coding sequence
accttcttcttcttcttcttcgagaccgactgcagaagcgtgaccagactggagtgcagcggcatcatcagcgcccactgcaagctgtgcctgcccggcagcagcgacagccccgccagcgccagccaggccgccagaaccatcggcgcctgccaccacgcccagctgatcttcgtgttcttcgagaccggcttccaccacgtgggccaggacggcctgctggacctggtgatccacccccccagaccccccaaggtgctgggcctgcaggtgtag

SEQ ID NO: 23993 - DNA, 372 bp, Artificial Sequence; identical to SEQ ID NO: 23903
  Description of Artificial Sequence: Synthetic coding sequence

SEQ ID NO: 23994 - DNA, 765 bp, Artificial Sequence
  Description of Artificial Sequence: Synthetic coding sequence
aaggtgagccacgtgtacttcttcctgcacagacacggcaaccaccccatcagccagagcttcccccacctgagcagactgagcatcccccagagcagacactgccaccccggccccttcagcatgagctgctgggcccacctgcccgacggcgccgtggccggccagagaggcagcagcctgcccagcagaggcggcagagccgaggcccccctgaccagcagaaccggcagactggccggccagggcgccccccccaccagcctgcccgactgggtggccgccggcagaagaagaagcagcctgcccagatggggcggctgcagagccgagagactgctgaccagccagaccggccagctgcccggcggcggcgccccccacttcagcgacggcgtggtggccagacagagagtgagcagcctgctgagaagaggcggcagagccgagaccctgctgaccagccagaccggcagcagacccggcagaggcgccccccacatccccgacggcgccgccggccagagaagaagcccccacctgagaagatgggccgccggccagagaagaagcagcctgcccagatgggacggcggcagagccgagaccctgctgaccttccagaccggccagcccggcagaggcgccccccacatccccgacgacggcagacccggcagagacaccccccacttccccgacggcgtggccgccggccagagactgcagagcagacacttcggcagacccagacaggccgcctag

SEQ ID NO: 23995 - DNA, 456 bp, Artificial Sequence
  Description of Artificial Sequence: Synthetic coding sequence
atggagagaaagaaccccagcagagagagccccagaagactgagcgccaaggtgggcaagggcaccgagatgaagaaggtggccagacagctgggcatggccgccgccgagagcgacaaggacagcggcttcagcgacggcagcagcgagtgcctgagcagcgccgagcagatggagagcgaggacatgctgagcgccctgggctggagcagagaggacagacccagacagaacagcaagaccgccaagaacgccttccccaccctgagccccatggtggtgatgaagaacgtgctggtgaagcagggcagcagcagcagccagctgcagagctggaccgtgcagcccagcttcgaggtgatcagcgcccagccccagctgctgttcctgcacccccccgtgcccagccccgtgagcccctgccacaccggcgagaagaagagcgacagcagatag

SEQ ID NO: 23996 - DNA, 408 bp, Artificial Sequence
  Description of Artificial Sequence: Synthetic coding sequence
atggagagaaagaaccccagcagagagagccccagaagactgagcgccaaggtgggcaagggcaccgagatgaagaaggtggccagacagctgggcatggccgccgccgagagcgacaaggacagcggcttcagcgacggcagcagcgagtgcctgagcagcgccgagcagatggagagcgaggacatgctgagcgccctgggctggagcagagaggacagacccagacagaacagcaagaccgccaagaacgccttccccaccctgagccccatggtggtgatgaagaacgtgctggtgaagcagggcagcagcagcagccagctgcagagctggaccgtgcagcccagcttcgaggtgatcagcgcccagccccagctgctgttcctgcacccccccgtgccctag

SEQ ID NO: 23997 - DNA, 426 bp, Artificial Sequence
  Description of Artificial Sequence: Synthetic coding sequence
atggagagaaagaaccccagcagagagagccccagaagactgagcgccaaggtgggcaagggcaccgagatgaagaaggtggccagacagctgggcatggccgccgccgagagcgacaaggacagcggcttcagcgacggcagcagcgagtgcctgagcagcgccgagcagatggagagcgaggacatgctgagcgccctgggctggagcagagaggacagacccagacagaacagcaagaccgccaagaacgccttccccaccctgagccccatggtggtgatgaagaacgtgctggtgaagcagggcagcagcagcagccagctgcagagctggaccgtgcagcccagcttcgaggtgatcagcgcccagccccagctgctgttcctgcacccccccgtgcccagccccgtgagcccctgctag

SEQ ID NO: 23998 - DNA, 474 bp, Artificial Sequence
  Description of Artificial Sequence: Synthetic coding sequence
atggagagaaagaaccccagcagagagagccccagaagactgagcgccaaggtgggcaagggcaccgagatgaagaaggtggccagacagctgggcatggccgccgccgagagcgacaaggacagcggcttcagcgacggcagcagcgagtgcctgagcagcgccgagcagatggagagcgaggacatgctgagcgccctgggctggagcagagaggacagacccagacagaacagcaagaccgccaagaacgccttccccaccctgagccccatggtggtgatgaagaacgtgctggtgaagcagggcagcagcagcagccagctgcagagctggaccgtgcagcccagcttcgaggtgatcagcgcccagccccagctgctgttcctgcacccccccgtgcccagccccgtgagcccctgccacaccggcgagaagaagagcgacagcagaaactacctgcccatcctgtag

SEQ ID NO: 23999 - DNA, 1752 bp, Artificial Sequence
  Description of Artificial Sequence: Synthetic coding sequence
atgaccttctacctgttcggcatcagaagcttccccaagctgtggaagagcccctacctgggcctgggccccggccacagctacgtgagcctgttcctggccgacagatgcggcatcagaaaccagcagagactgttcagcctgaagaccatgagcccccagaacaccaaggccaccaacctgatcgccaaggccagatacctgagaaaggacgagggcagcaacaagcaggtgtacagcgtgccccacttcttcctggccggcgccgccaaggagagaagccagatgaacagccagaccgaggaccacgccctggcccccgtgagaaacaccatccagctgcccacccagcccctgaacagcgaggagtgggacaagctgaaggaggacctgaaggagaacaccggcaagaccagcttcgagagctggatcatcagccagatggccggctgccacagcagcatcgacgtggccaagagcctgctggcctgggtggccgccaagaacaacggcatcgtgagctacgacctgctggtgaagtacctgtacctgtgcgtgttccacatgcagaccagcgaggtgatcgacgtgttcgagatcatgaaggccagatacaagaccctggagcccagaggctacagcctgctgatcagaggcctgatccacagcgacagatggagagaggccctgctgctgctggaggacatcaagaaggtgatcacccccagcaagaagaactacaacgactgcatccagggcgccctgctgcaccaggacgtgaacaccgcctggaacctgtaccaggagctgctgggccacgacatcgtgcccatgctggagaccctgaaggccttcttcgacttcggcaaggacatcaaggacgacaactacagcaacaagctgctggacatcctgagctacctgagaaacaaccagctgtaccccggcgagagcttcgcccacagcatcaagacctggttcgagagcgtgcccggcaagcagtggaagggccagttcaccaccgtgagaaagagcggccagtgcagcggctgcggcaagaccatcgagagcatccagctgagccccgaggagtacgagtgcctgaagggcaagatcatgagagacgtgatcgacggcggcgaccagtacagaaagaccaccccccaggagctgaagagattcgagaacttcatcaagagcagaccccccttcgacgtggtgatcgacggcctgaacgtggccaagatgttccccaaggtgagagagagccagctgctgctgaacgtggtgagccagctggccaagagaaacctgagactgctggtgctgggcagaaagcacatgctgagaagaagcagccagtggagcagagacgagatggaggaggtgcagaagcaggccagctgcttcttcgccgacgacatcagcgaggacgaccccttcctgctgtacgccaccctgcacagcggcaaccactgcagattcatcaccagagacctgatgagagaccacaaggcctgcctgcccgacgccaagacccagagactgttcttcaagtggcagcagggccaccagctggccatcgtgaacagattccccggcagcaagctgaccttccagagaatcctgagctacgacaccgtggtgcagaccaccggcgacagctggcacatcccctacgacgaggacctggtggagagatgcagctgcgaggtgcccaccaagtggctgtgcctgcaccagaagacctag

SEQ ID NO: 24000 - DNA, 309 bp, Artificial Sequence
  Description of Artificial Sequence: Synthetic coding sequence
gacatcgtgatgacccagagccccctgagcctgcccgtgacccccggcgagcccgccagcatcagctgcagaagcagccagagcctgctgcacagcaacggctacaactacctggactggtacctgcagaagcccggccagagcccccagctgctgatctacctgggcagcaacagagccagcggcgtgcccgacagattcagcggcagcggcagcggcaccgacttcaccctgaagatcagcagagtggaggccgaggacgtgggcgtgtactactgcatgcaggccctgcagaccccccccacctag

SEQ ID NO: 24001 - DNA, 348 bp, Artificial Sequence
  Description of Artificial Sequence: Synthetic coding sequence
aagatgagccccagccagctgatcggcttcctgctgctgtgggtgcccgccagcagaggcgagatcgtgctgacccagagccccgacttccagagcgtgacccccaaggagaaggtgaccatcacctgcagagccagccagagcatcggcagcagcctgcactggtaccagcagaagcccgaccagagccccaagctgctgatcaagtacgccagccagagcatcagcggcgtgcccagcagattcagcggcagcggcagcggcaccgacttcaccctgaccatcaacagcctggaggccgaggacgccgccgcctactactgccaccagagcagcagcctgccctag

SEQ ID NO: 24002 - DNA, 396 bp, Artificial Sequence
  Description of Artificial Sequence: Synthetic coding sequence
atgggccccgccgtgctgggccagggccaggagggccagcccgaggccagagcctgcagcggcctgctgcagccccccaagagacccatcgtgttcaaggagaagctgaccatgaagaccgacagcctgatggaggagaagctggagtgcagcctgtggtgctgcctgagcgaccccagcatccccggcagatgctgcgtgctggagagaagaatcgtgccctggatgcagcaggagagctacagcagcagcagccccatctggagcgtggacagcgacgagcccaacctgaccagcgtgctggagagactggaggacaccaaggagaacagcagcgtgagaaaggagaccaagctgttcagcctgttcctgatgaacatcatcttcagaaactag

SEQ ID NO: 24003 - DNA, 411 bp, Artificial Sequence
  Description of Artificial Sequence: Synthetic coding sequence
atgggcgacagcagaagagacgtgctgcacgagcccgccatcgccctgctgagcagcccccagacccagagcagactgcagatcgacgccttcatcgccagaagatgctggggcagccagtgggacatcaccggctacatccaccagcaggacttccccaccgccgtgttcatcggcttcagcaacgagttcaacatctgcatcccccaccccttcaccgagtggctgcagtgcgtgagaaagtacagccagagctggggcgtgagaaagggccagagacacatcagatacggcatgtgcagcgagagaacccaccacctgagcagaacctacagcagcctgctggagagagaggagaagctggccttctacggcgtgctgaccatgtgccagatctggtgcgagacctag

SEQ ID NO: 24004 - DNA, 315 bp, Artificial Sequence
  Description of Artificial Sequence: Synthetic coding sequence
gaggacatcgtgatgacccagacccccctgagcctgcccgtgacccccggcgagcccgccagcatcagctgcagaagcagccagagcctgctggacagcgacgacggcaacacctacctggactggtacctgcagaagcccggccagagcccccagctgctgatctacaccctgagctacagagccagcggcgtgcccgacagattcagcggcagcggcagcggcaccgacttcaccctgaagatcagcagagtggaggccgaggacgtgggcgtgtactactgcatgcagagaatcgagttccccagcacctag

SEQ ID NO: 24005 - DNA, 345 bp, Artificial Sequence
  Description of Artificial Sequence: Synthetic coding sequence
atgggcaccagactgctgtgctgggtggtgctgggcttcctgggcaccgaccacaccggcgccggcgtgagccagagccccagatacaaggtggccaagagaggccaggacgtggccctgagatgcgaccccatcagcggccacgtgagcctgttctggtaccagcaggccctgggccagggccccgagttcctgacctacttccagaacgaggcccagctggacaagagcggcctgcccagcgacagattcttcgccgagagacccgagggcagcgtgagcaccctgaagatccagagaacccagcaggaggacagcgccgtgtacctgtgcgccagcagctag

SEQ ID NO: 24006 - DNA, 372 bp, Artificial Sequence
  Description of Artificial Sequence: Synthetic coding sequence
atgtgcggccagtgccagagcagcagcggccacatggaggaggaggcccaccccgagctgtgcccccactggcccctgcagttcagcccccagagccactgcagacaggcctacggcagagacacccacgccggcggccccggcgccagagtggacagcggccaccacctgggcctgttccccggcctgctgagcacctgccccgacggcctgtgcgtgttccccgtgcccagccccaccttcagcaccagcctgcacgtgctgatggagtgcaaggtgcaccagcccggccccctgcccggcagaggcagcgccgacgccggcctgagaggcctgccccagggcagaaccctgtgcgtgctgaccgcctag

SEQ ID NO: 24007 - DNA, 528 bp, Artificial Sequence
  Description of Artificial Sequence: Synthetic coding sequence
atgcacggcgagaagagccacggcagaggccaggccggcagacaggtgcccctgaagcagcagagcgtgagcggcgagagccagcagggcgccagacagggcgccggccagagcacctgctacctgagcagcgccttcctgtgcaacggcagcttccccgccggcagcatgagcctgtgggacccccagcccaagcaggccttccccagcgtgctgtggtgcagctgggccggcgtgcccggcagaagaaccggccagagagaccccagagtgcaggagagaagaggcgacttcgtgagcaagctgggcgccgccgtgggcggcgagcccctggccctgttcggcccccacagctggcccggcatgggccacagagtgcccggcctgggcgccggcttcctgctgttcgccggcttcgccctggagccctgggacagctaccacgtggtgttcgagggctggaccatcgacatgagaagaaacgagcccgagagaaccagaagcctgagcgcccccggccccctgtag

SEQ ID NO: 24008 - DNA, 1671 bp, Artificial Sequence
  Description of Artificial Sequence: Synthetic coding sequence
atgcaccccatggccctgcacatggtgctgcccgcccacctgcccttcctgagccccgaggtgctgagactgctggaggtgcacgtgaagaagtggatgcacttccagagatggggcctgcccagaagagtggaggagagcctgagacagctgatgcccaacccccccctgtactaccagcccggcaacgaccagcccgtgagcttcaacctgaacaacaccagccaggtgagcctgcacagaagcgagaccatcagcctgcagacctggtgcagctgcgtggccggccagcccatccagaccttctgggtgagcgagtggagcaccatgaaccccgagcagagacaccactgccagcagacccccaaccccatggccctggccctgcccagccccgccctgaaggccctgagcggcccccacccccagagcggcggccaggacaacgacagcggcagcgacctgcagcagaagtacagccagctgttctgcggcctgcccagcctgcacagcgagagcctggtggccaccttcatgggcagccagggcctgcccaagatcgagaacgtgcccaagccccccctgaaggaccccttcctgttcaacgacctgagcttcccccagctgctgcccaagaccagcccccagagcgccccccccagcagccccctgagccccaactgggtgagccccagcgaccaccagagagcccagatcaacgtgcccttcctgaccctggccgagtacgaggccctggagtggcacctgctgcagagacagctgcagctgcagtggggctggcccgccgccctgcagagaagccagcacacccagtgcctgatgcagcacgagccctgcggcaaggcccagagccccgagaccaccaccgccagccagaccggcaagagcatcagcgtgctgaccagagagctgctgttcttccccgagcacgccagaaagctgctggagttccacatccagaagcagagcatcagacacagatggggcctgccccagaagatccagcagagcatccagctgctgctgaccagcaccgaccagcagaccgtgagcagcagcagcaccgccctggccaacgtgagcatcccccagcccgtggccctggaggccaacggcgcctgcgacgtgctgagccccatcgccgcccccgtgagcatccccagaccccacctgctgacccaggtgaaggccatcctgcagagccacatcgacagcaagtgcggccagatccaccagggcaagatccccgcctgcgtgcacagaagctgggactgcagaatcagcggcgtgctggccgtggcccccttcccctgcatccccgagagccagttcctggtgctgcagaccgccagcgaccccgacctgcaccacaaggtgatgccctggatgcccaccgccctggaccagcagcagcaggccctgcccggcaccgtgaccgagcaccccaagctgctgagagtgctgagcgtggaggccatcgagaagctggagaccaccctgagacacaagcacctggccttcctgagcggcctgcccgccctgtactacgtggccctgcccagagccctggcccccgccgtgaccagccagagcgtgatcaccgagatggagcccagccccgtggagatccccgccgagcccctgatctag

SEQ ID NO: 24009 - DNA, 624 bp, Artificial Sequence
  Description of Artificial Sequence: Synthetic coding sequence
atgggcatgagactgcagctgctgagagacagaagaatcagcagcagaggccccggcctgcacagagccaaggccgacccccagcagcagaagagactgaccaccggcctgatgacccaggccgagacccagaaggaggcccagcagagacaggccgccatgagaaagaccgccctgtggcacaccggccacctgcagcccaagacccacacccacaccggcatgcacacccagacccacagagagagagagagaaacacccagagactgagagacagagagagaagagagaacggcagacacacccacagacacacccacaccctgacccacacccacacccacagagacacccacaccgccagctacagaagaggcatcgagacccacaccaccagacagcccctgagactgagaggcagcgcccacgacgagaacgaccccagagtgagagagcagcccagaggcacccaggccgacctgagcagcagaagcagaatggccgccagactgctgggcagactgacccccaccaacaccgtgagagccggcctgagactgggcagcagagccgccagccccgaccccgcctggggcttcctgatcgtggtgggccccctgtag

SEQ ID NO: 24010 - DNA, 381 bp, Artificial Sequence
  Description of Artificial Sequence: Synthetic coding sequence
atgggcatgagactgcagctgctgagagacagaagaatcagcagcagaggccccggcctgcacagagccaaggccgacccccagcagcagaagagactgaccaccggcctgatgacccaggccgagacccagaaggaggcccagcagagacaggccgccatgagaaagaccgccctgtggcacaccggccacctgcagcccaagacccacacccacaccggcatgcacacccagacccacagagagagagagagaaacacccagagactgagagacagagagagaagagagaacggcagacacacccacacccacaccgagacccacacccagagacacaccgaggaggccctgaagcacaccccccccggcaacccctag

SEQ ID NO: 24011 - DNA, 693 bp, Artificial Sequence
  Description of Artificial Sequence: Synthetic coding sequence
atgagactggccggccccctgagaatcgtggtgctggtggtgagcgtgggcgtgacctggatcgtggtgagcatcctgctgggcggccccggcagcggcttccccagaatccagcagctgttcaccagccccgagagcagcgtgaccgccgcccccagagccagaaagtacaagtgcggcctgccccagccctgccccgaggagcacctggccttcagagtggtgagcggcgccgccaacgtgatcggccccaagatctgcctggaggacaagatgctgatgagcagcgtgaaggacaacgtgggcagaggcctgaacatcgccctggtgaacggcgtgagcggcgagctgatcgaggccagagccttcgacatgtgggccggcgacgtgaacgacctgctgaagttcatcagacccctgcacgagggcaccctggtgttcgtggccagctacgacgaccccgccaccaagatgaacgaggagaccagaaagctgttcagcgagctgggcagcagaaacgccaaggagctggccttcagagacagctgggtgttcgtgggcgccaagggcgtgcagaacaagagccccttcgagcagcacgtgaagaacagcaagcacagcaacaagtacgagggctggcccgaggccctggagatggagggctgcatccccagaagaagcaccgccagctag

SEQ ID NO: 24012 - DNA, 840 bp, Artificial Sequence
  Description of Artificial Sequence: Synthetic coding sequence
atgggcaagggcaacgaggacagcgacctgcactgcagcagcatccagtgcagcaccgaccagccccccttccagcagatcagcttcaccgagaagggcagcgacgagaagaagcccttcaaggagaagggcaagaccgccttcagccacagcagcgagaagcacatccagagacaggccggcagcgagcccaaccccaacaaggagaacagcgaggagaccaagctgaaggccggcaacagcaccgccggcagcgagcccgagagcagcagctacagagagaactgcagaaagagaaagatgagcagcaaggacagctgccaggacaccgccggcaactgccccgagaaggagtgcagcctgagcctgaacaagaagagcagaagcagcaccgccgtgcacaacagcgagatccaggagacctgcgacgcccaccacagaggccacagcagagcctgcaccggccacagcaagagacacagaagcagagccctgggcgtgcagacccccagcatcagaaagagcctggtgaccagcgtgagagccatgagcgaggccgtgtaccaggacctggcccaggtgtgggcccagcagatccacagccccctgacctgcgagcagctgaccctgctgaccagactgagaggccccctgtgcgcccaggtgcagaccctgtacagcatggccacccaggccgcctacgtgttccccgccgagagctggctggtgcccgccaccctgcccggccccggcgagagcgccctggacagagaggcccaccccttccccggccaggagatcaccgagaccgtgagcggcagcgacgaggccaagctgtag

SEQ ID NO: 24013 - DNA, 849 bp, Artificial Sequence; identical to SEQ ID NO: 21442
  Description of Artificial Sequence: Synthetic coding sequence

SEQ ID NO: 24014 - DNA, 903 bp, Artificial Sequence
  Description of Artificial Sequence: Synthetic coding sequence
atggccgccaccgaggacgagagactggccggcagcggcgagggcgagagactggacttcctgagagacagacacgtgagattcttccagagatgcctgcaggtgctgcccgagagatacagcagcctggagaccagcagactgaccatcgccttcttcgccctgagcggcctggacatgctggacagcctggacgtggtgaacaaggacgacatcatcgagtggatctacagcctgcaggtgctgcccaccgaggacagaagcaacctgaacagatgcggcttcagaggcagcagctacctgggcatccccttcaaccccagcaaggcccccggcaccgcccacccctacgacagcggccacatcgccatgacctacaccggcctgagctgcctggtgatcctgggcgacgacctgagcagagtgaacaaggaggcctgcctggccggcctgagagccctgcagctggaggacggcagcttctgcgccgtgcccgagggcagcgagaacgacatgagattcgtgtactgcgccagctgcatctgctacatgctgaacaactggagcggcatggacatgaagaaggccatcacctacatcagaagaagcatgctgctgaagatcttccagtacaccaacttcgagaagaacagaaactacatcctgagcacccaggacagactggtgggcggcttcgccaagtggcccgacagccaccccgacgccctgcacgcctacttcggcatctgcggcctgagcctgatggaggagagcggcatctgcaaggtgcaccccgccctgaacgtgagcaccagaaccagcgagagactgctggacctgcaccagagctggaagaccaaggacagcaagcagtgcagcgagaacgtgcacatcagcacctag

SEQ ID NO: 24015 - DNA, 1134 bp, Artificial Sequence
  Description of Artificial Sequence: Synthetic coding sequence
atggccgccaccgaggacgagagactggccggcagcggcgagggcgagagactggacttcctgagagacagacacgtgagattcttccagagatgcctgcaggtgctgcccgagagatacagcagcctggagaccagcagactgaccatcgccttcttcgccctgagcggcctggacatgctggacagcctggacgtggtgaacaaggacgacatcatcgagtggatctacagcctgcaggtgctgcccaccgaggacagaagcaacctgaacagatgcggcttcagaggcagcagctacctgggcatccccttcaaccccagcaaggcccccggcaccgcccacccctacgacagcggccacatcgccatgacctacaccggcctgagctgcctggtgatcctgggcgacgacctgagcagagtgaacaaggaggcctgcctggccggcctgagagccctgcagctggaggacggcagcttctgcgccgtgcccgagggcagcgagaacgacatgagattcgtgtactgcgccagctgcatctgctacatgctgaacaactggagcggcatggacatgaagaaggccatcacctacatcagaagaagcatgagctacgacaacggcctggcccagggcgccggcctggagagccacggcggcagcaccttctgcggcatcgccagcctgtgcctgatgggcaagctggaggaggtgttcagcgagaaggagctgaacagaatcaagagatggtgcatcatgagacagcagaacggctaccacggcagacccaacaagcccgtggacacctgctacagcttctgggtgggcgccaccctgaagctgctgaagatcttccagtacaccaacttcgagaagaacagaaactacatcctgagcacccaggacagactggtgggcggcttcgccaagtggcccgacagccaccccgacgccctgcacgcctacttcggcatctgcggcctgagcctgatggaggagagcggcatctgcaaggtgcaccccgccctgaacgtgagcaccagaaccagcgagagactgctggacctgcaccagagctggaagaccaaggacagcaagcagtgcagcgagaacgtgcacatcagcacctag

SEQ ID NO: 24016 - DNA, 1011 bp, Artificial Sequence
  Description of Artificial Sequence: Synthetic coding sequence
atgtgggtgagaaccaccctgaccatcgagagatggaccaaggagaagaccgagcccaaggccagaagctgggacgagagcagatgcagaggcgactgcaaggagcccgacaagtgctgctggagacacaagcagtgcaccggccacatcatctaccccttcgccagcgactgcgtgagacacagcctgcacctgcacagcgtgaaccactgcaactgcaacagcagactgaaggacagcagcgaggacagcagcagcagcagaggcgccggccccacctgcagccacgtgatcgagagcccctgcttcgagctgacccccgaggaggagcacgtggagagattcagatacggctggtgcaagagctacagacccgtgagcgtggccgtgatccaccaccccctgtaccacgagtgcggcgccgacgacctgaacgaggaggaggaggaggaggaggaggagagcaagccccccatccccacccaggtgggccccgccaccgccagccccgacctgggcaccagcatggccaccggcacccccgacagcaccgcccccatcaccatctggagaagcgagagccccaccggcaagggccagggcagcaaggtgatcaagaaggtgaagaagaagaaggagaaggagaaggacaaggaggagatggacgagaaggccaagctgaagaagaaggccaagaagggccagctgaccaagaagaagagccccgtgaagctggagcccagcccccccgacgtgagcagaagcctgagcgccagacagctggccagaatgagcgagagcagccccgagagcagagaggagctggagagcgaggacagctacaacggcagaggccagggcgagctgagcagcgaggacatcgtggagagcagcagccccagaaagagagagaacaccgtgcaggccaagaagaccggcgccaagcccagccaggccagaaaggtgaacaagagaaagagcccccccggcagcaaccccaacctgagctag

SEQ ID NO: 24017 - DNA, 1095 bp, Artificial Sequence
  Description of Artificial Sequence: Synthetic coding sequence
atgtgggtgagaaccaccctgaccatcgagagatggaccaaggagaagaccgagcccaaggccagaagctgggacgaggccctgagcgacgtgaacagactgcccagctgggagagaggccacctgctggccggcgtggccagcagcaccgacgtgagcaccttcagcgaggccggcgactgcaaggagcccgacaagtgctgctggagacacaagcagtgcaccggccacatcatctaccccttcgccagcgactgcgtgagacacagcctgcacctgcacagcgtgaaccactgcaactgcaacagcagactgaaggacagcagcgaggacagcagcagcagcagaggcgccggccccacctgcagccacgtgatcgagagcccctgcttcgagctgacccccgaggaggagcacgtggagagattcagatacggctggtgcaagagctacagacccgtgagcgtggccgtgatccaccaccccctgtaccacgagtgcggcgccgacgacctgaacgaggaggaggaggaggaggaggaggagagcaagccccccatccccacccaggtgggccccgccaccgccagccccgacctgggcaccagcatggccaccggcacccccgacagcaccgcccccatcaccatctggagaagcgagagccccaccggcaagggccagggcagcaaggtgatcaagaaggtgaagaagaagaaggagaaggagaaggacaaggaggagatggacgagaaggccaagctgaagaagaaggccaagaagggccagctgaccaagaagaagagccccgtgaagctggagcccagcccccccgacgtgagcagaagcctgagcgccagacagctggccagaatgagcgagagcagccccgagagcagagaggagctggagagcgaggacagctacaacggcagaggccagggcgagctgagcagcgaggacatcgtggagagcagcagccccagaaagagagagaacaccgtgcaggccaagaagaccggcgccaagcccagccaggccagaaaggtgaacaagagaaagagcccccccggcagcaaccccaacctgagctag

SEQ ID NO: 24018 - DNA, 462 bp, Artificial Sequence
  Description of Artificial Sequence: Synthetic coding sequence
atgagcatcacctacgtgaacagactgcccagctgggagagaggccacctgctggccggcgtggccagcagcaccgacgtgagcaccttcagcgagggcgactgcaaggagcccgacaagtgctgctggagacacaagcagtgcaccggccacatcatctaccccttcgccagcgactgcgtgagacacagcctgcacctgcacagcgtgaaccactgcaactgcaacagcagactgaaggacagcagcgaggacagcagcagcagcagaggcgccggccccacctgcagccacgtgatcgagagcccctgcttcgagctgacccccgaggaggagcacgtggagagattcagatacggctggtgcaagagctacagacccgtgagcgtggccgtgatccaccaccccctgtaccacgagtgcggcgccgacgacctgaacgaggaggaggaggaggagtag

SEQ ID NO: 24019 - DNA, 1017 bp, Artificial Sequence
  Description of Artificial Sequence: Synthetic coding sequence
atgagcatcacctacgtgaacagactgcccagctgggagagaggccacctgctggccggcgtggccagcagcaccgacgtgagcaccttcagcgagggcgactgcaaggagcccgacaagtgctgctggagacacaagcagtgcaccggccacatcatctaccccttcgccagcgactgcgtgagacacagcctgcacctgcacagcgtgaaccactgcaactgcaacagcagactgaaggacagcagcgaggacagcagcagcagcagaggcgccggccccacctgcagccacgtgatcgagagcccctgcttcgagctgacccccgaggaggagcacgtggagagattcagatacggctggtgcaagagctacagacccgtgagcgtggccgtgatccaccaccccctgtaccacgagtgcggcgccgacgacctgaacgaggaggaggaggaggaggaggaggagagcaagccccccatccccacccaggtgggccccgccaccgccagccccgacctgggcaccagcatggccaccggcacccccgacagcaccgcccccatcaccatctggagaagcgagagccccaccggcaagggccagggcagcaaggtgatcaagaaggtgaagaagaagaaggagaaggagaaggacaaggaggagatggacgagaaggccaagctgaagaagaaggccaagaagggccagctgaccaagaagaagagccccgtgaagctggagcccagcccccccgacgtgagcagaagcctgagcgccagacagctggccagaatgagcgagagcagccccgagagcagagaggagctggagagcgaggacagctacaacggcagaggccagggcgagctgagcagcgaggacatcgtggagagcagcagccccagaaagagagagaacaccgtgcaggccaagaagaccggcgccaagcccagccaggccagaaaggtgaacaagagaaagagcccccccggcagcaaccccaacctgagctag

SEQ ID NO: 24020 - DNA, 303 bp, Artificial Sequence
  Description of Artificial Sequence: Synthetic coding sequence
atgggcatcagcgaggagggcaacctgctgagcaccgtgagccccaccgtgaaggccctgttcggcaagaccagagtgagccccatcttccccttcagccccagaagccccttccagcccctgatccccagaacccccggcagcccctggggccccgtgggccccgccagccccctgggccccggcttccccatcggccccatgggccccggcaagcccgtgggccccaagggccccatgctgcccctgggccccagcggccccgtgggccccaccagccccctgttccccttctgcccctag

SEQ ID NO: 24021 - DNA, 315 bp, Artificial Sequence
  Description of Artificial Sequence: Synthetic coding sequence
atgatgagcaccgagcagatgcagcccctggagctgagcgaggacagactggacaagctggaccccagatgcagccacctgggcgtgttcagcgagcacctgatcaagagatacgacgtgcaggagagacaccccaagggcaagatgatccccgtgctgcacaacaccgacctggagcagaagaagcccagaagaaaggacacccccgccctgcacatgagccccttcgccgccggcgtgaccctgctgagagacgagagacccaaggccatcgtggaggacgacgagaaggacggcgacaagatcgccatctag

SEQ ID NO: 24022 - DNA, 2400 bp, Artificial Sequence
  Description of Artificial Sequence: Synthetic coding sequence
atggccagaaccgcccccgtggagccccccctgagacacagcgccccccccagccccgccgccggcgagcccagaaccagcgtggaggccgccgtggcccccagaagagtgctgttcgccgacgaggccctgggcctgcccctggcccagctgagaagatacagaccctggggcggccccggcgccggcaagatggccgccgccgccggccaggacggcggcggcggcggcggcgccgacgaggacgacgacggcgaggacggcgacgagggcgaggaggaggaggaggcctgccccgagcccagccccctgtgccccgtgcccgccggcggcggcttctacctggtgcccaccttcagcctgccccccgcccccggcagactggagagactgggcagagtgatggtggagctggaggccctgctgcccccccccggcgccgtgcccggcggcgccggcgtgtgggtgcccggcggcagaccccccgtgctgagaggcctggtgagagtgctgaacagaagcttcgagaaggccgtgcacgtgagagccagccacgacggctgggccagcttctgcgaccaccccgccagatacgtgcccagaagccccccctgggccggcgccggcggcaccggcgccggcgaccccatcctggaccccggcctgggcctgggccccggccaggccagcgccagcagccccgacgacggcggcagaaccgacagattcgccttccagctgcccttcgccgagggcgccggcgacggcgccagactggacttcgtggtgagatacgagacccccgagggcaccttctgggccaacaaccacggcagaaactacaccgtgctgctgagaatcgcccccgcccccacccccaccgacgccgagggcctgccccagcagcagcagctgccccagctggagccccagcccgagtgccagggccccgtggaggccgaggccagacagctgaagagctgcatgaagcccgtgagaagaagacccgccgaggaggagctgaagaccaagaacatggacgacaacaccttcgccatggccgagcaccccgacgtgcaggagagcgtgggccccctggtggcccccacccccctgagaccctggccccagatgaccctgcaggtgagcgacgtgcccatgaccggcaaccccgccgaggagggcgacgtgcccagaagcagcccccccgtggccttcaccgaggtgctgcaggcccccgccatcagaatcccccccagcagccccctgtgcggcctgggcggcagccccagagaccaggccagcggccccgacgccagcgagggcgccaccggccccttcctggagcccagccagcagcaggccgaggccacctggggcgtgagcagcgagaacggcggcggcctggaggccgtgagcggcagcgaggagctgctgggcgaggacaccatcgaccaggagctggagcagctgtacctgagccacctgagcagactgagagccgccgtggccgccggcggcgccggcggcggcggcgagggcagcaccgacggcggcatgagccccagccaccccctgggcatcctgaccgacagagacctgatcctgaagtggcccggccccgagagagccctgaacagcgccctggccgaggagatcaccctgcactacgccagactgggcagaggcgtggagctgatcaaggacaccgaggaccccgacgacgagggcgagggcgaggagggcctgagcgtgacccccagcagccccgagggcgacagccccaaggagagcccccccgagatcctgagcggcgccagaagcgtggtggccaccatgggcgacgtgtggctgccctgggccgagggcagcggctgcgacggccccgtggtgctgggcaccgagggccagttcatcggcgaccccgagaagggcatgggcaaggacaccagcagcctgcacatgaacagagtgatcgccggcgtgaccgagagcctgggcgaggccggcaccgaggcccagatcgaggtgaccagcgagtgggccggcagcctggaccccatcagcggcaaggagcccgccagccccgtgctgctgcagggccagaaccccaccctgctgagccccctgggcgccgaggtgtgcctgagcagcgtggccagaccccacgtgagcagccaggacgagaaggacgccggccccagcctggagccccccaagaagagccccaccctggccgtgcccgccgagtgcgtgtgcgccctgcccccccagctgagaggccccctgacccagaccctgggcgtgctggccggcctggtggtggtgcccgtggccctgaacagcggcgtgagcctgctggtgctggccctgtgcctgagcctggcctggttcagctag

SEQ ID NO: 24023 - DNA, 468 bp, Artificial Sequence
  Description of Artificial Sequence: Synthetic coding sequence
atgatgagcaccgagcagatgcagcccctggagctgagcgaggacagactggacaagctggaccccagatgcagccacctggacgacctgagcgaccagttcatcaaggactgcgacctgaagaagaagcccagaaagggcaagaacgtgcaggccaccctgaacgtggagagcgaccagaagaagcccagaagaaaggacacccccgccctgcacatcccccccttcatccccggcgtgttcagcgagcacctgatcaagagatacgacgtgcaggagagacaccccaagggcaagatgatccccgtgctgcacaacaccgacctggagcagaagaagcccagaagaaaggacacccccgccctgcacatgagccccttcgccgccggcgtgaccctgctgagagacgagagacccaaggccatcgtggaggacgacgagaaggacggcgacaagatcgccatctag

SEQ ID NO: 24024 - DNA, 1842 bp, Artificial Sequence
  Description of Artificial Sequence: Synthetic coding sequence
atggccaccatccccgactggaagctgcagctgctggccagaagaagacaggaggaggccagcgtgagaggcagagagaaggccgagagagagagactgagccagatgcccgcctggaagagaggcctgctggagagaagaagagccaagctgggcctgagccccggcgagcccagccccgtgctgggcaccgtggaggccggcccccccgaccccgacgagagcgccgtgctgctggaggccatcggccccgtgcaccagaacagattcatcagacaggagagacagcagcagcagcagcagcagcagagaagcgaggagctgctggccgagagaaagcccggccccctggaggccagagagagaagacccagccccggcgagatgagagaccagagccccaagggcagagagagcagagaggagagactgagccccagagagaccagagagagaagactgggcatcggcggcgcccaggagctgagcctgagacccctggaggccagagactggagacagagccccggcgaggtgggcgacagaagcagcagactgagcgaggcctggaagtggagactgagccccggcgagacccccgagagaagcctgagactggccgagagcagagagcagagccccagaagaaaggaggtggagagcggcctgagccccggcgagagcgcctaccagaagctgggcctgaccgaggcccacaagtggagacccgacagcagagagagccaggagcagagcctggtgcagctggaggccaccgagtggagactgagaagcggcgaggagagacaggactacagcgaggagtgcggcagaaaggaggagtggcccgtgcccggcgtggcccccaaggagaccgccgagctgagcgagaccctgaccagagaggcccagggcaacagcagcgccggcgtggaggccgccgagcagagacccgtggaggacggcgagagaggcatgaagcccaccgagggctggaagtggaccctgaacagcggcaaggccagagagtggacccccagagacatcgaggcccagacccagaagcccgagccccccgagagcgccgagaagctgctggagagccccggcgtggaggccggcgagggcgaggccgagaaggaggaggccggcgcccagggcagacccctgagagccctgcagaactgctgcagcgtgcccagccccctgccccccgaggacgccggcaccggcggcctgagacagcaggaggaggaggccgtggagctgcagccccccccccccgcccccctgagcccccccccccccgcccccaccgccccccagccccccggcgaccccctgatgagcagactgttctacggcgtgaaggccggccccggcgtgggcgcccccagaagaagcggccacaccttcaccgtgaaccccagaagaagcgtgccccccgccacccccgccacccccaccagccccgccaccgtggacgccgccgtgcccggcgccggcaagaagagataccccaccgccgaggagatcctggtgctgggcggctacctgagactgagcagaagctgcctggccaagggcagccccgagagacaccacaagcagctgaagatcagcttcagcgagaccgccctggagaccacctaccagtaccccagcgagagcagcgtgctggaggagctgggccccgagcccgaggtgcccagcgcccccaacccccccgccgcccagcccgacgacgaggaggacgaggaggagctgctgctgctgcagcccgagctgcagggcggcctgagaaccaaggccctgatcgtggacgagagctgcagaagatag

SEQ ID NO: 24025 - DNA, 1842 bp, Artificial Sequence; identical to SEQ ID NO: 24024
  Description of Artificial Sequence: Synthetic coding sequence

SEQ ID NO: 24026 - DNA, 1842 bp, Artificial Sequence
  Description of Artificial Sequence: Synthetic coding sequence
atggccaccatccccgactggaagctgcagctgctggccagaagaagacaggaggaggccagcgtgagaggcagagagaaggccgagagagagagactgagccagatgcccgcctggaagagaggcctgctggagagaagaagagccaagctgggcctgagccccggcgagcccagccccgtgctgggcaccgtggaggccggcccccccgaccccgacgagagcgccgtgctgctggaggccatcggccccgtgcaccagaacagattcatcagacaggagagacagcagcagcagcagcagcagcagagaagcgaggagctgctggccgagagaaagcccggccccctggaggccagagagagaagacccagccccggcgagatgagagaccagagccccaagggcagagagagcagagaggagagactgagccccagagagaccagagagagaagactgggcatcggcggcgcccaggagctgagcctgagacccctggaggccagagactggagacagagccccggcgaggtgggcgacagaagcagcagactgagcgaggcctggaagtggagactgagccccggcgagacccccgagagaagcctgagactggccgagagcagagagcagagccccagaagaaaggaggtggagagcagactgagccccggcgagagcgcctaccagaagctgggcctgaccgaggcccacaagtggagacccgacagcagagagagccaggagcagagcctggtgcagctggaggccaccgagtggagactgagaagcggcgaggagagacaggactacagcgaggagtgcggcagaaaggaggagtggcccgtgcccggcgtggcccccaaggagaccgccgagctgagcgagaccctgaccagagaggcccagggcaacagcagcgccggcgtggaggccgccgagcagagacccgtggaggacggcgagagaggcatgaagcccaccgagggctggaagtggaccctgaacagcagaaaggccagagagtggacccccagagacatcgaggcccagacccagaagcccgagccccccgagagcgccgagaagctgctggagagccccggcgtggaggccggcgagggcgaggccgagaaggaggaggccggcgcccagggcagacccctgagagccctgcagaactgctgcagcgtgcccagccccctgccccccgaggacgccggcaccggcggcctgagacagcaggaggaggaggccgtggagctgcagccccccccccccgcccccctgagcccccccccccccgcccccaccgccccccagccccccggcgaccccctgatgagcagactgttctacggcgtgaaggccggccccggcgtgggcgcccccagaagaagcggccacaccttcaccgtgaaccccagaagaagcgtgccccccgccacccccgccacccccaccagccccgccaccgtggacgccgccgtgcccggcgccggcaagaagagataccccaccgccgaggagatcctggtgctgggcggctacctgagactgagcagaagctgcctggccaagggcagccccgagagacaccacaagcagctgaagatcagcttcagcgagaccgccctggagaccacctaccagtaccccagcgagagcagcgtgctggaggagctgggccccgagcccgaggtgcccagcgcccccaacccccccgccgcccagcccgacgacgaggaggacgaggaggagctgctgctgctgcagcccgagctgcagggcggcctgagaaccaaggccctgatcgtggacgagagctgcagaagatag

SEQ ID NO: 24027 - DNA, 231 bp, Artificial Sequence
  Description of Artificial Sequence: Synthetic coding sequence
ctgaagatcagcttcagcgagaccgccctggagaccacctaccagtaccccagcgagagcagcgtgctggaggagctgggccccgagcccgaggtgcccagcgcccccaacccccccgccgcccagcccgacgacgaggaggacgaggaggagctgctgctgctgcagcccgagctgcagggcggcctgagaaccaaggccctgatcgtggacgagagctgcagaagatag

SEQ ID NO: 24028 - DNA, 1842 bp, Artificial Sequence; identical to SEQ ID NO: 24026
  Description of Artificial Sequence: Synthetic coding sequence

SEQ ID NO: 24029 - DNA, 231 bp, Artificial Sequence; identical to SEQ ID NO: 24027
  Description of Artificial Sequence: Synthetic coding sequence

SEQ ID NO: 24030 - DNA, 1134 bp, Artificial Sequence
  Description of Artificial Sequence: Synthetic coding sequence
atggccaccatccccgactggaagctgcagctgctggccagaagaagacaggaggaggccagcgtgagaggcagagagaaggccgagagagagagactgagccagatgcccgcctggaagagaggcctgctggagagaagaagagccaagctgggcctgagccccggcgagcccagccccgtgctgggcaccgtggaggccggcccccccgaccccgacgagagcgccgtgctgctggaggccatcggccccgtgcaccagaacagattcatcagacaggagagacagcagcagcagcagcagcagcagagaagcgaggagctgctggccgagagaaagcccggccccctggaggccagagagagaagacccagccccggcgagatgagagaccagagccccaagggcagagagagcagagaggagagactgagccccagagagaccagagagagaagactgggcatcggcggcgcccaggagctgagcctgagacccctggaggccagagactggagacagagccccggcgaggtgggcgacagaagcagcagactgagcgaggcctggaagtggagactgagccccggcgagacccccgagagaagcctgagactggccgagagcagagagcagagccccagaagaaaggaggtggagagcagactgagccccggcgagagcgcctaccagaagctgggcctgaccgaggcccacaagtggagacccgacagcagagagagccaggagcagagcctggtgcagctggaggccaccgagtggagactgagaagcggcgaggagagacaggactacagcgaggagtgcggcagaaaggaggagtggcccgtgcccggcgtggcccccaaggagaccgccgagctgagcgagaccctgaccagagaggcccagggcaacagcagcgccggcgtggaggccgccgagcagagacccgtggaggacggcgagagaggcatgaagcccaccgagggctggaagtggaccctgatcatgagcctggccggcaagggcaaccagcacctggtgacctgcttcccccaccccgtgagcggcggcagagccaactgccccatcagcaccctgatccagagcccctggtgcggctggggctag

SEQ ID NO: 24031 - DNA, 1134 bp, Artificial Sequence
  Description of Artificial Sequence: Synthetic coding sequence
atggccaccatccccgactggaagctgcagctgctggccagaagaagacaggaggaggccagcgtgagaggcagagagaaggccgagagagagagactgagccagatgcccgcctggaagagaggcctgctggagagaagaagagccaagctgggcctgagccccggcgagcccagccccgtgctgggcaccgtggaggccggcccccccgaccccgacgagagcgccgtgctgctggaggccatcggccccgtgcaccagaacagattcatcagacaggagagacagcagcagcagcagcagcagcagagaagcgaggagctgctggccgagagaaagcccggccccctggaggccagagagagaagacccagccccggcgagatgagagaccagagccccaagggcagagagagcagagaggagagactgagccccagagagaccagagagagaagactgggcatcggcggcgcccaggagctgagcctgagacccctggaggccagagactggagacagagccccggcgaggtgggcgacagaagcagcagactgagcgaggcctggaagtggagactgagccccggcgagacccccgagagaagcctgagactggccgagagcagagagcagagccccagaagaaaggaggtggagagcggcctgagccccggcgagagcgcctaccagaagctgggcctgaccgaggcccacaagtggagacccgacagcagagagagccaggagcagagcctggtgcagctggaggccaccgagtggagactgagaagcggcgaggagagacaggactacagcgaggagtgcggcagaaaggaggagtggcccgtgcccggcgtggcccccaaggagaccgccgagctgagcgagaccctgaccagagaggcccagggcaacagcagcgccggcgtggaggccgccgagcagagacccgtggaggacggcgagagaggcatgaagcccaccgagggctggaagtggaccctgatcatgagcctggccggcaagggcaaccagcacctggtgacctgcttcccccaccccgtgagcggcggcagagccaactgccccatcagcaccctgatccagagcccctggtgcggctggggctag

SEQ ID NO: 24032 - DNA, 2310 bp, Artificial Sequence
  Description of Artificial Sequence: Synthetic coding sequence
atggccagcgccgagctgcagggcaagtaccagaagctggcccaggagtacagcaagctgagagcccagaaccaggtgctgaagaagggcgtggtggacgagcaggccaacagcgccgccctgaaggagcagctgaagatgaaggaccagagcctgagaaagctgcagcaggagatggacagcctgaccttcagaaacctgcagctggccaagagagtggagctgctgcaggacgagctggccctgagcgagcccagaggcaagaagaacaagaagagcggcgagagcagcagccagctgagccaggagcagaagagcgtgttcgacgaggacctgcagaagaagatcgaggagaacgagagactgcacatccagttcttcgaggccgacgagcagcacaagcacgtggaggccgagctgagaagcagactggccaccctggagaccgaggccgcccagcaccaggccgtggtggacggcctgaccagaaagtacatggagaccatcgagaagctgcagaacgacaaggccaagctggaggtgaagagccagaccctggagaaggaggccaaggagtgcagactgagaaccgaggagtgccagctgcagctgaagaccctgcacgaggacctgagcggcagactggaggagagcctgagcatcatcaacgagaaggtgcccttcaacgacaccaagtacagccagtacaacgccctgaacgtgcccctgcacaacagaagacaccagctgaagatgagagacatcgccggccaggccctggccttcgtgcaggacctggtgaccgccctgctgaacttccacacctacaccgagcagagaatccagatcttccccgtggacagcgccatcgacaccatcagccccctgaaccagaagttcagccagtacctgcacgagaacgccagctacgtgagacccctggaggagggcatgctgcacctgttcgagagcatcaccgaggacaccgtgaccgtgctggagaccaccgtgaagctgaagaccttcagcgagcacctgaccagctacatctgcttcctgagaaagatcctgccctaccagctgaagagcctggaggaggagtgcgagagcagcctgtgcaccagcgccctgagagccagaaacctggagctgagccaggacatgaagaagatgaccgccgtgttcgagaagctgcagacctacatcgccctgctggccctgcccagcaccgagcccgacggcctgctgagaaccaactacagcagcgtgctgaccaacgtgggcgccgccctgcacggcttccacgacgtgatgaaggacatcagcaagcactacagccagaaggccgccatcgagcacgagctgcccaccgccacccagaagctgatcaccaccaacgactgcatcctgagcagcgtggtggccctgaccaacggcgccggcaagatcgccagcttcttcagcaacaacctggactacttcatcgccagcctgagctacggccccaaggccgccagcggcttcatcagccccctgagcgccgagtgcatgctgcagtacaagaagaaggccgccgcctacatgaagagcctgagaaagcccctgctggagagcgtgccctacgaggaggccctggccaacagaagaatcctgctgagcagcaccgagagcagagagggcctggcccagcaggtgcagcagagcctggagaagatcagcaagctggagcaggagaaggagcactggatgctggaggcccagctggccaagatcaagctggagaaggagaaccagagaatcgccgacaagctgaagaacaccggcagcgcccagctggtgggcctggcccaggagaacgccgccgtgagcaacaccgccggccaggacgaggccaccgccaaggccgtgctggagcccatccagagcaccagcctggtgcccgacgtggagagcagagaggacctgatcaagaaccactacatggccagaatcgtggagctgaccagccagctgcagctggccgacagcaagagcgtgcacttctacgccgagtgcagagccctgagcaagagactggccctggccgagaagagcaaggaggccctgaccgaggagatgaagctggccagccagaacatcagcagactgcaggacgagctgaccaccaccaagagaagctacgaggaccagctgagcatgatgagcgaccacctgtgcagcatgaacgagaccctgagcaagcagagagaggagatcgacaccctgaagatgagcagcaagggcaacagcaagaagaacaagagcagatag

SEQ ID NO: 24033 - DNA, 2343 bp, Artificial Sequence
  Description of Artificial Sequence: Synthetic coding sequence
atggccagcgccgagctgcagggcaagtaccagaagctggcccaggagtacagcaagctgagagcccagaaccaggtgctgaagaagggcgtggtggacgagcaggccaacagcgccgccctgaaggagcagctgaagatgaaggaccagagcctgagaaagctgcagcaggagatggacagcctgaccttcagaaacctgcagctggccaagagagtggagctgctgcaggacgagctggccctgagcgagcccagaggcaagaagaacaagaagagcggcgagagcagcagccagctgagccaggagcagaagagcgtgttcgacgaggacctgcagaagaagatcgaggagaacgagagactgcacatccagttcttcgaggccgacgagcagcacaagcacgtggaggccgagctgagaagcagactggccaccctggagaccgaggccgcccagcaccaggccgtggtggacggcctgaccagaaagtacatggagaccatcgagaagctgcagaacgacaaggccaagctggaggtgaagagccagaccctggagaaggaggccaaggagtgcagactgagaaccgaggagtgccagctgcagctgaagaccctgcacgaggacctgagcggcagactggaggagagcctgagcatcatcaacgagaaggtgcccttcaacgacaccaagtacagccagtacaacgccctgaacgtgcccctgcacaacagaagacaccagctgaagatgagagacatcgccggccaggccctggccttcgtgcaggacctggtgaccgccctgctgaacttccacacctacaccgagcagagaatccagatcttccccgtggacagcgccatcgacaccatcagccccctgaaccagaagttcagccagtacctgcacgagaacgccagctacgtgagacccctggaggagggcatgctgcacctgttcgagagcatcaccgaggacaccgtgaccgtgctggagaccaccgtgaagctgaagaccttcagcgagcacctgaccagctacatctgcttcctgagaaagatcctgccctaccagctgaagagcctggaggaggagtgcgagagcagcctgtgcaccagcgccctgagagccagaaacctggagctgagccaggacatgaagaagatgaccgccgtgttcgagaagctgcagacctacatcgccctgctggccctgcccagcaccgagcccgacggcctgctgagaaccaactacagcagcgtgctgaccaacgtgggcgccgccctgcacggcttccacgacgtgatgaaggacatcagcaagcactacagccagaaggccgccatcgagcacgagctgcccaccgccacccagaagctgatcaccaccaacgactgcatcctgagcagcgtggtggccctgaccaacggcgccggcaagatcgccagcttcttcagcaacaacctggactacttcatcgccagcctgagctacggccccaaggccgccagcggcttcatcagccccctgagcgccgagtgcatgctgcagtacaagaagaaggccgccgcctacatgaagagcctgagaaagcccctgctggagagcgtgccctacgaggaggccctggccaacagaagaatcctgctgagcagcaccgagagcagagagggcctggcccagcaggtgcagcagagcctggagaagatcagcaagctggagcaggagaaggagcactggatgctggaggcccagctggccaagatcaagctggagaaggagaaccagagaatcgccgacaagctgaagaacaccggcagcgcccagctggtgggcctggcccaggagaacgccgccgtgagcaacaccgccggccaggacgaggccaccgccaaggccgtgctggagcccatccagagcaccagcctgatcggcaccctgaccagaaccagcgacagcgaggtgcccgacgtggagagcagagaggacctgatcaagaaccactacatggccagaatcgtggagctgaccagccagctgcagctggccgacagcaagagcgtgcacttctacgccgagtgcagagccctgagcaagagactggccctggccgagaagagcaaggaggccctgaccgaggagatgaagctggccagccagaacatcagcagactgcaggacgagctgaccaccaccaagagaagctacgaggaccagctgagcatgatgagcgaccacctgtgcagcatgaacgagaccctgagcaagcagagagaggagatcgacaccctgaagatgagcagcaagggcaacagcaagaagaacaagagcagatag

SEQ ID NO: 24034 - DNA, 2217 bp, Artificial Sequence
  Description of Artificial Sequence: Synthetic coding sequence
atggccagcgccgagctgcagggcaagtaccagaagctggcccaggagtacagcaagctgagagcccagaaccaggtgctgaagaagggcgtggtggacgagcaggccaacagcgccgccctgaaggagcagctgaagatgaaggaccagagcctgagaaagctgcagcaggagatggacagcctgaccttcagaaacctgcagctggccaagagagtggagctgctgcaggacgagctggccctgagcgagcccagaggcaagaagaacaagaagagcggcgagagcagcagccagctgagccaggagcagaagagcgtgttcgacgaggacctgcagaagaagatcgaggagaacgagagactgcacatccagttcttcgaggccgacgagcagcacaagcacgtggaggccgagctgagaagcagactggccaccctggagaccgaggccgcccagcaccaggccgtggtggacggcctgaccagaaagtacatggagaccatcgagaagctgcagaacgacaaggccaagctggaggtgaagagccagaccctggagaaggaggccaaggagtgcagactgagaaccgaggagtgccagctgcagctgaagaccctgcacgaggacctgagcggcagactggaggagagcctgagcatcatcaacgagaaggtgcccttcaacgacaccaagtacagccagtacaacgccctgaacgtgcccctgcacaacagaagacaccagctgaagatgagagacatcgccggccaggccctggccttcgtgcaggacctggtgaccgccctgctgaacttccacacctacaccgagcagagaatccagatcttccccgtggacagcgccatcgacaccatcagccccctgaaccagaagttcagccagtacctgcacgagaacgccagctacgtgagacccctggaggagggcatgctgcacctgttcgagagcatcaccgaggacaccgtgaccgtgctggagaccaccgtgaagctgaagaccttcagcgagcacctgaccagctacatctgcttcctgagaaagatcctgccctaccagctgaagagcctggaggaggagtgcgagagcagcctgtgcaccagcgccctgagagccagaaacctggagctgagccaggacatgaagaagatgaccgccgtgttcgagaagctgcagacctacatcgccctgctggccctgcccagcaccgagcccgacggcctgctgagaaccaactacagcagcgtgctgaccaacgtgggcgccgccctgcacggcttccacgacgtgatgaaggacatcagcaagcactacagccagaaggccgccatcgagcacgagctgcccaccgccacccagaagctgatcaccaccaacgactgcatcctgagcagcgtggtggccctgaccaacggcgccggcaagatcgccagcttcttcagcaacaacctggactacttcatcgccagcctgagctacggccccaaggccgccagcggcttcatcagccccctgagcgccgagtgcatgctgcagtacaagaagaaggccgccgcctacatgaagagcctgagaaaggtgcagcagagcctggagaagatcagcaagctggagcaggagaaggagcactggatgctggaggcccagctggccaagatcaagctggagaaggagaaccagagaatcgccgacaagctgaagaacaccggcagcgcccagctggtgggcctggcccaggagaacgccgccgtgagcaacaccgccggccaggacgaggccaccgccaaggccgtgctggagcccatccagagcaccagcctggtgcccgacgtggagagcagagaggacctgatcaagaaccactacatggccagaatcgtggagctgaccagccagctgcagctggccgacagcaagagcgtgcacttctacgccgagtgcagagccctgagcaagagactggccctggccgagaagagcaaggaggccctgaccgaggagatgaagctggccagccagaacatcagcagactgcaggacgagctgaccaccaccaagagaagctacgaggaccagctgagcatgatgagcgaccacctgtgcagcatgaacgagaccctgagcaagcagagagaggagatcgacaccctgaagatgagcagcaagggcaacagcaagaagaacaagagcagatag

SEQ ID NO: 24035 - DNA, 465 bp, Artificial Sequence
  Description of Artificial Sequence: Synthetic coding sequence
atgcccagcagaaccgccagatacgccagatacagccccagacagagaagaagaagaatgctggccgacagaagcgtgagattccccaacgacgtgctgttcctggaccacatcagacagggcgacctggagcaggtgggcagattcatcagaaccagaaaggtgagcctggccaccatccaccccagcggcctggccgccctgcacgaggccgtgctgagcggcaacctggagtgcgtgaagctgctggtgaagtacggcgccgacatccaccagagagacgaggccggctggacccccctgcacatcgcctgcagcgacggctaccccgacatcgccagatacctgatcagcctgggcgccgacagagacgccaccaacgacgacggcgacctgcccagcgacctgatcgaccccgactacaaggagctggtggagctgttcaagggcaccaccatggactag

SEQ ID NO: 24036 - DNA, 1278 bp, Artificial Sequence
  Description of Artificial Sequence: Synthetic coding sequence
atgatgggcaagctgcccctgggcgtggtgagcccctacgtgaagatgagcagcggcggctacaccgaccccctgaagttctacgccaccagctactgcaccgcctacggcagagaggacttcaagcccagagtgggcagccacgtgggcaccggctacaagagcaacttccagcccgtggtgagctgccaggccagcctggaggccctggacaaccccgccagaggcgagcaggcccaggaccacttccagagcgtggccagccagagctacagacccctggaggtgcccgacggcaagcaccccctgccctggagcatgagacagaccagcagcggctacggcagagagaagcccagcgccggcccccccaccaaggaggtgagaaaggtgcacttcgacacccaggagcacggcccccaggccatcaccggcctggagcccagagaggtgcccctgctgcaccagcagcagggccaggaccccctggagagagagaacttcagacacggccccagattcatgaccagcgagtacaacagcaagtacctgagagaccccctggaccagcccgacttcctgcagaagaagagcatcggcgccaaggagggcagcggcttcaccaagcagagccaccagagccccatcgtgttccagccccccagccaggccctgcccggcgaccccgccctgctgcccggccagagcgtgaccaagagcgacttcctgcccaagacccacctgcacggcgacgagttcctgcccgtgctggccagaggcagcaagagagagaccgccttcagcagaggcaacgagagaatcctgaaccccagagtgccccccccctgccccgagcccagcagcgtgagccaccagcagttccagcccctgcacagaatgcagcagaccaacgtggccctgctgggcagagagaccgtgggcaagaaggagcccaccggcttcagcctgaacaaccccatgtacgtgagaagcccctgcgaccccgacagagaccagagatacctgaccacctacaaccagggctacttcgagaacatccccaagggcctggaccaggagggctggaccagaggcggcatccagccccagatgcccggcggctacgccctgagccagcccgtgagctgcatggaggccacccccaaccccatggagagcctgagacacctgcacccccacgtgggcagaaccctgaccagcgccgaccccttctaccagaacaccccccacagcagcagatgcgtggcccacagctag

SEQ ID NO: 24037 - DNA, 1218 bp, Artificial Sequence
  Description of Artificial Sequence: Synthetic coding sequence
atgatgggcaagctgcccctgggcgtggtgagcccctacgtgaagatgagcagcggcggctacaccgaccccctgaagttctacgccaccagctactgcaccgcctacggcagagaggacttcaagcccagagtgggcagccacgtgggcaccggctacaagagcaacttccagcccgtggtgagctgccaggccagcctggaggccctggacaaccccgccagaggcgagcaggcccaggaccacttccagagcgtggccagccagagctacagacccctggaggtgcccgacggcaagcaccccctgccctggagcatgagacagaccagcagcggctacggcagagagaagcccagcgccggcccccccaccaaggaggtgagaaaggtgcacttcgacacccaggagcacggcccccaggccatcaccggcctggagcccagagaggtgcccctgctgcaccagcagcagggccaggaccccctggagagagagaacttcagacacggccccagattcatgaccagcgagtacaacagcaagtacctgagagaccccctggaccagcccgacttcctgcagaagaagagcatcggcgccaaggagggcagcggcttcaccaagcagagccaccagagccccatcgtgttccagccccccagccaggccctgcccggcgaccccggcgacgagttcctgcccgtgctggccagaggcagcaagagagagaccgccttcagcagaggcaacgagagaatcctgaaccccagagtgccccccccctgccccgagcccagcagcgtgagccaccagcagttccagcccctgcacagaatgcagcagaccaacgtggccctgctgggcagagagaccgtgggcaagaaggagcccaccggcttcagcctgaacaaccccatgtacgtgagaagcccctgcgaccccgacagagaccagagatacctgaccacctacaaccagggctacttcgagaacatccccaagggcctggaccaggagggctggaccagaggcggcatccagccccagatgcccggcggctacgccctgagccagcccgtgagctgcatggaggccacccccaaccccatggagagcctgagacacctgcacccccacgtgggcagaaccctgaccagcgccgaccccttctaccagaacaccccccacagcagcagatgcgtggcccacagctag

SEQ ID NO: 24038 - DNA, 762 bp, Artificial Sequence
  Description of Artificial Sequence: Synthetic coding sequence
atgatgatgggctgcggcgagagcgagctgaagagcgccgacggcgaggaggccgccgccgtgcccggccccccccccgagccccaggtgccccagctgagagcccccgtgcccgagcccggcctggacctgagcctgagccccagacccgacagcccccagcccagacacggcagccccggcagaagaaagggcagagccgagagaagaggcgccgccagacagagaagacaggtgagattcagactgaccccccccagccccgtgagaagcgagccccagcccgccgtgccccaggagctggagatgcccgtgctgaagagcagcctggccctgggcctggagctgagagccgccgccggcagccacttcgacgccgccaaggccgtggaggagcagctgagaaagagcttccagatcagatgcggcctggaggagagcgtgagcgagggcctgaacgtgcccagaagcaagagactgttcagagacctggtgagcctgcaggtgcccgaggagcaggtgctgaacgccgccctgagagagaagctggccctgctgcccccccaggccagagccccccaccccaaggagccccccggccccggccccgacatgaccatcctgtgcgaccccgagaccctgttctacgagagcccccacctgaccctggacggcctgccccccctgagactgcagctgagacccagacccagcgaggacaccttcctgatgcacagaaccctgagaagatgggaggcctag

SEQ ID NO: 24039 - DNA, 1269 bp, Artificial Sequence
  Description of Artificial Sequence: Synthetic coding sequence
atgtacagagtgcccgagttctacgccagaagaaagagactgggcggccagaccccctacctgatggaccagctgggcctgagactgggcatgtggtactggaaggacgagaccagaaccctggagttcagaagattcgccgccgaggacagcgtgcagtggctgctgaagcaccacccccacttcacccccgccgccgaggtgaaggagaagggcaagaagggcaaggccgtgcacttcgccgagaccgacggccccgccagcgacagactgaccgacaagagactggccgccaaggacgacaagagcgccaaggccgtggagaagagaggccagcagggcaccatcaccctggacgacgtgaagttcgtgaccctgctgctgctgcaggacaccgagatgcagagaatctgcagcttcaccaccttcatgagaaacaagaacctggacaacttcctgatggccctgctgtactacctgagccactacctggagaagaacagcctggagaagaagcccaagagctacatggtgggcctggtggagaagaaggagatggagctggtgctgagcgagctggaggccgcccagagatacctggcccagaagtactgcatcctggtgctgggcctggccgtgcccgacaagcaccacatgtgctgcggcaaggagaagatcagcgacacccagaaggactggaagttcttcgagagcttctacaccttctgcacctacgtggcctggatcgtgttcagaagacagcacctgaccgagatcgaggaggaggtgggcagactgttcagaaccaacatgttcaacatccccagaagaagaagagaggacgaggagagcggcggcgagaagaagagaatgaccttcgtgcagttcagaagaatgatggccaagagacccgccatcaagaaggccatcaacatgagaagccccgtgatgagcaccctgctgcccagcctgagagagaaggcccagaacgtgttcgagaagaagtaccaccaggtggacgtgagattccccgccgagatgcagaagcacgtgggcaccctggacagcgtgcccatgcccgtggtgggcatcctgggcgagcccagatgcctgttcaacccccacaccctgcaccccctggaccccgaggagaacaccaagagcttcggcagataccccagcctgatggagaacaacaacatgagaatccaggacaccctggacctggtgatgaagaccctgagcagccacaccagctgccccaagtag

SEQ ID NO: 24040 - DNA, 624 bp, Artificial Sequence
  Description of Artificial Sequence: Synthetic coding sequence
atggccgccctggtggagcccctgggcctggagagagacgtgagcagagccgtggagctgctggagagactgcagagaagcggcgagctgcccccccagaagctgcaggccctgcagagagtgctgcagagcagattctgcagcgccatcagagaggtgtacgagcagctgtacgacaccctggacatcaccggcagcgccgagatcagagcccacgccaccgccaaggccaccgtggccgccttcaccgccagcgagggccacgcccaccccagagtggtggagctgcccaagaccgacgagggcctgggcttcaacatcatgggcggcaaggagcagaacagccccatctacatcagcagagtgatccccggcggcgtggccgacagacacggcggcctgaagagaggcgaccagctgctgagcgtgaacggcgtgagcgtggagggcgagcagcacgagaaggccgtggagctgctgaaggccgcccagggcagcgtgaagctggtggtgagatacacccccagagtgctggaggagatggaggccagattcgagaagatgagaagcgccagaagaagacagcagcaccagagctacagcagcctggagagcagaggctag

SEQ ID NO: 24041 - DNA, 2064 bp, Artificial Sequence
  Description of Artificial Sequence: Synthetic coding sequence
atggagatcgccccccaggaggccccccccgtgcccggcgccgacggcgacatcgaggaggcccccgccgaggccggcagccccagccccgccagcccccccgccgacggcagactgaaggccgccgccaagagagtgaccttccccagcgacgaggacatcgtgagcggcgccgtggagcccaaggacccctggagacacgcccagaacgtgaccgtggacgaggtgatcggcgcctacaagcaggcctgccagaagctgaactgcagacagatccccaagctgctgagacagctgcaggagttcaccgacctgggccacagactggactgcctggacctgaagggcgagaagctggactacaagacctgcgaggccctggaggaggtgttcaagagactgcagttcaaggtggtggacctggagcagaccaacctggacgaggacggcgccagcgccctgttcgacatgatcgagtactacgagagcgccacccacctgaacatcagcttcaacaagcacatcggcaccagaggctggcaggccgccgcccacatgatgagaaagaccagctgcctgcagtacctggacgccagaaacacccccctgctggaccacagcgcccccttcgtggccagagccctgagaatcagaagcagcctggccgtgctgcacctggagaacgccagcctgagcggcagacccctgatgctgctggccaccgccctgaagatgaacatgaacctgagagagctgtacctggccgacaacaagctgaacggcctgcaggacagcgcccagctgggcaacctgctgaagttcaactgcagcctgcagatcctggacctgagaaacaaccacgtgctggacagcggcctggcctacatctgcgagggcctgaaggagcagagaaagggcctggtgaccctggtgctgtggaacaaccagctgacccacaccggcatggccttcctgggcatgaccctgagcctggagaccctgaacctgggccacaaccccatcggcaacgagggcgtgagacacctgaagaacggcctgatcagcaacagaagcgtgctgagactgggcctggccagcaccaagctgacctgcgagggcgccgtggccgtggccgagttcatcgccgagagccccagactgctgagactggacctgagagagaacgagatcaagaccggcggcctgatggccctgagcctggccctgaaggtgaaccacagcctgctgagactggacctggacagagagcccaagaaggaggccgtgaagagcttcatcgagacccagaaggccctgctggccgagatccagaacggctgcaagagaaacctggtgctggccagagagagagaggagaaggagcagcccccccagctgagcgccagcatgcccgagaccaccgccaccgagccccagcccgacgacgagcccgccgccggcgtgcagaacggcgcccccagccccgcccccagccccgacagcgacagcgacagcgacagcgacggcgaggaggaggaggaggaggagggcgagagagacgagaccccctgccccgccctggtgccccccaccgacagcctgggccccggcgacagaagcccccccggcagccccagcacccccaccgagcagagaatcagcgtgagcagccccggcagaggccacaaggtgttcgtggtgaccagagtggagagcccccccgagagagccgagccccccgccagccccaccccccccagccccccccccccccccagcccccccgccagccccagcctgccccccgccggcgccatcgacaccagagacaccggcagcagcgagccccagcccccccccgagccccccagaagcggcccccccctgcccaacggcctgaagcccgagttcgccctggccctgccccccgagcccccccccggccccgaggtgaagggcggcagctgcggcctggagcacgagctgagctgcagcaagaacgagaaggagctggaggagctgctgctggaggccagccaggagagcggccaggagaccctgtag

SEQ ID NO: 24042 - DNA, 858 bp, Artificial Sequence
  Description of Artificial Sequence: Synthetic coding sequence
atgatggccgtggacatcgagtacagatacaactgcatggcccccagcctgagacaggagagattcgccttcaagatcagccccaagcccagcaagcccctgagaccctgcatccagctgagcagcaagaacgaggccagcggcatggtggcccccgccgtgcaggagaagaaggtgaagaagagagtgagcttcgccgacaaccagggcctggccctgaccatggtgaaggtgttcagcgagttcgacgaccccctggacatgcccttcaacatcaccgagctgctggacaacatcgtgagcctgaccaccgccgagagcgagagcttcgtgctggacttcagccagcccagcgccgactacctggacttcagaaacagactgcaggccgaccacgtgtgcctggagaactgcgtgctgaaggacaaggccatcgccggcaccgtgaaggtgcagaacctggccttcgagaagaccgtgaagatcagaatgaccttcgacacctggaagagctacaccgacttcccctgccagtacgtgaaggacacctacgccggcagcgacagagacaccttcagcttcgacatcagcctgcccgagaagatccagagctacgagagaatggagttcgccgtgtactacgagtgcaacggccagacctactgggacagcaacagaggcaagaactacagaatcatcagagccgagctgaagagcacccagggcatgaccaagccccacagcggccccgacctgggcatcagcttcgaccagttcggcagccccagatgcagctacggcctgttccccgagtggcccagctacctgggctacgagaagctgggcccctactactag

SEQ ID NO: 24043 - DNA, 858 bp, Artificial Sequence; identical to SEQ ID NO: 24042
  Description of Artificial Sequence: Synthetic coding sequence

SEQ ID NO: 24044 - DNA, 687 bp, Artificial Sequence
  Description of Artificial Sequence: Synthetic coding sequence
atggtgagactgaccctggacctgatcgccagaaacagcaacctgaagcccagaaaggaggagaccatcagccagtgcctgaagaagatcacccacatcaacttcagcgacaagaacatcgacgccatcgaggacctgagcctgtgcaagaacctgagcgtgctgtacctgtacgacaactgcatcagccagatcaccaacctgaactacgccaccaacctgacccacctgtacctgcagaacaactgcatcagctgcatcgagaacctgagaagcctgaagaagctggagaagctgtacctgggcggcaactacatcgccgtgatcgagggcctggagggcctgggcgagctgagagagctgcacgtggagaaccagagactgcccctgggcgagaagctgctgttcgaccccagaaccctgcacagcctggccaagagcctgtgcatcctgaacatcagcaacaacaacatcgacgacatcaccgacctggagctgctggagaacctgaaccagctgatcgccgtggacaaccagctgctgcacgtgaaggacctggagttcctgctgaacaagctgatgaagctgtggaagatcgacctgaacggcaaccccgtgtgcctgaagcccaagtacagagacagactgatcctggtgagcaagagcctgggcacctacctgtactag

SEQ ID NO: 24045 - DNA, 1068 bp, Artificial Sequence
  Description of Artificial Sequence: Synthetic coding sequence
atggtgagactgaccctggacctgatcgccagaaacagcaacctgaagcccagaaaggaggagaccatcagccagtgcctgaagaagatcacccacatcaacttcagcgacaagaacatcgacgccatcgaggacctgagcctgtgcaagaacctgagcgtgctgtacctgtacgacaactgcatcagccagatcaccaacctgaactacgccaccaacctgacccacctgtacctgcagaacaactgcatcagctgcatcgagaacctgagaagcctgaagaagctggagaagctgtacctgggcggcaactacatcgccgtgatcgagggcctggagggcctgggcgagctgagagagctgcacgtggagaaccagagactgcccctgggcgagaagctgctgttcgaccccagaaccctgcacagcctggccaagagcctgtgcatcctgaacatcagcaacaacaacatcgacgacatcaccgacctggagctgctggagaacctgaaccagctgatcgccgtggacaaccagctgctgcacgtgaaggacctggagttcctgctgaacaagctgatgaagctgtggaagatcgacctgaacggcaaccccgtgtgcctgaagcccaagtacagagacagactgatcctggtgagcaagagcctggagttcctggacggcaaggagatcaagaacatcgagagacagttcctgatgaactggaaggccagcaaggacgccaagaagatcagcaagaagagaagcagcaagaacgaggacgccagcaacagcctgatcagcaacttcaagaccatgcaccacatcgtgcccgtgtactacccccaggtgggcaagcccaagctggccttcttcagcgagatccagagataccccgtgaacgccaacgccagccccgagagcagctgccccttctggcccaacatcgagagaaagaacctgagcctgaagcagagcgagagcctgctgaccaagaacgacgtgcacgagccccacctgttccacaaccccgaggagaaggagaacctgttcgtggagaacgagtag

SEQ ID NO: 24046 - DNA, 930 bp, Artificial Sequence
  Description of Artificial Sequence: Synthetic coding sequence
atggtgagactgaccctggacctgatcgccagaaacagcaacctgaagcccagaaaggaggagaccatcagccagtgcctgaagaagatcacccacatcaacttcagcgacaagaacatcgacgccatcgaggacctgagcctgtgcaagaacctgagcgtgctgtacctgtacgacaactgcatcagccagatcaccaacctgaactacgccaccaacctgacccacctgtacctgcagaacaactgcatcagctgcatcgagaacctgagaagcctgaagaagctggagaagctgtacctgggcggcaactacatcgccgtgatcgagggcctggagggcctgggcgagctgagagagctgcacgtggagaaccagagactgcccctgggcgagaagctgctgttcgaccccagaaccctgcacagcctggccaagagcctgtgcatcctgaacatcagcaacaacaacatcgacgacatcaccgacctggagctgctggagaacctgaaccagctgatcgccgtggacaaccagctgctgcacgtgaaggacctggagttcctgctgaacaagctgatgaagctgtggaagatcgacctgaacggcaaccccgtgtgcctgaagcccaagtacagagacagactgatcctggtgagcaagagcctggagttcctggacggcaaggagatcaagaacatcgagagacagttcctgatgaactggaaggccagcaaggacgccaagaagatcagcaagaagagaagcagcaagaacgaggacgccagcaacagcctgatcagcaacttcaagaccatgcaccacatcgtgcccgtgtactacccccaggtgggcaagcccaagctggccttcttcagcgagatccagagataccccgtgaacgccaacgccagccccgagagcagctag

SEQ ID NO: 24047 - DNA, 1245 bp, Artificial Sequence
  Description of Artificial Sequence: Synthetic coding sequence
atggacatcgaggagcagaaggccgacatctacgagatgggcaagatcgccaaggtgtgcggctgccccctgtactggaaggcccccatgttcagagccgccggcggcgagaagaccggcttcgtgaccgcccagagcttcatcgccatgtggagaaagctgctgaacaaccaccacgacgacgccagcaagttcatctgcctgctggccaagcccaactgcagcagcctggagcaggaggacttcatccccctgctgcaggacgtggtggacacccaccccggcctgaccttcctgaaggacgcccccgagttccacagcagatacatcaccaccgtgatccagagaatcttctacaccgtgaacagaagctggagcggcaagatcaccagcaccgagatcagaaagagcaacttcctgcagaccctggccctgctggaggaggaggaggacatcaaccagatcaccgactacttcagctacgagcacttctacgtgatctactgcaagttctgggagctggacaccgaccacgacctgtacatcagccaggccgacctgagcagatacaacgaccaggccagcagcagcagaatcatcgagagaatcttcagcggcgccgtgaccagaggcaagaccatccagaaggagggcagaatgagctacgccgacttcgtgtggttcctgatcagcgaggaggacaagagaaaccccaccagcatcgagtactggttcagatgcatggacgtggacggcgacggcgtgctgagcatgtacgagctggagtacttctacgaggagcagtgcgagagaatggaggccatgggcatcgagcccctgcccttccacgacctgctgtgccagatgctggacctggtgaagcccgccgtggacggcaagatcaccctgagagacctgaagagatgcagaatggcccacatcttctacgacaccttcttcaacctggagaagtacctggaccacgagcagagagaccccttcgccgtgcagaaggacgtggagaacgacggccccgagcccagcgactgggacagattcgccgccgaggagtacgagaccctggtggccgaggagagcgcccaggcccagttccaggagggcttcgaggactacgagaccgacgagcccgccagccccagcgagttcggcaacaagagcaacaagatcctgagcgccagcctgcccgagaagtgcggcaagctgcagagcgtggacgaggagtag

SEQ ID NO: 24048 - DNA, 3453 bp, Artificial Sequence
  Description of Artificial Sequence: Synthetic coding sequence
atggccgccacctacagactggtggtgagcaccgtgaaccactacagcagcgtggtgatcgacagaagattcgagcaggccatccactactgcaccggcacctgccacaccttcacccacggcatcgactgcatcgtggtgcaccacagcgtgtgcgccgacctgctgcacatccccgtgagccagttcaaggacgccgacctgaacagcatgttcctgccccacgagaacggcctgagcagcgccgagggcgactacccccagcaggccttcaccggcatccccagagtgaagagaggcagcaccttccagaacacctacaacctgaaggacatcgccggcgaggccatcagcttcgccagcggcaagatcaaggagttcagcttcgagaagctgaagaacagcaaccacgccgcctacagaaagggcagaaaggtgaagagcgacagcttcaacagaagaagcgtggacctggacctgctgtgcggccactacaacaacgacggcaacgcccccagcttcggcctgctgagaagcagcagcgtggaggagaagcccctgagccacagaaacagcctggacaccaacctgaccagcatgttcctgcagaacttcagcgaggaggacctggtgacccagatcctggagaagcacaagatcgacaacttcagcagcggcaccgacatcaagatgtgcctggacatcctgctgaagtgcagcgaggacctgaagaagtgcaccgacatcatcaagcagtgcatcaagaagaagagcggcagcagcatcagcgagggcagcggcaacgacaccatcagcagcagcgagaccgtgtacatgaacgtgatgaccagactggccagctacctgaagaagctgcccttcgagttcatgcagagcggcaacaacgaggccctggacctgaccgagctgatcagcaacatgcccagcctgcagctgacccccttcagccccgtgttcggcaccgagcagccccccaagtacgaggacgtggtgcagctgagcgccagcgacagcggcagattccagaccatcgagctgcagaacgacaagcccaacagcagaaagatggacaccgtgcagagcatccccaacaacagcaccaacagcctgtacaacctggaggtgaacgaccccagaaccctgaaggccgtgcaggtgcagagccagagcctgaccatgaaccccctggagaacgtgagcagcgacgacctgatggagaccctgtacatcgaggaggagagcgacggcaagaaggccctggacaagggccagaagaccgagaacggccccagccacgagctgctgaaggtgaacgagcacagagccgagttccccgagcacgccacccacctgaagaagtgccccacccccatgcagaacgagatcggcaagatcttcgagaagagcttcgtgaacctgcccaaggaggactgcaagagcaaggtgagcaagttcgaggagggcgaccagagagacttcaccaacagcagcagccaggaggagatcgacaagctgctgatggacctggagagcttcagccagaagatggagaccagcctgagagagcccctggccaagggcaagaacagcaacttcctgaacagccacagccagctgaccggccagaccctggtggacctggagcccaagagcaaggtgagcagccccatcgagaaggtgagccccagctgcctgaccagaatcatcgagaccaacggccacaagatcgaggaggaggacagagccctgctgctgagaatcctggagagcatcgaggacttcgcccaggagctggtggagtgcaagagcagcagaggcagcctgagccaggagaaggagatgatgcagatcctgcaggagaccctgaccaccagcagccaggccaacctgagcgtgtgcagaagccccgtgggcgacaaggccaaggacaccaccagcgccgtgctgatccagcagacccccgaggtgatcaagatccagaacaagcccgagaagaagcccggcacccccctgcccccccccgccaccagccccagcagccccagacccctgagccccgtgccccacgtgaacaacgtggtgaacgcccccctgagcatcaacatccccagattctacttccccgagggcctgcccgacacctgcagcaaccacgagcagaccctgagcagaatcgagaccgccttcatggacatcgaggagcagaaggccgacatctacgagatgggcaagatcgccaaggtgtgcggctgccccctgtactggaaggcccccatgttcagagccgccggcggcgagaagaccggcttcgtgaccgcccagagcttcatcgccatgtggagaaagctgctgaacaaccaccacgacgacgccagcaagttcatctgcctgctggccaagcccaactgcagcagcctggagcaggaggacttcatccccctgctgcaggacgtggtggacacccaccccggcctgaccttcctgaaggacgcccccgagttccacagcagatacatcaccaccgtgatccagagaatcttctacaccgtgaacagaagctggagcggcaagatcaccagcaccgagatcagaaagagcaacttcctgcagaccctggccctgctggaggaggaggaggacatcaaccagatcaccgactacttcagctacgagcacttctacgtgatctactgcaagttctgggagctggacaccgaccacgacctgtacatcagccaggccgacctgagcagatacaacgaccaggccagcagcagcagaatcatcgagagaatcttcagcggcgccgtgaccagaggcaagaccatccagaaggagggcagaatgagctacgccgacttcgtgtggttcctgatcagcgaggaggacaagagaaaccccaccagcatcgagtactggttcagatgcatggacgtggacggcgacggcgtgctgagcatgtacgagctggagtacttctacgaggagcagtgcgagagaatggaggccatgggcatcgagcccctgcccttccacgacctgctgtgccagatgctggacctggtgaagcccgccgtggacggcaagatcaccctgagagacctgaagagatgcagaatggcccacatcttctacgacaccttcttcaacctggagaagtacctggaccacgagcagagagaccccttcgccgtgcagaaggacgtggagaacgacggccccgagcccagcgactgggacagattcgccgccgaggagtacgagaccctggtggccgaggagagcgcccaggcccagttccaggagggcttcgaggactacgagaccgacgagcccgccagccccagcgagttcggcaacaagagcaacaagatcctgagcgccagcctgcccgagaagtgcggcaagctgcagagcgtggacgaggagtag

SEQ ID NO: 24049 - DNA, 1590 bp, Artificial Sequence
  Description of Artificial Sequence: Synthetic coding sequence
atgatgatcaaggagaccagcctgagaagagaccccgacctgagaggcgagctggccttcctggccagaggctgcgacttcgtgctgcccagcagattcaagaagagactgaagagcttccagcagacccagatccagaacaagcccgagaagaagcccggcacccccctgcccccccccgccaccagccccagcagccccagacccctgagccccgtgccccacgtgaacaacgtggtgaacgcccccctgagcatcaacatccccagattctacttccccgagggcctgcccgacacctgcagcaaccacgagcagaccctgagcagaatcgagaccgccttcatggacatcgaggagcagaaggccgacatctacgagatgggcaagatcgccaaggtgtgcggctgccccctgtactggaaggcccccatgttcagagccgccggcggcgagaagaccggcttcgtgaccgcccagagcttcatcgccatgtggagaaagctgctgaacaaccaccacgacgacgccagcaagttcatctgcctgctggccaagcccaactgcagcagcctggagcaggaggacttcatccccctgctgcaggacgtggtggacacccaccccggcctgaccttcctgaaggacgcccccgagttccacagcagatacatcaccaccgtgatccagagaatcttctacaccgtgaacagaagctggagcggcaagatcaccagcaccgagatcagaaagagcaacttcctgcagaccctggccctgctggaggaggaggaggacatcaaccagatcaccgactacttcagctacgagcacttctacgtgatctactgcaagttctgggagctggacaccgaccacgacctgtacatcagccaggccgacctgagcagatacaacgaccaggccagcagcagcagaatcatcgagagaatcttcagcggcgccgtgaccagaggcaagaccatccagaaggagggcagaatgagctacgccgacttcgtgtggttcctgatcagcgaggaggacaagagaaaccccaccagcatcgagtactggttcagatgcatggacgtggacggcgacggcgtgctgagcatgtacgagctggagtacttctacgaggagcagtgcgagagaatggaggccatgggcatcgagcccctgcccttccacgacctgctgtgccagatgctggacctggtgaagcccgccgtggacggcaagatcaccctgagagacctgaagagatgcagaatggcccacatcttctacgacaccttcttcaacctggagaagtacctggaccacgagcagagagaccccttcgccgtgcagaaggacgtggagaacgacggccccgagcccagcgactgggacagattcgccgccgaggagtacgagaccctggtggccgaggagagcgcccaggcccagttccaggagggcttcgaggactacgagaccgacgagcccgccagccccagcgagttcggcaacaagagcaacaagatcctgagcgccagcctgcccgagaagtgcggcaagctgcagagcgtggacgaggagtag

SEQ ID NO: 24050 - DNA, 486 bp, Artificial Sequence
  Description of Artificial Sequence: Synthetic coding sequence
atggacatcgaggagcagaaggccgacatctacgagatgggcaagatcgccaaggtgtgcggctgccccctgtactggaaggcccccatgttcagagccgccggcggcgagaagaccggcttcgtgaccgcccagagcttcatcgccatgtggagaaagctgctgaacaaccaccacgacgacgccagcaagttcatctgcctgctggccaagcccaactgcagcagcctggagcaggaggacttcatccccctgctgcaggacgtggtggacacccaccccggcctgaccttcctgaaggacgcccccgagttccacagcagatacatcaccaccgtgatccagagaatcttctacaccgtgaacagaagctggagcggcaagatcaccagcaccgagatcagaaagagcaacttcctgcagagcaacgaggacctggccaagctggccgtgcacgacggctacaccaacatcttcctgttctag

SEQ ID NO: 24051 - DNA, 1893 bp, Artificial Sequence
  Description of Artificial Sequence: Synthetic coding sequence
atgagcaccaacaacgccctgagagtgttctggaagagcagagagtggaacatgaagaccagcaccttcgacagcgacgaggacatcctgctgctgcccaagagaaagagattcagaaagaagaagagcagacccgtgagacacaccaagagacacgaggaggagcaggtgtacgagcagggcaccaccctgccctgcagcatctgcaagcacgagatcgacctgaccggcatcttcctgcacaagaagcagcacgtggccctggccaccctgggcttccagtggatgggcagaaagaagccccagcccagcgtgatcgccgtgcagagacagttcatgatcagcaagctgctgagcagcttcatgttcaccgagaagaccctgcagagcatcaacaacgccttcgagctgctgtggaagaagcagatccccgcctactacaagatcttcgacaacatcgacagaagcgtgatctacagccagaagatctgccacctgctgatcaagggcgtgggcatctgcgaggacagaaacagcacctggaaggccgacatgaacgacaagttcaccgtggtgagcaacttcggcaacaagcccaacgtgtgcttcttcggcctgttcgacggccaccacggcgccagcgccgccgagctgaccagcatggagctgcccgtgctgctgctgcaccagctgagcaagttcgaccccagctaccagatgaccaccgacgagcagcagatcatcaacagcttctacaccgtgttcagagaggagtacgccgccatcgaggacctgttcagcgccatcaacaagaccgaggccgtgagatgcgagtacgaggacacccacaaggccttcgccaaggccttctggagaatggacagactgctgggcctgggcagaaaggaggtgagcagagtgcagtggagcggctgcagcgccgtgacctgcatcctggagggcaagcccaagagcccctacgcccacaagaactggaagagaaagaacacccacgacggcctggccgagagcagccccagccaggagatgcccaagatcatcagcggcatcctgcacgtggccaacaccggcaacgtgcaggccgtgctgtgcagaaacggcaagggcttctgcctgaccaaggagcacaccaccagaaacaccaacgagagaagaagaatcctgcagaacggcgccgtgatcagcagcaacgagccctacggcctggtggagggccaggtgaagaccaccagaggcctgggcttccacggcaacctgaagctgaagaagagcatcatccccgccccccagaccatcagcgtgcccatcgacgacctgtgccagttcctgatcgtggccaccaacggcctgtgggaggtgctggacaaggaggaggtgaccgccctggccatgaccaccttccacatgtacaaggagacctactgccccatcatccccaacaagagccccagcaagggccccctgctgttcagcaccagcgagcccaacctgaccaagagccagagcaacatccacgtgctgttccagtacaagagcgtgagcgaggtgagagtgagcaccaccaacagcaaggagaacctgagcgacagcaactacagcaagtactgcatctacaaccccgagaacgtggagaccttccccgccgagaccacccacagaaagccctgcagcgagaaggtgaccgacagacccaccagcgtgaacgacgtggccaccaacgagaaggagagcgacaccaagagcttctacgagggcgccgccgagtacgtgagccacgagctggtgaacgccgccctgctggccggcagcagagacaacatcaccgtgatggtgatcttcctgaacggcagcgagtaccagctgctgacctag

SEQ ID NO: 24052 - DNA, 1248 bp, Artificial Sequence
  Description of Artificial Sequence: Synthetic coding sequence
atggccgagatccccctgtacttcgtggacctgcaggacgacctggacgactacggcttcgaggactacggcaccgactgcgacaacatgagagtgaccgccttcctggacatccccggccaggacaacctgccccccctgaccagactggagaagtacgccttcagcgagaacaccttcaacagacagatcatcgccagaggcctgctggacatcttcagagacttcggcaacaacgaggaggacttcctgaccgtgatggagatcgtggtgagactgagcgaggacgccgagcccaccgtgagaaccgagctgatggagcagatcccccccatcgccatcttcctgcaggagaacagaagcaacttccccgtggtgctgagcgagtacctgatccccatcgtggtgagatacctgaccgaccccaacaaccagatcatctgcaagatggccagcatgctgagcaagagcaccgtggagagactgctgctgcccagattctgcgagctgtgcggcgacagaaagctgttccaggtgagaaaggtgtgcgccgccaacttcggcgacatctgccacgccgtgggccaggaggccaccgagaagttcctgatccccaagttcttcgagctgtgcagcgacgccgtgtggggcatgagaaaggcctgcgccgagtgcttcaccgccgtgagccacagcagcagccccggcgtgagaagaacccagctgttccccctgttcatcagactggtgagcgacccctgcagatgggtgcaccaggccgccttccagagcctgggccccttcaccagcaccttcgccaaccccagcagagccggcctgtacctgagagaggacggcgccctgagcatctggcccctgacccaggacctggacagcggcttcgccagcggcagccccgcccccagcagcggcggcaacaccagccccgccagcctgaccagaagcgccaagcccgtgagaagcgagcccgagctgcccgtggagggcaccagcgccaagaccagcgactgcccccacagcagcagcagcagcgacggccccgccgagagccccgtggagagctgcgtgagcgccggcgccgagtggaccagagtgagccccgagaccagcgcctgcagcaagctgagcgacatgaacgacctgcccatcagcagctaccccggcagcgacagctgggcctgccccggcaacaccgaggacgtgttcagccacttcctgtactggtag

SEQ ID NO: 24053 - DNA, 1365 bp, Artificial Sequence
  Description of Artificial Sequence: Synthetic coding sequence
atgagcagcggcgccccccagaagagcagccccatggccagcggcgccgaggagacccccggcttcctggacaccctgctgcaggacttccccgccctgctgaaccccgaggaccccctgccctggaaggcccccggcaccgtgctgagccaggaggaggtggagggcgagctggccgagctggccatgggcttcctgggcagcagaaaggcccccccccccctggccgccgccctggcccacgaggccgtgagccagctgctgcagaccgacctgagcgagttcagaaagctgcccagagaggaggaggaggaggaggaggacgacgacgaggaggagaaggcccccgtgaccctgctggacgcccagagcctggcccagagcttcttcaacagactgtgggaggtggccggccagtggcagaagcaggtgcccctggccgccagagccagccagagacagtggctggtgagcatccacgccatcagaaacaccagaagaaagatggaggacagacacgtgagcctgcccagcttcaaccagctgttcggcctgagcgaccccgtgaacagagcctacttcgccgtgttcgacggccacggcggcgtggacgccgccagatacgccgccgtgcacgtgcacaccaacgccgccagacagcccgagctgcccaccgaccccgagggcgccctgagagaggccttcagaagaaccgaccagatgttcctgagaaaggccaagagagagagactgcagagcggcaccaccggcgtgtgcgccctgatcgccggcgccaccctgcacgtggcctggctgggcgacagccaggtgatcctggtgcagcagggccaggtggtgaagctgatggagccccacagacccgagagacaggacgagaaggccagaatcgaggccctgggcggcttcgtgagccacatggactgctggagagtgaacggcaccctggccgtgagcagagccatcggcgacgtgttccagaagccctacgtgagcggcgaggccgacgccgccagcagagccctgaccggcagcgaggactacctgctgctggcctgcgacggcttcttcgacgtggtgccccaccaggaggtggtgggcctggtgcagagccacctgaccagacagcagggcagcggcctgagagtggccgaggagctggtggccgccgccagagagagaggcagccacgacaacatcaccgtgatggtggtgttcctgagagacccccaggagctgctggagggcggcaaccagggcgagggcgacccccaggccgagggcagaagacaggacctgcccagcagcctgcccgagcccgagacccaggccccccccagaagctag

SEQ ID NO: 24054 - DNA, 1086 bp, Artificial Sequence
  Description of Artificial Sequence: Synthetic coding sequence
atgagcagcggcgccccccagaagagcagccccatggccagcggcgccgaggagacccccggcttcctggacaccctgctgcaggacttccccgccctgctgaaccccgaggaccccctgccctggaaggcccccggcaccgtgctgagccaggaggaggtggagggcgagctggccgagctggccatgggcttcctgggcagcagaaaggcccccccccccctggccgccgccctggcccacgaggccgtgagccagctgctgcagaccgacctgagcgagttcagaaagctgcccagagaggaggaggaggaggaggaggacgacgacgaggaggagaaggcccccgtgaccctgctggacgcccagagcctggcccagagcttcttcaacagactgtgggaggtggccggccagtggcagaagcaggtgcccctggccgccagagccagccagagacagtggctggtgagcatccacgccatcagaaacaccagaagaaagatggaggacagacacgtgagcctgcccagcttcaaccagctgttcggcctgagcgaccccgtgaacagagcctacttcgccgtgttcgacggccacggcggcgtggacgccgccagatacgccgccgtgcacgtgcacaccaacgccgccagacagcccgagctgcccaccgaccccgagggcgccctgagagaggccttcagaagaaccgaccagatgttcctgagaaaggccaagagagagagactgcagagcggcaccaccggcgtgtgcgccctgatcgccggcgccaccctgcacgtggcctggctgggcgacagccaggtgatcctggtgcagcagggccaggtggtgaagctgatggagccccacagacccgagagacaggacgagaaggccagaatcgaggccctgggcggcttcgtgagccacatggactgctggagagtgaacggcaccctggccgtgagcagagccatcggcgagagccagagaggcagacccaagtgggagaaggtgagcagaaagcccagacccagagtgtggcccgccgcccaccagggcttcagagaggccgtgtag

SEQ ID NO: 24055 - DNA, 861 bp, Artificial Sequence
  Description of Artificial Sequence: Synthetic coding sequence
atggaggacagacacgtgagcctgcccagcttcaaccagctgttcggcctgagcgaccccgtgaacagagcctacttcgccgtgttcgacggccacggcggcgtggacgccgccagatacgccgccgtgcacgtgcacaccaacgccgccagacagcccgagctgcccaccgaccccgagggcgccctgagagaggccttcagaagaaccgaccagatgttcctgagaaaggccaagagagagagactgcagagcggcaccaccggcgtgtgcgccctgatcgccggcgccaccctgcacgtggcctggctgggcgacagccaggtgatcctggtgcagcagggccaggtggtgaagctgatggagccccacagacccgagagacaggacgagaaggccagaatcgaggccctgggcggcttcgtgagccacatggactgctggagagtgaacggcaccctggccgtgagcagagccatcggcgacgtgttccagaagccctacgtgagcggcgaggccgacgccgccagcagagccctgaccggcagcgaggactacctgctgctggcctgcgacggcttcttcgacgtggtgccccaccaggaggtggtgggcctggtgcagagccacctgaccagacagcagggcagcggcctgagagtggccgaggagctggtggccgccgccagagagagaggcagccacgacaacatcaccgtgatggtggtgttcctgagagacccccaggagctgctggagggcggcaaccagggcgagggcgacccccaggccgagggcagaagacaggacctgcccagcagcctgcccgagcccgagacccaggccccccccagaagctag

SEQ ID NO: 24056 - DNA, 861 bp, Artificial Sequence; identical to SEQ ID NO: 24055
  Description of Artificial Sequence: Synthetic coding sequence

SEQ ID NO: 24057 - DNA, 1053 bp, Artificial Sequence
  Description of Artificial Sequence: Synthetic coding sequence
atgggcctgtgccccagcaccagagagaccgccccccccgccgtgctggacgcccagagcctggcccagagcttcttcaacagactgtgggaggtggccggccagtggcagaagcaggtgcccctggccgccagagccagccagagacagtggctggtgagcatccacgccatcagaaacaccagaagaaagatggaggacagacacgtgagcctgcccagcttcaaccagctgttcggcctgagcgaccccgtgaacagagcctacttcgccgtgttcgacggccacggcggcgtggacgccgccagatacgccgccgtgcacgtgcacaccaacgccgccagacagcccgagctgcccaccgaccccgagggcgccctgagagaggccttcagaagaaccgaccagatgttcctgagaaaggccaagagagagagactgcagagcggcaccaccggcgtgtgcgccctgatcgccggcgccaccctgcacgtggcctggctgggcgacagccaggtgatcctggtgcagcagggccaggtggtgaagctgatggagccccacagacccgagagacaggacgagaaggccagaatcgaggccctgggcggcttcgtgagccacatggactgctggagagtgaacggcaccctggccgtgagcagagccatcggcgacgtgttccagaagccctacgtgagcggcgaggccgacgccgccagcagagccctgaccggcagcgaggactacctgctgctggcctgcgacggcttcttcgacgtggtgccccaccaggaggtggtgggcctggtgcagagccacctgaccagacagcagggcagcggcctgagagtggccgaggagctggtggccgccgccagagagagaggcagccacgacaacatcaccgtgatggtggtgttcctgagagacccccaggagctgctggagggcggcaaccagggcgagggcgacccccaggccgagggcagaagacaggacctgcccagcagcctgcccgagcccgagacccaggccccccccagaagctag

SEQ ID NO: 24058 - DNA, 3321 bp, Artificial Sequence
  Description of Artificial Sequence: Synthetic coding sequence
atgttcaacagcatgacccccccccccatcagcagctacggcgagccctgctgcctgagacccctgcccagccagggcgcccccagcgtgggcaccgagggcctgagcggcccccccttctgccaccaggccaacctgatgagcggcccccacagctacggccccgccagagagaccaacagctgcaccgagggccccctgttcagcagccccagaagcgccgtgaagctgaccaagaagagagccctgagcatcagccccctgagcgacgccagcctggacctgcagaccgtgatcagaaccagccccagcagcctggtggccttcatcaacagcagatgcaccagccccggcggcagctacggccacctgagcatcggcaccatgagccccagcctgggcttccccgcccagatgaaccaccagaagggccccagccccagcttcggcgtgcagccctgcggcccccacgacagcgccagaggcggcatgatcccccacccccagagcagaggccccttccccacctgccagctgaagagcgagctggacatgctggtgggcaagtgcagagaggagcccctggagggcgacatgagcagccccaacagcaccggcatccaggaccccctgctgggcatgctggacggcagagaggacctggagagagaggagaagagagagcccgagagcgtgtacgagaccgactgcagatgggacggctgcagccaggagttcgacagccaggagcagctggtgcaccacatcaacagcgagcacatccacggcgagagaaaggagttcgtgtgccactggggcggctgcagcagagagctgagacccttcaaggcccagtacatgctggtggtgcacatgagaagacacaccggcgagaagccccacaagtgcaccttcgagggctgcagaaagagctacagcagactggagaacctgaagacccacctgagaagccacaccggcgagaagccctacatgtgcgagcacgagggctgcagcaaggccttcagcaacgccagcgacagagccaagcaccagaacagaacccacagcaacgagaagccctacgtgtgcaagctgcccggctgcaccaagagatacaccgaccccagcagcctgagaaagcacgtgaagaccgtgcacggccccgacgcccacgtgaccaagagacacagaggcgacggccccctgcccagagcccccagcatcagcaccgtggagcccaagagagagagagagggcggccccatcagagaggagagcagactgaccgtgcccgagggcgccatgaagccccagcccagccccggcgcccagagcagctgcagcagcgaccacagccccgccggcagcgccgccaacaccgacagcggcgtggagatgaccggcaacgccggcggcagcaccgaggacctgagcagcctggacgagggcccctgcatcgccggcaccggcctgagcaccctgagaagactggagaacctgagactggaccagctgcaccagctgagacccatcggcaccagaggcctgaagctgcccagcctgagccacaccggcaccaccgtgagcagaagagtgggcccccccgtgagcctggagagaagaagcagcagcagcagcagcatcagcagcgcctacaccgtgagcagaagaagcagcctggccagccccttcccccccggcagcccccccgagaacggcgccagcagcctgcccggcctgatgcccgcccagcactacctgctgagagccagatacgccagcgccagaggcggcggcaccagccccaccgccgccagcagcctggacagaatcggcggcctgcccatgcccccctggagaagcagagccgagtaccccggctacaaccccaacgccggcgtgaccagaagagccagcgaccccgcccaggccgccgacagacccgcccccgccagagtgcagagattcaagagcctgggctgcgtgcacaccccccccaccgtggccggcggcggccagaacttcgacccctacctgcccaccagcgtgtacagcccccagccccccagcatcaccgagaacgccgccatggacgccagaggcctgcaggaggagcccgaggtgggcaccagcatggtgggcagcggcctgaacccctacatggacttcccccccaccgacaccctgggctacggcggccccgagggcgccgccgccgagccctacggcgccagaggccccggcagcctgcccctgggccccggcccccccaccaactacggccccaacccctgcccccagcaggccagctaccccgaccccacccaggagacctggggcgagttccccagccacagcggcctgtaccccggccccaaggccctgggcggcacctacagccagtgccccagactggagcactacggccaggtgcaggtgaagcccgagcagggctgccccgtgggcagcgacagcaccggcctggccccctgcctgaacgcccaccccagcgagggccccccccacccccagcccctgttcagccactacccccagcccagccccccccagtacctgcagagcggcccctacacccagcccccccccgactacctgcccagcgagcccagaccctgcctggacttcgacagccccacccacagcaccggccagctgaaggcccagctggtgtgcaactacgtgcagagccagcaggagctgctgtgggagggcggcggcagagaggacgcccccgcccaggagcccagctaccagagccccaagttcctgggcggcagccaggtgagccccagcagagccaaggcccccgtgaacacctacggccccggcttcggccccaacctgcccaaccacaagagcggcagctaccccacccccagcccctgccacgagaacttcgtggtgggcgccaacagagccagccacagagccgccgccccccccagactgctgccccccctgcccacctgctacggccccctgaaggtgggcggcaccaaccccagctgcggccaccccgaggtgggcagactgggcggcggccccgccctgtaccccccccccgagggccaggtgtgcaaccccctggacagcctggacctggacaacacccagctggacttcgtggccatcctggacgagccccagggcctgagccccccccccagccacgaccagagaggcagcagcggccacacccccccccccagcggcccccccaacatggccgtgggcaacatgagcgtgctgctgagaagcctgcccggcgagaccgagttcctgaacagcagcgcctag

SEQ ID NO: 24059 - DNA, 1023 bp, Artificial Sequence
  Description of Artificial Sequence: Synthetic coding sequence
atggaggacgcccactgcacctggctgagcctgcccggcctgccccccggctgggccctgttcgccgtgctggacggccacggcggcgccagagccgccagattcggcgccagacacctgcccggccacgtgctgcaggagctgggccccgagcccagcgagcccgagggcgtgagagaggccctgagaagagccttcctgagcgccgacgagagactgagaagcctgtggcccagagtggagaccggcggctgcaccgccgtggtgctgctggtgagccccagattcctgtacctggcccactgcggcgacagcagagccgtgctgagcagagccggcgccgtggccttcagcaccgaggaccacagacccctgagacccagagagagagagagaatccacgccgccggcggcaccatcagaagaagaagagtggagggcagcctggccgtgagcagagccctgggcgacttcacctacaaggaggcccccggcagaccccccgagctgcagctggtgagcgccgagcccgaggtggccgccctggccagacaggccgaggacgagttcatgctgctggccagcgacggcgtgtgggacaccgtgagcggcgccgccctggccggcctggtggccagcagactgagactgggcctggcccccgagctgctgtgcgcccagctgctggacacctgcctgtgcaaggtgctgggcgcctggagaggcaccttcggcgcctggtgcagcagaggcagagagcccagaggcttcggcgaggagggcttcgacagagaggccagagtgaagctggccaaggagggcatcggcctgaagagaagagcctggcccgaggtgggcagagccaagatccagggcagaagcctgagagacgccctgagacacggcagagtgagcggcagagacctgagagagagagcctggagcttcggcaagggcagattctgggtggtgggcgccggccccgaggtgctgatcagcgccggcagatggaagagcagatag

SEQ ID NO: 24060 - DNA, 1293 bp, Artificial Sequence
  Description of Artificial Sequence: Synthetic coding sequence
atggccgtgctggccagacagctgcagagactgctgtggaccgcctgcaagaagaaggagagagagaaggagggcagagaggaggaggaggaggaggaggccggcagaagagcccccgagggccccagaagcctgctgaccgcccccagaagagcccagagaccccacggcggcgccgaggccagcggcggcctgagattcggcgccagcgccgcccagggctggagagccagaatggaggacgcccactgcacctggctgagcctgcccggcctgccccccggctgggccctgttcgccgtgctggacggccacggcggcgccagagccgccagattcggcgccagacacctgcccggccacgtgctgcaggagctgggccccgagcccagcgagcccgagggcgtgagagaggccctgagaagagccttcctgagcgccgacgagagactgagaagcctgtggcccagagtggagaccggcggctgcaccgccgtggtgctgctggtgagccccagattcctgtacctggcccactgcggcgacagcagagccgtgctgagcagagccggcgccgtggccttcagcaccgaggaccacagacccctgagacccagagagagagagagaatccacgccgccggcggcaccatcagaagaagaagagtggagggcagcctggccgtgagcagagccctgggcgacttcacctacaaggaggcccccggcagaccccccgagctgcagctggtgagcgccgagcccgaggtggccgccctggccagacaggccgaggacgagttcatgctgctggccagcgacggcgtgtgggacaccgtgagcggcgccgccctggccggcctggtggccagcagactgagactgggcctggcccccgagctgctgtgcgcccagctgctggacacctgcctgtgcaagggcagcctggacaacatgacctgcatcctggtgtgcttccccggcgcccccagacccagcgaggaggccatcagaagagagctggccctggacgccgccctgggctgcagaatcgccgagctgtgcgccagcgcccagaagccccccagcctgaacaccgtgttcagaaccctggccagcgaggacatccccgacctgccccccggcggcggcctggactgcaaggccaccgtgatcgccgaggtgtacagccagatctgccaggtgagcgaggagtgcggcgagaagggccaggacggcgccggcaagagcaaccccacccacctgggcagcgccctggacatggaggcctag

SEQ ID NO: 24061 - DNA, 1209 bp, Artificial Sequence
  Description of Artificial Sequence: Synthetic coding sequence
atggccgagaccagcgaggaggtggccgtgctggtgcagagagtggtgaaggacatcaccaacgccttcagaagaaacccccacatcgacgagatcggcctgatcccctgccccgaggccagatacaacagaagccccatcgtgctggtggagaacaagctgggcgtggagagctggtgcgtgaagttcctgctgccctacgtgcacaacaagctgctgctgtacagaaccagaaagcagtggctgaacagagacgagctgatcgacgtgacctgcaccctgctgctgctgaaccccgacttcaccaccgcctggaacgtgagaaaggagctgatcctgagcggcaccctgaaccccatcaaggacctgcacctgggcaagctggccctgaccaagttccccaagagccccgagacctggatccacagaagatgggtgctgcagcagctgatccaggagaccagcctgcccagcttcgtgaccaagggcaacctgggcaccatccccaccgagagagcccagagactgatccaggaggagatggaggtgtgcggcgaggccgccggcagataccccagcaactacaacgcctggagccacagaatctgggtgctgcagcacctggccaagctggacgtgaagatcctgctggacgagctgagcagcaccaagcactgggccagcatgcacgtgagcgaccacagcggcttccactacagacagttcctgctgaagagcctgatcagccagaccgtgatcgacagcagcgtgatggagcagaaccccctgagaagcgagcccgccctggtgccccccaaggacgaggaggccgccgtgagcaccgaggagcccagaatcaacctgccccacctgctggaggaggaggtggagttcagcaccgacctgatcgacagctaccccggccacgagaccctgtggtgccacagaagacacatcttctacctgcagcaccacctgaacgccggcagccagctgagccaggccatggaggtggacggcctgaacgacagcagcaagcagggctacagccaggagaccaagagactgaagagaacccccgtgcccgacagcctgggcctggagatggagcacagattcatcgaccaggtgctgagcacctgcagaaacgtggagcaggccagattcgccagcgcctacagaaagtggctggtgaccctgagccagtag

SEQ ID NO: 24062 - DNA, 1158 bp, Artificial Sequence
  Description of Artificial Sequence: Synthetic coding sequence
atgggctgcggcgccagcagaaaggtggtgcccggcccccccgccctggcctgggccaagcacgagggccagaaccaggccggcgtgggcggcgccggccccggccccgaggccgccgcccaggccgcccagagaatccaggtggccagattcagagccaagttcgaccccagagtgctggccagatacgacatcaaggccctgatcggcaccggcagcttcagcagagtggtgagagtggagcagaagaccaccaagaagcccttcgccatcaaggtgatggagaccagagagagagagggcagagaggcctgcgtgagcgagctgagcgtgctgagaagagtgagccacagatacatcgtgcagctgatggagatcttcgagaccgaggaccaggtgtacatggtgatggagctggccaccggcggcgagctgttcgacagactgatcgcccagggcagcttcaccgagagagacgccgtgagaatcctgcagatggtggccgacggcatcagatacctgcacgccctgcagatcacccacagaaacctgaagcccgagaacctgctgtactaccaccccggcgaggagagcaagatcctgatcaccgacttcggcctggcctacagcggcaagaagagcggcgactggaccatgaagaccctgtgcggcacccccgagtacatcgcccccgaggtgctgctgagaaagccctacaccagcgccgtggacatgtgggccctgggcgtgatcacctacgccctgctgagcggcttcctgcccttcgacgacgagagccagaccagactgtacagaaagatcctgaagggcaagtacaactacaccggcgagccctggcccagcatcagccacctggccaaggacttcatcgacaagctgctgatcctggaggccggccacagaatgagcgccggccaggccctggaccacccctgggtgatcaccatggccgccggcagcagcatgaagaacctgcagagagccatcagcagaaacctgatgcagagagccagcccccacagccagagccccggcagcgcccagagcagcaagagccactacagccacaagagcagacacatgtggagcaagagaaacctgagaatcgtggagagccccctgagcgccctgctgtag

SEQ ID NO: 24063 - DNA, 2265 bp, Artificial Sequence
  Description of Artificial Sequence: Synthetic coding sequence
atggccgccggcgtgctgccccagaacgagcagccctacagcaccctggtgaacaacagcgagtgcgtggccaacatgaagggcaacctggagagacccacccccaagtacaccaaggtgggcgagagactgagacacgtgatccccggccacatggcctgcagcatggcctgcggcggcagagcctgcaagtacgagaaccccgccagatggagcgagcaggagcaggccatcaagggcgtgtacagcagctgggtgaccgacaacatcctggccatggccagacccagcagcgagctgctggagaagtaccacatcatcgaccagttcctgagccacggcatcaagaccatcatcaacctgcagagacccggcgagcacgccagctgcggcaaccccctggagcaggagagcggcttcacctacctgcccgaggccttcatggaggccggcatctacttctacaacttcggctggaaggactacggcgtggccagcctgaccaccatcctggacatggtgaaggtgatgaccttcgccctgcaggagggcaaggtggccatccactgccacgccggcctgggcagaaccggcgtgctgatcgcctgctacctggtgttcgccaccagaatgaccgccgaccaggccatcatcttcgtgagagccaagagacccaacagcatccagaccagaggccagctgctgtgcgtgagagagttcacccagttcctgacccccctgagaaacatcttcagctgctgcgaccccaaggcccacgccgtgaccctgccccagtacctgatcagacagagacacctgctgcacggctacgaggccagactgctgaagcacgtgcccaagatcatccacctggtgtgcaagctgctgctggacctggccgagaacagacccgtgatgatgaaggacgtgagcgagggccccggcctgagcgccgagatcgagaagaccatgagcgagatggtgaccatgcagctggacaaggagctgctgagacacgacagcgacgtgagcaacccccccaaccccaccgccgtggccgccgacttcgacaacagaggcatgatcttcagcaacgagcagcagttcgaccccctgtggaagagaagaaacgtggagtgcctgcagcccctgacccacctgaagagaagactgagctacagcgacagcgacctgaagagagccgagaacctgctggagcagggcgagaccccccagaccgtgcccgcccagatcctggtgggccacaagcccagacagcagaagctgatcagccactgctacatcccccagagccccgagcccgacctgcacaaggaggccctggtgagaagcaccctgagcttctggagccagagcaagttcggcggcctggagggcctgaaggacaacggcagccccatcttccacggcagaatcatccccaaggaggcccagcagagcggcgccttcagcgccgacgtgagcggcagccacagccccggcgagcccgtgagccccagcttcgccaacgtgcacaaggaccccaaccccgcccaccagcaggtgagccactgccagtgcaagacccacggcgtgggcagccccggcagcgtgagacagaacagcagaacccccagaagccccctggactgcggcagcagccccaaggcccagttcctggtggagcacgagacccaggacagcaaggacctgagcgaggccgccagccacagcgccctgcagagcgagctgagcgccgaggccagaagaatcctggccgccaaggccctggccaacctgaacgagagcgtggagaaggaggagctgaagagaaaggtggagatgtggcagaaggagctgaacagcagagacggcgcctgggagagaatctgcggcgagagagaccccttcatcctgtgcagcctgatgtggagctgggtggagcagctgaaggagcccgtgatcaccaaggaggacgtggacatgctggtggacagaagagccgacgccgccgaggccctgttcctgctggagaagggccagcaccagaccatcctgtgcgtgctgcactgcatcgtgaacctgcagaccatccccgtggacgtggaggaggccttcctggcccacgccatcaaggccttcaccaaggtgaacttcgacagcgagaacggccccaccgtgtacaacaccctgaagaagatcttcaagcacaccctggaggagaagagaaagatgaccaaggacggccccaagcccggcctgtag

SEQ ID NO: 24064 - DNA, 2421 bp, Artificial Sequence
  Description of Artificial Sequence: Synthetic coding sequence
atgcaggtgcaggacgccaccagaagacccagcgccgtgagattcctgagcagcttcctgcagggcagaagacacagcaccagcgaccccgtgctgagactgcagcaggccagaagaggcagcggcctgggcagcggcagcgccaccaagctgctgagcagcagcagcctgcaggtgatggtggccgtgagcagcgtgagccacgccgagggcaaccccaccttccccgagagaaagagaaacctggagagacccacccccaagtacaccaaggtgggcgagagactgagacacgtgatccccggccacatggcctgcagcatggcctgcggcggcagagcctgcaagtacgagaaccccgccagatggagcgagcaggagcaggccatcaagggcgtgtacagcagctgggtgaccgacaacatcctggccatggccagacccagcagcgagctgctggagaagtaccacatcatcgaccagttcctgagccacggcatcaagaccatcatcaacctgcagagacccggcgagcacgccagctgcggcaaccccctggagcaggagagcggcttcacctacctgcccgaggccttcatggaggccggcatctacttctacaacttcggctggaaggactacggcgtggccagcctgaccaccatcctggacatggtgaaggtgatgaccttcgccctgcaggagggcaaggtggccatccactgccacgccggcctgggcagaaccggcgtgctgatcgcctgctacctggtgttcgccaccagaatgaccgccgaccaggccatcatcttcgtgagagccaagagacccaacagcatccagaccagaggccagctgctgtgcgtgagagagttcacccagttcctgacccccctgagaaacatcttcagctgctgcgaccccaaggcccacgccgtgaccctgccccagtacctgatcagacagagacacctgctgcacggctacgaggccagactgctgaagcacgtgcccaagatcatccacctggtgtgcaagctgctgctggacctggccgagaacagacccgtgatgatgaaggacgtgagcgagggccccggcctgagcgccgagatcgagaagaccatgagcgagatggtgaccatgcagctggacaaggagctgctgagacacgacagcgacgtgagcaacccccccaaccccaccgccgtggccgccgacttcgacaacagaggcatgatcttcagcaacgagcagcagttcgaccccctgtggaagagaagaaacgtggagtgcctgcagcccctgacccacctgaagagaagactgagctacagcgacagcgacctgaagagagccgagaacctgctggagcagggcgagaccccccagaccgtgcccgcccagatcctggtgggccacaagcccagacagcagaagctgatcagccactgctacatcccccagagccccgagcccgacctgcacaaggaggccctggtgagaagcaccctgagcttctggagccagagcaagttcggcggcctggagggcctgaaggacaacggcagccccatcttccacggcagaatcatccccaaggaggcccagcagagcggcgccttcagcgccgacgtgagcggcagccacagccccggcgagcccgtgagccccagcttcgccaacgtgcacaaggaccccaaccccgcccaccagcaggtgagccactgccagtgcaagacccacggcgtgggcagccccggcagcgtgagacagaacagcagaacccccagaagccccctggactgcggcagcagccccaaggcccagttcctggtggagcacgagacccaggacagcaaggacctgagcgaggccgccagccacagcgccctgcagagcgagctgagcgccgaggccagaagaatcctggccgccaaggccctggccaacctgaacgagagcgtggagaaggaggagctgaagagaaaggtggagatgtggcagaaggagctgaacagcagagacggcgcctgggagagaatctgcggcgagagagaccccttcatcctgtgcagcctgatgtggagctgggtggagcagctgaaggagcccgtgatcaccaaggaggacgtggacatgctggtggacagaagagccgacgccgccgaggccctgttcctgctggagaagggccagcaccagaccatcctgtgcgtgctgcactgcatcgtgaacctgcagaccatccccgtggacgtggaggaggccttcctggcccacgccatcaaggccttcaccaaggtgaacttcgacagcgagaacggccccaccgtgtacaacaccctgaagaagatcttcaagcacaccctggaggagaagagaaagatgaccaaggacggccccaagcccggcctgtag

SEQ ID NO: 24065 - DNA, 438 bp, Artificial Sequence
  Description of Artificial Sequence: Synthetic coding sequence
atgtggaccgccagaggccccttcagaagagacagatggagcagcgaggacgaggaggccgccggccccagccaggccctgagccccctgctgagcgacaccagaaagatcgtgagcgagggcgagctggaccagctggcccagatcagacccctgatcttcaacttccacgagcagaccgccatcaaggactgcctgaagatcctggaggagaagaccgccgcctacgacatcatgcaggagttcatggccctggagctgaagaacctgcccggcgagttcaacagcggcaaccagcccagcaacagagagaagaacagatacagagacatcctgcccttccagcaccacggctacagcggccccaacgagagaaccaccttctggcacggcagcaacgagggcgccgtgagcctgctgctgagatactgcgcctag

SEQ ID NO: 24066 - DNA, 681 bp, Artificial Sequence
  Description of Artificial Sequence: Synthetic coding sequence
atgagcagccccagagacttcagagccgagcccgtgaacgactacgagggcaacgacagcgaggccgaggacctgaacttcagagagaccctgcccagcagcagccaggagaacacccccagaagcaaggtgttcgagaacaaggtgaacagcgagaaggtgaagctgagcctgagaaacttcccccacaacgactacgaggacgtgttcgaggagcccagcgagagcggcagcgaccccagcatgtggaccgccagaggccccttcagaagagacagatggagcagcgaggacgaggaggccgccggccccagccaggccctgagccccctgctgagcgacaccagaaagatcgtgagcgagggcgagctggaccagctggcccagatcagacccctgatcttcaacttccacgagcagaccgccatcaaggactgcctgaagatcctggaggagaagaccgccgcctacgacatcatgcaggagttcatggccctggagctgaagaacctgcccggcgagttcaacagcggcaaccagcccagcaacagagagaagaacagatacagagacatcctgcccttccagcaccacggctacagcggccccaacgagagaaccaccttctggcacggcagcaacgagggcgccgtgagcctgctgctgagatactgcgcctag

SEQ ID NO: 24067 - DNA, 1020 bp, Artificial Sequence
  Description of Artificial Sequence: Synthetic coding sequence
atgtggaccgccagaggccccttcagaagagacagatggagcagcgaggacgaggaggccgccggccccagccaggccctgagccccctgctgagcgacaccagaaagatcgtgagcgagggcgagctggaccagctggcccagatcagacccctgatcttcaacttccacgagcagaccgccatcaaggactgcctgaagatcctggaggagaagaccgccgcctacgacatcatgcaggagttcatggccctggagctgaagaacctgcccggcgagttcaacagcggcaaccagcccagcaacagagagaagaacagatacagagacatcctgccctacgacagcaccagagtgcccctgggcaagagcaaggactacatcaacgccagctacatcagaatcgtgaactgcggcgaggagtacttctacatcgccacccagggccccctgctgagcaccatcgacgacttctggcagatggtgctggagaacaacagcaacgtgatcgccatgatcaccagagagatcgagggcggcatcatcaagtgctaccactactggcccatcagcctgaagaagcccctggagctgaagcacttcagagtgttcctggagaactaccagatcctgcagtacttcatcatcagaatgttccaggtggtggagaagagcaccggcaccagccacagcgtgaagcagctgcagttcaccaagtggcccgaccacggcacccccgccagcgccgacagcttcatcaagtacatcagatacgccagaaagagccacctgaccggccccatggtggtgcactgcagcgccggcatcggcagaaccggcgtgttcctgtgcgtggacgtggtgttctgcgccatcgtgaagaactgcagcttcaacatcatggacatcgtggcccagatgagagagcagagaagcggcatggtgcagaccaaggagcagtaccacttctgctacgacatcgtgctggaggtgctgagaaagctgctgaccctggactag

SEQ ID NO: 24068 - DNA, 1137 bp, Artificial Sequence
  Description of Artificial Sequence: Synthetic coding sequence
agcttcagccccagactgtgcagcgtgaacgactacgagggcaacgacagcgaggccgaggacctgaacttcagagaggccctgcccagcagcagccaggagaacacccccagaagcaaggtgttcgagaacaaggtgaacagcgagaaggtgaagctgagcctgagaaacttcccccacaacgactacgaggacgtgttcgaggagcccagcgagagcggcagcgaccccagcatgtggaccgccagaggccccttcggcagagacagatggagcagcgaggacgaggaggccgccggccccagccaggccctgagccccctgctgagcgacaccagaaagatcgtgagcgagggcgagctggaccagctggcccagatcagacccctgatcttcaacttccacgagcagaccgccatcaaggactgcctgaagatcctggaggagaagaccgccgcctacgacatcatgcaggagttcatggccctggagctgaagaacctgcccggcgagttcaacagcggcaaccagcccagcaacagagagaagaacagatacagagacatcctgccctacgacagcaccagagtgcccctgggcaagagcaaggactacatcaacgccagctacatcagaatcgtgaactgcggcgaggagtacttctacatcgccacccagggccccctgctgagcaccatcgacgacttctggcagatggtgctggagaacaacagcaacgtgatcgccatgatcaccagagagatcgagggcggcatcatcaagtgctaccactactggcccatcagcctgaagaagcccctggagctgaagcacttcagagtgttcctggagaactaccagatcctgcagtacttcatcatcagaatgttccaggtggtggagaagagcaccggcaccagccacagcgtgaagcagctgcagttcaccaagtggcccgaccacggcacccccgccagcgccgacagcttcatcaagtacatcagatacgccagaaagagccacctgaccggccccatggtggtgcactgcagcgccggcatcggcagaaccggcgtgttcctgtgcgtggacgtggtgttctgcgccatcgtgaagaactgcagcgtgagcgtgtag

SEQ ID NO: 24069 - DNA, 279 bp, Artificial Sequence
  Description of Artificial Sequence: Synthetic coding sequence
tgaggccccaactggagaggctgctggggctgcagcggcaccgtgggcgccgccccccaggcccaggtgttcgagaacaaggtgaacagcgagaaggtgaagctgagcctgagaaacttcccccacaacgactacgaggacgtgttcgaggagcccagcgagagcggcagcgaccccagcatgtggaccgccagaggccccttcggcagagacagatggagcagcgaggacgaggaggccgccggccccagccaggccctgagccccctgctgagctag

SEQ ID NO: 24070 - DNA, 342 bp, Artificial Sequence
  Description of Artificial Sequence: Synthetic coding sequence
atgagcagccccagagacttcagagccgagagcgtgaacgactacgagggcaacgacagcgaggccgaggacctgaacttcagagaggccctgcccagcagcagccaggagaacacccccagaagcaaggtgttcgagaacaaggtgaacagcgagaaggtgaagctgagcctgagaaacttcccccacaacgactacgaggacgtgttcgaggagcccagcgagagcggcagcgaccccagcatgtggaccgccagaggccccttcggcagagacagatggagcagcgaggacgaggaggccgccggccccagccaggccctgagccccctgctgagctag

SEQ ID NO: 24071 - DNA, 924 bp, Artificial Sequence
  Description of Artificial Sequence: Synthetic coding sequence
atggagaaccaggtgctgaccccccacgtgtactgggcccagagacacagagagctgtacctgagagtggagctgagcgacgtgcagaaccccgccatcagcatcaccgagaacgtgctgcacttcaaggcccagggccacggcgccaagggcgacaacgtgtacgagttccacctggagttcctggacctggtgaagcccgaggaggaggagagactgaacaagctgagactggagagcgagggcagccccgagaccctgaccaacctgagaaagggctacctgttcatgtacaacctggtgcagttcctgggcttcagctggatcttcgtgaacctgaccgtgagattctgcatcctgggcaaggagagcttctacgacaccttccacaccgtggccgacatgatgtacttctgccagatgctggccgtggtggagaccatcaacgccgccatcggcgtgaccaccagccccgtgctgcccagcctgatccagctgctgggcagaaacttcatcctgttcatcatcttcggcaccatggaggagatgcagaacaaggccgtggtgttcttcgtgttctacctgtggagcgccatcgagatcttcagatacagcttctacatgctgacctgcatcgacatggactggaaggtgctgacctggctgagatacaccctgtggatccccctgtaccccctgggctgcctggccgaggccgtgagcgtgatccagagcatccccatcttcaacgagaccggcagattcagcttcaccctgccctaccccgtgaagatcaaggtgagattcagcttcttcctgcagatctacctgatcatgatcttcctgggcctgtacatcaacttcagacacctgtacaagcagagaagaagaagatacggccagaagaagaagaagatccactag

SEQ ID NO: 24072 - DNA, 1932 bp, Artificial Sequence
  Description of Artificial Sequence: Synthetic coding sequence
atgagaaccctgagaagactgaagttcatgagcagccccagcctgagcgacctgggcaagagagagcccgccgccgccgccgacgagagaggcacccagcagagaagagcctgcgccaacgccacctggaacagcatccacaacggcgtgatcgccgtgttccagagaaagggcctgcccgaccaggagctgttcagcctgaacgagggcgtgagacagctgctgaagaccgagctgggcagcttcttcaccgagtacctgcagaaccagctgctgaccaagggcatggtgatcctgagagacaagatcagattctacgagggccagaagctgctggacagcctggccgagacctgggacttcttcttcagcgacgtgctgcccatgctgcaggccatcttctaccccgtgcagggcaaggagcccagcgtgagacagctggccctgctgcacttcagaaacgccatcaccctgagcgtgaagctggaggacgccctggccagagcccacgccagagtgccccccgccatcgtgcagatgctgctggtgctgcagggcgtgcacgagagcagaggcgtgaccgaggactacctgagactggagaccctggtgcagaaggtggtgagcccctacctgggcacctacggcctgcacagcagcgagggccccttcacccacagctgcatcctggagctgcagagagacaaggccgccgccgccgccgtgctgggcgccgtgagaaagagacccagcgtggtgcccatggccggccaggaccccgccctgagcaccagccaccccttctacgacgtggccagacacggcatcctgcaggtggccggcgacgacagattcggcagaagagtggtgaccttcagctgctgcagaatgccccccagccacgagctggaccaccagagactgctggagtacaagaagaacctgaaggccctgtacgtggtgcaccccaccagcttcatcaaggtgctgtggaacatcctgaagcccctgatcagccacaagttcggcaagaaggtgatctacttcaactacctgagcgagctgcacgagcacctgaagtacgaccagctggtgatcccccccgaggtgctgagatacgacgagaagctgcagagcctgcacgagggcagaacccccccccccaccaagacccccccccccagaccccccctgcccacccagcagttcggcgtgagcctgcagtacctgaaggacaagaaccagggcgagctgatcccccccgtgctgagattcaccgtgacctacctgagagagaagggcctgagaaccgagggcctgttcagaagaagcgccagcgtgcagaccgtgagagagatccagagactgtacaaccagggcaagcccgtgaacttcgacgactacggcgacatccacatccccgccgtgatcctgaagaccttcctgagagagctgccccagcccctgctgaccttccaggcctacgagcagatcctgggcatcacctgcgtggagagcagcctgagagtgaccggctgcagacagatcctgagaagcctgcccgagcacaactacgtggtgctgagatacctgatgggcttcctgcacgccgtgagcagagagagcatcttcaacaagatgaacagcagcaacctggcctgcgtgttcggcctgaacctgatctggcccagccagggcgtgagcagcctgagcgccctggtgcccctgaacatgttcaccgagctgctgatcgagtactacgagaagatcttcagcacccccgaggcccccggcgagcacggcctggccccctgggagcagggcagcagagccgcccccctgcaggaggccgtgcccagaacccaggccaccggcctgaccaagcccaccctgccccccagccccctgatggccgccagaagaagactgtag

SEQ ID NO: 24073 - DNA, 1695 bp, Artificial Sequence
  Description of Artificial Sequence: Synthetic coding sequence
atgagaaccctgagaagactgaagttcatgagcagccccagcctgagcgacctgggcaagagagagcccgccgccgccgccgacgagagaggcacccagcagagaagagcctgcgccaacgccacctggaacagcatccacaacggcgtgatcgccgtgttccagagaaagggcctgcccgaccaggagctgttcagcctgaacgagggcgtgagacagctgctgaagaccgagctgggcagcttcttcaccgagtacctgcagaaccagctgctgaccaagggcatggtgatcctgagagacaagatcagattctacgaggagctgcagagagacaaggccgccgccgccgccgtgctgggcgccgtgagaaagagacccagcgtggtgcccatggccggccaggaccccgccctgagcaccagccaccccttctacgacgtggccagacacggcatcctgcaggtggccggcgacgacagattcggcagaagagtggtgaccttcagctgctgcagaatgccccccagccacgagctggaccaccagagactgctggagtacctgaagtacaccctggaccagtacgtggagaacgactacaccatcgtgtacttccactacggcctgaacagcagaaacaagcccagcctgggctggctgcagagcgcctacaaggagttcgacagaaagtacaagaagaacctgaaggccctgtacgtggtgcaccccaccagcttcatcaaggtgctgtggaacatcctgaagcccctgatcagccacaagttcggcaagaaggtgatctacttcaactacctgagcgagctgcacgagcacctgaagtacgaccagctggtgatcccccccgaggtgctgagatacgacgagaagctgcagagcctgcacgagggcagaacccccccccccaccaagacccccccccccagaccccccctgcccacccagcagttcggcgtgagcctgcagtacctgaaggacaagaaccagggcgagctgatcccccccgtgctgagattcaccgtgacctacctgagagagaagggcctgagaaccgagggcctgttcagaagaagcgccagcgtgcagaccgtgagagagatccagagactgtacaaccagggcaagcccgtgaacttcgacgactacggcgacatccacatccccgccgtgatcctgaagaccttcctgagagagctgccccagcccctgctgaccttccaggcctacgagcagatcctgggcatcacctgcgtggagagcagcctgagagtgaccggctgcagacagatcctgagaagcctgcccgagcacaactacgtggtgctgagatacctgatgggcttcctgcacgccgtgagcagagagagcatcttcaacaagatgaacagcagcaacctggcctgcgtgttcggcctgaacctgatctggcccagccagggcgtgagcagcctgagcgccctggtgcccctgaacatgttcaccgagctgctgatcgagtactacgagaagatcttcagcacccccgaggcccccggcgagcacggcctggccccctgggagcagggcagcagagccgcccccctgcaggaggccgtgcccagaacccaggccaccggcctgaccaagcccaccctgccccccagccccctgatggccgccagaagaagactgtag

SEQ ID NO: 24074 - DNA, 1515 bp, Artificial Sequence
  Description of Artificial Sequence: Synthetic coding sequence
tgactgggcagcttcttcaccgagtacctgcagaaccagctgctgaccaagggcatggtgatcctgagagacaagatcagattctacgaggagctgcagagagacaaggccgccgccgccgccgtgctgggcgccgtgagaaagagacccagcgtggtgcccatggccggccaggaccccgccctgagcaccagccaccccttctacgacgtggccagacacggcatcctgcaggtggccggcgacgacagattcggcagaagagtggtgaccttcagctgctgcagaatgccccccagccacgagctggaccaccagagactgctggagtacctgaagtacaccctggaccagtacgtggagaacgactacaccatcgtgtacttccactacggcctgaacagcagaaacaagcccagcctgggctggctgcagagcgcctacaaggagttcgacagaaagtacaagaagaacctgaaggccctgtacgtggtgcaccccaccagcttcatcaaggtgctgtggaacatcctgaagcccctgatcagccacaagttcggcaagaaggtgatctacttcaactacctgagcgagctgcacgagcacctgaagtacgaccagctggtgatcccccccgaggtgctgagatacgacgagaagctgcagagcctgcacgagggcagaacccccccccccaccaagacccccccccccagaccccccctgcccacccagcagttcggcgtgagcctgcagtacctgaaggacaagaaccagggcgagctgatcccccccgtgctgagattcaccgtgacctacctgagagagaagggcctgagaaccgagggcctgttcagaagaagcgccagcgtgcagaccgtgagagagatccagagactgtacaaccagggcaagcccgtgaacttcgacgactacggcgacatccacatccccgccgtgatcctgaagaccttcctgagagagctgccccagcccctgctgaccttccaggcctacgagcagatcctgggcatcaccagcctgcccctggcccccctggagctgagcagagagccccacgccctgcccggcgtggagagcagcctgagagtgaccggctgcagacagatcctgagaagcctgcccgagcacaactacgtggtgctgagatacctgatgggcttcctgcacgccgtgagcagagagagcatcttcaacaagatgaacagcagcaacctggcctgcgtgttcggcctgaacctgatctggcccagccagggcgtgagcagcctgagcgccctggtgcccctgaacatgttcaccgagctgctgatcgagtactacgagaagatcttcagcacccccgaggcccccggcgagcacggcctggccccctgggagcagggcagcagagccgcccccctgcaggaggccgtgcccagaacccaggccaccggcctgaccaagcccaccctgccccccagccccctgatggccgccagaagaagactgtag

SEQ ID NO: 24075 - DNA, 1590 bp, Artificial Sequence
  Description of Artificial Sequence: Synthetic coding sequence
atgttccccctgaccgaggagaacaagcacgtggcccagctgctgctgaacaccggcacctgccccagatgcatcttcagattctgcggcgtggacttccacgccccctacaagctgccctacaaggagctgctgaacgagctgcagaagttcctggagaccgagaaggacgagctgatcctggaggtgatgaaccccccccccaagaagatcagactgcaggagctggaggacagcatcgacaacctgagccagaacggcgagggcagaatcagcgtgagccacgtgggcagcaccgccagcaagaacagcaacctgaacgtgtgcaacgtgtgcctgggcatcctgcaggagttctgcgagaaggacttcatcaagaaggtgtgccagaaggtggaggccagcggcttcgagttcaccagcctggtgttcagcgtgagcttccccccccagctgagcgtgagagagcacgccgcctggctgctggtgaagcaggagatgggcaagcagagcctgagcctgggcagagacgacatcgtgcagctgaaggaggcctacaagtggatcacccaccccctgttcagcgaggagctgggcgtgcccatcgacggcaagagcctgttcgaggtgagcgtggtgttcgcccaccccgagaccgtggaggactgccacttcctggccgccatctgccccgactgcttcaagcccgccaagaacaagcagagcgtgttcaccagaatggccgtgatgaaggccctgaacaagatcaaggaggaggacttcctgaagcagttcccctgcccccccaacagccccaaggccgtgtgcgccgtgctggagatcgagtgcgcccacggcgccgtgttcgtggccggcagatacaacaagtacagcagaaacctgccccagaccccctggatcatcgacggcgagagaaagctggagagcagcgtggaggagctgatcagcgaccacctgctggccgtgttcaaggccgagagcttcaacttcagcagcagcggcagagaggacgtggacgtgagaaccctgggcaacggcagacccttcgccatcgagctggtgaacccccacagagtgcacttcaccagccaggagatcaaggagctgcagcagaagatcaacaacagcagcaacaagatccaggtgagagacctgcagctggtgaccagagaggccatcggccacatgaaggagggcgaggaggagaagaccaagacctacagcgccctgatctggaccaacaaggccatccagaagaaggacatcgagttcctgaacgacatcaaggacctgaagatcgaccagaagacccccctgagagtgctgcacagaagacccctggccgtgagagccagagtgatccacttcatggagacccagtacgtggacgagcaccacttcagactgcacctgaagacccaggccggcacctacatcaaggagttcgtgcacggcgacttcggcagaaccaagcccaacatcggcagcctgatgaacgtgaccgccgacatcctggagctggacgtggagagcgtggacgtggactggccccccgccctggacgactag

SEQ ID NO: 24076 - DNA, 1590 bp, Artificial Sequence; identical to SEQ ID NO: 24075
  Description of Artificial Sequence: Synthetic coding sequence

SEQ ID NO: 24077 - DNA, 363 bp, Artificial Sequence
  Description of Artificial Sequence: Synthetic coding sequence
atgttccccctgaccgaggagaacaagcacgtggcccagctgctgctgaacaccggcacctgccccagatgcatcttcagattctgcggcgtggacttccacgccccctacaagctgccctacaaggagctgctgaacgagctgcagaagttcctggagaccgagaaggacgagctgatcctggaggtgatgaaccccccccccaagaagatcagactgcaggagctggaggacagcatcgacaacctgagccagaacggcgagggcagaatcagcgtgagccacgtgggcagcaccgccagcaagaacagcaacctgaacgtgtgcaacgtgtgcctgggcatcctgcaggagttctgctag

SEQ ID NO: 24078 - DNA, 1986 bp, Artificial Sequence
  Description of Artificial Sequence: Synthetic coding sequence
atggagatgaccgagatgaccggcgtgagcctgaagagaggcgccctggtggtggaggacaacgacagcggcgtgcccgtggaggagaccaagaagcagaagctgagcgagtgcagcctgaccaagggccaggacggcctgcagaacgacttcctgagcatcagcgaggacgtgcccagaccccccgacaccgtgagcaccggcaagggcggcaagaacagcgaggcccagctggaggacgaggaggaggaggaggaggacggcctgagcgaggagtgcgaggaggaggagagcgagagcttcgccgacatgatgaagcacggcctgaccgaggccgacgtgggcatcaccaagttcgtgagcagccaccagggcttcagcggcatcctgaaggagagatacagcgacttcgtggtgcacgagatcggcaaggacggcagaatcagccacctgaacgacctgagcatccccgtggacgaggaggaccccagcgaggacatcttcaccgtgctgaccgccgaggagaagcagagactggaggagctgcagctgttcaagaacaaggagaccagcgtggccatcgaggtgatcgaggacaccaaggagaagagaaccatcatccaccaggccatcaagagcctgttccccggcctggagaccaagaccgaggacagagagggcaagaagtacatcgtggcctaccacgccgccggcaagaaggccctggccaaccccagaaagcacagctggcccaagagcagaggcagctactgccacttcgtgctgtacaaggagaacaaggacaccatggacgccatcaacgtgctgagcaagtacctgagagtgaagcccaacatcttcagctacatgggcaccaaggacaagagagccatcaccgtgcaggagatcgccgtgctgaagatcaccgcccagagactggcccacctgaacaagtgcctgatgaacttcaagctgggcaacttcagctaccagaagaaccccctgaagctgggcgagctgcagggcaaccacttcaccgtggtgctgagaaacatcaccggcaccgacgaccaggtgcagcaggccatgaacagcctgaaggagatcggcttcatcaactactacggcatgcagagattcggcaccaccgccgtgcccacctaccaggtgggcagagccatcctgcagaacagctggaccgaggtgatggacctgatcctgaagcccagaagcggcgccgagaagggctacctggtgaagtgcagagaggagtgggccaagaccaaggaccccaccgccgccctgagaaagctgcccgtgaagagatgcgtggagggccagctgctgagaggcctgagcaagtacggcatgaagaacatcgtgagcgccttcggcatcatccccagaaacaacagactgatgtacatccacagctaccagagctacgtgtggaacaacatggtgagcaagagaatcgaggactacggcctgaagcccgtgcccggcgacctggtgctgaagggcgccaccgccacctacatcgaggaggacgacgtgaacaactacagcatccacgacgtggtgatgcccctgcccggcttcgacgtgatctaccccaagcacaagatccaggaggcctacagagagatgctgaccgccgacaacctggacatcgacaacatgagacacaagatcagagactacagcctgagcggcgcctacagaaagatcatcatcagaccccagaacgtgagctgggaggtggtggcctacgacgaccccaagatccccctgttcaacaccgacgtggacaacctggagggcaagaccccccccgtgttcgccagcgagggcaagtacagagccctgaagatggacttcagcctgccccccagcacctacgccaccatggccatcagagaggtgctgaagatggacaccagcatcaagaaccagacccagctgaacaccacctggctgagatag

SEQ ID NO: 24079 - DNA, 1986 bp, Artificial Sequence; identical to SEQ ID NO: 24078
  Description of Artificial Sequence: Synthetic coding sequence

SEQ ID NO: 24080 - DNA, 1986 bp, Artificial Sequence; identical to SEQ ID NO: 24078
  Description of Artificial Sequence: Synthetic coding sequence

SEQ ID NO: 24081 - DNA, 2106 bp, Artificial Sequence
  Description of Artificial Sequence: Synthetic coding sequence
atggaggaggacaccgactacagaatcagattcagcagcctgtgcttcttcaacgaccacgtgggcttccacggcaccatcaagagcagccccagcgacttcatcgtgatcgagatcgacgagcagggccagctggtgaacaagaccatcgacgagcccatcttcaagatcagcgagatccagctggagcccaacaacttccccaagaagcccaagctggacctgcagaacctgagcctggaggacggcagaaaccaggaggtgcacaccctgatcaagtacaccgacggcgaccagaaccaccagagcggcagcgagaaggaggacaccatcgtggacggcaccagcaagtgcgaggagaaggccgacgtgctgagcagcttcctggacgagaagacccacgagctgctgaacaacttcgcctgcgacgtgagagagaagtggctgagcaagaccgagctgatcggcctgccccccgagttcagcatcggcagaatcctggacaagaaccagagagccagcctgcacagcgccatcagacagaagttccccttcctggtgaccgtgggcaagaacagcgagatcgtggtgaagcccaacctggagtacaaggagctgtgccacctggtgagcgaggaggaggccttcgacttcttcaagtacctggacgccaagaaggagaacagcaagttcaccttcaagcccgacaccaacaaggaccacagaaaggccgtgcaccacttcgtgaacaagaagttcggcaacctggtggagaccaagagcttcagcaagatgaactgcagcgccggcaaccccaacgtggtggtgaccgtgagattcagagagaaggcccacaagagaggcaagagacccctgagcgagtgccaggagggcaaggtgatctacaccgccttcaccctgagaaaggagaacctggagatgttcgaggccatcggcttcctggccatcaagctgggcgtgatccccagcgacttcagctacgccggcctgaaggacaagaaggccatcacctaccaggccatggtggtgagaaaggtgacccccgagagactgaagaacatcgagaaggagatcgagaagaagagaatgaacgtgttcaacatcagaagcgtggacgacagcctgagactgggccagctgaagggcaaccacttcgacatcgtgatcagaaacctgaagaagcagatcaacgacagcgccaacctgagagagagaatcatggaggccatcgagaacgtgaagaagaagggcttcgtgaactactacggcccccagagattcggcaagggcagaaaggtgcacaccgaccagatcggcctggccctgctgaagaacgagatgatgaaggccatcaagctgttcctgacccccgaggacctggacgaccccgtgaacagagccaagaagtacttcctgcagaccgaggacgccaagggcaccctgagcctgatgcccgagttcaaggtgagagagagagccctgctggaggccctgcacagattcggcatgaccgaggagggctgcatccaggcctggttcagcctgccccacagcatgagaatcttctacgtgcacgcctacaccagcaagatctggaacgaggccgtgagctacagactggagacctacggcgccagagtggtgcagggcgacctggtgtgcctggacgaggacatcgacgacgagaacttccccaacagcaagatccacctggtgaccgaggaggagggcagcgccaacatgtacgccatccaccaggtggtgctgcccgtgctgggctacaacatccagtaccccaagaacaaggtgggccagtggtaccacgacatcctgagcagagacggcctgcagacctgcagattcaaggtgcccaccctgaagctgaacatccccggctgctacagacagatcctgaagcacccctgcaacctgagctaccagctgatggaggaccacgacatcgacgtgaagaccaagggcagccacatcgacgagaccgccctgagcctgctgatcagcttcgacctggacgccagctgctacgccaccgtgtgcctgaaggagatcatgaagcacgacgtgtag

SEQ ID NO: 24082 - DNA, 2106 bp, Artificial Sequence; identical to SEQ ID NO: 24081
  Description of Artificial Sequence: Synthetic coding sequence

SEQ ID NO: 24083 - DNA, 381 bp, Artificial Sequence
  Description of Artificial Sequence: Synthetic coding sequence
atggaggaggacaccgactacagaatcagattcagcagcctgtgcttcttcaacgaccacgtgggcttccacggcaccatcaagagcagccccagcgacttcatcgtgatcgagatcgacgagcagggccagctggtgaacaagaccatcgacgagcccatcttcaagatcagcgagatccagctggagcccaacaacttccccaagaagcccaagctggacctgcagaacctgagcctggaggacggcagaaaccaggaggtgcacaccctgatcaagtacaccgacggcgaccagaaccaccagagcggcagcgagaaggaggacaccatcgtggacggcaccagcaagtgcgaggagaaggccgacgtgctgagctag

SEQ ID NO: 24084 - DNA, 2106 bp, Artificial Sequence; identical to SEQ ID NO: 24081
  Description of Artificial Sequence: Synthetic coding sequence

SEQ ID NO: 24085 - DNA, 1098 bp, Artificial Sequence
  Description of Artificial Sequence: Synthetic coding sequence
atggaggaggacaccgactacagaatcagattcagcagcctgtgcttcttcaacgaccacgtgggcttccacggcaccatcaagagcagccccagcgacttcatcgtgatcgagatcgacgagcagggccagctggtgaacaagaccatcgacgagcccatcttcaagatcagcgagatccagctggagcccaacaacttccccaagaagcccaagctggacctgcagaacctgagcctggaggacggcagaaaccaggaggtgcacaccctgatcaagtacaccgacggcgaccagaaccaccagagcggcagcgagaaggaggacaccatcgtggacggcaccagcaagtgcgaggagaaggccgacgtgctgagcagcttcctggacgagaagacccacgagctgctgaacaacttcgcctgcgacgtgagagagaagtggctgagcaagaccgagctgatcggcctgccccccgagttcagcatcggcagaatcctggacaagaaccagagagccagcctgcacagcgccatcagacagaagttccccttcctggtgaccgtgggcaagaacagcgagatcgtggtgaagcccaacctggagtacaaggagctgtgccacctggtgagcgaggaggaggccttcgacttcttcaagtacctggacgccaagaaggagaacagcaagttcaccttcaagcccgacaccaacaaggaccacagaaaggccgtgcaccacttcgtgaacaagaagttcggcaacctggtggagaccaagagcttcagcaagatgaactgcagcgccggcaaccccaacgtggtggtgaccgtgagattcagagagaaggcccacaagagaggcaagagacccctgagcgagtgccaggagggcaaggtgatctacaccgccttcaccctgagaaaggagaacctggagatgttcgaggccatcggcttcctggccatcaagctgggcgtgatccccagcgacttcagctacgccggcctgaaggacaagaaggccatcacctaccaggccatggtggtgagaaaggtgacccccgagagactgaagaacatcgagaaggagatctag

SEQ ID NO: 24086 - DNA, 912 bp, Artificial Sequence
  Description of Artificial Sequence: Synthetic coding sequence
atgagcagcgcccccgccagcggcagcgtgagagccagatacctggtgtacttccagtacgtgggcaccgacttcaacggcgtggccgccgtgagaggcacccagagagccgtgggcgtgcagaactacctggaggaggccgccgagagactgaacagcgtggagcccgtgagattcaccatcagcagcagaaccgacgccggcgtgcacgccctgagcaacgccgcccacctggacgtgcagagaagaagcggcagaccccccttcccccccgaggtgctggccgaggccctgaacacccacctgagacaccccgccatcagagtgctgagagccttcagagtgcccagcgacttccacgccagacacgccgccaccagcagaacctacctgtacagactggccaccggctgccacagaagagacgagctgcccgtgttcgagagaaacctgtgctggaccctgcccgccgactgcctggacatggtggccatgcaggaggccgcccagcacctgctgggcacccacgacttcagcgccttccagagcgccggcagccccgtgcccagccccgtgagaaccctgagaagagtgagcgtgagccccggccaggccagccccctggtgacccccgaggagagcagaaagctgagattctggaacctggagttcgagagccagagcttcctgtacagacaggtgagaagaatgaccgccgtgctggtggccgtgggcctgggcgccctggcccccgcccaggtgaagaccatcctggagagccaggaccccctgggcaagcaccagaccagagtggcccccgcccacggcctgttcctgaagagcgtgctgtacggcaacctgggcgccgccagctgcaccctgcagggcccccagttcggcagccacggctag

SEQ ID NO: 24087 - DNA, 216 bp, Artificial Sequence
  Description of Artificial Sequence: Synthetic coding sequence
atgggcgccaccggcctgggcttcctgctgagctggagacaggacaacctgaacggcaccgactgccagggctgcaacatcctgtacttcagcgagaccaccggcagcatgtgcagcgagctgagcctgaacagaggcctggaggccagaagaaagaaggacctgaaggacagcttcctgtggagagacggcgtgagcccctgcctgccctgctag

SEQ ID NO: 24088 - DNA, 444 bp, Artificial Sequence
  Description of Artificial Sequence: Synthetic coding sequence
atgggcgccaccggcctgggcttcctgctgagctggagacaggacaacctgaacggcaccgactgccagggctgcaacatcctgtacttcagcgagaccaccggcagcatgtgcagcgagctgagcctgaacagaggcctggaggccagaagaaagaaggacctgaaggacagcttcctgtggagatacggcaaggtgggctgcatcagcctgcccctgagagagatgaccgcctggatcaaccccccccagatcagcgagatcttccagggctaccaccagagagtgcacggcgccgacgccctgagcctgcagaccaacagcctgagaagcagactgagcagccagtgcctgggccagagcttcctgctgagaaccctggagagaggcagaggcttcagagccctgggcgacatctgcggccacgtgcacgaggaggactag

SEQ ID NO: 24089 - DNA, 444 bp, Artificial Sequence; identical to SEQ ID NO: 24088
  Description of Artificial Sequence: Synthetic coding sequence

SEQ ID NO: 24090 - DNA, 216 bp, Artificial Sequence; identical to SEQ ID NO: 24087
  Description of Artificial Sequence: Synthetic coding sequence

SEQ ID NO: 24091 - DNA, 2202 bp, Artificial Sequence
  Description of Artificial Sequence: Synthetic coding sequence
atgggcaagctgatcaccagaatgtggaagctgctgagaagaagaagcgcccccaaggagctgctgagcagaaccagcctggagacccagaagctggacctgatgaccgaggtgagcgagctgaagctgaagctggtgggcatggagaaggagcagagagagcaggaggagaagcagagaaaggccgaggagctgctgcaggagctgagacacctgaagatcaaggtggaggagctggagaacgagagaaaccagtacgagtggaagctgaaggccaccaaggccgaggtggcccagctgcaggagcaggtggccctgaaggacgccgagatcgagagactgcacagccagctgagcagaaccgccgccctgcacagcgagagccacaccgagagagaccaggagatccagagactgaagatgggcatggagaccctgctgctggccaacgaggacaaggacagaagaatcgaggagctgaccggcctgctgaaccagtacagaaaggtgaaggagatcgtgatggtgacccagggccccagcgagagaaccctgagcatcaacgaggaggagcccgagggcggcttcagcaagtggaacgccaccaacaaggaccccgaggagctgttcaagcaggagatgccccccagatgcagcagccccaccgtgggccccccccccctgccccagaagagcctggagaccagagcccagaagaagctgagctgcagcctggaggacctgagaagcgagagcgtggacaagtgcatggacggcaaccagcccttccccgtgctggagcccaaggacagccccttcctggccgagcacaagtaccccaccctgcccggcaagctgagcggcgccacccccaacggcgaggccgccaagagcccccccaccatctgccagcccgacgccaccggcagcagcctgctgagactgagagacaccgagagcggctgggacgacaccgccgtggtgaacgacctgagcagcaccagcagcggcaccgagagcggcccccagagccccctgacccccgacggcaagagaaaccccaagggcatcaagaagttctggggcaagatcagaagaacccagagcggcaacttctacaccgacaccctgggcatggccgagttcagaagaggcggcctgagagccaccgccggccccagactgagcagaaccagagacagcaagggccagaagagcgacgccaacgcccccttcgcccagtggagcaccgagagagtgtgcgcctggctggaggacttcggcctggcccagtacgtgatcttcgccagacagtgggtgagcagcggccacaccctgctgaccgccaccccccaggacatggagaaggagctgggcatcaagcaccccctgcacagaaagaagctggtgctggccgtgaaggccatcaacaccaagcaggaggagaagagcgccctgctggaccacatctgggtgaccagatggctggacgacatcggcctgccccagtacaaggaccagttccacgagagcagagtggacagaagaatgctgcagtacctgaccgtgaacgacctgctgttcctgaaggtgaccagccagctgcaccacctgagcatcaagtgcgccatccacgtgctgcacgtgaacaagttcaacccccactgcctgcacagaagacccgccgacgagagcaacctgagccccagcgaggtggtgcagtggagcaaccacagagtgatggagtggctgagaagcgtggacctggccgagtacgcccccaacctgagaggcagcggcgtgcacggcggcctgatcatcctggagcccagattcaccggcgacaccctggccatgctgctgaacatccccccccagaagaccctgctgagaagacacctgaccaccaagttcaacgccctgatcggccccgaggccgagcaggagaagagagagaagatggccagccccgcctacacccccctgaccaccaccgccaaggtgagacccagaaagctgggcttcagccacttcggcaacatcagaaagaagaagttcgacgagagcaccgactacatctgccccatggagcccagcgacggcgtgagcgacagccacagagtgtacagcggctacagaggcctgagccccctggacgcccccgagctggacggcctggaccaggtgggccagatcagctag

SEQ ID NO: 24092 - DNA, 2157 bp, Artificial Sequence
  Description of Artificial Sequence: Synthetic coding sequence
atgctgcagcaggagctgctgagcagaaccagcctggagacccagaagctggacctgatgaccgaggtgagcgagctgaagctgaagctggtgggcatggagaaggagcagagagagcaggaggagaagcagagaaaggccgaggagctgctgcaggagctgagacacctgaagatcaaggtggaggagctggagaacgagagaaaccagtacgagtggaagctgaaggccaccaaggccgaggtggcccagctgcaggagcaggtggccctgaaggacgccgagatcgagagactgcacagccagctgagcagaaccgccgccctgcacagcgagagccacaccgagagagaccaggagatccagagactgaagatgggcatggagaccctgctgctggccaacgaggacaaggacagaagaatcgaggagctgaccggcctgctgaaccagtacagaaaggtgaaggagatcgtgatggtgacccagggccccagcgagagaaccctgagcatcaacgaggaggagcccgagggcggcttcagcaagtggaacgccaccaacaaggaccccgaggagctgttcaagcaggagatgccccccagatgcagcagccccaccgtgggccccccccccctgccccagaagagcctggagaccagagcccagaagaagctgagctgcagcctggaggacctgagaagcgagagcgtggacaagtgcatggacggcaaccagcccttccccgtgctggagcccaaggacagccccttcctggccgagcacaagtaccccaccctgcccggcaagctgagcggcgccacccccaacggcgaggccgccaagagcccccccaccatctgccagcccgacgccaccggcagcagcctgctgagactgagagacaccgagagcggctgggacgacaccgccgtggtgaacgacctgagcagcaccagcagcggcaccgagagcggcccccagagccccctgacccccgacggcaagagaaaccccaagggcatcaagaagttctggggcaagatcagaagaacccagagcggcaacttctacaccgacaccctgggcatggccgagttcagaagaggcggcctgagagccaccgccggccccagactgagcagaaccagagacagcaagggccagaagagcgacgccaacgcccccttcgcccagtggagcaccgagagagtgtgcgcctggctggaggacttcggcctggcccagtacgtgatcttcgccagacagtgggtgagcagcggccacaccctgctgaccgccaccccccaggacatggagaaggagctgggcatcaagcaccccctgcacagaaagaagctggtgctggccgtgaaggccatcaacaccaagcaggaggagaagagcgccctgctggaccacatctgggtgaccagatggctggacgacatcggcctgccccagtacaaggaccagttccacgagagcagagtggacagaagaatgctgcagtacctgaccgtgaacgacctgctgttcctgaaggtgaccagccagctgcaccacctgagcatcaagtgcgccatccacgtgctgcacgtgaacaagttcaacccccactgcctgcacagaagacccgccgacgagagcaacctgagccccagcgaggtggtgcagtggagcaaccacagagtgatggagtggctgagaagcgtggacctggccgagtacgcccccaacctgagaggcagcggcgtgcacggcggcctgatcatcctggagcccagattcaccggcgacaccctggccatgctgctgaacatccccccccagaagaccctgctgagaagacacctgaccaccaagttcaacgccctgatcggccccgaggccgagcaggagaagagagagaagatggccagccccgcctacacccccctgaccaccaccgccaaggtgagacccagaaagctgggcttcagccacttcggcaacatcagaaagaagaagttcgacgagagcaccgactacatctgccccatggagcccagcgacggcgtgagcgacagccacagagtgtacagcggctacagaggcctgagccccctggacgcccccgagctggacggcctggaccaggtgggccagatcagctag

SEQ ID NO: 24093 - DNA, 2631 bp, Artificial Sequence
  Description of Artificial Sequence: Synthetic coding sequence
atggccagcgacgccagccacgccctggaggccgccctggagcagatggacggcatcatcgccggcaccaagaccggcgccgacctgagcgacggcacctgcgagcccggcctggccagccccgccagctacatgaaccccttccccgtgctgcacctgatcgaggacctgagactggccctggagatgctggagctgccccaggagagagccgccctgctgagccagatccccggccccaccgccgcctacatcaaggagtggttcgaggagagcctgagccaggtgaaccaccacagcgccgccagcaacgagacctaccaggagagactggccagactggagggcgacaaggagagcctgatcctgcaggtgagcgtgctgaccgaccaggtggaggcccagggcgagaagatcagagacctggaggtgtgcctggagggccaccaggtgaagctgaacgccgccgaggagatgctgcagcaggagctgctgagcagaaccagcctggagacccagaagctggacctgatgaccgaggtgagcgagctgaagctgaagctggtgggcatggagaaggagcagagagagcaggaggagaagcagagaaaggccgaggagctgctgcaggagctgagacacctgaagatcaaggtggaggagctggagaacgagagaaaccagtacgagtggaagctgaaggccaccaaggccgaggtggcccagctgcaggagcaggtggccctgaaggacgccgagatcgagagactgcacagccagctgagcagaaccgccgccctgcacagcgagagccacaccgagagagaccaggagatccagagactgaagatgggcatggagaccctgctgctggccaacgaggacaaggacagaagaatcgaggagctgaccggcctgctgaaccagtacagaaaggtgaaggagatcgtgatggtgacccagggccccagcgagagaaccctgagcatcaacgaggaggagcccgagggcggcttcagcaagtggaacgccaccaacaaggaccccgaggagctgttcaagcaggagatgccccccagatgcagcagccccaccgtgggccccccccccctgccccagaagagcctggagaccagagcccagaagaagctgagctgcagcctggaggacctgagaagcgagagcgtggacaagtgcatggacggcaaccagcccttccccgtgctggagcccaaggacagccccttcctggccgagcacaagtaccccaccctgcccggcaagctgagcggcgccacccccaacggcgaggccgccaagagcccccccaccatctgccagcccgacgccaccggcagcagcctgctgagactgagagacaccgagagcggctgggacgacaccgccgtggtgaacgacctgagcagcaccagcagcggcaccgagagcggcccccagagccccctgacccccgacggcaagagaaaccccaagggcatcaagaagttctggggcaagatcagaagaacccagagcggcaacttctacaccgacaccctgggcatggccgagttcagaagaggcggcctgagagccaccgccggccccagactgagcagaaccagagacagcaagggccagaagagcgacgccaacgcccccttcgcccagtggagcaccgagagagtgtgcgcctggctggaggacttcggcctggcccagtacgtgatcttcgccagacagtgggtgagcagcggccacaccctgctgaccgccaccccccaggacatggagaaggagctgggcatcaagcaccccctgcacagaaagaagctggtgctggccgtgaaggccatcaacaccaagcaggaggagaagagcgccctgctggaccacatctgggtgaccagatggctggacgacatcggcctgccccagtacaaggaccagttccacgagagcagagtggacagaagaatgctgcagtacctgaccgtgaacgacctgctgttcctgaaggtgaccagccagctgcaccacctgagcatcaagtgcgccatccacgtgctgcacgtgaacaagttcaacccccactgcctgcacagaagacccgccgacgagagcaacctgagccccagcgaggtggtgcagtggagcaaccacagagtgatggagtggctgagaagcgtggacctggccgagtacgcccccaacctgagaggcagcggcgtgcacggcggcctgatcatcctggagcccagattcaccggcgacaccctggccatgctgctgaacatccccccccagaagaccctgctgagaagacacctgaccaccaagttcaacgccctgatcggccccgaggccgagcaggagaagagagagaagatggccagccccgcctacacccccctgaccaccaccgccaaggtgagacccagaaagctgggcttcagccacttcggcaacatcagaaagaagaagttcgacgagagcaccgactacatctgccccatggagcccagcgacggcgtgagcgacagccacagagtgtacagcggctacagaggcctgagccccctggacgcccccgagctggacggcctggaccaggtgggccagatcagctag

SEQ ID NO: 24094 - DNA, 213 bp, Artificial Sequence
  Description of Artificial Sequence: Synthetic coding sequence
atggccagcgacgccagccacgccctggaggccgccctggagcagatggacggcatcatcgccggcaccaagaccggcgccgacctgagcgacggcacctgcgagcccggcctggccagccccgccagctacatgaaccccttccccgtgctgcacctgatcgaggacctgagactggccctggagatgctggagctgccccaggagagatag

SEQ ID NO: 24095 - DNA, 270 bp, Artificial Sequence
  Description of Artificial Sequence: Synthetic coding sequence
atggccagcgacgccagccacgccctggaggccgccctggagcagatggacggcatcatcgccggcaccaagaccggcgccgacctgagcgacggcacctgcgagcccggcctggccagccccgccagctacatgaaccccttccccgtgctgcacctgatcgaggacctgagactggccctggagatgctggagctgccccaggagagagccgccctgctgagccagatccccggccccaccgccgcctacatcaaggagtggttctag

SEQ ID NO: 24096 - DNA, 513 bp, Artificial Sequence
  Description of Artificial Sequence: Synthetic coding sequence
atggccagcgacgccagccacgccctggaggccgccctggagcagatggacggcatcatcgccggcaccaagaccggcgccgacctgagcgacggcacctgcgagcccggcctggccagccccgccagctacatgaaccccttccccgtgctgcacctgatcgaggacctgagactggccctggagatgctggagctgccccaggagagagccgccctgctgagccagatccccggccccaccgccgcctacatcaaggagtggttcgaggagagcctgagccaggtgaaccaccacagcgccgccagcaacgagacctaccaggagagactggccagactggagggcgacaaggagagcctgatcctgcaggtgagcgtgctgaccgaccaggtggaggcccagggcgagaagatcagagacctggaggtgtgcctggagggccaccaggtgaagctgaacgccgccgaggagatgctgcagcaggagctgctgagcagaaccagcctgtag

SEQ ID NO: 24097 - DNA, 270 bp, Artificial Sequence; identical to SEQ ID NO: 24095
  Description of Artificial Sequence: Synthetic coding sequence

SEQ ID NO: 24098 - DNA, 654 bp, Artificial Sequence
  Description of Artificial Sequence: Synthetic coding sequence
atgctgcagtacctgaccgtgaacgacctgctgttcctgaaggtgaccagccagctgcaccacctgagcatcaagtgcgccatccacgtgctgcacgtgaacaagttcaacccccactgcctgcacagaagacccgccgacgagagcaacctgagccccagcgaggtggtgcagtggagcaaccacagagtgatggagtggctgagaagcgtggacctggccgagtacgcccccaacctgagaggcagcggcgtgcacggcggcctgatcatcctggagcccagattcaccggcgacaccctggccatgctgctgaacatccccccccagaagaccctgctgagaagacacctgaccaccaagttcaacgccctgatcggccccgaggccgagcaggagaagagagagaagatggccagccccgcctacacccccctgaccaccaccgccaaggtgagacccagaaagctgggcttcagccacttcggcaacatcagaaagaagaagttcgacgagagcaccgactacatctgccccatggagcccagcgacggcgtgagcgacagccacagagtgtacagcggctacagaggcctgagccccctggacgcccccgagctggacggcctggaccaggtgggccagatcagctag

SEQ ID NO: 24099 - DNA, 1203 bp, Artificial Sequence
  Description of Artificial Sequence: Synthetic coding sequence
atgctgcagcaggagctgctgagcagaaccagcctggagacccagaagctggacctgatgaccgaggtgagcgagctgaagctgaagctggtgggcatggagaaggagcagagagagcaggaggagaagcagagaaaggccgaggagctgctgcaggagctgagacacctgaagatcaaggtggaggagctggagaacgagagaaaccagtacgagtggaagctgaaggccaccaaggccgaggtggcccagctgcaggagcaggtggccctgaaggacgccgagatcgagagactgcacagccagctgagcagaaccgccgccctgcacagcgagagccacaccgagagagaccaggagatccagagactgaagatgggcatggagaccctgctgctggccaacgaggacaaggacagaagaatcgaggagctgaccggcctgctgaaccagtacagaaaggtgaaggagatcgtgatggtgacccagggccccagcgagagaaccctgagcatcaacgaggaggagcccgagggcggcttcagcaagtggaacgccaccaacaaggaccccgaggagctgttcaagcaggagatgccccccagatgcagcagccccaccgtgggccccccccccctgccccagaagagcctggagaccagagcccagaagaagctgagctgcagcctggaggacctgagaagcgagagcgtggacaagtgcatggacggcaaccagcccttccccgtgctggagcccaaggacagccccttcctggccgagcacaagtaccccaccctgcccggcaagctgagcggcgccacccccaacggcgaggccgccaagagcccccccaccatctgccagcccgacgccaccggcagcagcctgctgagactgagagacaccgagagcggctgggacgacaccgccgtggtgaacgacctgagcagcaccagcagcggcaccgagagcggcccccagagccccctgacccccgacggcaagagaaaccccaagggcatcaagaagttctggggcaagatcagaagaacccagagcggcaacttctacaccgacaccctgggcatggccgagttcagaagaggcggcctgagagccaccgccggccccagactgagcagaaccagagacagcaagggccagggcctgcagtggctgcccggcccccagcccccctag

SEQ ID NO: 24100 - DNA, 2277 bp, Artificial Sequence
  Description of Artificial Sequence: Synthetic coding sequence
atggacggcgacatcgacgtgtacaagcacttcagctggctgaagagaagccaggtgaaccaccacagcgccgccagcaacgagacctaccaggagagactggccagactggagggcgacaaggagagcctgatcctgcaggtgagcgtgctgaccgaccaggtggaggcccagggcgagaagatcagagacctggaggtgtgcctggagggccaccaggtgaagctgaacgccgccgaggagatgctgcagcaggagctgctgagcagaaccagcctggagacccagaagctggacctgatgaccgaggtgagcgagctgaagctgaagctggtgggcatggagaaggagcagagagagcaggaggagaagcagagaaaggccgaggagctgctgcaggagctgagacacctgaagatcaaggtggaggagctggagaacgagagaaaccagtacgagtggaagctgaaggccaccaaggccgaggtggcccagctgcaggagcaggtggccctgaaggacgccgagatcgagagactgcacagccagctgagcagaaccgccgccctgcacagcgagagccacaccgagagagaccaggagatccagagactgaagatgggcatggagaccctgctgctggccaacgaggacaaggacagaagaatcgaggagctgaccggcctgctgaaccagtacagaaaggtgaaggagatcgtgatggtgacccagggccccagcgagagaaccctgagcatcaacgaggaggagcccgagggcggcttcagcaagtggaacgccaccaacaaggaccccgaggagctgttcaagcaggagatgccccccagatgcagcagccccaccgtgggccccccccccctgccccagaagagcctggagaccagagcccagaagaagctgagctgcagcctggaggacctgagaagcgagagcgtggacaagtgcatggacggcaaccagcccttccccgtgctggagcccaaggacagccccttcctggccgagcacaagtaccccaccctgcccggcaagctgagcggcgccacccccaacggcgaggccgccaagagcccccccaccatctgccagcccgacgccaccggcagcagcctgctgagactgagagacaccgagagcggctgggacgacaccgccgtggtgaacgacctgagcagcaccagcagcggcaccgagagcggcccccagagccccctgacccccgacggcaagagaaaccccaagggcatcaagaagttctggggcaagatcagaagaacccagagcggcaacttctacaccgacaccctgggcatggccgagttcagaagaggcggcctgagagccaccgccggccccagactgagcagaaccagagacagcaagggccagaagagcgacgccaacgcccccttcgcccagtggagcaccgagagagtgtgcgcctggctggaggacttcggcctggcccagtacgtgatcttcgccagacagtgggtgagcagcggccacaccctgctgaccgccaccccccaggacatggagaaggagctgggcatcaagcaccccctgcacagaaagaagctggtgctggccgtgaaggccatcaacaccaagcaggaggagaagagcgccctgctggaccacatctgggtgaccagatggctggacgacatcggcctgccccagtacaaggaccagttccacgagagcagagtggacagaagaatgctgcagtacctgaccgtgaacgacctgctgttcctgaaggtgaccagccagctgcaccacctgagcatcaagtgcgccatccacgtgctgcacgtgaacaagttcaacccccactgcctgcacagaagacccgccgacgagagcaacctgagccccagcgaggtggtgcagtggagcaaccacagagtgatggagtggctgagaagcgtggacctggccgagtacgcccccaacctgagaggcagcggcgtgcacggcggcctgatcatcctggagcccagattcaccggcgacaccctggccatgctgctgaacatccccccccagaagaccctgctgagaagacacctgaccaccaagttcaacgccctgatcggccccgaggccgagcaggagaagagagagaagatggccagccccgcctacacccccctgaccaccagatgggacagactggccgacgccctggtgacctgccccctgtgcaccctgagagcccacagcaacaccgtgtgcgtgaccatctag

SEQ ID NO: 24101 - DNA, 411 bp, Artificial Sequence
  Description of Artificial Sequence: Synthetic coding sequence
atgatggaccaggaggagaagaccgaggagggcagcggcccctgcgccgaggccggcagccccgaccaggagggcttcttcaacctgctgagccacgtgcagggcgacagaatggagggccagagatgcagcctgcaggccggccccggccagaccaccaagagccagagcgaccccacccccgagatggacagcctgatggacatgctggccagcacccagggcagaagaatggacgaccagagagtgaccgtgagcagcctgcccggcttccagcccgtgggcagcaaggacggcgcccagaagagagccggcaccctgagcccccagcccctgctgaccccccaggaccccaccgccctgggcttcagaagaaacagcagcccccagccccccacccaggccccctag

SEQ ID NO: 24102 - DNA, 207 bp, Artificial Sequence
  Description of Artificial Sequence: Synthetic coding sequence
atgagcgagctgaacaccaagaccagccccgccaccaaccaggccgccggccaggaggagaagggcaaggccggcaacgtgaagaaggccgaggaggaggaggagatcgacatcgacctgaccgcccccgagaccgagaaggccgccctggccatccagggcaagttcagaagattccagaagagaaagaaggaccccagcagctag

SEQ ID NO: 24103 - DNA, 1437 bp, Artificial Sequence
  Description of Artificial Sequence: Synthetic coding sequence
atgtggctggccgccgccgcccccagcctggccagaagactgctgttcctgggccccccccccccccccctgctgctgctggtgttcagcagaagcagcagaagaagactgcacagcctgggcctggccgccatgcccgagaagagacccttcgagagactgcccgccgacgtgagccccatcaactgcagcctgtgcctgaagcccgacctgctggacttcaccttcgagggcaagctggaggccgccgcccaggtgagacaggccaccaaccagatcgtgatgaactgcgccgacatcgacatcatcaccgccagctacgcccccgagggcgacgaggagatccacgccaccggcttcaactaccagaacgaggacgagaaggtgaccctgagcttccccagcaccctgcagaccggcaccggcaccctgaagatcgacttcgtgggcgagctgaacgacaagatgaagggcttctacagaagcaagtacaccacccccagcggcgaggtgagatacgccgccgtgacccagttcgaggccaccgacgccagaagagccttcccctgctgggacgagcccgccatcaaggccaccttcgacatcagcctggtggtgcccaaggacagagtggccctgagcaacatgaacgtgatcgacagaaagccctaccccgacgacgagaacctggtggaggtgaagttcgccagaacccccgtgaccagcacctacctggtggccttcgtggtgggcgagtacgacttcgtggagaccagaagcaaggacggcgtgtgcgtgtgcgtgtacacccccgtgggcaaggccgagcagggcaagttcgccatcgaggtggccgccaagaccctgcccttctacaaggactacttcaacgtgccctaccccctgcccaagatcgacctgatcgccatcgccgacttcgccgccggcgccatggagaactgggacctggtgacctacagagagaccgccctgctgatcgaccccaagaacagctgcagcagcagcagacagtgggtggccctggtggtgggccacgagctggcccaccagtggttcggcaacctggtgaccatggagtggtggacccacctgtggctgaacgagggcttcgccagctggatcgagtacctgtgcgtggaccactgcttccccgagtacgacatctggacccagttcgtgagcgccgactacaccagagcccaggagctggacgccctggacaacagccaccccatcgaggtgagcgtgggccaccccagcgaggtggacgagatcttcgacgccatcagctacagcaagggcgccagcgtgatcagaatgctgcacgactacatcggcgacaaggacttcaagaagggcatgaacatgtacctgaccaagttccagcagaagaacgccgccgccggcaacctgtag

SEQ ID NO: 24104 - DNA, 975 bp, Artificial Sequence
  Description of Artificial Sequence: Synthetic coding sequence
atgaagggcttctacagaagcaagtacaccacccccagcggcgaggtgagatacgccgccgtgacccagttcgaggccaccgacgccagaagagccttcccctgctgggacgagcccgccatcaaggccaccttcgacatcagcctggtggtgcccaaggacagagtggccctgagcaacatgaacgtgatcgacagaaagccctaccccgacgacgagaacctggtggaggtgaagttcgccagaacccccgtgaccagcacctacctggtggccttcgtggtgggcgagtacgacttcgtggagaccagaagcaaggacggcgtgtgcgtgtgcgtgtacacccccgtgggcaaggccgagcagggcaagttcgccatcgaggtggccgccaagaccctgcccttctacaaggactacttcaacgtgccctaccccctgcccaagatcgacctgatcgccatcgccgacttcgccgccggcgccatggagaactgggacctggtgacctacagagagaccgccctgctgatcgaccccaagaacagctgcagcagcagcagacagtgggtggccctggtggtgggccacgagctggcccaccagtggttcggcaacctggtgaccatggagtggtggacccacctgtggctgaacgagggcttcgccagctggatcgagtacctgtgcgtggaccactgcttccccgagtacgacatctggacccagttcgtgagcgccgactacaccagagcccaggagctggacgccctggacaacagccaccccatcgaggtgagcgtgggccaccccagcgaggtggacgagatcttcgacgccatcagctacagcaagggcgccagcgtgatcagaatgctgcacgactacatcggcgacaaggacttcaagaagggcatgaacatgtacctgaccaagttccagcagaagaacgccgccgccggctggacctggtag

SEQ ID NO: 24105 - DNA, 729 bp, Artificial Sequence
  Description of Artificial Sequence: Synthetic coding sequence
ctggtgaagaccgccaagctgggcaccagctggaactacctgttcgacttccacccccacagagtgctggtggtgggcgccttcgccaacttctgcaccgagcccaccggctgcagctgcctgttccccaagctgcccccccacctgctgatgctgccctgctggttccacctgctgttcttccaggactacatcatgagcggcgccagcgccctgccccccggcctggtgagcttcgtgaaggcccccctgccccagtggtggcccggcggctgccccggcgtgggcggccccctgcaggccctggaggccaagcccggccagctgagcctgcccatcagaaaccagaagagactggtgaagagcgccctggagctgggcgagaacgagctgttccagcagttccccaacccccagagcagctgggtgcagagaacccaggaggccctgagacccctgctgagcgtggccctgcagctgttcctgggcagaagaggcctgcccctgcccttcagagcccccatcagaaccgtggtgggcagcgccatccccgtgcagcagagccccccccccagccccgcccaggtggacaccctgcaggccagatacgtgggcagactgacccagctgttcgaggagcaccaggccagatacggcgtgcccgccgacagacacctggtgctgaccgaggccagacccaccgcctggcccagactgagcgccggctag

SEQ ID NO: 24106 - DNA, 1419 bp, Artificial Sequence
  Description of Artificial Sequence: Synthetic coding sequence
atggccggcggcgaggccggcgtgaccctgggccagccccacctgagcagacaggacctgaccaccctggacgtgaccaagctgacccccctgagccacgaggtgatcagcagacaggccaccatcaacatcggcaccatcggccacgtggcccacggcaagagcaccgtggtgaaggccatcagcggcgtgcacaccgtgagattcaagaacgagctggagagaaacatcaccatcaagctgggctacgccaacgccaagatctaccagctggacgaccccagctgccccagacccgagtgctacagaagctgcggcagcagcatgcccgacgagttccccaccgacatccccggcaccaagggcaacttcagactggtgagacacgtgagcttcgtggactgccccggccacgacatcctgatggccaccatgctgaacggcgccgccgtgatggacgccgccctgctgctgatcgccggcaacgagagctgcccccagccccagaccagcgagcacctggccgccatcgagatcatgaagctgaagcacatcctgatcctgcagaacaagatcgacctggtgaaggagagacaggccaaggagcagtacgagcagatcctggccttcgtgcagggcaccgtggccgagggcgcccccatcatccccatcagcgcccagctgaagtacaacatcgaggtggtgtgcgagtacatcgtgaagaagatccccgtgccccccagagacttcaccagcgagcccagactgatcgtgatcagaagcttcgacgtgaacaagcccggctgcgaggtggacgacctgaagggcggcgtggccggcggcagcatcctgaagggcgtgctgaaggtgggccaggagaccgaggtgagacccggcatcgtgagcaaggacagcgagggcaagctgatgtgcaagagcatcttcagcaagatcgtgagcctgttcgccgagcacaacgacctgcagtacgccgcccccggcggcctgatcggcgtgggcaccaagatcgaccccaccctgtgcagagccgacagaatggtgggccagatcctgggcgccgtgggcgccctgcccgagatcttcaccgagctggagatcagctacttcctgctgagaagactgctgggcgtgagaaccgagggcgacaagaaggccgccaaggtgcagaagctgagcaagaacgaggtgctgatggtgaacatcggcagcctgagcaccggcggcagagtgagcgccgtgaaggccgacctgggcaagatcgtgctgaccaaccccgtgtgcaccgaggtgggcgagaagatcgccctgagcagaagagtggagaagcactggagactgatcggctggggccagatcagaagaggcgtgaccatcaagcccaccgtggacgacgactag

SEQ ID NO: 24107 - DNA, 543 bp, Artificial Sequence
  Description of Artificial Sequence: Synthetic coding sequence
atggaggaggccggcctgtgcggcctgagagagaaggccgacatgctgtgcaacagcgagagccacgacatcctgcagcaccaggacagcaactgcagcgccaccagcaacaagcacctgctggaggacgaggagggcagagacttcatcaccaagaacagaagctgggtgagccccgtgcactgcacccaggagagcagaagagagctgcccgagcaggaggtggccccccccagcggccagcaggccctgcagcagcaggagcagagaaagagcctgagaaagagaagcttcatcatcgacgccagccccaagcacttcagactgcagagaagaagctggcagctgagcgtgagaaacatgctgatcctggagatccacctgttctacagaagagtgtgcttcgagctgtacgacctgaagcagaacagcttcttcggcgactacggcaacatcctgaacagagagaccctgctggacttcgtgaagcagatcatggagaagatccagaacttcctgaagaaccacggcaagttcctgtag

SEQ ID NO: 24108 - DNA, 396 bp, Artificial Sequence
  Description of Artificial Sequence: Synthetic coding sequence
atggaggaggccggcctgtgcggcctgagagagaaggccgacatgctgtgcaacagcgagagccacgacatcctgcagcaccaggacagcaactgcagcgccaccagcaacaagcacctgctggaggacgaggagggcagagacttcatcaccaagaacagaagctgggtgagccccgtgcactgcacccaggagagcagaagagagctgcccgagcaggaggtggccccccccagcggccagcaggccctgcagtgcaacagaaacaaggagaaggtgctgggcaaggaggtgctgctgctgatgcaggccctgaacaccctgagcacccccgaggagaagctggccgccctgtgcaagaagtacgccgacctgggcaacagccccctgctgtag

SEQ ID NO: 24109 - DNA, 423 bp, Artificial Sequence
  Description of Artificial Sequence: Synthetic coding sequence
atggaggaggccggcctgtgcggcctgagagagaaggccgacatgctgtgcaacagcgagagccacgacatcctgcagcaccaggacagcaactgcagcgccaccagcaacaagcacctgctggaggacgaggagggcagagacttcatcaccaagaacagaagctgggtgagccccgtgcactgcacccaggagagcagaagagagctgcccgagcaggaggtggccccccccagcggccagcaggccctgcagtgcaacagaaacaaggagaaggtgctgggcaacaacctgtgcagcgtggtgggctgctgccacatcctggtgttcctgttctacatcttctgcagcatgagcgactacgagctgggcctgttcggcggcaagtgctgcctggtgaacctgttcctgcacctggtgtag

SEQ ID NO: 24110 - DNA, 513 bp, Artificial Sequence
  Description of Artificial Sequence: Synthetic coding sequence
tgaaccagctggagaagaggcgaggtgacccccagaagaggcagcggcggcggcgccaagaccatcggcgccaagcagggcagaacccagctgagcagcggcttcgtgaacagcaccatggaggaggccggcctgtgcggcctgagagagaaggccgacatgctgtgcaacagcgagagccacgacatcctgcagcaccaggacagcaactgcagcgccaccagcaacaagcacctgctggaggacgaggagggcagagacttcatcaccaagaacagaagctgggtgagccccgtgcactgcacccaggagagcagaagagagctgcccgagcaggaggtggccccccccagcggccagcaggccctgcagtgcaacagaaacaaggagaaggtgctgggcaaggaggtgctgctgctgatgcaggccctgaacaccctgagcacccccgaggagaagctggccgccctgtgcaagaagtacgccgacctgggcaacagccccctgctgtag

SEQ ID NO: 24111 - DNA, 396 bp, Artificial Sequence
  Description of Artificial Sequence: Synthetic coding sequence
atggaggaggccggcctgtgcggcctgagagagaaggccgacatgctgtgcaacagcgagagccacgacatcctgcagcaccaggacagcaactgcagcgccaccagcaacaagcacctgctggaggacgaggagggcagagacttcatcaccaagaacagaagctgggtgagccccgtgcactgcacccaggagagcagaagagagctgcccgagcaggaggtggccccccccagcggccagcaggccctgcagtgcaacagaaacaaggagaaggtgctggagagacagggcctgagcctgagccccagactggagagaggcggcaccttcatgggccacggcagcctgaagctgcccgagctggtgatcctgagcctgcagaccctggagtag

SEQ ID NO: 24112 - DNA, 546 bp, Artificial Sequence
  Description of Artificial Sequence: Synthetic coding sequence
atgaagcaggaggaggcccagctgaaggagcagctgttcctgtacatggacaagttcgaggagttccagaccaccatggccaagaccaacgagctgttcaccgccttcaagcaggagaccgagaagctgaccaagaagatcaagaagctggagaaggagatggtgatctggtacaccaagtgggagaacaacaacaccaccctgctgcagatggccgaggagaagaccatcagagacaagaactacaaggtgttccagatcaagctggagagactggagaagctgtacaaggccctgcagatcgagagaaacgagctgagcgagaagctgggcatcctgaagggccaggtgagcgtgaaggtggccgacgtggacctggccgtgcccgtgacccacagctgcgccgacctggacagcagcaacatgctgaacaccagcagcaagagagcccccggcgtgcacctggaggccgaccccaagggcatgaacgaggtgaagtgctacagcaaggccctgagcaccggcagccccctgggcatcgactag

SEQ ID NO: 24113 - DNA, 546 bp, Artificial Sequence; identical to SEQ ID NO: 24112
  Description of Artificial Sequence: Synthetic coding sequence

SEQ ID NO: 24114 - DNA, 792 bp, Artificial Sequence
  Description of Artificial Sequence: Synthetic coding sequence
atggacagagccaagcagcagcaggccctgctgctgctgcccgtgtgcctggccctgaccttcagcctgaccgccgtggtgagcagccactggtgcgagggcaccagaagagtggtgaagcccctgtgccaggaccagcccggcggccagcactgcatccacttcaagagagacaacagcagcaacggcagaatggacaacaacagccaggccgtgctgtacatctgggagctgggcgacgacaagttcatccagagaggcttccacgtgggcctgtggcagagctgcgaggagagcctgaacggcgaggacgagaagtgcagaagcttcagaagcgtggtgcccgccgaggagcagggcgtgctgtggctgagcatcggcggcgaggtgctggacatcgtgctgatcctgaccagcgccatcctgctgggcagcagagtgagctgcagaagccccggcttccactggctgagagtggacgccctggtggccatcttcatggtgctggccggcctgctgggcatggtggcccacatgatgtacaccaccatcttccagatcaccgtgaacctgggccccgaggactggaagccccagacctgggactacggctggagctactgcctggcctggggcagcttcgccctgtgcctggccgtgagcgtgagcgccatgagcagattcaccgccgccagactggagttcaccgagaagcagcaggcccagaacggcagcagacacagccagcacagcttcctggagcccgaggccagcgagagcatctggaagtag

SEQ ID NO: 24115 - DNA, 888 bp, Artificial Sequence
  Description of Artificial Sequence: Synthetic coding sequence
atggccgaggagacccagcacaacaagctggccgccgccaagaagaagctgaaggagtactggcagaagaacagacccagagtgcccgccggcgtgaacagaaacagaaagaccaacggcagcatccccgagaccgccaccagcggcggctgccagccccccggcgacagcgccaccggcttccacagagagggccccaccagcagcgccaccctgaaggacctggagagcccctgccaggagagagccgtggtgctggacagcaccagcgtgaagatcagcagactgaagaacaccatcaagagcctgatctgcaccctgaagaaggagaagcagcaggacatgagaagagtggaggagctggagagaagcctgagcaagctgaagaaccagatggccgagcccctgccccccgagccccccgccgtgcccagcgaggtggagctgcagcacctgagaaaggagctggagagagtggccggcgagctgcagagccaggtgaagaacaaccagcacatcagcctgctgaacagaagacaggaggagagaatcagagagcaggaggagagactgagaaagcaggaggagagactgcaggagcagcacgagaagctgagacagctggccaagccccagagcgtgttcgaggagctgaacaacgagaacaagagcaccctgcagctggagcagcaggtgaaggagctgcaggagaagctgggcgaggtgaaggagaccgagaccagcacccccagcaagaagggctgggaggccggcagcagcctgctgggcggcgaggtgcccggccagagacagctgcccgcctggggcctggtgaccaccgcccccagaagagccgtgctgagactgttcctggccagctgcctgtag

SEQ ID NO: 24116 - DNA, 888 bp, Artificial Sequence; identical to SEQ ID NO: 24115
  Description of Artificial Sequence: Synthetic coding sequence

SEQ ID NO: 24117 - DNA, 720 bp, Artificial Sequence
  Description of Artificial Sequence: Synthetic coding sequence
agcgccaccggcttccacagagagggccccaccagcagcgccaccctgaaggacctggagagcccctgccaggagagagccgtggtgctggacagcaccagcgtgaagatcagcagactgaagaacaccatcaagagcctgatctgcaccctgaagaaggagaagcagcaggacatgagaagagtggaggagctggagagaagcctgagcaagctgaagaaccagatggccgagcccctgccccccgagccccccgccgtgcccagcgaggtggagctgcagcacctgagaaaggagctggagagagtggccggcgagctgcagagccaggtgaagaacaaccagcacatcagcctgctgaacagaagacaggaggagagaatcagagagcaggaggagagactgagaaagcaggaggagagactgcaggagcagcacgagaagctgagacagctggccaagccccagagcgtgttcgaggagctgaacaacgagaacaagagcaccctgcagctggagcagcaggtgaaggagctgcaggagaagctgggcgaggtgaaggagaccgagaccagcacccccagcaagaagggctgggaggccggcagcagcctgctgggcggcgaggtgcccggccagagacagctgcccgcctggggcctggtgaccaccgcccccagaagagccgtgctgagactgttcctggccagctgcctgtag

SEQ ID NO: 24118 - DNA, 1899 bp, Artificial Sequence
  Description of Artificial Sequence: Synthetic coding sequence
atggccgaggagacccagcacaacaagctggccgccgccaagaagaagctgaaggagtactggcagaagaacagacccagagtgcccgccggcgtgaacagaaacagaaagaccaacggcagcatccccgagaccgccaccagcggcggctgccagccccccggcgacagcgccaccggcttccacagagagggccccaccagcagcgccaccctgaaggacctggagagcccctgccaggagagagccgtggtgctggacagcaccagcgtgaagatcagcagactgaagaacaccatcaagagcctgaagcagcagaagaagcaggtggagcaccagctggaggaggagaagaaggccaacaacgagagacagaaggccgagagagagctggaggtgcagatccagaccctgatcatccagaaggaggagctgaacaccgacctgtaccacatggagagaagcctgagatacttcgaggaggagagcaaggacctggccgtgagactgcagcacagcctgcagtgcaagggcgagctggagagcgccctgagcgccgtgatcgccaccgagaagaagaaggccaaccagctgagcagctgcagcaaggcccacaccgagtgggagctggagcagagcctgcaggaccaggccctgctgaaggcccagctgacccagctgaaggagagcttccagcagctgcagctggagagagacgagtgcgccgagcacatcgagggcgagagagccagatggcaccagagaatgagcaagatgagccaggagatctgcaccctgaagaaggagaagcagcaggacatgagaagagtggaggagctggagagaagcctgagcaagctgaagaaccagatggccgagcccctgccccccgagccccccgccgtgcccagcgaggtggagctgcagcacctgagaaaggagctggagagagtggccggcgagctgcagagccaggtgaagaacaaccagcacatcagcctgctgaacagaagacaggaggagagaatcagagagcaggaggagagactgagaaagcaggaggagagactgcaggagcagcacgagaagctgagacagctggccaagccccagagcgtgttcgaggagctgaacaacgagaacaagagcaccctgcagctggagcagcaggtgaaggagctgcaggagaagctgggcgaggagcacctggaggccgccagccagcagaaccagcagctgaccgcccagctgagcctgatggccctgcccggcgagggccacggcggcgagcacctggacagcgagggcgaggaggccccccagcccatgcccagcgtgcccgaggacctggagagcagagaggccatgagcagcttcatggaccacctgaaggagaaggccgacctgagcgagctggtgaagaagcaggagctgagattcatccagtactggcaggagagatgccaccagaagatccaccacctgctgagcgagcccggcggcagagccaaggacgccgccctgggcggcggccaccaccaggccggcgcccagggcggcgacgagggcgaggccgccggcgccgccgccgacggcatcgccgcctacagcaactacaacaacggccacagaaagttcctggccgccgcccacaacagcgccgacgagcccggccccggcgcccccgccccccaggagctgggcgccgccgacaagcacggcgacctgagagaggtgaccctgaccagcagcgcccagggcgaggccagagaggaccccctgctggacaagcccaccgcccagcccatcgtgcaggaccaccaggagcaccccggcctgggcagcaactgctgcgtgcccctgttctgctgggcctggctgcccagaagaagaagatag

SEQ ID NO: 24119 - DNA, 1899 bp, Artificial Sequence
  Description of Artificial Sequence: Synthetic coding sequence
atggccgaggagacccagcacaacaagctggccgccgccaagaagaagctgaaggagtactggcagaagaacagacccagagtgcccgccggcgtgaacagaaacagaaagaccaacggcagcatccccgagaccgccaccagcggcggctgccagccccccggcgacagcgccaccggcttccacagagagggccccaccagcagcgccaccctgaaggacctggagagcccctgccaggagagagccgtggtgctggacagcaccagcgtgaagatcagcagactgaagaacaccatcaagagcctgaagcagcagaagaagcaggtggagcaccagctggaggaggagaagaaggccaacaacgagagacagaaggccgagagagagctggaggtgcagatccagaccctgatcatccagaaggaggagctgaacaccgacctgtaccacatggagagaagcctgagatacttcgaggaggagagcaaggacctggccgtgagactgcagcacagcctgcagtgcaagggcgagctggagagcgccctgagcgccgtgatcgccaccgagaagaagaaggccaaccagctgagcagctgcagcaaggcccacaccgagtgggagctggagcagagcctgcaggaccaggccctgctgaaggcccagctgacccagctgaaggagagcttccagcagctgcagctggagagagacgagtgcgccgagcacatcgagggcgagagagccagatggcaccagagaatgagcaagatgagccaggagatctgcaccctgaagaaggagaagcagcaggacatgagaagagtggaggagctggagagaagcctgagcaagctgaagaaccagatggccgagcccctgccccccgagccccccgccgtgcccagcgaggtggagctgcagcacctgagaaaggagctggagagagtggccggcgagctgcagagccaggtgaagaacaaccagcacatcagcctgctgaacagaagacaggaggagagaatcagagagcaggaggagagactgagaaagcaggaggagagactgcaggagcagcacgagaagctgagacagctggccaagccccagagcgtgttcgaggagctgaacaacgagaacaagagcaccctgcagctggagcagcaggtgaaggagctgcaggagaagctgggcgaggagcacctggaggccgccagccagcagaaccagcagctgaccgcccagctgagcctgatggccctgcccggcgagggccacggcggcgagcacctggacagcgagggcgaggaggcccccagacccatgcccagcgtgcccgaggaccccgagagcagagaggccatgagcagcttcatggaccacctgaaggagaaggccgacctgagcgagctggtgaagaagcaggagctgagattcatccagtactggcaggagagatgccaccagaagatccaccacctgctgagcgagcccggcggcagagccaaggacgccgccctgggcggcggccaccaccaggccggcgcccagggcggcgacgagggcgaggccgccggcgccgccgccgacggcatcgccgcctacagcaactacaacaacggccacagaaagttcctggccgccgcccacaacagcgccgacgagcccggccccggcgcccccgccccccaggagctgggcgccgccgacaagcacggcgacctgagagaggtgaccctgaccagcagcgcccagggcgaggccagagaggaccccctgctggacaagcccaccgcccagcccatcgtgcaggaccaccaggagcaccccggcctgggcagcaactgctgcgtgcccctgttctgctgggcctggctgcccagaagaagaagatag

SEQ ID NO: 24120 - DNA, 690 bp, Artificial Sequence
  Description of Artificial Sequence: Synthetic coding sequence
atggacatgggcaccagcgccctgagcaagaagccctggtggaccctgccccagaacttccacgcccccatggtgttccacatggaggaggaccaggaggagctgatcttcggccacggcgacacctacctgagatgcatcgaggtgcacagccacaccctgatccagctggagagctggttcaccgccaccggccagaccagagtgaccgtggtgggcccccacagagccagacagtggctgctgcacatgttctgctgcgtgggcagccaggacagctaccaccacgccagaggcggcagcaccgcctggccctgggagagagtgctgagcgccagaagcagaggcggcccctgccccaagaccttcatcctgcagtggtgcagcacctggaagagaaccagaagaagcagcagcagcgacctgatgaccagaaccttcgccgccctgagctgcaccgccacccccctgttcagctggtgcttcaccgccaccggccagaccagagtgaccgtggtgggcccccccatggccaagcagtggctgctgctgatgttccactgcgtgggcagccaggacagcaagtgccacgccagaggcctgaagatgctggagagagtgagaagccagcccctgaccaacgacgacctggtgaccagcgtgagcctgcccccctacaccggcgactag

SEQ ID NO: 24121 - DNA, 492 bp, Artificial Sequence
  Description of Artificial Sequence: Synthetic coding sequence
atgagcagctgccccgtgcacgactgccccagctgggaccccgagagactggagcccgtggagaccggcagcagaggcgccctgagactgagaggcggcgcccccggcagcgccgccggcttcagagccagcatctggggccccgccggctaccccagccccgtgggcctgggccaccccgccagcctgcccagacccgcctacagccccagatgccccgagcccgacgccagacacggctggggcagcggcagcaacgccggctacagaggccccgacagagccggcaccccctgccccgcccaggacagagagggcagaagcagcagccccgtgcccccccccagactgaaggccatgaccagccaggccagaaagcagaacggcggcgccctgatcgacaccgtggactggaccagagaggcccccgacagcgaccccgtgatgagcatgcagaagacccagaagccccagaccaccgtgggccagtag

SEQ ID NO: 24122 - DNA, 591 bp, Artificial Sequence
  Description of Artificial Sequence: Synthetic coding sequence
atggaccacgaggccgcccagctggagaagcagcacgtgcacaacgtgtacgagagcaccgccccctacttcagcgacctgcagagcaaggcctggcccagagtgagacagttcctgcaggagcagaagcccggcagcctgatcgccgacatcggctgcggcaccggcaagtacctgaaggtgaacagccaggtgcacaccgtgggctgcgactactgcggccccctggtggagatcgccagaaacagaggctgcgaggccatgggcctggagcacccctggatctggtaccccagagccagctggaaccagccccccaccgacatcgagggcccccagtacttctaccccccctgccaccccatccccgacctgcagaagcagaccatcatctgccacttcaagggccccaccctgaacgagcagcagaagagcagccccacccaccacagactgcacgcctgcttccagcactgcagagaggaggagagcagaccctggctgatggccctgagcagctgggaccaggtggccatggagggccacgtgagcgccagcctgaccagctgcatcgtgagactgctgctgtag

SEQ ID NO: 24123 - DNA, 1365 bp, Artificial Sequence
  Description of Artificial Sequence: Synthetic coding sequence
atggaccacgaggccgcccagctggagaagcagcacgtgcacaacgtgtacgagagcaccgccccctacttcagcgacctgcagagcaaggcctggcccagagtgagacagttcctgcaggagcagaagcccggcagcctgatcgccgacatcggctgcggcaccggcaagtacctgaaggtgaacagccaggtgcacaccgtgggctgcgactactgcggccccctggtggagatcgccagaaacagaggctgcgaggccatggtgtgcgacaacctgaacctgcccttcagagacgagggcttcgacgccatcatcagcatcggcgtgatccaccacttcagcaccaagcagagaagaatcagagccatcaaggagatggccagagtgctggtgcccggcggccagctgatgatctacgtgtgggccatggagcagaagaacagacacttcgagaagcaggacgtgctggtgccctggaacagagccctgtgcagccagctgttcagcgagagcagccagagcggcagaaagagacagtgcggctaccccgagagaggccacccctaccaccccccctgcagcgagtgcagctgcagcgtgtgcttcaaggagcagtgcggcagcaagagaagccacagcgtgggctacgagcccgccatggccagaacctgcttcgccaacatcagcaaggagggcgaggaggagtacggcttctacagcaccctgggcaagagcttcagaagctggttcttcagcagaagcctggacgagagcaccctgagaaagcagatcgagagagtgagacccctgaagaacaccgaggtgtgggccagcagcaccgtgaccgtgcagcccagcagacacagcagcctggacttcgaccaccaggagcccttcagcaccaagggccagagcctggacgaggaggtgttcgtggagagcagcagcggcaagcacctggagtggctgagagcccccggcaccctgaagcacctgaacggcgaccaccagggcgagatgagaagaaacggcggcggcaacttcctggacagcaccaacaccggcgtgaactgcgtggacgccggcaacatcgaggacgacaaccccagcgccagcaagatcctgagaagaatcagcgccgtggacagcaccgacttcaaccccgacgacaccatgagcgtggaggacccccagaccgacgtgctggacagcaccgccttcatgagatactaccacgtgttcagagagggcgagctgtgcagcctgctgaaggagaacgtgagcgagctgagaatcctgagcagcggcaacgaccacggcaactggtgcatcatcgccgagaagaagagaggctgcgactag

SEQ ID NO: 24124 - DNA, 1104 bp, Artificial Sequence
  Description of Artificial Sequence: Synthetic coding sequence
atggtgtgcgacaacctgaacctgcccttcagagacgagggcttcgacgccatcatcagcatcggcgtgatccaccacttcagcaccaagcagagaagaatcagagccatcaaggagatggccagagtgctggtgcccggcggccagctgatgatctacgtgtgggccatggagcagaagaacagacacttcgagaagcaggacgtgctggtgccctggaacagagccctgtgcagccagctgttcagcgagagcagccagagcggcagaaagagacagtgcggctaccccgagagaggccacccctaccaccccccctgcagcgagtgcagctgcagcgtgtgcttcaaggagcagtgcggcagcaagagaagccacagcgtgggctacgagcccgccatggccagaacctgcttcgccaacatcagcaaggagggcgaggaggagtacggcttctacagcaccctgggcaagagcttcagaagctggttcttcagcagaagcctggacgagagcaccctgagaaagcagatcgagagagtgagacccctgaagaacaccgaggtgtgggccagcagcaccgtgaccgtgcagcccagcagacacagcagcctggacttcgaccaccaggagcccttcagcaccaagggccagagcctggacgaggaggtgttcgtggagagcagcagcggcaagcacctggagtggctgagagcccccggcaccctgaagcacctgaacggcgaccaccagggcgagatgagaagaaacggcggcggcaacttcctggacagcaccaacaccggcgtgaactgcgtggacgccggcaacatcgaggacgacaaccccagcgccagcaagatcctgagaagaatcagcgccgtggacagcaccgacttcaaccccgacgacaccatgagcgtggaggacccccagaccgacgtgctggacagcaccgccttcatgagatactaccacgtgttcagagagggcgagctgtgcagcctgctgaaggagaacgtgagcgagctgagaatcctgagcagcggcaacgaccacggcaactggtgcatcatcgccgagaagaagagaggctgcgactag

SEQ ID NO: 24125 - DNA, 2547 bp, Artificial Sequence
  Description of Artificial Sequence: Synthetic coding sequence
atggtgaagctgagcatcgtgctgaccccccagttcctgagccacgaccagggccagctgaccaaggagctgcagcagcacgtgaagagcgtgacctgcccctgcgagtacctgagaaaggtgatcaacaccctggccgaccaccaccacagaggcaccgacttcggcggcagcccctggctgcacgtgatcatcgccttccccaccagctacaaggtggtgatcaccctgtggatcgtgtacctgtgggtgagcctgctgaagaccatcttctggagcagaaacggccacgacggcagcaccgacgtgcagcagagagcctggagaagcaacagaagaagacaggagggcctgagaagcatctgcatgcacaccaagaagagagtgagcagcttcagaggcaacaagatcgtgctgaaggacgtgatcaccctgagaagacacgtggagaccaaggtgagagccaagatcagaaagagaaaggtgaccaccaagatcaaccaccacgacaagatcaacggcaagagaaagaccgccagaaagcagaagatgttccagagagcccaggagctgagaagaagagccgaggactaccacaagtgcaagatcccccccagcgccagaaaggccctgtgcaactgggtgagaatggccgccgccgagcacagacacagcagcggcctgccctactggccctacctgaccgccgagaccctgaagaacagaatgggccaccagccccccccccccacccagcagcacagcatcaccgacaacagcctgagcctgaagaccccccccgagtgcctgctgacccccctgccccccagcgccgacgacaacctgaagaccccccccgagtgcgtgctgacccccctgccccccagcgccgacgacaacctgaagaccccccccgagtgcctgctgacccccctgccccccagcgccctgcccagcgccccccccagcgccgacgacaacctgaagaccagagccgagtgcctgctgcaccccctgccccccagcgccgacgacaacctgaagacccccagcgagagacagctgacccccctgccccccagcgccccccccagcgccgacgacaacatcaagacccccgccttccacccccagagaatgatcatcagcagacacctgcccagcgtgagcagcctgcccttccacccccagctgcacccccagcagatgatcatcagcagacacctgcccagcgtgtgcggcggcagattccacccccagagaatgatcatcagcagacacctgcccagcgtgagcagcctgcccttccacccccagctgcacccccagcagatgatcatcagcagacacctgcccagcgtgtgcggcggcagattccacccccagagaatgatcatcagcagacacctgcccagcgtgagcagcctgcccttccacccccagctgcacccccagcagatgatcatcagcagacacctgcccagcgtgtgcggcggcagattccacccccagagaatgatcatcagcagacacctgcccagcgtgagcagcctgcccttccacccccagctgcacccccagcagatgatcatcagcagacacctgcccagcgtgtgcggcggcagattccacccccagagaatgatcatcagcagacacctgcccagcgtgagcagcctgcccttccacccccagctgcacccccagcagatgatcatcagcagacacctgcccagcgtgtgcggcggcagattccacccccagagaatgatcatcagcagacacctgcccagcgtgagcagcctgcccttccacacccagctgcacccccagcagatgatcatcagcagacacctgcccagcgtgtgcggcgagagactgagaggccccctgccccccagcgccgacgacaacctgaagacccccagcgagagacagctgacccccctgccccccagcgccccccccagcgccgacgacaacatcaagacccccgccgagagactgagaggccccctgccccccagcgccgacgacaacctgaagacccccagcgagagacagctgacccccctgccccccagcgccccccccagcgccgacgacaacatcaagacccccgccgagagactgagaggccccctgccccccagcgccgacgacaacctgaagaccccccccctggccacccaggaggccgaggccgagaagcccagaaagcccaagagacagagagccgccgagatggagcccccccccgagcccaagagaagaagagtgggcgacgtggagcccagcagaaagcccaagagaagaagagccgccgacgtggagcccagcagccccgagcccaagagaagaagagtgggcgacgtggagcccagcagaaagcccaagagaagaagagccgccgacgtggagcccagcagccccgagcccaagagaagaagagtgggcgacgtggagcccagcagaaagcccaagagaagaagagccgccgacgtggagcccagcctgcccgagcccaagagaagaagactgagctag

SEQ ID NO: 24126 - DNA, 3417 bp, Artificial Sequence
  Description of Artificial Sequence: Synthetic coding sequence
atggtgaagctgagcatcgtgctgaccccccagttcctgagccacgaccagggccagctgaccaaggagctgcagcagcacgtgaagagcgtgacctgcccctgcgagtacctgagaaaggtgatcaacaccctggccgaccaccaccacagaggcaccgacttcggcggcagcccctggctgcacgtgatcatcgccttccccaccagctacaaggtggtgatcaccctgtggatcgtgtacctgtgggtgagcctgctgaagaccatcttctggagcagaaacggccacgacggcagcaccgacgtgcagcagagagcctggagaagcaacagaagaagacaggagggcctgagaagcatctgcatgcacaccaagaagagagtgagcagcttcagaggcaacaagatcgtgctgaaggacgtgatcaccctgagaagacacgtggagaccaaggtgagagccaagatcagaaagagaaaggtgaccaccaagatcaaccaccacgacaagatcaacggcaagagaaagaccgccagaaagcagaagatgttccagagagcccaggagctgagaagaagagccgaggactaccacaagtgcaagatcccccccagcgccagaaaggccctgtgcaactgggtgagaatggccgccgccgagcacagacacagcagcggcctgccctactggccctacctgaccgccgagaccctgaagaacagaatgggccaccagccccccccccccacccagcagcacagcatcaccgacaacagcctgagcctgaagaccccccccgagtgcctgctgacccccctgccccccagcgccgacgacaacctgaagaccccccccgagtgcgtgctgacccccctgccccccagcgccgacgacaacctgaagaccccccccgagtgcgtgctgacccccctgccccccagcgccgacgacaacctgaagaccccccccgagtgcctgctgacccccctgccccccagcgccgacgacaagctgaagaccccccccgagtgcctgctgacccccctgccccccagcgccctgcccagcgccccccccagcgccgacgacaacctgaagaccagagccgagtgcctgctgcaccccctgccccccagcgccgacgacaacctgaagacccccagcgagagacagctgacccccctgccccccagcgccccccccagcgccgacgacaacatcaagacccccgccgagagactgagaggccccctgccccccagcgccgacgacaacctgaagacccccagcgagagacagctgacccccctgccccccagcgccccccccagcgccgacgacaacatcaagacccccgccgagagactgagaggccccctgccccccagcgccgacgacaacctgaagacccccagcgagagacagctgacccccctgccccccagcgccccccccagcgccgacgacaacatcaagacccccgccgagagactgagaggccccctgccccccagcgccgacgacaacctgaagacccccagcgagagacagctgacccccctgccccccagcgccccccccagcgccgacgacaacatcaagacccccgccgagagactgagaggccccctgccccccagcgccgacgacaacctgaagacccccagcgagagacagctgacccccctgccccccagcgccccccccagcgccgacgacaacatcaagacccccgccgagagactgagaggccccctgccccccagcgccgacgacaacctgaagacccccagcgagagacagctgacccccctgccccccagcgccccccccagcgccgacgacaacatcaagacccccgccttccacccccagagaatgatcatcagcagacacctgcccagcgtgagcagcctgcccttccacccccagctgcacccccagcagatgatcatcagcagatacctgctgagcgtgtgcggcttcagattccaccaccagcccatgatcatcagcagacacctgcccagcgtgagcagcctgcccttccacccccagctgcacccccagcagatgatcatcagcagacacctgcccagcgtgtgcggcggcagattccacccccagagaatgatcatcagcagacacctgcccagcgtgagcagcctgcccttccacccccagctgcacccccagcagatgatcatcagcagacacctgcccagcgtgtgcggcggcagattccacccccagagaatgatcatcagcagacacctgcccagcgtgagcagcctgcccttccacccccagctgcacccccagcagatgatcatcagcagacacctgcccagcgtgtgcggcggcagattccacccccagagaatgatcatcagcagacacctgcccagcgtgagcagcctgcccttccacccccagctgcacccccagcagatgatcatcagcagacacctgcccagcgtgtgcggcggcagattccacccccagagaatgatcatcagcagacacctgcccagcgtgagcagcctgcccttccacccccagctgcacccccagcagatgatcatcagcagacacctgcccagcgtgtgcggcgagagactgagaggccccctgccccccagcgccgacgacaacctgaagacccccagcgagagacagctgacccccctgccccccagcgccccccccagcgccgacgacaacatcaagacccccgccgagagactgagaggccccctgccccccagcgccgacgacaacctgaagacccccagcgagagacagctgacccccctgccccccagcgccccccccagcgccgacgacaacatcaagacccccgccgagagactgagaggccccctgccccccagcgccgacgacaacctgaagacccccagcgagagacagctgacccccctgccccccagcgccccccccagcgccgacgacaacatcaagacccccgccgagagactgagaggccccctgccccccagcgccgacgacaacctgaagaccccccccctggccacccaggaggccgaggccgagaagcccagaaagcccaagagacagagagccgccgagatggagcccccccccgagcccaagagaagaagagtgggcgacgtggagcccagcagaaagcccaagagaagaagagccgccgacgtggagcccagcagccccgagcccaagagaagaagagtgggcgacgtggagcccagcagaaagcccaagagaagaagagccgccgacgtggagcccagcagccccgagcccaagagaagaagagtgggcgacgtggagcccagcagaaagcccaagagaagaagagccgccgacgtggagcccagcctgcccgagcccaagagaagaagactgagctag

SEQ ID NO: 24127 - DNA, 2979 bp, Artificial Sequence
  Description of Artificial Sequence: Synthetic coding sequence
atgttccagagagcccaggagctgagaagaagagccgaggactaccacaagtgcaagatcccccccagcgccagaaaggccctgtgcaactgggtgagaatggccgccgccgagcacagacacagcagcggcctgccctactggccctacctgaccgccgagaccctgaagaacagaatgggccaccagccccccccccccacccagcagcacagcatcaccgacaacagcctgagcctgaagaccccccccgagtgcctgctgacccccctgccccccagcgccgacgacaacctgaagaccccccccgagtgcgtgctgacccccctgccccccagcgccgacgacaacctgaagaccccccccgagtgcgtgctgacccccctgccccccagcgccgacgacaacctgaagaccccccccgagtgcctgctgacccccctgccccccagcgccgacgacaagctgaagaccccccccgagtgcctgctgacccccctgccccccagcgccctgcccagcgccccccccagcgccgacgacaacctgaagaccagagccgagtgcctgctgcaccccctgccccccagcgccgacgacaacctgaagacccccagcgagagacagctgacccccctgccccccagcgccccccccagcgccgacgacaacatcaagacccccgccgagagactgagaggccccctgccccccagcgccgacgacaacctgaagacccccagcgagagacagctgacccccctgccccccagcgccccccccagcgccgacgacaacatcaagacccccgccgagagactgagaggccccctgccccccagcgccgacgacaacctgaagacccccagcgagagacagctgacccccctgccccccagcgccccccccagcgccgacgacaacatcaagacccccgccgagagactgagaggccccctgccccccagcgccgacgacaacctgaagacccccagcgagagacagctgacccccctgccccccagcgccccccccagcgccgacgacaacatcaagacccccgccgagagactgagaggccccctgccccccagcgccgacgacaacctgaagacccccagcgagagacagctgacccccctgccccccagcgccccccccagcgccgacgacaacatcaagacccccgccgagagactgagaggccccctgccccccagcgccgacgacaacctgaagacccccagcgagagacagctgacccccctgccccccagcgccccccccagcgccgacgacaacatcaagatccccgccgagagactgagaatccccctgccccccagcgccgacgacaacctgaagacccccagcgagagacagctgacccccctgccccccagcgccccccccagcgccgacgacaacatcaagacccccgccttccacccccagagaatgatcatcagcagacacctgcccagcgtgagcagcctgcccttccacccccagctgcacccccagcagatgatcatcagcagacacctgcccagcgtgtgcggcggcagattccacccccagagaatgatcatcagcagacacctgcccagcgtgagcagcctgcccttccacccccagctgcacccccagcagatgatcatcagcagacacctgcccagcgtgtgcggcggcagattccacccccagagaatgatcatcagcagacacctgcccagcgtgagcagcctgcccttccacacccagctgcacccccagcagatgatcatcagcagacacctgcccagcgtgtgcggcggcagattccacccccagagaatgatcatcagcagacacctgcccagcgtgagcagcctgcccttccacccccagctgcacccccagcagatgatcatcagcagacacctgcccagcgtgtgcggcggcagattccacccccagagaatgatcatcagcagacacctgcccagcgtgagcagcctgcccttccacccccagctgcacccccagcagatgatcatcagcagacacctgcccagcgtgtgcggccccctgccccccagcgccgacgacaacctgaagacccccagcgagagacagctgacccccctgccccccagcgccccccccagcgccgacgacaacatcaagacccccgccgagagactgagaggccccctgccccccagcgccgacgacaacctgaagacccccagcgagagacagctgacccccctgccccccagcgccccccccagcgccgacgacaacatcaagacccccgccgagagactgagaggccccctgccccccagcgccgacgacaacctgaagacccccagcgagagacagctgacccccctgccccccagcgccccccccagcgccgacgacaacatcaagacccccgccgagagactgagaggccccctgccccccagcgccgacgacaacctgaagacccccagcgagagacagctgacccccctgccccccagcgccccccccagcgccgacgacaacatcaagacccccgccgagagactgagaggccccctgccccccagcgccgacgacaacctgaagaccccccccctggccacccaggaggccgaggccgagaagcccagaaagcccaagagacagagagccgccgagatggagcccccccccgagcccaagagaagaagagtgggcgacgtggagcccagcagaaagcccaagagaagaagagccgccgacgtggagcccagcagccccgagcccaagagaagaagagtgggcgacgtggagcccagcagaaagcccaagagaagaagagccgccgacgtggagcccagcagccccgagcccaagagaagaagagtgggcgacgtggagcccagcagaaagcccaagagaagaagagccgccgacgtggagcccagcctgcccgagcccaagagaagaagactgagctag

SEQ ID NO: 24128 - DNA, 1263 bp, Artificial Sequence
  Description of Artificial Sequence: Synthetic coding sequence
atggccgccgccgagcacagacacagcagcggcctgccctactggccctacctgaccgccgagaccctgaagaacagaatgggccaccagccccccccccccacccagcagcacagcatcaccgacaacagcctgagcctgaagaccccccccgagtgcctgctgacccccctgccccccagcgccgacgacaacctgaagaccccccccgagtgcgtgctgacccccctgccccccagcgccgacgacaacctgaagaccccccccgagtgcgtgctgacccccctgccccccagcgccgacgacaacctgaagaccccccccgagtgcctgctgacccccctgccccccagcgccgacgacaagctgaagaccccccccgagtgcctgctgacccccctgccccccagcgccctgcccagcgccccccccagcgccgacgacaacctgaagaccagagccgagtgcctgctgcaccccctgccccccagcgccgacgacaacctgaagacccccagcgagagacagctgacccccctgccccccagcgccccccccagcgccgacgacaacatcaagacccccgccgagagactgagaggccccctgccccccagcgccgacgacaacctgaagacccccagcgagagacagctgacccccctgccccccagcgccccccccagcgccgacgacaacatcaagacccccgccgagagactgagaggccccctgccccccagcgccgacgacaacctgaagacccccagcgagagacagctgacccccctgccccccagcgccccccccagcgccgacgacaacatcaagacccccgccgagagactgagaggccccctgccccccagcgccgacgacaacctgaagaccccccccctggccacccaggaggccgaggccgagaagcccagaaagcccaagagacagagagccgccgagatggagcccccccccgagcccaagagaagaagagtgggcgacgtggagcccagcagaaagcccaagagaagaagagccgccgacgtggagcccagcagccccgagcccaagagaagaagagtgggcgacgtggagcccagcagaaagcccaagagaagaagagccgccgacgtggagcccagcagccccgagcccaagagaagaagagtgggcgacgtggagcccagcagaaagcccaagagaagaagagccgccgacgtggagcccagcctgcccgagcccaagagaagaagactgagctag

SEQ ID NO: 24129 - DNA, 1986 bp, Artificial Sequence
  Description of Artificial Sequence: Synthetic coding sequence
atgttccagagagcccaggagctgagaagaagagccgaggactaccacaagtgcaagatcccccccagcgccagaaaggccctgtgcaactgggtgagaatggccgccgccgagcacagacacagcagcggcctgccctactggccctacctgaccgccgagaccctgaagaacagaatgggccaccagccccccccccccacccagcagcacagcatcaccgacaacagcctgagcctgaagaccccccccgagtgcgtgctgacccccctgccccccagcgccgacgacaacctgaagaccccccccgagtgcgtgctgacccccctgccccccagcgccgacgacaacctgaagaccccccccgagtgcctgctgacccccctgccccccagcgccgacgacaacctgaagaccccccccgagtgcctgctgacccccctgccccccagcgccgacgacaacctgaagaccccccccgagtgcctgctgacccccctgccccccagcgccccccccagcgccccccccagcgccgacgacaacctgaagaccagagccgagtgcctgctgcaccccctgccccccagcgccgacgacaacctgaagacccccagcgagagacagctgacccccctgccccccagcgccccccccagcgccgacgacaacatcaagacccccgccttccacccccagagaatgatcatcagcagacacctgcccagcgtgagcagcctgcccttccacccccagctgcacagccagcagatgatcatcagcagatacctgctgagcgtgtgcggcttcagattccaccaccagcccatgatcatcagcagacacctgcccagcgtgagcagcctgcccttccacccccagctgcacccccagcagatgatcatcagcagacacctgcccagcgtgtgcggcggcagattccacccccagagaatgatcatcagcagacacctgcccagcgtgagcagcctgcccttccacccccagctgcacccccagcagatgatcatcagcagacacctgcccagcgtgtgcggcggcagattccacccccagagaatgatcatcagcagacacctgcccagcgtgagcagcctgcccttccacccccagctgcacccccagcagatgatcatcagcagacacctgcccagcgtgtgcggcggcagattccacccccagagaatgatcatcagcagacacctgcccagcgtgagcagcctgcccttccacccccagctgcacccccagcagatgatcatcagcagacacctgcccagcgtgtgcggcggcagattccacccccagagaatgatcatcagcagacacctgcccagcgtgagcagcctgcccttccacccccagctgcacccccagcagatgatcatcagcagacacctgcccagcgtgtgcggcgagagactgagaggccccctgccccccagcgccgacgacaacctgaagacccccagcgagagacagctgacccccctgccccccagcgccccccccagcgccgacgacaacatcaagacccccgccgagagactgagaggccccctgccccccagcgccgacgacaacctgaagaccccccccctggccacccaggaggccgaggccgagaagcccagaaagcccaagagacagagagccgccgagatggagcccccccccgagcccaagagaagaagagtgggcgacgtggagcccagcagaaagcccaagagaagaagagccgccgacgtggagcccagcagccccaagcccaagagaagaagagtgggcgacgtggagcccagcagaaagcccaagagaagaagagccgccgacgtggagcccagcagccccgagcccaagagaagaagagtgggcgacgtggagcccagcagaaagcccaagagaagaagagccgccgacgtggagcccagcagccccgagcccaagagaagaagactgagctag

SEQ ID NO: 24130 - DNA, 1263 bp, Artificial Sequence
  Description of Artificial Sequence: Synthetic coding sequence
atggccgccgccgagcacagacacagcagcggcctgccctactggccctacctgaccgccgagaccctgaagaacagaatgggccaccagccccccccccccacccagcagcacagcatcaccgacaacagcctgagcctgaagaccccccccgagtgcgtgctgacccccctgccccccagcgccgacgacaacctgaagaccccccccgagtgcgtgctgacccccctgccccccagcgccgacgacaacctgaagaccccccccgagtgcctgctgacccccctgccccccagcgccgacgacaacctgaagaccccccccgagtgcctgctgacccccctgccccccagcgccgacgacaacctgaagaccccccccgagtgcctgctgacccccctgccccccagcgccccccccagcgccccccccagcgccgacgacaacctgaagaccagagccgagtgcctgctgcaccccctgccccccagcgccgacgacaacctgaagacccccagcgagagacagctgacccccctgccccccagcgccccccccagcgccgacgacaacatcaagacccccgccgagagactgagaggccccctgccccccagcgccgacgacaacctgaagacccccagcgagagacagctgacccccctgccccccagcgccccccccagcgccgacgacaacatcaagacccccgccgagagactgagaggccccctgccccccagcgccgacgacaacctgaagacccccagcgagagacagctgacccccctgccccccagcgccccccccagcgccgacgacaacatcaagacccccgccgagagactgagaggccccctgccccccagcgccgacgacaacctgaagaccccccccctggccacccaggaggccgaggccgagaagcccagaaagcccaagagacagagagccgccgagatggagcccccccccgagcccaagagaagaagagtgggcgacgtggagcccagcagaaagcccaagagaagaagagccgccgacgtggagcccagcagccccaagcccaagagaagaagagtgggcgacgtggagcccagcagaaagcccaagagaagaagagccgccgacgtggagcccagcagccccgagcccaagagaagaagagtgggcgacgtggagcccagcagaaagcccaagagaagaagagccgccgacgtggagcccagcagccccgagcccaagagaagaagactgagctag

SEQ ID NO: 24131 - DNA, 2505 bp, Artificial Sequence
  Description of Artificial Sequence: Synthetic coding sequence
atgaaggtgatcgtgatccacagaaagatgttccagagagcccaggagctgagaagaagagccgaggactaccacaagtgcaagatcccccccagcgccagaaaggccctgtgcaactgggtgagaatggccgccgccgagcacagacacagcagcggcctgccctactggccctacctgaccgccgagaccctgaagaacagaatgggccaccagccccccccccccacccagcagcacagcatcaccgacaacagcctgagcctgaagaccccccccgagtgcgtgctgacccccctgccccccagcgccgacgacaacctgaagaccccccccgagtgcgtgctgacccccctgccccccagcgccgacgacaacctgaagaccccccccgagtgcctgctgacccccctgccccccagcgccgacgacaacctgaagaccccccccgagtgcctgctgacccccctgccccccagcgccgacgacaacctgaagaccccccccgagtgcctgctgacccccctgccccccagcgccccccccagcgccccccccagcgccgacgacaacctgaagaccagagccgagtgcctgctgcaccccctgccccccagcgccgacgacaacctgaagacccccagcgagagacagctgacccccctgccccccagcgccccccccagcgccgacgacaacatcaagacccccgccgagagactgagaggccccctgccccccagcgccgacgacaacctgaagacccccagcgagagacagctgacccccctgccccccagcgccccccccagcgccgacgacaacatcaagacccccgccgagagactgagaggccccctgccccccagcgccgacgacaacctgaagacccccagcgagagacagctgacccccctgccccccagcgccccccccagcgccgacgacaacatcaagacccccgccgagagactgagaggccccctgccccccagcgccgacgacaacctgaagacccccagcgagagacagctgacccccctgccccccagcgccgacgacaacatcaagacccccgccttccacccccagagaatgatcatcagcagacacctgcccagcgtgagcagcctgcccttccacccccagctgcacagccagcagatgatcatcagcagatacctgctgagcgtgtgcggcttcagattccaccaccagcccatgatcatcagcagacacctgcccagcgtgagcagcctgcccttccacccccagctgcacccccagcagatgatcatcagcagacacctgcccagcgtgtgcggcggcagattccacccccagagaatgatcatcagcagacacctgcccagcgtgagcagcctgcccttccacccccagctgcacccccagcagatgatcatcagcagacacctgcccagcgtgtgcggcggcagattccacccccagagaatgatcatcagcagacacctgcccagcgtgagcagcctgcccttccacccccagctgcacccccagcagatgatcatcagcagacacctgcccagcgtgtgcggcggcagattccacccccagagaatgatcatcagcagacacctgcccagcgtgagcagcctgcccttccacccccagctgcacccccagcagatgatcatcagcagacacctgcccagcgtgtgcggcgagagactgagaggccccctgccccccagcgccgacgacaacctgaagacccccagcgagagacagctgacccccctgccccccagcgccccccccagcgccgacgacaacatcaagacccccgccgagagactgagaggccccctgccccccagcgccgacgacaacctgaagacccccagcgagagacagctgacccccctgccccccagcgccccccccagcgccgacgacaacatcaagacccccgccgagagactgagaggccccctgccccccagcgccgacgacaacctgaagacccccagcgagagacagctgacccccctgccccccagcgccccccccagcgccgacgacaacatcaagacccccgccgagagactgagaggccccctgccccccagcgccgacgacaacctgaagaccccccccctggccacccaggaggccgaggccgagaagcccagaaagcccaagagacagagagccgccgagatggagcccccccccgagcccaagagaagaagagtgggcgacgtggagcccagcagaaagcccaagagaagaagagccgccgacgtggagcccagcagccccaagcccaagagaagaagagtgggcgacgtggagcccagcagaaagcccaagagaagaagagccgccgacgtggagcccagcagccccgagcccaagagaagaagagtgggcgacgtggagcccagcagaaagcccaagagaagaagagccgccgacgtggagcccagcagccccgagcccaagagaagaagactgagctag

SEQ ID NO: 24132 - DNA, 591 bp, Artificial Sequence
  Description of Artificial Sequence: Synthetic coding sequence
atgatcagatgcggcctggcctgcgagagatgcagatggatcctgaccctgctgctgctgagcgccatcgccttcgacatcatcgccctggccggcagaggctggctgcagagcagcgacagagtgcagaccagcagcctgtggtggagatgcttcctgccccagggcagaagaagaagacagagagtgctgagaggcagactgccccagccccacggcgtgagagtgggcagcagcagcgccgccatgctgttctggggcgtgagcatcctggtgatctgcttcatcctgagcttcttcgtgctgtgcgtgccccagatcctggtgttcctgagagtgatcggcggcctgctggccctggccgccgtgttccagatcatcagcctggtgatctaccccgtgaagtacacccagcccagcaccttcatgcccagccccgccgtgaccagcatctacaactgggcctgcggcttcggctgggccgccatgatcatcctgatcggctgcgccttcttctgctgctgcctgcccagctgcgaggacgacctgctgggcaacaccaagcccagatacttctacaccagcgcctag

SEQ ID NO: 24133 - DNA, 1389 bp, Artificial Sequence
  Description of Artificial Sequence: Synthetic coding sequence
atggacagcctgtggggccccggcgccggcagccaccccttcggcgtgcacaacaccagactgagccccgacctgtgccccggcaagatcgtgctgagagccctgaaggagagcggcgccggcatgcccgagcaggacaaggaccccagagtgcaggagaaccccggcgaccagagaagagtgcccgaggtgaccggcgacgcccccagcgccttcagacccctgagagacaacagaggcctgagccccttcgtgcccggccccggccccctgcagaccgacctgcacgcccagagaagcgagatcagatacaaccagaccagccagaccagctggaccagcagctgcaccaacagaaacgccatcagcagcagctacagcagcaccggcggcctgcccggcctgaagagaagaagaggccccgccagcagccactgccagctgaccctgagcagcagcaagaccgtgagcgaggacagaccccaggccgtgagcagcggccacacccagtgcgagaaggccgccgacatcgcccccggccagaccctggccctgagaaacgacagcagcaccagcgaggccagcagacccagcacccacaagttccccctgctgcccagaagaagaggcgagcccctgatgctgcccccccccctggagctgggctacagagtgaccgtggaggacctggacagagagaaggaggccgccttccagagaatcaacagcgccctgcaggtggaggacaaggccatcagcgactgcagacccagcagacccagccacaccctgagcagcctggccaccggcaccagcggcctgcccgccatcagcaaggcccccagcatggacgtgcagcaggagacccacaagagccaggactgcctgggcctgctggcccccctggccagcgccgccggcgtgcccagcaccgcccccatgagcggcaagaagcacaagccccccggccccctgttcagcagcagcgaccccctgcccgccaccagcagccacagccaggacagcgcccaggtgaccagcctgatccccgcccccttccccgccgccagcatggacgtgggcatgagaagaaccagatgcggcaccagcgcccccgccgccgccgccgccgcccccccccccagcaccctgaaccccaccctgggcagcctgctggagtggatggaggccctgcacatcagcggcccccagccccagctgcagcaggtgcccagaggccagaaccagagaagccagaccagcagaaccagcagctgccccaagagaaacgccatcagcagcccctacagaagcaccggcggcctgcccgagagaaagagaagaagaggccccgccagcagccactgccagctgaacctgagcagctag

SEQ ID NO: 24134 - DNA, 381 bp, Artificial Sequence
  Description of Artificial Sequence: Synthetic coding sequence
atgggcagaatcttccagctgctgagagacagaagaatcagcagcagaggccccggcctgcacacccccaaggccgagcccagaagaagaaagggcctgaccaccggcctgatgacccaggccgagagacagaagcaggcccaccagagacaggccgccatgagagagaccgccctgtggtgcaccggccacatcagacccagaacccacacccacaccggcacccacacccagaccgacagagagagagagagaaacacccagagactgagagacagagagagaagagagaacggcagacacacccacatccacacccagacccacacccagagcctgatcgccaaggccctgaaggacacccaccccggcaacccctag

SEQ ID NO: 24135 - DNA, 1395 bp, Artificial Sequence
  Description of Artificial Sequence: Synthetic coding sequence
atgatggcctgcagagaccccaagcccggcgccaagagactggtgagagcccagaccctgcagaagcagagaagagcccccgtgggccccagagcccccccccccgacgaggaggaccccagactgaagtgcaagaactgcggcgccttcggccacatggccagaagcaccagatgccccatgaagtgctggaaggccgccctggtgccccccaccctgggcaagaaggagggcaaggagaacctgaagccctggaagccccaggtggaggccaaccccggccccctgaacaaggacaagggcgagaaggaggagagacccagacagcaggacccccagagaaaggccctgctgcacatcttcagcggcaagccccccgagaagcccctgcccaacagaaagggcagcaccgagagcagcgtgtacctgagagtggccagcggccccatgcccgtgcacaccaccagcaagagacccagagtggaccccgtgctggccgacagaagcgccaccgagatgagcgacagaggcagcgccctggccagcctgagccccctgagaaaggccagcctgagcagcagcagcagcctgggccccaaggagagacagaccggcgccgccgccgacatcccccagcccgccgtgagacaccagggccccgagcccctgctggtggtgaagcccacccacagcagccccgagggcggctgcagagaggtgccccaggccgccagcaagacccacggcctgctgcaggccatcagcccccaggcccaggacaagagacccgccgtgaccagccagccctgcccccccgccgccacccacagcctgggcctgggcagcaacctgagcttcggccccggcgccaagagacccgcccaggcccccatccaggcctgcctgaacttccccaagaagcccagactgggccccttccagatccccgagagcgccatccagggcggcgagctgggcgcccccgagtacctgcagcccccccccgccaccaccgagctgggccccagcaccagcccccagatgggcagaagaacccccgcccaggtgagcagcgtggacagacagcccccccacagcagaccctgcctgcccaccgcccaggcctgcaccatgagccaccaccccgccaccagccacgacggcgcccagcccctgagagtgctgttcagaagactggagaacggcagatggagcagcagcctgctggccgcccccagcttccacagccccgagaagcccggcgccttcctggcccagagcccccacgtgagcgagaagagcgaggtgcccagagtgagagtgccccccaacgtgctgtacgaggacctgcaggtgagcagcagcagcgaggacagcgacagcgacctggagtag

SEQ ID NO: 24136 - DNA, 1383 bp, Artificial Sequence
  Description of Artificial Sequence: Synthetic coding sequence
cagatggccagacacagcgtgcaccaccaggcccagagaccccccagagccaagaacccccaggagcagcagagaagacccatgggccagaccaccctgcccgccgagcaggaggagagcagagtgaagtgcaagaactgcggcgccttcggccacagcgccagaagcaagacctgccccatcaagagatggagcggcgccctgcccctgcaggccctgggcagccacaaggagaaggagaacctgaagcccgccaaggcccagctgcccttcaccacccccggccccttcaccaccaacgacagagagaaggagagaagccccagcccccagcagcagcagagcgaggcccccacccagaccttccccagaaccccccaggagaagatgcaggaggcctggaaggagcccgccgaggactgcctgttcctgagacaccccaccatgcccctgcccgtgcacaccaccaagaagagaagcgtgctgggccccgtgagcaccggccccccccccgtgaacaagcccgagatgagactgctgtgccccagcggccacaacgacagcccccagctgagcacctgcggccccaccaagggccacggcagagacgtgaccgccagcctgctgcccgtgctgaagagcagccaccagacccccaccctgagcgccagactgcccgccaacagacccgacatgagcagccacggcgccctgcagcccgccatgcaggccctggccctgggccccggcctgaagagccaggccgagatcaagcaccccgacgccgacgccaagcccagaccccagcaggtgagaaagcagtgcggccaggacagcagaacccaggcccccgacaaggagcccgcccccgtgcccacccagaccttccagaaccccgccaagaaggccagattcagcagcttccagacccccgccctgagaacccagctgcccgacgtgggcgccgtgcagaccctgcagccccccagaaccgccaccggcctgggcagcaaggaggcccccaaggccaccgccgagaccgccgccaccaagaccgccaccctgcagcccagagtgaacctgcagcccgcccccagcagccccttcctgggccccgcccagggctgccccgtgctgcagcccggcccccccatccacgtgcccggcagacccggcagcgtgaccttcatgagaggcgacaagggccagaagagccccagattcagaatgccccccaccagcagaccccccgagaacagcgccagcgcccagagccccagattcagcagacagcccgagggccagggcccccaggtgagcaccagcgtgctgtacgaggacctgctggtgaccagcagcagcgaggacagcgacagcgactag

SEQ ID NO: 24137 - DNA, 894 bp, Artificial Sequence
  Description of Artificial Sequence: Synthetic coding sequence
ttcgtgctgggcgccgtgagccccgccgtggtggtgctgtacaccatggtgctgcaggagaacggctacggcgtggaggaggacatccccaccctgctgatggccgccagcagcatggacgacctgctggccatcaccggcttcaacacctgcctgagcatcgtgttctacagcggcggcatgatcaacaacgccatcgccagcctgagaaacgtgtgcatcagcctgctggccggcatcgtgctgggcttcttcgtgagatacttccccagcgaggaccagaagaagatcaccctgaagagaggcttcctggtgctgatcaccttcgtgagcgccgtgctgggcagccagcccatcggcctgcacggcagcggcggcctgtgcaccctggtgctgcacttcatcgagtggaccaagtggagccaggagaagatgaaggtgcagaagatcatcaccaacgtgtgggacatcttccagcccctgctgttcggcctggtgggcgccgaggtgagcgtgagcctgctggagagcaacatcgtgggcatcagcgtgagcaccctgagcctggccctgtgcgtgagaatcctgaacatctacctgctgatgtgcttcgccggcttcagcttcaaggagaagatcttcatcgccctggcctggatgcccaaggccaccgtgcaggccgtgctgggccccctggccctggagaccgccagagtgagcaccccccacctggagacctacgccaaggacgtgatgaccgtggccttcctggccatcatgatcaccgcccccaacggcgccctgctgatgggcatcctgggccccaagatgctgaccagacactacgaccccagcaagatcaagctgcagctgagcaccctggagcaccactag

SEQ ID NO: 24138 - DNA, 2325 bp, Artificial Sequence
  Description of Artificial Sequence: Synthetic coding sequence
atggagcccgagagagagggcaccgagagacaccccagaaaggtgagagagagcagacaggcccccaacaagctggtgggcgccgccgaggccatgaaggccggctgggacctggaggagagccagcccgaggccaagaaggccagactgagcaccatcctgttcaccgacaactgcgaggtgacccacgaccagctgtgcgagctgctgaagtacgccgtgctgggcaagagcaacgtgcccaagcccagctggtgccagctgttccaccagaaccacctgaacaacgtggtggtgttcgtgctgcagggcatgagccagctgcacttctacagattctacctggagttcggctgcctgagaaaggccttcagacacaagttcagactgcccccccccagcagcgacttcctggccgacgtggtgggcctgcagaccgagcagagagccggcgacctgcccaagaccatggagggccccctgcccagcaacgccaaggccgccatcaacctgcaggacgaccccatcatccagaagtacggcagcaagaaggtgggcctgaccagatgcctgctgaccaaggaggagatgagaaccttccacttccccctgcagggcttccccgactgcgagaacttcctgctgaccaagtgcaacggcagcatcgccgacaacagccccctgttcggcctggactgcgagatgtgcctgaccagcaagggcagagagctgaccagaatcagcctggtggccgagggcggctgctgcgtgatggacgagctggtgaagcccgagaacaagatcctggactacctgaccagcttcagcggcatcaccaagaagatcctgaaccccgtgaccaccaagctgaaggacgtgcagagacagctgaaggccctgctgccccccgacgccgtgctggtgggccacagcctggacctggacctgagagccctgaagatgatccacccctacgtgatcgacaccagcctgctgtacgtgagagagcagggcagaagattcaagctgaagttcctggccaaggtgatcctgggcaaggacatccagtgccccgacagactgggccacgacgccaccgaggacgccagaaccatcctggagctggccagatacttcctgaagcacggccccaagaagatcgccgagctgaacctggaggccctggccaaccaccaggagatccaggccgccggccaggagcccaagaacaccgccgaggtgctgcagcaccccaacaccagcgtgctggagtgcctggacagcgtgggccagaagctgctgttcctgaccagagagaccgacgccggcgagctgcccagcagcagaaactgccagaccatcaagtgcctgagcaacaaggaggtgctggagcaggccagagtggagatccccctgttccccttcagcatcgtgcagttcagcttcaaggccttcagccccgtgctgaccgaggagatgaacaagagaatgagaatcaagtggaccgagatcagcaccgtgtacgccggccccttcagcaagaactgcaacctgagagccctgaagagactgttcaagagcttcggccccgtgcagagcatgaccttcgtgctggagaccagacagccccacctgtgcatccagtacgaggtgctggaggccgcccagctggccatcgagagcctggacggcatcctggtggacggcatctgcatcaaggtgcagagacccgtgaccgagctgaccctggactgcgacaccctggtgaacgagctggagggcgacagcgagaaccagggcagcatctacctgagcggcgtgagcgagaccttcaaggagcagctgctgcaggagcccagactgttcctgggcctggaggccgtgatcctgcccaaggacctgaagagcggcaagcagaagaagtactgcttcctgaagttcaagagcttcggcagcgcccagcaggccctgaacatcctgaccggcaaggactggaagctgaagggcagacacgccctgacccccagacacctgcacgcctggctgagaggcctgccccccgagagcaccagactgcccggcctgagagtggtgcccccccccttcgagcaggaggccctgcagaccctgaagctggaccaccccaagatcgccgcctggagatggagcagaaagatcggcaagctgtacaacagcctgtgccccggcaccctgtgcctgatcctgctgcccggcaccaagagcacccacggcagcctgagcggcctgggcctgatgggcatcaaggaggaggaggagagcgccggccccggcctgtgcagctag

SEQ ID NO: 24139 - DNA, 2232 bp, Artificial Sequence
  Description of Artificial Sequence: Synthetic coding sequence
atggagcccgagagagagggcaccgagagacaccccagaaaggtgagagagagcagacaggcccccaacaagctggtgggcgccgccgaggccatgaaggccggctgggacctggaggagagccagcccgaggccaagaaggccagactgagcaccatcctgttcaccgacaactgcgaggtgacccacgaccagctgtgcgagctgctgaagtacgccgtgctgggcaagagcaacgtgcccaagcccagctggtgccagctgttccaccagaaccacctgaacaacgtggtggtgttcgtgctgcagggcatgagccagctgcacttctacagattctacctggagttcggctgcctgagaaaggccttcagacacaagttcagactgcccccccccagcagcgacttcctggccgacgtggtgggcctgcagaccgagcagagagccggcgacctgcccaagaccatggagggccccctgcccagcaacgccaaggccgccatcaacctgcaggacgaccccatcatccagaagtacggcagcaagaaggtgggcctgaccagatgcctgctgaccaaggaggagatgagaaccttccacttccccctgcagggcttccccgactgcgagaacttcctgctgaccaagtgcaacggcagcatcgccgacaacagccccctgttcggcctggactgcgagatgtgcctgaccagcaagggcagagagctgaccagaatcagcctggtggccgagggcggctgctgcgtgatggacgagctggtgaagcccgagaacaagatcctggactacctgaccagcttcagcggcatcaccaagaagatcctgaaccccgtgaccaccaagctgaaggacgtgcagagacagctgaaggccctgctgccccccgacgccgtgctggtgggccacagcctggacctggacctgagagccctgaagatgatccacccctacgtgatcgacaccagcctgctgtacgtgagagagcagggcagaagattcaagctgaagttcctggccaaggtgatcctgggcaaggacatccagtgccccgacagactgggccacgacgccaccgaggacgccagaaccatcctggagctggccagatacttcctgaagcacggccccaagaagatcgccgagctgaacctggaggccctggccaaccaccaggagatccaggccgccggccaggagcccaagaacaccgccgaggtgctgcagcaccccaacaccagcgtgctggagtgcctggacagcgtgggccagaagctgctgttcctgaccagagagaccgacgccggcgagctgcccagcagcagaaactgccagaccatcaagtgcctgagcaacaaggaggtgctggagcaggccagagtggagatccccctgttccccttcagcatcgtgcagttcagcttcaaggccttcagccccgtgctgaccgaggagatgaacaagagaatgagaatcaagtggaccgagatcagcaccgtgtacgccggccccttcagcaagaactgcaacctgagagccctgaagagactgttcaagagcttcggccccgtgcagagcatgaccttcgtgctggagaccagacaggtgcagagacccgtgaccgagctgaccctggactgcgacaccctggtgaacgagctggagggcgacagcgagaaccagggcagcatctacctgagcggcgtgagcgagaccttcaaggagcagctgctgcaggagcccagactgttcctgggcctggaggccgtgatcctgcccaaggacctgaagagcggcaagcagaagaagtactgcttcctgaagttcaagagcttcggcagcgcccagcaggccctgaacatcctgaccggcaaggactggaagctgaagggcagacacgccctgacccccagacacctgcacgcctggctgagaggcctgccccccgagagcaccagactgcccggcctgagagtggtgcccccccccttcgagcaggaggccctgcagaccctgaagctggaccaccccaagatcgccgcctggagatggagcagaaagatcggcaagctgtacaacagcctgtgccccggcaccctgtgcctgatcctgctgcccggcaccaagagcacccacggcagcctgagcggcctgggcctgatgggcatcaaggaggaggaggagagcgccggccccggcctgtgcagctag

SEQ ID NO: 24140 - DNA, 2082 bp, Artificial Sequence
  Description of Artificial Sequence: Synthetic coding sequence
agcctgccccagagcgaggcccagggccaggccgtggacctgagaacccccgtgagctgcctgagaggcagactgccccccggccacaccgaggccagactggtgggcggcgagcacccctgcgccggcagactggaggtgacctggggcaccgtgtgcgacgccgccctggacctggccaccgcccacgtggtgtgcagagagctgcagtgcggcgccgtggtgagcacccccgagggcgccagattcggcagaggcagcggccccgtgtggaccgaggccttcagatgcgccggcaacgagagcctgctgttccactgccccagaggcagaggcagccagtgcggccacggccacgacgccggcctgagatgcagcgagttcagaatggtgaacggcagcagcagctgcgagggcagagtggagttccaggtgcagggcagctgggcccccctgtgcgccacccactgggacatcgccgacgccaccgtgctgtgccaccagctgaactgcggcaacgccgtggccgcccccggcggcggccacttcggcgacggcgacgccgccatctggcccgacgccttccactgcgagggcaccgagagctacctgtggaactgccccgtgagcaccctgggcgcccccgcctgcgcccccggcaacaccgccagcgccgtgtgcagcggcctggcccacgccctgagactgagagagggccagagcagatgcgacggcagagtggaggtgagcctggacggcgtgtggggcagagtgctggacgacgcctgggacctgagaggcgccggcgtggtgtgcagacagctgggctgcagaggcgcccagcaggcctacgacgcccccgcccccagcagaggcagcgtgcaggtggccctgagcagagtgagatgcctgggcaccgagaccagactgacccagtgcaacgtgagcgccaccctgcaggagcccgccggcaccagcagagacgccggcgtggtgtgcagcggcgaggtgggcaccgccagccccatggccagaagacacggcatccccggcgccctgaccctgagcctgcacagagagccccagggcgccgccggcagaggcgccggcgccctgcacggcggcgcctggggcaccgtgtgcgacgacgcctgggacctgagagacgcccacgtggtgtgcagacagctgggctgcggcagagccctgagccccggcggcagaaccctgagaagcagaggcagagcccacctggccggcagagccggcctgcccggccccagagtgtgcgccgtggccgtgcccgtgggcggcctgggcgccgccagactggaggcccagggcggcagaagaagactgctgctgagagtgggcggcagcgaggccgccagatgggacctgctgctgtgctgggtggccggcagagtgctgcagtgggacctgggcagacacgtgcagcagtgccccgagggccccctgctggtgcaccacctgcaggccgccggcgtgtggggcgtgggcctggccggcgagcaggccctgcccctgtgcggccacagagacagactgggcggccagcacagagtgccccaggccgcccagctgcacagcgtggccatgcccttcccccccatggcccccgccctgctgagacccagcagagccggcctggactacctgtgcagaatcgtgagaggccaggccaccggctgctggggcgccccccagctgctgctgctggccagactgcccagaggcggcagaaccgccagagccagaggcagaggccccctgctgagagccagaggcgccctggccagaggcctgctgggccacagagtgagaagatggctgggccccggcggcagaggcggcagagtgccccccgccggcctgtggagcggcagaagaagacccggcggcagaagactgtggccctggctgagagccagagtggccggcagaggcggcgtgcccggccagagaggcgtgcccgtgggcctgcccagaagcggcggcgacgccgagaccgccagaaccagaagaaccagagcctgcgccgccggcaagaccaacagctag

SEQ ID NO: 24141 - DNA, 1359 bp, Artificial Sequence
  Description of Artificial Sequence: Synthetic coding sequence
atgaacagcggcatcctgcaggtgttccagagagagctgatctgccccatctgcatgaactacttcatcgaccccgtgaccatcgactgcggccacagcttctgcagaccctgcttctacctgaactggaaggacagccccttcctggtgcagtgcagcgagtgcaccaagagcaccggccagatcaacctgaagaccaacatccacttcaagaagatggccagcctggccagaaaggtgagcctgtggctgttcctgagcagcgaggagcagatgtgcggcacccacagagagaccaagaagatgttctgcgaggtggacagaagcctgctgtgcctgctgtgcagcagcagccaggagcacagagaccacagacactgccccatcgagagcgccgccgaggagcaccaggagaagctgctgcagaagatgcagagcctgtgggagaaggcctgcgagaaccacagaaacctgaacgtggagaccaccagaaccagatgctggaaggactacgtgaacctgagactggaggccatcagagccgagtaccagaagatgcccgccttccaccacgaggaggagaagcacaacctggagatgctgaagaagaagggcaaggacatcttccacagactgcacctgagcaaggccaagatggcccacagaagagagatcctgagaggcatgtacgaggagctgaacgagatgtgccacaagcccgacgtggagctgctgcaggccttcggcgacatcctgcacagaagcgagagcgtgctgctgcacatgccccagcccctgaaccccgagctgagcgccggccccatcaccggcctgagagacagactgaaccagttcagagtgcacatcaccctgcaccacgaggaggccaacagcgacatcttcctgtgcgagatcctgagaagcatgtgcatcggctgcgaccaccaggacgtgccctacttcaccgccacccccagaagcttcctggcctggggcgcccagaccttcaccagcggcaagtactactgggaggtgcacgtgggcgacagctggaactgggccttcggcgtgtgcaacatgtactggaaggagaagaaccagaacgagaagatcgacggcgaggacggcctgttcctgctgggctgcgtgaagaacgacatccagagaagcctgttcaccaccagccccctgctgctgcagtacatccccagacccaccagcagagtgggcctgttcctggactgcgaggccaagaccgtgagcttcgtggacgtgaaccagagcagcctgatctacaccatccccaactgcagcttcagcccccccctgagacccatcttctgctgcatccacttctag

SEQ ID NO: 24142 - DNA, 339 bp, Artificial Sequence
  Description of Artificial Sequence: Synthetic coding sequence
caggtggcctacgtgagagccagagagctgcacaccctggaggtgaccggcctggagaccgtggcccagagcaaggcccacgtggccagcctggagggcctgatccccgaggacaaggtggtgctgctggccggcagccccctgcagaacgaggccaccctgggccagtgcggcgtggaggccctgaccaccctggaggtggtgggcagaagactgggcggcaacaactgcctgagcctgcaggtgaaccccgtgcagcccgccagatacctgtggaccaccctgcacagcagcaagcagggcgagcccaacagcagcgccaaccacagatgcagctag

SEQ ID NO: 24143 - DNA, 1026 bp, Artificial Sequence
  Description of Artificial Sequence: Synthetic coding sequence
atgagactgtgcctgatccccagaaacaccggcaccccccagagagtgctgagacccgtggtgtggagcccccccagcagaaagaagcccgtgctgagcccccacaacagcatcatgttcggccacctgagccccgtgagaatcccctgcctgagaggcaagttcaacctgcagctgcccagcctggacgaccaggtgatccccgccagactgcccaagaccgaggtgagcgccgaggagcccaaggaggccaccgaggtgaaggaccaggtggagacccagggccaggaggacaacaagagaggcccctgcagcaacggcgaggccgccagcaccagcagacccctggagacccagggcaacctgaccagcagctggtacaaccccagacccctggagggcaacgtgcacctgaagagcctgaccgagaagaaccagaccgacaaggcccaggtgcacgccgtgagcttctacagcaagggccacggcgtggccagcagccacagccccgccggcggcatcctgcccttcggcaagcccgaccccctgcccaccgtgctgcccgcccccgtgcccggctgcagcctgtggcccgagaaggccgccctgaaggtgctgggcgaggaccacctgcccagcagccccggcctgctgatggtgggcgaggacatgcagcccaaggaccccgccgccctgggcagcagcagaagcagcccccccagagccgccggccacagaagccacaagagaaagctgagcggcccccccctgcagctgcagcccaccccccccctgcagctgagatgcgacagagacgagagacccccccccgccaagctgccctgcctgagccccgaggccctgctggtgggccaggccagccagagagagggcagactgcagcacggcaacatgagaaagaacatgagagtgctgagcagaatcagcaagttcagaagactgagacagctgctgagaagaagaaagaagaccagacagggcagaagaggcggcagctgcctgtag

SEQ ID NO: 24144 - DNA, 285 bp, Artificial Sequence
  Description of Artificial Sequence: Synthetic coding sequence
atgagaaagctgagactgagagccagcaaccccggccccagcggcgcccccggcaccagacagcacttcagcaccagcagaggcggccaccactgcgccagaagatggctgagaagagtgagaagaagcagaagccagacccccagctaccagaacctggaccccaacccccccatcgtgagattccccctgcccctggagagaatcagcgaggtgcccagaagagcctgcctgcacggcagagacgccagcagcgtgtggcccccccccgagagaagcgactag

SEQ ID NO: 24145 - DNA, 2268 bp, Artificial Sequence
  Description of Artificial Sequence: Synthetic coding sequence
atggccgccgtggccgccgaggccgccgccaccgccgccagccccggcgagggcggcgccggcgaggccgagcccgagatggagcccatccccggcagcgaggccggcaccgaccccctgcccgtgaccgccaccgaggccagcgtgcccgacggcgagaccgacggccagcagagcgccccccaggccgacgagccccccctgcccccccccccccccccccccggcgagctggccagaagccccgaggccgtgggccccgagctggaggccgaggagaagctgagcgtgagagtggccgagagcgccgccgccgccccccagggcggccccgagctgccccccagccccgccagcccccccgagcagccccccgcccccgaggagagagaggagccccccctgccccagcccgtggcccccgccctggtgccccccgccggcggcgacagcaccgtgagccagctgatccccggcagcgaggtgagagtgaccctggaccacatcatcgaggacgccctggtggtgagcttcagattcggcgagaagctgttcagcggcgtgctgatggacctgagcaagagattcggcccccacggcatccccgtgaccgtgttccccaagagagagtacaaggacaagcccgaggccatgcccctgcagagcaacaccttccaggagggcaccgaggtgaagtgcgaggccaacggcgccgtgcccgacgaccccagccccgtgccccaccccgagctgagcctggccgagagcctgtggaccagcaagcccccccccctgttccacgagggcgccccctaccccccccccctgttcatcagagacacctacaaccagagcatcccccagcccccccccagaaagatcaagagacccaagagaaagatgtacagagaggagcccaccagcatcatgaacgccatcaagctgagacccagacaggtgctgtgcgacaagtgcaagaacagcgtggtggccgagaagaaggagatcagaaagggcagcagcgccaccgacagcagcaagtacgaggacaagaagagaagaaacgagagcgtgaccaccgtgaacaagaagctgaagaccgaccacaaggtggacggcaagaaccagaacgagagccagaagagaaacgccgtggtgaaggtgagcaacatcgcccacagcagaggcagagtggtgaaggtgagcgcccaggccaacaccagcaaggcccagctgagcaccaagaaggtgctgcagagcaagaacatggaccacgccaaggccagagaggtgctgaagatcgccaaggagaaggcccagaagaagcagaacgagaccagcaccagcaagaacgcccacagcaaggtgcacttcaccagaagataccagaaccccagcagcggcagcctgccccccagagtgagactgaagccccagagatacagaaacgaggagaacgacagcagcctgaagaccggcctggagaagatgagaagcggcaagatggcccccaagccccagagcagatgcaccagcaccagaagcgccggcgaggcccccagcgagaaccagagccccagcaagggccccgaggaggccagcagcgaggtgcaggacaccaacgaggtgcacgtgcccggcgaccaggacgagccccagaccctgggcaagaagggcagcaagaacaacatcagcgtgtacatgaccctgaaccagaagaagagcgacagcagcagcgccagcgtgtgcagcatcgacagcaccgacgacctgaagagcagcaacagcgagtgcagcagcagcgagagcttcgacttcccccccggcagcatgcacgcccccagcaccagcagcaccagcagcagcagcaaggaggagaagaagctgagcaacagcctgaagatgaaggtgttcagcaagaacgtgagcaagtgcgtgacccccgacggcagaaccatctgcgtgggcgacatcgtgtgggccaagatctacggcttcccctggtggcccgccagaatcctgaccatcaccgtgagcagaaaggacaacggcctgctggtgagacaggaggccagaatcagctggttcggcagccccaccaccagcttcctggccctgagccagctgagccccttcctggagaacttccagagcagattcaacaagaagagaaagggcctgtacagaaaggccatcaccgaggccgccaaggccgccaagcagctgacccccgaggtgagagccctgctgacccagttcgagacctag

SEQ ID NO: 24146 - DNA, 1683 bp, Artificial Sequence
  Description of Artificial Sequence: Synthetic coding sequence
atggccgccgtggccgccgaggccgccgccaccgccgccagccccggcgagggcggcgccggcgaggccgagcccgagatggagcccatccccggcagcgaggccggcaccgaccccctgcccgtgaccgccaccgaggccagcgtgcccgacggcgagaccgacggccagcagagcgccccccaggccgacgagccccccctgcccccccccccccccccccccggcgagctggccagaagccccgaggccgtgggccccgagctggaggccgaggagaagctgagcgtgagagtggccgagagcgccgccgccgccccccagggcggccccgagctgccccccagccccgccagcccccccgagcagccccccgcccccgaggagagagaggagccccccctgccccagcccgtggcccccgccctggtgccccccgccggcggcgacagcaccgtgagccagctgatccccggcagcgaggtgagagtgaccctggaccacatcatcgaggacgccctggtggtgagcttcagattcggcgagaagctgttcagcggcgtgctgatggacctgagcaagagattcggcccccacggcatccccgtgaccgtgttccccaagagagagtacaaggacaagcccgaggccatgcccctgcagagcaacaccttccaggagggcaccgaggtgaagtgcgaggccaacggcgccgtgcccgacgaccccagccccgtgccccaccccgagctgagcctggccgagagcctgtggaccagcaagcccccccccctgttccacgagggcgccccctaccccccccccctgttcatcagagacacctacaaccagagcatcccccagcccccccccagaaagatcaagagacccaagagaaagatgtacagagaggagcccaccagcatcatgaacgccatcaagctgagacccagacaggtgctgtgcgacaagtgcaagaacagcgtggtggccgagaagaaggagatcagaaagggcagcagcgccaccgacagcagcaagtacgaggacaagaagagaagaaacgagagcgtgaccaccgtgaacaagaagctgaagaccgaccacaaggtggacggcaagaaccagaacgagagccagaagagaaacgccgtggtgaaggtgagcaacatcgcccacagcagaggcagagtggtgaaggtgagcgcccaggccaacaccagcaaggcccagctgagcaccaagaaggtgctgcagagcaagaacatggaccacgccaaggccagagaggtgctgaagatcgccaaggagaaggcccagaagaagcagaacgagaccagcaccagcaagaacgcccacagcaaggtgcacttcaccagaagataccagaaccccagcagcggcagcctgccccccagagtgagactgaagccccagagatacagaaacgaggagaacgacagcagcctgaagaccggcctggagaagatgagaagcggcaagatggcccccaagccccagagcagatgcaccagcaccagaagcgccggcctgaacaagtggcagctgctgcaccagaccgtgaccagccccgccgcccccctgcagtgcctgaccgaccactgcggcttcagactgggcgccctgaagctgaccgtgaagagagccgcccagagacactag

SEQ ID NO: 24147 - DNA, 1563 bp, Artificial Sequence
  Description of Artificial Sequence: Synthetic coding sequence
atggccgccgtggccgccgaggccgccgccaccgccgccagccccggcgagggcggcgccggcgaggccgagcccgagatggagcccatccccggcagcgaggccggcaccgaccccctgcccgtgaccgccaccgaggccagcgtgcccgacggcgagaccgacggccagcagagcgccccccaggccgacgagccccccctgcccccccccccccccccccccggcgagctggccagaagccccgaggccgtgggccccgagctggaggccgaggagaagctgagcgtgagagtggccgagagcgccgccgccgccccccagggcggccccgagctgccccccagccccgccagcccccccgagcagccccccgcccccgaggagagagaggagccccccctgccccagcccgtggcccccgccctggtgccccccgccggcggcgacagcaccgtgagccagctgatccccggcagcgaggtgagagtgaccctggaccacatcatcgaggacgccctggtggtgagcttcagattcggcgagaagctgttcagcggcgtgctgatggacctgagcaagagattcggcccccacggcatccccgtgaccgtgttccccaagagagagtacaaggacaagcccgaggccatgcccctgcagagcaacaccttccaggagggcaccgaggtgaagtgcgaggccaacggcgccgtgcccgacgaccccagccccgtgccccaccccgagctgagcctggccgagagcctgtggaccagcaagcccccccccctgttccacgagggcgccccctaccccccccccctgttcatcagagacacctacaaccagagcatcccccagcccccccccagaaagatcaagagacccaagagaaagatgtacagagaggagcccaccagcatcatgaacgccatcaagctgagacccagacaggtgctgtgcgacaagtgcaagaacagcgtggtggccgagaagaaggagatcagaaagggcagcagcgccaccgacagcagcaagtacgaggacaagaagagaagaaacgagagcgtgaccaccgtgaacaagaagctgaagaccgaccacaaggtggacggcaagaaccagaacgagagccagaagagaaacgccgtggtgaaggtgagcaacatcgcccacagcagaggcagagtggtgaaggtgagcgcccaggccaacaccagcaaggcccagctgagcaccaagaaggtgctgcagagcaagaacatggaccacgccaaggccagagaggtgctgaagatcgccaaggagaaggcccagaagaagcagaacgagaccagcaccagcaagaacgcccacagcaaggtgcacttcaccagaagataccagaaccccagcagcggcagcctgccccccagagtgagactgaagccccagagatacagaaacgaggagaacgacagcagcctgaagaccggcctggagaagatgagaagcggcaagatggcccccaagccccagagcagatgcaccagcaccagaagcgccgcccagagacactag

SEQ ID NO: 24148 - DNA, 1773 bp, Artificial Sequence
  Description of Artificial Sequence: Synthetic coding sequence
atggagcccagagccggctgcagactgcccgtgagagtggagcaggtggtgaacggcgccctggtggtgaccgtgagctgcggcgagagaagcttcgccggcatcctgctggactgcaccaagaagagcggcctgttcggcctgccccccctggcccccctgccccaggtggacgagagccccgtgaacgacagccacggcagagcccccgaggagggcgacgccgaggtgatgcagctgggcagcagcagccccccccccgccagaggcgtgcagccccccgagaccaccagacccgagccccccccccccctggtgccccccctgcccgccggcagcctgcccccctaccccccctacttcgagggcgcccccttcccccaccccctgtggctgagagacacctacaagctgtgggtgccccagcccccccccagaaccatcaagagaaccagaagaagactgagcagaaacagagaccccggcagactgatcctgagcaccatcagactgagacccagacaggtgctgtgcgagaagtgcaagagcaccctgagcccccccgaggccagccccggcccccccgccgcccccagagccagaagaagactgggcagcggccccgacagagagctgagaaagcccgaggagcccgagaacggcgagcccaccgccgccgccaccgccagaagaagcaagagagagagaagagaggaggacagagcccccgccgagcaggtgcccagaagccccgtgatcaagatcagctacagcaccccccagggcaagggcgaggtggtgaagatccccagcagagtgcacggcagcctggagcccttcagaccccagcaggccccccaggacgacggcagccaggaccccgaggtgctggacagagagagcagagacagacccagctgcgcccccagcgccagcatccccaagctgaagctgaccagacccgtgcccgccggcgccgacctgcccccccccaagatcagactgaagccccacagactgggcgacagcgagcacgagcccgtgtacagagccgagctggtgggcgagctgaacggctacctgagagacagcagccccgccccctgcgccgacggccccgccggcggcctggccgacctgagcagcggcagcagcggcgaggacgacgacttcaagagctgcccccagggcccccagggcagagagggcctggccttcctggtgagctgccccgagggcagagccgactgcgccagcgagagcgcctgcagcagcgacagcctggacgaggccagaagcagcggcagcgagggcacccccgccgacaccggcgacctgagccccggccacggcgccagcgcccccagcgtgagcagagaggccagacagaccgtgccccccctgaccgtgagactgcacacccagagcgtgagcgagtgcatcaccgaggacggcagaaccgtggccgtgggcgacatcgtgtggggcaagatccacggcttcccctggtggcccgccagagtgctggacatcagcctgggccagaaggaggacggcgagcccagctggagagaggccaaggtgagctggttcggcagccccaccaccagcttcctgagcatcagcaagctgagccccttcagcgagttcttcaagctgagattcaacagaaagaagaagggcatgtacagaaaggccatcaccgaggccgccaacgccgccagacacgtggcccccgagatcagagagctgctgacccagttcgagacctag

SEQ ID NO: 24149 - DNA, 1500 bp, Artificial Sequence
  Description of Artificial Sequence: Synthetic coding sequence
atggagcccagagccggctgcagactgcccgtgagagtggagcaggtggtgaacggcgccctggtggtgaccgtgagctgcggcgagagaagcttcgccggcatcctgctggactgcaccaagaagagcggcctgttcggcctgccccccctggcccccctgccccaggtggacgagagccccgtgaacgacagccacggcagagcccccgaggagggcgacgccgaggtgatgcagctgggcagcagcagccccccccccgccagaggcgtgcagccccccgagaccaccagacccgagccccccccccccctggtgccccccctgcccgccggcagcctgcccccctaccccccctacttcgagggcgcccccttcccccaccccctgtggctgagagacacctacaagctgtgggtgccccagcccccccccagaaccatcaagagaaccagaagaagactgagcagaaacagagaccccggcagactgatcctgagcaccatcagactgagacccagacaggtgctgtgcgagaagtgcaagagcaccctgagcccccccgaggccagccccggcccccccgccgcccccagagccagaagaagactgggcagcggccccgacagagagctgagaaagcccgaggagcccgagaacggcgagcccaccgccgccgccaccgccagaagaagcaagagagagagaagagaggaggacagagcccccgccgagcaggtgcccagaagccccgtgatcaagatcagctacagcaccccccagggcaagggcgaggtggtgaagatccccagcagagtgcacggcagcctggagcccttcagaccccagcaggccccccaggacgacggcagccaggaccccgaggtgctggacagagagagcagagacagacccagctgcgcccccagcgccagcatccccaagctgaagctgaccagacccgtgcccgccggcgccgacctgcccccccccaagatcagactgaagccccacagactgggcgacagcgagcacgagcccgtgtacagagccgagctggtgggcgagctgaacggctacctgagagacagcagccccgccccctgcgccgacggccccgccggcggcctggccgacctgagcagcggcagcagcggcgaggacgacgacttcaagagctgcccccagggcccccagggcagagagggcctggccttcctggtgagctgccccgagggcagagccgactgcgccagcgagagcgcctgcagcagcgacagcctggacgaggccagaagcagcggcagcgagggcacccccgccgacaccggcgacctgagccccggccacggcgccagcgcccccagcgtgagcagagaggccagacagaccgtgccccccctgaccgtgagactgcacacccagagcgtgagcgagtgcatcaccgaggacggcagaaccgtggccgtgggcgacatcgtgtggggccacagaagatag

SEQ ID NO: 24150 - DNA, 540 bp, Artificial Sequence
  Description of Artificial Sequence: Synthetic coding sequence
tgacagagcagaagaatcgagcccgtgatgggcagactgctgctgtgcgccagccacggcgagatcgagaagcaccccagcctgcacgccagcagctacggcctggtggccatcaaggaggcccacgacatcgagaccagactgaacgaggtggagaagctgctgaagaccatcatcagcatgccctgcaagtacagcagaagcgaggtggtgctgaccttcttcgagagaagccccctggaccaggtgctgaagaacgacaacgtgcacaagatccagcccagcttccagagccccgtgaagatcagcgagatcatgagaagcaacggcttctgcctggccaacaccgagaccatcgtgatcgaccacagcatccccaacggcagagaccagcagctgggcgtggaccccaccgagcacctgttcgagaacggcagcgagttccccagcgagctggaggacggcgacgaccccgccgcctacgtgaccaacctgagctactaccacctggtgcccttcgagaccgacatctgggactag

SEQ ID NO: 24151 - DNA, 696 bp, Artificial Sequence
  Description of Artificial Sequence: Synthetic coding sequence
atggccagcgccgtgttcgagggcaccagcctggtgaacatgttcgtgagaggctgctgggtgaacggcatcagaagactgatcgtgagcagaagaggcgacgaggaggagttcttcgagatcagaaccgagtggagcgacagaagcgtgctgtacctgcacagaagcctggccgacctgggcagactgtggcagagactgagagacgccttccccgaggacagaagcgagctggcccagggccccctgagacagggcctggtggccatcaaggaggcccacgacatcgagaccagactgaacgaggtggagaagctgctgaagaccatcatcagcatgccctgcaagtacagcagaagcgaggtggtgctgaccttcttcgagagaagccccctggaccaggtgctgaagaacgacaacgtgcacaagatccagcccagcttccagagccccgtgaagatcagcgagatcatgagaagcaacggcttctgcctggccaacaccgagaccatcgtgatcgaccacagcatccccaacggcagagaccagcagctgggcgtggaccccaccgagcacctgttcgagaacggcagcgagttccccagcgagctggaggacggcgacgaccccgccgcctacgtgaccaacctgagctactaccacctggtgcccttcgagaccgacatctgggactag

SEQ ID NO: 24152 - DNA, 1503 bp, Artificial Sequence
  Description of Artificial Sequence: Synthetic coding sequence
atggaggccgccagacccccccccaccgccggcaagttcgtggtggtgggcggcggcatcgccggcgtgacctgcgccgagcagctggccacccacttccccagcgaggacatcctgctggtgaccgccagccccgtgatcaaggccgtgaccaacttcaagcagatcagcaagatcctggaggagttcgacgtggaggagcagagcagcaccatgctgggcaagagattccccaacatcaaggtgatcgagagcggcgtgaagcagctgaagagcgaggagcactgcatcgtgaccgaggacggcaaccagcacgtgtacaagaagctgtgcctgtgcgccggcgccaagcccaagctgatctgcgagggcaacccctacgtgctgggcatcagagacaccgacagcgcccaggagttccagaagcagctgaccaaggccaagagaatcatgatcatcggcaacggcggcatcgccctggagctggtgtacgagatcgagggctgcgaggtgatctgggccatcaaggacaaggccatcggcaacaccttcttcgacgccggcgccgccgagttcctgaccagcaagctgatcgccgagaagagcgaggccaagatcgcccacaagagaaccagatacaccaccgagggcagaaagaaggaggccagaagcaagagcaaggccgacaacgtgggcagcgccctgggccccgactggcacgagggcctgaacctgaagggcaccaaggagttcagccacaagatccacctggagaccatgtgcgaggtgaagaagatctacctgcaggacgagttcagaatcctgaagaagaagagcttcaccttccccagagaccacaagagcgtgaccgccgacaccgagatgtggcccgtgtacgtggagctgaccaacgagaagatctacggctgcgacttcatcgtgagcgccaccggcgtgacccccaacgtggagcccttcctgcacggcaacagcttcgacctgggcgaggacggcggcctgaaggtggacgaccacatgcacaccagcctgcccgacatctacgccgccggcgacatctgcaccaccagctggcagctgagccccgtgtggcagcagatgagactgtggacccaggccagacagatgggctggtacgccgccaagtgcatggccgccgccagcagcggcgacagcatcgacatggacttcagcttcgagctgttcgcccacgtgaccaagttcttcaactacaaggtggtgctgctgggcaagtacaacgcccagggcctgggcagcgaccacgagctgatgctgagatgcaccaagggcagagagtacatcaaggtggtgatgcagaacggcagaatgatgggcgccgtgctgatcggcgagaccgacctggaggagaccttcgagaacctgatcctgaaccagatgaacctgagcagctacggcgaggacctgctggaccccaacatcgacatcgaggactacttcgactag

SEQ ID NO: 24153 - DNA, 420 bp, Artificial Sequence
  Description of Artificial Sequence: Synthetic coding sequence
atggaggccgccagacccccccccaccgccggcaagttcgtggtggtgggcggcggcatcgccggcgtgacctgcgccgagcagctggccacccacttccccagcgaggacatcctgctggtgaccgccagccccgtgatcaaggccgtgaccaacttcaagcagatcagcaagatcctggaggagttcgacgtggaggagcagagcagcaccatgctgggcaagagattccccaacatcaaggtgatcgagagcggcgtgaagcagctgaagagcgaggagcactgcatcgtgaccgaggacggcaaccagcacgtgtacaagaagctgtgcctgtgcgccggcgccaagcccaagctgatctgcgagggcaacccctacgtgctgggcatcagagacaccgacagcgcccaggtgtag

SEQ ID NO: 24154 - DNA, 1746 bp, Artificial Sequence
  Description of Artificial Sequence: Synthetic coding sequence
atggccgccagcggcagaggcctgtgcaaggccgtggccgccagccccttccccgcctggagaagagacaacaccgaggccagaggcggcctgaagcccgagtacgacgccgtggtgatcggcgccggccacaacggcctggtggccgccgcctacctgcagagactgggcgtgaacaccgccgtgttcgagagaagacacgtgatcggcggcgccgccgtgaccgaggagatcatccccggcttcaagttcagcagagccagctacctgctgagcctgctgagaccccagatctacaccgacctggagctgaagaagcacggcctgagactgcacctgagaaacccctacagcttcacccccatgctggaggagggcgccggcagcaaggtgcccagatgcctgctgctgggcaccgacatggccgagaaccagaagcagatcgcccagttcagccagaaggacgcccaggtgttccccaagtacgaggagttcatgcacagactggccctggccatcgaccccctgctggacgccgcccccgtggacatggccgccttccagcacggcagcctgctgcagagaatgagaagcctgagcaccctgaagcccctgctgaaggccggcagaatcctgggcgcccagctgcccagatactacgaggtgctgaccgcccccatcaccaaggtgctggaccagtggttcgagagcgagcccctgaaggccaccctggccaccgacgccgtgatcggcgccatgaccagcccccacacccccggcagcggctacgtgctgctgcaccacgtgatgggcggcctggagggcatgcagggcgcctggggctacgtgcagggcggcatgggcgccctgagcgacgccatcgccagcagcgccaccacccacggcgccagcatcttcaccgagaagaccgtggccaaggtgcaggtgaacagcgagggctgcgtgcagggcgtggtgctggaggacggcaccgaggtgagaagcaagatggtgctgagcaacaccagcccccagatcaccttcctgaagctgaccccccaggagtggctgcccgaggagttcctggagagaatcagccagctggacaccagaagccccgtgaccaagatcaacgtggccgtggacagactgcccagcttcctggccgcccccaacgcccccagaggccagcccctgccccaccaccagtgcagcatccacctgaactgcgaggacaccctgctgctgcaccaggccttcgaggacgccatggacggcctgcccagccacagacccgtgatcgagctgtgcatccccagcagcctggaccccaccctggccccccccggctgccacgtggtgagcctgttcacccagtacatgccctacaccctggccggcggcaaggcctgggacgagcaggagagagacgcctacgccgacagagtgttcgactgcatcgaggtgtacgcccccggcttcaaggacagcgtggtgggcagagacatcctgaccccccccgacctggagagaatcttcggcctgcccggcggcaacatcttccactgcgccatgagcctggaccagctgtacttcgccagacccgtgcccctgcacagcggctacagatgccccctgcagggcctgtacctgtgcggcagcggcgcccaccccggcggcggcgtgatgggcgccgccggcagaaacgccgcccacgtggccttcagagacctgaagagcatgtag

SEQ ID NO: 24155 - DNA, 591 bp, Artificial Sequence
  Description of Artificial Sequence: Synthetic coding sequence
atgaagcccagaaccctggtggagctgagcaagctgggcctgggcaacgagaccgtggtgcagctgagaaccctggagctgcccgtggactacagagaggccaagagaagagtgaccggcatctgggaggaccaccagccccagctggtggtgcacgtgggcatggacaccgccgccaaggccatcatcctggagcagagcggcaagaaccagggctacagagacgccgacatcagaagcttctggcccgagggcggcgtgtgcctgcccggcagccccgacgtgctggagagcggcgtgtgcatgaaggccgtgtgcaagagagtggccgtggagggcgtggacgtgatcttcagcagagacgccggcagatacgtgtgcgactacacctactacctgagcctgcaccacggcaagggctgcgccgccctgatccacgtgccccccctgagcagaggcctgcccgccagcctgctgggcagagccctgagagtgatcatccaggagatgctggaggaggtgggcaagcccaagcacagagcccagttcgaggagaacagcaccatggtgctgcccgccaagggcaactag

SEQ ID NO: 24156 - DNA, 429 bp, Artificial Sequence
  Description of Artificial Sequence: Synthetic coding sequence
atggacaccgccgccaaggccatcatcctggagcagagcggcaagaaccagggctacagagacgccgacatcagaagcttctggcccgagggcggcgtgtgcctgcccggcagccccgacgtgctggagagcggcgtgtgcatgaaggccgtgtgcaagagagtggccgtggagggcgtggacgtgatcttcagcagagacgccggcagatacgtgtgcgactacacctactacctgagcctgcaccacggcaagggctgcgccgccctgatccacgtgccccccctgagcagaggcctgcccgccagcctgctgggcagagccctgagagtgatcatccaggagatgctggaggaggtgggcaagcccaagcacagagcccagttcgaggagaacagcaccatggtgctgcccgccaagggcaactag

SEQ ID NO: 24157 - DNA, 429 bp, Artificial Sequence; identical to SEQ ID NO: 24156
  Description of Artificial Sequence: Synthetic coding sequence

SEQ ID NO: 24158 - DNA, 8397 bp, Artificial Sequence
  Description of Artificial Sequence: Synthetic coding sequence
atgaccagcatccacttcgtggtgcaccccctgcccggcaccgaggaccagctgaacgacagactgagagaggtgagcgagaagctgaacaagtacaacctgaacagccacccccccctgaacgtgctggagcaggccaccatcaagcagtgcgtggtgggccccaaccacgccgccttcctgctggaggacggcagagtgtgcagaatcggcttcagcgtgcagcccgacagactggagctgggcaagcccgacaacaacgacggcagcaagctgaacagcaacagcggcgccggcagaaccagcagacccggcagaaccagcgacagcccctggttcctgagcggcagcgagaccctgggcagactggccggcaacaccctgggcagcagatggagcagcggcgtgggcggcagcggcggcggcagcagcggcagaagcagcgccggcgccagagacagcagaagacagaccagagtgatcagaaccggcagagacagaggcagcggcctgctgggcagccagccccagcccgtgatccccgccagcgtgatccccgaggagctgatcagccaggcccaggtggtgctgcagggcaagagcagaagcgtgatcatcagagagctgcagagaaccaacctggacgtgaacctggccgtgaacaacctgctgagcagagacgacgaggacggcgacgacggcgacgacaccgccagcgagagctacctgcccggcgaggacctgatgagcctgctggacgccgacatccacagcgcccaccccagcgtgatcatcgacgccgacgccatgttcagcgaggacatcagctacttcggctaccccagcttcagaagaagcagcctgagcagactgggcagcagcagagtgctgctgctgcccctggagagagacagcgagctgctgagagagagagagagcgtgctgagactgagagagagaagatggctggacggcgccagcttcgacaacgagagaggcagcaccagcaaggagggcgagcccaacctggacaagaagaacacccccgtgcagagccccgtgagcctgggcgaggacctgcagtggtggcccgacaaggacggcaccaagttcatctgcatcggcgccctgtacagcgagctgctggccgtgagcagcaagggcgagctgtaccagtggaagtggagcgagagcgagccctacagaaacgcccagaaccccagcctgcaccaccccagagccaccttcctgggcctgaccaacgagaagatcgtgctgctgagcgccaacagcatcagagccaccgtggccaccgagaacaacaaggtggccacctgggtggacgagaccctgagcagcgtggccagcaagctggagcacaccgcccagacctacagcgagctgcagggcgagagaatcgtgagcctgcactgctgcgccctgtacacctgcgcccagctggagaacagcctgtactggtggggcgtggtgcccttcagccagagaaagaagatgctggagaaggccagagccaagaacaagaagcccaagagcagcgccggcatcagcagcatgcccaacatcaccgtgggcacccaggtgtgcctgagaaacaaccccctgtaccacgccggcgccgtggccttcagcatcagcgccggcatccccaaggtgggcgtgctgatggagagcgtgtggaacatgaacgacagctgcagattccagctgagaagccccgagagcctgaagaacatggagaaggccagcaagaccaccgaggccaagcccgagagcaagcaggagcccgtgaagaccgagatgggccccccccccagccccgccagcacctgcagcgacgccagcagcatcgccagcagcgccagcatgccctacaagagaagaagaagcacccccgcccccaaggaggaggagaaggtgaacgaggagcagtggagcctgagagaggtggtgttcgtggaggacgtgaagaacgtgcccgtgggcaaggtgctgaaggtggacggcgcctacgtggccgtgaagttccccggcaccagcagcaacaccaactgccagaacagcagcggccccgacgccgaccccagcagcctgctgcaggactgcagactgctgagaatcgacgagctgcaggtggtgaagaccggcggcacccccaaggtgcccgactgcttccagagaacccccaagaagctgtgcatccccgagaagaccgagatcctggccgtgaacgtggacagcaagggcgtgcacgccgtgctgaagaccggcaactgggtgagatactgcatcttcgacctggccaccggcaaggccgagcaggagaacaacttccccaccagcagcatcgccttcctgggccagaacgagagaaacgtggccatcttcaccgccggccaggagagccccatcatcctgagagacggcaacggcaccatctaccccatggccaaggactgcatgggcggcatcagagaccccgactggctggacctgccccccatcagcagcctgggcatgggcgtgcacagcctgatcaacctgcccgccaacagcaccatcaagaagaaggccgccgtgatcatcatggccgtggagaagcagaccctgatgcagcacatcctgagatgcgactacgaggcctgcagacagtacctgatgaacctggagcaggccgtggtgctggagcagaacctgcagatgctgcagaccttcatcagccacagatgcgacggcaacagaaacatcctgcacgcctgcgtgagcgtgtgcttccccaccagcaacaaggagaccaaggaggaggaggaggccgagagaagcgagagaaacaccttcgccgagagactgagcgccgtggaggccatcgccaacgccatcagcgtggtgagcagcaacggccccggcaacagagccggcagcagcagcagcagaagcctgagactgagagagatgatgagaagaagcctgagagccgccggcctgggcagacacgaggccggcgccagcagcagcgaccaccaggaccccgtgagcccccccatcgccccccccagctgggtgcccgacccccccgccatggaccccgacggcgacatcgacttcatcctggcccccgccgtgggcagcctgaccaccgccgccaccggcaccggccagggccccagcaccagcaccatccccggccccagcaccgagcccagcgtggtggagagcaaggacagaaaggccaacgcccacttcatcctgaagctgctgtgcgacagcgtggtgctgcagccctacctgagagagctgctgagcgccaaggacgccagaggcatgacccccttcatgagcgccgtgagcggcagagcctaccccgccgccatcaccatcctggagaccgcccagaagatcgccaaggccgagatcagcagcagcgagaaggaggaggacgtgttcatgggcatggtgtgccccagcggcaccaaccccgacgacagccccctgtacgtgctgtgctgcaacgacacctgcagcttcacctggaccggcgccgagcacatcaaccaggacatcttcgagtgcagaacctgcggcctgctggagagcctgtgctgctgcaccgagtgcgccagagtgtgccacaagggccacgactgcaagctgaagagaaccagccccaccgcctactgcgactgctgggagaagtgcaagtgcaagaccctgatcgccggccagaagagcgccagactggacctgctgtacagactgctgaccgccaccaacctggtgaccctgcccaacagcagaggcgagcacctgctgctgttcctggtgcagaccgtggccagacagaccgtggagcactgccagtacagaccccccagaatcagagaggacagaaacagaaagaccgccagccccgaggacagcgacatgcccgaccacgacctggagccccccagattcgcccagctggccctggagagagtgctgcaggactggaacgccctgaagagcatgatcatgttcggcagccaggagaacaaggaccccctgagcgccagcagcagaatcggccacctgctgcccgaggagcaggtgtacctgaaccagcagagcggcaccatcagactggactgcttcacccactgcctgatcgtgaagtgcaccgccgacatcctgctgctggacaccctgctgggcaccctggtgaaggagctgcagaacaagtacacccccggcagaagagaggaggccatcgccgtgaccatgagattcctgagaagcgtggccagagtgttcgtgatcctgagcgtggagatggccagcagcaagaagaagaacaacttcatcccccagcccatcggcaagtgcaagagagtgttccaggccctgctgccctacgccgtggaggagctgtgcaacgtggccgagagcctgatcgtgcccgtgagaatgggcatcgccagacccaccgcccccttcaccctggccagcaccagcatcgacgccatgcagggcagcgaggagctgttcagcgtggagcccctgccccccagacccagcagcgaccagagcagcagcagcagccagagccagagcagctacatcatcagaaacccccagcagagaagaatcagccagagccagcccgtgagaggcagagacgaggagcaggacgacatcgtgagcgccgacgtggaggaggtggaggtggtggagggcgtggccggcgaggaggaccaccacgacgagcaggaggagcacggcgaggagaacgccgaggccgagggccagcacgacgagcacgacgaggacggcagcgacatggagctggacctgctggccgccgccgagaccgagagcgacagcgagagcaaccacagcaaccaggacaacgccagcggcagaagaagcgtggtgaccgccgccaccgccggcagcgaggccggcgccagcagcgtgcccgccttcttcagcgaggacgacagccagagcaacgacagcagcgacagcgacagcagcagcagccagagcgacgacatcgagcaggagaccttcatgctggacgagcccctggagagaaccaccaacagcagccacgccaacggcgccgcccaggcccccagaagcatgcagtgggccgtgagaaacacccagcaccagagagccgccagcaccgcccccagcagcaccagcacccccgccgccagcagcgccggcctgatctacatcgaccccagcaacctgagaagaagcggcaccatcagcaccagcgccgccgccgccgccgccgccctggaggccagcaacgccagcagctacctgaccagcgccagcagcctggccagagcctacagcatcgtgatcagacagatcagcgacctgatgggcctgatccccaagtacaaccacctggtgtacagccagatccccgccgccgtgaagctgacctaccaggacgccgtgaacctgcagaactacgtggaggagaagctgatccccacctggaactggatggtgagcatcatggacagcaccgaggcccagctgagatacggcagcgccctggccagcgccggcgaccccggccaccccaaccaccccctgcacgccagccagaacagcgccagaagagagagaatgaccgccagagaggaggccagcctgagaaccctggagggcagaagaagagccaccctgctgagcgccagacagggcatgatgagcgccagaggcgacttcctgaactacgccctgagcctgatgagaagccacaacgacgagcacagcgacgtgctgcccgtgctggacgtgtgcagcctgaagcacgtggcctacgtgttccaggccctgatctactggatcaaggccatgaaccagcagaccaccctggacaccccccagctggagagaaagagaaccagagagctgctggagctgggcatcgacaacgaggacagcgagcacgagaacgacgacgacaccaaccagagcgccaccctgaacgacaaggacgacgacagcctgcccgccgagaccggccagaaccaccccttcttcagaagaagcgacagcatgaccttcctgggctgcatcccccccaaccccttcgaggtgcccctggccgaggccatccccctggccgaccagccccacctgctgcagcccaacgccagaaaggaggacctgttcggcagacccagccagggcctgtacagcagcagcgccagcagcggcaagtgcctgatggaggtgaccgtggacagaaactgcctggaggtgctgcccaccaagatgagctacgccgccaacctgaagaacgtgatgaacatgcagaacagacagaagaaggagggcgaggagcagcccgtgctgcccgaggagaccgagagcagcaagcccggccccagcgcccacgacctggccgcccagctgaagagcagcctgctggccgagatcggcctgaccgagagcgagggcccccccctgaccagcttcagaccccagtgcagcttcatgggcatggtgatcagccacgacatgctgctgggcagatggagactgagcctggagctgttcggcagagtgttcatggaggacgtgggcgccgagcccggcagcatcctgaccgagctgggcggcttcgaggtgaaggagagcaagttcagaagagagatggagaagctgagaaaccagcagagcagagacctgagcctggaggtggacagagacagagacctgctgatccagcagaccatgagacagctgaacaaccacttcggcagaagatgcgccaccacccccatggccgtgcacagagtgaaggtgaccttcaaggacgagcccggcgagggcagcggcgtggccagaagcttctacaccgccatcgcccaggccttcctgagcaacgagaagctgcccaacctggagtgcatccagaacgccaacaagggcacccacaccagcctgatgcagagactgagaaacagaggcgagagagacagagagagagagagagagagagagatgagaagaagcagcggcctgagagccggcagcagaagagacagagacagagacttcagaagacagctgagcatcgacaccagacccttcagacccgccagcgagggcaaccccagcgacgaccccgagcccctgcccgcccacagacaggccctgggcgagagactgtaccccagagtgcaggccatgcagcccgccttcgccagcaagatcaccggcatgctgctggagctgagccccgcccagctgctgctgctgctggccagcgaggacagcctgagagccagagtggacgaggccatggagctgatcatcgcccacggcagagagaacggcgccgacagcatcctggacctgggcctggtggacagcagcgagaaggtgcaggagaacagaaagagacacggcagcagcagaagcgtggtggacatggacctggacgacaccgacgacggcgacgacaacgcccccctgttctaccagcccggcaagagaggcttctacacccccagacccggcaagaacaccgaggccagactgaactgcttcagaaacatcggcagaatcctgggcctgtgcctgctgcagaacgagctgtgccccatcaccctgaacagacacgtgatcaaggtgctgctgggcagaaaggtgaactggcacgacttcgccttcttcgaccccgtgatgtacgagagcctgagacagctgatcctggccagccagagcagcgacgccgacgccgtgttcagcgccatggacctggccttcgccatcgacctgtgcaaggaggagggcggcggccaggtggagctgatccccaacggcgtgaacatccccgtgaccccccagaacgtgtacgagtacgtgagaaagtacgccgagcacagaatgctggtggtggccgagcagcccctgcacgccatgagaaagggcctgctggacgtgctgcccaagaacagcctggaggacctgaccgccgaggacttcagactgctggtgaacggctgcggcgaggtgaacgtgcagatgctgatcagcttcaccagcttcaacgacgagagcggcgagaacgccgagaagctgctgcagttcaagagatggttctggagcatcgtggagaagatgagcatgaccgagagacaggacctggtgtacttctggaccagcagccccagcctgcccgccagcgaggagggcttccagcccatgcccagcatcaccatcagaccccccgacgaccagcacctgcccaccgccaacacctgcatcagcagactgtacgtgcccctgtacagcagcaagcagatcctgaagcagaagctgctgctggccatcaagaccaagaacttcggcttcgtgtag

SEQ ID NO: 24159 - DNA, 414 bp, Artificial Sequence
  Description of Artificial Sequence: Synthetic coding sequence
atggccagaggcagacacgtgggcagcagcgagaccaagctgctgcagcacctgctggaggcctgcggcagatgcgaggaggtgcccgaggcctacgtggacatccacaccggcctgagcggcagcggcgtggccttcgtgtgcgccttcagcgaggccctggccgagggcgccgtgaagatgggcatgcccagcagcctggcccacagaatcgccgcccagaccctgctgggcaccgccaagatgctgctgcacgagggccagcaccccgcccagctgagaagcgacgtgtgcacccccggcggcaccaccatctacggcctgcacgccctggagcagggcggcctgagagccgccaccatgagcgccgtggaggccgccacctgcagagccaaggagctgagcagaaagtag

SEQ ID NO: 24160 - DNA, 762 bp, Artificial Sequence
  Description of Artificial Sequence: Synthetic coding sequence
atgacccagggcaccgaggacctgaagggccccggccagagatgcgagaacgagcccctgctggaccccgtgggccccgagcccctgggccccgagagccagagcggcaagggcgacatggtggagatggccaccagattcggcagcaccctgcagctggacctggagaagggcaaggagagcctgctggagaagagactggtggccgaggaggaggaggacgaggaggaggtggaggaggacggccccagcagctgcagcgaggacgactacagcgagctgctgcaggagatcaccgacaacctgaccaagaaggagatccagatcgagaagatccacctggacaccagcagcttcgtggaggagctgcccggcgagaaggacctggcccacgtggtggagatctacgacttcgagcccgccctgaagaccgaggacctgctggccaccttcagcgagttccaggagaagggcttcagaatccagtgggtggacgacacccacgccctgggcatcttcccctgcctggccagcgccgccgaggccctgaccagagagttcagcgtgctgaagatcagacccctgacccagggcaccaagcagagcaagctgaaggccctgcagagacccaagctgctgagactggtgaaggagagaccccagaccaacgccaccgtggccagaagactggtggccagagccctgggcctgcagcacaagaagaaggagagacccgccgtgagaggccccctgcccccctag

SEQ ID NO: 24161 - DNA, 1443 bp, Artificial Sequence
  Description of Artificial Sequence: Synthetic coding sequence
atgaacatgaaggccagcagagtgaccctgggcgaggccggcgccagagccagatggcccctgggcacccccagagccgccgccaccagaagagaggccgccgccctgccccccgtgaccctggccctgctgtgcctggacggcgtgttcctgagcagcgccgagaacgacttcgtgcacagaatccaggaggagctggacagattcctgctgcagaagcagctgagcaaggtgctgctgttcccccccctgagcagcagactgagatacctgatccacagaaccgccgagaacttcgacctgctgagcagcttcagcgtgggcgagggctggaagagaagaaccgtgatctgccaccaggacatcagagtgcccagcagcgacggcctgagcggcccctgcagagcccccgccagctgccccagcagataccacggccccagacccatcagcaaccagggcgccgccgccgtgcccagaggcgccagagccggcagatggtacagaggcagaaagcccgaccagcccctgtacgtgcccagagtgctgagaagacaggaggagtggggcctgaccagcaccagcgtgctgaagagagaggcccccgccggcagagaccccgaggagcccggcgacgtgggcgccggcgaccccaacagcgaccagggcctgcccgtgctgatgacccagggcaccgaggacctgaagggccccggccagagatgcgagaacgagcccctgctggaccccgtgggccccgagcccctgggccccgagagccagagcggcaagggcgacatggtggagatggccaccagattcggcagcaccctgcagctggacctggagaagggcaaggagagcctgctggagaagagactggtggccgaggaggaggaggacgaggaggaggtggaggaggacggccccagcagctgcagcgaggacgactacagcgagctgctgcaggagatcaccgacaacctgaccaagaaggagatccagatcgagaagatccacctggacaccagcagcttcgtggaggagctgcccggcgagaaggacctggcccacgtggtggagatctacgacttcgagcccgccctgaagaccgaggacctgctggccaccttcagcgagttccaggagaagggcttcagaatccagtgggtggacgacacccacgccctgggcatcttcccctgcctggccagcgccgccgaggccctgaccagagagttcagcgtgctgaagatcagacccctgacccagggcaccaagcagagcaagctgaaggccctgcagagacccaagctgctgagactggtgaaggagagaccccagaccaacgccaccgtggccagaagactggtggccagagccctgggcctgcagcacaagaagaaggagagacccgccgtgagaggccccctgcccccctag

SEQ ID NO: 24162 - DNA, 762 bp, Artificial Sequence; identical to SEQ ID NO: 24160
  Description of Artificial Sequence: Synthetic coding sequence

SEQ ID NO: 24163 - DNA, 111 bp, Artificial Sequence
  Description of Artificial Sequence: Synthetic coding sequence
atgacccagggcaccgaggacctgaagggccccggccagagatgcgagaacgagcccctgctggaccccgtgggccccgagcccctgggccccgagagccagagcggctag

SEQ ID NO: 24164 - DNA, 402 bp, Artificial Sequence
  Description of Artificial Sequence: Synthetic coding sequence
atgacccagggcaccgaggacctgaagggccccggccagagatgcgagaacgagcccctgctggaccccgtgggccccgagcccctgggccccgagagccagagcggcaagggcgacatggtggagatggccaccagattcggcagcaccctgcagctggacctggagaagggcaaggagagcctgctggagaagagactggtggccgaggaggaggaggacgaggaggaggtggaggaggacggccccagcagctgcagcgaggacgactacagcgagctgctgcaggagatcaccgacaacctgaccaagaaggagatccagatcgagaagatccacctggacaccagcagcttcgtggaggagctgcccggcgagaaggacctggcccacgtggtgtag

SEQ ID NO: 24165 - DNA, 291 bp, Artificial Sequence
  Description of Artificial Sequence: Synthetic coding sequence
atgacccagggcaccgaggacctgaagggccccggccagagatgcgagaacgagcccctgctggaccccgtgggccccgagcccctgggccccgagagccagagcggcaagggcgacatggtggagatggccaccagattcggcagcaccctgcagctggacctggagaagggcaaggagagcctgctggagaagagactggtggccgaggaggaggaggacgaggaggaggtggaggaggacggccccagcagctgcagcgaggacgactacagcgagctgctgcagtag

SEQ ID NO: 24166 - DNA, 3300 bp, Artificial Sequence
  Description of Artificial Sequence: Synthetic coding sequence
atgagaatgagcgacaccgtgaccgtgaaggacgagaccgccaccatgaaggacctggaggccgaggtgaaggacaccaccagagtggagaacctgatcaagagcgagaactacggcaagatcctggtggagaagaacgagcactgcatcgagaacaacatcgacctgcagagacccctgcagagcttcggccagaccggcaagagaagcaagagcagcagcaagctgaagctggtgagaagcctggccgtgtgcgaggagagcccccccccccccgcccccgagatcagccaggagaaccaggagaagatccagatccagctgacccagagcttcgagaaggaggagaagcccagcaaggacgaggccgagaaggagaaggccagcgacaagctgcccagaaagatgctgagcagagacagcagccaggagtacaccgacagcaccggcatcgacctgcacgagttcctggtgaacaccctgaagaacaaccccagagacagaatgatgctgctgaagctggagcaggagatcctggacttcatcggcaacaacgagagccccagaaagaagttcccccccatgaccagctaccacagaatgctgctgcacagagtggccgcctacttcggcctggaccacaacgtggaccagagcggcaagagcgtgatcgtgaacaagaccagcaacaccagaatccccgaccagaagttcaacgagcacatcaaggacgacaagggcgaggacttccagaagagatacatcctgaagagagacaacagcagcttcgacaaggacgacaaccagatgagaatcagactgaaggacgacagaagaagcaagagcatcgaggagagagaggaggagtaccagagagccagagacagaatcttcagccaggacagcctgtgcagccaggagaactacatcatcgacaagagactgcaggacgaggacgccagcagcacccagcagagaagacagatcttcagagtgaacaaggacgccagcggcagaagcaccaacagccaccagagcagcaccgagaacgagctgaagtacagcgagcccagaccctggagcagcaccgacagcgacagcagcctgagaaacctgaagcccgccgtgaccaaggccagcagcttcagcggcatcagcgtgctgaccagaggcgacagcagcggcagcagcaagagcatcggcagactgagcaagaccggcagcgagagcagcggcagcgtgggcagcagcaccggcagcctgagccacatccagcagcccctgcccggcaccgccctgagccagagcagccacggcgcccccgtggtgtaccccaccgtgagcacccacagcagcctgagcttcgacggcggcctgaacggccaggtggccagccccagcaccagcttcttcctgctgcccctggaggccgccggcatcccccccggcagcatcctgatcaacccccagaccggccagcccttcatcaaccccgacggcagccccgtggtgtacaacccccccatgacccagcagcccgtgagaagccaggtgcccggccccccccagccccccctgcccgcccccccccagcagcccgccgccaaccacatcttcagccaggacaacctgggcagccagttcagccacatgagcctggccagacagcccagcgccgacggcagcgacccccacgccgccatgttccagagcaccgtggtgctgcagagcccccagcagagcggctacatcatgaccgccgccccccccccccaccccccccccccccccccccccccccccccccccccccccctgccccccggccagcccgtgcccaccgccggctaccccgccagcggccaccccgtgagccagcccgtgctgcagcagcagggctacatccagcagcccagcccccagatgcccgcctgctactgcgcccccggccactaccacagcagccagccccagtacagacccgtgcccagcgtgcactacaacagccacctgaaccagcccctgccccagcccgcccagcagaccggctaccaggtgatccccaaccagcagcagaactaccagggcatcgtgggcgtgcagcagccccagagccagagcctggtgagcggccagcccaacagcatcggcaaccagatccagggcgtggtgatcccctacaccagcgtgcccacctaccaggtgagcctgccccagggcagccagggcatcccccaccagacctaccagcagcccgtgatgttccccaaccagagcaaccagggcagcatgcccaccaccggcatgcccgtgtactacagcgtgatcccccccggccagcagaacaacctgagcagcagcgtgggctacctgcagcaccccggcagcgagcaggtgcagttccccagaaccaccagcccctgcagcagccagcagctgcagggccaccagtgcaccgccggccccccccccccccccggcggcggcatggtgatgatgcagctgagcgtgcccaacaacccccagagctgcgcccacagccccccccagtggaagcagaacaagtactactgcgaccaccagagaggccagaagtgcgtggagttcagcagcgtggacaacatcgtgcagcacagcccccagctgagcagccccatcatcagccccgcccagagccccgcccccgcccagctgagcaccctgaagaccgtgagacccagcggcccccccctgagcatcatgccccagttcagcagacccttcgtgcccggccagggcgacagcagataccccctgctgggccagcccctgcagtacaacccccccgccgtgctgcacggccacatccccaaccagcagggccagcccggcagcagacacggcaacagaggcagaagacaggccaagaaggccgccagcaccgacctgggcgccggcgagaccgtggtgggcaaggtgctggagatcaccgagctgcccgacggcatcaccagaatggaggccgagaagctgttcggcgagctgttcaagatcggcgccaagatcagatggctgagagacccccagagccagcccagaagacaccccctgtgctgcggcagcggcgacaacaccgccaaccccgagagaagcaagcccagcgacctggccagcacctacaccgtgctggccaccttccccagcatcagcgccgcccagaacgccctgaagaagcagatcaacagcgtgaacaagttcaagctgagaaccagcaagaagcactacgacttccacatcctggagagagccagcagccagtag

SEQ ID NO: 24167 - DNA, 2913 bp, Artificial Sequence
  Description of Artificial Sequence: Synthetic coding sequence
atgagaatgagcgacaccgtgaccgtgaaggacgagaccgccaccatgaaggacctggaggccgaggtgaaggacaccaccagagtggagaacctgatcaagagcgagaactacggcaagatcctggtggagaagaacgagcactgcatcgagaacaacatcgacctgcaggagaagatccagatccagctgacccagagcttcgagaaggaggagaagcccagcaaggacgaggccgagaaggagaaggccagcgacaagctgcccagaaagatgctgagcagagacagcagccaggagtacaccgacagcaccggcatcgacctgcacgagttcctggtgaacaccctgaagaacaaccccagagacagaatgatgctgctgaagctggagcaggagatcctggacttcatcggcaacaacgagagccccagaaagaagttcccccccatgaccagctaccacagaatgctgctgcacagagtggccgcctacttcggcctggaccacaacgtggaccagagcggcaagagcgtgatcgtgaacaagaccagcaacaccagaatccccgaccagaagttcaacgagcacatcaaggacgacaagggcgaggacttccagaagagatacatcctgaagagagacaacagcagcttcgacaaggacgacaaccagatgagaatcagactgaaggacgacagaagaagcaagagcatcgaggagagagaggaggagtaccagagagccagagacagaatcttcagccaggacagcctgtgcagccaggagaactacatcatcgacaagagactgcaggacgaggacgccagcagcacccagcagagaagacagatcttcagagtgaacaaggacgccagcggcagaagcaccaacagccaccagagcagcaccgagaacgagctgaagtacagcgagcccagaccctggagcagcaccgacagcgacagcagcctgagaaacctgaagcccgccgtgaccaaggccagcagcttcagcggcatcagcgtgctgaccagaggcgacagcagcggcagcagcaagagcatcggcagactgagcaagaccggccagcccttcatcaaccccgacggcagccccgtggtgtacaacccccccatgacccagcagcccgtgagaagccaggtgcccggccccccccagccccccctgcccgcccccccccagcagcccgccgccaaccacatcttcagccaggacaacctgggcagccagttcagccacatgagcctggccagacagcccagcgccgacggcagcgacccccacgccgccatgttccagagcaccgtggtgctgcagagcccccagcagagcggctacatcatgaccgccgccccccccccccaccccccccccccccccccccccccccccccccccccccccctgccccccggccagcccgtgcccaccgccggctaccccgccagcggccaccccgtgagccagcccgtgctgcagcagcagggctacatccagcagcccagcccccagatgcccgcctgctactgcgcccccggccactaccacagcagccagccccagtacagacccgtgcccagcgtgcactacaacagccacctgaaccagcccctgccccagcccgcccagcagaccggctaccaggtgatccccaaccagcagcagaactaccagggcatcgtgggcgtgcagcagccccagagccagagcctggtgagcggccagcccaacagcatcggcaaccagatccagggcgtggtgatcccctacaccagcgtgcccacctaccaggtgagcctgccccagggcagccagggcatcccccaccagacctaccagcagcccgtgatgttccccaaccagagcaaccagggcagcatgcccaccaccggcatgcccgtgtactacagcgtgatcccccccggccagcagaacaacctgagcagcagcgtgggctacctgcagcaccccggcagcgagcaggtgcagttccccagaaccaccagcccctgcagcagccagcagctgcagggccaccagtgcaccgccggccccccccccccccccggcggcggcatggtgatgatgcagctgagcgtgcccaacaacccccagagctgcgcccacagccccccccagtggaagcagaacaagtactactgcgaccaccagagaggccagaagtgcgtggagttcagcagcgtggacaacatcgtgcagcacagcccccagctgagcagccccatcatcagccccgcccagagccccgcccccgcccagctgagcaccctgaagaccgtgagacccagcggcccccccctgagcatcatgccccagttcagcagacccttcgtgcccggccagggcgacagcagataccccctgctgggccagcccctgcagtacaacccccccgccgtgctgcacggccacatccccaaccagcagggccagcccggcagcagacacggcaacagaggcagaagacaggccaagaaggccgccagcaccgacctgggcgccggcgagaccgtggtgggcaaggtgctggagatcaccgagctgcccgacggcatcaccagaatggaggccgagaagctgttcggcgagctgttcaagatcggcgccaagatcagatggctgagagacccccagagccagcccagaagacaccccctgtgctgcggcagcggcgacaacaccgccaaccccgagagaagcaagcccagcgacctggccagcacctacaccgtgctggccaccttccccagcatcagcgccgcccagaacgccctgaagaagcagatcaacagcgtgaacaagttcaagctgagaaccagcaagaagcactacgacttccacatcctggagagagccagcagccagtag

SEQ ID NO: 24168 - DNA, 807 bp, Artificial Sequence
  Description of Artificial Sequence: Synthetic coding sequence
atggtggccctggagaaccccgagtgcggccccgaggccgccgagggcacccccggcggcagaagactgctgcccctgcccagctgcctgcccgccctggccagcagccaggtgaagagactgagcgccagcagaagaaagcagcacttcatcaaccaggccgtgagaaacagcgacctggtgcccaaggccaagggcagaaagagcctgcagagactggagaacacccagtacctgctgaccctgctggagaccgacggcggcctgcccggcctggaggacggcgacctggccccccccgccagccccggcatcttcgccgaggcctgcaacaacgccacctacgtggaggtgtggaacgacttcatgaacagaagcggcgaggagcaggagagagtgctgagatacctggaggacgagggcagaagcaaggccagaagaagaggccccggcagaggcgaggacagaagaagagaggaccccgcctacacccccagagagtgcttccagagaatcagcagaagactgagagccgtgctgaagagaagcagaatccccatggagaccctggagacctgggaggagagactgctgagattcttcagcgtgagcccccaggccgtgtacaccgccatgctggacaacagcttcgagagactgctgctgcacgccgtgtgccagtacatggacctgatcagcgccagcgccgacctggagggcaagagacagatgaaggtgagcaacagacacctggacttcctgccccccggcctgctgctgagcgcctacctggagcagcacagctag

SEQ ID NO: 24169 - DNA, 690 bp, Artificial Sequence
  Description of Artificial Sequence: Synthetic coding sequence
atggccgaggacaagaccaagcccagcgagctggaccagggcaagtacgacgccgacgacaacgtgaagatcatctgcctgggcgacagcgccgtgggcaagagcaagctgatggagagattcctgatggacggcttccagccccagcagctgagcacctacgccctgaccctgtacaagcacaccgccaccgtggacggcagaaccatcctggtggacttctgggacaccgccggccaggagagattccagagcatgcacgccagctactaccacaaggcccacgcctgcatcatggtgttcgacgtgcagagaaaggtgacctacagaaacctgagcacctggtacaccgagctgagagagttcagacccgagatcccctgcatcgtggtggccaacaagatcgacgccgacatcaacgtgacccagaagagcttcaacttcgccaagaagttcagcctgcccctgtacttcgtgagcgccgccgacggcaccaacgtggtgaagctgttcaacgacgccatcagactggccgtgagctacaagcagaacagccaggacttcatggacgagatcttccaggagctggagaacttcagcctggagcaggaggaggaggacgtgcccgaccaggagcagagcagcagcatcgagacccccagcgaggaggccgccagcccccacagctag

SEQ ID NO: 24170 - DNA, 687 bp, Artificial Sequence
  Description of Artificial Sequence: Synthetic coding sequence
atggccgaggacaagaccaagcccagcgagctggaccagggcaagtacgacgccgacgacaacgtgaagatcatctgcctgggcgacagcgccgtgggcaagagcaagctgatggagagattcctgatggacggcttccagccccagcagctgagcacctacgccctgaccctgtacaagcacaccgccaccgtggacggcagaaccatcctggtggacttctgggacaccgccggccaggagagattccagagcatgcacgccagctactaccacaaggcccacgcctgcatcatggtgttcgacgtgcagagaaaggtgacctacagaaacctgagcacctggtacaccgagctgagagagttcagacccgagatcccctgcatcgtggtggccaacaagatcgacgacatcaacgtgacccagaagagcttcaacttcgccaagaagttcagcctgcccctgtacttcgtgagcgccgccgacggcaccaacgtggtgaagctgttcaacgacgccatcagactggccgtgagctacaagcagaacagccaggacttcatggacgagatcttccaggagctggagaacttcagcctggagcaggaggaggaggacgtgcccgaccaggagcagagcagcagcatcgagacccccagcgaggaggccgccagcccccacagctag

SEQ ID NO: 24171 - DNA, 690 bp, Artificial Sequence; identical to SEQ ID NO: 24169
  Description of Artificial Sequence: Synthetic coding sequence

SEQ ID NO: 24172 - DNA, 558 bp, Artificial Sequence
  Description of Artificial Sequence: Synthetic coding sequence
atgctgaaggccaagatcctgttcgtgggcccctgcgagagcggcaagaccgtgctggccaacttcctgaccgagagcagcgacatcaccgagtacagccccacccagggcgtgagaatcctggagttcgagaacccccacgtgaccagcaacaacaagggcaccggctgcgagttcgagctgtgggactgcggcggcgacgccaagttcgagagctgctggcccgccctgatgaaggacgcccacggcgtggtgatcgtgttcaacgccgacatccccagccacagaaaggagatggagatgtggtacagctgcttcgtgcagcagcccagcctgcaggacacccagtgcatgctgatcgcccaccacaagcccggcagcggcgacgacaagggcagcctgagcctgagcccccccctgaacaagctgaagctggtgcacagcaacctggaggacgaccccgaggagatcagaatggagttcatcaagtacctgaagagcatcatcaacagcatgagcgagagcagagacagagaggagatgagcatcatgacctag

SEQ ID NO: 24173 - DNA, 558 bp, Artificial Sequence; identical to SEQ ID NO: 24172
  Description of Artificial Sequence: Synthetic coding sequence

SEQ ID NO: 24174 - DNA, 468 bp, Artificial Sequence
  Description of Artificial Sequence: Synthetic coding sequence
atgctgaaggccaagatcctgttcgtgggcccctgcgagagcggcaagaccgtgctggccaacttcctgaccgagagcagcgacatcaccgagtacagccccacccagggcgtgagattcgagagctgctggcccgccctgatgaaggacgcccacggcgtggtgatcgtgttcaacgccgacatccccagccacagaaaggagatggagatgtggtacagctgcttcgtgcagcagcccagcctgcaggacacccagtgcatgctgatcgcccaccacaagcccggcagcggcgacgacaagggcagcctgagcctgagcccccccctgaacaagctgaagctggtgcacagcaacctggaggacgaccccgaggagatcagaatggagttcatcaagtacctgaagagcatcatcaacagcatgagcgagagcagagacagagaggagatgagcatcatgacctag

SEQ ID NO: 24175 - DNA, 327 bp, Artificial Sequence
  Description of Artificial Sequence: Synthetic coding sequence
atgaaggacgcccacggcgtggtgatcgtgttcaacgccgacatccccagccacagaaaggagatggagatgtggtacagctgcttcgtgcagcagcccagcctgcaggacacccagtgcatgctgatcgcccaccacaagcccggcagcggcgacgacaagggcagcctgagcctgagcccccccctgaacaagctgaagctggtgcacagcaacctggaggacgaccccgaggagatcagaatggagttcatcaagtacctgaagagcatcatcaacagcatgagcgagagcagagacagagaggagatgagcatcatgacctag

SEQ ID NO: 24176 - DNA, 327 bp, Artificial Sequence; identical to SEQ ID NO: 24175
  Description of Artificial Sequence: Synthetic coding sequence

SEQ ID NO: 24177 - DNA, 1071 bp, Artificial Sequence
  Description of Artificial Sequence: Synthetic coding sequence
atggacagcagcgaggagcacgccggctgccccgccagaggcacctgccccgtgttcctggccatgagcgccggcaccgtgagatacgcccccagcggcctgtgccccgtgctggagggcaacctgagagaggagccctggggcaccgacagccccccccagcccgaccagggcctgcccccccccctggccgccgtgcccgtgccctggaagagcaccgacccctgccagggccacagagagagccccggcgccctggtggagaccagcgccggcgaggaggcccagggccaggagggccccgccgccgcccagctggacgtgctgagactgagaagcagcagcatggagatcagagagaagggcagcgagttcctgaaggaggagctgcacagagcccagaaggagctgaagctgaaggacgaggagtgcgagagactgagcaaggtgagagagcagctggagcaggagctggaggagctgaccgccagcctgttcgaggaggcccacaagatggtgagagaggccaacatgaagcaggccgccagcgagaagcagctgaaggaggccagaggcaaggtggacaccatcctgttcgccgagttccaggcctggagagagagccccaccctggacaagacctgccccttcctggagagagtgtacagagaggacgtgggcccctgcctggacttcaccatgcaggagctgagcgtgctggtgagagccgccgtggaggacaacaccctgaccatcgagcccgtggccagccagaccctgcccaccgtgaaggtggccgaggtggactgcagcagcaccaacacctgcgccctgagcggcctgaccagaacctgcagacacagaatcagactgggcgacagcaagagccactactacatcagccccagcagcagagccagaatcaccgccgtgtgcaacttcttcacctacatcagatacatccagcagggcctggtgagacaggacgccgagcccatgttctgggagatcatgagactgagaaaggagatgagcctggccaagctgggcttcttcccccaggaggcctag

SEQ ID NO: 24178 - DNA, 1149 bp, Artificial Sequence
  Description of Artificial Sequence: Synthetic coding sequence
atgtggagcggccccccccagcccgaccagggcctgcccccccccctggccgccgtgcccgtgccctggaagagcaccgacccctgccagggccacagagagagccccggcgccctggtggagaccagcgccggcgaggaggcccagggccaggagggccccgccgccgcccagctggacgtgctgagactgagaagcagcagcatggagatcagagagaagggcagcgagttcctgaaggaggagctgcacagagcccagaaggagctgaagctgaaggacgaggagtgcgagagactgagcaaggtgagagagcagctggagcaggagctggaggagctgaccgccagcctgttcgaggaggcccacaagatggtgagagaggccaacatgaagcaggccgccagcgagaagcagctgaaggaggccagaggcaagatcgacatgctgcaggccgaggtgaccgccctgaagaccctggtgatcaccagcacccccgccagccccaacagagagctgcacccccagctgctgagccccaccaaggccggccccagaaagggccacagcagacacaagagcaccagcagcaccctgtgccccgccgtgtgccccgccgccggccacaccctgacccccgacagagagggcaaggaggtggacaccatcctgttcgccgagttccaggcctggagagagagccccaccctggacaagacctgccccttcctggagagagtgtacagagaggacgtgggcccctgcctggacttcaccatgcaggagctgagcgtgctggtgagagccgccgtggaggacaacaccctgaccatcgagcccgtggccagccagaccctgcccaccgtgaaggtggccgaggtggactgcagcagcaccaacacctgcgccctgagcggcctgaccagaacctgcagacacagaatcagactgggcgacagcaagagccactactacatcagccccagcagcagagccagaatcaccgccgtgtgcaacttcttcacctacatcagatacatccagcagggcctggtgagacaggacgccgagcccatgttctgggagatcatgagactgagaaaggagatgagcctggccaagctgggcttcttcccccaggaggcctag

SEQ ID NO: 24179 - DNA, 318 bp, Artificial Sequence
  Description of Artificial Sequence: Synthetic coding sequence
atggccacccagggccccgacaaggtgatcttcctgctggtgggccacaagagcgacctgcagagcaccagatgcgtgagcgcccaggaggccgaggagctggccgccagcctgggcatggccttcgtggagaccagcgtgaagaacaactgcaacgtggacctggccttcgacaccctggccgacgccatccagcaggccctgcagcagggcgacatcaagctggaggagggctggggcggcgtgagactgatccacaagacccagatccccagaagccccagcagaaagcagcacagcggcccctgccagtgctag

SEQ ID NO: 24180 - DNA, 1398 bp, Artificial Sequence
  Description of Artificial Sequence: Synthetic coding sequence
atggccatgaccggcagcaccccctgcagcagcatgagcaaccacaccaaggagagagtgaccatgaccaaggtgaccctggagaacttctacagcaacctgatcgcccagcacgaggagagagagatgagacagaagaagctggagaaggtgatggaggaggagggcctgaaggacgaggagaagagactgagaagaagcgcccacgccagaaaggagaccgagttcctgagactgaagagaaccagactgggcctggaggacttcgagagcctgaaggtgatcggcagaggcgccttcggcgaggtgagactggtgcagaagaaggacaccggccacgtgtacgccatgaagatcctgagaaaggccgacatgctggagaaggagcaggtgggccacatcagagccgagagagacatcctggtggaggccgacagcctgtgggtggtgaagatgttctacagcttccaggacaagctgaacctgtacctgatcatggagttcctgcccggcggcgacatgatgaccctgctgatgaagaaggacaccctgaccgaggaggagacccagttctacatcgccgagaccgtgctggccatcgacagcatccaccagctgggcttcatccacagagacatcaagcccgacaacctgctgctggacagcaagggccacgtgaagctgagcgacttcggcctgtgcaccggcctgaagaaggcccacagaaccgagttctacagaaacctgaaccacagcctgcccagcgacttcaccttccagaacatgaacagcaagagaaaggccgagacctggaagagaaacagaagacagctggccttcagcaccgtgggcacccccgactacatcgcccccgaggtgttcatgcagaccggctacaacaagctgtgcgactggtggagcctgggcgtgatcatgtacgagatgctgatcggctacccccccttctgcagcgagaccccccaggagacctacaagaaggtgatgaactggaaggagaccctgaccttcccccccgaggtgcccatcagcgagaaggccaaggacctgatcctgagattctgctgcgagtgggagcacagaatcggcgcccccggcgtggaggagatcaagagcaacagcttcttcgagggcgtggactgggagcacatcagagagagacccgccgccatcagcatcgagatcaagagcatcgacgacaccagcaacttcgacgagttccccgagagcgacatcctgaagcccaccgtggccaccagcaaccaccccgagaccgactacaagaacaaggactgggtgttcatcaactacacctacaagagattcgagggcctgaccgccagaggcgccatccccagctacatgaaggccgccaagtag

SEQ ID NO: 24181 - DNA, 651 bp, Artificial Sequence
  Description of Artificial Sequence: Synthetic coding sequence
atggccggcagaggcggcgccgccagacccaacggccccgccgccggcaacaagatctgccagttcaagctggtgctgctgggcgagagcgccgtgggcaagagcagcctggtgctgagattcgtgaagggccagttccacgagtaccaggagagcaccatcggcgccgccttcctgacccagaccgtgtgcctggacgacaccaccgtgaagttcgagatctgggacaccgccggccaggagagataccacagcctggcccccatgtactacagaggcgcccaggccgccatcgtggtgtacgacatcaccaacaccgacaccttcgccagagccaagaactgggtgaaggagctgcagagacaggccagccccaacatcgtgatcgccctggccggcaacaaggccgacctggccagcaagagagccgtggagttccaggaggcccaggcctacgccgacgacaacagcctgctgttcatggagaccagcgccaagaccgccatgaacgtgaacgagatcttcatggccatcgccaagaagctgcccaagaacgagccccagaacgccaccggcgcccccggcagaaacagaggcgtggacctgcaggagaacaaccccgccagcagaagccagtgctgcagcaactag

SEQ ID NO: 24182 - DNA, 861 bp, Artificial Sequence
  Description of Artificial Sequence: Synthetic coding sequence
atggccgacaccatcttcggcagcggcaacgaccagtgggtgtgccccaacgacagacagctggccctgagagccaagctgcagaccggctggagcgtgcacacctaccagaccgagaagcagagaagaaagcagcacctgagccccgccgaggtggaggccatcctgcaggtgatccagagagccgagagactggacgtgctggagcagcagagaatcggcagactggtggagagactggagaccatgagaagaaacgtgatgggcaacggcctgagccagtgcctgctgtgcggcgaggtgctgggcttcctgggcagcagcagcgtgttctgcaaggactgcagaaaggtgtggaagagaagcggcgcctggttctacaagggcctgcccaagtacatcctgcccctgaagacccccggcagagccgacgacccccacttcagacccctgcccaccgagcccgccgagagagagcccagaagcagcgagaccagcagaatctacacctgggccagaggcagagtggtgagcagcgacagcgacagcgacagcgacctgagcagcagcagcctggaggacagactgcccagcaccggcgtgagagacagaaagggcgacaagccctggaaggagagcggcggcagcgtggaggcccccagaatgggcttcacccacccccccggccacctgagcggctgccagagcagcctggccagcggcgagaccggcaccggcagcgccgacccccccggcggccccagacccggcctgaccagaagagcccccgtgaaggacacccccggcagagcccccgccgccgacgccgcccccgccggccccagcagctgcctgggctag

SEQ ID NO: 24183 - DNA, 2013 bp, Artificial Sequence
  Description of Artificial Sequence: Synthetic coding sequence
atgaaccaggtgaccgactgggtggaccccagcttcgacgacttcctggagtgcagcggcgtgagcaccatcaccgccaccagcctgggcgtgaacaacagcagccacagaagaaagaacggccccagcaccctggagagcagcagattccccgccagaaagagaggcaacctgagcagcctggagcagatctacggcctggagaacagcaaggagtacctgagcgagaacgagccctgggtggacaagtacaagcccgagacccagcacgagctggccgtgcacaagaagaagatcgaggaggtggagacctggctgaaggcccaggtgctggagagacagcccaagcagggcggcagcatcctgctgatcaccggcccccccggctgcggcaagaccaccaccctgaagatcctgagcaaggagcacggcatccaggtgcaggagtggatcaaccccgtgctgcccgacttccagaaggacgacttcaagggcatgttcaacaccgagagcagcttccacatgttcccctaccagagccagatcgccgtgttcaaggagttcctgctgagagccaccaagtacaacaagctgcagatgctgggcgacgacctgagaaccgacaagaagatcatcctggtggaggacctgcccaaccagttctacagagacagccacaccctgcacgaggtgctgagaaagtacgtgagaatcggcagatgccccctgatcttcatcatcagcgacagcctgagcggcgacaacaaccagagactgctgttccccaaggagatccaggaggagtgcagcatcagcaacatcagcttcaaccccgtggcccccaccatcatgatgaagttcctgaacagaatcgtgaccatcgaggccaacaagaacggcggcaagatcaccgtgcccgacaagaccagcctggagctgctgtgccagggctgcagcggcgacatcagaagcgccatcaacagcctgcagttcagcagcagcaagggcgagaacaacctgagacccagaaagaagggcatgagcctgaagagcgacgccgtgctgagcaagagcaagagaagaaagaagcccgacagagtgttcgagaaccaggaggtgcaggccatcggcggcaaggacgtgagcctgttcctgttcagagccctgggcaagatcctgtactgcaagagagccagcctgaccgagctggacagccccagactgcccagccacctgagcgagtacgagagagacaccctgctggtggagcccgaggaggtggtggagatgagccacatgcccggcgacctgttcaacctgtacctgcaccagaactacatcgacttcttcatggagatcgacgacatcgtgagagccagcgagttcctgagcttcgccgacatcctgagcggcgactggaacaccagaagcctgctgagagagtacagcaccagcatcgccaccagaggcgtgatgcacagcaacaaggccagaggctacgcccactgccagggcggcggcagcagcttcagacccctgcacaagccccagtggttcctgatcaacaagaagtacagagagaactgcctggccgccaaggccctgttccccgacttctgcctgcccgccctgtgcagacagacccagctgctgccctacctggccctgctgaccatccccatgagaaaccaggcccagatcagcttcatccaggacatcggcagactgcccctgaagagacacttcggcagactgaagatggaggccctgaccgacagagagcacggcatgatcgaccccgacagcggcgacgaggcccagctgaacggcggccacagcgccgaggagagcctgggcgagcccacccaggccaccgtgcccgagacctggagcctgcccctgagccagaacagcgccagcgagctgcccgccagccagccccagcccttcagcgcccagggcgacatggaggagaacatcatcatcgaggactacgagagcgacggcacctag

SEQ ID NO: 24184 - DNA, 2013 bp, Artificial Sequence; identical to SEQ ID NO: 24183
  Description of Artificial Sequence: Synthetic coding sequence

SEQ ID NO: 24185 - DNA, 2013 bp, Artificial Sequence; identical to SEQ ID NO: 24183
  Description of Artificial Sequence: Synthetic coding sequence

SEQ ID NO: 24186 - DNA, 3480 bp, Artificial Sequence
  Description of Artificial Sequence: Synthetic coding sequence
atgagcctgccccagcccacccccagaatggccgagctgagaaagcccaccagcagcctgaccccccccgaggaccccgacagccagccccccagcagcaagagactgtgcctggaggagcccggcggcgtgttcaaggccggctggagactgcccctggtgcccagactgagcgaggccgagaaggtgtgggagctgagccccagacccttcaagggcctgctggtgagcaccaacgccatcttcgacaacagcaccgacagctgcgtggagaagagcgtgagcggcaagcagatctgcaacctgaagtgcagcaacctgaagttccagatgagcagctgcctgcagagcccccccagccagagccccgacagcgacctgagagccagcggcagaagcgaggccggcctgcacgacagagaggccttcagcgtgcacagaagcaacagcagcaaggccggcgtgagccagctgctgcccagcaccagcatccacgacatccacggcatcagaaacgagaacagaaagcagcagttcgtgcagggcagagacaacgtgcacaaggagaaccccttcctggacgtgaccttctacaaggagaccaagagccccttccacgagatcaagaacagatgcaaggccaacagcgtggtgcccagcaacaagagagagaacaacatcagcagcagcgtgctgaagatcagcaagagccagaaccagcccagcctggagatcgccaagcccagctacttcagagacagcggcaccatcagcgtgccccagttccccatggacctgaacagcaagatgagcagcgtgtacctgaaggagatcgccaagaagaagaacgacaagaaggaggcctacgtgagagacttcaccaacatctactggagccagaacagacccgacgtgaagaagcagaagctgcagaacgacaagaagaccgtggaggccgagaacatcttcagcaagtgctacgagaacgactaccccagcctgagcagccagaacacctgcaagagaaaggacctgatcagcagcaactactgcaactgcagcagcatccagtgcaacgtgagagacagcagaaagaacttcgccatcctggagaacgccaactgggaggaggccgagtgcctggacagctacgtgctgaccagactggagaagagccagaactgggactgcaacgtgagacacatcctgagaagaaacagaggcaactgctggatcatcaacaactgcaagaccaagtgcgagaacatgaagaagaccgaggagaagtggaactggctgctgctgctggagatcgacctgctgagcaaggaggactaccactgcgccaaggtgatcaacgcctacgaggagcagagcaagctgctggtgagagagatcctgggcagccagaccgccctgatcaccaccgtgtggctgaacggcaagggcgagaacgacaacaccctgcagctgagatacaacaccacccagaaggtgttccacgtgaacaaccccttcgagagcttcatcatcgagatcttctacttccacaagagcatcagcggcaacaagaaggacaacagcatcctgacctgctgcaacatcctgaagtgcaagaagcagatcggcatcatcggcatccagaacctgatcaccagaaacatgaacaccaacatcaagaacggcatcctgagcatctacctgcaggacagcgtgagcgagcccctggacatcctgctgaagaccaacatcgccttcctgctgaacaacttcgacagcctgaccagaatcgagaacgacttcgagctggaggaggagtgcatcttcaagtgcatgctgtacctgaagtaccccaagaacatcgtggagaaccacaccgcctacctggtgaagatcctgaccagcagcagactgctggaggacaacatgaagcccatgctgaagaagagaaagctgttcagaaccgagcaggtgttcgagaagagcaagaagaagctgatcaacagcttcagcatgaccacccagaacaccggcttccccatcttcgagacctacgagaagatccccctgctgatggacttcgacgacatggacgagatcagcctgatcagagagatcacctgccagaacatgagctgcccccagcaggtggtgaacgtggagaactgggcccactacaacagcagcaccgtgaaggcccacggcaacagctgcccccagttcatccagaacaacagaggctacatcaacgagaacttctacgaggtgaacatgcacagccaggacctgaacatggagagaaagcagggccacaacaagatcagcaacttcgactgcgagcacatcttcgaggacctgtgcaacgtgagacagcaggccatccccgccagccacaacatcatccacaacgaggagacccacaccaccagcatcacccaggtgctgaacttctggaacctgctgagcgagatcgaggagaagaagtacgacctgatcctgaaggaggaggtgaaggtgaccgccgagagcctgaccaacagctgccaggtgcacaaggacaccaagatcgagaaggaggagaaggacagcttcttccccatggacgacatgttcagcgtgcagagcgtgagcctgatcagcaaggaggtgaacgtggaggagaacaagtacgtgaaccagaactacgtgaccaacaccaacgagtacgagagcatcctgcccgagagagagatcgccaacagcaaggacttccacagaaagaacgacagcgccctgtacatcaaccaccagttcgagaccggcctgagcgagggcaacgacgagtgcttccaggacctggccgccaagtacctgagcaccgaggccctgaccatcgtgaaggacttcgagatgaagagaaagttcgacctggtgctggaggagctgagaatgttccacgagatcagcagagagaacgagctgctgagcaccgtggagaccaacaacggccaggagaactacttcggcgagaacgacgccgagaaggtgaagatggagatcgagaaggacctgaagatggtggtggtgaacaagatcagagccagcagcagcttccacgacaccatcgccggccccaacatgggcaagagccaccagagcctgttcaagtggaagaccgtgcccaacaacggcgagcaggaggtgcccaacgagagctgctaccccagcagaagcgaggaggagctgctgtacagcaccagcgagaaggactgcgagacccccctgcccaagagacccgccttcctgcccgacgagtgcaaggaggagttcaactacctgctgagaggcggcagccacttcccccacggcatcagcagagtgagacccctgaagacctgcagcagacccatcagaatcggcctgagcagaaaggccagaatcaagcagctgcacccctacctgaagcagatgtgctacggcaacctgaaggagaacttctag

SEQ ID NO: 24187 - DNA, 1683 bp, Artificial Sequence
  Description of Artificial Sequence: Synthetic coding sequence
atgaccgtgaagcccgccaaggccgccagcctggccagaaacctggccaagagaagaagaacctacctgggcggcgccgccggcagaagccaggagcccgaggtgccctgcgccgccgtgctgcccggcaagcccggcgacagaaactgccccgagttccccccccccgacagaaccctgggctgctgggccaccgacgccgcccccgccgccggcctgtgcggcgccggcagcgagcccagcatcgcccccaccagctgcgccggcaacctgcccagcagacccccccccctgctgagccccctgctggccagcagaaacccctgcccctggcactacctgcacctgagcggcagccacaacaccctggcccccacctgcttcaaggccaagctgcacagaaagagaggcagccagccccccgacatggccagcgccctgaccgacagaaccagcagagcccccagcacctacacctacaccagcagacccagagccctgccctgccagagaagcagatacagagacagcctgacccagcccgacgaggagcccatgcactacggcaacatcatgtacgacagaagagtgatcagaggcaacacctacgccctgcagaccggccccctgctgggcagacccgacagcctggagctgcagagacagagagaggccagaaagagagccctggccagaaagcaggcccaggagcagctgagaccccagacccccgagcccgtggagggcagaaagcacgtggacgtgcagaccgagctgtacctggaggagatcgccgacagaatcatcgaggtggacatggagtgccagaccgacgccttcctggacagaccccccacccccctgttcatccccgccaagaccggcaaggacgtggccacccagatcctggagggcgagctgttcgacttcgacctggaggtgaagcccgtgctggaggtgctggtgggcaagaccatcgagcagagcctgctggaggtgatggaggaggaggagctggccaacctgagagccagccagagagagtacgaggagctgagaaacagcgagagagccgaggtgcagagactggaggagcaggagagaagacacagagaggagaaggagagaagaaagaagcagcagtgggagatcatgcacaagcacaacgagaccagccagaagatcgccgccagagccttcgcccagagatacctggccgacctgctgcccagcgtgttcggcagcctgagagacagcggctacttctacgaccccatcgagagagacatcgagatcggcttcctgccctggctgatgaacgaggtggagaagaccatggagtacagcatggtgggcagaaccgtgctggacatgctgatcagagaggtggtggagaagagactgtgcatgtacgagcacggcgaggacacccaccagagccccgagcccgaggacgagcccggcggccccggcgccatgaccgagagcctggaggccagcgagttcctggagcagagcatgagccagaccagagagctgctgctggacggcggctacctgcagagaaccacctacgacagaagaagcagccaggagagaaagttcatggaggagagagagctgctgggccaggacgaggagaccgccatgagaaagagcctgggcgaggaggagctgagctag

SEQ ID NO: 24188 - DNA, 1395 bp, Artificial Sequence
  Description of Artificial Sequence: Synthetic coding sequence
atgaccgtgaagcccgccaaggccgccagcctggccagaaacctggccaagagaagaagaacctacctgggcggcgccgccggcagaagccaggagcccgaggtgccctgcgccgccgtgctgcccggcaagcccggcgacagaaactgccccgagttccccccccccgacagaaccctgggctgctgggccaccgacgccgcccccgccgccggcctgtgcggcgccggcagcgagcccagcatcgcccccaccagctgcgccggcaacctgcccagcagacccccccccctgctgagccccctgctggccagcagaaacccctgcccctggcactacctgcacctgagcggcagccacaacaccctggcccccacctgcttcaaggccaagctgcacagaaagagaggcagccagccccccgacatggccagcgccctgaccgacagaaccagcagagcccccagcacctacacctacaccagcagacccagagccctgccctgccagagaagcagatacagagacagcctgacccagcccgacgaggagcccatgcactacggcaacatcatgtacgacagaagagtgatcagaggcaacacctacgccctgcagaccggccccctgctgttcgacttcgacctggaggtgaagcccgtgctggaggtgctggtgggcaagaccatcgagcagagcctgctggaggtgatggaggaggaggagctggccaacctgagagccagccagagagagtacgaggagctgagaaacagcgagagagccgaggtgcagagactggaggagcaggagagaagacacagagaggagaaggagagaagaaagaagcagcagtgggagatcatgcacaagcacaacgagaccagccagaagatcgccgccagagccttcgcccagagatacctggccgacctgctgcccagcgtgttcggcagcctgagagacagcggctacttctacgaccccatcgagagagacatcgagatcggcttcctgccctggctgatgaacgaggtggagaagaccatggagtacagcatggtgggcagaaccgtgctggacatgctgatcagagaggtggtggagaagagactgtgcatgtacgagcacggcgaggacacccaccagagccccgagcccgaggacgagcccggcggccccggcgccatgaccgagagcctggaggccagcgagttcctggagcagagcatgagccagaccagagagctgctgctggacggcggctacctgcagagaaccacctacgacagaagaagcagccaggagagaaagttcatggaggagagagagctgctgggccaggacgaggagaccgccatgagaaagagcctgggcgaggaggagctgagctag

SEQ ID NO: 24189 - DNA, 1257 bp, Artificial Sequence
  Description of Artificial Sequence: Synthetic coding sequence
atggccagcgccctgaccgacagaaccagcagagcccccagcacctacacctacaccagcagacccagagccctgccctgccagagaagcagatacagagacagcctgacccagcccgacgaggagcccatgcactacggcaacatcatgtacgacagaagagtgatcagaggcaacacctacgccctgcagaccggccccctgctgggcagacccgacagcctggagctgcagagacagagagaggccagaaagagagccctggccagaaagcaggcccaggagcagctgagaccccagacccccgagcccgtggagggcagaaagcacgtggacgtgcagaccgagctgtacctggaggagatcgccgacagaatcatcgaggtggacatggagtgccagaccgacgccttcctggacagaccccccacccccctgttcatccccgccaagaccggcaaggacgtggccacccagatcctggagggcgagctgttcgacttcgacctggaggtgaagcccgtgctggaggtgctggtgggcaagaccatcgagcagagcctgctggaggtgatggaggaggaggagctggccaacctgagagccagccagagagagtacgaggagctgagaaacagcgagagagccgaggtgcagagactggaggagcaggagagaagacacagagaggagaaggagagaagaaagaagcagcagtgggagatcatgcacaagcacaacgagaccagccagaagatcgccgccagagccttcgcccagagatacctggccgacctgctgcccagcgtgttcggcagcctgagagacagcggctacttctacgaccccatcgagagagacatcgagatcggcttcctgccctggctgatgaacgaggtggagaagaccatggagtacagcatggtgggcagaaccgtgctggacatgctgatcagagaggtggtggagaagagactgtgcatgtacgagcacggcgaggacacccaccagagccccgagcccgaggacgagcccggcggccccggcgccatgaccgagagcctggaggccagcgagttcctggagcagagcatgagccagaccagagagctgctgctggacggcggctacctgcagagaaccacctacgacagaagaagcagccaggagagaaagttcatggaggagagagagctgctgggccaggacgaggagaccgccatgagaaagagcctgggcgaggaggagctgagctag

SEQ ID NO: 24190 - DNA, 969 bp, Artificial Sequence
  Description of Artificial Sequence: Synthetic coding sequence
atggccagcgccctgaccgacagaaccagcagagcccccagcacctacacctacaccagcagacccagagccctgccctgccagagaagcagatacagagacagcctgacccagcccgacgaggagcccatgcactacggcaacatcatgtacgacagaagagtgatcagaggcaacacctacgccctgcagaccggccccctgctgttcgacttcgacctggaggtgaagcccgtgctggaggtgctggtgggcaagaccatcgagcagagcctgctggaggtgatggaggaggaggagctggccaacctgagagccagccagagagagtacgaggagctgagaaacagcgagagagccgaggtgcagagactggaggagcaggagagaagacacagagaggagaaggagagaagaaagaagcagcagtgggagatcatgcacaagcacaacgagaccagccagaagatcgccgccagagccttcgcccagagatacctggccgacctgctgcccagcgtgttcggcagcctgagagacagcggctacttctacgaccccatcgagagagacatcgagatcggcttcctgccctggctgatgaacgaggtggagaagaccatggagtacagcatggtgggcagaaccgtgctggacatgctgatcagagaggtggtggagaagagactgtgcatgtacgagcacggcgaggacacccaccagagccccgagcccgaggacgagcccggcggccccggcgccatgaccgagagcctggaggccagcgagttcctggagcagagcatgagccagaccagagagctgctgctggacggcggctacctgcagagaaccacctacgacagaagaagcagccaggagagaaagttcatggaggagagagagctgctgggccaggacgaggagaccgccatgagaaagagcctgggcgaggaggagctgagctag

SEQ ID NO: 24191 - DNA, 2613 bp, Artificial Sequence
  Description of Artificial Sequence: Synthetic coding sequence
atggtgaaggagaagaagaaggccgacaagaagggcgagaagagcgccagaagccccagcagcctgagcgacaacctggacttcagcaagcaggacggcaacaccaccagacaggagatgagccccgccggcgtgcccctgctgggcatgcagctgaacgaggtgaagcccaagaaggacagacagaacgtgcagcagaacgaggacgccacccagtacgaggagagcatcctgaccaagctgatcgtggagagctacgagggcgagaaggtgagaggcctgtacgagggcgagggcttcgccgccttccagggcggctgcacctacagaggcatgttcagcgagggcctgatgcacggccagggcacctacatctgggccgacggcctgaagtacgagggcgacttcgtgaagaacgtgcccatgaaccacggcgtgtacacctggcccgacggcagcatgtacgagggcgaggtggtgaacggcatgagaaacggcttcggcatgttcaagtgcagcacccagcccgtgagctacatcggccactggtgcaacggcaagagacacggcaagggcagcatctactacaaccaggagggcacctgctggtacgagggcgactgggtgcagaacatcaagaagggctggggcatcagatgctacaagagcggcaacatctacgagggccagtgggaggacaacatgagacacggcgagggcagaatgagatggctgaccaccaacgaggagtacaccggcagatgggagagaggcatccagaacggcttcggcacccacacctggttcctgaagagaatcagaagcagccagtaccccctgagaaacgagtacatcggcgagttcgtgaacggctacagacacggcagaggcaagttctactacgccagcggcgccatgtacgacggcgagtgggtgagcaacaagaagcacggcatgggcagactgaccttcaagaacggcagagtgtacgagggcgccttcagcaacgaccacatcgccggcttccccgacctggaggtggagttcatcagctgcctggacctgagcagcggcgtggcccccagactgagcagaagcgccgagctgatcagaaagctggacggcagcgagagccacagcgtgctgggcagcagcatcgagctggacctgaacctgctgctggacatgtaccccgagaccgtgcagcccgaggagaagaagcaggtggagtacgccgtgctgagaaacatcaccgagctgagaagaatctacagcttctacagcagcctgggctgcggccacagcctggacaacaccttcctgatgaccaagctgcacttctggagattcctgaaggactgcaagttccaccaccacaagctgaccctggccgacatggacagaatcctgagcgccaacaacgacatccccgtggaggagatccacagccccttcaccaccatcctgctgagaaccttcctgaactacctgctgcacctggcctaccacatctaccacgaggagttccagaagagaagccccagcctgttcctgtgcttcaccaagctgatgaccgagaacatcagacccaacgccttccagatcaagggcaacctgttcagagagcagcagagaaccctgtacagcatgagctacatgaacaagtgctgggagatctacctggcctactgcagacccagcgccgcccccccccacgagcccaccatgaagatgagacacttcctgtggatgctgaaggacttcaagatgatcaacaaggagctgaccgccgccaccttcatggaggtgatcgccgaggacaacagattcatctacgacggcatcgacagcaacttcgagcccgagctggtgttcctggagttcttcgaggccctgctgagcttcgccttcatctgcgtgaccgaccagatgaccaagagctacaccaacgtgcccgccgacgacgtgagcggcaacaagcacgagaccatctacaccatcctgaaccaggacgcccagaacaagagccccagcgccgtgatgagccacgagagcgacgccgcccacagcgacagcgccagaagcagcagcagcaagctggagctgagccccgacgtgaacaagatcagaaagagcgagcccaagatcaagaagagcgtgagccacgagagagtgagcaagatgaacttcaagctgaccggcaagggcatcaccttcttcagcagcgagagcaagaagtacgagagacccaaggacgacagagaggaggagttcaacacctgggtgaacaacatgtacgtgttcttcgtgaacaccctgttccacgcctacaagagagaggaggccatcaaggagaagatcagagccgacagactgagaagcaccgcccaggcccagcagagaaagatggaggacgacgagctggaggccagactgaacatcttcatcctgagagaggaggaggccaagagacacgactacgaggtggacatcaccgtgctgaaggagcccgccgacgtgagcagcagccacctgatcctggacccccccaaggaggacgtgaccgtgagccccagcagcaagaccatcaccagcaagaagaagaagaagtag

SEQ ID NO: 24192 - DNA, 1857 bp, Artificial Sequence
  Description of Artificial Sequence: Synthetic coding sequence
atgaaccacggcgtgtacacctggcccgacggcagcatgtacgagggcgaggtggtgaacggcatgagaaacggcttcggcatgttcaagtgcagcacccagcccgtgagctacatcggccactggtgcaacggcaagagacacggcaagggcagcatctactacaaccaggagggcacctgctggtacgagggcgactgggtgcagaacatcaagaagggctggggcatcagatgctacaagagcggcaacatctacgagggccagtgggaggacaacatgagacacggcgagggcagaatgagatggctgaccaccaacgaggagtacaccggcagatgggagagaggcatccagaacggcttcggcacccacacctggttcctgaagagaatcagaagcagccagtaccccctgagaaacgagtacatcggcgagttcgtgaacggctacagacacggcagaggcaagttctactacgccagcggcgccatgtacgacggcgagtgggtgagcaacaagaagcacggcatgggcagactgaccttcaagaacggcagagtgtacgagggcgccttcagcaacgaccacatcgccggcttccccgacctggaggtggagttcatcagctgcctggacctgagcagcggcgtggcccccagactgagcagaagcgccgagctgatcagaaagctggacggcagcgagagccacagcgtgctgggcagcagcatcgagctggacctgaacctgctgctggacatgtaccccgagaccgtgcagcccgaggagaagaagcaggtggagtacgccgtgctgagaaacatcaccgagctgagaagaatctacagcttctacagcagcctgggctgcggccacagcctggacaacaccttcctgatgaccaagctgcacttctggagattcctgaaggactgcaagttccaccaccacaagctgaccctggccgacatggacagaatcctgagcgccaacaacgacatccccgtggaggagatccacagccccttcaccaccatcctgctgagaaccttcctgaactacctgctgcacctggcctaccacatctaccacgaggagttccagaagagaagccccagcctgttcctgtgcttcaccaagctgatgaccgagaacatcagacccaacgccttccagatcaagggcaacctgttcagagagcagcagagaaccctgtacagcatgagctacatgaacaagtgctgggagatctacctggcctactgcagacccagcgccgcccccccccacgagcccaccatgaagatgagacacttcctgtggatgctgaaggacttcaagatgatcaacaaggagctgaccgccgccaccttcatggaggtgatcgccgaggacaacagattcatctacgacggcatcgacagcaacttcgagcccgagctggtgttcctggagttcttcgaggccctgctgagcttcgccttcatctgcgtgaccgaccagatgaccaagagctacaccaacgtgcccgccgacgacgtgagcggcaacaagcacgagaccatctacaccatcctgaaccaggacgcccagaacaagagccccagcgccgtgatgagccacgagagcgacgccgcccacagcgacagcgccagaagcagcagcagcaagctggagctgagccccgacgtgaacaagatcagaaagagcgagcccaagatcaagaagagcgtgagccacgagagagtgagcaagatgaacttcaagctgaccggcaagggcatcaccttcttcagcagcgagagcaagaagtacgagagacccaaggacgacagagaggaggacggcagatag

SEQ ID NO: 24193 - DNA, 2613 bp, Artificial Sequence; identical to SEQ ID NO: 24191
  Description of Artificial Sequence: Synthetic coding sequence

SEQ ID NO: 24194 - DNA, 2613 bp, Artificial Sequence; identical to SEQ ID NO: 24191
  Description of Artificial Sequence: Synthetic coding sequence

SEQ ID NO: 24195 - DNA, 2613 bp, Artificial Sequence; identical to SEQ ID NO: 24191
  Description of Artificial Sequence: Synthetic coding sequence

SEQ ID NO: 24196 - DNA, 15 bp, Artificial Sequence
  Description of Artificial Sequence: Synthetic coding sequence
atggtgaaggagtag

SEQ ID NO: 24197 - DNA, 843 bp, Artificial Sequence
  Description of Artificial Sequence: Synthetic coding sequence
atgagacacggcgagggcagaatgagatggctgaccaccaacgaggagtacaccggcagatgggagagaggcatccagaacggcttcggcacccacacctggttcctgaagagaatcagaagcagccagtaccccctgagaaacgagtacatcggcgagttcgtgaacggctacagacacggcagaggcaagttctactacgccagcggcgccatgtacgacggcgagtgggtgagcaacaagaagcacggcatgggcagactgaccttcaagaacggcagagtgtacgagggcgccttcagcaacgaccacatcgccggcttccccgacctggaggtggagttcatcagctgcctggacctgagcagcggcgtggcccccagactgagcagaagcgccgagctgatcagaaagctggacggcagcgagagccacagcgtgctgggcagcagcatcgagctggacctgaacctgctgctggacatgtaccccgagaccgtgcagcccgaggagaagaagcaggtggagtacgccgtgctgagaaacatcaccgagctgagaagaatctacagcttctacagcagcctgggctgcggccacagcctggacaacaccttcctgatgaccaagctgcacttctggagattcctgaaggactgcaagttccaccaccacaagctgaccctggccgacatggacagaatcctgagcgccaacaacgacatccccgtggaggagatccacagccccttcaccaccatcctgctgagaaccttcctgaactacctgctgcacctggcctaccacatctaccacgaggagttccagcagttcatcccctag

SEQ ID NO: 24198 - DNA, 42 bp, Artificial Sequence
  Description of Artificial Sequence: Synthetic coding sequence
atggtgaaggagaagaagaaggccgacaagaagggcgagtag

SEQ ID NO: 24199 - DNA, 2613 bp, Artificial Sequence
  Description of Artificial Sequence: Synthetic coding sequence
atggtgaaggagaagaagaaggccgacaagaagggcgagaagagcgccagaagccccagcagcctgagcgacaacctggacttcagcaagcaggacggcaacaccaccagacaggagatgagccccgccggcgtgcccctgctgggcatgcagctgaacgaggtgaagcccaagaaggacagacagaacgtgcagcagaacgaggacgccagccagtacgaggagagcatcctgaccaagctgatcgtggagagctacgagggcgagaaggtgagaggcctgtacgagggcgagggcttcgccgccttccagggcggctgcacctacagaggcatgttcagcgagggcctgatgcacggccagggcacctacatctgggccgacggcctgaagtacgagggcgacttcgtgaagaacgtgcccatgaaccacggcgtgtacacctggcccgacggcagcatgtacgagggcgaggtggtgaacggcatgagaaacggcttcggcatgttcaagtgcagcacccagcccgtgagctacatcggccactggtgcaacggcaagagacacggcaagggcagcatctactacaaccaggagggcacctgctggtacgagggcgactgggtgcagaacatcaagaagggctggggcatcagatgctacaagagcggcaacatctacgagggccagtgggaggacaacatgagacacggcgagggcagaatgagatggctgaccaccaacgaggagtacaccggcagatgggagagaggcatccagaacggcttcggcacccacacctggttcctgaagagaatcagaagcagccagtaccccctgagaaacgagtacatcggcgagttcgtgaacggctacagacacggcagaggcaagttctactacgccagcggcgccatgtacgacggcgagtgggtgagcaacaagaagcacggcatgggcagactgaccttcaagaacggcagagtgtacgagggcgccttcagcaacgaccacatcgccggcttccccgacctggaggtggagttcatcagctgcctggacctgagcagcggcgtggcccccagactgagcagaagcgccgagctgatcagaaagctggacggcagcgagagccacagcgtgctgggcagcagcatcgagctggacctgaacctgctgctggacatgtaccccgagaccgtgcagcccgaggagaagaagcaggtggagtacgccgtgctgagaaacatcaccgagctgagaagaatctacagcttctacagcagcctgggctgcggccacagcctggacaacaccttcctgatgaccaagctgcacttctggagattcctgaaggactgcaagttccaccaccacaagctgaccctggccgacatggacagaatcctgagcgccaacaacgacatccccgtggaggagatccacagccccttcaccaccatcctgctgagaaccttcctgaactacctgctgcacctggcctaccacatctaccacgaggagttccagaagagaagccccagcctgttcctgtgcttcaccaagctgatgaccgagaacatcagacccaacgcctgccagatcaagggcaacctgttcagagagcagcagagaaccctgtacagcatgagctacatgaacaagtgctgggagatctacctggcctactgcagacccagcgccgcccccccccacgagcccaccatgaagatgagacacttcctgtggatgctgaaggacttcaagatgatcaacaaggagctgaccgccgccaccttcatggaggtgatcgccgaggacaacagattcatctacgacggcatcgacagcaacttcgagcccgagctggtgttcctggagttcttcgaggccctgctgagcttcgccttcatctgcgtgaccgaccagatgaccaagagctacaccaacgtgcccgccgacgacgtgagcggcaacaagcacgagaccatctacaccatcctgaaccaggacgcccagaacaagagccccagcgccgtgatgagccacgagagcgacgccgcccacagcgacagcgccagaagcagcagcagcaagctggagctgagccccgacgtgaacaagatcagaaagagcgagcccaagatcaagaagagcgtgagccacgagagagtgagcaagatgaacttcaagctgaccggcaagggcatcaccttcttcagcagcgagagcaagaagtacgagagacccaaggacgacagagaggaggagttcaacacctgggtgaacaacacctacgtgttcttcgtgaacaccctgttccacgcctacaagagagaggaggccatcaaggagaagatcagagccgacagactgagaagcaccgcccaggcccagcagagaaagatggaggacgacgagctggaggccagactgaacatcttcatcctgagagaggaggaggccaagagacacgactacgaggtggacatcaccgtgctgaaggagcccgccgacgtgagcagcagccacctgatcctggacccccccaaggaggacgtgaccgtgagccccagcagcaagaccatcaccagcaagaagaagaagaagtag

SEQ ID NO: 24200 - DNA, 843 bp, Artificial Sequence; identical to SEQ ID NO: 24197
  Description of Artificial Sequence: Synthetic coding sequence

SEQ ID NO: 24201 - DNA, 2613 bp, Artificial Sequence; identical to SEQ ID NO: 24199
  Description of Artificial Sequence: Synthetic coding sequence

SEQ ID NO: 24202 - DNA, 2613 bp, Artificial Sequence; identical to SEQ ID NO: 24199
  Description of Artificial Sequence: Synthetic coding sequence

SEQ ID NO: 24203 - DNA, 180 bp, Artificial Sequence
  Description of Artificial Sequence: Synthetic coding sequence
atggtgaaggagaagaagaaggccgacaagaagggcgagaagagcgccagaagccccagcagcctgagcgacaacctggacttcagcaagcaggacggcaacaccaccagacaggagatgagccccgccggcgtgcccctgctgggcatgcagctgaacgaggtgaagcccaagaagtag

SEQ ID NO: 24204 - DNA, 2613 bp, Artificial Sequence; identical to SEQ ID NO: 24199
  Description of Artificial Sequence: Synthetic coding sequence

SEQ ID NO: 24205 - DNA, 30 bp, Artificial Sequence
  Description of Artificial Sequence: Synthetic coding sequence
atggtgaaggagaagaagaaggccgactag

SEQ ID NO: 24206 - DNA, 1857 bp, Artificial Sequence
  Description of Artificial Sequence: Synthetic coding sequence
atgaaccacggcgtgtacacctggcccgacggcagcatgtacgagggcgaggtggtgaacggcatgagaaacggcttcggcatgttcaagtgcagcacccagcccgtgagctacatcggccactggtgcaacggcaagagacacggcaagggcagcatctactacaaccaggagggcacctgctggtacgagggcgactgggtgcagaacatcaagaagggctggggcatcagatgctacaagagcggcaacatctacgagggccagtgggaggacaacatgagacacggcgagggcagaatgagatggctgaccaccaacgaggagtacaccggcagatgggagagaggcatccagaacggcttcggcacccacacctggttcctgaagagaatcagaagcagccagtaccccctgagaaacgagtacatcggcgagttcgtgaacggctacagacacggcagaggcaagttctactacgccagcggcgccatgtacgacggcgagtgggtgagcaacaagaagcacggcatgggcagactgaccttcaagaacggcagagtgtacgagggcgccttcagcaacgaccacatcgccggcttccccgacctggaggtggagttcatcagctgcctggacctgagcagcggcgtggcccccagactgagcagaagcgccgagctgatcagaaagctggacggcagcgagagccacagcgtgctgggcagcagcatcgagctggacctgaacctgctgctggacatgtaccccgagaccgtgcagcccgaggagaagaagcaggtggagtacgccgtgctgagaaacatcaccgagctgagaagaatctacagcttctacagcagcctgggctgcggccacagcctggacaacaccttcctgatgaccaagctgcacttctggagattcctgaaggactgcaagttccaccaccacaagctgaccctggccgacatggacagaatcctgagcgccaacaacgacatccccgtggaggagatccacagccccttcaccaccatcctgctgagaaccttcctgaactacctgctgcacctggcctaccacatctaccacgaggagttccagaagagaagccccagcctgttcctgtgcttcaccaagctgatgaccgagaacatcagacccaacgcctgccagatcaagggcaacctgttcagagagcagcagagaaccctgtacagcatgagctacatgaacaagtgctgggagatctacctggcctactgcagacccagcgccgcccccccccacgagcccaccatgaagatgagacacttcctgtggatgctgaaggacttcaagatgatcaacaaggagctgaccgccgccaccttcatggaggtgatcgccgaggacaacagattcatctacgacggcatcgacagcaacttcgagcccgagctggtgttcctggagttcttcgaggccctgctgagcttcgccttcatctgcgtgaccgaccagatgaccaagagctacaccaacgtgcccgccgacgacgtgagcggcaacaagcacgagaccatctacaccatcctgaaccaggacgcccagaacaagagccccagcgccgtgatgagccacgagagcgacgccgcccacagcgacagcgccagaagcagcagcagcaagctggagctgagccccgacgtgaacaagatcagaaagagcgagcccaagatcaagaagagcgtgagccacgagagagtgagcaagatgaacttcaagctgaccggcaagggcatcaccttcttcagcagcgagagcaagaagtacgagagacccaaggacgacagagaggaggacggcagatag

SEQ ID NO: 24207 - DNA, 327 bp, Artificial Sequence
  Description of Artificial Sequence: Synthetic coding sequence
atgaaggccctgtgcctgctgctgctgcccgtgctgggcctgctggtgagcagcaagaccctgtgcagcatggaggaggccatcaacgagagaatccaggaggtggccggcagcctgatcttcagagccatcagcagcatcggcctggagtgccagagcgtgaccagcagaggcgacctggccacctgccccagaggcttcgccgtgaccggctgcacctgcggcagcgcctgcggcagctgggacgtgagagccgagaccacctgccactgccagtgcgccggcatggactggaccggcgccagatgctgcagagtgcagccctag

SEQ ID NO: 24208 - DNA, 4485 bp, Artificial Sequence
  Description of Artificial Sequence: Synthetic coding sequence
atgtacagcgagtggagaagcctgcacctggtgatccagaacgaccagggccacaccagcgtgctgcacagctaccccgagagcgtgggcagagaggtggccaacgccgtggtgagacccctgggccaggtgctgggcacccccagcgtggccggcagcgagaacctgctgaagaccgacaaggaggtgaagtggaccatggaggtgatctgctacggcctgaccctgcccctggacggcgagaccgtgaagtactgcgtggacgtgtacaccgactggatcatggccctggtgctgcccaaggacagcatccccctgcccgtgatcaaggagcccaaccagtacgtgcagaccatcctgaagcacctgcagaacctgttcgtgcccagacaggagcagggcagcagccagatcagactgtgcctgcaggtgctgagagccatccagaagctggccagagagagcagcctgatggccagagagacctgggaggtgctgctgctgttcctgctgcagatcaacgacatcctgctggccccccccaccgtgcagggcggcatcgccgagaacctggccgagaagctgatcggcgtgctgttcgaggtgtggctgctggcctgcaccagatgcttccccacccccccctactggaagaccgccaaggagatggtggccaactggagacaccaccccgccgtggtggagcagtggagcaaggtgatctgcgccctgaccagcagactgctgagattcacctacggccccagcttccccgccttcaaggtgcccgacgaggacgccagcctgatcccccccgagatggacaacgagtgcgtggcccagacctggttcagattcctgcacatgctgagcaaccccgtggacctgagcaaccccgccatcatcagcagcacccccaagttccaggagcagttcctgaacgtgagcggcatgccccaggagctgaaccagtacccctgcctgaagcacctgccccagatcttcttcagagccatgagaggcatcagctgcctggtggacgccttcctgggcatcagcagacccagaagcgacagcgccccccccacccccgtgaacagactgagcatgccccagagcgccgccgtgagcaccacccccccccacaacagaagacacagagccgtgaccgtgaacaaggccaccatgaagaccagcaccgtgagcaccgcccacgccagcaaggtgcagcaccagaccagcagcaccagccccctgagcagccccaaccagaccagcagcgagcccagacccctgcccgcccccagaagacccaaggtgaacagcatcctgaacctgttcggcagctggctgttcgacgccgccttcgtgcactgcaagctgcacaacggcatcaacagagacagcagcatgaccgccatcaccacccaggccagcatggagttcagaagaaagggcagccagatgagcaccgacaccatggtgagcaaccccatgttcgacgccagcgagttccccgacaactacgaggccggcagagccgaggcctgcggcaccctgtgcagaatcttctgcagcaagaagaccggcgaggagatcctgcccgcctacctgagcagattctacatgctgctgatccagggcctgcagatcaacgactacgtgtgccaccccgtgctggccagcgtgatcctgaacagcccccccctgttctgctgcgacctgaagggcatcgacgtggtggtgccctacttcatcagcgccctggagaccatcctgcccgacagagagctgagcaagttcaagagctacgtgaaccccaccgagctgagaagaagcagcatcaacatcctgctgagcctgctgcccctgccccaccacttcggcaccgtgaagagcgaggtggtgctggagggcaagttcagcaacgacgacagcagcagctacgacaagcccatcaccttcctgagcctgaagctgagactggtgaacatcctgatcggcgccctgcagaccgagaccgaccccaacaacacccagatgatcctgggcgccatgctgaacatcgtgcaggacagcgccctgctggaggccatcggctgccagatggagatgggcggcggcgagaacaacctgaagagccacagcagaaccaacagcggcatcagcagcgccagcggcggcagcaccgagcccaccacccccgacagcgagagacccgcccaggccctgctgagagactacgccctgaacaccgacagcgccgccggcctgctgatcagaagcatccacctggtgacccagagactgaacagccagtggagacaggacatgagcatcagcctggccgccctggagctgctgagcggcctggccaaggtgaaggtgatggtggacagcggcgacagaaagagagccatcagcagcgtgtgcacctacatcgtgtaccagtgcagcagacccgcccccctgcacagcagagacctgcacagcatgatcgtggccgccttccagtgcctgtgcgtgtggctgaccgagcaccccgacatgctggacgagaaggactgcctgaaggaggtgctggagatcgtggagctgggcatcagcggcagcaagagcaagaacaacgagcaggaggtgaagtacaagggcgacaaggagcccaaccccgccagcatgagagtgaaggacgccgccgaggccaccctgacctgcatcatgcagctgctgggcgccttccccagccccagcggccccgccagcccctgcagcctggtgaacgagaccaccctgatcaagtacagcagactgcccaccatcaacaagcacagcttcagatacttcgtgctggacaacagcgtgatcctggccatgctggagcagcccctgggcaacgagcagaacgacttcttccccagcgtgaccgtgctggtgagaggcatgagcggcagactggcctgggcccagcagctgtgcctgctgcccagaggcgccaaggccaaccagaagctgttcgtgcccgagcccagacccgtgcccaagaacgacgtgggcttcaagtacagcgtgaagcacagacccttccccgaggaggtggacaagatccccttcgtgaaggccgacctgagcatccccgacctgcacgagatcgtgaccgaggagctggaggagagacacgagaagctgagaagcggcatggcccagcagatcgcctacgagatccacctggagcagcagagcgaggaggagctgcagaagagaagcttccccgaccccgtgaccgactgcaagccccccccccccgcccaggagttccagaccgccagactgttcctgagccacttcggcttcctgagcctggaggccctgaaggagcccgccaacagcagactgcccccccacctgatcgccctggacagcaccatccccggcttcttcgacgacatcggctacctggacctgctgccctgcagacccttcgacaccgtgttcatcttctacatgaagcccggccagaagaccaaccaggagatcctgaagaacgtggagagcagcagaaccgtgcagccccacttcctggagttcctgctgagcctgggctggagcgtggacgtgggcagacaccccggctggaccggccacgtgagcaccagctggagcatcaactgctgcgacgacggcgagggcagccagcaggaggtgatcagcagcgaggacatcggcgccagcatcttcaacggccagaagaaggtgctgtactacgccgacgccctgaccgagatcgccttcgtggtgcccagccccgtggagagcctgaccgacagcctggagagcaacatcagcgaccaggacagcgacagcaacatggacctgatgcccggcatcctgaagcagcccagcctgaccctggagctgttccccaaccacaccgacaacctgaacagcagccagagactgagccccagcagcagaatgagaaagctgccccagggcagacccgtgccccccctgggccccgagaccagagtgagcgtggtgtgggtggagagatacgacgacatcgagaacttccccctgagcgagctgatgaccgagatcagcaccggcgtggagaccaccgccaacagcagcaccagcctgagaagcaccaccctggagaaggaggtgcccgtgatcttcatccaccccctgaacaccggcctgttcagaatcaagatccagggcgccaccggcaagttcaacatggtgatccccctggtggacggcatgatcgtgagcagaagagccctgggcttcctggtgagacagaccgtgatcaacatctgcagaagaaagagactggagagcgacagctacagccccccccacgtgagaagaaagcagaagatcaccgacatcgtgaacaagtacagaaacaagcagctggagcccgagttctacaccagcctgttccaggaggtgggcctgaagaactgcagcagctag

SEQ ID NO: 24209 - DNA, 2892 bp, Artificial Sequence
  Description of Artificial Sequence: Synthetic coding sequence
atgtacagcgagtggagaagcctgcacctggtgatccagaacgaccagggccacaccagcgtgctgcacagctaccccgagagcgtgggcagagaggtggccaacgccgtggtgagacccctgggccaggtgctgggcacccccagcgtggccggcagcgagaacctgctgaagaccgacaaggaggtgaagtggaccatggaggtgatctgctacggcctgaccctgcccctggacggcgagaccgtgaagtactgcgtggacgtgtacaccgactggatcatggccctggtgctgcccaaggacagcatccccctgcccgtgatcaaggagcccaaccagtacgtgcagaccatcctgaagcacctgcagaacctgttcgtgcccagacaggagcagggcagcagccagatcagactgtgcctgcaggtgctgagagccatccagaagctggccagagagagcagcctgatggccagagagacctgggaggtgctgctgctgttcctgctgcagatcaacgacatcctgctggccccccccaccgtgcagggcggcatcgccgagaacctggccgagaagctgatcggcgtgctgttcgaggtgtggctgctggcctgcaccagatgcttccccacccccccctactggaagaccgccaaggagatggtggccaactggagacaccaccccgccgtggtggagcagtggagcaaggtgatctgcgccctgaccagcagactgctgagattcacctacggccccagcttccccgccttcaaggtgcccgacgaggacgccagcctgatcccccccgagatggacaacgagtgcgtggcccagacctggttcagattcctgcacatgctgagcaaccccgtggacctgagcaaccccgccatcatcagcagcacccccaagttccaggagcagttcctgaacgtgagcggcatgccccaggagctgaaccagtacccctgcctgaagcacctgccccagatcttcttcagagccatgagaggcatcagctgcctggtggacgccttcctgggcatcagcagacccagaagcgacagcgccccccccacccccgtgaacagactgagcatgccccagagcgccgccgtgagcaccacccccccccacaacagaagacacagagccgtgaccgtgaacaaggccaccatgaagaccagcaccgtgagcaccgcccacgccagcaaggtgcagcaccagaccagcagcaccagccccctgagcagccccaaccagaccagcagcgagcccagacccctgcccgcccccagaagacccaaggtgaacagcatcctgaacctgttcggcagctggctgttcgacgccgccttcgtgcactgcaagctgcacaacggcatcaacagagacagcagcatgaccgccatcaccacccaggccagcatggagttcagaagaaagggcagccagatgagcaccgacaccatggtgagcaaccccatgttcgacgccagcgagttccccgacaactacgaggccggcagagccgaggcctgcggcaccctgtgcagaatcttctgcagcaagaagaccggcgaggagatcctgcccgcctacctgagcagattctacatgctgctgatccagggcctgcagatcaacgactacgtgtgccaccccgtgctggccagcgtgatcctgaacagcccccccctgttctgctgcgacctgaagggcatcgacgtggtggtgccctacttcatcagcgccctggagaccatcctgcccgacagagagctgagcaagttcaagagctacgtgaaccccaccgagctgagaagaagcagcatcaacatcctgctgagcctgctgcccctgccccaccacttcggcaccgtgaagagcgaggtggtgctggagggcaagttcagcaacgacgacagcagcagctacgacaagcccatcaccttcctgagcctgaagctgagactggtgaacatcctgatcggcgccctgcagaccgagaccgaccccaacaacacccagatgatcctgggcgccatgctgaacatcgtgcaggacagcgccctgctggaggccatcggctgccagatggagatgggcggcggcgagaacaacctgaagagccacagcagaaccaacagcggcatcagcagcgccagcggcggcagcaccgagcccaccacccccgacagcgagagacccgcccaggccctgctgagagactacgccctgaacaccgacagcgccgccggcctgctgatcagaagcatccacctggtgacccagagactgaacagccagtggagacaggacatgagcatcagcctggccgccctggagctgctgagcggcctggccaaggtgaaggtgatggtggacagcggcgacagaaagagagccatcagcagcgtgtgcacctacatcgtgtaccagtgcagcagacccgcccccctgcacagcagagacctgcacagcatgatcgtggccgccttccagtgcctgtgcgtgtggctgaccgagcaccccgacatgctggacgagaaggactgcctgaaggaggtgctggagatcgtggagctgggcatcagcggcagcaagagcaagaacaacgagcaggaggtgaagtacaagggcgacaaggagcccaaccccgccagcatgagagtgaaggacgccgccgaggccaccctgacctgcatcatgcagctgctgggcgccttccccagccccagcggccccgccagcccctgcagcctggtgaacgagaccaccctgatcaagtacagcagactgcccaccatcaacaagcagctggagcccgagttctacaccagcctgttccaggaggtgggcctgaagaactgcagcagctag

SEQ ID NO: 24210 - DNA, 3822 bp, Artificial Sequence
  Description of Artificial Sequence: Synthetic coding sequence
atggtggccaactggagacaccaccccgccgtggtggagcagtggagcaaggtgatctgcgccctgaccagcagactgctgagattcacctacggccccagcttccccgccttcaaggtgcccgacgaggacgccagcctgatcccccccgagatggacaacgagtgcgtggcccagacctggttcagattcctgcacatgctgagcaaccccgtggacctgagcaaccccgccatcatcagcagcacccccaagttccaggagcagttcctgaacgtgagcggcatgccccaggagctgaaccagtacccctgcctgaagcacctgccccagatcttcttcagagccatgagaggcatcagctgcctggtggacgccttcctgggcatcagcagacccagaagcgacagcgccccccccacccccgtgaacagactgagcatgccccagagcgccgccgtgagcaccacccccccccacaacagaagacacagagccgtgaccgtgaacaaggccaccatgaagaccagcaccgtgagcaccgcccacgccagcaaggtgcagcaccagaccagcagcaccagccccctgagcagccccaaccagaccagcagcgagcccagacccctgcccgcccccagaagacccaaggtgaacagcatcctgaacctgttcggcagctggctgttcgacgccgccttcgtgcactgcaagctgcacaacggcatcaacagagacagcagcatgaccgccatcaccacccaggccagcatggagttcagaagaaagggcagccagatgagcaccgacaccatggtgagcaaccccatgttcgacgccagcgagttccccgacaactacgaggccggcagagccgaggcctgcggcaccctgtgcagaatcttctgcagcaagaagaccggcgaggagatcctgcccgcctacctgagcagattctacatgctgctgatccagggcctgcagatcaacgactacgtgtgccaccccgtgctggccagcgtgatcctgaacagcccccccctgttctgctgcgacctgaagggcatcgacgtggtggtgccctacttcatcagcgccctggagaccatcctgcccgacagagagctgagcaagttcaagagctacgtgaaccccaccgagctgagaagaagcagcatcaacatcctgctgagcctgctgcccctgccccaccacttcggcaccgtgaagagcgaggtggtgctggagggcaagttcagcaacgacgacagcagcagctacgacaagcccatcaccttcctgagcctgaagctgagactggtgaacatcctgatcggcgccctgcagaccgagaccgaccccaacaacacccagatgatcctgggcgccatgctgaacatcgtgcaggacagcgccctgctggaggccatcggctgccagatggagatgggcggcggcgagaacaacctgaagagccacagcagaaccaacagcggcatcagcagcgccagcggcggcagcaccgagcccaccacccccgacagcgagagacccgcccaggccctgctgagagactacgccctgaacaccgacagcgccgccggcctgctgatcagaagcatccacctggtgacccagagactgaacagccagtggagacaggacatgagcatcagcctggccgccctggagctgctgagcggcctggccaaggtgaaggtgatggtggacagcggcgacagaaagagagccatcagcagcgtgtgcacctacatcgtgtaccagtgcagcagacccgcccccctgcacagcagagacctgcacagcatgatcgtggccgccttccagtgcctgtgcgtgtggctgaccgagcaccccgacatgctggacgagaaggactgcctgaaggaggtgctggagatcgtggagctgggcatcagcggcagcaagagcaagaacaacgagcaggaggtgaagtacaagggcgacaaggagcccaaccccgccagcatgagagtgaaggacgccgccgaggccaccctgacctgcatcatgcagctgctgggcgccttccccagccccagcggccccgccagcccctgcagcctggtgaacgagaccaccctgatcaagtacagcagactgcccaccatcaacaagcacagcttcagatacttcgtgctggacaacagcgtgatcctggccatgctggagcagcccctgggcaacgagcagaacgacttcttccccagcgtgaccgtgctggtgagaggcatgagcggcagactggcctgggcccagcagctgtgcctgctgcccagaggcgccaaggccaaccagaagctgttcgtgcccgagcccagacccgtgcccaagaacgacgtgggcttcaagtacagcgtgaagcacagacccttccccgaggaggtggacaagatccccttcgtgaaggccgacctgagcatccccgacctgcacgagatcgtgaccgaggagctggaggagagacacgagaagctgagaagcggcatggcccagcagatcgcctacgagatccacctggagcagcagagcgaggaggagctgcagaagagaagcttccccgaccccgtgaccgactgcaagccccccccccccgcccaggagttccagaccgccagactgttcctgagccacttcggcttcctgagcctggaggccctgaaggagcccgccaacagcagactgcccccccacctgatcgccctggacagcaccatccccggcttcttcgacgacatcggctacctggacctgctgccctgcagacccttcgacaccgtgttcatcttctacatgaagcccggccagaagaccaaccaggagatcctgaagaacgtggagagcagcagaaccgtgcagccccacttcctggagttcctgctgagcctgggctggagcgtggacgtgggcagacaccccggctggaccggccacgtgagcaccagctggagcatcaactgctgcgacgacggcgagggcagccagcaggaggaggtgatcagcagcgaggacatcggcgccagcatcttcaacggccagaagaaggtgctgtactacgccgacgccctgaccgagatcgccttcgtggtgcccagccccgtggagagcctgaccgacagcctggagagcaacatcagcgaccaggacagcgacagcaacatggacctgatgcccggcatcctgaagcagcccagcctgaccctggagctgttccccaaccacaccgacaacctgaacagcagccagagactgagccccagcagcagaatgagaaagctgccccagggcagacccgtgccccccctgggccccgagaccagagtgagcgtggtgtgggtggagagatacgacgacatcgagaacttccccctgagcgagctgatgaccgagatcagcaccggcgtggagaccaccgccaacagcagcaccagcctgagaagcaccaccctggagaaggaggtgcccgtgatcttcatccaccccctgaacaccggcctgttcagaatcaagatccagggcgccaccggcaagttcaacatggtgatccccctggtggacggcatgatcgtgagcagaagagccctgggcttcctggtgagacagaccgtgatcaacatctgcagaagaaagagactggagagcgacagctacagccccccccacgtgagaagaaagcagaagatcaccgacatcgtgaacaagtacagaaacaagcagctggagcccgagttctacaccagcctgttccaggaggtgggcctgaagaactgcagcagctag

SEQ ID NO: 24211 - DNA, 4485 bp, Artificial Sequence; identical to SEQ ID NO: 24208
  Description of Artificial Sequence: Synthetic coding sequence

SEQ ID NO: 24212 - DNA, 4476 bp, Artificial Sequence
  Description of Artificial Sequence: Synthetic coding sequence
atgtacagcgagtggagaagcctgcacctggtgatccagaacgaccagggccacaccagcgtgctgcacagctaccccgagagcgtgggcagagaggtggccaacgccgtggtgagacccctgggccaggtgctgggcacccccagcgtggccggcagcgagaacctgctgaagaccgacaaggaggtgaagtggaccatggaggtgatctgctacggcctgaccctgcccctggacggcgagaccgtgaagtactgcgtggacgtgtacaccgactggatcatggccctggtgctgcccaaggacagcatccccctgcccgtgatcaaggagcccaaccagtacgtgcagaccatcctgaagcacctgcagaacctgttcgtgcccagacaggagcagggcagcagccagatcagactgtgcctgcaggtgctgagagccatccagaagctggccagagagagcagcctgatggccagagagacctgggaggtgctgctgctgttcctgctgcagatcaacgacatcctgctggccccccccaccgtgcagggcggcatcgccgagaacctggccgagaagctgatcggcgtgctgttcgaggtgtggctgctggcctgcaccagatgcttccccacccccccctactggaagaccgccaaggagatggtggccaactggagacaccaccccgccgtggtggagcagtggagcaaggtgatctgcgccctgaccagcagactgctgagattcacctacggccccagcttccccgccttcaaggtgcccgacgaggacgccagcctgatcccccccgagatggacaacgagtgcgtggcccagacctggttcagattcctgcacatgctgagcaaccccgtggacctgagcaaccccgccatcatcagcagcacccccaagttccaggagcagttcctgaacgtgagcggcatgccccaggagctgaaccagtacccctgcctgaagcacctgccccagatcttcttcagagccatgagaggcatcagctgcctggtggacgccttcctgggcatcagcagacccagaagcgacagcgccccccccacccccgtgaacagactgagcatgccccagagcgccgccgtgagcaccacccccccccacaacagaagacacagagccgtgaccgtgaacaaggccaccatgaagaccagcaccgtgagcaccgcccacgccagcaaggtgcagcaccagaccagcagcaccagccccctgagcagccccaaccagaccagcagcgagcccagacccctgcccgcccccagaagacccaaggtgaacagcatcctgaacctgttcggcagctggctgttcgacgccgccttcgtgcactgcaagctgcacaacggcatcaacagagacagcagcatgaccgccatcaccacccaggccagcatggagttcagaagaaagggcagccagatgagcaccgacaccatggtgagcaaccccatgttcgacgccagcgagttccccgacaactacgaggccggcagagccgaggcctgcggcaccctgtgcagaatcttctgcagcaagaagaccggcgaggagatcctgcccgcctacctgagcagattctacatgctgctgatccagggcctgcagatcaacgactacgtgtgccaccccgtgctggccagcgtgatcctgaacagcccccccctgttctgctgcgacctgaagggcatcgacgtggtggtgccctacttcatcagcgccctggagaccatcctgcccgacagagagctgagcaagttcaagagctacgtgaaccccaccgagctgagaagaagcagcatcaacatcctgctgagcctgctgcccctgccccaccacttcggcaccgtgaagagcgaggtggtgctggagggcaagttcagcaacgacgacagcagcagctacgacaagcccatcaccttcctgagcctgaagctgagactggtgaacatcctgatcggcgccctgcagaccgagaccgaccccaacaacacccagatgatcctgggcgccatgctgaacatcgtgcaggacagcgccctgctggaggccatcggctgccagatggagatgggcggcggcgagaacaacctgaagagccacagcagaaccaacagcggcatcagcagcgccagcggcggcagcaccgagcccaccacccccgacagcgagagacccgcccaggccctgctgagagactacgacagcgccgccggcctgctgatcagaagcatccacctggtgacccagagactgaacagccagtggagacaggacatgagcatcagcctggccgccctggagctgctgagcggcctggccaaggtgaaggtgatggtggacagcggcgacagaaagagagccatcagcagcgtgtgcacctacatcgtgtaccagtgcagcagacccgcccccctgcacagcagagacctgcacagcatgatcgtggccgccttccagtgcctgtgcgtgtggctgaccgagcaccccgacatgctggacgagaaggactgcctgaaggaggtgctggagatcgtggagctgggcatcagcggcagcaagagcaagaacaacgagcaggaggtgaagtacaagggcgacaaggagcccaaccccgccagcatgagagtgaaggacgccgccgaggccaccctgacctgcatcatgcagctgctgggcgccttccccagccccagcggccccgccagcccctgcagcctggtgaacgagaccaccctgatcaagtacagcagactgcccaccatcaacaagcacagcttcagatacttcgtgctggacaacagcgtgatcctggccatgctggagcagcccctgggcaacgagcagaacgacttcttccccagcgtgaccgtgctggtgagaggcatgagcggcagactggcctgggcccagcagctgtgcctgctgcccagaggcgccaaggccaaccagaagctgttcgtgcccgagcccagacccgtgcccaagaacgacgtgggcttcaagtacagcgtgaagcacagacccttccccgaggaggtggacaagatccccttcgtgaaggccgacctgagcatccccgacctgcacgagatcgtgaccgaggagctggaggagagacacgagaagctgagaagcggcatggcccagcagatcgcctacgagatccacctggagcagcagagcgaggaggagctgcagaagagaagcttccccgaccccgtgaccgactgcaagccccccccccccgcccaggagttccagaccgccagactgttcctgagccacttcggcttcctgagcctggaggccctgaaggagcccgccaacagcagactgcccccccacctgatcgccctggacagcaccatccccggcttcttcgacgacatcggctacctggacctgctgccctgcagacccttcgacaccgtgttcatcttctacatgaagcccggccagaagaccaaccaggagatcctgaagaacgtggagagcagcagaaccgtgcagccccacttcctggagttcctgctgagcctgggctggagcgtggacgtgggcagacaccccggctggaccggccacgtgagcaccagctggagcatcaactgctgcgacgacggcgagggcagccagcaggaggaggtgatcagcagcgaggacatcggcgccagcatcttcaacggccagaagaaggtgctgtactacgccgacgccctgaccgagatcgccttcgtggtgcccagccccgtggagagcctgaccgacagcctggagagcaacatcagcgaccaggacagcgacagcaacatggacctgatgcccggcatcctgaagcagcccagcctgaccctggagctgttccccaaccacaccgacaacctgaacagcagccagagactgagccccagcagcagaatgagaaagctgccccagggcagacccgtgccccccctgggccccgagaccagagtgagcgtggtgtgggtggagagatacgacgacatcgagaacttccccctgagcgagctgatgaccgagatcagcaccggcgtggagaccaccgccaacagcagcaccagcctgagaagcaccaccctggagaaggaggtgcccgtgatcttcatccaccccctgaacaccggcctgttcagaatcaagatccagggcgccaccggcaagttcaacatggtgatccccctggtggacggcatgatcgtgagcagaagagccctgggcttcctggtgagacagaccgtgatcaacatctgcagaagaaagagactggagagcgacagctacagccccccccacgtgagaagaaagcagaagatcaccgacatcgtgaacaagtacagaaacaagcagctggagcccgagttctacaccagcctgttccaggaggtgggcctgaagaactgcagcagctag

SEQ ID NO: 24213 - DNA, 3972 bp, Artificial Sequence
  Description of Artificial Sequence: Synthetic coding sequence
atcaacgacatcctgctggccccccccaccgtgcagggcggcatcgccgagaacctggccgagaagctgatcggcgtgctgttcgaggtgtggctgctggcctgcaccagatgcttccccacccccccctactggaagaccgccaaggagatggtggccaactggagacaccaccccgccgtggtggagcagtggagcaaggtgatctgcgccctgaccagcagactgctgagattcacctacggccccagcttccccgccttcaaggtgcccgacgaggacgccagcctgatcccccccgagatggacaacgagtgcgtggcccagacctggttcagattcctgcacatgctgagcaaccccgtggacctgagcaaccccgccatcatcagcagcacccccaagttccaggagcagttcctgaacgtgagcggcatgccccaggagctgaaccagtacccctgcctgaagcacctgccccagatcttcttcagagccatgagaggcatcagctgcctggtggacgccttcctgggcatcagcagacccagaagcgacagcgccccccccacccccgtgaacagactgagcatgccccagagcgccgccgtgagcaccacccccccccacaacagaagacacagagccgtgaccgtgaacaaggccaccatgaagaccagcaccgtgagcaccgcccacgccagcaaggtgcagcaccagaccagcagcaccagccccctgagcagccccaaccagaccagcagcgagcccagacccctgcccgcccccagaagacccaaggtgaacagcatcctgaacctgttcggcagctggctgttcgacgccgccttcgtgcactgcaagctgcacaacggcatcaacagagacagcagcatgaccgccatcaccacccaggccagcatggagttcagaagaaagggcagccagatgagcaccgacaccatggtgagcaaccccatgttcgacgccagcgagttccccgacaactacgaggccggcagagccgaggcctgcggcaccctgtgcagaatcttctgcagcaagaagaccggcgaggagatcctgcccgcctacctgagcagattctacatgctgctgatccagggcctgcagatcaacgactacgtgtgccaccccgtgctggccagcgtgatcctgaacagcccccccctgttctgctgcgacctgaagggcatcgacgtggtggtgccctacttcatcagcgccctggagaccatcctgcccgacagagagctgagcaagttcaagagctacgtgaaccccaccgagctgagaagaagcagcatcaacatcctgctgagcctgctgcccctgccccaccacttcggcaccgtgaagagcgaggtggtgctggagggcaagttcagcaacgacgacagcagcagctacgacaagcccatcaccttcctgagcctgaagctgagactggtgaacatcctgatcggcgccctgcagaccgagaccgaccccaacaacacccagatgatcctgggcgccatgctgaacatcgtgcaggacagcgccctgctggaggccatcggctgccagatggagatgggcggcggcgagaacaacctgaagagccacagcagaaccaacagcggcatcagcagcgccagcggcggcagcaccgagcccaccacccccgacagcgagagacccgcccaggccctgctgagagactacgccctgaacaccgacagcgccgccggcctgctgatcagaagcatccacctggtgacccagagactgaacagccagtggagacaggacatgagcatcagcctggccgccctggagctgctgagcggcctggccaaggtgaaggtgatggtggacagcggcgacagaaagagagccatcagcagcgtgtgcacctacatcgtgtaccagtgcagcagacccgcccccctgcacagcagagacctgcacagcatgatcgtggccgccttccagtgcctgtgcgtgtggctgaccgagcaccccgacatgctggacgagaaggactgcctgaaggaggtgctggagatcgtggagctgggcatcagcggcagcaagagcaagaacaacgagcaggaggtgaagtacaagggcgacaaggagcccaaccccgccagcatgagagtgaaggacgccgccgaggccaccctgacctgcatcatgcagctgctgggcgccttccccagccccagcggccccgccagcccctgcagcctggtgaacgagaccaccctgatcaagtacagcagactgcccaccatcaacaagcacagcttcagatacttcgtgctggacaacagcgtgatcctggccatgctggagcagcccctgggcaacgagcagaacgacttcttccccagcgtgaccgtgctggtgagaggcatgagcggcagactggcctgggcccagcagctgtgcctgctgcccagaggcgccaaggccaaccagaagctgttcgtgcccgagcccagacccgtgcccaagaacgacgtgggcttcaagtacagcgtgaagcacagacccttccccgaggaggtggacaagatccccttcgtgaaggccgacctgagcatccccgacctgcacgagatcgtgaccgaggagctggaggagagacacgagaagctgagaagcggcatggcccagcagatcgcctacgagatccacctggagcagcagagcgaggaggagctgcagaagagaagcttccccgaccccgtgaccgactgcaagccccccccccccgcccaggagttccagaccgccagactgttcctgagccacttcggcttcctgagcctggaggccctgaaggagcccgccaacagcagactgcccccccacctgatcgccctggacagcaccatccccggcttcttcgacgacatcggctacctggacctgctgccctgcagacccttcgacaccgtgttcatcttctacatgaagcccggccagaagaccaaccaggagatcctgaagaacgtggagagcagcagaaccgtgcagccccacttcctggagttcctgctgagcctgggctggagcgtggacgtgggcagacaccccggctggaccggccacgtgagcaccagctggagcatcaactgctgcgacgacggcgagggcagccagcaggaggaggtgatcagcagcgaggacatcggcgccagcatcttcaacggccagaagaaggtgctgtactacgccgacgccctgaccgagatcgccttcgtggtgcccagccccgtggagagcctgaccgacagcctggagagcaacatcagcgaccaggacagcgacagcaacatggacctgatgcccggcatcctgaagcagcccagcctgaccctggagctgttccccaaccacaccgacaacctgaacagcagccagagactgagccccagcagcagaatgagaaagctgccccagggcagacccgtgccccccctgggccccgagaccagagtgagcgtggtgtgggtggagagatacgacgacatcgagaacttccccctgagcgagctgatgaccgagatcagcaccggcgtggagaccaccgccaacagcagcaccagcctgagaagcaccaccctggagaaggaggtgcccgtgatcttcatccaccccctgaacaccggcctgttcagaatcaagatccagggcgccaccggcaagttcaacatggtgatccccctggtggacggcatgatcgtgagcagaagagccctgggcttcctggtgagacagaccgtgatcaacatctgcagaagaaagagactggagagcgacagctacagccccccccacgtgagaagaaagcagaagatcaccgacatcgtgaacaagtacagaaacaagcagctggagcccgagttctacaccagcctgttccaggaggtgggcctgaagaactgcagcagctag

SEQ ID NO: 24214 - DNA, 1434 bp, Artificial Sequence
  Description of Artificial Sequence: Synthetic coding sequence
atgtacagcgagtggagaagcctgcacctggtgatccagaacgaccagggccacaccagcgtgctgcacagctaccccgagagcgtgggcagagaggtggccaacgccgtggtgagacccctgggccaggtgctgggcacccccagcgtggccggcagcgagaacctgctgaagaccgacaaggaggtgaagtggaccatggaggtgatctgctacggcctgaccctgcccctggacggcgagaccgtgaagtactgcgtggacgtgtacaccgactggatcatggccctggtgctgcccaaggacagcatccccctgcccgtgatcaaggagcccaaccagtacgtgcagaccatcctgaagcacctgcagaacctgttcgtgcccagacaggagcagggcagcagccagatcagactgtgcctgcaggtgctgagagccatccagaagctggccagagagagcagcctgatggccagagagacctgggaggtgctgctgctgttcctgctgcagatcaacgacatcctgctggccccccccaccgtgcagggcggcatcgccgagaacctggccgagaagctgatcggcgtgctgttcgaggtgtggctgctggcctgcaccagatgcttccccacccccccctactggaagaccgccaaggagatggtggccaactggagacaccaccccgccgtggtggagcagtggagcaaggtgatctgcgccctgaccagcagactgctgagattcacctacggccccagcttccccgccttcaaggtgcccgacgaggacgccagcctgatcccccccgagatggacaacgagtgcgtggcccagacctggttcagattcctgcacatgctgagcaaccccgtggacctgagcaaccccgccatcatcagcagcacccccaagttccaggagcagttcctgaacgtgagcggcatgccccaggagctgaaccagtacccctgcctgaagcacctgccccagatcttcttcagagccatgagaggcatcagctgcctggtggacgccttcctgggcatcagcagacccagaagcgacagcgccccccccacccccgtgaacagactgagcatgccccagagcgccgccgtgagcaccacccccccccacaacagaagacacagagccgtgaccgtgaacaaggccaccatgaagaccagcaccgtgagcaccgcccacgccagcaaggtgcagcaccagaccagcagcaccagccccctgagcagccccaaccagaccagcagcgagcccagacccctgcccgcccccagaagacccaaggtgaacagcatcctgaacctgttcggcagctggctgttcgacgccgccttcgtgcactgcaagctgcacaacggcatcaacagagacagcagcatgaccgacttcacctgcttctag

SEQ ID NO: 24215 - DNA, 2334 bp, Artificial Sequence
  Description of Artificial Sequence: Synthetic coding sequence
atgctgcccagacccctgagactgctgctggacaccagcccccccggcggcgtggtgctgagcagcttcagaagcagagaccccgaggagggcggcggccccggcggcctggtggtgggcggcggccaggaggaggaggaggaggaggaggaggaggcccccgtgagcgtgtgggacgaggaggaggacggcgccgtgttcaccgtgaccagcagacagtacagacccctggaccccctggtgcccatgcccccccccagaagcagcagaagactgagagccggcaccctggaggccctggtgagacacctgctggacaccagaaccagcggcaccgacgtgagcttcatgagcgccttcctggccacccacagagccttcaccagcacccccgccctgctgggcctgatggccgacagactggaggccctggagagccaccccaccgacgagctggagagaaccaccgaggtggccatcagcgtgctgagcacctggctggccagccaccccgaggacttcggcagcgaggccaagggccagctggacagactggagagcttcctgctgcagaccggctacgccgccggcaagggcgtgggcggcggcagcgccgacctgatcagaaacctgagaagcagagtggacccccaggcccccgacctgcccaagcccctggccctgcccggcgacccccccgccgaccccaccgacgtgctggtgttcctggccgaccacctggccgagcagctgaccctgctggacgccgagctgttcctgaacctgatccccagccagtgcctgggcggcctgtggggccacagagacagacccggccacagccacctgtgccccagcgtgagagccaccgtgacccagttcaacaaggtggccggcgccgtggtgagcagcgtgctgggcgccaccagcaccggcgagggccccggcgaggtgaccatcagacccctgagacccccccagagagccagactgctggagaagtggatcagagtggccgaggagtgcagactgctgagaaacttcagcagcgtgtacgccgtggtgagcgccctgcagagcagccccatccacagactgagagccgcctggggcgaggccaccagagacagcctgagagtgttcagcagcctgtgccagatcttcagcgaggaggacaactacagccagagcagagagctgctggtgcaggaggtgaagctgcagagccccctggagccccacagcaagaaggcccccagaagcggcagcagaggcggcggcgtggtgccctacctgggcaccttcctgaaggacctggtgatgctggacgccgccagcaaggacgagctggagaacggctacatcaacttcgacaagagaagaaaggagttcgccgtgctgagcgagctgagaagactgcagaacgagtgcagaggctacaacctgcagcccgaccacgacatccagagatggctgcagggcctgagacccctgaccgaggcccagagccacagagtgagctgcgaggtggagccccccggcagcagcgacccccccgcccccagagtgctgagacccaccctggtgatcagccagtggaccgaggtgctgggcagcgtgggcgtgcccacccccctggtgagctgcgacagacccagcaccggcggcgacgaggcccccaccacccccgcccccctgctgaccagactggcccagcacatgaagtggcccagcgtgagcagcctggacagcgccctggagagcagccccagcctgcacagccccgccgaccccagccacctgagcccccccgccagcagccccagacccagcagaggccacagaagaagcgccagctgcggcagccccctgagcggcggcgccgaggaggccagcggcggcaccggctacggcggcgagggcagcggccccggcgccagcgactgcagaatcatcagagtgcagatggagctgggcgaggacggcagcgtgtacaagagcatcctggtgaccagccaggacaaggcccccagcgtgatcagcagagtgctgaagaagaacaacagagacagcgccgtggccagcgagtacgagctggtgcagctgctgcccggcgagagagagctgaccatccccgccagcgccaacgtgttctacgccatggacggcgccagccacgacttcctgctgagacagagaagaagaagcagcaccgccacccccggcgtgaccagcggccccagcgccagcggcaccccccccagcgagggcggcggcggcagcttccccagaatcaaggccaccggcagaaagatcgccagagccctgttctag

SEQ ID NO: 24216 - DNA, 441 bp, Artificial Sequence
  Description of Artificial Sequence: Synthetic coding sequence
atgctgcccagacccctgagactgctgctggacaccagcccccccggcggcgtggtgctgagcagcttcagaagcagagaccccgaggagggcggcggccccggcggcctggtggtgggcggcggccaggaggaggaggaggaggaggaggaggaggcccccgtgagcgtgtgggacgaggaggaggacggcgccgtgttcaccgtgaccagcagacagtacagacccctggaccccctggtgcccatgcccccccccagaagcagcagaagactgagagccggcaccctggaggccctggtgagacacctgctggacaccagaaccagcggcaccgacgtgagcttcatgagcgccttcctggccacccacagagccttcaccagcacccccgccctgctgggcctgatggccgacagactggaggccctggagagctag

SEQ ID NO: 24217 - DNA, 2334 bp, Artificial Sequence; identical to SEQ ID NO: 24215
  Description of Artificial Sequence: Synthetic coding sequence

SEQ ID NO: 24218 - DNA, 2334 bp, Artificial Sequence; identical to SEQ ID NO: 24215
  Description of Artificial Sequence: Synthetic coding sequence

SEQ ID NO: 24219 - DNA, 1977 bp, Artificial Sequence
  Description of Artificial Sequence: Synthetic coding sequence
atggccgacagactggaggccctggagagccaccccaccgacgagctggagagaaccaccgaggtggccatcagcgtgctgagcacctggctggccagccaccccgaggacttcggcagcgaggccaagggccagctggacagactggagagcttcctgctgcagaccggctacgccgccggcaagggcgtgggcggcggcagcgccgacctgatcagaaacctgagaagcagagtggacccccaggcccccgacctgcccaagcccctggccctgcccggcgacccccccgccgaccccaccgacgtgctggtgttcctggccgaccacctggccgagcagctgaccctgctggacgccgagctgttcctgaacctgatccccagccagtgcctgggcggcctgtggggccacagagacagacccggccacagccacctgtgccccagcgtgagagccaccgtgacccagttcaacaaggtggccggcgccgtggtgagcagcgtgctgggcgccaccagcaccggcgagggccccggcgaggtgaccatcagacccctgagacccccccagagagccagactgctggagaagtggatcagagtggccgaggagtgcagactgctgagaaacttcagcagcgtgtacgccgtggtgagcgccctgcagagcagccccatccacagactgagagccgcctggggcgaggccaccagagacagcctgagagtgttcagcagcctgtgccagatcttcagcgaggaggacaactacagccagagcagagagctgctggtgcaggaggtgaagctgcagagccccctggagccccacagcaagaaggcccccagaagcggcagcagaggcggcggcgtggtgccctacctgggcaccttcctgaaggacctggtgatgctggacgccgccagcaaggacgagctggagaacggctacatcaacttcgacaagagaagaaaggagttcgccgtgctgagcgagctgagaagactgcagaacgagtgcagaggctacaacctgcagcccgaccacgacatccagagatggctgcagggcctgagacccctgaccgaggcccagagccacagagtgagctgcgaggtggagccccccggcagcagcgacccccccgcccccagagtgctgagacccaccctggtgatcagccagtggaccgaggtgctgggcagcgtgggcgtgcccacccccctggtgagctgcgacagacccagcaccggcggcgacgaggcccccaccacccccgcccccctgctgaccagactggcccagcacatgaagtggcccagcgtgagcagcctggacagcgccctggagagcagccccagcctgcacagccccgccgaccccagccacctgagcccccccgccagcagccccagacccagcagaggccacagaagaagcgccagctgcggcagccccctgagcggcggcgccgaggaggccagcggcggcaccggctacggcggcgagggcagcggccccggcgccagcgactgcagaatcatcagagtgcagatggagctgggcgaggacggcagcgtgtacaagagcatcctggtgaccagccaggacaaggcccccagcgtgatcagcagagtgctgaagaagaacaacagagacagcgccgtggccagcgagtacgagctggtgcagctgctgcccggcgagagagagctgaccatccccgccagcgccaacgtgttctacgccatggacggcgccagccacgacttcctgctgagaggcgagggccccctgctgctgcacctggccagccccgtggccagactgccccaggagctgctgagagtgagagaggagggcgcccccttccccggcagcagaccccagggcggcagactgcacggccactgcagcgaggaggaggcccccctggcctacagaagccacggcgtgcacaccagatgcggctag

SEQ ID NO: 24220 - DNA, 441 bp, Artificial Sequence; identical to SEQ ID NO: 24216
  Description of Artificial Sequence: Synthetic coding sequence

SEQ ID NO: 24221 - DNA, 441 bp, Artificial Sequence; identical to SEQ ID NO: 24216
  Description of Artificial Sequence: Synthetic coding sequence

SEQ ID NO: 24222 - DNA, 1383 bp, Artificial Sequence
  Description of Artificial Sequence: Synthetic coding sequence
atgcccccccccagaagcagcagaagactgagagccggcaccctggaggccctggtgagacacctgctggacaccagaaccagcggcaccgacgtgagcttcatgagcgccttcctggccacccacagagccttcaccagcacccccgccctgctgggcctgatggccgacagactggaggccctggagagccaccccaccgacgagctggagagaaccaccgaggtggccatcagcgtgctgagcacctggctggccagccaccccgaggacttcggcagcgaggccaagggccagctggacagactggagagcttcctgctgcagaccggctacgccgccggcaagggcgtgggcggcggcagcgccgacctgatcagaaacctgagaagcagagtggacccccaggcccccgacctgcccaagcccctggccctgcccggcgacccccccgccgaccccaccgacgtgctggtgttcctggccgaccacctggccgagcagctgaccctgctggacgccgagctgttcctgaacctgatccccagccagtgcctgggcggcctgtggggccacagagacagacccggccacagccacctgtgccccagcgtgagagccaccgtgacccagttcaacaaggtggccggcgccgtggtgagcagcgtgctgggcgccaccagcaccggcgagggccccggcgaggtgaccatcagacccctgagacccccccagagagccagactgctggagaagtggatcagagtggccgaggagtgcagactgctgagaaacttcagcagcgtgtacgccgtggtgagcgccctgcagagcagccccatccacagactgagagccgcctggggcgaggccaccagagacagcctgagagtgttcagcagcctgtgccagatcttcagcgaggaggacaactacagccagagcagagagctgctggtgcaggaggtgaagctgcagagccccctggagccccacagcaagaaggcccccagaagcggcagcagaggcggcggcgtggtgccctacctgggcaccttcctgaaggacctggtgatgctggacgccgccagcaaggacgagctggagaacggctacatcaacttcgacaagagaagaaaggtgagcggcgtgagcggcctggacgccggcctgccctacccctgcagcagaaagggcagaggcaagagccagggcagcctgagcttcggcagctgcagcctgagagcccccagccaggagttcgccgtgctgagcgagctgagaagactgcagaacgagtgcagaggctacaacctgcagcccgaccacgacatccagagatggctgcagggcctgagacccctgaccgaggcccagagatag

SEQ ID NO: 24223 - DNA, 441 bp, Artificial Sequence; identical to SEQ ID NO: 24216
  Description of Artificial Sequence: Synthetic coding sequence

SEQ ID NO: 24224 - DNA, 2334 bp, Artificial Sequence; identical to SEQ ID NO: 24215
  Description of Artificial Sequence: Synthetic coding sequence

SEQ ID NO: 24225 - DNA, 441 bp, Artificial Sequence; identical to SEQ ID NO: 24216
  Description of Artificial Sequence: Synthetic coding sequence

SEQ ID NO: 24226 - DNA, 2334 bp, Artificial Sequence; identical to SEQ ID NO: 24215
  Description of Artificial Sequence: Synthetic coding sequence

SEQ ID NO: 24227 - DNA, 1383 bp, Artificial Sequence; identical to SEQ ID NO: 24222
  Description of Artificial Sequence: Synthetic coding sequence

SEQ ID NO: 24228 - DNA, 1977 bp, Artificial Sequence; identical to SEQ ID NO: 24219
  Description of Artificial Sequence: Synthetic coding sequence

SEQ ID NO: 24229 - DNA, 1977 bp, Artificial Sequence; identical to SEQ ID NO: 24219
  Description of Artificial Sequence: Synthetic coding sequence

SEQ ID NO: 24230 - DNA, 1977 bp, Artificial Sequence; identical to SEQ ID NO: 24219
  Description of Artificial Sequence: Synthetic coding sequence

SEQ ID NO: 24231 - DNA, 1977 bp, Artificial Sequence; identical to SEQ ID NO: 24219
  Description of Artificial Sequence: Synthetic coding sequence

SEQ ID NO: 24232 - DNA, 1383 bp, Artificial Sequence; identical to SEQ ID NO: 24222
  Description of Artificial Sequence: Synthetic coding sequence

SEQ ID NO: 24233 - DNA, 1383 bp, Artificial Sequence; identical to SEQ ID NO: 24222
  Description of Artificial Sequence: Synthetic coding sequence

SEQ ID NO: 24234 - DNA, 1383 bp, Artificial Sequence; identical to SEQ ID NO: 24222
  Description of Artificial Sequence: Synthetic coding sequence

SEQ ID NO: 24235 - DNA, 1494 bp, Artificial Sequence
  Description of Artificial Sequence: Synthetic coding sequence
gccagagccggcagaggcgccgccagcggcccccccagagtggcccagaccagcgaccccgacagcagcgaggcctgcgccgaggaggaggagggcctgatgccccagggcccccagctgctggacttcagcgtggacgaggtggccgagcagctgaccctgatcgacctggagctgttcagcaaggtgagactgtacgagtgcctgggcagcgtgtggagccagagagacagacccggcgccgccggcgccagccccaccgtgagagccaccgtggcccagttcaacaccgtgaccggctgcgtgctgggcagcgtgctgggcgcccccggcctggccgccccccagagagcccagagactggagaagtggatcagaatcgcccagagatgcagagagctgagaaacttcagcagcctgagagccatcctgagcgccctgcagagcaaccccatctacagactgaagagaagctggggcgccgtgagcagagagcccctgagcaccttcagaaagctgagccagatcttcagcgacgagaacaaccacctgagcagcagagagatcctgttccaggaggaggccaccgagggcagccaggaggaggacaacacccccggcagcctgcccagcaagcccccccccggccccgtgccctacctgggcaccttcctgaccgacctggtgatgctggacaccgccctgcccgacatgctggagggcgacctgatcaacttcgagaagagaagaaaggagtgggagatcctggccagaatccagcagctgcagagaagatgccagagctacaccctgagcccccacccccccatcctggccgccctgcacgcccagaaccagctgaccgaggagcagagctacagactgagcagagtgatcgagccccccgccgccagctgccccagcagccccagaatcagaagaagaatcagcctgaccaagagactgagcgccaagctggccagagagaagagcagcagccccagcggcagccccggcgaccccagcagccccaccagcagcgtgagccccggcagcccccccagcagccccagaagcagagacgcccccgccggcagcccccccgccagccccggcccccagggccccagcaccaagctgcccctgagcctggacctgcccagccccagacccttcgccctgcccctgggcagccccagaatccccctgcccgcccagcagagcagcgaggccagagtgatcagagtgagcatcgacaacgaccacggcaacctgtacagaagcatcctgctgaccagccaggacaaggcccccagcgtggtgagaagagccctgcagaagcacaacgtgccccagccctgggcctgcgactaccagctgttccaggtgctgcccggcgacagaggctgggaggagatgctgatcagcgccatcaagagcgtgggcaccttcttcggcatgttcgccatgtgccaggccagattctacagatag

SEQ ID NO: 24236 - DNA, 2133 bp, Artificial Sequence
  Description of Artificial Sequence: Synthetic coding sequence
atggagagaaccgccggcaaggagctggccctggcccccctgcaggactggggcgaggagaccgaggacggcgccgtgtacagcgtgagcctgagaagacagagaagccagagaagaagccccgccgagggccccggcggcagccaggcccccagccccatcgccaacaccttcctgcactacagaaccagcaaggtgagagtgctgagagccgccagactggagagactggtgggcgagctggtgttcggcgacagagagcaggaccccagcttcatgcccgccttcctggccacctacagaaccttcgtgcccaccgcctgcctgctgggcttcctgctgccccccatgccccccccccccccccccggcgtggagatcaagaagaccgccgtgcaggacctgagcttcaacaagaacctgagagccgtggtgagcgtgctgggcagctggctgcaggaccacccccaggacttcagagacccccccgcccacagcgacctgggcagcgtgagaaccttcctgggctgggccgcccccggcagcgccgaggcccagaaggccgagaagctgctggaggacttcctggaggaggccgagagagagcaggaggaggagcccccccaggtgtggaccggcccccccagagtggcccagaccagcgaccccgacagcagcgaggcctgcgccgaggaggaggagggcctgatgccccagggcccccagctgctggacttcagcgtggacgaggtggccgagcagctgaccctgatcgacctggagctgttcagcaaggtgagactgtacgagtgcctgggcagcgtgtggagccagagagacagacccggcgccgccggcgccagccccaccgtgagagccaccgtggcccagttcaacaccgtgaccggctgcgtgctgggcagcgtgctgggcgcccccggcctggccgccccccagagagcccagagactggagaagtggatcagaatcgcccagagatgcagagagctgagaaacttcagcagcctgagagccatcctgagcgccctgcagagcaaccccatctacagactgaagagaagctggggcgccgtgagcagagagcccctgagcaccttcagaaagctgagccagatcttcagcgacgagaacaaccacctgagcagcagagagatcctgttccaggaggaggccaccgagggcagccaggaggaggacaacacccccggcagcctgcccagcaagcccccccccggccccgtgccctacctgggcaccttcctgaccgacctggtgatgctggacaccgccctgcccgacatgctggagggcgacctgatcaacttcgagaagagaagaaaggagtgggagatcctggccagaatccagcagctgcagagaagatgccagagctacaccctgagcccccacccccccatcctggccgccctgcacgcccagaaccagctgaccgaggagcagagctacagactgagcagagtgatcgagccccccgccgccagctgccccagcagccccagaatcagaagaagaatcagcctgaccaagagactgagcgccaagctggccagagagaagagcagcagccccagcggcagccccggcgaccccagcagccccaccagcagcgtgagccccggcagcccccccagcagccccagaagcagagacgcccccgccggcagcccccccgccagccccggcccccagggccccagcaccaagctgcccctgagcctggacctgcccagccccagacccttcgccctgcccctgggcagccccagaatccccctgcccgcccagcagagcagcgaggccagagtgatcagagtgagcatcgacaacgaccacggcaacctgtacagaagcatcctgctgaccagccaggacaaggcccccagcgtggtgagaagagccctgcagaagcacaacgtgccccagccctgggcctgcgactaccagctgttccaggtgctgcccggcgacagagtgctgctgatccccgacaacgccaacgtgttctacgccatgagccccgtggcccccagagacttcatgctgagaagaaaggagggcaccagaaacaccctgagcgtgagccccagctag

SEQ ID NO: 24237 - DNA, 2151 bp, Artificial Sequence
  Description of Artificial Sequence: Synthetic coding sequence
atggagagaaccgccggcaaggagctggccctggcccccctgcaggactggggcgaggagaccgaggacggcgccgtgtacagcgtgagcctgagaagacagagaagccagagaagaagccccgccgagggccccggcggcagccaggcccccagccccatcgccaacaccttcctgcactacagaaccagcaaggtgagagtgctgagagccgccagactggagagactggtgggcgagctggtgttcggcgacagagagcaggaccccagcttcatgcccgccttcctggccacctacagaaccttcgtgcccaccgcctgcctgctgggcttcctgctgccccccatgccccccccccccccccccggcgtggagatcaagaagaccgccgtgcaggacctgagcttcaacaagaacctgagagccgtggtgagcgtgctgggcagctggctgcaggaccacccccaggacttcagagacccccccgcccacagcgacctgggcagcgtgagaaccttcctgggctgggccgcccccggcagcgccgaggcccagaaggccgagaagctgctggaggacttcctggaggaggccgagagagagcaggaggaggagcccccccaggtgtggaccggcccccccagagtggcccagaccagcgaccccgacagcagcgaggcctgcgccgaggaggaggagggcctgatgccccagggcccccagctgctggacttcagcgtggacgaggtggccgagcagctgaccctgatcgacctggagctgttcagcaaggtgagactgtacgagtgcctgggcagcgtgtggagccagagagacagacccggcgccgccggcgccagccccaccgtgagagccaccgtggcccagttcaacaccgtgaccggctgcgtgctgggcagcgtgctgggcgcccccggcctggccgccccccagagagcccagagactggagaagtggatcagaatcgcccagagatgcagagagctgagaaacttcagcagcctgagagccatcctgagcgccctgcagagcaaccccatctacagactgaagagaagctggggcgccgtgagcagagagcccctgagcaccttcagaaagctgagccagatcttcagcgacgagaacaaccacctgagcagcagagagatcctgttccaggaggaggccaccgagggcagccaggaggaggacaacacccccggcagcctgcccagcaagcccccccccggccccgtgccctacctgggcaccttcctgaccgacctggtgatgctggacaccgccctgcccgacatgctggagggcgacctgatcaacttcgagaagagaagaaaggagtgggagatcctggccagaatccagcagctgcagagaagatgccagagctacaccctgagcccccacccccccatcctggccgccctgcacgcccagaaccagctgaccgaggagcagagctacagactgagcagagtgatcgagccccccgccgccagctgccccagcagccccagaatcagaagaagaatcagcctgaccaagagactgagcgccaagctggccagagagaagagcagcagccccagcggcagccccggcgaccccagcagccccaccagcagcctgtgcatcagccccagcgtgagccccggcagcccccccagcagccccagaagcagagacgcccccgccggcagcccccccgccagccccggcccccagggccccagcaccaagctgcccctgagcctggacctgcccagccccagacccttcgccctgcccctgggcagccccagaatccccctgcccgcccagcagagcagcgaggccagagtgatcagagtgagcatcgacaacgaccacggcaacctgtacagaagcatcctgctgaccagccaggacaaggcccccagcgtggtgagaagagccctgcagaagcacaacgtgccccagccctgggcctgcgactaccagctgttccaggtgctgcccggcgacagagtgctgctgatccccgacaacgccaacgtgttctacgccatgagccccgtggcccccagagacttcatgctgagaagaaaggagggcaccagaaacaccctgagcgtgagccccagctag

SEQ ID NO: 24238 - DNA, 813 bp, Artificial Sequence
  Description of Artificial Sequence: Synthetic coding sequence
atggagagaaccgccggcaaggagctggccctggcccccctgcaggactggggcgaggagaccgaggacggcgccgtgtacagcgtgagcctgagaagacagagaagccagagaagaagccccgccgagggccccggcggcagccaggcccccagccccatcgccaacaccttcctgcactacagaaccagcaaggtgagagtgctgagagccgccagactggagagactggtgggcgagctggtgttcggcgacagagagcaggaccccagcttcatgcccgccttcctggccacctacagaaccttcgtgcccaccgcctgcctgctgggcttcctgctgccccccatgccccccccccccccccccggcgtggagatcaagaagaccgccgtgcaggacctgagcttcaacaagaacctgagactgttcagaggcctgagaggcggcagaggcagagcccacgccagcagaagccccgcccccggcctgcagagaggcagaggcggcagagccgccgacccccacagactgggcgccctgctgcagggcgaggccctgagagtgctgggcctgagagtggtggccgagggccccgccggcggctgcagaagactgccccactgcgccagacacagaggccccgtgcagcacagagacagactgtgcgccggcttcagagccagaagcaccggcctgggcagacccgccgagggcgccgccgccggcgaggtggacccccacagacccgccctgcccagaaccgccgagctgctgctgctggccagacaccccgtgagacccgccatctag

SEQ ID NO: 24239 - DNA, 258 bp, Artificial Sequence
  Description of Artificial Sequence: Synthetic coding sequence
atgaccggcaagacccagaccagcaacgtgaccaacaagaacgaccccaagagcatcaacagcagagtgttcatcggcaacctgaacaccgccatcgtgaagaaggtggacatcgaggccatcttcagcaagtacggcaagatcgtgggctgcagcgtgcacaagggctacgccttcgtgcagtacatgagcgagagacacgccagagccgccgtggccggcgagaacgccagagtgatcgccggccagcccctgtag

SEQ ID NO: 24240 - DNA, 876 bp, Artificial Sequence
  Description of Artificial Sequence: Synthetic coding sequence
atgaccggcaagacccagaccagcaacgtgaccaacaagaacgaccccaagagcatcaacagcagagtgttcatcggcaacctgaacaccgccatcgtgaagaaggtggacatcgaggccatcttcagcaagtacggcaagatcgtgggctgcagcgtgcacaagggctacgccttcgtgcagtacatgagcgagagacacgccagagccgccgtggccggcgagaacgccagagtgatcgccggccagcccctggacatcaacatggccggcgagcccaagccctacagacccaagcccggcaacaagagacccctgagcgccctgtacagactggagagcaaggagcccttcctgagcgtgggcggctacgtgttcgactacgactactacagagacgacttctacaacagactgttcgactaccacggcagagtgccccccccccccagagccgtgatccccctgaagagacccagagtggccgtgaccaccaccagaagaggcaagggcgtgttcagcatgaagggcggcagcagaagcaccgccagcggcagcaccggcagcaagctgaagagcgacgagctgcagaccatcaagaaggagctgacccagatcaagaccaagatcgacagcctgctgggcagactggagaagatcgagaagcagcagaaggccgaggccgaggcccagaagaagcagctggaggagagcctggtgctgatccaggaggagtgcgtgagcgagatcgccgaccacagcaccgaggagcccgccgagggcggccccgacgccgacggcgaggagatgaccgacggcatcgaggaggacttcgacgaggacggcggccacgagctgttcctgcagatcaagtag

SEQ ID NO: 24241 - DNA, 876 bp, Artificial Sequence; identical to SEQ ID NO: 24240
  Description of Artificial Sequence: Synthetic coding sequence

SEQ ID NO: 24242 - DNA, 876 bp, Artificial Sequence; identical to SEQ ID NO: 24240
  Description of Artificial Sequence: Synthetic coding sequence

SEQ ID NO: 24243 - DNA, 258 bp, Artificial Sequence; identical to SEQ ID NO: 24239
  Description of Artificial Sequence: Synthetic coding sequence

SEQ ID NO: 24244 - DNA, 657 bp, Artificial Sequence
  Description of Artificial Sequence: Synthetic coding sequence
atgaccatgtacaagagcaagagaagacaccagagatacatcaacatggccggcgagcccaagccctacagacccaagcccggcaacaagagacccctgagcgccctgtacagactggagagcaaggagcccttcctgagcgtgggcggctacgtgttcgactacgactactacagagacgacttctacaacagactgttcgactaccacggcagagtgccccccccccccagagccgtgatccccctgaagagacccagagtggccgtgaccaccaccagaagaggcaagggcgtgttcagcatgaagggcggcagcagaagcaccgccagcggcagcaccggcagcaagctgaagagcgacgagctgcagaccatcaagaaggagctgacccagatcaagaccaagatcgacagcctgctgggcagactggagaagatcgagaagcagcagaaggccgaggccgaggcccagaagaagcagctggaggagagcctggtgctgatccaggaggagtgcgtgagcgagatcgccgaccacagcaccgaggagcccgccgagggcggccccgacgccgacggcgaggagatgaccgacggcatcgaggaggacttcgacgaggacggcggccacgagctgttcctgcagatcaagtag

SEQ ID NO: 24245 - DNA, 1986 bp, Artificial Sequence
  Description of Artificial Sequence: Synthetic coding sequence
atgaagcccctggagaagttcctgaagaagcagaccagccagctggccggcagaaccgtggccggcggccccggcggcggcctgggcagctgcggcggccccggcggcggcggcggccccggcggcggcggcggccccgccggcggccagagaagcctgcagagaagacagagcgtgagcagactgctgctgcccgccttcctgagagagccccccgccgagcccggcctggagcccccccccgaggagggcggcgagcccgccggcgtggccgaggagcccggcagcggcggcccctgctggctgcagctggaggaggtgcccggccccggccccctgggcggcggcggccccctgagaagccccagcagctacagcagcgacgagctgagccccggcgagcccctgaccagccccccctgggcccccctgggcgcccccgagagacccgagcacctgctgaacagagtgctggagagactggccggcggcgccaccagagacagcgccgccagcgacatcctgctggacgacatcgtgctgacccacagcctgttcctgcccaccgagaagttcctgcaggagctgcaccagtacttcgtgagagccggcggcatggagggccccgagggcctgggcagaaagcaggcctgcctggccatgctgctgcacttcctggacacctaccagggcctgctgcaggaggaggagggcgccggccacatcatcaaggacctgtacctgctgatcatgaaggacgagagcctgtaccagggcctgagagaggacaccctgagactgcaccagctggtggagaccgtggagctgaagatccccgaggagaaccagccccccagcaagcaggtgaagcccctgttcagacacttcagaagaatcgacagctgcctgcagaccagagtggccttcagaggcagcgacgagatcttctgcagagtgtacatgcccgaccacagctacgtgaccatcagaagcagactgagcgccagcgtgcaggacatcctgggcagcgtgaccgagaagctgcagtacagcgaggagcccgccggcagagaggacagcctgatcctggtggccgtgagcagcagcggcgagaaggtgctgctgcagcccaccgaggactgcgtgttcaccgccctgggcatcaacagccacctgttcgcctgcaccagagacagctacgaggccctggtgcccctgcccgaggagatccaggtgagccccggcgacaccgagatccacagagtggagcccgaggacgtggccaaccacctgaccgccttccactgggagctgttcagatgcgtgcacgagctggagttcgtggactacgtgttccacggcgagagaggcagaagagagaccgccaacctggagctgctgctgcagagatgcagcgaggtgacccactgggtggccaccgaggtgctgctgtgcgaggcccccggcaagagagcccagctgctgaagaagttcatcaagatcgccgccctgtgcaagcagaaccaggacctgctgagcttctacgccgtggtgatgggcctggacaacgccgccgtgagcagactgagactgacctgggagaagctgcccggcaagttcaagaacctgttcagaaagttcgagaacctgaccgacccctgcagaaaccacaagagctacagagaggtgatcagcaagatgaagccccccgtgatccccttcgtgcccctgatcctgaaggacctgaccttcctgcacgagggcagcaagaccctggtggacggcctggtgaacatcgagaagctgcacagcgtggccgagaaggtgagaaccatcagaaagtacagaagcagacccctgtgcctggacatggaggccagccccaaccacctgcagaccaaggcctacgtgagacagttccaggtgatcgacaaccagaacctgctgttcgagctgagctacaagctggaggccaacagccagtag

SEQ ID NO: 24246 - DNA, 1371 bp, Artificial Sequence
  Description of Artificial Sequence: Synthetic coding sequence
atggagggccccgagggcctgggcagaaagcaggcctgcctggccatgctgctgcacttcctggacacctaccagggcctgctgcaggaggaggagggcgccggccacatcatcaaggacctgtacctgctgatcatgaaggacgagagcctgtaccagggcctgagagaggacaccctgagactgcaccagctggtggagaccgtggagctgaagatccccgaggagaaccagccccccagcaagcaggtgaagcccctgttcagacacttcagaagaatcgacagctgcctgcagaccagagtggccttcagaggcagcgacgagatcttctgcagagtgtacatgcccgaccacagctacgtgaccatcagaagcagactgagcgccagcgtgcaggacatcctgggcagcgtgaccgagaagctgcagtacagcgaggagcccgccggcagagaggacagcctgatcctggtggccgtgagcagcagcggcgagaaggtgctgctgcagcccaccgaggactgcgtgttcaccgccctgggcatcaacagccacctgttcgcctgcaccagagacagctacgaggccctggtgcccctgcccgaggagatccaggtgagccccggcgacaccgagatccacagagtggagcccgaggacgtggccaaccacctgaccgccttccactgggagctgttcagatgcgtgcacgagctggagttcgtggactacgtgttccacggcgagagaggcagaagagagaccgccaacctggagctgctgctgcagagatgcagcgaggtgacccactgggtggccaccgaggtgctgctgtgcgaggcccccggcaagagagcccagctgctgaagaagttcatcaagatcgccgccctgtgcaagcagaaccaggacctgctgagcttctacgccgtggtgatgggcctggacaacgccgccgtgagcagactgagactgacctgggagaagctgcccggcaagttcaagaacctgttcagaaagttcgagaacctgaccgacccctgcagaaaccacaagagctacagagaggtgatcagcaagatgaagccccccgtgatccccttcgtgcccctgatcctgaaggacctgaccttcctgcacgagggcagcaagaccctggtggacggcctggtgaacatcgagaagctgcacagcgtggccgagaaggtgagaaccatcagaaagtacagaagcagacccctgtgcctggacatggaggccagccccaaccacctgcagaccaaggcctacgtgagacagttccaggtgatcgacaaccagaacctgctgttcgagctgagctacaagctggaggccaacagccagtag

SEQ ID NO: 24247 - DNA, 1371 bp, Artificial Sequence; identical to SEQ ID NO: 24246
  Description of Artificial Sequence: Synthetic coding sequence

SEQ ID NO: 24248 - DNA, 63 bp, Artificial Sequence
  Description of Artificial Sequence: Synthetic coding sequence
atggagggccccgagggcctgggcagaaagcaggcctgcctggccatgctgctgcacttctag

SEQ ID NO: 24249 - DNA, 306 bp, Artificial Sequence
  Description of Artificial Sequence: Synthetic coding sequence
atggagggccccgagggcctgggcagaaagcaggcctgcctggccatgctgctgcacttcctggacacctaccagggcctgctgcaggaggaggagggcgccggccacatcatcaaggacctgtacctgctgatcatgaaggacgagagcctgtaccagggcctgagagaggacaccctgagactgcaccagctggtggagaccgtggagctgaagatccccgaggagaaccagccccccagcaagcaggtgaagcccctgttcagacacttcagaagaatcgacagctgcctgcagaccagatag

SEQ ID NO: 24250 - DNA, 450 bp, Artificial Sequence
  Description of Artificial Sequence: Synthetic coding sequence
atggagggccccgagggcctgggcagaaagcaggcctgcctggccatgctgctgcacttcctggacacctaccagggcctgctgcaggaggaggagggcgccggccacatcatcaaggacctgtacctgctgatcatgaaggacgagagcctgtaccagggcctgagagaggacaccctgagactgcaccagctggtggagaccgtggagctgaagatccccgaggagaaccagccccccagcaagcaggtgaagcccctgttcagacacttcagaagaatcgacagctgcctgcagaccagagtggccttcagaggcagcgacgagatcttctgcagagtgtacatgcccgaccacagctacgtgaccatcagaagcagactgagcgccagcgtgcaggacatcctgggcagcgtgaccgagaagctgcagtacagcgaggagccctag

SEQ ID NO: 24251 - DNA, 1359 bp, Artificial Sequence
  Description of Artificial Sequence: Synthetic coding sequence
atgcccgacctgccccacctgctggccttcctgagcgccagcagagacgtgctgcccagaaccctgctgctgcccccccccaccctgggccccagagacgagcacaccgaccccgtgcagatcggcagagtgcagcaggacacccccggcaaggtgctgagcatcgtgaaccagctgtacctggagacccacagaggctggggcagagagcagaccccccaggagaccgagcccgaggccgcccagagacacgaccccgcccccagaaaccccgccccccacggcgtgagctgggtgaagggccccctgagccccgaggtggaccaccccggccccgccctggccagcctgctggaggaggaggaggaggacctggagggcaaggaggagggcagagaggacgaccccgaggaggagggccccgaggacgtgctgaccatccacgtgcagagcctggtgagagccagaagcagctacgtggccagacagtacagaagcctgagagtgagaatcgccagcgacagcggcggcccccacggcagcggcgaccccgccaccgagctgctgcaggacgtgagacacctgctgaccgacctgcaggaccacctggccaaggacagctacatcagagccgtgttcggcagcagaggccccggcctgcccaagaaggacgaggaccccggccccgccctggagaccgccgtgtgccaggccgtgctggcccccctgaagcccgccctgtggaccagactgagaaccctgagagcccccgagctgagaagactgagaagaagacagaccgccctgagagccggcgccggcccccccggcgcccagggccccggccccgagggccagagccccgcccccgccctgagaagcagaatccacgagagactggcccacctgcacgccgcctgcgcccccagaagaaaggtggccctgctgctggaggtgtgcagagacgtgtacgccggcctggccagaggcgagaaccaggaccccctgggcgccgacgccttcctgcccgccctgaccgaggagctgatctggagccccgacatcggcgacacccagctggacgtggagttcctgatggagctgctggaccccgacgagctgagaggcgaggccggctactacctgaccacctggttcggcgccctgcaccacatcgcccactaccagcccgagaccgacagagcccccagaggcctgagcagcgaggccagagccagcctgcaccagtggcacagaagaagaaccctgcacagaaaggaccaccccagagcccaggccaacctgcccttcaaggagccctgggccgaggagaccgtgaccggcaccagcgacaactag

SEQ ID NO: 24252 - DNA, 1359 bp, Artificial Sequence; identical to SEQ ID NO: 24251
  Description of Artificial Sequence: Synthetic coding sequence

SEQ ID NO: 24253 - DNA, 1260 bp, Artificial Sequence
  Description of Artificial Sequence: Synthetic coding sequence
atggagctgaaggtgtgggtggacggcgtgcagagaatcgtgtgcggcgtgaccgaggtgaccacctgccaggaggtggtgatcgccctggcccaggccatcggcagaaccggcagatacaccctgatcgagaagtggagagacaccgagagacacctggccccccacgagaaccccatcatcagcctgaacaagtggggccagtacgccagcgacgtgcagctgatcctgagaagaaccggccccagcctgagcgagagacccaccagcgacagcgtggccagaatccccgagagaaccctgtacagacagagcctgccccccctggccaagctgagaccccagatcgacaagagcatcaagagaagagagcccaagagaaagagcctgaccttcaccggcggcgccaagggcctgatggacatcttcggcaagggcaaggagaccgagttcaagcagaaggtgctgaacaactgcaagaccaccgccgacgagctgaagaagctgatcagactgcagaccgagaagctgcagagcatcgagaagcagctggagagcaacgagatcgagatcagattctgggagcagaagtacaacagcaacctggaggaggagatcgtgagactggagcagaagatcaagagaaacgacgtggagatcgaggaggaggagttctgggagaacgagctgcagatcgagcaggagaacgagaagcagctgaaggaccagctgcaggagatcagacagaagatcaccgagtgcgagaacaagctgaaggactacctggcccagatcagaaccatggagagcggcctggaggccgagaagctgcagagagaggtgcaggaggcccaggtgaacgaggaggaggtgaagggcaagatcggcaaggtgaagggcgagatcgacatccagggccagcagagcctgagactggagaacggcatcaaggccgtggagagaagcctgggccaggccaccaagagactgcaggacaaggagcaggagctggagcagctgaccaaggagctgagacaggtgaacctgcagcagttcatccagcagaccggcaccaaggtgaccgtgctgcccgccgagcccatcgagatcgaggccagccacgccgacatcgagagagaggcccccttccagagcggcagcctgaagagacccggcagcagcagacagctgcccagcaacctgagaatcctgcagaaccccatcagcagcggcttcaaccccgagggcatctacgtgtag

SEQ ID NO: 24254 - DNA, 1179 bp, Artificial Sequence
  Description of Artificial Sequence: Synthetic coding sequence
atggagctgaaggtgtgggtggacggcgtgcagagaatcgtgtgcggcgtgaccgaggtgaccacctgccaggaggtggtgatcgccctggcccaggccatcggcagaaccggcagatacaccctgatcgagaagtggagagacaccgagagacacctggccccccacgagaaccccatcatcagcctgaacaagtggggccagtacgccagcgacgtgcagctgatcctgagaagaaccggccccagcctgagcgagagacccaccagcgacagcgtggccagaatccccgagagaaccctgtacagacagagcctgccccccctggccaagctgagaccccagatcgacaagagcatcaagagaagagagcccaagagaaagagcctgaccttcaccggcggcgccaagggcctgatggacatcttcggcaagggcaaggagaccgagttcaagcagaaggtgctgaacaactgcaagaccaccgccgacgagctgaagaagctgatcagactgcagaccgagaagctgcagagcatcgagaagcagctggagagcaacgagatcgagatcagattctgggagcagaagtacaacagcaacctggaggaggagatcgtgagactggagcagaagatcaagagaaacgacgtggagatcgaggaggaggagttctgggagaacgagctgcagatcgagcaggagaacgagaagcagctgaaggaccagctgcaggagatcagacagaagatcaccgagtgcgagaacaagctgaaggactacctggcccagatcagaaccatggagagcggcctggaggccgagaagctgcagagagaggtgcaggaggcccaggtgaacgaggaggaggtgaagggcaagatcggcaaggtgaagggcgagatcgacatccagggccagcagagcctgagactggagaacggcatcaaggccgtggagagaagcctgggccaggccaccaagagactgcaggacaaggagcaggagctggagcagctgaccaaggagctgagacaggtgaacctgcagcagttcatccagcagaccggcaccaaggtgaccgtgctgcccgccgagcccatcgagatcgaggccagccacgccgacatcgagagaggcatcatcatcctgagcgacaagcaggagtgcaaggactag

SEQ ID NO: 24255 - DNA, 1260 bp, Artificial Sequence; identical to SEQ ID NO: 24253
  Description of Artificial Sequence: Synthetic coding sequence

SEQ ID NO: 24256 - DNA, 276 bp, Artificial Sequence
  Description of Artificial Sequence: Synthetic coding sequence
atggagctgaaggtgtgggtggacggcgtgcagagaatcgtgtgcggcgtgaccgaggtgaccacctgccaggaggtggtgatcgccctggcccaggccatcggcagaaccggcagatacaccctgatcgagaagtggagagacaccgagagacacctggccccccacgagaaccccatcatcagcctgaacaagtggggccagtacgccagcgacgtgcagctgatcctgagaagaaccggccccagcctgagcgagagacccaccagcgactag

SEQ ID NO: 24257 - DNA, 90 bp, Artificial Sequence
  Description of Artificial Sequence: Synthetic coding sequence
atggagctgaaggtgtgggtggacggcgtgcagagaatcgtgtgcggcgtgaccgaggtgaccacctgccaggaggtggtgatcgcctag

SEQ ID NO: 24258 - DNA, 627 bp, Artificial Sequence
  Description of Artificial Sequence: Synthetic coding sequence
atggagctgaaggtgtgggtggacggcgtgcagagaatcgtgtgcggcgtgaccgaggtgaccacctgccaggaggtggtgatcgccctggcccaggccatcggcagaaccggcagatacaccctgatcgagaagtggagagacaccgagagacacctggccccccacgagaaccccatcatcagcctgaacaagtggggccagtacgccagcgacgtgcagctgatcctgagaagaaccggccccagcctgagcgagagacccaccagcgacagcgtggccagaatccccgagagaaccctgtacagacagagcctgccccccctggccaagctgagaccccagatcgacaagagcatcaagagaagagagcccaagagaaagagcctgaccttcaccggcggcgccaagggcctgatggacatcttcggcaagggcaaggagaccgagttcaagcagaaggtgctgaacaactgcaagaccaccgccgacgagctgaagaagctgatcagactgcagaccgagaagctgcagagcatcgagaagcagctggagagcaacgagatcgagatcagattctgggagcagaagtacaacagcaacctggaggaggagatcgtgagatag

SEQ ID NO: 24259 - DNA, 1260 bp, Artificial Sequence; identical to SEQ ID NO: 24253
  Description of Artificial Sequence: Synthetic coding sequence

SEQ ID NO: 24260 - DNA, 330 bp, Artificial Sequence
  Description of Artificial Sequence: Synthetic coding sequence
atggagctgaaggtgtgggtggacggcgtgcagagaatcgtgtgcggcgtgaccgaggtgaccacctgccaggaggtggtgatcgccctggcccaggccatcggcagaaccggcagatacaccctgatcgagaagtggagagacaccgagagacacctggccccccacgagaaccccatcatcagcctgaacaagtggggccagtacgccagcgacgtgcagctgatcctgagaagaaccggccccagcctgagcgagagacccaccagcgacagcgtggccagaatccccgagagaaccctgtacagacagagcctgcccctgagctag

SEQ ID NO: 24261 - DNA, 660 bp, Artificial Sequence
  Description of Artificial Sequence: Synthetic coding sequence
atggagctgaaggtgtgggtggacggcgtgcagagaatcgtgtgcggcgtgaccgaggtgaccacctgccaggaggtggtgatcgccctggcccaggccatcggcagaaccggcagatacaccctgatcgagaagtggagagacaccgagagacacctggccccccacgagaaccccatcatcagcctgaacaagtggggccagtacgccagcgacgtgcagctgatcctgagaagaaccggccccagcctgagcgagagacccaccagcgacagcgtggccagaatccccgagagaaccctgtacagacagagcctgccccccctggccaagctgagaccccagatcgacaagagcatcaagagaagagagcccaagagaaagagcctgaccttcaccggcggcgccaagggcctgatggacatcttcggcaagggcaaggagaccgagttcaagcagaaggtgctgaacaactgcaagaccaccgccgacgagctgaagaagctgatcagactgcagaccgagaagctgcagagcatcgagaagcagctggagagcaacgagatcgagatcagattctgggagcagaagtacaacagcaacctggaggaggagatcgtgagactggagcagaagatcaagagaaacgacgtggagtag

SEQ ID NO: 24262 - DNA, 369 bp, Artificial Sequence
  Description of Artificial Sequence: Synthetic coding sequence
atggagctgaaggtgtgggtggacggcgtgcagagaatcgtgtgcggcgtgaccgaggtgaccacctgccaggaggtggtgatcgccctggcccaggccatcggcagaaccggcagatacaccctgatcgagaagtggagagacaccgagagacacctggccccccacgagaaccccatcatcagcctgaacaagtggggccagtacgccagcgacgtgcagctgatcctgagaagaaccggccccagcctgagcgagagacccaccagcgacagcgtggccagaatccccgagagaaccctgtacagacagagcctgccccccctggccaagctgagaccccagatcgacaagagcatcaagagatag

SEQ ID NO: 24263 - DNA, 1260 bp, Artificial Sequence; identical to SEQ ID NO: 24253
  Description of Artificial Sequence: Synthetic coding sequence

SEQ ID NO: 24264 - DNA, 480 bp, Artificial Sequence
  Description of Artificial Sequence: Synthetic coding sequence
atggagctgaaggtgtgggtggacggcgtgcagagaatcgtgtgcggcgtgaccgaggtgaccacctgccaggaggtggtgatcgccctggcccaggccatcggcagaaccggcagatacaccctgatcgagaagtggagagacaccgagagacacctggccccccacgagaaccccatcatcagcctgaacaagtggggccagtacgccagcgacgtgcagctgatcctgagaagaaccggccccagcctgagcgagagacccaccagcgacagcgtggccagaatccccgagagaaccctgtacagacagagcctgccccccctggccaagctgagaccccagatcgacaagagcatcaagagaagagagcccaagagaaagagcctgaccttcaccggcggcgccaagggcctgatggacatcttcggcaagggcaaggagaccgagttcaagcagaaggtgctgaacaactgctag

SEQ ID NO: 24265 - DNA, 2412 bp, Artificial Sequence
  Description of Artificial Sequence: Synthetic coding sequence
atggccaagagaagcagcctgtacatcagaatcgtggagggcaagaacctgcccgccaaggacatcaccggcagcagcgacccctactgcatcgtgaaggtggacaacgagcccatcatcagaaccgccaccgtgtggaagaccctgtgccccttctggggcgaggagtaccaggtgcacctgccccccaccttccacgccgtggccttctacgtgatggacgaggacgccctgagcagagacgacgtgatcggcaaggtgtgcctgaccagagacaccatcgccagccaccccaagggcttcagcggctgggcccacctgaccgaggtggaccccgacgaggaggtgcagggcgagatccacctgagactggaggtgtggcccggcgccagagcctgcagactgagatgcagcgtgctggaggccagagacctggcccccaaggacagaaacggcaccagcgaccccttcgtgagagtgagatacaagggcagaaccagagagaccagcatcgtgaagaagagctgctaccccagatggaacgagaccttcgagttcgagctgcaggagggcgccatggaggccctgtgcgtggaggcctgggactgggacctggtgagcagaaacgacttcctgggcaaggtggtgatcgacgtgcagagactgagagtggtgcagcaggaggagggctggttcagactgcagcccgaccagagcaagagcagaagacacgacgagggcaacctgggcagcctgcagctggaggtgagactgagagacgagaccgtgctgcccagcagctactaccagcccctggtgcacctgctgtgccacgaggtgaagctgggcatgcagggccccggccagctgatccccctgatcgaggagaccaccagcaccgagtgcagacaggacgtggccaccaacctgctgaagctgttcctgggccagggcctggccaaggacttcctggacctgctgttccagctggagctgagcagaaccagcgagaccaacaccctgttcagaagcaacagcctggccagcaagagcgtggagagcttcctgaaggtggccggcatgcagtacctgcacggcgtgctgggccccatcatcaacaaggtgttcgaggagaagaagtacgtggagctggaccccagcaaggtggaggtgaaggacgtgggctgcagcggcctgcacagaccccagaccgaggccgaggtgctggagcagagcgcccagaccctgagagcccacctgggcgccctgctgagcgccctgagcagaagcgtgagagcctgccccgccgtggtgagagccaccttcagacagctgttcagaagagtgagagagagattccccggcgcccagcacgagaacgtgcccttcatcgccgtgaccagcttcctgtgcctgagattcttcagccccgccatcatgagccccaagctgttccacctgagagagagacacgccgacgccagaaccagcagaaccctgctgctgctggccaaggccgtgcagaacgtgggcaacatggacacccccgccagcagagccaaggaggcctggatggagcccctgcagcccaccgtgcaccagggcgtggcccagctgaaggacttcatcaccaagctggtggacatcgaggagaaggacgagctggacctgcagagaaccctgagcctgcaggccccccccgtgaaggagggccccctgttcatccacagaaccaagggcaagggccccctgatgagcagcagcttcaagaagctgtacttcagcctgaccaccgaggccctgagcttcgccaagacccccagcagcaagaagagcgccctgatcaagctggccaacatcagagccgccgagaaggtggaggagaagagcttcggcggcagccacgtgatgcaggtgatctacaccgacgacgccggcagaccccagaccgcctacctgcagtgcaagtgcgtgaacgagctgaaccagtggctgagcgccctgagaaaggtgagcatcaacaacaccggcctgctgggcagctaccaccccggcgtgttcagaggcgacaagtggagctgctgccaccagaaggagaagaccggccagggctgcgacaagaccagaagcagagtgaccctgcaggagtggaacgaccccctggaccacgacctggaggcccagctgatctacagacacctgctgggcgtggaggccatgctgtgggagagacacagagagctgagcggcggcgccgaggccggcaccgtgcccaccagccccggcaaggtgcccgaggacagcctggccagactgctgagagtgctgcaggacctgagagaggcccacagcagcagccccgccggcagcccccccagcgagcccaactgcctgctggagctgcagacctag

SEQ ID NO: 24266 - DNA, 2274 bp, Artificial Sequence
  Description of Artificial Sequence: Synthetic coding sequence
atggccaagagaagcagcctgtacatcagaatcgtggagggcaagaacctgcccgccaaggacatcaccggcagcagcgacccctactgcatcgtgaaggtggacaacgagcccatcatcagaaccgccaccgtgtggaagaccctgtgccccttctggggcgaggagtaccaggtgcacctgccccccaccttccacgccgtggccttctacgtgatggacgaggacgccctgagcagagacgacgtgatcggcaaggtgtgcctgaccagagacaccatcgccagccaccccaagggcttcagcggctgggcccacctgaccgaggtggaccccgacgaggaggtgcagggcgagatccacctgagactggaggtgtggcccggcgccagagcctgcagactgagatgcagcgtgctggaggccagagacctggcccccaaggacagaaacggcaccagcgaccccttcgtgagagtgagatacaagggcagaaccagagagaccagcatcgtgaagaagagctgctaccccagatggaacgagaccttcgagttcgagctgcaggagggcgccatggaggccctgtgcgtggaggcctgggactgggacctggtgagcagaaacgacttcctgggcaaggtggtgatcgacgtgcagagactgagagtggtgcagcaggaggagggctggttcagactgcagcccgaccagagcaagagcagaagacacgacgagggcaacctgggcagcctgcagctggaggtgagactgagagacgagaccgtgctgcccagcagctactaccagcccctggtgcacctgctgtgccacgaggtgaagctgggcatgcagggccccggccagctgatccccctgatcgaggagaccaccagcaccgagtgcagacaggacgtggccaccaacctgctgaagctgttcctgggccagggcctggccaaggacttcctggacctgctgttccagctggagctgagcagaaccagcgagaccaacaccctgttcagaagcaacagcctggccagcaagagcgtggagagcttcctgaaggtggccggcatgcagtacctgcacggcgtgctgggccccatcatcaacaaggtgttcgaggagaagaagtacgtggagctggaccccagcaaggtggaggtgaaggacgtgggctgcagcggcctgcacagaccccagaccgaggccgaggtgctggagcagagcgcccagaccctgagagcccacctgggcgccctgctgagcgccctgagcagaagcgtgagagcctgccccgccgtggtgagagccaccttcagacagctgttcagaagagtgagagagagattccccggcgcccagcacgagaacgtgcccttcatcgccgtgaccagcttcctgtgcctgagattcttcagccccgccatcatgagccccaagctgttccacctgagagagagacacgccgacgccagaaccagcagaaccctgctgctgctggccaaggccgtgcagaacgtgggcaacatggacacccccgccagcagagccaaggaggcctggatggagcccctgcagcccaccgtgcaccagggcgtggcccagctgaaggacttcatcaccaagctggtggacatcgaggagaaggacgagctggacctgcagagaaccctgagcctgcaggccccccccgtgaaggagggccccctgttcatccacagaaccaagggcaagggccccctgatgagcagcagcttcaagaagctgtacttcagcctgaccaccgaggccctgagcttcgccaagacccccagcagcaagtgcgtgaacgagctgaaccagtggctgagcgccctgagaaaggtgagcatcaacaacaccggcctgctgggcagctaccaccccggcgtgttcagaggcgacaagtggagctgctgccaccagaaggagaagaccggccagggctgcgacaagaccagaagcagagtgaccctgcaggagtggaacgaccccctggaccacgacctggaggcccagctgatctacagacacctgctgggcgtggaggccatgctgtgggagagacacagagagctgagcggcggcgccgaggccggcaccgtgcccaccagccccggcaaggtgcccgaggacagcctggccagactgctgagagtgctgcaggacctgagagaggcccacagcagcagccccgccggcagcccccccagcgagcccaactgcctgctggagctgcagacctag

SEQ ID NO: 24267 - DNA, 3774 bp, Artificial Sequence
  Description of Artificial Sequence: Synthetic coding sequence
atgcagaagggcatcagactgaacgacggccacgtggccagcctgggcctgctggccagaaaggacggcaccagaaagggctacctgagcaagagaagcagcgacaacaccaagtggcagaccaagtggttcgccctgctgcagaacctgctgttctacttcgagagcgacagcagcagcagacccagcggcctgtacctgctggagggctgcgtgtgcgacagagcccccagccccaagcccgccctgagcgccaaggagcccctggagaagcagcactacttcaccgtgaacttcagccacgagaaccagaaggccctggagctgagaaccgaggacgccaaggactgcgacgagtgggtggccgccatcgcccacgccagctacagaaccctggccaccgagcacgaggccctgatgcagaagtacctgcacctgctgcagatcgtggagaccgagaagaccgtggccaagcagctgagacagcagatcgaggacggcgagatcgagatcgagagactgaaggccgagatcaccagcctgctgaaggacaacgagagaatccagagcacccagaccgtggcccccaacgacgaggacagcgacatcaagaagatcaagaaggtgcagagcttcctgagaggctggctgtgcagaagaaagtggaagaccatcatccaggactacatcagaagcccccacgccgacagcatgagaaagagaaaccaggtggtgttcagcatgctggaggccgaggccgagtacgtgcagcagctgcacatcctggtgaacaacttcctgagacccctgagaatggccgccagcagcaagaagccccccatcacccacgacgacgtgagcagcatcttcctgaacagcgagaccatcatgttcctgcaccagatcttctaccagggcctgaaggccagaatcagcagctggcccaccctggtgctggccgacctgttcgacatcctgctgcccatgctgaacatctaccaggagttcgtgagaaaccaccagtacagcctgcagatcctggcccactgcaagcagaacagagacttcgacaagctgctgaagcactacgaggccaagcccgactgcgaggagagaaccctggagaccttcctgacctaccccatgttccagatccccagatacatcctgaccctgcacgagctgctggcccacaccccccacgagcacgtggagagaaacagcctggactacgccaagagcaagctggaggagctgagcagaatcatgcacgacgaggtgagcgagaccgagaacatcagaaagaacctggccatcgagagaatgatcatcgagggctgcgagatcctgctggacaccagccagaccttcgtgagacagggcagcctgatccaggtgcccatgagcgagaagggcaagatcaccagaggcagactgggcagcctgagcctgaagaaggagggcgagagacagtgcttcctgttcagcaagcacctgatcatctgcaccagaggcagcggcggcaagctgcacctgaccaagaacggcgtgatcagcctgatcgactgcaccctgctggaggagcccgagagcaccgaggaggaggccaagggcagcggccaggacatcgaccacctggacttcaagatcggcgtggagcccaaggacagcccccccttcaccgtgatcctggtggccagcagcagacaggagaaggccgcctggaccagcgacatcagccagtgcgtggacaacatcagatgcaacggcctgatgatgaacgccttcgaggagaacagcaaggtgaccgtgccccagatgatcaagagcgacgccagcctgtactgcgacgacgtggacatcagattcagcaagaccatgaacagctgcaaggtgctgcagatcagatacgccagcgtggagagactgctggagagactgaccgacctgagattcctgagcatcgacttcctgaacaccttcctgcacagctacagagtgttcaccaccgccatcgtggtgctggacaagctgatcaccatctacaagaagcccatcagcgccatccccgccagaagcctggagctgctgttcgccagcggccagaacaacaagctgctgtacggcgagccccccaagagccccagagccaccagaaagttcagcagccccccccccctgagcatcaccaagaccagcagccccagcagaagaagaaagctgagcctgaacatccccatcatcaccggcggcaaggccctggacctggccgccctgagctgcaacagcaacggctacaccagcatgtacagcgccatgagccccttcagcaaggccaccctggacaccagcaagctgtacgtgagcagcagcttcaccaacaagatccccgacgagggcgacaccacccccgagaagcccgaggaccccagcgccctgagcaagcagagcagcgaggtgagcatgagagaggagagcgacatcgaccagaaccagagcgacgacggcgacaccgagaccagccccaccaagagccccaccacccccaagagcgtgaagaacaagaacagcagcgagttccccctgttcagctacaacaacggcgtggtgatgaccagctgcagagagctggacaacaacagaagcgccctgagcgccgccagcgccttcgccatcgccaccgccggcgccaacgagggcacccccaacaaggagaagtacagaagaatgagcctggccagcgccggcttcccccccgaccagagaaacggcgacaaggagttcgtgatcagaagagccgccaccaacagagtgctgaacgtgctgagacactgggtgagcaagcacagccaggacttcgagaccaacgacgagctgaagtgcaaggtgatcggcttcctggaggaggtgatgcacgaccccgagctgctgacccaggagagaaaggccgccgccaacatcatcagaaccctgacccaggaggaccccggcgacaaccagatcaccctggaggagatcacccagatggccgagggcgtgaaggccgagcccttcgagaaccacagcgccctggagatcgccgagcagctgaccctgctggaccacctggtgttcaagaagatcccctacgaggagttcttcggccagggctggatgaagctggagaagaacgagagaaccccctacatcatgaagaccaccaagcacttcaacgacatcagcaacctgatcgccagcgagatcatcagaaacgaggacatcaacgccagagtgagcgccatcgagaagtgggtggccgtggccgacatctgcagatgcctgcacaactacaacgccgtgctggagatcaccagcagcatgaacagaagcgccatcttcagactgaagaagacctggctgaaggtgagcaagcagaccaaggccctgatcgacaagctgcagaagctggtgagcagcgagggcagattcaagaacctgagagaggccctgaagaactgcgaccccccctgcgtgccctacctgggcatgtacctgaccgacctggccttcatcgaggagggcacccccaactacaccgaggacggcctggtgaacttcagcaagatgagaatgatcagccacatcatcagagagatcagacagttccagcagaccgcctacaagatcgagcaccaggccaaggtgacccagtacctgctggaccagagcttcgtgatggacgaggagagcctgtacgagagcagcctgagaatcgagcccaagctgcccacctag

SEQ ID NO: 24268 - DNA, 1470 bp, Artificial Sequence
  Description of Artificial Sequence: Synthetic coding sequence
atgtacagcgccatgagccccttcagcaaggccaccctggacaccagcaagctgtacgtgagcagcagcttcaccaacaagatccccgacgagggcgacaccacccccgagaagcccgaggaccccagcgccctgagcaagcagagcagcgaggtgagcatgagagaggagagcgacatcgaccagaaccagagcgacgacggcgacaccgagaccagccccaccaagagccccaccacccccaagagcgtgaagaacaagaacagcagcgagttccccctgttcagctacaacaacggcgtggtgatgaccagctgcagagagctggacaacaacagaagcgccctgagcgccgccagcgccttcgccatcgccaccgccggcgccaacgagggcacccccaacaaggagaagtacagaagaatgagcctggccagcgccggcttcccccccgaccagagaaacggcgacaaggagttcgtgatcagaagagccgccaccaacagagtgctgaacgtgctgagacactgggtgagcaagcacagccaggacttcgagaccaacgacgagctgaagtgcaaggtgatcggcttcctggaggaggtgatgcacgaccccgagctgctgacccaggagagaaaggccgccgccaacatcatcagaaccctgacccaggaggaccccggcgacaaccagatcaccctggaggagatcacccagatggccgagggcgtgaaggccgagcccttcgagaaccacagcgccctggagatcgccgagcagctgaccctgctggaccacctggtgttcaagaagatcccctacgaggagttcttcggccagggctggatgaagctggagaagaacgagagaaccccctacatcatgaagaccaccaagcacttcaacgacatcagcaacctgatcgccagcgagatcatcagaaacgaggacatcaacgccagagtgagcgccatcgagaagtgggtggccgtggccgacatctgcagatgcctgcacaactacaacgccgtgctggagatcaccagcagcatgaacagaagcgccatcttcagactgaagaagacctggctgaaggtgagcaagcagaccaaggccctgatcgacaagctgcagaagctggtgagcagcgagggcagattcaagaacctgagagaggccctgaagaactgcgaccccccctgcgtgccctacctgggcatgtacctgaccgacctggccttcatcgaggagggcacccccaactacaccgaggacggcctggtgaacttcagcaagatgagaatgatcagccacatcatcagagagatcagacagttccagcagaccgcctacaagatcgagcaccaggccaaggtgacccagtacctgctggaccagagcttcgtgatggacgaggagagcctgtacgagagcagcctgagaatcgagcccaagctgcccacctag

SEQ ID NO: 24269 - DNA, 3822 bp, Artificial Sequence
  Description of Artificial Sequence: Synthetic coding sequence
atgcagaagggcatcagactgaacgacggccacgtggccagcctgggcctgctggccagaaaggacggcaccagaaagggctacctgagcaagagaagcagcgacaacaccaagtggcagaccaagtggttcgccctgctgcagaacctgctgttctacttcgagagcgacagcagcagcagacccagcggcctgtacctgctggagggctgcgtgtgcgacagagcccccagccccaagcccgccctgagcgccaaggagcccctggagaagcagcactacttcaccgtgaacttcagccacgagaaccagaaggccctggagctgagaaccgaggacgccaaggactgcgacgagtgggtggccgccatcgcccacgccagctacagaaccctggccaccgagcacgaggccctgatgcagaagtacctgcacctgctgcagatcgtggagaccgagaagaccgtggccaagcagctgagacagcagatcgaggacggcgagatcgagatcgagagactgaaggccgagatcaccagcctgctgaaggacaacgagagaatccagagcacccagaccgtggcccccaacgacgaggacagcgacatcaagaagatcaagaaggtgcagagcttcctgagaggctggctgtgcagaagaaagtggaagaccatcatccaggactacatcagaagcccccacgccgacagcatgagaaagagaaaccaggtggtgttcagcatgctggaggccgaggccgagtacgtgcagcagctgcacatcctggtgaacaacttcctgagacccctgagaatggccgccagcagcaagaagccccccatcacccacgacgacgtgagcagcatcttcctgaacagcgagaccatcatgttcctgcaccagatcttctaccagggcctgaaggccagaatcagcagctggcccaccctggtgctggccgacctgttcgacatcctgctgcccatgctgaacatctaccaggagttcgtgagaaaccaccagtacagcctgcagatcctggcccactgcaagcagaacagagacttcgacaagctgctgaagcactacgaggccaagcccgactgcgaggagagaaccctggagaccttcctgacctaccccatgttccagatccccagatacatcctgaccctgcacgagctgctggcccacaccccccacgagcacgtggagagaaacagcctggactacgccaagagcaagctggaggagctgagcagaatcatgcacgacgaggtgagcgagaccgagaacatcagaaagaacctggccatcgagagaatgatcatcgagggctgcgagatcctgctggacaccagccagaccttcgtgagacagggcagcctgatccaggtgcccatgagcgagaagggcaagatcaccagaggcagactgggcagcctgagcctgaagaaggagggcgagagacagtgcttcctgttcagcaagcacctgatcatctgcaccagaggcagcggcggcaagctgcacctgaccaagaacggcgtgatcagcctgatcgactgcaccctgctggaggagcccgagagcaccgaggaggaggccaagggcagcggccaggacatcgaccacctggacttcaagatcggcgtggagcccaaggacagcccccccttcaccgtgatcctggtggccagcagcagacaggagaaggccgcctggaccagcgacatcagccagtgcgtggacaacatcagatgcaacggcctgatgatgaacgccttcgaggagaacagcaaggtgaccgtgccccagatgatcaagagaaccagagagggcaccagagaggccgagatgagcagaagcgacgccagcctgtactgcgacgacgtggacatcagattcagcaagaccatgaacagctgcaaggtgctgcagatcagatacgccagcgtggagagactgctggagagactgaccgacctgagattcctgagcatcgacttcctgaacaccttcctgcacagctacagagtgttcaccaccgccatcgtggtgctggacaagctgatcaccatctacaagaagcccatcagcgccatccccgccagatggctgagaagcctggagctgctgttcgccagcggccagaacaacaagctgctgtacggcgagccccccaagagccccagagccaccagaaagttcagcagccccccccccctgagcatcaccaagaccagcagccccagcagaagaagaaagctgagcctgaacatccccatcatcaccggcggcaaggccctggacctggccgccctgagctgcaacagcaacggctacaccagcatgtacagcgccatgagccccttcagcaaggccaccctggacaccagcaagctgtacgtgagcagcagcttcaccaacaagatccccgacgagggcgacaccacccccgagaagcccgaggaccccagcgccctgagcaagcagagcagcgaggtgagcatgagagaggagagcgacatcgaccagaaccagagcgacgacggcgacaccgagaccagccccaccaagagccccaccacccccaagagcgtgaagaacaagaacagcagcgagttccccctgttcagctacaacaacggcgtggtgatgaccagctgcagagagctggacaacaacagaagcgccctgagcgccgccagcgccttcgccatcgccaccgccggcgccaacgagggcacccccaacaaggagaagtacagaagaatgagcctggccagcgccggcttcccccccgaccagagaaacggcgacaaggagttcgtgatcagaagagccgccaccaacagagtgctgaacgtgctgagacactgggtgagcaagcacagccaggacttcgagaccaacgacgagctgaagtgcaaggtgatcggcttcctggaggaggtgatgcacgaccccgagctgctgacccaggagagaaaggccgccgccaacatcatcagaaccctgacccaggaggaccccggcgacaaccagatcaccctggaggagatcacccagatggccgagggcgtgaaggccgagcccttcgagaaccacagcgccctggagatcgccgagcagctgaccctgctggaccacctggtgttcaagaagatcccctacgaggagttcttcggccagggctggatgaagctggagaagaacgagagaaccccctacatcatgaagaccaccaagcacttcaacgacatcagcaacctgatcgccagcgagatcatcagaaacgaggacatcaacgccagagtgagcgccatcgagaagtgggtggccgtggccgacatctgcagatgcctgcacaactacaacgccgtgctggagatcaccagcagcatgaacagaagcgccatcttcagactgaagaagacctggctgaaggtgagcaagcagaccaaggccctgatcgacaagctgcagaagctggtgagcagcgagggcagattcaagaacctgagagaggccctgaagaactgcgaccccccctgcgtgccctacctgggcatgtacctgaccgacctggccttcatcgaggagggcacccccaactacaccgaggacggcctggtgaacttcagcaagatgagaatgatcagccacatcatcagagagatcagacagttccagcagaccgcctacaagatcgagcaccaggccaaggtgacccagtacctgctggaccagagcttcgtgatggacgaggagagcctgtacgagagcagcctgagaatcgagcccaagctgcccacctag

SEQ ID NO: 24270 - DNA, 3783 bp, Artificial Sequence
  Description of Artificial Sequence: Synthetic coding sequence
atgcagaagggcatcagactgaacgacggccacgtggccagcctgggcctgctggccagaaaggacggcaccagaaagggctacctgagcaagagaagcagcgacaacaccaagtggcagaccaagtggttcgccctgctgcagaacctgctgttctacttcgagagcgacagcagcagcagacccagcggcctgtacctgctggagggctgcgtgtgcgacagagcccccagccccaagcccgccctgagcgccaaggagcccctggagaagcagcactacttcaccgtgaacttcagccacgagaaccagaaggccctggagctgagaaccgaggacgccaaggactgcgacgagtgggtggccgccatcgcccacgccagctacagaaccctggccaccgagcacgaggccctgatgcagaagtacctgcacctgctgcagatcgtggagaccgagaagaccgtggccaagcagctgagacagcagatcgaggacggcgagatcgagatcgagagactgaaggccgagatcaccagcctgctgaaggacaacgagagaatccagagcacccagaccgtggcccccaacgacgaggacagcgacatcaagaagatcaagaaggtgcagagcttcctgagaggctggctgtgcagaagaaagtggaagaccatcatccaggactacatcagaagcccccacgccgacagcatgagaaagagaaaccaggtggtgttcagcatgctggaggccgaggccgagtacgtgcagcagctgcacatcctggtgaacaacttcctgagacccctgagaatggccgccagcagcaagaagccccccatcacccacgacgacgtgagcagcatcttcctgaacagcgagaccatcatgttcctgcaccagatcttctaccagggcctgaaggccagaatcagcagctggcccaccctggtgctggccgacctgttcgacatcctgctgcccatgctgaacatctaccaggagttcgtgagaaaccaccagtacagcctgcagatcctggcccactgcaagcagaacagagacttcgacaagctgctgaagcactacgaggccaagcccgactgcgaggagagaaccctggagaccttcctgacctaccccatgttccagatccccagatacatcctgaccctgcacgagctgctggcccacaccccccacgagcacgtggagagaaacagcctggactacgccaagagcaagctggaggagctgagcagaatcatgcacgacgaggtgagcgagaccgagaacatcagaaagaacctggccatcgagagaatgatcatcgagggctgcgagatcctgctggacaccagccagaccttcgtgagacagggcagcctgatccaggtgcccatgagcgagaagggcaagatcaccagaggcagactgggcagcctgagcctgaagaaggagggcgagagacagtgcttcctgttcagcaagcacctgatcatctgcaccagaggcagcggcggcaagctgcacctgaccaagaacggcgtgatcagcctgatcgactgcaccctgctggaggagcccgagagcaccgaggaggaggccaagggcagcggccaggacatcgaccacctggacttcaagatcggcgtggagcccaaggacagcccccccttcaccgtgatcctggtggccagcagcagacaggagaaggccgcctggaccagcgacatcagccagtgcgtggacaacatcagatgcaacggcctgatgatgaacgccttcgaggagaacagcaaggtgaccgtgccccagatgatcaagagcgacgccagcctgtactgcgacgacgtggacatcagattcagcaagaccatgaacagctgcaaggtgctgcagatcagatacgccagcgtggagagactgctggagagactgaccgacctgagattcctgagcatcgacttcctgaacaccttcctgcacagctacagagtgttcaccaccgccatcgtggtgctggacaagctgatcaccatctacaagaagcccatcagcgccatccccgccagatggctgagaagcctggagctgctgttcgccagcggccagaacaacaagctgctgtacggcgagccccccaagagccccagagccaccagaaagttcagcagccccccccccctgagcatcaccaagaccagcagccccagcagaagaagaaagctgagcctgaacatccccatcatcaccggcggcaaggccctggacctggccgccctgagctgcaacagcaacggctacaccagcatgtacagcgccatgagccccttcagcaaggccaccctggacaccagcaagctgtacgtgagcagcagcttcaccaacaagatccccgacgagggcgacaccacccccgagaagcccgaggaccccagcgccctgagcaagcagagcagcgaggtgagcatgagagaggagagcgacatcgaccagaaccagagcgacgacggcgacaccgagaccagccccaccaagagccccaccacccccaagagcgtgaagaacaagaacagcagcgagttccccctgttcagctacaacaacggcgtggtgatgaccagctgcagagagctggacaacaacagaagcgccctgagcgccgccagcgccttcgccatcgccaccgccggcgccaacgagggcacccccaacaaggagaagtacagaagaatgagcctggccagcgccggcttcccccccgaccagagaaacggcgacaaggagttcgtgatcagaagagccgccaccaacagagtgctgaacgtgctgagacactgggtgagcaagcacagccaggacttcgagaccaacgacgagctgaagtgcaaggtgatcggcttcctggaggaggtgatgcacgaccccgagctgctgacccaggagagaaaggccgccgccaacatcatcagaaccctgacccaggaggaccccggcgacaaccagatcaccctggaggagatcacccagatggccgagggcgtgaaggccgagcccttcgagaaccacagcgccctggagatcgccgagcagctgaccctgctggaccacctggtgttcaagaagatcccctacgaggagttcttcggccagggctggatgaagctggagaagaacgagagaaccccctacatcatgaagaccaccaagcacttcaacgacatcagcaacctgatcgccagcgagatcatcagaaacgaggacatcaacgccagagtgagcgccatcgagaagtgggtggccgtggccgacatctgcagatgcctgcacaactacaacgccgtgctggagatcaccagcagcatgaacagaagcgccatcttcagactgaagaagacctggctgaaggtgagcaagcagaccaaggccctgatcgacaagctgcagaagctggtgagcagcgagggcagattcaagaacctgagagaggccctgaagaactgcgaccccccctgcgtgccctacctgggcatgtacctgaccgacctggccttcatcgaggagggcacccccaactacaccgaggacggcctggtgaacttcagcaagatgagaatgatcagccacatcatcagagagatcagacagttccagcagaccgcctacaagatcgagcaccaggccaaggtgacccagtacctgctggaccagagcttcgtgatggacgaggagagcctgtacgagagcagcctgagaatcgagcccaagctgcccacctag

SEQ ID NO: 24271 - DNA, 1470 bp, Artificial Sequence
  Description of Artificial Sequence: Synthetic coding sequence
atgttcctggagccccaggagaccatgccccagaccagcgtggtgttcagcagcatcctgggccccagctgcagcggccaggtgcagcccggcatgggcgagagaggcggcggcgccggcggcggcagcggcgacctgatcttccaggacggccacctgatcagcggcagcctggaggccctgatggagcacctggtgcccaccgtggactactaccccgacagaacctacatcttcaccttcctgctgagcagcagagtgttcatgcccccccacgacctgctggccagagtgggccagatctgcgtggagcagaagcagcagctggaggccggccccgagaaggccaagctgaagagcttcagcgccaagatcgtgcagctgctgaaggagtggaccgaggccttcccctacgacttccaggacgagaaggccatggccgagctgaaggccatcacccacagagtgacccagtgcgacgaggagaacggcaccgtgaagaaggccatcgcccagatgacccagagcctgctgctgagcctggccgccagaagccagctgcaggagctgagagagaagctgagaccccccgccgtggacaagggccccatcctgaagaccaagccccccgccgcccagaaggacatcctgggcgtgtgctgcgaccccctggtgctggcccagcagctgacccacatcgagctggacagagtgagcagcatctaccccgaggacctgatgcagatcgtgagccacatggacagcctggacaaccacagatgcagaggcgacctgaccaagacctacagcctggaggcctacgacaactggttcaactgcctgagcatgctggtggccaccgaggtgtgcagagtggtgaagaagaagcacagaaccagaatgctggagttcttcatcgacgtggccagagagtgcttcaacatcggcaacttcaacagcatgatggccatcatcagcggcatgaacctgagccccgtggccagactgaagaagacctggagcaaggtgaagaccgccaagttcgacgtgctggagcaccacatggaccccagcagcaacttctgcaactacagaaccgccctgcagggcgccacccagagaagccagatggccaacagcagcagagagaagatcgtgatccccgtgttcaacctgttcgtgaaggacatctacttcctgcacaagatccacaccaaccacctgcccaacggccacatcaacttcaagaagttctgggagatcagcagacagatccacgagttcatgacctggacccaggtggagtgccccttcgagaaggacaagaagatccagagctacctgctgaccgcccccatctacagcgaggaggccctgttcgtggccagcttcgagagcgagggccccgagaaccacatggagaaggacagctggaagaccctgagaaccaccctgctgaacagagcctag

SEQ ID NO: 24272 - DNA, 1446 bp, Artificial Sequence
  Description of Artificial Sequence: Synthetic coding sequence
atgccccagaccagcgtggtgttcagcagcatcctgggccccagctgcagcggccaggtgcagcccggcatgggcgagagaggcggcggcgccggcggcggcagcggcgacctgatcttccaggacggccacctgatcagcggcagcctggaggccctgatggagcacctggtgcccaccgtggactactaccccgacagaacctacatcttcaccttcctgctgagcagcagagtgttcatgcccccccacgacctgctggccagagtgggccagatctgcgtggagcagaagcagcagctggaggccggccccgagaaggccaagctgaagagcttcagcgccaagatcgtgcagctgctgaaggagtggaccgaggccttcccctacgacttccaggacgagaaggccatggccgagctgaaggccatcacccacagagtgacccagtgcgacgaggagaacggcaccgtgaagaaggccatcgcccagatgacccagagcctgctgctgagcctggccgccagaagccagctgcaggagctgagagagaagctgagaccccccgccgtggacaagggccccatcctgaagaccaagccccccgccgcccagaaggacatcctgggcgtgtgctgcgaccccctggtgctggcccagcagctgacccacatcgagctggacagagtgagcagcatctaccccgaggacctgatgcagatcgtgagccacatggacagcctggacaaccacagatgcagaggcgacctgaccaagacctacagcctggaggcctacgacaactggttcaactgcctgagcatgctggtggccaccgaggtgtgcagagtggtgaagaagaagcacagaaccagaatgctggagttcttcatcgacgtggccagagagtgcttcaacatcggcaacttcaacagcatgatggccatcatcagcggcatgaacctgagccccgtggccagactgaagaagacctggagcaaggtgaagaccgccaagttcgacgtgctggagcaccacatggaccccagcagcaacttctgcaactacagaaccgccctgcagggcgccacccagagaagccagatggccaacagcagcagagagaagatcgtgatccccgtgttcaacctgttcgtgaaggacatctacttcctgcacaagatccacaccaaccacctgcccaacggccacatcaacttcaagaagttctgggagatcagcagacagatccacgagttcatgacctggacccaggtggagtgccccttcgagaaggacaagaagatccagagctacctgctgaccgcccccatctacagcgaggaggccctgttcgtggccagcttcgagagcgagggccccgagaaccacatggagaaggacagctggaagaccctgagaaccaccctgctgaacagagcctag

SEQ ID NO: 24273 - DNA, 1446 bp, Artificial Sequence; identical to SEQ ID NO: 24272
  Description of Artificial Sequence: Synthetic coding sequence

SEQ ID NO: 24274 - DNA, 1422 bp, Artificial Sequence
  Description of Artificial Sequence: Synthetic coding sequence
atgccccagaccccccccttcagcgccatgttcgacagcagcggctacaacagaaacctgtaccagagcgccgaggacagctgcggcggcctgtactaccacgacaacaacctgctgagcggcagcctggaggccctgatccagcacctggtgcccaacgtggactactaccccgacagaacctacatcttcaccttcctgctgagcagcagactgttcatgcacccctacgagctgatggccaaggtgtgccacctgtgcgtggagcaccagagactgagcgaccccgacagcgacaagaaccagatgagaaagatcgcccccaagatcctgcagctgctgaccgagtggaccgagaccttcccctacgacttcagagacgagagaatgatgagaaacctgaaggacctggcccacagaatcgccagcggcgaggagcagacctacagaaagaacgtgcagcagatgatgcagtgcctgatcagaaagctggccgccctgagccagtacgaggaggtgctggccaagatcagcagcaccagcaccgacagactgaccgtgctgaagaccaagccccagagcatccagagagacatcatcaccgtgtgcaacgacccctacaccctggcccagcagctgacccacatcgagctggagagactgaactacatcggccccgaggagttcgtgcaggccttcgtgcagaaggaccccctggacaacgacaagagctgctacagcgagagaaagaagaccagaaacctggaggcctacgtggagtggttcaacagactgagctacctggtggccaccgagatctgcatgcccgtgaagaagaagcacagagccagaatgatcgagtacttcatcgacgtggccagagagtgcttcaacatcggcaacttcaacagcctgatggccatcatcagcggcatgaacatgagccccgtgagcagactgaagaagacctgggccaaggtgaagaccgccaagttcgacatcctggagcaccagatggaccccagcagcaacttctacaactacagaaccgccctgagaggcgccgcccagagaagcctgaccgcccacagcagcagagagaagatcgtgatccccttcttcagcctgctgatcaaggacatctacttcctgaacgagggctgcgccaacagactgcccaacggccacgtgaacttcgagaagttctgggagctggccaagcaggtgagcgagttcatgacctggaagcaggtggagtgccccttcgagagagacagaaagatcctgcagtacctgctgaccgtgcccgtgttcagcgaggacgccctgtacctggccagctacgagagcgagggccccgagaaccacatcgagaaggacagatggaagagcctgagaagcagcctgctgggcagagtgtag

SEQ ID NO: 24275 - DNA, 1296 bp, Artificial Sequence
  Description of Artificial Sequence: Synthetic coding sequence
atgccccagaccccccccttcagcgccatgttcgacagcagcggctacaacagaaacctgtaccagagcgccgaggacagctgcggcggcctgtactaccacgacaacaacctgctgagcggcagcctggaggccctgatccagcacctggtgcccaacgtggactactaccccgacaaccagatgagaaagatcgcccccaagatcctgcagctgctgaccgagtggaccgagaccttcccctacgacttcagagacgagagaatgatgagaaacctgaaggacctggcccacagaatcgccagcggcgaggagacctacagaaagaacgtgcagcagatgatgcagtgcctgatcagaaagctggccgccctgagccagtacgaggaggtgctggccaagatcagcagcaccagcaccgacagactgaccgtgctgaagaccaagccccagagcatccagagagacatcatcaccgtgtgcaacgacccctacaccctggcccagcagctgacccacatcgagctggagagactgaactacatcggccccgaggagttcgtgcaggccttcgtgcagaaggaccccctggacaacgacaagagctgctacagcgagagaaagaagaccagaaacctggaggcctacgtggagtggttcaacagactgagctacctggtggccaccgagatctgcatgcccgtgaagaagaagcacagagccagaatgatcgagtacttcatcgacgtggccagagagtgcttcaacatcggcaacttcaacagcctgatggccatcatcagcggcatgaacatgagccccgtgagcagactgaagaagacctgggccaaggtgaagaccgccaagttcgacatcctggagcaccagatggaccccagcagcaacttctacaactacagaaccgccctgagaggcgccgcccagagaagcctgaccgcccacagcagcagagagaagatcgtgatccccttcttcagcctgctgatcaaggacatctacttcctgaacgagggctgcgccaacagactgcccaacggccacgtgaacttcgagaagttctgggagctggccaagcaggtgagcgagttcatgacctggaagcaggtggagtgccccttcgagagagacagaaagatcctgcagtacctgctgaccgtgcccgtgttcagcgaggacgccctgtacctggccagctacgagagcgagggccccgagaaccacatcgagaaggacagatggaagagcctgagaagcagcctgctgggcagagtgtag

SEQ ID NO: 24276 - DNA, 633 bp, Artificial Sequence
  Description of Artificial Sequence: Synthetic coding sequence
atgccccagaccccccccttcagcgccatgttcgacagcagcggctacaacagaaacctgtaccagagcgccgaggacagctgcggcggcctgtactaccacgacaacaacctgctgagcggcagcctggaggccctgatccagcacctggtgcccaacgtggactactaccccgacagaacctacatcttcaccttcctgctgagcagcagactgttcatgcacccctacgagctgatggccaaggtgtgccacctgtgcgtggagcaccagagactgagcgaccccgacagcgacaagaaccagatgagaaagatcgcccccaagatcctgcagctgctgaccgagtggaccgagaccttcccctacgacttcagagacgagagaatgatgagaaacctgaaggacctggcccacagaatcgccagcggcgaggaggtgggcaacctgaacctggccagactgctggagttccccggcagagcctgggtgggcaacggcgccgagctgtgcatcctgatcagcaccgccagcagcctgttctgcctgtgggccagccccccccaccacatcctggtgtacctggtgtgccaggtgagaatgatcatccccagccacttcaagggcatctag

SEQ ID NO: 24277 - DNA, 633 bp, Artificial Sequence; identical to SEQ ID NO: 24276
  Description of Artificial Sequence: Synthetic coding sequence

SEQ ID NO: 24278 - DNA, 1419 bp, Artificial Sequence
  Description of Artificial Sequence: Synthetic coding sequence
atgccccagaccccccccttcagcgccatgttcgacagcagcggctacaacagaaacctgtaccagagcgccgaggacagctgcggcggcctgtactaccacgacaacaacctgctgagcggcagcctggaggccctgatccagcacctggtgcccaacgtggactactaccccgacagaacctacatcttcaccttcctgctgagcagcagactgttcatgcacccctacgagctgatggccaaggtgtgccacctgtgcgtggagcaccagagactgagcgaccccgacagcgacaagaaccagatgagaaagatcgcccccaagatcctgcagctgctgaccgagtggaccgagaccttcccctacgacttcagagacgagagaatgatgagaaacctgaaggacctggcccacagaatcgccagcggcgaggagacctacagaaagaacgtgcagcagatgatgcagtgcctgatcagaaagctggccgccctgagccagtacgaggaggtgctggccaagatcagcagcaccagcaccgacagactgaccgtgctgaagaccaagccccagagcatccagagagacatcatcaccgtgtgcaacgacccctacaccctggcccagcagctgacccacatcgagctggagagactgaactacatcggccccgaggagttcgtgcaggccttcgtgcagaaggaccccctggacaacgacaagagctgctacagcgagagaaagaagaccagaaacctggaggcctacgtggagtggttcaacagactgagctacctggtggccaccgagatctgcatgcccgtgaagaagaagcacagagccagaatgatcgagtacttcatcgacgtggccagagagtgcttcaacatcggcaacttcaacagcctgatggccatcatcagcggcatgaacatgagccccgtgagcagactgaagaagacctgggccaaggtgaagaccgccaagttcgacatcctggagcaccagatggaccccagcagcaacttctacaactacagaaccgccctgagaggcgccgcccagagaagcctgaccgcccacagcagcagagagaagatcgtgatccccttcttcagcctgctgatcaaggacatctacttcctgaacgagggctgcgccaacagactgcccaacggccacgtgaacttcgagaagttctgggagctggccaagcaggtgagcgagttcatgacctggaagcaggtggagtgccccttcgagagagacagaaagatcctgcagtacctgctgaccgtgcccgtgttcagcgaggacgccctgtacctggccagctacgagagcgagggccccgagaaccacatcgagaaggacagatggaagagcctgagaagcagcctgctgggcagagtgtag

SEQ ID NO: 24279 - DNA, 1401 bp, Artificial Sequence
  Description of Artificial Sequence: Synthetic coding sequence
atgccccagaccctgagcgccagcgacatggtgacccccggcagcctgagccccccccccaccgagcccaccgacggcgagcaggccggccagcccctgctggacggcgcccccagcagcgccagcctggagaccctgatccagcacctggtgcccaccgccgactactaccccgagaaggcctacatcttcaccttcctgctgagcagcagactgttcatcgagcccagagagctgctggccagagtgtgccacctgtgcatcgagcagcagcagctggacaagcccgtgctggacaaggccagagtgagaaagttcggccccaagctgctgcagctgctggccgagtggaccgagaccttccccagagacttccaggaggagagcaccatcggccacctgaaggacgtggtgggcagaatcgccccctgcgacgaggcctacagaaagagaatgcaccagctgctgcaggccctgcaccagaagctggccgccctgagacagggccccgagggcctggtgggcgccgacaagcccatcagctacagaaccaagccccccgccagcatccacagagagctgctgggcgtgtgcagcgacccctacaccctggcccagcagctgacccacgtggagctggagagactgagacacatcggccccgaggagttcgtgcaggccttcgtgaacaaggaccccctggccagcaccaagccctgcttcagcgacaagaccagcaacctggaggcctacgtgaagtggttcaacagactgtgctacctggtggccaccgagatctgcatgcccgccaagaagaagcagagagcccaggtgatcgagttcttcatcgacgtggccagagagtgcttcaacatcggcaacttcaacagcctgatggccatcatcagcggcatgaacatgagccccgtgagcagactgaagaagacctgggccaaggtgagaaccgccaagttcttcatcctggagcaccagatggaccccaccggcaacttctgcaactacagaaccgccctgagaggcgccgcccacagaagcctgaccgcccacagcagcagagagaagatcgtgatccccttcttcagcctgctgatcaaggacatctacttcctgaacgagggctgcgccaacagactgcccaacggccacgtgaacttcgagaagttcctggagctggccaagcaggtgggcgagttcatcacctggaagcaggtggagtgccccttcgagcaggacgccagcatcacccactacctgtacaccgcccccatcttcagcgaggacggcctgtacctggccagctacgagagcgagagccccgagaaccagaccgagaaggagagatggaaggccctgagaagcagcatcctgggcaagacctag

SEQ ID NO: 24280 - DNA, 1401 bp, Artificial Sequence; identical to SEQ ID NO: 24279
  Description of Artificial Sequence: Synthetic coding sequence

SEQ ID NO: 24281 - DNA, 1170 bp, Artificial Sequence
  Description of Artificial Sequence: Synthetic coding sequence
atgagagtgctggtgagaagatgctggggcccccccctggcccacggcgccagaagaggcagacccagcccccagtggagagccctggccagactgggctgggaggactgcagagacagcagagtgagagagaagcccccctggagagtgctgttcttcggcaccgaccagttcgccagagaggccctgagagccctgcacgccgccagagagaacaaggaggaggagctgatcgacaagctggaggtggtgaccatgcccagccccagccccaagggcctgcccgtgaagcagtacgccgtgcagagccagctgcccgtgtacgagtggcccgacgtgggcagcggcgagtacgacgtgggcgtggtggccagcttcggcagactgctgaacgaggccctgatcctgaagttcccctacggcatcctgaacgtgcaccccagctgcctgcccagatggagaggccccgcccccgtgatccacaccgtgctgcacggcgacaccgtgaccggcgtgaccatcatgcagatcagacccaagagattcgacgtgggccccatcctgaagcaggagaccgtgcccgtgccccccaagagcaccgccaaggagctggaggccgtgctgagcagactgggcgccaacatgctgatcagcgtgctgaagaacctgcccgagagcctgagcaacggcagacagcagcccatggagggcgccacctacgcccccaagatcagcgccggcaccagctgcatcaagtgggaggagcagaccagcgagcagatcttcagactgtacagagccatcggcaacatcatccccctgcagaccctgtggatggccaacaccatcaagctgctggacctggtggaggtgaacagcagcgtgctggccgaccccaagctgaccggccaggccctgatccccggcagcgtgatctaccacaagcagagccagatcctgctggtgtactgcaaggacggctggatcggcgtgagaagcgtgatgctgaagaagagcctgaccgccaccgacttctacaacggctacctgcacccctggtaccagaagaacagccaggcccagcccagccagtgcagattccagaccctgagactgcccaccaagaagaagcagaagaagaccgtggccatgcagcagtgcatcgagtag

SEQ ID NO: 24282 - DNA, 744 bp, Artificial Sequence
  Description of Artificial Sequence: Synthetic coding sequence
atgagcagcgtgttcggcaagcccagagccggcagcggcccccagagcgcccccctggaggtgaacctggccatcctgggcagaagaggcgccggcaagagcgaggacacctacagcagcgaggagaccgtggaccaccagcccgtgcacctgagagtgatggacaccgccgacctggacacccccagaaactgcgagagatacctgaactgggcccacgccttcctggtggtgtacagcgtggacagcagacagagcttcgacagcagcagcagctacctggagctgctggccctgcacgccaaggagacccagagaagcatccccgccctgctgctgggcaacaagctggacatggcccagtacagacaggtgaccaaggccgagggcgtggccctggccggcagattcggctgcctgttcttcgaggtgagcgcctgcctggacttcgagcacgtgcagcacgtgttccacgaggccgtgagagaggccagaagagagctggagaagagccccctgaccagacccctgttcatcagcgaggagagagccctgccccaccaggcccccctgaccgccagacacggcctggccagctgcaccttcaacaccctgagcaccatcaacctgaaggagatgcccaccgtggcccaggccaagctggtgaccgtgaagagcagcagagcccagagcaagagaaaggcccccaccctgaccctgctgaagggcttcaagatcttctag

SEQ ID NO: 24283 - DNA, 768 bp, Artificial Sequence
  Description of Artificial Sequence: Synthetic coding sequence
atggtgatcatgggccccgagctggtgggcagctggagcgacttcaagaacgaggccgccgaccccagagccctgaccgtgaagttcctgaccaagagattcatcagcgagtacgaccccaacctggaggacacctacagcagcgaggagaccgtggaccaccagcccgtgcacctgagagtgatggacaccgccgacctggacacccccagaaactgcgagagatacctgaactgggcccacgccttcctggtggtgtacagcgtggacagcagacagagcttcgacagcagcagcagctacctggagctgctggccctgcacgccaaggagacccagagaagcatccccgccctgctgctgggcaacaagctggacatggcccagtacagacaggtgaccaaggccgagggcgtggccctggccggcagattcggctgcctgttcttcgaggtgagcgcctgcctggacttcgagcacgtgcagcacgtgttccacgaggccgtgagagaggccagaagagagctggagaagagccccctgaccagacccctgttcatcagcgaggagagagccctgccccaccaggcccccctgaccgccagacacggcctggccagctgcaccttcaacaccctgagcaccatcaacctgaaggagatgcccaccgtggcccaggccaagctggtgaccgtgaagagcagcagagcccagagcaagagaaaggcccccaccctgaccctgctgaagggcttcaagatcttctag

SEQ ID NO: 24284 - DNA, 1131 bp, Artificial Sequence
  Description of Artificial Sequence: Synthetic coding sequence
atggccgaggagagacccggcgcctggttcggcttcggcttctgcggcttcggccaggagctgggcagcggcagaggcagacaggtgcacagccccagccccctgagagccggcgtggacatctgcagagtgagcgccagctggagctacaccgccttcgtgaccagaggcggcagactggagctgagcggcagcgccagcggcgccgccggcagatgcaaggacgcctgggccagcgagggcctgctggccgtgctgagagccggccccggccccgaggccctgctgcaggtgtgggccgccgagagcgccctgagaggcgagcccctgtgggcccagaacgtggtgcccgaggccgagggcgaggacgaccccgccggcgaggcccaggccggcagactgcccctgctgccctgcgccagagcctacgtgagccccagagcccccttctacagacccctggcccccgagctgagagccagacagctggagctgggcgccgagcacgccctgctgctggacgccgccggccaggtgttcagctggggcggcggcagacacggccagctgggccacggcaccctggaggccgagctggagcccagactgctggaggccctgcagggcctggtgatggccgaggtggccgccggcggctggcacagcgtgtgcgtgagcgagaccggcgacatctacatctggggctggaacgagagcggccagctggccctgcccaccagaaacctggccgaggacggcgagaccgtggccagagaggccaccgagctgaacgaggacggcagccaggtgaagagaaccggcggcgccgaggacggcgcccccgcccccttcatcgccgtgcagcccttccccgccctgctggacctgcccatgggcagcgacgccgtgaaggccagctgcggcagcagacacaccgccgtggtgaccagaaccggcgagctgtacacctggggctggggcaagtacggccagctgggccacgaggacaccaccagcctggacagacccagaagagtggagtacttcgtggacaagcagctgcaggtgaaggccgtgacctgcggcccctggaacacctacgtgtacgccgtggagaagggcaagagctag

SEQ ID NO: 24285 - DNA, 1131 bp, Artificial Sequence; identical to SEQ ID NO: 24284
  Description of Artificial Sequence: Synthetic coding sequence

SEQ ID NO: 24286 - DNA, 594 bp, Artificial Sequence
  Description of Artificial Sequence: Synthetic coding sequence
atggaggagagacccgccgagaccaacgccaacgtggacaacagcgccagccccagcgtggcccagctggccggcagattcagagagcaggccgccgccgccaaggagacccccgccagcaagcccaccagaagaaagcccccctgcagcctgcccctgttcccccccaaggtggacctgggccagaacggcgaggaggccaacctgaccttcgaccccgccgccctgctgcccggcgccagccccaagagccccggcctgaaggccatggtgagccccttccacagcccccccagcacccccagcagccccggcgtgagaagcagacccagcgaggccgaggaggtgcccgtgagcttcgaccagccccccgagggcagccacctgccctgctacaacaaggtgagaaccagaggcagcatcaagagaagaccccccagcagaagattcagaagaagccagagcgactgcggcgagctgggcgacttcagagccgtggagagcagccagcagaacggcgccaaggaggaggacggcgacgaggtgctgcccagcaagagcaaggcccccggcagccccctgagcagcgagtag

SEQ ID NO: 24287 - DNA, 1251 bp, Artificial Sequence
  Description of Artificial Sequence: Synthetic coding sequence
atggaggagagacccgccgagaccaacgccaacgtggacaacagcgccagccccagcgtggcccagctggccggcagattcagagagcaggccgccgccgccaaggagacccccgccagcaagcccaccagaagaaagcccccctgcagcctgcccctgttcccccccaaggtggacctgggccagaacggcgaggagaagagcccccccaacgccagccacccccccaagttcaaggtgaagagcagccccctgatcgagaagctgcaggccaacctgaccttcgaccccgccgccctgctgcccggcgccagccccaagagccccggcctgaaggccatggtgagccccttccacagcccccccagcacccccagcagccccggcgtgagaagcagacccagcgaggccgaggaggtgcccgtgagcttcgaccagccccccgagggcagccacctgccctgctacaacaaggtgagaaccagaggcagcatcaagagaagaccccccagcagaagattcagaagaagccagagcgactgcggcgagctgggcgacttcagagccgtggagagcagccagcagaacggcgccaaggaggaggacggcgacgaggtgctgcccagcaagagcaaggcccccggcagccccctgagcagcgagggcgccgccggcgagggcgtgagaaccctgggccccgccgagaagccccccctgagaagaagccccagcagaaccgagaagcaggaggaggacagagccaccgaggaggccaagaacggcgagaaggccagaagaagcagcgaggaggtggacggccagcaccccgcccaggaggaggtgcccgagagcccccagaccagcggccccgaggccgagaacagatgcggcagccccagagaggagaagcccgccggcgaggaggccgagatggagaaggccaccgaggtgaagggcgagagagtgcagaacgaggaggtgggccccgagcacgacagccaggagaccaagaagctggaggagggcgccgccgtgaaggagaccccccacagcccccccggcggcgtgaagggcggcgacgtgcccaagcaggagaagggcaaggagaagcagcaggagggcgccgtgctggagcccggctgcagcccccagaccggccccgcccagctggagaccagcagcgaggtgcagagcgagcccgccgtgcccaagcccgaggacgacacccccgtgcaggacaccaagatgtag

SEQ ID NO: 24288 - DNA, 1161 bp, Artificial Sequence
  Description of Artificial Sequence: Synthetic coding sequence
atggaggagagacccgccgagaccaacgccaacgtggacaacagcgccagccccagcgtggcccagctggccggcagattcagagagcaggccgccgccgccaaggagaagagcccccccaacgccagccacccccccaagttcaaggtgaagagcagccccctgatcgagaagctgcaggccaacctgaccttcgaccccgccgccctgctgcccggcgccagccccaagagccccggcctgaaggccatggtgagccccttccacagcccccccagcacccccagcagccccggcgtgagaagcagacccagcgaggccgaggaggtgcccgtgagcttcgaccagccccccgagggcagccacctgccctgctacaacaaggtgagaaccagaggcagcatcaagagaagaccccccagcagaagattcagaagaagccagagcgactgcggcgagctgggcgacttcagagccgtggagagcagccagcagaacggcgccaaggaggaggacggcgacgaggtgctgcccagcaagagcaaggcccccggcagccccctgagcagcgagggcgccgccggcgagggcgtgagaaccctgggccccgccgagaagccccccctgagaagaagccccagcagaaccgagaagcaggaggaggacagagccaccgaggaggccaagaacggcgagaaggccagaagaagcagcgaggaggtggacggccagcaccccgcccaggaggaggtgcccgagagcccccagaccagcggccccgaggccgagaacagatgcggcagccccagagaggagaagcccgccggcgaggaggccgagatggagaaggccaccgaggtgaagggcgagagagtgcagaacgaggaggtgggccccgagcacgacagccaggagaccaagaagctggaggagggcgccgccgtgaaggagaccccccacagcccccccggcggcgtgaagggcggcgacgtgcccaagcaggagaagggcaaggagaagcagcaggagggcgccgtgctggagcccggctgcagcccccagaccggccccgcccagctggagaccagcagcgaggtgcagagcgagcccgccgtgcccaagcccgaggacgacacccccgtgcaggacaccaagatgtag

SEQ ID NO: 24289 - DNA, 561 bp, Artificial Sequence
  Description of Artificial Sequence: Synthetic coding sequence
atggagcccaccagagactgccccctgttcggcggcgccttcagcgccatcctgcccatgggcgccatcgacgtgagcgacctgagacccgtgcccgacaaccaggaggtgttctgccaccccgtgaccgaccagagcctgatcgtggagctgctggagctgcaggcccacgtgagaggcgaggccgccgccagataccacttcgaggacgtgggcggcgtgcagggcgccagagccgtgcacgtggagagcgtgcagcccctgagcctggagaacctggccctgagaggcagatgccaggaggcctgggtgctgagcggcaagcagcagatcgccaaggagaaccagcaggtggccaaggacgtgaccctgcaccaggccctgctgagactgccccagtaccagaccgacctgctgctgaccttcaaccagcccccccccgacaacagaagcagcctgggccccgagaacctgagccccgccccctggagcctgggcgacttcgagcagctggtgaccagcctgaccctgcacgaccccaacatcttcggcccccagtag

SEQ ID NO: 24290 - DNA, 870 bp, Artificial Sequence
  Description of Artificial Sequence: Synthetic coding sequence
atgagcgccttcagcgaggccgccctggagaagaagctgagcgagctgagcaacagccagcagagcgtgcagaccctgagcctgtggctgatccaccacagaaagcacagcagacccatcgtgaccgtgtgggagagagagctgagaaaggccaagcccaacagaaagctgaccttcctgtacctggccaacgacgtgatccagaacagcaagagaaagggccccgagttcaccaaggacttcgcccccgtgatcgtggaggccttcaagcacgtgagcagcgagaccgacgagagctgcaagaagcacctgggcagagtgctgagcatctgggaggagagaagcgtgtacgagaacgacgtgctggagcagctgaagcaggccctgtacggcgacaagaagcccagaaagagaacctacgagcagatcaaggtggacgagaacgagaactgcagcagcctgggcagccccagcgagcccccccagaccctggacctggtgagagccctgcaggacctggagaacgccgccagcggcgacgccgccgtgcaccagagaatcgccagcctgcccgtggaggtgcaggaggtgagcctgctggacaagatcaccgacaaggagagcggcgagagactgagcaagatggtggaggacgcctgcatgctgctggccgactacaacggcagactggccgccgagatcgacgacagaaagcagctgaccagaatgctggccgacttcctgagatgccagaaggaggccctggccgagaaggagcacaagctggagatcctggacatgggcgtgagcagcaacgacgtggtgaccatcagcatcttcttcctgctgaagatcaacatcaagccctag

SEQ ID NO: 24291 - DNA, 831 bp, Artificial Sequence
  Description of Artificial Sequence: Synthetic coding sequence
atgagaaacagcaactggagattctgccagaccggcatctacagcaagcccaacagaaagctgaccttcctgtacctggccaacgacgtgatccagaacagcaagagaaagggccccgagttcaccaaggacttcgcccccgtgatcgtggaggccttcaagcacgtgagcagcgagaccgacgagagctgcaagaagcacctgggcagagtgctgagcatctgggaggagagaagcgtgtacgagaacgacgtgctggagcagctgaagcaggccctgtacggcgacaagaagcccagaaagagaacctacgagcagatcaaggtggacgagaacgagaactgcagcagcctgggcagccccagcgagcccccccagaccctggacctggtgagagccctgcaggacctggagaacgccgccagcggcgacgccgccgtgcaccagagaatcgccagcctgcccgtggaggtgcaggaggtgagcctgctggacaagatcaccgacaaggagagcggcgagagactgagcaagatggtggaggacgcctgcatgctgctggccgactacaacggcagactggccgccgagatcgacgacagaaagcagctgaccagaatgctggccgacttcctgagatgccagaaggaggccctggccgagaaggagcacaagctggaggagtacaagagaaagctggccagagtgagcctggtgagaaaggagctgagaagcagaatccagagcctgcccgacctgagcagactgcccaacgtgaccggcagccacatgcacctgcccttcgccggcgacatctacagcgaggactag

SEQ ID NO: 24292 - DNA, 939 bp, Artificial Sequence
  Description of Artificial Sequence: Synthetic coding sequence
atgagcgccttcagcgaggccgccctggagaagaagctgagcgagctgagcaacagccagcagagcgtgcagaccctgagcctgtggctgatccaccacagaaagcacagcagacccatcgtgaccgtgtgggagagagagctgagaaaggccaagcccaacagaaagctgaccttcctgtacctggccaacgacgtgatccagaacagcaagagaaagggccccgagttcaccaaggacttcgcccccgtgatcgtggaggccttcaagcacgtgagcagcgagaccgacgagagctgcaagaagcacctgggcagagtgctgagcatctgggaggagagaagcgtgtacgagaacgacgtgctggagcagctgaagcaggccctgtacggcgacaagaagcccagaaagagaacctacgagcagatcaaggtggacgagaacgagaactgcagcagcctgggcagccccagcgagcccccccagaccctggacctggtgagagccctgcaggacctggagaacgccgccagcggcgacgccgccgtgcaccagagaatcgccagcctgcccgtggaggtgcaggaggtgagcctgctggacaagatcaccgacaaggagagcggcgagagactgagcaagatggtggaggacgcctgcatgctgctggccgactacaacggcagactggccgccgagatcgacgacagaaagcagctgaccagaatgctggccgacttcctgagatgccagaaggaggccctggccgagaaggagcacaagctggaggagtacaagagaaagctggccagagtgagcctggtgagaaaggagctgagaagcagaatccagagcctgcccgacctgagcagactgcccaacgtgaccggcagccacatgcacctgcccttcgccggcgacatctacagcgaggactag

SEQ ID NO: 24293 - DNA, 939 bp, Artificial Sequence; identical to SEQ ID NO: 24292
  Description of Artificial Sequence: Synthetic coding sequence

SEQ ID NO: 24294 - DNA, 981 bp, Artificial Sequence
  Description of Artificial Sequence: Synthetic coding sequence
atgagcagcttcagcgagagcgccctggagaagaagctgagcgagctgagcaacagccagcagagcgtgcagaccctgagcctgtggctgatccaccacagaaagcacgccggccccatcgtgagcgtgtggcacagagagctgagaaaggccaagagcaacagaaagctgaccttcctgtacctggccaacgacgtgatccagaacagcaagagaaagggccccgagttcaccagagagttcgagagcgtgctggtggacgccttcagccacgtggccagagaggccgacgagggctgcaagaagcccctggagagactgctgaacatctggcaggagagaagcgtgtacggcggcgagttcatccagcagctgaagctgagcatggaggacagcaagagccccccccccaaggccaccgaggagaagaagagcctgaagagaaccttccagcagatccaggaggaggaggacgacgactaccccggcagctacagcccccaggaccccagcgccggccccctgctgaccgaggagctgatcaaggccctgcaggacctggagaacgccgccagcggcgacgccaccgtgagacagaagatcgccagcctgccccaggaggtgcaggacgtgagcctgctggagaagatcaccgacaaggaggccgccgagagactgagcaagaccgtggacgaggcctgcctgctgctggccgagtacaacggcagactggccgccgagctggaggacagaagacagctggccagaatgctggtggagtacacccagaaccagaaggacgtgctgagcgagaaggagaagaagctggaggagtacaagcagaagctggccagagtgacccaggtgagaaaggagctgaagagccacatccagagcctgcccgacctgagcctgctgcccaacgtgaccggcggcctggcccccctgcccagcgccggcgacctgttcagcaccgactag

SEQ ID NO: 24295 - DNA, 459 bp, Artificial Sequence
  Description of Artificial Sequence: Synthetic coding sequence
atggccgccggcggcggcggcggcagcagcaaggccagcagcagcagcgccagcagcgccggcgccctggagagcagcctggacagaaagttccagagcgtgaccaacaccatggagagcatccagggcctgagcagctggtgcatcgagaacaagaagcaccacagcaccatcgtgtaccactggatgaagtggctgagaagaagcgcctacccccacagactgaacctgttctacctggccaacgacgtgatccagaactgcaagagaaagaacgccatcatcttcagagagagcttcgccgacgtgctgcccgaggccgccgccctggtgaaggaccccagcgtgagcaagagcgtggagagaatcttcaagatctgggaggacagaaacgtgtaccccgaggagatgatcgtggccctgagagaggccctgagcaagtgcctgttcctgagctag

SEQ ID NO: 24296 - DNA, 4386 bp, Artificial Sequence
  Description of Artificial Sequence: Synthetic coding sequence
atggccgccggcggcggcggcggcagcagcaaggccagcagcagcagcgccagcagcgccggcgccctggagagcagcctggacagaaagttccagagcgtgaccaacaccatggagagcatccagggcctgagcagctggtgcatcgagaacaagaagcaccacagcaccatcgtgtaccactggatgaagtggctgagaagaagcgcctacccccacagactgaacctgttctacctggccaacgacgtgatccagaactgcaagagaaagaacgccatcatcttcagagagagcttcgccgacgtgctgcccgaggccgccgccctggtgaaggaccccagcgtgagcaagagcgtggagagaatcttcaagatctgggaggacagaaacgtgtaccccgaggagatgatcgtggccctgagagaggccctgagcaccaccttcaagacccagaagcagctgaaggagaacctgaacaagcagcccaacaagcagtggaagaagagccagaccagcaccaaccccaaggccgccctgaagagcaagatcgtggccgagttcagaagccaggccctgatcgaggagctgctgctgtacaagagaagcgaggaccagatcgagctgaaggagaagcagctgagcaccatgagagtggacgtgtgcagcaccgagaccctgaagtgcctgaaggacaagaccggcggcaagaagttcagcaaggagttcgaggaggccagcagcaagctggaggagttcgtgaacggcctggacaagcaggtgaagaacggccccagcctgaccgaggccctggagaacgccggcatcttctacgaggcccagtacaaggaggtgaaggtggtggccaacgcctacaagaccttcgccaacagagtgaacaacctgaagaagaagctggaccagctgaagagcaccctgcccgaccccgaggagagccccgtgcccagccccagcatggacgcccccagccccaccggcagcgagagccccttccagggcatgggcggcgaggagagccagagccccaccatggagagcgagaagagcgccacccccgagcccgtgaccgacaacagagacgtggaggacatggagctgagcgacgtggaggacgacggcagcaagatcatcgtggaggacagaaaggagaagcccgccgagaagagcgccgtgagcaccagcgtgcccaccaagcccaccgagaacatcagcaaggccagcagctgcacccccgtgcccgtgaccatgaccgccaccccccccctgcccaagcccgtgaacaccagcctgagccccagccccgccctggccctgcccaacctggccaacgtggacctggccaagatcagcagcatcctgagcagcctgaccagcgtgatgaagaacaccggcgtgagccccgccagcagacccagccccggcacccccaccagccccagcaacctgaccagcggcctgaagacccccgcccccgccaccaccaccagccacaaccccctggccaacatcctgagcaaggtggagatcacccccgagagcatcctgagcgccctgagcaagacccagacccagagcgcccccgccctgcagggcctgagcagcctgctgcagagcgtgaccggcaaccccgtgcccgccagcgaggccgccagccagagcaccagcgccagccccgccaacaccaccgtgagcaccatcaagggcagaaacctgcccagcagcgcccagcccttcatccccaagagcttcaactacagccccaacagcagcaccagcgaggtgagcagcaccagcgccagcaaggccagcatcggccagagccccggcctgcccagcaccaccttcaagctgcccagcaacagcctgggcttcaccgccacccacaacaccagccccgccgccccccccaccgaggtgaccatctgccagagcagcgaggtgagcaagcccaagctggagagcgagagcaccagccccagcctggagatgaagatccacaacttcctgaagggcaaccccggcttcagcggcctgaacctgaacatccccatcctgagcagcctgggcagcagcgcccccagcgagagccaccccagcgacttccagagaggccccaccagcaccagcatcgacaacatcgacggcacccccgtgagagacgagagaagcggcacccccacccaggacgagatgatggacaagcccaccagcagcagcgtggacaccatgagcctgctgagcaagatcatcagccccggcagcagcacccccagcagcaccagaagccccccccccggcagagacgagagctaccccagagagctgagcaacagcgtgagcacctacagacccttcggcctgggcagcgagagcccctacaagcagcccagcgacggcatggagagacccagcagcctgatggacagcagccaggagaagttctaccccgacaccagcttccaggaggacgaggactacagagacttcgagtacagcggccccccccccagcgccatgatgaacctggagaagaagcccgccaagagcatcctgaagagcagcaagctgagcgacaccaccgagtaccagcccatcctgagcagctacagccacagagcccaggagttcggcgtgaagagcgccttcccccccagcgtgagagccctgctggacagcagcgagaactgcgacagactgagcagcagccccggcctgttcggcgccttcagcgtgagaggcaacgagcccggcagcgacagaagccccagccccagcaagaacgacagcttcttcacccccgacagcaaccacaacagcctgagccagagcaccaccggccacctgagcctgccccagaagcagtaccccgacagcccccaccccgtgccccacagaagcctgttcagcccccagaacaccctggccgcccccaccggccacccccccaccagcggcgtggagaaggtgctggccagcaccatcagcaccaccagcaccatcgagttcaagaacatgctgaagaacgccagcagaaagcccagcgacgacaagcacttcggccaggcccccagcaagggcacccccagcgacggcgtgagcctgagcaacctgacccagcccagcctgaccgccaccgaccagcagcagcaggaggagcactacagaatcgagaccagagtgagcagcagctgcctggacctgcccgacagcaccgaggagaagggcgcccccatcgagaccctgggctaccacagcgccagcaacagaagaatgagcggcgagcccatccagaccgtggagagcatcagagtgcccggcaagggcaacagaggccacggcagagaggccagcagagtgggctggttcgacctgagcaccagcggcagcagcttcgacaacggccccagcagcgccagcgagctggccagcctgggcggcggcggcagcggcggcctgaccggcttcaagaccgccccctacaaggagagagccccccagttccaggagagcgtgggcagcttcagaagcaacagcttcaacagcaccttcgagcaccacctgccccccagccccctggagcacggcacccccttccagagagagcccgtgggccccagcagcgccccccccgtgccccccaaggaccacggcggcatcttcagcagagacgcccccacccacctgcccagcgtggacctgagcaaccccttcaccaaggaggccgccctggcccacgccgcccccccccccccccccggcgagcacagcggcatccccttccccacccccccccccccccccccccccggcgagcacagcagcagcggcggcagcggcgtgcccttcagcacccccccccccccccccccccccgtggaccacagcggcgtggtgcccttccccgccccccccctggccgagcacggcgtggccggcgccgtggccgtgttccccaaggaccacagcagcctgctgcagggcaccctggccgagcacttcggcgtgctgcccggccccagagaccacggcggccccacccagagagacctgaacggccccggcctgagcagagtgagagagagcctgaccctgcccagccacagcctggagcacctgggccccccccacggcggcggcggcggcggcggcagcaacagcagcagcggcccccccctgggccccagccacagagacaccatcagcagaagcggcatcatcctgagaagccccagacccgacttcagacccagagagcccttcctgagcagagaccccttccacagcctgaagagacccagaccccccttcgccagaggcccccccttcttcgcccccaagagacccttcttcccccccagatactag

SEQ ID NO: 24297 - DNA, 4308 bp, Artificial Sequence
  Description of Artificial Sequence: Synthetic coding sequence
atggccgccggcggcggcggcggcagcagcaaggccagcagcagcagcgccagcagcgccggcgccctggagagcagcctggacagaaagttccagagcgtgaccaacaccatggagagcatccagggcctgagcagctggtgcatcgagaacaagaagcaccacagcaccatcgtgtaccactggatgaagtggctgagaagaagcgcctacccccacagactgaacctgttctacctggccaacgacgtgatccagaactgcaagagaaagaacgccatcatcttcagagagagcttcgccgacgtgctgcccgaggccgccgccctggtgaaggaccccagcgtgagcaagagcgtggagagaatcttcaagatctgggaggacagaaacgtgtaccccgaggagatgatcgtggccctgagagaggccctgaccagcaccaaccccaaggccgccctgaagagcaagatcgtggccgagttcagaagccaggccctgatcgaggagctgctgctgtacaagagaagcgaggaccagatcgagctgaaggagaagcagctgagcaccatgagagtggacgtgtgcagcaccgagaccctgaagtgcctgaaggacaagaccggcggcaagaagttcagcaaggagttcgaggaggccagcagcaagctggaggagttcgtgaacggcctggacaagcaggtgaagaacggccccagcctgaccgaggccctggagaacgccggcatcttctacgaggcccagtacaaggaggtgaaggtggtggccaacgcctacaagaccttcgccaacagagtgaacaacctgaagaagaagctggaccagctgaagagcaccctgcccgaccccgaggagagccccgtgcccagccccagcatggacgcccccagccccaccggcagcgagagccccttccagggcatgggcggcgaggagagccagagccccaccatggagagcgagaagagcgccacccccgagcccgtgaccgacaacagagacgtggaggacatggagctgagcgacgtggaggacgacggcagcaagatcatcgtggaggacagaaaggagaagcccgccgagaagagcgccgtgagcaccagcgtgcccaccaagcccaccgagaacatcagcaaggccagcagctgcacccccgtgcccgtgaccatgaccgccaccccccccctgcccaagcccgtgaacaccagcctgagccccagccccgccctggccctgcccaacctggccaacgtggacctggccaagatcagcagcatcctgagcagcctgaccagcgtgatgaagaacaccggcgtgagccccgccagcagacccagccccggcacccccaccagccccagcaacctgaccagcggcctgaagacccccgcccccgccaccaccaccagccacaaccccctggccaacatcctgagcaaggtggagatcacccccgagagcatcctgagcgccctgagcaagacccagacccagagcgcccccgccctgcagggcctgagcagcctgctgcagagcgtgaccggcaaccccgtgcccgccagcgaggccgccagccagagcaccagcgccagccccgccaacaccaccgtgagcaccatcaagggcagaaacctgcccagcagcgcccagcccttcatccccaagagcttcaactacagccccaacagcagcaccagcgaggtgagcagcaccagcgccagcaaggccagcatcggccagagccccggcctgcccagcaccaccttcaagctgcccagcaacagcctgggcttcaccgccacccacaacaccagccccgccgccccccccaccgaggtgaccatctgccagagcagcgaggtgagcaagcccaagctggagagcgagagcaccagccccagcctggagatgaagatccacaacttcctgaagggcaaccccggcttcagcggcctgaacctgaacatccccatcctgagcagcctgggcagcagcgcccccagcgagagccaccccagcgacttccagagaggccccaccagcaccagcatcgacaacatcgacggcacccccgtgagagacgagagaagcggcacccccacccaggacgagatgatggacaagcccaccagcagcagcgtggacaccatgagcctgctgagcaagatcatcagccccggcagcagcacccccagcagcaccagaagccccccccccggcagagacgagagctaccccagagagctgagcaacagcgtgagcacctacagacccttcggcctgggcagcgagagcccctacaagcagcccagcgacggcatggagagacccagcagcctgatggacagcagccaggagaagttctaccccgacaccagcttccaggaggacgaggactacagagacttcgagtacagcggccccccccccagcgccatgatgaacctggagaagaagcccgccaagagcatcctgaagagcagcaagctgagcgacaccaccgagtaccagcccatcctgagcagctacagccacagagcccaggagttcggcgtgaagagcgccttcccccccagcgtgagagccctgctggacagcagcgagaactgcgacagactgagcagcagccccggcctgttcggcgccttcagcgtgagaggcaacgagcccggcagcgacagaagccccagccccagcaagaacgacagcttcttcacccccgacagcaaccacaacagcctgagccagagcaccaccggccacctgagcctgccccagaagcagtaccccgacagcccccaccccgtgccccacagaagcctgttcagcccccagaacaccctggccgcccccaccggccacccccccaccagcggcgtggagaaggtgctggccagcaccatcagcaccaccagcaccatcgagttcaagaacatgctgaagaacgccagcagaaagcccagcgacgacaagcacttcggccaggcccccagcaagggcacccccagcgacggcgtgagcctgagcaacctgacccagcccagcctgaccgccaccgaccagcagcagcaggaggagcactacagaatcgagaccagagtgagcagcagctgcctggacctgcccgacagcaccgaggagaagggcgcccccatcgagaccctgggctaccacagcgccagcaacagaagaatgagcggcgagcccatccagaccgtggagagcatcagagtgcccggcaagggcaacagaggccacggcagagaggccagcagagtgggctggttcgacctgagcaccagcggcagcagcttcgacaacggccccagcagcgccagcgagctggccagcctgggcggcggcggcagcggcggcctgaccggcttcaagaccgccccctacaaggagagagccccccagttccaggagagcgtgggcagcttcagaagcaacagcttcaacagcaccttcgagcaccacctgccccccagccccctggagcacggcacccccttccagagagagcccgtgggccccagcagcgccccccccgtgccccccaaggaccacggcggcatcttcagcagagacgcccccacccacctgcccagcgtggacctgagcaaccccttcaccaaggaggccgccctggcccacgccgcccccccccccccccccggcgagcacagcggcatccccttccccacccccccccccccccccccccccggcgagcacagcagcagcggcggcagcggcgtgcccttcagcacccccccccccccccccccccccgtggaccacagcggcgtggtgcccttccccgccccccccctggccgagcacggcgtggccggcgccgtggccgtgttccccaaggaccacagcagcctgctgcagggcaccctggccgagcacttcggcgtgctgcccggccccagagaccacggcggccccacccagagagacctgaacggccccggcctgagcagagtgagagagagcctgaccctgcccagccacagcctggagcacctgggccccccccacggcggcggcggcggcggcggcagcaacagcagcagcggcccccccctgggccccagccacagagacaccatcagcagaagcggcatcatcctgagaagccccagacccgacttcagacccagagagcccttcctgagcagagaccccttccacagcctgaagagacccagaccccccttcgccagaggcccccccttcttcgcccccaagagacccttcttcccccccagatactag

SEQ ID NO: 24298 - DNA, 2805 bp, Artificial Sequence
  Description of Artificial Sequence: Synthetic coding sequence
atggccgccggcggcggcggcggcagcagcaaggccagcagcagcagcgccagcagcgccggcgccctggagagcagcctggacagaaagttccagagcgtgaccaacaccatggagagcatccagggcctgagcagctggtgcatcgagaacaagaagcaccacagcaccatcgtgtaccactggatgaagtggctgagaagaagcgcctacccccacagactgaacctgttctacctggccaacgacgtgatccagaactgcaagagaaagaacgccatcatcttcagagagagcttcgccgacgtgctgcccgaggccgccgccctggtgaaggaccccagcgtgagcaagagcgtggagagaatcttcaagatctgggaggacagaaacgtgtaccccgaggagatgatcgtggccctgagagaggccctgaccagcaccaaccccaaggccgccctgaagagcaagatcgtggccgagttcagaagccaggccctgatcgaggagctgctgctgtacaagagaagcgaggaccagatcgagctgaaggagaagcagctgagcaccatgagagtggacgtgtgcagcaccgagaccctgaagtgcctgaaggacaagaccggcggcaagaagttcagcaaggagttcgaggaggccagcagcaagctggaggagttcgtgaacggcctggacaagcaggtgaagaacggccccagcctgaccgaggccctggagaacgccggcatcttctacgaggcccagtacaaggaggtgaaggtggtggccaacgcctacaagaccttcgccaacagagtgaacaacctgaagaagaagctggaccagctgaagagcaccctgcccgaccccgaggagagccccgtgcccagccccagcatggacgcccccagccccaccggcagcgagagccccttccagggcatgggcggcgaggagagccagagccccaccatggagagcgagaagagcgccacccccgagcccgtgaccgacaacagagacgtggaggacatggagctgagcgacgtggaggacgacggcagcaagatcatcgtggaggacagaaaggagaagcccgccgagaagagcgccgtgagcaccagcgtgcccaccaagcccaccgagaacatcagcaaggccagcagctgcacccccgtgcccgtgaccatgaccgccaccccccccctgcccaagcccgtgaacaccagcctgagccccagccccgccctggccctgcccaacctggccaacgtggacctggccaagatcagcagcatcctgagcagcctgaccagcgtgatgaagaacaccggcgtgagccccgccagcagacccagccccggcacccccaccagccccagcaacctgaccagcggcctgaagacccccgcccccgccaccaccaccagccacaaccccctggccaacatcctgagcaaggtggagatcacccccgagagcatcctgagcgccctgagcaagacccagacccagagcgcccccgccctgcagggcctgagcagcctgctgcagagcgtgaccggcaaccccgtgcccgccagcgaggccgccagccagagcaccagcgccagccccgccaacaccaccgtgagcaccatcaagggcagaaacctgcccagcagcgcccagcccttcatccccaagagcttcaactacagccccaacagcagcaccagcgaggtgagcagcaccagcgccagcaaggccagcatcggccagagccccggcctgcccagcaccaccttcaagctgcccagcaacagcctgggcttcaccgccacccacaacaccagccccgccgccccccccaccgaggtgaccatctgccagagcagcgaggtgagcaagcccaagctggagagcgagagcaccagccccagcctggagatgaagatccacaacttcctgaagggcaaccccggcttcagcggcctgaacctgaacatccccatcctgagcagcctgggcagcagcgcccccagcgagagccaccccagcgacttccagagaggccccaccagcaccagcatcgacaacatcgacggcacccccgtgagagacgagagaagcggcacccccacccaggacgagatgatggacaagcccaccagcagcagcgtggacaccatgagcctgctgagcaagatcatcagccccggcagcagcacccccagcagcaccagaagccccccccccggcagagacgagagctaccccagagagctgagcaacagcgtgagcacctacagacccttcggcctgggcagcgagagcccctacaagcagcccagcgacggcatggagagacccagcagcctgatggacagcagccaggagaagttctaccccgacaccagcttccaggaggacgaggactacagagacttcgagtacagcggccccccccccagcgccatgatgaacctggagaagaagcccgccaagagcatcctgaagagcagcaagctgagcgacaccaccgagtaccagcccatcctgagcagctacagccacagagcccaggagttcggcgtgaagagcgccttcccccccagcgtgagagccctgctggacagcagcgagaactgcgacagactgagcagcagccccggcctgttcggcgccttcagcgtgagaggcaacgagcccggcagcgacagaagccccagccccaagcacccctgcagaagccacggcagccccacccacgtgagaagaggcgagagccccggcctgcaccacttccaccacgtggacgactag

SEQ ID NO: 24299 - DNA, 3231 bp, Artificial Sequence
  Description of Artificial Sequence: Synthetic coding sequence
atgagcagcgccgagatcatcggcagcaccaacctgatcatcctgctggaggacgaggtgttcgccgacttcttcaacaccttcctgagcctgcccgtgttcggccagacccccttctacaccgtggagaacagccagtggagcctgtggcccgagatcccctgcaacctgatcgccaagtacaagggcctgctgacctggctggagaagtgcagactgcccttcttctgcaagaccaacctgtgcttccactacatcctgtgccaggagttcatcagcttcatcaagagccccgagggcggcgaggagctggtggacttctggatcctggccgagaacatcctgagcatcgacgagatggacctggaggtgagagactactacctgagcctgctgctgatgctgagagccacccacctgcaggagggcagcagagtggtgaccctgtgcaacatgaacatcaagagcctgctgaacctgagcatctggcaccccaaccagagcaccaccagaagagagatcctgagccacatgcagaaggtggccctgttcaagctgcagagctactggctgcccaacttctacacccacaccaagatgaccatggccaaggaggaggcctgccacggcctgatgcaggagtacgagaccagactgtacagcgtgtgctacacccacatcggcggcctgcccctgaacatgagcatcaagaagtgccaccacttccagaagagatacagcagcagaaaggccaagagaaagatgtggcagctggtggaccccgacagctggagcctggagatggacctgaagcccgacgccatcggcatgcccctgcaggagacctgcccccaggagaaggtggtgatccagatgcccagcctgaagatggccagcagcaaggagaccagaatcagcagcctggagaaggacatgcactacgccaagatcagcagcatggagaacaaggccaagagccacctgcacatggaggcccccttcgagaccaaggtgagcacccacctgagaaccgtgatccccatcgtgaaccacagcagcaagatgaccatccagaaggccatcaagcagagcttcagcctgggctacatccacctggccctgtgcgccgacgcctgcgccggcaaccccttcagagaccacctgaagaagctgaacctgaaggtggagatccagctgctggacctgtggcaggacctgcagcacttcctgagcgtgctgctgaacaacaagaagaacggcaacgccatcttcagacacctgctgggcgacagaatctgcgagctgtacctgaacgagcagatcggcccctgcctgcccctgaagagccagaccatccagggcctgaaggagctgctgcccagcggcgacgtgatcccctggatccccaaggcccagaaggagatctgcaagatgctgagcccctggtacgacgagttcctggacgaggaggactactggttcctgctgttcaccacccagaacagattcatcagcagcagacagcacaagagagagttcatcggcaaggaggagaacatcctgctgtacaagagaatccagcagagcctggagctgagccaggccctggccgacatgaaggagatggactacagacagtggagaaagatcgccaccgaggacctgaagcagggcggcagcctgcaggtggagctgaccagccccgtgttcctgaccgacatcaccaagatgagcttcgaggagctgtgctacaagaaccccaagatggccatccagaagatcagcgacgactacaagatctactgcgagaaggcccccaagatcgacttcaagatggagatcatcaaggagaccaagaccgtgagcagaagcaacagaaagatgagcctgctgaagagaaccctggtgagaaagcccagcatgagacccagaaacctgaccgaggtgctgctgaacacccagcacctggagttcttcagagagttcctgaaggagagaaaggccaagatccccctgcagttcctgaccgccgtgcagaagatcagcatcgagaccaacgagaagatctgcaagagcctgatcgagaacgtgatcaagaccttcttccagggccagctgagccccgaggagatgctgcagtgcgacgcccccatcatcaaggagatcgccagcatgagacacgtgaccaccagcaccctgctgaccctgcagggccacgtgatgaagagcatcgaggagaagtggttcaaggactaccaggacctgttccccccccaccaccaggaggtggaggtgcagagcgaggtgcagatcagcagcagaaagcccagcaagatcgtgagcacctacctgcaggagagccagaagaagggctggatgagaatgatcagcttcatcagaagcttctgcaagtacagaagattcatgctgaaccccagcaagagacaggagttcgaggactacctgcaccaggagatgcagaacagcaaggagaacttcaccaccgcccacaacaccagcggcagaagcgccccccccagcaccaacgtgagaagcgccgaccaggagaacggcgagatcaccctggtgaagagaagaatcttcggccacagaatcatcaccgtgaacttcgccatcaacgacctgtacttcttcagcgagatggagaagttcaacgacctggtgagcagcgcccacatgctgcaggtgaacagagcctacaacgagaacgacgtgatcctgatgagaagcaagatgaacatcatccagaagctgttcctgaacagcgacatcccccccaagctgagagtgaacgtgcccgagttccagaaggacgccatcctggccgccatcaccgagggctacctggacagaagcgtgttccacggcgccatcatgagcgtgttccccgtggtgatgtacttctggaagagattctgcttctggaaggccaccagaagctacctgcagtacagaggcaagaagttcaaggacagaaagagcccccccaagagcaccgacaagtaccccttcagcagcggcggcgacaacgccatcctgagattcaccctgctgagaggcatcgagtggctgcagccccagagagaggccatcagcagcgtgcagaacagcagcagcagcaagctgacccagcccagactggtggtgagcgccatgcagctgcaccccgtgcagggccagaagctgagctacatcaagaaggagaagtag

SEQ ID NO: 24300 - DNA, 309 bp, Artificial Sequence
  Description of Artificial Sequence: Synthetic coding sequence
atgctgagcgtgagaagagtgagcgaggacatctgcagcagaatctacgagagcgcccagagaatcgacagcatcaccttcctgcccagcagcggcttccacctgaagtggaagatccagaccagaatcgccaacgagaagtacctgagaacccacaaggaggtggagtggctgatcagcggcttcttcagagagatcttcctgaagagacccgacaacatcctggagttcgccgccgactacttcaccgaccccagactgcccaacaagatccacatgcagctgatcaaggacaagaaggccgcctag

SEQ ID NO: 24301 - DNA, 1176 bp, Artificial Sequence
  Description of Artificial Sequence: Synthetic coding sequence
atggaccagtgcgtgaccgtggagagagagctggagaaggtgctgcacaagttcagcggctacggccagctgtgcgagagaggcctggaggagctgatcgactacaccggcggcctgaagcacgagatcctgcagagccacggccaggacgccgagctgagcggcaccctgagcctggtgctgacccagtgctgcaagagaatcaaggacaccgtgcagaagctggccagcgaccacaaggacatccacagcagcgtgagcagagtgggcaaggccatcgacaagaacttcgacagcgacatcagcagcgtgggcatcgacggctgctggcaggccgacagccagagactgctgaacgaggtgatggtggagcacttcttcagacagggcatgctggacgtggccgaggagctgtgccaggagagcggcctgagcgtggaccccagccagaaggagcccttcgtggagctgaacagaatcctggaggccctgaaggtgagagtgctgagacccgccctggagtgggccgtgagcaacagagagatgctgatcgcccagaacagcagcctggagttcaagctgcacagactgtacttcatcagcctgctgatgggcggcaccaccaaccagagagaggccctgcagtacgccaagaacttccagcccttcgccctgaaccaccagaaggacatccaggtgctgatgggcagcctggtgtacctgagacagggcatcgagaacagcccctacgtgcacctgctggacgccaaccagtgggccgacatctgcgacatcttcaccagagacgcctgcgccctgctgggcctgagcgtggagagccccctgagcgtgagcttcagcgccggctgcgtggccctgcccgccctgatcaacatcaaggccgtgatcgagcagagacagtgcaccggcgtgtggaaccagaaggacgagctgcccatcgaggtggacctgggcaagaagtgctggtaccacagcatcttcgcctgccccatcctgagacagcagaccaccgacaacaacccccccatgaagctggtgtgcggccacatcatcagcagagacgccctgaacaagatgttcaacggcagcaagctgaagtgcccctactgccccatggagcagagccccggcgacgccaagcagatcttcttctag

SEQ ID NO: 24302 - DNA, 1182 bp, Artificial Sequence
  Description of Artificial Sequence: Synthetic coding sequence
atggagcagtgcgcctgcgtggagagagagctggacaaggtgctgcagaagttcctgacctacggccagcactgcgagagaagcctggaggagctgctgcactacgtgggccagctgagagccgagctggccagcgccgccctgcagggcacccccctgagcgccaccctgagcctggtgatgagccagtgctgcagaaagatcaaggacaccgtgcagaagctggccagcgaccacaaggacatccacagcagcgtgagcagagtgggcaaggccatcgacagaaacttcgacagcgagatctgcggcgtggtgagcgacgccgtgtgggacgccagagagcagcagcagcagatcctgcagatggccatcgtggagcacctgtaccagcagggcatgctgagcgtggccgaggagctgtgccaggagagcaccctgaacgtggacctggacttcaagcagcccttcctggagctgaacagaatcctggaggccctgcacgagcaggacctgggccccgccctggagtgggccgtgagccacagacagagactgctggagctgaacagcagcctggagttcaagctgcacagactgcacttcatcagactgctggccggcggccccgccaagcagctggaggccctgagctacgccagacacttccagcccttcgccagactgcaccagagagagatccaggtgatgatgggcagcctggtgtacctgagactgggcctggagaagagcccctactgccacctgctggacagcagccactgggccgagatctgcgagaccttcaccagagacgcctgcagcctgctgggcctgagcgtggagagccccctgagcgtgagcttcgccagcggctgcgtggccctgcccgtgctgatgaacatcaaggccgtgatcgagcagagacagtgcaccggcgtgtggaaccacaaggacgagctgcccatcgagatcgagctgggcatgaagtgctggtaccacagcgtgttcgcctgccccatcctgagacagcagaccagcgacagcaacccccccatcaagctgatctgcggccacgtgatcagcagagacgccctgaacaagctgatcaacggcggcaagctgaagtgcccctactgccccatggagcagaaccccgccgacggcaagagaatcatcttctag

SEQ ID NO: 24303 - DNA, 345 bp, Artificial Sequence
  Description of Artificial Sequence: Synthetic coding sequence
atggagcagtgcgcctgcgtggagagagagctggacaaggtgctgcagaagttcctgacctacggccagcactgcgagagaagcctggaggagctgctgcactacgtgggccagctgagagccgagctggccagcgccgccctgcagggcacccccctgagcgccaccctgagcctggtgatgagccagtgctgcagaaagatcaaggacaccgtgcagaagctggccagcgaccacaaggacatccacagcagcgtgagcagagtgggcaaggccatcgacagaaacttcgacagcgagatctgcggcgtggtgagcgacgccgtgtgggacgccagagagtag

SEQ ID NO: 24304 - DNA, 447 bp, Artificial Sequence
  Description of Artificial Sequence: Synthetic coding sequence
atggagcagtgcgcctgcgtggagagagagctggacaaggtgctgcagaagttcctgacctacggccagcactgcgagagaagcctggaggagctgctgcactacgtgggccagctgagagccgagctggccagcgccgccctgcagggcacccccctgagcgccaccctgagcctggtgatgagccagtgctgcagaaagatcaaggacaccgtgcagaagctggccagcgaccacaaggacatccacagcagcgtgagcagagtgggcaaggccatcgacagaaacttcgacagcgagatctgcggcgtggtgagcgacgccgtgtgggacgccagagagcagcagcagcagatcctgcagatggccatcgtggagcacctgtaccagcagggcatgctgagcgtggccgaggagctgtgccaggagagcaccctgaacgtgtag

SEQ ID NO: 24305 - DNA, 174 bp, Artificial Sequence
  Description of Artificial Sequence: Synthetic coding sequence
atggagcagtgcgcctgcgtggagagagagctggacaaggtgctgcagaagttcctgacctacggccagcactgcgagagaagcctggaggagctgctgcactacgtgggccagctgagagccgagctggccagcgccgccctgcagggcacccccctgagcgccaccctgtag

SEQ ID NO: 24306 - DNA, 1182 bp, Artificial Sequence; identical to SEQ ID NO: 24302
  Description of Artificial Sequence: Synthetic coding sequence

SEQ ID NO: 24307 - DNA, 1143 bp, Artificial Sequence
  Description of Artificial Sequence: Synthetic coding sequence
atggccgactgcagcctggacctgcccggcagcagcagcccccccagccacctgagcctgctgagaagctgggaccacagaagagtgcccccctgccccgccctgcagggcacccccctgagcgccaccctgagcctggtgatgagccagtgctgcagaaagatcaaggacaccgtgcagaagctggccagcgaccacaaggacatccacagcagcgtgagcagagtgggcaaggccatcgacagaaacttcgacagcgagatctgcggcgtggtgagcgacgccgtgtgggacgccagagagcagcagcagcagatcctgcagatggccatcgtggagcacctgtaccagcagggcatgctgagcgtggccgaggagctgtgccaggagagcaccctgaacgtggacctggacttcaagcagcccttcctggagctgaacagaatcctggaggccctgcacgagcaggacctgggccccgccctggagtgggccgtgagccacagacagagactgctggagctgaacagcagcctggagttcaagctgcacagactgcacttcatcagactgctggccggcggccccgccaagcagctggaggccctgagctacgccagacacttccagcccttcgccagactgcaccagagagagatccaggtgatgatgggcagcctggtgtacctgagactgggcctggagaagagcccctactgccacctgctggacagcagccactgggccgagatctgcgagaccttcaccagagacgcctgcagcctgctgggcctgagcgtggagagccccctgagcgtgagcttcgccagcggctgcgtggccctgcccgtgctgatgaacatcaaggccgtgatcgagcagagacagtgcaccggcgtgtggaaccacaaggacgagctgcccatcgagatcgagctgggcatgaagtgctggtaccacagcgtgttcgcctgccccatcctgagacagcagaccagcgacagcaacccccccatcaagctgatctgcggccacgtgatcagcagagacgccctgaacaagctgatcaacggcggcaagctgaagtgcccctactgccccatggagcagaaccccgccgacggcaagagaatcatcttctag

SEQ ID NO: 24308 - DNA, 804 bp, Artificial Sequence
  Description of Artificial Sequence: Synthetic coding sequence
atggtgctgggcaacagccacctgttcatgaacagaagcaacaagctggccgtgatcgccagccacatccaggagagcagattcctgtaccccggcaagaacggcagactgggcgacttcttcggcgaccccggcaacccccccgagttcaaccccagcggcagcaaggacggcaagtacgagctgctgaccagcgccaacgaggtgatcgtggaggagatcaaggacctgatgaccaagagcgacatcaagggccagcacaccgagaccctgctggccggcagcctggccaaggccctgtgctacatccacagaatgaacaaggaggtgaaggacaaccaggagatgaagagcagaatcctggtgatcaaggccgccgaggacagcgccctgcagtacatgaacttcatgaacgtgatcttcgccgcccagaagcagaacatcctgatcgacgcctgcgtgctggacagcgacagcggcctgctgcagcaggcctgcgacatcaccggcggcctgtacctgaaggtgccccagatgcccagcctgctgcagtacctgctgtgggtgttcctgcccgaccaggaccagagaagccagctgatcctgcccccccccgtgcacgtggactacagagccgcctgcttctgccacagaaacctgatcgagatcggctacgtgtgcagcgtgtgcctgagcatcttctgcaacttcagccccatctgcaccacctgcgagaccgccttcaagatcagcctgccccccgtgctgaaggccaagaagaagaagctgaaggtgagcgcctag

SEQ ID NO: 24309 - DNA, 864 bp, Artificial Sequence
  Description of Artificial Sequence: Synthetic coding sequence
atggccgagcacttcaagcagatcatcagatgccccgtgtgcctgaaggacctggaggaggccgtgcagctgaagtgcggctacgcctgctgcctgcagtgcctgaacagcctgcagaaggagcccgacggcgagggcctgctgtgcagattctgcagcgtggtgagccagaaggacgacatcaagcccaagtacaagctgagagccctggtgagcatcatcaaggagctggagcccaagctgaagagcgtgctgaccatgaaccccagaatgagaaagttccaggtggacatgaccttcgacgtggacaccgccaacaactacctgatcatcagcgaggacctgagaagcttcagaagcggcgacctgagccagaacagaaaggagcaggccgagagattcgacaccgccctgtgcgtgctgggcacccccagattcaccagcggcagacactactgggaggtggacgtgggcaccagccaggtgtgggacgtgggcgtgtgcaaggagagcgtgaacagacagggcaagatcgtgctgagcagcgagcacggcttcctgaccgtgggctgcagagagggcaaggtgttcgccgccagcaccgtgcccatgacccccctgtgggtgagcccccagctgcacagagtgggcatcttcctggacgtgggcatgagaagcatcgccttctacaacgtgagcgacggctgccacatctacaccttcatcgagatccccgtgtgcgagccctggagacccttcttcgcccacaagagaggcagccaggacgaccagagcatcctgagcatctgcagcgtgatcaaccccagcgccgccagcgcccccgtgagcagcgagggcaagtag

SEQ ID NO: 24310 - DNA, 792 bp, Artificial Sequence
  Description of Artificial Sequence: Synthetic coding sequence
atggccaagagactgcaggccgagctgagctgccccgtgtgcctggacttcttcagctgcagcatcagcctgagctgcacccacgtgttctgcttcgactgcatccagagatacatcctggagaaccacgacttcagagccatgtgccccctgtgcagagacgtggtgaaggtgcccgccctggaggagtggcaggtgagcgtgctgaccctgatgaccaagcagcacaacagcagactggagcagagcctgcacgtgagagaggagctgagacacttcagagaggacgtgaccctggacgccgccaccgccagcagcctgctggtgttcagcaacgacctgagaagcgcccagtgcaagaagatccaccacgacctgaccaaggaccccagactggcctgcgtgctgggcaccccctgcttcagcagcggccagcactactgggaggtggaggtgggcgaggtgaagagctggagcctgggcgtgtgcaaggagcccgccgacagaaagagcaacgacctgttccccgagcacggcttctggatcagcatgaaggccggcgccatccacgccaacacccacctggagagaatccccgccagccccagactgagaagagtgggcatcttcctggacgccgacctggaggagatccagttcttcgacgtggacaacaacgtgctgatctacacccacgacggcttcttcagcctggagctgctgtgccccttcttctgcctggagctgctgggcgagggcgagagcggcaacgtgctgaccatctgcccctag

SEQ ID NO: 24311 - DNA, 597 bp, Artificial Sequence
  Description of Artificial Sequence: Synthetic coding sequence
atgcccctgttcggctggatgaagtggcccaagaacgacagctacaagcccacccactaccccggcagcgacatcgtgaccaagaccctgctgagagagctgaagtggcacctgaaggagagagagagactgatccaggagatcgagaacgagcagaaggtgaagaagaccggcgtggactacaactggctgagaaactaccagaacccccacaccaccatccccgtgaccgagcagagacagctggaggtgctgtgcagccaggtgcagccctgccagaccggcaccatcctgagcagattcagagaggtgctggccgagaacgacgtgctgccctgggagatcgtgtacatcttcaagcaggtgctgaaggacttcctgagcagcagcgacagaggcagcgagcaggaggacctggaggacagcggcagcatggactgcagcgcccccagcgtgatccagggcgacagcagcaagagagccgacaaggacgagatccccaccatcagcagctacgtggacaagaacaccaaggacagattccccgtgttcagccacagaatctggaacctgccctactaccaccccagcagctag

SEQ ID NO: 24312 - DNA, 4167 bp, Artificial Sequence
  Description of Artificial Sequence: Synthetic coding sequence
atgagcatccccctgcacagcctgagattcaacaacaccatgagagaggagaacgtggagccccagaacaagcagatggccttctgcagacccatgaccgagaccagagccgacgtgcagatcctgcacagccacgtgcagctgcccatcgtgagcaccagcgccagcgaccccggcggcaccagcacccagctgatgaccagccccgtgttcgacaccatgagcgcccccctgatgggcgtgcccaacagcggcgccctgagcccccccctgatgcccgccagcgacagcggcgccctgagccccctgctgatgcccgccagcgacagcggcgccctgagccccctgctgatgcccgccctggacagcggcaccctgagccccctgctgagcaccagcgagtacggcgtgatgagccccggcatgatgaccatccccgacttcggcaccatgagcgccaccctgatggtggcccccgacagcgccgagatcagccccctggccatgcccgcccccagcagcggcgtggtgtgcacccccatcatgagcaccagcagcagcgaggccatgagcacccccctgatgctggcccccgacagcggcgagctgagccccatcctgatgcaggacatgaaccccggcgtgatgagcacccagcccgtgcccgcccccagcagcgaggccatgagccccctgcagatcaccgacgaggacaccgaggccatgagcaaggtgctgatgaccgccctggccagcggcgagatcagcagcctgctgatgagcggcaccgacagcgaggccatcagcagcctgatcatgagcgccgtggccagcggcggcaccagcccccagcccaccagcacccagaacagcggcggcatccccacccccctgatgagcgacctggacagcggcatcatgagcagcctgctgatgagcagccccggcagcgaggtgatgagcacccccctgctgagcgtgcccgacgccggcgagatgagcaccctgcccaagcccgcccccgacgccgaggccatgagccccgccctgatgaccgccctgcccagcggcgtgatgcccacccagaccatgcccgcccccggcagcggcgccatgagcccctggagcacccagaacgtggacagcgagatgatgagcaacccccccgtgagagccaccgccagcggcgtgatgagcgccccccccgtgagagccctggacagcggcgccatgagcacccccctgatgggcgcccccgccagcggcaacatgagcaccctgcagaagaccgtgcccgccagcggcgccatgaccaccagcctgatgaccgtgcccagcagcggcgtgatgagcaccgagcagatgagcgccaccgccagcagagtgatgagcgcccagctgaccatggccaagaccagcggcgccatgcccaccggcagcatgaaggccgtggccaagcagtacaagagagccaccgccagcggcaagatgagcacccccctgagaagagcccccaccagcggcgccatgagcacccagcccgtgaccgccaccgccagcgagaccatgagcatgccccagctgaccgtgcccgccagcggcagcatgagcatgctgcagatgagagcccccgtgagcgaggccatgagcatgccccagatgagaaccatggccagcggcctgaccagcgccgcccagatgaaggccatgaccagcggcgccatgagcacccccctgatgaccgcccagaccagcggcagcaccagcaccctgctgatgagagacaccgccagcggcgtgatgagctgcccccagatgagaagcctggccagcggcgccctgagcaagcccctgatgacccccaaggccagcggcaccatgttcaccgagaagatgaccaccaccgccagcgaggccatgcccaccctgctgatgagagacaccgtgagcggcgccctgagcatgccccagatgaccgacaccgccagcggcggcctgagcgccagcctgatgagagacaccgccagcggcgccatgagcaccagccagatgaccgccaccgtgagcggcggcatgagcatgcccctgatgagagcccaggaccccggcgtgatgcccgccagcctgatgagagccaaggtgagcggcaagatgctgagccagcccatgagcacccaggaccccggcggcatgagcatgagccccatgaagagcatgaccgccggcggcatgcagatgaacagccccaccagcgacgtgatgagcacccccaccgtgagagcctggaccagcgagaccatgagcacccccctgatgagaaccagcgaccccggcgagagacccagcctgctgaccagagccagcagcagcggcgagatgagcctgcccctgatgagagcccccgccagcggcgagatcgccacccccctgagaagccccgcctacggcgccatgagcgccccccagatgaccgccaccgccagcggcatgatgagcagcatgccccaggtgaaggcccccatcagcggcgccatgagcatgcccctgaccagaagcaccgccagcggcggcatgagcatgcccctgatgagagcccccgacagcagagtgaccagcaccagccagatgatgcccaccgccagcggcgacatgtgcaccctgcccgtgagagcccccgccagcggcggcgtgagcagccccctggtgagagcccccgccagcggcaccatgagcacccccctgagaagacccagcgcctgcgagaccgtgagcaccgagctgatgagagccagcgccagcggccacatgagcaccgcccagaccaccgccatggtgagcggcggcatgagcaagcccctgatgagagcccccgccagcggcaccatgcccatgcccctgatgagcgccatggccagcggcgagatgagcatgcccctgatggagaccatggccagcggcgccaccagcaccctgcagaccagcgtggccaacagcagaagcatgagcctgagccagaccacctacaccgtgagcggcagaatggccaccgcccccatcagagccagcgccagcggcgccagaagcaccagcttcatgagagccagcgtgagcggcagcatgcccatgcccctgcccagagccaccgccagcggctgcggcatgggcatgagcatgccccagatgaccgccaccgacagcagaggcatgagcacccccctgatgagagccagcggccccggcaccatgagcaccccccagaccgccttcggcgtgatgagcacccccgagatcaaggccaccgacagcggcgaggccagcaccagccacatcaacatcaccgccagcggcagcaagcccaccagccacatgaccgccaccacccccgagaccgccaagcccccccccaaggaggtgcccagcttcggcatgctgacccccgccctgtgctacctgctggaggagcaggaggccgccagaggcagctgcagcgtggaggaggagatggagatcgacgaggagaagcagatgaagggcttcctggacgacagcgagagaatggccttcctggtgagcctgcacctgggcgccgccgagagatggttcatcctgcagatggaggtgggcgagcccctgagccacgagaacaagagcttcctgagaagaagccagggcatctacgacagcctgagcgagatcgacatcctgagcgccgtgctgtgccaccccaagcagggccagaagagcgtgagacagtacgccaccgacttcctgctgctggccagacacctgagctggagcgacgccatcctgagaaccagattcctggagggcctgagcgaggccgtgaccaccaagatgggcagaatcttcctgaaggtggccggcagcctgaaggagctgatcgacagaagcctgtacaccgagtgccagctggccgaggagaaggacagccccggcaacagcagccaggtgctgcccaccgcctgcaagagaaacaacgaggaggccatgggcaacgagctgagcagccagcagcagaccgaggagcaccagcacgtgagcaagagatgctactacctgaaggagcacggcgacccccaggagggcctgcacgaccacctgggccagagcaccggccaccaccagaaggcccacaccaacaagtag

SEQ ID NO: 24313 - DNA, 267 bp, Artificial Sequence
  Description of Artificial Sequence: Synthetic coding sequence
atgagcatccccctgcacagcctgagattcaacaacaccatgagagaggagaacgtggagccccagaacaagcagatggccttctgcagacccatgaccgagaccagagccgacgtgcagatcctgcacagccacgtgcagctgcccatcgtgagcaccagcgccagcgaccccggcggcaccagcacccagctgatgaccagccccgtgttcgacaccatgagcgcccccctgatgggcgtgcccaacagcggcgccctgagctag

SEQ ID NO: 24314 - DNA, 4167 bp, Artificial Sequence; identical to SEQ ID NO: 24312
  Description of Artificial Sequence: Synthetic coding sequence

SEQ ID NO: 24315 - DNA, 2850 bp, Artificial Sequence
  Description of Artificial Sequence: Synthetic coding sequence
atgagcatccccctgcacagcctgagattcaacaacaccatgagagaggagaacgtggagccccagaacaagcagatggccttctgcagacccatgaccgagaccagagccgacgtgcagatcctgcacagccacgtgcagctgcccatcgtgagcaccagcgccagcgaccccggcggcaccagcacccagctgatgaccagccccgtgttcgacaccatgagcgcccccctgatgggcgtgcccaacagcggcgccctgagcccccccctgatgcccgccagcgacagcggcgccctgagccccctgctgatgcccgccagcgacagcggcgccctgagccccctgctgatgcccgccctggacagcggcaccctgagccccctgctgagcaccagcgagtacggcgtgatgagccccggcatgatgaccatccccgacttcggcaccatgagcgccaccctgatggtggcccccgacagcgccgagatcagccccctggccatgcccgcccccagcagcggcgtggtgtgcacccccatcatgagcaccagcagcagcgaggccatgagcacccccctgatgctggcccccgacagcggcgagctgagccccatcctgatgcaggacatgaaccccggcgtgatgagcacccagcccgtgcccgcccccagcagcgaggccatgagccccctgcagatcaccgacgaggacaccgaggccatgagcaaggtgctgatgaccgccctggccagcggcgagatcagcagcctgctgatgagcggcaccgacagcgaggccatcagcagcctgatcatgagcgccgtggccagcggcggcaccagcccccagcccaccagcacccagaacagcggcggcatccccacccccctgatgagcgacctggacagcggcatcatgagcagcctgctgatgagcagccccggcagcgaggtgatgagcacccccctgctgagcgtgcccgacgccggcgagatgagcaccctgcccaagcccgcccccgacgccgaggccatgagccccgccctgatgaccgccctgcccagcggcgtgatgcccacccagaccatgcccgcccccggcagcggcgccatgagcccctggagcacccagaacgtggacagcgagatgatgagcaacccccccgtgagagccaccgccagcggcgtgatgagcgccccccccgtgagagccctggacagcggcgccatgagcacccccctgatgggcgcccccgccagcggcaacatgagcaccctgcagaagaccgtgcccgccagcggcgccatgaccaccagcctgatgaccgtgcccagcagcggcgtgatgagcaccgagcagatgagcgccaccgccagcagagtgatgagcgcccagctgaccatggccaagaccagcggcgccatgcccaccggcagcatgaaggccgtggccaagcagtacaagagagccaccgccagcggcaagatgagcacccccctgagaagagcccccaccagcggcgccatgagcacccagcccgtgaccgccaccgccagcgagaccatgagcatgccccagctgaccgtgcccgccagcggcagcatgagcatgctgcagatgagagcccccgtgagcgaggccaccagcaccctgcagaccagcgtggccaacagcagaagcatgagcctgagccagaccacctacaccgtgagcggcagaatggccaccgcccccatcagagccagcgccagcggcgccagaagcaccagcttcatgagagccagcgtgagcggcagcatgcccatgcccctgcccagagccaccgccagcggctgcggcatgggcatgagcatgccccagatgaccgccaccgacagcagaggcatgagcacccccctgatgagagccagcggccccggcaccatgagcaccccccagaccgccttcggcgtgatgagcacccccgagatcaaggccaccgacagcggcgaggccagcaccagccacatcaacatcaccgccagcggcagcaagcccaccagccacatgaccgccaccacccccgagaccgccaagcccccccccaaggaggtgcccagcttcggcatgctgacccccgccctgtgctacctgctggaggagcaggaggccgccagaggcagctgcagcgtggaggaggagatggagatcgacgaggagaagcagatgaagggcttcctggacgacagcgagagaatggccttcctggtgagcctgcacctgggcgccgccgagagatggttcatcctgcagatggaggtgggcgagcccctgagccacgagaacaagagcttcctgagaagaagccagggcatctacgacagcctgagcgagatcgacatcctgagcgccgtgctgtgccaccccaagcagggccagaagagcgtgagacagtacgccaccgacttcctgctgctggccagacacctgagctggagcgacgccatcctgagaaccagattcctggagggcctgagcgaggccgtgaccaccaagatgggcagaatcttcctgaaggtggccggcagcctgaaggagctgatcgacagaagcctgtacaccgagtgccagctggccgaggagaaggacagccccggcaacagcagccaggtgctgcccaccgcctgcaagagaaacaacgaggaggccatgggcaacgagctgagcagccagcagcagaccgaggagcaccagcacgtgagcaagagatgctactacctgaaggagcacggcgacccccaggagggcctgcacgaccacctgggccagagcaccggccaccaccagaaggcccacaccaacaagtag

SEQ ID NO: 24316 - DNA, 1710 bp, Artificial Sequence
  Description of Artificial Sequence: Synthetic coding sequence
atgagcgaggccagcggcaacctgaacagcctgagaatggccaacgtggccctgagagaggagctgaacgccctgagaggcgagaacgccaacctgggcctgcagctgggcagagccctggccgaggtgaacagcctgagaggcaacgtgagcagctacatcagatggcccgtgcccatcgtgcccgtgctggccgaggagaacctggagttcgccctgagcgagatcgaggtgatccccggcggcgagctgcccttcctgtgcagacccccccccagagccgagcccgactgcatcagcgacgacctgctgatcaacgtgatccaggacagaagcacccccgacggccccgccgacccccccctgctgcccatcccccccccccccgccctgcccccccccgccagcaaggagccccccccccagccccccctggcccccctggagagacccgagatcgagcccttcagcggcgaccccgtgtacctggccgagttcctgatgcagctggagaccttcatcgccgaccacgaggtgcacttccccggcggcgccgagagagtggccttcctgatcagcttcttcaccggcgaggccaaggactgggccatcagcgtgacccaggagggcagccccctgcacgccaacttccccagattcctggacgagatcagaaaggagttctgcggccccatcccccccagagtggccaagaaggccatcagaaagctgaagcagggccactgcaccctgggcagctacgccgacgccttccagttcctggcccagttcctgagctgggacgactgcagactgcagaaccagttcctgaagggcctgagcgagttcttcagaaaggagctgctgtggagcaccgagatggccgacctggacgagctgatcctggagtgcgtggagatcgagagaaaggtgagagtgcccaagcccatccccctgcccggcgtgagaaacatcatcttccccttcgcccccagccccaacgaggaggagagcgaggacgaggagtactacagcgaggacgaggaccaggaggccagaagacacagactgcacagcaaggaccagagaaagagaatgagagccttccagcaggagatgaaggagaaggaggaggaggagatgaagaaggaggaggagatgaagaagaaggaggagaaggaggaggaggaggaggaggagatgaagcagaaggaggaggaggaggagatcagaaacaagaacgaggaggagggcgagagcaaggacgaggaggacgaggacgaggacggcggccagaagcccgagggcgagccccagcaggaccccggcaccgaggagacctacggcgaggtggaggaggagcccctggacgaggcccaggacgacgacctggacgagctgatggagatggagcccaccttcgtgcacgccagcagccagaccagcggccccaccagcggctaccacgccgagaacttcctgggcgccagcccccccatcatccagcccagcagaagaagaaaccagaacagagtgcccctgctggagggcctgcccggcaccaacagccccttctacagcagcccccagctgatcagaagaaccggcagactgggccagagacaggtgagaagaagaccccccgtgctgttcagactgacccccagacagggcggccacagagccgccagaggcagaatcagagtgtag

SEQ ID NO: 24317 - DNA, 1710 bp, Artificial Sequence; identical to SEQ ID NO: 24316
  Description of Artificial Sequence: Synthetic coding sequence

SEQ ID NO: 24318 - DNA, 2028 bp, Artificial Sequence
  Description of Artificial Sequence: Synthetic coding sequence
atgctgagagccaccgccccctgctggttcccccccggctaccccgaggccaagaaggtggccgaggaggccgccctggaggccagcagacacctgggcggcgagcagagccaggccggcgcccccgagggcagcaagatgctgagagccaccgccccctgctggttcagacccggctaccccgaggccaagaaggtggccaaggaggccgcccccgaggccagcagacacctgggcgccgagcagagccccgccggcgcccccgagggcagcaagatgctgagagccaccgccccctgctggttcccccccggctaccccgaggccaagaaggtggccgaggaggccgccctggaggcccccgagttccccctgcccagccaccagcccgcccagagcttcggcctgtgggtgccccagatgcacaagcaggccagcgccttcgtggacatccaggccgagccccagaacagaggccccgccgtgccccccgcctggcccaagatggtgaccgagagctgctacttccccgcccagagaggcagcgcctgcagactgcccgccgcccccagactgaccgagagacccagcggcgtgagaatcagcgcccccagaaagagaaagaccatcgcccacagcagcagcccctgcctggtgaccggctacaccgacgccaagagaaccagagtggccagcagcagccagagaagcagaggcagcaaggtgggcagacagcccggcaagaccagaaacagaagcggcatggcctgcaagaccaccgccaccaccagcagcaagagaatcgtgagaagagccagcctgcccagcctgagcctgaagaagcccatcatcctgagaagcagcggctgccaggtgcccaccgtgctgagaagaggctacctgcagctgttcaccgaggagtgcctgaagttctgcgccagcaagcaggaggccgaggagaaggccctgaacgaggagaaggtggcctacgactgcagccccaacaagaacagatacctgaacgtggtgctgaacaccctgaagagactgaagggcctgacccccagcagcatgcccggcctgagcagagccgccctgtacagcagactgcaggagttcctgctgacccaggaccagctgaaggagaacggctaccccttcccccaccccgagagacccggcggcgccgtgctgttcaccggccagggcaagggccccggcgacagcagctgcagagtgtgctgcagatgcggcaccgagtacctggtgagcagcagcggcagatgcgtgagagaccagctgtgctactaccactggggcagagtgagaagcagccaggtggccggcggcagagtgagccagtacacctgctgcgccgccgcccccggcagcgtgggctgccaggtggccaagcagcacgtgagagacggcagaaaggagagcctggacggcttcgtggagaccttcaagaaggagctgagcagagacgcctaccccggcatctacgccctggactgcgagatgtgctacaccacccacggcctggagctgaccagagtgaccgtggtggacgccgacatgagagtggtgtacgacaccttcgtgaagcccgacaacgagatcgtggactacaacaccagattcagcggcgtgaccgaggccgacgtggccaagaccagcatcaccctgccccaggtgcaggccatcctgctgagcttcttcagcgcccagaccatcctgatcggccacagcctggagagcgacctgctggccctgaagctgatccacagcaccgtggtggacaccgccgtgctgttcccccactacctgggcttcccctacaagagaagcctgagaaacctggccgccgactacctggcccagatcatccaggacagccaggacggccacaacagcagcgaggacgccaacgcctgcctgcagctggtgatgtggaaggtgagacagagagcccagatccagcccagacacagaagcgccagccccgccgccctggcctgcccctag

SEQ ID NO: 24319 - DNA, 2028 bp, Artificial Sequence; identical to SEQ ID NO: 24318
  Description of Artificial Sequence: Synthetic coding sequence

SEQ ID NO: 24320 - DNA, 3864 bp, Artificial Sequence
  Description of Artificial Sequence: Synthetic coding sequence
atggtggccagaagcaccgacagcctggacggccccggcgagggcagcgtgcagcccctgcccaccgccggcggccccagcgtgaagggcaagcccggcaagagactgagcgcccccagaggccccttccccagactggccgactgcgcccacttccactacgagaacgtggacttcggccacatccagctgctgctgagccccgacagagagggccccagcctgagcggcgagaacgagctggtgttcggcgtgcaggtgacctgccagggcagaagctggcccgtgctgagaagctacgacgacttcagaagcctggacgcccacctgcacagatgcatcttcgacagaagattcagctgcctgcccgagctgccccccccccccgagggcgccagagccgcccagatgctggtgcccctgctgctgcagtacctggagaccctgagcggcctggtggacagcaacctgaactgcggccccgtgctgacctggatggagctggacaaccacggcagaagactgctgctgagcgaggaggccagcctgaacatccccgccgtggccgccgcccacgtgatcaagagatacaccgcccaggcccccgacgagctgagcttcgaggtgggcgacatcgtgagcgtgatcgacatgccccccaccgaggacagaagctggtggagaggcaagagaggcttccaggtgggcttcttccccagcgagtgcgtggagctgttcaccgagagacccggccccggcctgaaggccgacgccgacggccccccctgcggcatccccgccccccagggcatcagcagcctgaccagcgccgtgcccagacccagaggcaagctggccggcctgctgagaaccttcatgagaagcagacccagcagacagagactgagacagagaggcatcctgagacagagagtgttcggctgcgacctgggcgagcacctgagcaacagcggccaggacgtgccccaggtgctgagatgctgcagcgagttcatcgaggcccacggcgtggtggacggcatctacagactgagcggcgtgagcagcaacatccagagactgagacacgagttcgacagcgagagaatccccgagctgagcggccccgccttcctgcaggacatccacagcgtgagcagcctgtgcaagctgtacttcagagagctgcccaaccccctgctgacctaccagctgtacggcaagttcagcgaggccatgagcgtgcccggcgaggaggagagactggtgagagtgcacgacgtgatccagcagctgccccccccccactacagaaccctggagtacctgctgagacacctggccagaatggccagacacagcgccaacaccagcatgcacgccagaaacctggccatcgtgtgggcccccaacctgctgagaagcatggagctggagagcgtgggcatgggcggcgccgccgccttcagagaggtgagagtgcagagcgtggtggtggagttcctgctgacccacgtggacgtgctgttcagcgacaccttcaccagcgccggcctggaccccgccggcagatgcctgctgcccagacccaagagcctggccggcagctgccccagcaccagactgctgaccctggaggaggcccaggccagaacccagggcagactgggcacccccaccgagcccaccacccccaaggcccccgccagccccgccgagagaagaaagggcgagagaggcgagaagcagagaaagcccggcggcagcagctggaagaccttcttcgccctgggcagaggccccagcgtgcccagaaagaagcccctgccctggctgggcggcaccagagcccccccccagcccagcggcagcagacccgacaccgtgaccctgagaagcgccaagagcgaggagagcctgagcagccaggccagcggcgccggcctgcagagactgcacagactgagaagaccccacagcagcagcgacgccttccccgtgggccccgcccccgccggcagctgcgagagcctgagcagcagcagcagcagcgagagcagcagcagcgagagcagcagcagcagcagcgagagcagcgccgccggcctgggcgccctgagcggcagccccagccacagaaccagcgcctggctggacgacggcgacgagctggacttcagcccccccagatgcctggagggcctgagaggcctggacttcgaccccctgaccttcagatgcagcagccccacccccggcgaccccgccccccccgccagccccgccccccccgcccccgccagcgccttcccccccagagtgaccccccaggccatcagccccagaggccccaccagccccgccagccccgccgccctggacatcagcgagcccctggccgtgagcgtgccccccgccgtgctggagctgctgggcgccggcggcgcccccgccagcgccacccccacccccgccctgagccccggcagaagcctgagaccccacctgatccccctgctgctgagaggcgccgaggcccccctgaccgacgcctgccagcaggagatgtgcagcaagctgagaggcgcccagggccccctgggccccgacatggagagccccctgccccccccccccctgagcctgctgagacccggcggcgcccccccccccccccccaagaaccccgccagactgatggccctggccctggccgagagagcccagcaggtggccgagcagcagagccagcaggagtgcggcggcaccccccccgccagccagagccccttccacagaagcctgagcctggaggtgggcggcgagcccctgggcaccagcggcagcggccccccccccaacagcctggcccaccccggcgcctgggtgcccggcccccccccctacctgcccagacagcagagcgacggcagcctgctgagaagccagagacccatgggcaccagcagaagaggcctgagaggccccgcccaggtgagcgcccagctgagagccggcggcggcggcagagacgcccccgaggccgccgcccagagcccctgcagcgtgcccagccaggtgcccacccccggcttcttcagccccgcccccagagagtgcctgccccccttcctgggcgtgcccaagcccggcctgtaccccctgggcccccccagcttccagcccagcagccccgcccccgtgtggagaagcagcctgggcccccccgcccccctggacagaggcgagaacctgtactacgagatcggcgccagcgagggcagcccctacagcggccccaccagaagctggagccccttcagaagcatgccccccgacagactgaacgccagctacggcatgctgggccagagcccccccctgcacagaagccccgacttcctgctgagctacccccccgcccccagctgcttcccccccgaccacctgggctacagcgccccccagcaccccgccagaagacccaccccccccgagcccctgtacgtgaacctggccctgggccccagaggccccagccccgccagcagcagcagcagcagcccccccgcccaccccagaagcagaagcgaccccggcccccccgtgcccagactgccccagaagcagagagccccctggggccccagaaccccccacagagtgcccggcccctggggcccccccgagcccctgctgctgtacagagccgccccccccgcctacggcagaggcggcgagctgcacagaggcagcctgtacagaaacggcggccagagaggcgagggcgccggccccccccccccctaccccacccccagctggagcctgcacagcgagggccagaccagaagctactgctag

SEQ ID NO: 24321 - DNA, 2604 bp, Artificial Sequence
  Description of Artificial Sequence: Synthetic coding sequence
atgagaagcagaagcccccccagacccaagtggcacagcagagacggcagcagccagagcgacagcggcgaggagcagagcagaggccagtgggccagaagaagaagaagagccagaagctggagccccagcagcagcgccagcagcagcgccagccccggcagaagccagagccccagagccgccgccgccgccctgagccagcagcagagcctgcaggagagactgagactgagagaggagagaaagcagcaggaggagctgatgaaggccttcgagacccccgaggagaagagagccagaagactggccaagaaggaggccaaggagagaaagaagagagagaagatgggctggggcgaggagtacatgggctacaccaacaccgacaaccccttcggcgacaacaacctgctgggcaccttcatctggaacaaggccctggagaagaagggcatcagccacctggaggagaaggagctgaaggagagaaacaagagaatccaggaggacaacagactggagctgcagaaggtgaagcagctgagactggagagagagagagagaaggccatgagagagcaggagctggagatgctgcagagagagaaggaggccgagcacttcaagacctgggaggagcaggaggacaacttccacctgcagcaggccaagctgagaagcaagatcagaatcagagacggcagagccaagcccatcgacctgctggccaagtacatcagcgccgaggacgacgacctggccgtggagatgcacgagccctacaccttcctgaacggcctgaccgtggccgacatggaggacctgctggaggacatccaggtgtacatggagctggagcagggcaagaacgccgacttctggagagacatgaccaccatcaccgaggacgagatcagcaagctgagaaagctggaggccagcggcaagggccccggcgagagaagagagggcgtgaacgccagcgtgagcagcgacgtgcagagcgtgttcaagggcaagacctacaaccagctgcaggtgatcttccagggcatcgagggcaagatcagagccggcggccccaacctggacatgggctactgggagagcctgctgcagcagctgagagcccacatggccagagccagactgagagagagacaccaggacgtgctgagacagaagctgtacaagctgaagcaggagcagggcgtggagagcgagcccctgttccccatcctgaagcaggagccccagagccccagcagaagcctggagcccgaggacgccgcccccaccccccccggccccagcagcgagggcggccccgccgaggccgaggtggacggcgccacccccaccgagggcgacggcgacggcgacggcgagggcgagggcgagggcgaggccgtgctgatggaggaggacctgatccagcagagcctggacgactacgacgccggcagatacagccccagactgctgaccgcccacgagctgcccctggacgcccacgtgctggagcccgacgaggacctgcagagactgcagctgagcagacagcagctgcaggtgaccggcgacgccagcgagagcgccgaggacatcttcttcagaagagccaaggagggcatgggccaggacgaggcccagttcagcgtggagatgcccctgaccggcaaggcctacctgtgggccgacaagtacagacccagaaagcccagattcttcaacagagtgcacaccggcttcgagtggaacaagtacaaccagacccactacgacttcgacaaccccccccccaagatcgtgcagggctacaagttcaacatcttctaccccgacctgatcgacaagagaagcacccccgagtacttcctggaggcctgcgccgacaacaaggacttcgccatcctgagattccacgccggccccccctacgaggacatcgccttcaagatcgtgaacagagagtgggagtacagccacagacacggcttcagatgccagttcgccaacggcatcttccagctgtggttccacttcaagagatacagatacagaagacccggcccctgctggagacccatcagacactgcagaagagaccccctgtggacccccaccctgtgcagagactggccccccacccaccccgtgctggccggcggcgtgcacttccccgccgccggcatccccccccccggcctgctgaccggcccctggagcatgagacccgtgacccccagcttcgcccacatcagaaccgtggcccccagccacagccccttcagcggccaggagggcagaggcccccacggctgccacagccccggcagaagcggccccgccggcagactggtgctgcagcaccccaccggcaccagccccaccgaggccaagagaaaggtgccccccggcccccccgagggccaccccaccagccccgtgaccagccccagaccccccaccgccccccccagacaccccgccagcagcggcaacagcagcgtgtgcttcagcaagaagacctgcagatgggagaagaagagcttcgtgctgatggagctggcctactggcaggacagaatgttcttctag

SEQ ID NO: 24322 - DNA, 3381 bp, Artificial Sequence
  Description of Artificial Sequence: Synthetic coding sequence
atggtggccagaagcaccgacagcctggacggccccggcgagggcagcgtgcagcccctgcccaccgccggcggccccagcgtgaagggcaagcccggcaagagactgagcgcccccagaggccccttccccagactggccgactgcgcccacttccactacgagaacgtggacttcggccacatccagctgctgctgagccccgacagagagggccccagcctgagcggcgagaacgagctggtgttcggcgtgcaggtgacctgccagggcagaagctggcccgtgctgagaagctacgacgacttcagaagcctggacgcccacctgcacagatgcatcttcgacagaagattcagctgcctgcccgagctgccccccccccccgagggcgccagagccgcccagatgctggtgcccctgctgctgcagtacctggagaccctgagcggcctggtggacagcaacctgaactgcggccccgtgctgacctggatggagctggacaaccacggcagaagactgctgctgagcgaggaggccagcctgaacatccccgccgtggccgccgcccacgtgatcaagagatacaccgcccaggcccccgacgagctgagcttcgaggtgggcgacatcgtgagcgtgatcgacatgccccccaccgaggacagaagctggtggagaggcaagagaggcttccaggtgggcttcttccccagcgagtgcgtggagctgttcaccgagagacccggccccggcctgaaggccgacgccgacggccccccctgcggcatccccgccccccagggcatcagcagcctgaccagcgccgtgcccagacccagaggcaagctggccggcctgctgagaaccttcatgagaagcagacccagcagacagagactgagacagagaggcatcctgagacagagagtgttcggctgcgacctgggcgagcacctgagcaacagcggccaggacgtgccccaggtgctgagatgctgcagcgagttcatcgaggcccacggcgtggtggacggcatctacagactgagcggcgtgagcagcaacatccagagactgagacacgagttcgacagcgagagaatccccgagctgagcggccccgccttcctgcaggacatccacagcgtgagcagcctgtgcaagctgtacttcagagagctgcccaaccccctgctgacctaccagctgtacggcaagttcagcgaggccatgagcgtgcccggcgaggaggagagactggtgagagtgcacgacgtgatccagcagctgccccccccccactacagaaccctggagtacctgctgagacacctggccagaatggccagacacagcgccaacaccagcatgcacgccagaaacctggccatcgtgtgggcccccaacctgctgagaagcatggagctggagagcgtgggcatgggcggcgccgccgccttcagagaggtgagagtgcagagcgtggtggtggagttcctgctgacccacgtggacgtgctgttcagcgacaccttcaccagcgccggcctggaccccgccggcagatgcctgctgcccagacccaagagcctggccggcagctgccccagcaccagactgctgaccctggaggaggcccaggccagaacccagggcagactgggcacccccaccgagcccaccacccccaaggcccccgccagccccgccgagagaagaaagggcgagagaggcgagaagcagagaaagcccggcggcagcagctggaagaccttcttcgccctgggcagaggccccagcgtgcccagaaagaagcccctgccctggctgggcggcaccagagcccccccccagcccagcggcagcagacccgacaccgtgaccctgagaagcgccaagagcgaggagagcctgagcagccaggccagcggcgccgagctgctgggcgccggcggcgcccccgccagcgccacccccacccccgccctgagccccggcagaagcctgagaccccacctgatccccctgctgctgagaggcgccgaggcccccctgaccgacgcctgccagcaggagatgtgcagcaagctgagaggcgcccagggccccctgggccccgacatggagagccccctgccccccccccccctgagcctgctgagacccggcggcgcccccccccccccccccaagaaccccgccagactgatggccctggccctggccgagagagcccagcaggtggccgagcagcagagccagcaggagtgcggcggcaccccccccgccagccagagccccttccacagaagcctgagcctggaggtgggcggcgagcccctgggcaccagcggcagcggccccccccccaacagcctggcccaccccggcgcctgggtgcccggcccccccccctacctgcccagacagcagagcgacggcagcctgctgagaagccagagacccatgggcaccagcagaagaggcctgagaggccccgcccaggtgagcgcccagctgagagccggcggcggcggcagagacgcccccgaggccgccgcccagagcccctgcagcgtgcccagccaggtgcccacccccggcttcttcagccccgcccccagagagtgcctgccccccttcctgggcgtgcccaagcccggcctgtaccccctgggcccccccagcttccagcccagcagccccgcccccgtgtggagaagcagcctgggcccccccgcccccctggacagaggcgagaacctgtactacgagatcggcgccagcgagggcagcccctacagcggccccaccagaagctggagccccttcagaagcatgccccccgacagactgaacgccagctacggcatgctgggccagagcccccccctgcacagaagccccgacttcctgctgagctacccccccgcccccagctgcttcccccccgaccacctgggctacagcgccccccagcaccccgccagaagacccaccccccccgagcccctgtacgtgaacctggccctgggccccagaggccccagccccgccagcagcagcagcagcagcccccccgcccaccccagaagcagaagcgaccccggcccccccgtgcccagactgccccagaagcagagagccccctggggccccagaaccccccacagagtgcccggcccctggggcccccccgagcccctgctgctgtacagagccgccccccccgcctacggcagaggcggcgagctgcacagaggcagcctgtacagaaacggcggccagagaggcgagggcgccggccccccccccccctaccccacccccagctggagcctgcacagcgagggccagaccagaagctactgctag

SEQ ID NO: 24323 - DNA, 3372 bp, Artificial Sequence
  Description of Artificial Sequence: Synthetic coding sequence
atgctggtgcccctgctgctgcagtacctggagaccctgagcggcctggtggacagcaacctgaactgcggccccgtgctgacctggatggagctggacaaccacggcagaagactgctgctgagcgaggaggccagcctgaacatccccgccgtggccgccgcccacgtgatcaagagatacaccgcccaggcccccgacgagctgagcttcgaggtgggcgacatcgtgagcgtgatcgacatgccccccaccgaggacagaagctggtggagaggcaagagaggcttccaggtgggcttcttccccagcgagtgcgtggagctgttcaccgagagacccggccccggcctgaaggccgacgccgacggccccccctgcggcatccccgccccccagggcatcagcagcctgaccagcgccgtgcccagacccagaggcaagctggccggcctgctgagaaccttcatgagaagcagacccagcagacagagactgagacagagaggcatcctgagacagagagtgttcggctgcgacctgggcgagcacctgagcaacagcggccaggacgtgccccaggtgctgagatgctgcagcgagttcatcgaggcccacggcgtggtggacggcatctacagactgagcggcgtgagcagcaacatccagagactgagacacgagttcgacagcgagagaatccccgagctgagcggccccgccttcctgcaggacatccacagcgtgagcagcctgtgcaagctgtacttcagagagctgcccaaccccctgctgacctaccagctgtacggcaagttcagcgaggccatgagcgtgcccggcgaggaggagagactggtgagagtgcacgacgtgatccagcagctgccccccccccactacagaaccctggagtacctgctgagacacctggccagaatggccagacacagcgccaacaccagcatgcacgccagaaacctggccatcgtgtgggcccccaacctgctgagaagcatggagctggagagcgtgggcatgggcggcgccgccgccttcagagaggtgagagtgcagagcgtggtggtggagttcctgctgacccacgtggacgtgctgttcagcgacaccttcaccagcgccggcctggaccccgccggcagatgcctgctgcccagacccaagagcctggccggcagctgccccagcaccagactgctgaccctggaggaggcccaggccagaacccagggcagactgggcacccccaccgagcccaccacccccaaggcccccgccagccccgccgagagaagaaagggcgagagaggcgagaagcagagaaagcccggcggcagcagctggaagaccttcttcgccctgggcagaggccccagcgtgcccagaaagaagcccctgccctggctgggcggcaccagagcccccccccagcccagcggcagcagacccgacaccgtgaccctgagaagcgccaagagcgaggagagcctgagcagccaggccagcggcgccggcctgcagagactgcacagactgagaagaccccacagcagcagcgacgccttccccgtgggccccgcccccgccggcagctgcgagagcctgagcagcagcagcagcagcgagagcagcagcagcgagagcagcagcagcagcagcgagagcagcgccgccggcctgggcgccctgagcggcagccccagccacagaaccagcgcctggctggacgacggcgacgagctggacttcagcccccccagatgcctggagggcctgagaggcctggacttcgaccccctgaccttcagatgcagcagccccacccccggcgaccccgccccccccgccagccccgccccccccgcccccgccagcgccttcccccccagagtgaccccccaggccatcagccccagaggccccaccagccccgccagccccgccgccctggacatcagcgagcccctggccgtgagcgtgccccccgccgtgctggagctgctgggcgccggcggcgcccccgccagcgccacccccacccccgccctgagccccggcagaagcctgagaccccacctgatccccctgctgctgagaggcgccgaggcccccctgaccgacgcctgccagcaggagatgtgcagcaagctgagaggcgcccagggccccctgggccccgacatggagagccccctgccccccccccccctgagcctgctgagacccggcggcgcccccccccccccccccaagaaccccgccagactgatggccctggccctggccgagagagcccagcaggtggccgagcagcagagccagcaggagtgcggcggcaccccccccgccagccagagccccttccacagaagcctgagcctggaggtgggcggcgagcccctgggcaccagcggcagcggccccccccccaacagcctggcccaccccggcgcctgggtgcccggcccccccccctacctgcccagacagcagagcgacggcagcctgctgagaagccagagacccatgggcaccagcagaagaggcctgagaggccccgcccaggtgcccacccccggcttcttcagccccgcccccagagagtgcctgccccccttcctgggcgtgcccaagcccggcctgtaccccctgggcccccccagcttccagcccagcagccccgcccccgtgtggagaagcagcctgggcccccccgcccccctggacagaggcgagaacctgtactacgagatcggcgccagcgagggcagcccctacagcggccccaccagaagctggagccccttcagaagcatgccccccgacagactgaacgccagctacggcatgctgggccagagcccccccctgcacagaagccccgacttcctgctgagctacccccccgcccccagctgcttcccccccgaccacctgggctacagcgccccccagcaccccgccagaagacccaccccccccgagcccctgtacgtgaacctggccctgggccccagaggccccagccccgccagcagcagcagcagcagcccccccgcccaccccagaagcagaagcgaccccggcccccccgtgcccagactgccccagaagcagagagccccctggggccccagaaccccccacagagtgcccggcccctggggcccccccgagcccctgctgctgtacagagccgccccccccgcctacggcagaggcggcgagctgcacagaggcagcctgtacagaaacggcggccagagaggcgagggcgccggccccccccccccctaccccacccccagctggagcctgcacagcgagggccagaccagaagctactgctag

SEQ ID NO: 24324 - DNA, 2625 bp, Artificial Sequence
  Description of Artificial Sequence: Synthetic coding sequence
atgggcctgcccaccctggagttcagcgacagctacctggacagccccgacttcagagagagactgcagtgccacgagatcgagctggagagaaccaacaagttcatcaaggagctgatcaaggacggcagcctgctgatcggcgccctgagaaacctgagcatggccgtgcagaagttcagccagagcctgcaggacttccagttcgagtgcatcggcgacgccgagaccgacgacgagatcagcatcgcccagagcctgaaggagttcgccagactgctgatcgccgtggaggaggagagaagaagactgatccagaacgccaacgacgtgctgatcgcccccctggagaagttcagaaaggagcagatcggcgccgccaaggacggcaagaagaagttcgacaaggagagcgagaagtactacagcatcctggagaagcacctgaacctgagcgccaagaagaaggagagccacctgcaggaggccgacacccagatcgacagagagcaccagaacttctacgaggccagcctggagtacgtgttcaagatccaggaggtgcaggagaagaagaagttcgagttcgtggagcccctgctgagcttcctgcagggcctgttcaccttctaccacgagggctacgagctggcccaggagttcgccccctacaagcagcagctgcagttcaacctgcagaacaccagaaacaacttcgagagcaccagacaggaggtggagagactgatgcagagaatgaagagcgccaaccaggactacagaccccccagccagtggaccatggagggctacctgtacgtgcaggagaagagacccctgggcttcacctggatcaagcactactgcacctacgacaagggcagcaagaccttcaccatgagcgtgagcgagatgaagagcagcggcaagatgaacggcctggtgaccagcagccccgagatgttcaagctgaagagctgcatcagaagaaagaccgacagcatcgacaagagattctgcttcgacatcgaggtggtggagagacacggcatcatcaccctgcaggccttcagcgaggccaacagaaagctgtggctggaggccatggacggcaaggagcccatctacaccctgcccgccatcatcagcaagaaggaggagatgtacctgaacgaggccggcttcaacttcgtgagaaagtgcatccaggccgtggagaccagaggcatcaccatcctgggcctgtacagaatcggcggcgtgaacagcaaggtgcagaagctgatgaacaccaccttcagccccaagagcccccccgacatcgacatcgacatcgagctgtgggacaacaagaccatcaccagcggcctgaagaactacctgagatgcctggccgagcccctgatgacctacaagctgcacaaggacttcatcatcgccgtgaagagcgacgaccagaactacagagtggaggccgtgcacgccctggtgcacaagctgcccgagaagaacagagagatgctggacatcctgatcaagcacctggtgaaggtgagcctgcacagccagcagaacctgatgaccgtgagcaacctgggcgtgatcttcggccccaccctgatgagagcccaggaggagaccgtggccgccatgatgaacatcaagttccagaacatcgtggtggagatcctgatcgagcactacgagaagatcttccacaccgcccccgaccccagcatccccctgccccagccccagagcagaagcggcagcagaagaaccagagccatctgcctgagcaccggcagcagaaagcccagaggcagatacaccccctgcctggccgagcccgacagcgacagctacagcagcagccccgacagcacccccatgggcagcatcgagagcctgagcagccacagcagcgagcagaacagcaccaccaagagcgccagctgccagcccagagagaagagcggcggcatcccctggatcgccacccccagcagcagcaacggccagaagagcctgggcctgtggaccaccagccccgagagcagcagcagagaggacgccaccaagaccgacgccgagagcgactgccagagcgtggccagcgtgaccagccccggcgacgtgagcccccccatcgacctggtgaagaaggagccctacggcctgagcggcctgaagagagccagcgccagcagcctgagaagcatcagcgccgccgagggcaacaagagctacagcggcagcatccagagcctgaccagcgtgggcagcaaggagacccccaaggccagccccaaccccgacctgccccccaagatgtgcagaagactgagactggacaccgccagcagcaacggctaccagagacccggcagcgtggtggccgccaaggcccagctgttcgagaacgtgggcagccccaagcccgtgagcagcggcagacaggccaaggccatgtacagctgcaaggccgagcacagccacgagctgagcttcccccagggcgccatcttcagcaacgtgtaccccagcgtggagcccggctggctgaaggccacctacgagggcaagaccggcctggtgcccgagaactacgtggtgttcctgtag

SEQ ID NO: 24325 - DNA, 1647 bp, Artificial Sequence
  Description of Artificial Sequence: Synthetic coding sequence
atgcagcccggcctgagccccggcagccccggcgaccccagaccccccacccccgagaccgactaccccgagagcctgaccagctaccccgaggaggactacagccccgtgggcagcttcggcgagcccggccccaccagccccctgaccaccccccccggctggagctgccacgtgagccaggacaagcagatgctgtacaccaaccacttcacccaggagcagtgggtgagactggaggacccccacggcaagccctacttctacaaccccgaggacagcagcgtgagatgggagctgccccaggtgcccgtgcccgcccccagaagcatccacaagagcagccaggacggcgacacccccgcccaggccagcccccccgaggagaaggtgcccgccgagctggacgaggtgggcagctgggaggaggtgagccccgccaccgccgccgtgagaaccaagaccctggacaaggccggcgtgctgcacagaaccaagaccgccgacaagggcaagagactgagaaagaagcactggagcgccagctggaccgtgctggagggcggcgtgctgaccttcttcaaggacagcaagaccagcgccgccggcggcctgagacagcccagcaagttcagcacccccgagtacaccgtggagctgagaggcgccaccctgagctgggcccccaaggacaagagcagcagaaagaacgtgctggagctgagaagcagagacggcagcgagtacctgatccagcacgacagcgaggccatcatcagcacctggcacaaggccatcgcccagggcatccaggagctgagcgccgagctgccccccgaggagagcgagagcagcagagtggacttcggcagcagcgagagactgggcagctggcaggagaaggaggaggacgccagacccaacgccgccgcccccgccctgggccccgtgggcctggagagcgacctgagcaaggtgagacacaagctgagaaagttcctgcagagaagacccaccctgcagagcctgagagagaagggctacatcaaggaccaggtgttcggctgcgccctggccgccctgtgcgagagagagagaagcagagtgcccagattcgtgcagcagtgcatcagagccgtggaggccagaggcctggacatcgacggcctgtacagaatcagcggcaacctggccaccatccagaagctgagatacaaggtggaccacgacgagagactggacctggacgacggcagatgggaggacgtgcacgtgatcaccggcgccctgaagctgttcttcagagagctgcccgagcccctgttccccttcagccacttcagacagttcatcgccgccatcaagctgcaggaccaggccagaagaagcagatgcgtgagagacctggtgagaagcctgcccgcccccaaccacgacaccctgagaatgctgttccagcacctgtgcagagtgatcgagcacggcgagcagaacagaatgagcgtgcagagcgtggccatcgtgttcggccccaccctgctgagacccgaggtggaggagaccagcatgcccatgaccatggtgttccagaaccaggtggtggagctgatcctgcagcagtgcgccgacatcttccccccccactag

SEQ ID NO: 24326 - DNA, 1200 bp, Artificial Sequence
  Description of Artificial Sequence: Synthetic coding sequence
atggtggacatcatcgccaaggtgaccagaagacagagcagagccctgcccgcccaggtggacgacccccccgagcccgtgtacgccaacatcgagagacagcccagagccaccagccccggcgccgccgccgcccccctgcccagccccgtgtgggagacccacaccgacgccggcaccggcagaccctactactacaaccccgacaccggcgtgaccacctgggagagccccttcgaggccgccgagggcgccgccagccccgccaccagccccgccagcgtggacagccacgtgagcctggagaccgagtggggccagtactgggacgaggagagcagaagagtgttcttctacaaccccctgaccggcgagaccgcctgggaggacgaggccgagaacgagcccgaggaggagctggagatgcagcccggcctgagccccggcagccccggcgaccccagaccccccacccccgagaccgactaccccgagagcctgaccagctaccccgaggaggactacagccccgtgggcagcttcggcgagcccggccccaccagccccctgaccaccccccccggctggagctgccacgtgagccaggacaagcagatgctgtacaccaaccacttcacccaggagcagtgggtgagactggaggacccccacggcaagccctacttctacaaccccgaggacagcagcgtgagatgggagctgccccaggtgcccgtgcccgcccccagaagcatccacaagagcagccaggacggcgacacccccgcccaggccagcccccccgaggagaagaccaagaccctggacaaggccggcgtgctgcacagaaccaagaccgccgacaagggcaagagactgagaaagaagcactggagcgccagctggaccgtgctggagggcggcgtgctgaccttcttcaaggacagcaagaccagcgccgccggcggcctgagacagcccagcaagttcagcacccccgagtacaccgtggagctgagaggcgccaccctgagctgggcccccaaggacaagagcagcagaaagaacgtgctggagctgagaagcagagacggcagcgagtacctgatccagcacgacagcgaggccatcatcagcacctggcacaaggccatcgcccagggcatccaggagctggtgagcagagcccagggcctgtag

SEQ ID NO: 24327 - DNA, 1647 bp, Artificial Sequence; identical to SEQ ID NO: 24325
  Description of Artificial Sequence: Synthetic coding sequence

SEQ ID NO: 24328 - DNA, 2589 bp, Artificial Sequence
  Description of Artificial Sequence: Synthetic coding sequence
atggccgccgacgtggtgggcgacgtgtacgtgctggtggagcaccccttcgagtacaccggcaaggacggcagaagagtggccatcagacccaacgagagatacagactgctgagaagaagcaccgagcactggtggcacgtgagaagagagcccggcggcagacccttctacctgcccgcccagtacgtgagagagctgcccgccctgggcaaccccgccgccgccgccccccccggcccccaccccagccccgccgcccccgagcccctggcctacgactacagattcgtgagcgccgccgccaccgccggccccgacggcgcccccgaggagagcggcggcagaaccagcagcctgtgcggccccgcccagagaggcgccgccacccagagaagcagcctggcccccggcctgcccgcctgcctgtacctgagacccgccgcccccgtgagacccgcccagagcctgaacgacctggcctgcgccgccgtgagcccccccgccggcctgctgggcagcagcggcagcttcaaggcctgcagcgtggccggcagctgggtgtgccccagacccctggccagaagcgacagcgagaacgtgtacgaggtgatccaggacctgcacgtgccccccagagaggagagcgccgagcaggtggacgacccccccgagcccgtgtacgccaacatcgagagacagcccagagccaccagccccggcgccgccgccgcccccctgcccagccccgtgtgggagacccacaccgacgccggcaccggcagaccctactactacaaccccgacaccggcgtgaccacctgggagagccccttcgaggccgccgagggcgccgccagccccgccaccagccccgccagcgtggacagccacgtgagcctggagaccgagtggggccagtactgggacgaggagagcagaagagtgttcttctacaaccccctgaccggcgagaccgcctgggaggacgaggccgagaacgagcccgaggaggagctggagatgcagcccggcctgagccccggcagccccggcgaccccagaccccccacccccgagaccgactaccccgagagcctgaccagctaccccgaggaggactacagccccgtgggcagcttcggcgagcccggccccaccagccccctgaccaccccccccggctggagctgccacgtgagccaggacaagcagatgctgtacaccaaccacttcacccaggagcaggtgcccgtgcccgcccccagaagcatccacaagagcagccaggacggcgacacccccgcccaggccagcccccccgaggagaaggtgcccgccgagctggacgaggtgggcagctgggaggaggtgagccccgccaccgccgccgtgagaaccaagaccctggacaaggccggcgtgctgcacagaaccaagaccgccgacaagggcaagagactgagaaagaagcactggagcgccagctggaccgtgctggagggcggcgtgctgaccttcttcaaggacagcaagaccagcgccgccggcggcctgagacagcccagcaagttcagcacccccgagtacaccgtggagctgagaggcgccaccctgagctgggcccccaaggacaagagcagcagaaagaacgtgctggagctgagaagcagagacggcagcgagtacctgatccagcacgacagcgaggccatcatcagcacctggcacaaggccatcgcccagggcatccaggagctgagcgccgagctgccccccgaggagagcgagagcagcagagtggacttcggcagcagcgagagactgggcagctggcaggagaaggaggaggacgccagacccaacgccgccgcccccgccctgggccccgtgggcctggagagcgacctgagcaaggtgagacacaagctgagaaagttcctgcagagaagacccaccctgcagagcctgagagagaagggctacatcaaggaccaggtgttcggctgcgccctggccgccctgtgcgagagagagagaagcagagtgcccagattcgtgcagcagtgcatcagagccgtggaggccagaggcctggacatcgacggcctgtacagaatcagcggcaacctggccaccatccagaagctgagatacaaggtggaccacgacgagagactggacctggacgacggcagatgggaggacgtgcacgtgatcaccggcgccctgaagctgttcttcagagagctgcccgagcccctgttccccttcagccacttcagacagttcatcgccgccatcaagctgcaggaccaggccagaagaagcagatgcgtgagagacctggtgagaagcctgcccgcccccaaccacgacaccctgagaatgctgttccagcacctgtgcagagtgatcgagcacggcgagcagaacagaatgagcgtgcagagcgtggccatcgtgttcggccccaccctgctgagacccgaggtggaggagaccagcatgcccatgaccatggtgttccagaaccaggtggtggagctgatcctgcagcagtgcgccgacatcttccccccccactag

SEQ ID NO: 24329 - DNA, 792 bp, Artificial Sequence
  Description of Artificial Sequence: Synthetic coding sequence
atggccgccgacgtggtgggcgacgtgtacgtgctggtggagcaccccttcgagtacaccggcaaggacggcagaagagtggccatcagacccaacgagagatacagactgctgagaagaagcaccgagcactggtggcacgtgagaagagagcccggcggcagacccttctacctgcccgcccagtacgtgagagagctgcccgccctgggcaaccccgccgccgccgccccccccggcccccaccccagccccgccgcccccgagcccctggcctacgactacagattcgtgagcgccgccgccaccgccggccccgacggcgcccccgaggagagcggcggcagaaccagcagcctgtgcggccccgcccagagaggcgccgccacccagagaagcagcctggcccccggcctgcccgcctgcctgtacctgagacccgccgcccccgtgagacccgcccagagcctgaacgacctggcctgcgccgccgtgagcccccccgccggcctgctgggcagcagcggcagcttcaaggcctgcagcgtggccggcagctgggtgtgccccagacccctggccagaagcgacagcgagaacgtgtacgaggtgatccaggacctgcacgtgccccccagagaggagagcgccgagcaggtgccccccagagccctgggcagaggcggcggctggagagccagagacagagccagaaccgagcccggcagaaaggagaccagaagcgcccagagaagagccagaagaccccccctgagcgaggacttcggctag

SEQ ID NO: 24330 - DNA, 2526 bp, Artificial Sequence
  Description of Artificial Sequence: Synthetic coding sequence
atgagcgcccagagcctgcccgccgccaccccccccacccagaagccccccagaatcatcagacccagaccccccagcagaagcagagccgcccagagccccggccccccccacaacggcagcagcccccaggagctgcccagaaacagcaacgacgcccccacccccatgtgcacccccatcttctgggagccccccgccgccagcctgaagccccccgccctgctgccccccagcgccagcagagccagcctggacagccagaccagccccgacagccccagcagcacccccacccccagccccgtgagcagaagaagcgccagccccgagcccgcccccagaagccccgtgcccccccccaagcccagcggcagcccctgcacccccctgctgcccatggccggcgtgctggcccagaacggcagcgccagcgcccccggcaccgtgagaagactggccggcagattcgagggcggcgccgagggcagagcccaggacgccgacgcccccgagcccggcctgcaggccagagccgacgtgaacggcgagagagaggcccccctgaccggcagcggcagccaggagaacggcgcccccgacgccggcctggcctgccccccctgctgcccctgcgtgtgccacaccaccagacccggcctggagctgagatgggtgcccgtgggcggctacgaggaggtgcccagagtgcccagaagagccagccccctgagaaccagcagaagcagaccccacccccccagcatcggccaccccgccgtggtgctgaccagctacagaagcaccgccgagagaaagctgctgcccctgctgaagccccccaagcccaccagagtgagacaggacgccaccatcttcggcgaccccccccagcccgacctggacctgctgagcgaggacggcatccagaccggcgacagccccgacgaggccccccagaacaccccccccgccaccgtggagggcagagaggaggagggcctggaggtgctgaaggagcagaactgggagctgcccctgcaggacgagcccctgtaccagacctacagagccgccgtgctgagcgaggagctgtggggcgtgggcgaggacggcagccccagccccgccaacgccggcgacgcccccaccttccccagaccccccggccccagaaacaccctgtggcaggagctgcccgccgtgcaggccagcggcctgctggacaccctgagcccccaggagagaagaatgcaggagagcctgttcgaggtggtgaccagcgaggccagctacctgagaagcctgagactgctgaccgacaccttcgtgctgagccaggccctgagagacaccctgacccccagagaccaccacaccctgttcagcaacgtgcagagagtgcagggcgtgagcgagagattcctggccaccctgctgagcagagtgagaagcagcccccacatcagcgacctgtgcgacgtggtgcacgcccacgccgtgggccccttcagcgtgtacgtggactacgtgagaaaccagcagtaccaggaggagacctacagcagactgatggacaccaacgtgagattcagcgccgagctgagaagactgcagagcctgcccaagtgcgagagactgcccctgcccagcttcctgctgctgcccttccagagaatcaccagactgagaatgctgctgcagaacatcctgagacagaccgaggagggcagcagcagacaggagaacgcccagaaggccctgggcgccgtgagcaagatcatcgagagatgcagcgccgaggtgggcagaatgaagcagaccgaggagctgatcagactgacccagagactgagattccacaaggtgaaggccctgcccctggtgagctggagcagaagactggagttccagggcgagctgaccgagctgggctgcagaagaggcggcgtgctgttcgccagcagacccagattcacccccctgtgcctgctgctgttcagcgacctgctgctgatcacccagcccaagagcggccagagactgcaggtgctggactacgcccacagaagcctggtgcaggcccagcaggtgcccgaccccagcggcccccccaccttcagactgagcctgctgagcaaccaccagggcagacccacccacagactgctgcaggccagcagcctgagcgacatgcagagatggctgggcgccttccccacccccggccccctgccctgcagccccgacaccatctacgaggactgcgactgcagccaggagctgtgcagcgagagcagcgcccccgccaagaccgagggcagaagcctggagagcagagccgcccccaagcacctgcacaagacccccgagggctggctgaagggcctgcccggcgccttccccgcccagctggtgtgcgaggtgaccggcgagcacgagagaagaagacacctgagacagaaccagagactgctggaggccgtgggcagcagcagcggcacccccaacgccccccccccctag

SEQ ID NO: 24331 - DNA, 2526 bp, Artificial Sequence; identical to SEQ ID NO: 24330
  Description of Artificial Sequence: Synthetic coding sequence

SEQ ID NO: 24332 - DNA, 1896 bp, Artificial Sequence
  Description of Artificial Sequence: Synthetic coding sequence
atggcccccctgcacaagaactaccccgagacccccatgatgcaccagccccagtgcgccccccccagcagcggcagcccccagctgcaccccagcagccccctgctgttctgccccccccagaacggcagcgccagcgcccccggcaccgtgagaagactggccggcagattcgagggcggcgccgagggcagagcccaggacgccgacgcccccgagcccggcctgcaggccagagccgacgtgaacggcgagagagaggcccccctgaccggcagcggcagccaggagaacggcgcccccggcgacagccccgacgaggccccccagaacaccccccccgccaccgtggagggcagagaggaggagggcctggaggtgctgaaggagcagaactgggagctgcccctgcaggacgagcccctgtaccagacctacagagccgccgtgctgagcgaggagctgtggggcgtgggcgaggacggcagccccagccccgccaacgccggcgacgcccccaccttccccagaccccccggccccagaaacaccctgtggcaggagctgcccgccgtgcaggccagcggcctgctggacaccctgagcccccaggagagaagaatgcaggagagcctgttcgaggtggtgaccagcgaggccagctacctgagaagcctgagactgctgaccgacaccttcgtgctgagccaggccctgagagacaccctgacccccagagaccaccacaccctgttcagcaacgtgcagagagtgcagggcgtgagcgagagattcctggccaccctgctgagcagagtgagaagcagcccccacatcagcgacctgtgcgacgtggtgcacgcccacgccgtgggccccttcagcgtgtacgtggactacgtgagaaaccagcagtaccaggaggagacctacagcagactgatggacaccaacgtgagattcagcgccgagctgagaagactgcagagcctgcccaagtgcgagagactgcccctgcccagcttcctgctgctgcccttccagagaatcaccagactgagaatgctgctgcagaacatcctgagacagaccgaggagggcagcagcagacaggagaacgcccagaaggccctgggcgccgtgagcaagatcatcgagagatgcagcgccgaggtgggcagaatgaagcagaccgaggagctgatcagactgacccagagactgagattccacaaggtgaaggccctgcccctggtgagctggagcagaagactggagttccagggcgagctgaccgagctgggctgcagaagaggcggcgtgctgttcgccagcagacccagattcacccccctgtgcctgctgctgttcagcgacctgctgctgatcacccagcccaagagcggccagagactgcaggtgctggactacgcccacagaagcctggtgcaggcccagcaggtgcccgaccccagcggcccccccaccttcagactgagcctgctgagcaaccaccagggcagacccacccacagactgctgcaggccagcagcctgagcgacatgcagagatggctgggcgccttccccacccccggccccctgccctgcagccccgacaccatctacgaggactgcgactgcagccaggagctgtgcagcgagagcagcgcccccgccaagaccgagggcagaagcctggagagcagagccgcccccaagcacctgcacaagacccccgagggctggctgaagggcctgcccggcgccttccccgcccagctggtgtgcgaggtgaccggcgagcacgagagaagaagacacctgagacagaaccagagactgctggaggccgtgggcagcagcagcggcacccccaacgccccccccccctag

SEQ ID NO: 24333 - DNA, 2616 bp, Artificial Sequence
  Description of Artificial Sequence: Synthetic coding sequence
atggacggcgagagcgaggtggacttcagcagcaacagcatcacccccctgtggagaagaagaagcatcccccagccccaccaggtgctgggcagaagcaagcccagaccccagagctaccagagccccaacggcctgctgatcaccgacttccccgtggaggacggcggcaccctgctggccgcccagatccccgcccaggtgcccaccgccagcgacagcagaaccgtgcacagaagccccctgctgctgggcgcccagagaagagccgtggccaacggcggcaccgccagccccgagtacagagccgccagccccagactgagaagacccaagagccccaagctgcccaaggccgtgcccggcggcagccccaagagccccgccaacggcgccgtgaccctgcccgcccccccccccccccccgtgctgagaccccccagaacccccaacgcccccgccccctgcacccccgaggaggacctgaccggcctgaccgccagccccgtgcccagccccaccgccaacggcctggccgccaacaacgacagccccggcagcggcagccagagcggcagaaaggccaaggaccccgagagaggcctgttccccggcccccagaagagcagcagcgagcagaagctgcccctgcagagactgcccagccaggagaacgagctgctggagaaccccagcgtggtgctgagcaccaacagccccgccgccctgaaggtgggcaagcagcagatcatccccaagagcctggccagcgagatcaagatcagcaagagcaacaaccagaacgtggagccccacaagagactgctgaaggtgagaagcatggtggagggcctgggcggccccctgggccacgccggcgaggagagcgaggtggacaacgacgtggacagccccggcagcctgagaagaggcctgagaagcaccagctacagaagagccgtggtgagcggcttcgacttcgacagccccaccagcagcaagaagaagaacagaatgagccagcccgtgctgaaggtggtgatggaggacaaggagaagttcagcagcctgggcagaatcaagaagaagatgctgaagggccagggcaccttcgacggcgaggagaacgccgtgctgtaccagaactacaaggagaaggccctggacatcgacagcgacgaggagagcgagcccaaggagcagaagagcgacgagaagatcgtgatccaccacaagcccctgagaagcacctggagccagctgagcgccgtgaagagaaagggcctgagccagaccgtgagccaggaggagagaaagagacaggaggccatcttcgaggtgatcagcagcgagcacagctacctgctgagcctggagatcctgatcagaatgttcaagaacagcaaggagctgagcgacaccatgaccaagaccgagagacaccacctgttcagcaacatcaccgacgtgtgcgaggccagcaagaagttcttcatcgagctggaggccagacaccagaacaacatcttcatcgacgacatcagcgacatcgtggagaagcacaccgccagcaccttcgacccctacgtgaagtactgcaccaacgaggtgtaccagcagagaaccctgcagaagctgctggccaccaaccccagcttcaaggaggtgctgagcagaatcgagagccacgaggactgcagaaacctgcccatgatcagcttcctgatcctgcccatgcagagagtgaccagactgcccctgctgatggacaccatctgccagaagacccccaaggacagccccaagtacgaggtgtgcaagagagccctgaaggaggtgagcaagctggtgagactgtgcaacgagggcgccagaaagatggagagaaccgagatgatgtacaccatcaacagccagctggagttcaagatcaagcccttccccctggtgagcagcagcagatggctggtgaagagaggcgagctgaccgcctacgtggaggacaccgtgctgttcagcagaagaaccagcaagcagcaggtgtacttcttcctgttcaacgacgtgctgatcatcaccaagaagaagagcgaggagagctacaacgtgaacgactacagcctgagagaccagctgctggtggagagctgcgacaacgaggagctgaacagcagccccggcaagaacagcagcaccatgctgtacagcagacagagcagcgccagccacctgttcaccctgaccgtgctgagcaaccacgccaacgagaaggtggagatgctgctgggcgccgagacccagagcgagagagccagatggatcaccgccctgggccacagcagcggcaagccccccgccgacagaaccagcctgacccaggtggagatcgtgagaagcttcaccgccaagcagcccgacgagctgagcctgcaggtggccgacgtggtgctgatctaccagagagtgagcgacggctggtacgagggcgagagactgagagacggcgagagaggctggttccccatggagtgcgccaaggagatcacctgccaggccaccatcgacaagaacgtggagagaatgggcagactgctgggcctggagaccaacgtgtag

SEQ ID NO: 24334 - DNA, 2616 bp, Artificial Sequence; identical to SEQ ID NO: 24333
  Description of Artificial Sequence: Synthetic coding sequence

SEQ ID NO: 24335 - DNA, 1341 bp, Artificial Sequence
  Description of Artificial Sequence: Synthetic coding sequence
atggacggcgagagcgaggtggacttcagcagcaacagcatcacccccctgtggagaagaagaagcatcccccagccccaccaggtgctgggcagaagcaagcccagaccccagagctaccagagccccaacggcctgctgatcaccgacttccccgtggaggacggcggcaccctgctggccgcccagatccccgcccaggtgcccaccgccagcgacagcagaaccgtgcacagaagccccctgctgctgggcgcccagagaagagccgtggccaacggcggcaccgccagccccgagtacagagccgccagccccagactgagaagacccaagagccccaagctgcccaaggccgtgcccggcggcagccccaagagccccgccaacggcgccgtgaccctgcccgcccccccccccccccccgtgctgagaccccccagaacccccaacgcccccgccccctgcacccccgaggaggacctgaccggcctgaccgccagccccgtgcccagccccaccgccaacggcctggccgccaacaacgacagccccggcagcggcagccagagcggcagaaaggccaaggaccccgagagaggcctgttccccggcccccagaagagcagcagcgagcagaagctgcccctgcagagactgcccagccaggagaacgagctgctggagaaccccagcgtggtgctgagcaccaacagccccgccgccctgaaggtgggcaagcagcagatcatccccaagagcctggccagcgagatcaagatcagcaagagcaacaaccagaacgtggagccccacaagagactgctgaaggtgagaagcatggtggagggcctgggcggccccctgggccacgccggcgaggagagcgaggtggacaacgacgtggacagccccggcagcctgagaagaggcctgagaagcaccagctacagaagagccgtggtgagcggcttcgacttcgacagccccaccagcagcaagaagaagaacagaatgagccagcccgtgctgaaggtggtgatggaggacaaggagaagttcagcagcctgggcagaatcaagaagaagatgctgaagggccagggcaccttcgacggcgaggagaacgccgtgctgtaccagaactacaaggagaaggccctggacatcgacagcgacgaggagagcgagcccaaggagcagaagagcgacgagaagatcgtgatccaccacaagcccctgagaagcacctggagccagctgagcgccgtgaagagaaaggtgatcctgatcgtgggcttcatggagatgaaggacggcagactgagaggcggcaagtag

SEQ ID NO: 24336 - DNA, 2376 bp, Artificial Sequence
  Description of Artificial Sequence: Synthetic coding sequence
atggacggcgagagcgaggtggacttcagcagcaacagcatcacccccctgtggagaagaagaagcatcccccagccccaccaggtgctgggcagaagcaagcccagaccccagagctaccagagccccaacggcctgctgatcaccgacttccccgtggaggacggcggcaccctgctggccgcccagatccccgcccaggtgcccaccgccagcgacagcagaaccgtgcacagaagccccctgctgctgggcgcccagagaagagccgtggccaacggcggcaccgccagccccgagtacagagccgccagccccagactgagaagacccaagagccccaagctgcccaaggccgtgcccggcggcagccccaagagccccgccaacggcgccgtgaccctgcccgcccccccccccccccccgtgctgagaccccccagaacccccaacgcccccgccccctgcacccccgaggaggacctgaccggcctgaccgccagccccgtgcccagccccaccgccaacggcctggccgccaacaacgacagccccggcagcggcagccagagcggcagaaaggccaaggaccccgagagaggcctgttccccggcccccagaagagcagcagcgagcagaagctgcccctgcagagactgcccagccaggagaacgagctgctggagaaccccagcgtggtgctgagcaccaacagccccgccgccctgaaggtgggcaagcagcagatcatccccaagagcctggccagcgagatcaagatcagcaagagcaacaaccagaacgtggagccccacaagagactgctgaaggtgagaagcatggtggagggcctgggcggccccctgggccacgccggcgaggagagcgaggtggacaacgacgtggacagccccggcagcctgagaagaggcctgagaagcaccagctacagaagagccgtggtgagcggcttcgacttcgacagccccaccagcagcaagaagaagaacagaatgagccagcccgtgctgaaggtggtgatggaggacaaggagaagttcagcagcctgggcagaatcaagaagaagatgctgaagggccagggcaccttcgacggcgaggagaacgccgtgctgtaccagaactacaaggagaaggccctggacatcgacagcgacgaggagagcgagcccaaggagcagaagagcgacgagaagatcgtgatccaccacaagcccctgagaagcacctggagccagctgagcgccgtgaagagaaagggcctgagccagaccgtgagccaggaggagagaaagagacaggaggccatcttcgaggtgatcagcagcgagcacagctacctgctgagcctggagatcctgatcagaatgttcaagaacagcaaggagctgagcgacaccatgaccaagaccgagagacaccacctgttcagcaacatcaccgacgtgtgcgaggccagcaagaagttcttcatcgagctggaggccagacaccagaacaacatcttcatcgacgacatcagcgacatcgtggagaagcacaccgccagcaccttcgacccctacgtgaagtactgcaccaacgaggtgtaccagcagagaaccctgcagaagctgctggccaccaaccccagcttcaaggaggtgctgagcagaatcgagagccacgaggactgcagaaacctgcccatgatcagcttcctgatcctgcccatgcagagagtgaccagactgcccctgctgatggacaccatctgccagaagacccccaaggacagccccaagtacgaggtgtgcaagagagccctgaaggaggtgagcaagctggtgagactgtgcaacgagggcgccagaaagatggagagaaccgagatgatgtacaccatcaacagccagctggagttcaagatcaagcccttccccctggtgagcagcagcagatggctggtgaagagaggcgagctgaccgcctacgtggaggacaccgtgctgttcagcagaagaaccagcaagcagcaggtgtacttcttcctgttcaacgacgtgctgatcatcaccaagaagaagagcgaggagagctacaacgtgaacgactacagcctgagagaccagctgctggtggagagctgcgacaacgaggagctgaacagcagccccggcaagaacagcagcaccatgctgtacagcagacagagcagcgccagccacctgttcaccctgaccgtgctgagcaaccacgccaacgagaaggtggagatgctgctgggcgccgagacccagagcgagagagccagatggatcaccgccctgggccacagcagcggcaagccccccgccgacagaacctgcggctag

SEQ ID NO: 24337 - DNA, 2613 bp, Artificial Sequence
  Description of Artificial Sequence: Synthetic coding sequence
atggagaagaccaagaccaagcagggcgagaacgagcacatgcccgtgaacaaccccagcacccagatctaccagctgcaggccctggccagcgagctgaagaccggcttcaccgaggccatgcaggagctgagcagaatccagcacggcgagtacgccctggaggagaaggtgaagagctgcagatgcagcatggaggagaaggtgaccgagatgaagaacagcctgaactacttcaaggaggagctgagcaacgccatgagcatgatccaggccatcaccagcaagcaggaggagatgcagcagaagatcgagcagctgcagcaggagaagagaagagagagcagaaaggtgaaggccaagaagacccagaaggaggagcacagcagccaggccggccccgcccaggcccagggcagccccttcagaagcatcaacatccccgagcccgtgctgcccagcgaggacttcaccaacctgctgcccagccaggcctacgagaaggcccaggagagcagaagcgtgcacgtgggcgacagcaacgtgaagggcatgatgggccccggcgtgaaccccaccacccccgaggccgaggagaacctgaagagctgcctgagcgccgacatccagagcaagggccacctgcccagcggcatgtggagacagcccaaggacggcaaggagtggggcgaggagtacgtgaccaaggaccaccccgacaagctgaaggaggccggccagggcagacacagcagcctggagaacgtgctgtgcgagaccagcctggccgccaagagacagaccgtggccctggagctgctggagagcgagagaaagtacgtgatcaacatcagcctgatcctgaagatcaaggccaccttccagggcagcgacggcaagagaaacagcaaggagagaagcctgttccccggcagcctgagatacctggtgcagcagcacctggacctgctgcacgccctgcaggagagagtgctgaagtggcccagacagggcgtgctgggcgacctgttcctgaagctgaccaacgacgagaacaacttcctggactactacgtggcctacctgagagacctgcccgagtgcatcagcctggtgcacgtggtggtgctgaaggagggcgacgaggagatcaagagcgacatctacaccctgttcttccacatcgtgcagagaatccccgagtacctgatccacctgcagaacgtgctgaagttcaccgagcaggagcaccccgactactacctgctgctggtgtgcgtgcagagactgagagtgttcatcagccactacaccctgctgttccagtgcaacgaggacctgctgatccagaagagaaagaagctgaagaagagcagcatggccaagctgtacaagggcctggccagccagtgcgccaacgccggccaggacgccagccccaccgccggccccgaggccgtgagagacaccggcatccacagcgaggagctgctgcagccctaccccagcgcccccagcagcggccccgccatcacccacctgatgccccccgtgaagaagagccagcagcagcagagcctgatggagagcatgcagcccggcaagcccagcgactgggagctggagggcagaaagcacgagagacccgagagcctgctggcccccacccagttctgcgccgccgagcaggacgtgaaggccctggccggccccctgcaggccatccccgagatggacttcgagagcagccccgccgagcccctgggcaacgtggagagaagcctgagagcccccgccgagctgctgcccgacgccagaggcttcgtgcccgccgcctacgaggagttcgagtacggcggcgagatcttcgccctgcccgccccctacgacgaggagcccttccaggcccccgccctgttcgagaactgcagccccgccagcagcgagagcagcctggacatctgcttcctgagacccgtgagcttcgccatggaggccgagagacccgagcaccccctgcagcccctgcccaagagcgccaccagccccgccggcagcagcagcgcctacaagctggaggccgccgcccaggcccacggcaaggccaagcccctgagcagaagcctgaaggagttccccagagccccccccgccgacggcgtggcccccagactgtacagcaccagaagcagcagcggcggcagagcccccatcaaggccgagagagccgcccaggcccacggccccgccgccgccgccgtggccgccagaggcgccagcagaaccttcttcccccagcagagaagccagagcgagaagcagacctacctggaggtgagaagagagatgcacctggaggacaccaccagattctgccccaaggaggagagagagagcgagcagaccagcttcagcgaccagaaccccagacaggaccagaagggcggcttcagaagcagcttcagaaagctgttcaagaagaagagcagcggcagcgagtacagagagaagaccaacgagaaccccagcatggaccccagccccaccaagcaggacttcttcagaaacagactggccctggccaacgacctggaccagggcaccgccgtgtag

SEQ ID NO: 24338 - DNA, 2535 bp, Artificial Sequence
  Description of Artificial Sequence: Synthetic coding sequence
atggagaagaccaagaccaagcagggcgagaacgagcacatgcccgtgaacaaccccagcacccagatctaccagctgcaggccctggccagcgagctgaagaccggcttcaccgaggccatgcaggagctgagcagaatccagcacggcgagtacgccctggaggagaaggtgaagagctgcagatgcagcatggaggagaaggtgaccgagatgaagaacagcctgaactacttcaaggaggagctgagcaacgccatgagcatgatccaggccatcaccagcaagcaggaggagatgcagcagaagatcgagcagctgcagcaggagaagagaagagagagcagaaaggtgaaggccaagaagacccagaaggaggagcacagcagccaggccggccccgcccaggcccagggcagccccttcagaagcatcaacatccccgagcccgtgctgcccagcgaggacttcaccaacctgctgcccagccaggcctacgagaaggcccaggagagcagaagcgtgcacgtgggcgacagcaacgtgaagggcatgatgggccccggcgtgaaccccaccacccccgaggccgaggagaacctgaagagctgcctgagcgccgacatccagagcaagggccacctgcccagcggcatgtggagacagcccaaggacggcaaggagtggggcgaggagtacgtgaccaaggaccaccccgacaagctgaaggaggccggccagggcagacacagcagcctggagaacgtgctgtgcgagaccagcctggccgccaagagacagaccgtggccctggagctgctggagagcgagagaaagtacgtgatcaacatcagcctgatcctgaagatcaaggccaccttccagggcagcgacggcaagagaaacagcaaggagagaagcctgttccccggcagcctgagatacctggtgcagcagcacctggacctgctgcacgccctgcaggagagagtgctgaagtggcccagacagggcgtgctgggcgacctgttcctgaagctgaccaacgacgagaacaacttcctggactactacgtggcctacctgagagacctgcccgagtgcatcagcctggtgcacgtggtggtgctgaaggagggcgacgaggagatcaagagcgacatctacaccctgttcttccacatcgtgcagagaatccccgagtacctgatccacctgcagaacgtgctgaagttcaccgagcaggagcaccccgactactacctgctgctggtgtgcgtgcagagactgagagtgttcatcagccactacaccctgctgttccagtgcaacgaggacctgctgatccagaagagaaagaagctgaagaagagcagcatggccaagctgtacaagggcctggccagccagtgcgccaacgccggccaggacgccagccccaccgccggccccgaggccgtgagagacaccggcatccacagcgaggagctgctgcagccctaccccagcgcccccagcagcggccccgccatcacccacctgatgccccccgtgaagaagagccagcagcagcagagcctgatggagagcatgcagcccggcaagcccagcgactgggagctggagggcagaaagcacgagagacccgagagcctgctggcccccacccagttctgcgccgccgagcaggacgtgaaggccctggccggccccctgcaggccatccccgagatggacttcgagagcagccccgccgagcccctgggcaacgtggagagaagcctgagagcccccgccgagctgctgcccgacgccagaggcttcgtgcccgccgcctacgaggagttcgagtacggcggcgagatcttcgccctgcccgccccctacgacgaggagcccttccaggcccccgccctgttcgagaactgcagccccgccagcagcgagagcagcctggacatctgcttcctgagacccgtgagcttcgccatggaggccgagagacccgagcaccccctgcagcccctgcccaagagcgccaccagccccgccggcagcagcagcgcctacaagctggaggccgccgcccaggcccacggcaaggccaagcccctgagcagaagcctgaaggagttccccagagccccccccgccgacggcgtggcccccagactgtacagcaccagaagcagcagcggcggcagagcccccatcaaggccgagagagccgcccaggcccacggccccgccgccgccgccgtggccgccagaggcgccagcagaaccttcttcccccagcagagaagccagagcgagaagcagacctacctggaggtgagaagagagatgcacctggaggacaccaccagattctgccccaaggaggagagagagagcgagcagaccagcttcagcgaccagaaccccagacaggaccagaagggcggcttcagaagcagcttcagaaagctgttcaagaagaagaacggcaacgccaccggcgaggacttctgcggcccctggggctggtggtag

SEQ ID NO: 24339 - DNA, 2613 bp, Artificial Sequence; identical to SEQ ID NO: 24337
  Description of Artificial Sequence: Synthetic coding sequence

SEQ ID NO: 24340 - DNA, 1455 bp, Artificial Sequence
  Description of Artificial Sequence: Synthetic coding sequence
atggaggccgaggaggcccagcacggcgccagcccccccatcagcgccatcgaggagttcagcatcatccccgaggcccccatgagaagcagccaggtgagcgccctgggcctggaggcccaggaggacgaggaccccagctacaagtggagagaggagcacagactgagcgccacccagcagagcgagctgagagacgtgtgcgactacgccatcgagaccatgcccagcttccccaaggagggcagcgccgacgtggagcccaaccaggagagcctggtggccgaggcctgcgacacccccgagcactgggaggccgtgccccagagcctggccggcagacaggccagaaccctggccccccccgagctgtgggcctgccccatccagagcgagcacctggacatggcccccttcagcagcgacctgggcagcgaggaggaggaggtggagttctggcccggcctgaccagcctgaccctgggcagcggccaggccgaggaggaggaggagaccagcagcgacaacagcggccagaccagatactacagcccctgcgaggagcaccccgccgagaccaaccagaacgagggcgccgagagcggcaccatcagacagggcgaggagctgcccagcgaggagctgcaggagagccagggcctgctgcacccccaggaggtgcaggtgctggaggagcagggccagcaggaggccggcttcagaggcgagggcaccctgagagaggacgtgtgcgccgacggcctgctgggcgaggagcagatgatcgagcaggtgaacgacgagaagggcgagcagaagcagaagcaggagcaggtgcaggacgtgatgctgggcagacagggcgagagaatgggcctgaccggcgagcccgagggcctgaacgacggcgagtgggagcaggaggacatggagagaaaggcccagggccagggcggccccgagcagggcgaggagagaaagagagagctgcaggtgcccgaggagaacagagccgacagccaggacgagaagagccagaccttcctgggcaagagcgaggaggtgaccggcaagcaggaggaccacggcatcaaggagaagggcgtgcccgtgagcggccaggaggccaaggagcccgagagctgggacggcggcagactgggcgccgtgggcagagccagaagcagagaggaggagaacgagcaccacggccccagcatgcccgccctgatcgcccccgaggacagcccccactgcgacctgttccccggcgccagctacctggtgacccagatccccggcacccagaccgagagcagagccgaggagctgagccccgccgccctgagccccctgctggagcccatcagatgcagccaccagcccatcagcctgctgggcagcttcctgaccgaggagagccccgacaaggagaagctgctgagcgtgctgtag

SEQ ID NO: 24341 - DNA, 1455 bp, Artificial Sequence; identical to SEQ ID NO: 24340
  Description of Artificial Sequence: Synthetic coding sequence

SEQ ID NO: 24342 - DNA, 672 bp, Artificial Sequence
  Description of Artificial Sequence: Synthetic coding sequence
atgctgggcgtgaccaccgtgagaagcagaatgagaagagccctggtgttcggcatggtggtgcccagcgtgctggtgccctggctgctgctgggcgccagctggctgatcccccagaccagcttcctgagcaacgtgtgcggcctgagcatcggcctggcctacggcctgacctactgctacagcatcgacctgagcgagagagtggccctgaagctggaccagaccttccccttcagcctgatgagaagaatcagcgtgttcaagtacgtgagcggcagcagcgccgagagaagagccgcccagagcagaaagctgaaccccgtgcccggcagctaccccacccagagctgccacccccacctgagccccagccaccccgtgagccagacccagcacgccagcggccagaagctggccagctggcccagctgcacccccggccacatgcccaccctgcccccctaccagcccgccagcggcctgtgctacgtgcagaaccacttcggccccaaccccaccagcagcagcgtgtaccccgccagcgccggcaccagcctgggcatccagccccccacccccgtgaacagccccggcaccgtgtacagcggcgccctgggcacccccggcgccgccggcagcaaggagagcagcagagtgcccatgccctag

SEQ ID NO: 24343 - DNA, 2013 bp, Artificial Sequence
  Description of Artificial Sequence: Synthetic coding sequence
atgatcctggaggagagacccgacggcgccggcgccggcgaggagagccccagactgcagggctgcgacagcctgacccagatccagtgcggccagctgcagagcagaagagcccagatccaccagcagatcgacaaggagctgcagatgagaaccggcgccgagaacctgtacagagccaccagcaacaacagagtgagagagaccgtggccctggagctgagctacgtgaacagcaacctgcagctgctgaaggaggagctggaggagctgagcggcggcgtggaccccggcagacacggcagcgaggccgtgaccgtgcccatgatccccctgggcctgaaggagaccaaggagctggactggagcacccccctgaaggagctgatcagcgtgcacttcggcgaggacggcgccagctacgaggccgagatcagagagctggaggccctgagacaggccatgagaacccccagcagaaacgagagcggcctggagctgctgaccgcctactacaaccagctgtgcttcctggacgccagattcctgacccccgccagaagcctgggcctgttcttccactggtacgacagcctgaccggcgtgcccgcccagcagagagccctggccttcgagaagggcagcgtgctgttcaacatcggcgccctgcacacccagatcggcgccagacaggacagaagctgcaccgagggcgccagaagagccatggaggccttccagagagccgccggcgccttcagcctgctgagagagaacttcagccacgcccccagccccgacatgagcgccgccagcctgtgcgccctggagcagctgatgatggcccaggcccaggagtgcgtgttcgagggcctgagcccccccgccagcatggccccccaggactgcctggcccagctgagactggcccaggaggccgcccaggtggccgccgagtacagactggtgcacagaaccatggcccagccccccgtgcacgactacgtgcccgtgagctggaccgccctggtgcacgtgaaggccgagtacttcagaagcctggcccactaccacgtggccatggccctgtgcgacggcagccccgccaccgagggcgagctgcccacccacgagcaggtgttcctgcagccccccaccagcagcaagcccagaggccccgtgctgccccaggagctggaggagagaagacagctgggcaaggcccacctgaagagagccatcctgggccaggaggaggccctgagactgcacgccctgtgcagagtgctgagagaggtggacctgctgagagccgtgatcagccagaccctgcagagaagcctggccaagtacgccgagctggacagagaggacgacttctgcgaggccgccgaggcccccgacatccagcccaagacccaccagaagcccgaggccagaatgcccagactgagccagggcaagggccccgacatcttccacagactgggccccctgagcgtgttcagcgccaagaacagatggagactggtgggccccgtgcacctgaccagaggcgagggcggcttcggcctgaccctgagaggcgacagccccgtgctgatcgccgccgtgatccccggcagccaggccgccgccgccggcctgaaggagggcgactacatcgtgagcgtgaacggccagccctgcagatggtggagacacgccgaggtggtgaccgagctgaaggccgccggcgaggccggcgccagcctgcaggtggtgagcctgctgcccagcagcagactgcccagcctgggcgacagaagacccgtgctgctgggccccagaggcctgctgagaagccagagagagcacggctgcaagacccccgccagcacctgggccagccccagacccctgctgaactggagcagaaaggcccagcagggcaagaccggcggctgcccccagccctgcgcccccgtgaagcccgccccccccagcagcctgaagcaccccggctggccctag

SEQ ID NO: 24344 - DNA, 546 bp, Artificial Sequence
  Description of Artificial Sequence: Synthetic coding sequence
atgtacaacatcaagcagagcaccgacaccaaggaggccgccgccatcgaggccagaagaaacagagagaaggagagacagaacagattcttcaacgtgagaaacagagtgatgggcgtggacgtgcaggccctgaacaaccaggtgggcgacagaaagagaagagaggccgccgagagaagcaaggaggccgcctacggcaccagccaggtgcagtacgacgtggtggtgcagatgctggagaaggaggaggccgacagaaccagacagctggccaagaaggtgcaggagttcagagagcagaagcagcagctgaagaacggcagagagttcagcctgtgggaccccggccaggtgtggaagggcctgcccacctacctgagctacagcaacacctaccccggccccgccagcctgcagtacttcagcggcgaggacctggacagagacaccagactgagaatgcagcagggccagttcagatacaacctggagagacagcagcaggagcagcagcaggccaaggtggacgagaactacacctag

SEQ ID NO: 24345 - DNA, 1140 bp, Artificial Sequence
  Description of Artificial Sequence: Synthetic coding sequence
atgtacaacatcaagcagagcaccgacaccaaggaggccgccgccatcgaggccagaagaaacagagagaaggagagacagaacagattcttcaacgtgagaaacagagtgatgggcgtggacgtgcaggccctgaacaaccaggtgggcgacagaaagagaagagaggccgccgagagaagcaaggaggccgcctacggcaccagccaggtgcagtacgacgtggtggtgcagatgctggagaaggaggaggccgacagaaccagacagctggccaagaaggtgcaggagttcagagagcagaagcagcagctgaagaacggcagagagttcagcctgtgggaccccggccaggtgtggaagggcctgcccacctacctgagctacagcaacacctaccccggccccgccagcctgcagtacttcagcggcgaggacctggacagagacaccagactgagaatgcagcagggccagttcagatacaacctggagagacagcagcaggagcagcagcaggccaaggtggacgagaactacaccgacgccctgagcaaccagctgagactggccatggacgcccaggccacccacctggccagactggaggagagctgcagagccgccatgatgtgcgccatggccaacgccaacaaggcccaggccgccgtgcaggccggcagacagagatgcgagagacagagagagcagaaggccaacctggccgagatccagcaccagagcaccagcgacctgctgaccgagaacccccaggtggcccagcaccccatggccccctacagagtgctgccctactgctggaagggcatgacccccgagcagcaggccgccatcagaaaggagcaggaggtgcagagaagcaagaagcaggcccacagacaggccgagaagaccctggacaccgagtggaagagccagaccatgagcagcgcccaggccgtgctggagctggaggagcaggagagagagctgtgcgccgtgttccagagaggcctgggcagcttcaaccagcagctggccaacgagcagaaggcccagcaggactacctgaacagcgtgatctacaccaaccagcccaccgcccagtaccaccagcagttcaacaccagcagcagatag

SEQ ID NO: 24346 - DNA, 717 bp, Artificial Sequence
  Description of Artificial Sequence: Synthetic coding sequence
atgtacaacatcaagcagagcaccgacaccaaggaggccgccgccatcgaggccagaagaaacagagagaaggagagacagaacagattcttcaacgtgagaaacagagtgatgggcgtggacgtgcaggccctgaacaaccaggtgggcgacagaaagagaagagaggccgccgagagaagcaaggaggccgcctacgacgccctgagcaaccagctgagactggccatggacgcccaggccacccacctggccagactggaggagagctgcagagccgccatgatgtgcgccatggccaacgccaacaaggcccaggccgccgtgcaggccggcagacagagatgcgagagacagagagagcagaaggccaacctggccgagatccagcaccagagcaccagcgacctgctgaccgagaacccccaggtggcccagcaccccatggccccctacagagtgctgccctactgctggaagggcatgacccccgagcagcaggccgccatcagaaaggagcaggaggtgcagagaagcaagaagcaggcccacagacaggccgagaagaccctggacaccgagtggaagagccagaccatgagcagcgcccaggccgtgctggagctggaggagcaggagagagagctgtgcgccgtgttccagagaggcctgggcagcttcaaccagcagctggccaacgagcagaaggcccagtag

SEQ ID NO: 24347 - DNA, 579 bp, Artificial Sequence
  Description of Artificial Sequence: Synthetic coding sequence
atgtacaacatcaagcagagcaccgacaccaaggaggccgccgccatcgaggccagaagaaacagagagaaggagagacagaacagattcttcaacgtgagaaacagagtgatgggcgtggacgtgcaggccctgaacaaccaggtgggcgacagaaagagaagagaggccgccgagagaagcaaggaggccgcctacggcaccagccaggtgcagtacgacgtggtggtgcagatgctggagaaggaggaggccgacagaaccagacagctggccaagaaggtgcaggagttcagagagcagaagcagcagctgaagaacggcagagagttcagcctgtgggaccccggccaggtgtggaagggcctgcccacctacctgagctacagcaacacctaccccggccccgccagcctgcagtacttcagcggcgaggacctggacagagacaccagactgagaatgcagcagggccagttcagatacaacctggagagacagcagcaggagcagcagcaggccaaggtggacgagaactacaccggcaagcagcccggcccccccgacagcgagacctag

SEQ ID NO: 24348 - DNA, 930 bp, Artificial Sequence
  Description of Artificial Sequence: Synthetic coding sequence
atgagacagaacgacaagatcatgtgcatcctggagaacagaaagaagagagacagaaagaacctgtgcagagccatcaacgacttccagcagagcttccagaagcccgagaccagaagagagttcgacctgagcgaccccctggccctgaagaaggacctgcccgccagacagagcgacaacgacgtgagaaacaccatcagcggcatgcagaagttcatgggcgaggacctgaacttccacgagagaaagaagttccaggaggagcagaacagagagtggagcctgcagcagcagagagagtggaagaacgccagagccgagcagaagtgcgccgaggccctgtacaccgagaccagactgcagttcgacgagaccgccaagcacctgcagaagctggagagcaccaccagaaaggccgtgtgcgccagcgtgaaggacttcaacaagagccaggccatcgagagcgtggagagaaagaagcaggagaagaagcaggagcaggaggacaacctggccgagatcaccaacctgctgagaggcgacctgctgagcgagaacccccagcaggccgccagcagcttcggcccccacagagtggtgcccgacagatggaagggcatgacccaggagcagctggagcagatcagactggtgcagaagcagcagatccaggagaagctgagactgcaggaggagaagagacagagagacctggactgggacagaagaagaatccagggcgccagagccaccctgctgttcgagagacagcagtggagaagacagagagacctgagaagagccctggacagcagcaacctgagcctggccaaggagcagcacctgcagaagaagtacatgaacgaggtgtacaccaaccagcccaccggcgactacttcacccagttcaacaccggcagcagatag

SEQ ID NO: 24349 - DNA, 1134 bp, Artificial Sequence
  Description of Artificial Sequence: Synthetic coding sequence
atggccgtggccctgcccagagacctgagacaggacgccaacctggccaagagaagacacgccgagctgtgcagacagaagagagtgttcaacgccagaaacagaatcatcggcggcgacaccgaggcctgggacgtgcaggtgcacgaccagaagatcaaggaggccaccgagaaggccagacacgagaccctggccgccgagatgagacagaacgacaagatcatgtgcatcctggagaacagaaagaagagagacagaaagaacctgtgcagagccatcaacgacttccagcagagcttccagaagcccgagaccagaagagagttcgacctgagcgaccccctggccctgaagaaggacctgcccgccagacagagcgacaacgacgtgagaaacaccatcagcggcatgcagaagttcatgggcgaggacctgaacttccacgagagaaagaagttccaggaggagcagaacagagagtggagcctgcagcagcagagagagtggaagaacgccagagccgagcagaagtgcgccgaggccctgtacaccgagaccagactgcagttcgacgagaccgccaagcacctgcagaagctggagagcaccaccagaaaggccgtgtgcgccagcgtgaaggacttcaacaagagccaggccatcgagagcgtggagagaaagaagcaggagaagaagcaggagcaggaggacaacctggccgagatcaccaacctgctgagaggcgacctgctgagcgagaacccccagcaggccgccagcagcttcggcccccacagagtggtgcccgacagatggaagggcatgacccaggagcagctggagcagatcagactggtgcagaagcagcagatccaggagaagctgagactgcaggaggagaagagacagagagacctggactgggacagaagaagaatccagggcgccagagccaccctgctgttcgagagacagcagtggagaagacagagagacctgagaagagccctggacagcagcaacctgagcctggccaaggagcagcacctgcagaagaagtacatgaacgaggtgtacaccaaccagcccaccggcgactacttcacccagttcaacaccggcagcagatag

SEQ ID NO: 24350 - DNA, 432 bp, Artificial Sequence
  Description of Artificial Sequence: Synthetic coding sequence
atggagaccttccccctgctgctgctgagcctgggcctggtgctggccgaggccagcgagagcaccatgaagatcatcaaggaggagttcaccgacgaggagatgcagtacgacatggccaagagcggccaggagaagcagaccatcgagatcctgatgaaccccatcctgctggtgaagaacaccagcctgagcatgagcaaggacgacatgagcagcaccctgctgaccttcagaagcctgcactacaacgaccccaagggcaacagcagcggcaacgacaaggagtgctgcaacgacatgaccgtgtggagaaaggtgagcgaggccaacggcagctgcaagtggagcaacaacttcatcagaagcagcaccgaggtgatgagaagagtgcacagagcccccagctgcaagttcgtgcagaacccctag

SEQ ID NO: 24351 - DNA, 555 bp, Artificial Sequence
  Description of Artificial Sequence: Synthetic coding sequence
atggtgagatacagcctggaccccgagaaccccaccaagagctgcaagagcagaggcagcaacctgagagtgcacttcaagaacaccagagagaccgcccaggccatcaagggcatgcacatcagaaaggccaccaagtacctgaaggacgtgaccctgcagaagcagtgcgtgcccttcagaagatacaacggcggcgtgggcagatgcgcccaggccaagcagtggggctggacccagggcagatggcccaagaagagcgccgagttcctgctgcacatgctgaagaacgccgagagcaacgccgagctgaagggcctggacgtggacagcctggtgatcgagcacatccaggtgaacaaggcccccaagatgagaagaagaacctacagagcccacggcagaatcaacccctacatgagcagcccctgccacatcgagatgatcctgaccgagaaggagcagatcgtgcccaagcccgaggaggaggtggcccagaagaagaagatcagccagaagaagctgaagaagcagaagctgatggccagagagtag

SEQ ID NO: 24352 - DNA, 441 bp, Artificial Sequence
  Description of Artificial Sequence: Synthetic coding sequence
atgcacatcagaaaggccaccaagtacctgaaggacgtgaccctgcagaagcagtgcgtgcccttcagaagatacaacggcggcgtgggcagatgcgcccaggccaagcagtggggctggacccagggcagatggcccaagaagagcgccgagttcctgctgcacatgctgaagaacgccgagagcaacgccgagctgaagggcctggacgtggacagcctggtgatcgagcacatccaggtgaacaaggcccccaagatgagaagaagaacctacagagcccacggcagaatcaacccctacatgagcagcccctgccacatcgagatgatcctgaccgagaaggagcagatcgtgcccaagcccgaggaggaggtggcccagaagaagaagatcagccagaagaagctgaagaagcagaagctgatggccagagagtag

SEQ ID NO: 24353 - DNA, 525 bp, Artificial Sequence
  Description of Artificial Sequence: Synthetic coding sequence
atggtgagatacagcctggaccccgagaaccccaccaagagctgcaagagcagaggcagcaacctgagagtgcacttcaagaacaccagagagaccgcccaggccatcaagggcatgcacatcagaaaggccaccaagtacctgaaggacgtgaccctgcagaagcagtgcgtgcccttcagaagatacaacggcggcgtgggcagatgcgcccaggccaagcagtggggctggacccagggcagatggcccaagaagagcgccgagttcctgctgcacatgctgaagaacgccgagagcaacgccgagctgaagggcctggacgtggacagcctggtgatcgagcacatccaggtgaacaaggcccccaagatgagaagaagaacctacagagcccacggcagaatcaacccctacatgagcagcccctgccacatcgagatgatcctgaccgagaaggagcagatcgtgcccaagcccgaggaggaggtggcccagaagaagaagatcagccagaagaagtag

SEQ ID NO: 24354 - DNA, 585 bp, Artificial Sequence
  Description of Artificial Sequence: Synthetic coding sequence
atgcccgtggccagaagctgggtgtgcagaaagacctacgtgacccccagaagacccttcgagaagagcagactggaccaggagctgaagctgatcggcgagtacggcctgagaaacaagagagaggtgtggagagtgaagttcaccctggccaagatcagaaaggccgccagagagctgctgaccctggacgagaaggaccccagaagactgttcgagggcaacgccctgctgagaagactggtgagaatcggcgtgctggacgagggcaagatgaagctggactacatcctgggcctgaagatcgaggacttcctggagagaagactgcagacccaggtgttcaagctgggcctggccaagagcatccaccacgccagagtgctgatcagacagagacacatcagagtgagaaagcaggtggtgaacatccccagcttcatcgtgagactggacagccagaagcacatcgacttcagcctgagaagcccctacggcggcggcagacccggcagagtgaagagaaagaacgccaagaagggccagggcggcgccggcgccggcgacgacgaggaggaggactag

SEQ ID NO: 24355 - DNA, 888 bp, Artificial Sequence
  Description of Artificial Sequence: Synthetic coding sequence
atgagcggcgccctggacgtgctgcagatgaaggaggaggacgtgctgaagttcctggccgccggcacccacctgggcggcaccaacctggacttccagatggagcactacatctacaagagaaagagcgacggcatctacatcatcaacctgaagagaacctgggagaagctgctgctggccgccagagccatcgtggccatcgagaaccccgccgacgtgagcgtgatcagcagcagaaacaccggccagagagccgtgctgaagttcgccgccgccaccggcgccacccccatcgccggcagattcacccccggcaccttcaccaaccagatccaggccgccttctgggagcccagactgctggtggtgaccgaccccagagccgaccaccagcccctgaccgaggccagctacgtgaacctgcccaccatcgccctgtgcaacaccgacagccccctgagatacgtggacatcgccatcccctgcaacaacaagggcgcccacagcgtgggcctgatgtggtggatgctggccagagaggtgctgagaatgagaggcaccatcagcagagagcacccctgggaggtgatgcccgacctgtacttctacagagaccccgaggagatcgagaaggaggagcaggccgccgccgagaaggccgtgaccaaggaggagttccagggcgagtggaccgcccccagccccgagttcaccgccacccagcccgaggtggccgactggagcgagggcgtgcaggtgcccagcgtgcccatccagcagttccccaccgaggactggagcgcccagcccgccaccgaggactggagcgccgcccccaccgcccaggccaccgagtgggtgggcgccaccaccgactggagctag

SEQ ID NO: 24356 - DNA, 843 bp, Artificial Sequence
  Description of Artificial Sequence: Synthetic coding sequence
atggtggccagaagaagaaagtgcgccgccagagaccccgaggacagaatccccagccccctgggctacgccgccatccccatcaagttcagcgagaagcagcaggccagccactacctgtacgtgagagcccacggcgtgagacagggcaccaagagcacctggccccagaagagaaccctgttcgtgctgaacgtgcccccctactgcaccgaggagagcctgagcagactgctgagcacctgcggcctggtgcagagcgtggagctgcaggagaagcccgacctggccgagagccccaaggagagcagaagcaagttcttccaccccaagcccgtgcccggcttccaggtggcctacgtggtgttccagaagcccagcggcgtgagcgccgccctggccctgaagggccccctgctggtgagcaccgagagccaccccgtgaagagcggcatccacaagtggatcagcgactacgccgacagcgtgcccgaccccgaggccctgagagtggaggtggacaccttcatggaggcctacgaccagaagatcgccgaggaggaggccaaggccaaggaggaggagggcgtgcccgacgaggagggctgggtgaaggtgaccagaagaggcagaagacccgtgctgcccagaaccgaggccgccagcctgagagtgctggagagagagagaagaaagagaagcagaaaggagctgctgaacttctacgcctggcagcacagagagagcaagatggagcacctggcccagctgagaaagaagttcgaggaggacaagcagagaatcgagctgctgagagcccagagaaagttcagaccctactag

SEQ ID NO: 24357 - DNA, 735 bp, Artificial Sequence
  Description of Artificial Sequence: Synthetic coding sequence
atggccgcccccagcgacggcttcaagcccagagagagaagcggcggcgagcaggcccaggactgggacgccctgccccccaagagacccagactgggcgccggcaacaagatcggcggcagaagactgatcgtggtgctggagggcgccagcctggagaccgtgaaggtgggcaagacctacgagctgctgaactgcgacaagcacaagagcatcctgctgaagaacggcagagaccccggcgaggccagacccgacatcacccaccagagcctgctgatgctgatggacagccccctgaacagagccggcctgctgcaggtgtacatccacacccagaagaacgtgctgatcgaggtgaacccccagaccagaatccccagaaccttcgacagattctgcggcctgatggtgcagctgctgcacaagctgagcgtgagagccgccgacggcccccagaagctgctgaaggtgatcaagaaccccgtgagcgaccacttccccgtgggctgcatgaaggtgggcaccagcttcagcatccccgtggtgagcgacgtgagagagctggtgcccagcagcgaccccatcgtgttcgtggtgggcgccttcgcccacggcaaggtgagcgtggagtacaccgagaagatggtgagcatcagcaactaccccctgagcgccgccctgacctgcgccaagctgaccaccgccttcgaggaggtgtggggcgtgatctag

SEQ ID NO: 24358 - DNA, 474 bp, Artificial Sequence
  Description of Artificial Sequence: Synthetic coding sequence
atgaacctggacggcagcgcccaggaccccgagaagagagagtacagcagcgtgtgcgtgggcagagaggacgacatcaagaagagcgagagaatgaccgccgtggtgcacgacagagaggtggtgatcttctaccacaagggcgagtaccacgccatggacatcagatgctaccacagcggcggccccctgcacctgggcgacatcgaggacttcgacggcagaccctgcatcgtgtgcccctggcacaagtacaagatcaccctggccaccggcgagggcctgtaccagagcatcaaccccaaggaccccagcgccaagcccaagtggtgcagcaagggcatcaagcagagaatccacaccgtgaccgtggacaacggcaacatctacgtgaccctgagcaacgagcccttcaagtgcgacagcgacttctacgccaccggcgacttcaaggtgatcaagagcagcagctag

SEQ ID NO: 24359 - DNA, 633 bp, Artificial Sequence
  Description of Artificial Sequence: Synthetic coding sequence
atgctgaagtgcttcagaaactgcctgagacccagcagcctgagcaccctgcccctgcagtacggcatcctgttccccaagctgctggcctgcctggtgcacctgcacttcggccacttcagcagcgccgtgatcagcgtgaccagcttctacctgagcatgaacctggacggcagcgcccaggaccccgagaagagagagtacagcagcgtgtgcgtgggcagagaggacgacatcaagaagagcgagagaatgaccgccgtggtgcacgacagagaggtggtgatcttctaccacaagggcgagtaccacgccatggacatcagatgctaccacagcggcggccccctgcacctgggcgacatcgaggacttcgacggcagaccctgcatcgtgtgcccctggcacaagtacaagatcaccctggccaccggcgagggcctgtaccagagcatcaaccccaaggaccccagcgccaagcccaagtggtgcagcaagggcatcaagcagagaatccacaccgtgaccgtggacaacggcaacatctacgtgaccctgagcaacgagcccttcaagtgcgacagcgacttctacgccaccggcgacttcaaggtgatcaagagcagcagctag

SEQ ID NO: 24360 - DNA, 633 bp, Artificial Sequence; identical to SEQ ID NO: 24359
  Description of Artificial Sequence: Synthetic coding sequence

SEQ ID NO: 24361 - DNA, 357 bp, Artificial Sequence
  Description of Artificial Sequence: Synthetic coding sequence
atgaacctggacggcagcgcccaggaccccgagaagagagagtacagcagcgtgtgcgtgggcagagaggacgacatcaagaagagcgagagaatgaccgccgtggtgcacgacagagaggtggtgatcttctaccacaagggcgagtaccacgccatggacatcagatgctaccacagcggcggccccctgcacctgggcgacatcgaggacttcgacggcagaccctgcatcgtgtgcccctggcacaagtacaagatcaccctggccaccggcgagggcctgtaccagagcatcaaccccaaggaccccagcgccaagcccaagtggtgcagcaagggcatcaagcagagatag

SEQ ID NO: 24362 - DNA, 1032 bp, Artificial Sequence
  Description of Artificial Sequence: Synthetic coding sequence
atggccgagcagctgagccccggcaaggccgtggaccaggtgtgcaccttcctgttcaagaagcccggcagaaagggcgccgccggcagaagaaagagacccgcctgcgaccccgagcccggcgagagcggcagcagcagcgacgagggctgcaccgtggtgagacccgagaagaagagagtgacccacaaccccatgatccagaagaccagagacagcggcaagcagaaggccgcctacggcgacctgagcagcgaggaggaggaggagaacgagcccgagagcctgggcgtggtgtacaagagcaccagaagcgccaagcccgtgggccccgaggacatgggcgccaccgccgtgtacgagctggacaccgagaaggagagagacgcccaggccatcttcgagagaagccagaagatccaggaggagctgagaggcaaggaggacgacaagatctacagaggcatcaacaactaccagaagtacatgaagcccaaggacaccagcatgggcaacgccagcagcggcatggtgagaaagggccccatcagagcccccgagcacctgagagccaccgtgagatgggactaccagcccgacatctgcaaggactacaaggagaccggcttctgcggcttcggcgacagctgcaagttcctgcacgacagaagcgactacaagcacggctggcagatcgagagagagctggacgagggcagatacggcgtgtacgaggacgagaactacgaggtgggcagcgacgacgaggagatccccttcaagtgcttcatctgcagacagagcttccagaaccccgtggtgaccaagtgcagacactacttctgcgagagctgcgccctgcagcacttcagaaccacccccagatgctacgtgtgcgaccagcagaccaacggcgtgttcaaccccgccaaggagctgatcgccaagctggagaagcacagagccaccggcgagggcggcgccagcgacctgcccgaggaccccgacgaggacgccatccccatcacctag

SEQ ID NO: 24363 - DNA, 969 bp, Artificial Sequence
  Description of Artificial Sequence: Synthetic coding sequence
atggccgccccccccagccccggcagaaccgccgaccaggccgaccaggtgtgcaccttcctgttcaagaagcccggcagaaagggcgccgccggcctgagaaagagacccgcctgcgaccccgagcacggcgagagcagcagcagcggcgacgagggcgacaccgtggcccagccccccagagtggcccccagacccagaggcctgcacagctggcagaaggccgcccacggcgacagaagaggcgaggaggccgcccccgagagcctggacgtggtgtacagaagcaccagaagcgccaagcccgtgggccccgaggacatgggcgccaccgccgacttcgagcaggacaccgagaaggagcaccacacccccaccatcctgaagtgcagccagagagtgcaggaggccctgagaggcagagagcacgaccacatctacagaggcatccacagctacctgagatacctgaagcccaaggacaccagcatgggcaacagcagcagcggcatggccagaaagggccccatcagagcccccggccacctgagagccaccgtgagatgggactaccagcccgacatctgcaaggactacaaggagaccggcttctgcggcttcggcgacagctgcaagttcctgcacgacagaagcgactacaagctgggctgggagatcgagagagagctggaggagggcagatactgcatctgcgaggacgagaaccacgaggtgggcagcgaggaggaggagatccccttcagatgcttcatctgcagacaggccttccagaaccccgtggtgaccaagtgcagacactacttctgcgagagctgcgccctggagcacttcagagccacccccagatgctacatctgcgaccagcccaccggcggcatcttcaaccccgccaaggagctgatggccaagctgcagaagctgcaggccgccgagggcaagaagagatag

SEQ ID NO: 24364 - DNA, 516 bp, Artificial Sequence
  Description of Artificial Sequence: Synthetic coding sequence
atgagcagcaagagaaccaagaccaagaccaagaagagaccccagagagccaccagcaacgtgttcgccatgttcgaccagagccagatccaggagttcaaggaggccttcaacatgatcgaccagaacagagacggcttcatcgacaaggaggacctgcacgacatgctggccagcctgggcaagaaccccaccgacgagtacctggacgccatgatgaacgaggcccccggccccatcaacttcaccatgttcctgaccatgttcggcgagaagctgaacggcaccgaccccgaggacgtgatcagaaacgccttcgcctgcttcgacgaggaggccaccggcaccatccaggaggactacctgagagagctgctgaccaccatgggcgacagattcaccgacgaggaggtggacgagctgtacagagaggcccccatcgacaagaagggcaacttcaactacatcgagttcaccagaatcctgaagcacggcgccaaggacaaggacgactag

SEQ ID NO: 24365 - DNA, 936 bp, Artificial Sequence
  Description of Artificial Sequence: Synthetic coding sequence
atggccgaggccagcccccaccccggcagatacttctgccactgctgcagcgtggagatcgtgcccagactgcccgactacatctgccccagatgcgagagcggcttcatcgaggagctgcccgaggagaccagaagcaccgagaacggcagcgcccccagcaccgcccccaccgaccagagcagaccccccctggagcacgtggaccagcacctgttcaccctgccccagggctacggccagttcgccttcggcatcttcgacgacagcttcgagatccccaccttcccccccggcgcccaggccgacgacggcagagaccccgagagcagaagagagagagaccaccccagcagacacagatacggcgccagacagcccagagccagactgaccaccagaagagccaccggcagacacgagggcgtgcccaccctggagggcatcatccagcagctggtgaacggcatcatcacccccgccaccatccccagcctgggcccctggggcgtgctgcacagcaaccccatggactacgcctggggcgccaacggcctggacgccatcatcacccagctgctgaaccagttcgagaacaccggccccccccccgccgacaaggagaagatccaggccctgcccaccgtgcccgtgaccgaggagcacgtgggcagcggcctggagtgccccgtgtgcaaggacgactacgccctgggcgagagagtgagacagctgccctgcaaccacctgttccacgacggctgcatcgtgccctggctggagcagcacgacagctgccccgtgtgcagaaagagcctgaccggccagaacaccgccaccaacccccccggcctgaccggcgtgagcttcagcagcagcagcagcagcagcagcagcagcagccccagcaacgagaacgccaccagcaacagctag

SEQ ID NO: 24366 - DNA, 984 bp, Artificial Sequence
  Description of Artificial Sequence: Synthetic coding sequence
atggccgaggccagcccccaccccggcagatacttctgccactgctgcagcgtggagatcgtgcccagactgcccgactacatctgccccagatgcgagagcggcttcatcgaggagctgcccgaggagaccagaagcaccgagaacggcagcgcccccagcaccgcccccaccgaccagagcagaccccccctggagcacgtggaccagcacctgttcaccctgccccagggctacggccagttcgccttcggcatcttcgacgacagcttcgagatccccaccttcccccccggcgcccaggccgacgacggcagagaccccgagagcagaagagagagagaccaccccagcagacacagatacggcgccagacagcccagagccagactgaccaccagaagagccaccggcagacacgagggcgtgcccaccctggagggcatcatccagcagctggtgaacggcatcatcacccccgccaccatccccagcctgggcccctggggcgtgctgcacagcaaccccatggactacgcctggggcgccaacggcctggacgccatcatcacccagctgctgaaccagttcgagaacaccggccccccccccgccgacaaggagaagatccaggccctgcccaccgtgcccgtgaccgaggagcacgtgggcagcggcctggagtgccccgtgtgcaaggacgactacgccctgggcgagagagtgagacagctgccctgcaaccacctgttccacgacggctgcatcgtgccctggctggagcagcacgacagctgccccgtgtgcagaaagagcctgaccggccagaacaccgccaccaacccccccggcctgaccggcgtgagcttcagcagcagcagcagcagcagcagcagcagcagccccagcaacgagaacgccaccacctggagccccctgggcagaccccagccccccagacccctgagcaacctgaccctgtag

SEQ ID NO: 24367 - DNA, 456 bp, Artificial Sequence
  Description of Artificial Sequence: Synthetic coding sequence
atggccgaggacctgagcgccgccaccagctacaccgaggacgacttctactgccccgtgtgccaggaggtgctgaagacccccgtgagaaccaccgcctgccagcacgtgaacagaagcgagaccagcaccagcgacaacaccgagacctaccaggagaacaccagcagcagcggccaccccaccttcaagtgccccctgtgccaggagagcaacttcaccagacagagactgctggaccactgcaacagcaaccacctgttccagatcgtgcccgtgacctgccccatctgcgtgagcctgccctggggcgaccccagccagatcaccagaaacttcgtgagccacctgaaccagagacaccagttcgactacggcgagttcgtgaacctgcagctggacgaggagacccagtaccagaccgccgtggaggagagcttccaggtgaacatctag

SEQ ID NO: 24368 - DNA, 738 bp, Artificial Sequence
  Description of Artificial Sequence: Synthetic coding sequence
atggccgaggacctgagcgccgccaccagctacaccgaggacgacttctactgccccgtgtgccaggaggtgctgaagacccccgtgagaaccaccgcctgccagcacgtgttctgcagaaagtgcttcctgaccgccatgagagagagcggcgcccactgccccctgtgcagaggcaacgtgaccagaagagagagagcctgccccgagagagccctggacctggagaacatcatgagaaagttcagcggcagctgcagatgctgcgccaagcagatcaagttctacagaatgagacaccactacaagagctgcaagaagtaccaggacgagtacggcgtgagcagcatcatccccaacttccagatcagccaggacagcgtgggcaacagcaacagaagcgagaccagcaccagcgacaacaccgagacctaccaggagaacaccagcagcagcggccaccccaccttcaagtgccccctgtgccaggagagcaacttcaccagacagagactgctggaccactgcaacagcaaccacctgttccagatcgtgcccgtgacctgccccatctgcgtgagcctgccctggggcgaccccagccagatcaccagaaacttcgtgagccacctgaaccagagacaccagttcgactacggcgagttcgtgaacctgcagctggacgaggagacccagtaccagaccgccgtggaggagagcttccaggtgaacatctag

SEQ ID NO: 24369 - DNA, 693 bp, Artificial Sequence
  Description of Artificial Sequence: Synthetic coding sequence
atgggccagcagatcagcgaccagacccagctggtgatcaacaagctgcccgagaaggtggccaagcacgtgaccctggtgagagagagcggcagcctgacctacgaggagttcctgggcagagtggccgagctgaacgacgtgaccgccaaggtggccagcggccaggagaagcacctgctgttcgaggtgcagcccggcagcgacagcagcgccttctggaaggtggtggtgagagtggtgtgcaccaagatcaacaagagcagcggcatcgtggaggccagcagaatcatgaacctgtaccagttcatccagctgtacaaggacatcaccagccaggccgccggcgtgctggcccagagcagcaccagcgaggagcccgacgagaacagcagcagcgtgaccagctgccaggccagcctgtggatgggcagagtgaagcagctgaccgacgaggaggagtgctgcatctgcatggacggcagagccgacctgatcctgccctgcgcccacagcttctgccagaagtgcatcgacaagtggagcgacagacacagaaactgccccatctgcagactgcagatgaccggcgccaacgagagctgggtggtgagcgacgcccccaccgaggacgacatggccaactacatcctgaacatggccgacgaggccggccagccccacagaccctag

SEQ ID NO: 24370 - DNA, 543 bp, Artificial Sequence
  Description of Artificial Sequence: Synthetic coding sequence
atgggccagcagatcagcgaccagacccagctggtgatcaacaagctgcccgagaaggtggccaagcacgtgaccctggtgagagagagcggcagcctgacctacgaggagttcctgggcagagtggccgagctgaacgacgtgaccgccaaggtggccagcggccaggagaagcacctgctgttcgaggtgcagcccggcagcgacagcagcgccttctggaaggtggtggtgagagtggtgtgcaccaagatcaacaagagcagcggcatcgtggaggccagcagaatcatgaacctgtaccagttcatccagctgtacaaggacatcaccagccaggccgccggcgtgctggcccagagcagcaccagcgaggagcccgacgagaacagcagcagcgtgaccagctgccaggccagcctgtggatgggcagagtgaagcagctgaccgacgaggaggagtgctgcatctgcatggacggcagagccgacctgatcctgccctgcgcccacagcttctgccagaagtgcatcgacaagtag

SEQ ID NO: 24371 - DNA, 2040 bp, Artificial Sequence
  Description of Artificial Sequence: Synthetic coding sequence
atgggcgccctgaccagcagacagcacgccggcgtggaggaggtggacatccccagcaacagcgtgtacagatacccccccaagagcggcagctacttcgccagccacttcatcatgggcggcgagaagttcgacagcacccaccccgagggctacctgttcggcgagaacagcgacctgaacttcctgggcaacagacccgtggtgttcccctacgccgccccccccccccaggagcccgtgaagaccctgagaagcctggtgaacatcagaaaggacaccctgagactggtgaagtgcgccgaggaggtgaagagccccggcgaggaggccagcaaggccaaggtgcactacaacgtggagttcaccttcgacaccgacgccagagtggccatcaccatctactaccaggccaccgaggagttccagaacggcatcgccagctacatccccaaggacaacagcctgcagagcgagaccgtgcagtacaagagaggcgtgtgccagcagttctgcctgcccagccacaccgtggaccccagcgagtgggccgaggaggagctgggcttcgacctggacagagaggtgtaccccctggtggtgcacgccgtggtggacgagggcgacgagtacttcggccactgccacgtgctgctgggcaccttcgagaagcacaccgacggcaccttctgcgtgaagcccctgaagcagaagcaggtggtggacggcgtgagctacctgctgcaggagatctacggcatcgagaacaagtacaacacccaggacagcaaggtggccgaggacgaggtgagcgacaacagcgccgagtgcgtggtgtgcctgagcgacgtgagagacaccctgatcctgccctgcagacacctgtgcctgtgcaacacctgcgccgacaccctgagataccaggccaacaactgccccatctgcagactgcccttcagagccctgctgcagatcagagccatgagaaagaagctgggccccctgagccccaccagcttcaaccccatcatcagcagccagaccagcgacagcgaggagcaccccagcagcgagaacatcccccccggctacgaggtggtgagcctgctggaggccctgaacggccccctgacccccagccccgccgtgccccccctgcacgtgctgggcgacggccacctgagcggcatgctgcccagctacggcagcgacggccacctgccccccgtgagaaccatcagccccctggacagactgagcgacagcagcagccagggcctgaagctgaagaagagcctgagcaagagcaccagccagaacagcagcgtgctgcacgaggaggaggacgagcacagctgcagcgagagcgagacccagctgagccagagacccagcgtgcagcacctgggcgaggagtgcggcgtgacccccgagagcgagaacctgaccctgagcagcagcggcgccatcgaccagagcagctgcaccggcacccccctgagcagcaccatcagcagccccgagggccccgccagcagcagcctggcccagagcgtgatgagcatggccagcagccagatcagcaccgacaccgtgagcagcatgagcggcagctacatcgcccccggcaccgaggaggagggcgaggccctgagcagcccccagcccgccagcagagcccccagcgaggagggcgagggcctgcccgccgagagccccgacagcaacttcgccggcctgcccgccggcgagcaggacgccgagggcaacgacgtgatcgaggaggaggacggcagccccacccaggagggccagagaacctgcgccttcctgggcatggagtgcgacaacaacaacgacttcgacatcgccagcgtgaaggccctggacaacaagctgtgcagcgaggtgtgcctgcccggcgcctggcaggccgacgacaacgccgtgagcagaaacgcccagagaagaagactgagcagcagcagcctggaggacagcgagaccagaccctgcgtgtggggccccctggccgtgtag

SEQ ID NO: 24372 - DNA, 1143 bp, Artificial Sequence
  Description of Artificial Sequence: Synthetic coding sequence
atgggcggcgagaagttcgacagcacccaccccgagggctacctgttcggcgagaacagcgacctgaacttcctgggcaacagacccgtggtgttcccctacgccgccccccccccccaggagcccgtgaagaccctgagaagcctggtgaacatcagaaaggacaccctgagactggtgaagtgcgccgaggaggtgaagagccccggcgaggaggccagcaaggccaaggtgcactacaacgtggagttcaccttcgacaccgacgccagagtggccatcaccatctactaccaggccaccgaggagttccagaacggcatcgccagctacatccccaaggacaacagcctgcagagcgagaccgtgcagtacaagagaggcgtgtgccagcagttctgcctgcccagccacaccgtggaccccagcgagtgggccgaggaggagctgggcttcgacctggacagagaggtgtaccccctggtggtgcacgccgtggtggacgagggcgacgagtacttcggccactgccacgtgctgctgggcaccttcgagaagcacaccgacggcaccttctgcgtgaagcccctgaagcagaagcaggtggtggacggcgtgagctacctgctgcaggagatctacggcatcgagaacaagtacaacacccaggacagcaaggtggccgaggacgaggtgagcgacaacagcgccgagtgcgtggtgtgcctgagcgacgtgagagacaccctgatcctgccctgcagacacctgtgcctgtgcaacacctgcgccgacaccctgagataccaggccaacaactgccccatctgcagactgcccttcagagccctgctgcagatcagagccatgagaaagaagctgggccccctgagccccaccagcttcaaccccatcatcagcagccagaccagcgacagcgaggagcaccccagcagcgagaacatcccccccggctacgaggtggtgagcctgctggaggccctgaacggccccctgaccccccccagcctgctgaagatccagaagatcagctgggcctggctgcaggcccccgtggtgcccgccacctgggaggccgaggccggcgagtggcccgagcccggcagaagaagcctgcagtag

SEQ ID NO: 24373 - DNA, 1974 bp, Artificial Sequence
  Description of Artificial Sequence: Synthetic coding sequence
atgggcgccctgaccagcagacagcacgccggcgtggaggaggtggacatccccagcaacagcgtgtacagatacccccccaagagcggcagctacttcgccagccacttcatcatgggcggcgagaagttcgacagcacccaccccgagggctacctgttcggcgagaacagcgacctgaacttcctgggcaacagacccgtggtgttcccctacgccgccccccccccccaggagcccgtgaagaccctgagaagcctggtgaacatcagaaaggacaccctgagactggtgaagtgcgccgaggaggtgaagagccccggcgaggaggccagcaaggccaaggtgcactacaacgtggagttcaccttcgacaccgacgccagagtggccatcaccatctactaccaggccaccgaggagttccagaacggcatcgccagctacatccccaaggacaacagcctgcagagcgagaccgtgcagtacaagagaggcgtgtgccagcagttctgcctgcccagccacaccgtggaccccagcgagtgggccgaggaggagctgggcttcgacctggacagagaggtgtaccccctggtggtgcacgccgtggtggacgagggcgacgagtacttcggccactgccacgtgctgctgggcaccttcgagaagcacaccgacggcaccttctgcgtgaagcccctgaagcagaagcaggtggtggacggcgtgagctacctgctgcaggagatctacggcatcgagaacaagtacaacacccaggacagcaaggtggccgaggacgaggtgagcgacaacagcgccgagtgcgtggtgtgcctgagcgacgtgagagacaccctgatcctgccctgcagacacctgtgcctgtgcaacacctgcgccgacaccctgagataccaggccaacaactgccccatctgcagactgcccttcagagccctgctgcagatcagagccatgagaaagaagctgggccccctgagccccaccagcttcaaccccatcatcagcagccagaccagcgacagcgaggagcaccccagcagcgagaacatcccccccggctacgaggtggtgagcctgctggaggccctgaacggccccctgacccccagccccgccgtgccccccctgcacgtgctgggcgacggccacctgagcggcatgctgcccagctacggcagcgacggccacctgccccccgtgagaaccatcagccccctggacagactgagcgacagcagcagccagggcctgaagctgaagaagagcctgagcaagagcaccagccagaacagcagcgtgctgcacgaggaggaggacgagcacagctgcagcgagagcgagacccagctgagccagagacccagcgtgcagcacctgggcgaggagtgcggcgtgacccccgagagcgagaacctgaccctgagcagcagcggcgccatcgaccagagcagctgcaccggcacccccctgagcagcaccatcagcagccccgagggccccgccagcagcagcctggcccagagcgtgatgagcatggccagcagccagatcagcaccgacaccgtgagcagcatgagcggcagctacatcgcccccggcaccgaggaggagggcgaggccctgagcagcccccagcccgccagcagagcccccagcgaggagggcgagggcaacgacgtgatcgaggaggaggacggcagccccacccaggagggccagagaacctgcgccttcctgggcatggagtgcgacaacaacaacgacttcgacatcgccagcgtgaaggccctggacaacaagctgtgcagcgaggtgtgcctgcccggcgcctggcaggccgacgacaacgccgtgagcagaaacgcccagagaagaagactgagcagcagcagcctggaggacagcgagaccagaccctgcgtgtggggccccctggccgtgtag

SEQ ID NO: 24374 - DNA, 1041 bp, Artificial Sequence
  Description of Artificial Sequence: Synthetic coding sequence
atggtgctggtgcacgtgggctacctggtgctgcccgtgttcggcagcgtgagaaacagaggcgcccccttccagagaagccagcacccccacgccaccagctgcagacacttccacctgggccccccccagccccagcagctggcccccgacttccccctggcccaccccgtgcagagccagcccggcctgagcgcccacatggcccccgcccaccagcacagcggcgccctgcaccagagcctgacccccctgcccaccctgcagttccaggacgtgaccggccccagcttcctgccccaggccctgcaccagcagtacctgctgcagcagcagctgctggaggcccagcacagaagactggtgagccaccccagaagaagccaggagagagtgagcgtgcacccccacagactgcaccccagcttcgacttcggccagctgcagaccccccagcccagatacctggccgagggcaccgactgggacctgagcgtggacgccggcctgagccccgcccagttccaggtgagacccatcccccagcactaccagcactacctggccacccccagaatgcaccacttccccagaaacagcagcagcacccagatggtggtgcacgagatcagaaactacccctacccccagctgcacttcctggccctgcagggcctgaaccccagcagacacaccagcgccgtgagagagagctacgaggagctgctgcagctggaggacagactgggcaacgtgaccagaggcgccgtgcagaacaccatcgagagattcaccttcccccacaagtacaagaagagaagaccccaggacggcaagggcaagaaggacgagggcgaggagagcgacaccgacgagaagtgcaccatctgcctgagcatgctggaggacggcgaggacgtgagaagactgccctgcatgcacctgttccaccagctgtgcgtggaccagtggctggccatgagcaagaagtgccccatctgcagagtggacatcgagacccagctgggcgccgacagctag

SEQ ID NO: 24375 - DNA, 465 bp, Artificial Sequence
  Description of Artificial Sequence: Synthetic coding sequence
atgcaccacttccccagaaacagcagcagcacccagatggtggtgcacgagatcagaaactacccctacccccagctgcacttcctggccctgcagggcctgaaccccagcagacacaccagcgccgtgagagagagctacgaggagctgctgcagctggaggacagactgggcaacgtgaccagaggcgccgtgcagaacaccatcgagagattcaccttcccccacaagtacaagaagagaagaccccaggacggcaagggcaagaaggacgagggcgaggagagcgacaccgacgagaagtgcaccatctgcctgagcatgctggaggacggcgaggacgtgagaagactgccctgcatgcacctgttccaccagctgtgcgtggaccagtggctggccatgagcaagaagtgccccatctgcagagtggacatcgagacccagctgggcgccgacagctag

SEQ ID NO: 24376 - DNA, 87 bp, Artificial Sequence
  Description of Artificial Sequence: Synthetic coding sequence
atggtgctggtgcacgtgggctacctggtgctgcccgtgttcggcagcgtgagaaacagaggcatcagcgtgtggatgctggcctag

SEQ ID NO: 24377 - DNA, 714 bp, Artificial Sequence
  Description of Artificial Sequence: Synthetic coding sequence
atggccatgttcagaagcctggtggccagcgcccagcagagacagccccccgccggccccgccggcggcgacagcggcctggaggcccagtacacctgccccatctgcctggaggtgtaccacagacccgtggccatcggcagctgcggccacaccttctgcggcgagtgcctgcagccctgcctgcaggtgcccagccccctgtgccccctgtgcagactgcccttcgaccccaagaaggtggacaaggccacccacgtggagaagcagctgagcagctacaaggccccctgcagaggctgcaacaagaaggtgaccctggccaagatgagagtgcacatcagcagctgcctgaaggtgcaggagcagatggccaactgccccaagttcgtgcccgtggtgcccaccagccagcccatccccagcaacatccccaacagaagcaccttcgcctgcccctactgcggcgccagaaacctggaccagcaggagctggtgaagcactgcgtggagagccacagaagcgaccccaacagagtggtgtgccccatctgcagcgccatgccctggggcgaccccagctacaagagcgccaacttcctgcagcacctgctgcacagacacaagttcagctacgacaccttcgtggactacagcatcgacgaggaggccgccttccaggccgccctggccctgagcctgagcgagaactag

SEQ ID NO: 24378 - DNA, 471 bp, Artificial Sequence
  Description of Artificial Sequence: Synthetic coding sequence
atggccatgttcagaagcctggtggccagcgcccagcagagacagccccccgccggccccgccggcggcgacagcggcctggaggcccagtacacctgccccatctgcctggaggtgcaggagcagatggccaactgccccaagttcgtgcccgtggtgcccaccagccagcccatccccagcaacatccccaacagaagcaccttcgcctgcccctactgcggcgccagaaacctggaccagcaggagctggtgaagcactgcgtggagagccacagaagcgaccccaacagagtggtgtgccccatctgcagcgccatgccctggggcgaccccagctacaagagcgccaacttcctgcagcacctgctgcacagacacaagttcagctacgacaccttcgtggactacagcatcgacgaggaggccgccttccaggccgccctggccctgagcctgagcgagaactag

SEQ ID NO: 24379 - DNA, 387 bp, Artificial Sequence
  Description of Artificial Sequence: Synthetic coding sequence
atgagagtgcacatcagcagctgcctgaaggtgcaggagcagatggccaactgccccaagttcgtgcccgtggtgcccaccagccagcccatccccagcaacatccccaacagaagcaccttcgcctgcccctactgcggcgccagaaacctggaccagcaggagctggtgaagcactgcgtggagagccacagaagcgaccccaacagagtggtgtgccccatctgcagcgccatgccctggggcgaccccagctacaagagcgccaacttcctgcagcacctgctgcacagacacaagttcagctacgacaccttcgtggactacagcatcgacgaggaggccgccttccaggccgccctggccctgagcctgagcgagaactag

SEQ ID NO: 24380 - DNA, 471 bp, Artificial Sequence; identical to SEQ ID NO: 24378
  Description of Artificial Sequence: Synthetic coding sequence

SEQ ID NO: 24381 - DNA, 2127 bp, Artificial Sequence
  Description of Artificial Sequence: Synthetic coding sequence
atggccgccgccggccccagcaccagagccagcagcgccgccgccgccgccgccctgagcagaagaggcagaagaggcagatgcgacgagaccgccgccgccaagaccggcgcccccggccccgccagcggccccagcctgctggtgctgagcccccccctgctgcagccccccctgccccccagacccgaggagagcggctgcgccggctgcctggagccccccggcgaggccgccgccctgccctgcggccacagcctgtgcagaggctgcgcccagagagccgccgacgccgccggccccggctgccccagatgcagagccagaggccccggctgggccagaagaagagccagagacgacggccaggccgacagcgaggtgctgggcgagtgcgccagaagaagccagcccgagagatgcagacccagaagagacggcggcgccgccgccgccggccccagacccgagcaggagcccagagccgcccccgccgagcccgacttcatcttcagagcccccatcaagctgagcaagcccggcgagctgagagaggagtacgagagcctgagaaagctgagagaggagaagctgcaggaggagaagcccagcgaggaccagatccacaagctgctgcccgaggacaccgagaccggcaagagaaagatggacgagcagaagaagagagacgagcccctggtgctgaagaccaacctggagagatgccccgccagactgagcgacagcgagaacgaggagcccagcagaggccagatgacccagacccacagaagcgccttcgtgagcaagaacaacagctacagcctggccttcctggccggcaagctgaacagcaaggtggagagaagccagagctgcagcgacaccgcccaggagagagccaagagcagagtgagagccgtgcccggcaacaaggccaaggtgaccaccatgacccccgccagcaaccccatcatcggcgtgctgctgagcacccagaacaacagatgcgtgagcgcccccgacctgaccatcgagaagagactgcccttcagcagcctgagcagcctggccagcctgcacaagcccgagagaagcgtgagccccgagagcaacgacagcatcagcgaggagctgaaccacttcaagcccatcgtgtgcagcccctgcaccccccccaagagactgcccgacggcagagtgctgagccccctgatcatcaagagcacccccagaaacctgaacagaagcctgcagaagcagaccagctacgaggccagccccagaatcctgaagaagtgggagcagatcttccaggagagacagatcaagaagaccctgagcaaggccaccctgaccagcctggcccccgagatgggcgaggagctgctgggcagcgagggcatccacagcagcaaggagaagcccctggtggccgtgaacaccagactgagcggcggccaggtgctgagcgagtacaccggccccaccagcgccgacctggaccacttccccagcgtgagccagaccaaggccgagcaggacagcgacaacaagagcagcaccgagatccccctggagacctgctgcagcagcgagctgaagggcggcggcagcggcaccagcctggagagagagcagttcgagggcctgggcagcacccccgacgccaagctggacaagacctgcatcagcagagccatgaagatcaccaccgtgaacagcgtgctgccccagaacagcgtgctgggcggcgtgctgaagaccaagcagcagctgaagaccctgaaccacttcgacctgaccaacggcgtgctggtggagagcctgagcgaggagcccctgcccagcctgagaagaggcagaaagagacactgcaagaccaagcacctggagcagaacggcagcctgaagaagctgagacagaccagcggcgaggtgggcctggcccccaccgaccccgtgctgagagagatggagcagaagctgcagcaggaggaggaggacagacagctggccctgcagctgcagagaatgttcgacaacgagagaagaaccgtgagcagaagaaagggcagcgtggaccagtacctgctgagaagcagcaacatggccggcgccaagtag

SEQ ID NO: 24382 - DNA, 240 bp, Artificial Sequence
  Description of Artificial Sequence: Synthetic coding sequence
tgactggagcagaacggcagcctgaagaagctgagacagaccagcggcgaggtgggcctggcccccaccgaccccgtgctgagagagatggagcagaagctgcagcaggaggaggaggacagacagctggccctgcagctgcagagaatgttcgacaacgagagaagaaccgtgagcagaagaaagggcagcgtggaccagtacctgctgagaagcagcaacatggccggcgccaagtag

SEQ ID NO: 24383 - DNA, 579 bp, Artificial Sequence
  Description of Artificial Sequence: Synthetic coding sequence
atggccgagcagcagggcagagagctggaggccgagtgccccgtgtgctggaaccccttcaacaacaccttccacacccccaagatgctggactgctgccacagcttctgcgtggagtgcctggcccacctgagcctggtgacccccgccagaagaagactgctgtgccccctgtgcagacagcccaccgtgctggccagcggccagcccgtgaccgacctgcccaccgacaccgccatgctggccctgctgagactggagccccaccacgtgatcctggagggccaccagctgtgcctgaaggaccagcccaagagcagatacttcctgagacagccccaggtgtacaccctggacctgggcccccagcccggcggccagaccggccccccccccgacaccgccagcgccaccgtgagcacccccatcctgatccccagccaccacagcctgagagagtgcttcagaaacccccagttcagaatcttcgcctacctgatggccgtgatcctgagcgtgaccctgctgctgatcttcagcatcttctggaccaagcagttcctgtggggcgtgggctag

SEQ ID NO: 24384 - DNA, 579 bp, Artificial Sequence; identical to SEQ ID NO: 24383
  Description of Artificial Sequence: Synthetic coding sequence

SEQ ID NO: 24385 - DNA, 579 bp, Artificial Sequence; identical to SEQ ID NO: 24383
  Description of Artificial Sequence: Synthetic coding sequence

SEQ ID NO: 24386 - DNA, 579 bp, Artificial Sequence; identical to SEQ ID NO: 24383
  Description of Artificial Sequence: Synthetic coding sequence

SEQ ID NO: 24387 - DNA, 1905 bp, Artificial Sequence
  Description of Artificial Sequence: Synthetic coding sequence
atgagcggcgccatcttcggccccctggagggccccagcagcctggacgcccccagcatccaccccctggtgtgccccctgtgccacgtgcagtacgagagaccctgcctgctggactgcttccacgacttctgcgccggctgcctgagaggcagagccaccgacggcagactgacctgccccctgtgccagcaccagaccgtgctgaagggccccagcggcctgccccccgtggacagactgctgcagttcctggtggacagcagcggcgacggcgtggaggccgtgagatgcgccaactgcgacctggagtgcagcgagcaggacgtggagaccacctacttctgcaacacctgcggccagcccctgtgcgccagatgcagagacgagacccacagagccagaatgttcgccagacacgacatcgtggccctgggccagagaagcagagacgtgccccagaagtgcaccctgcacgccgagccctacctgctgttcagcaccgacaagaagctgctgctgtgcatcagatgcttcagagacatgcagaaggagagcagagcccactgcgtggacctggagagcgcctacgtgcagggctgcgagagactggagcaggccgtgctggccgtgaaggccctgcagaccgccaccagagaggccatcgccctgctgcaggccatggtggaggaggtgagacacagcgccgccgaggaggaggacgccatccacgccctgttcggcagcatgcaggacagactggccgagagaaaggccctgctgctgcaggccgtgcagagccagtacgaggagaaggacaaggccttcaaggagcagctgagccacctggccaccctgctgcccaccctgcaggtgcacctggtgatctgcagcagcttcctgagcctggccaacaaggccgagttcctggacctgggctacgagctgatggagagactgcagggcatcgtgaccagaccccaccacctgagacccatccagagcagcaagatcgccagcgaccacagagccgagttcgccagatgcctggagcccctgctgctgctgggccccagaagagtggccgccgccgccagcggcgccaacaccctggccggcggcctgggccccaaggccctgaccggcccccactgccccagccccgtgggcaagatgagcggcagccccgtgcagaagcccaccctgcacagaagcatcagcaccaaggtgctgctggccgagggcgagaacacccccttcgccgagcactgcagacactacgaggacagctacagacacctgcaggccgagatgcagagcctgaaggaccaggtgcaggagctgcacagagacctgaccaagcaccacagcctgatcaaggccgagatcatgggcgacgtgctgcacaagagcctgcagctggacgtgcagatcgccagcgagcacgccagcctggagggcatgagagtggtgttccaggagatctgggaggaggcctaccagagagtggccaacgagcaggagatctacgaggcccagctgcacgacctgctgcagctgagacaggagaacgcctacctgaccaccatcaccaagcagatcaccccctacgtgagaagcatcgccaaggtgaaggagagactggagcccagattccaggcccccgtggacgagcagagcgagagcctgcagaacacccacgacgacagcagaaacaacgccgccagcgccagaaacaaccccggcagcgtgcccgagaagagagagaagaccagcgagcccaagggcaacagctgggcccccaacggcctgagcgaggagcccctgctgaagaacatggaccaccacagaagcaagcagaagaacggcggcgacgtgcccacctggagagagcaccccacctag

SEQ ID NO: 24388 - DNA, 435 bp, Artificial Sequence
  Description of Artificial Sequence: Synthetic coding sequence
atggtggaggaggtgagacacagcgccgccgaggaggaggacgccatccacgccctgttcggcagcatgcaggacagactggccgagagaaaggccctgctgctgcaggccgtgcagagccagtacgaggagaaggacaaggccttcaaggagcagctgagccacctggccaccctgctgcccaccctgcaggtgcacctggtgatctgcagcagcttcctgagcctggccaacaaggccgagttcctggacctgggctacgccggcagaggcctgagaccccagggcgccgacggcgcccccctgcccctgcccagcagaaaggacgtgggcgtgaccagacccaaggcccacgccgcccccgtgcaccagcaccagggcgccgccggcggcggcagagagcacgccctgagaagagccctgccccccctgtag

SEQ ID NO: 24389 - DNA, 786 bp, Artificial Sequence
  Description of Artificial Sequence: Synthetic coding sequence
atgcccagcgaccccggccccgaggccggcagcggctggcccggcctgctgatgagctgcctgaagggcccccacgtgatcctgaagatggaggccatgaagatcgtgcaccccgagaagttccccgagctgcccgccgccccctgcttcccccccgcccccagacccacccccaccctggcccccaagagagcctggcccagcgacaccgagatcatcgtgaaccaggcctgcggcggcgacatgcccgccctggagggcgccccccacaccccccccctgcccagaagacccagaaagggcagcagcgagctgggcttccccagagtggcccccgaggacgaggtgatcgtgaaccagtacgtgatcagacccggccccagcgccagcgccgccagcagcgccgccgccggcgagcccctggagtgccccacctgcggccacagctacaacgtgacccagagaagacccagagtgctgagctgcctgcacagcgtgtgcgagcagtgcctgcagatcctgtacgagagctgccccaagtacaagttcatcagctgccccacctgcagaagagagaccgtgctgttcaccgactacggcctggccgccctggccgtgaacaccagcatcctgagcagactgccccccgaggccctgaccgcccccagcggcggccagtggggcgccgagcccgagggcagctgctaccagaccttcagacagtactgcggcgccgcctgcacctgccacgtgagaaaccccctgagcgcctgcagcatcatgtag

SEQ ID NO: 24390 - DNA, 786 bp, Artificial Sequence; identical to SEQ ID NO: 24389
  Description of Artificial Sequence: Synthetic coding sequence

SEQ ID NO: 24391 - DNA, 2112 bp, Artificial Sequence
  Description of Artificial Sequence: Synthetic coding sequence
atggccgccagcgaggtggccggcgtggtggccaacgcccccagcccccccgagagcagcagcctgtgcgccagcaagagcgacgagggcctgcccgacggcctgagcaccaaggacagcgcccagaagcagaagaacagccccctgctgagcgtgagcagccagaccatcaccaaggagaacaacagaaacgtgcacctggagcacagcgagcagaaccccggcagcagcgccggcgacaccagcgccgcccaccaggtggtgctgggcgagaacctgatcgccaccgccctgtgcctgagcggcagcggcagccagagcgacctgaaggacgtggccagcaccgccggcgaggagggcgacaccagcctgagagagagcctgcaccccgtgaccagaagcctgaaggccggctgccacaccaagcagctggccagcagaaactgcagcgaggagaagagcccccagaccagcatcctgaaggagggcaacagagacaccagcctggacttcagacccgtggtgagccccgccaacggcgtggagggcgtgagagtggaccaggacgacgaccaggacagcagcagcctgaagctgagccagaacatcgccgtgcagaccgacttcaagaccgccgacagcgaggtgaacaccgaccaggacatcgagaagaacctggacaagatgatgaccgagagaaccctgctgaaggagagataccaggaggtgctggacaagcagagacaggtggagaaccagctgcaggtgcagctgaagcagctgcagcagagaagagaggaggagatgaagaaccaccaggagatcctgaaggccatccaggacgtgaccatcaagagagaggagaccaagaagaagatcgagaaggagaagaaggagttcctgcagaaggagcaggacctgaaggccgagatcgagaagctgtgcgagaagggcagaagagaggtgtgggagatggagctggacagactgaagaaccaggacggcgagatcaacagaaacatcatggaggagaccgagagagcctggaaggccgagatcctgagcctggagagcagaaaggagctgctggtgctgaagctggaggaggccgagaaggaggccgagctgcacctgacctacctgaagagcaccccccccaccctggagaccgtgagaagcaagcaggagtgggagaccagactgaacggcgtgagaatcatgaagaagaacgtgagagaccagttcaacagccacatccagctggtgagaaacggcgccaagctgagcagcctgccccagatccccacccccaccctgccccccccccccagcgagaccgacttcatgctgcaggtgttccagcccagccccagcctggcccccagaatgcccttcagcatcggccaggtgaccatgcccatggtgatgcccagcgccgaccccagaagcctgagcttccccatcctgaaccccgccctgagccagcccagccagcccagcagccccctgcccggcagccacggcagaaacagccccggcctgggcagcctggtgagcccccacggcccccacatgccccccgccgccagcatcccccccccccccggcctgggcggcgtgaaggccagcgccgagacccccagaccccagcccgtggacaagctggagaagatcctggagaagctgctgaccagattcccccagtgcaacaaggcccagatgaccaacatcctgcagcagatcaagaccgccagaaccaccatggccggcctgaccatggaggagctgatccagctggtggccgccagactggccgagcacgagagagtggccgccagcacccagcccctgggcagaatcagagccctgttccccgcccccctggcccagatcagcacccccatgttcctgcccagcgcccaggtgagctaccccggcagaagcagccacgcccccgccacctgcaagctgtgcctgatgtgccagaagctggtgcagcccagcgagctgcaccccatggcctgcacccacgtgctgcacaaggagtgcatcaagttctgggcccagaccaacaccaacgacacctgccccttctgccccaccctgaagtag

SEQ ID NO: 24392 - DNA, 2112 bp, Artificial Sequence; identical to SEQ ID NO: 24391
  Description of Artificial Sequence: Synthetic coding sequence

SEQ ID NO: 24393 - DNA, 441 bp, Artificial Sequence
  Description of Artificial Sequence: Synthetic coding sequence
atggccgccagcgaggtggccggcgtggtggccaacgcccccagcccccccgagagcagcagcctgtgcgccagcaagagcgacgagggcctgcccgacggcctgagcaccaaggacagcgcccagaagcagaagaacagccccctgctgagcgtgagcagccagaccatcaccaaggagaacaacagaaacgtgcacctggagcacagcgagcagaaccccggcagcagcgccggcgacaccagcgccgcccaccaggtggtgctgggcgagaacctgatcgccaccgccctgtgcctgagcggcagcggcagccagagcgacctgaaggacgtggccagcaccgccggcgaggagggcgacaccagcctgagagagagcctgcaccccgtgaccagaagcctgaaggccggctgccacaccaagcagctggccagctag

SEQ ID NO: 24394 - DNA, 2181 bp, Artificial Sequence
  Description of Artificial Sequence: Synthetic coding sequence
atggcccagaccgtgcagaacgtgaccctgagcctgaccctgcccatcacctgccacatctgcctgggcaaggtgagacagcccgtgatctgcatcaacaaccacgtgttctgcagcatctgcatcgacctgtggctgaagaacaacagccagtgccccgcctgcagagtgcccatcacccccgagaacccctgcaaggagatcatcggcggcaccagcgagagcgagcccatgctgagccacaccgtgagaaagcacctgagaaagaccagactggagctgctgcacaaggagtacgaggacgagatcgactgcctgcagaaggaggtggaggagctgaagagcaagaacctgagcctggagagccagatcaagaccatcctggaccccctgaccctggtgcagggcaaccagaacgaggacaagcacctggtgaccgacaaccccagcaagatcaaccccgagaccgtggccgagtggaagaagaagctgagaaccgccaacgagatctacgagaaggtgaaggacgacgtggacaagctgaaggaggccaacaagaagctgaagctggagaacggcggcctggtgagagagaacctgagactgaaggccgaggtggacaacagaagcccccagaagttcggcagattcgccgtggccgccctgcagagcaaggtggagcagtacgagagagagaccaacagactgaagaaggccctggagagaagcgacaagtacatcgaggagctggagagccaggtggcccagctgaagaacagcagcgaggagaaggaggccatgaacagcatctgccagaccgccctgagcgccgacggcaagggcagcaagggcagcgaggaggacgtggtgagcaagaaccagggcgacagcgccagaaagcagcccggcagcagcaccagcagcagcagccacctggccaagcccagcagcagcagactgtgcgacaccagcagcgccagacaggagagcaccagcaaggccgacctgaactgcagcaagaacaaggacctgtaccaggagcaggtggaggtgatgctggacgtgaccgacaccagcatggacacctacctggagagagagtggggcaacaagcccagcgactgcgtgccctacaaggacgaggagctgtacgacctgcccgccccctgcacccccctgagcctgagctgcctgcagctgagcacccccgagaacagagagagcagcgtggtgcaggccggcggcagcaagaagcacagcaaccacctgagaaagctggtgttcgacgacttctgcgacagcagcaacgtgagcaacaaggacagcagcgaggacgacatcagcagaagcgagaacgagaagaagagcgagtgcttcagcagccccaagaccggcttctgggactgctgcagcaccagctacgcccagaacctggacttcgagagcagcgagggcaacaccatcgccaacagcgtgggcgagatcagcagcaagctgagcgagaagagcggcctgtgcctgagcaagagactgaacagcatcagaagcttcgagatgaacagaaccagaaccagcagcgaggccagcatggacgccgcctacctggacaagatcagcgagctggacagcatgatgagcgagagcgacaacagcaagagcccctgcaacaacggcttcaagagcctggacctggacggcctgagcaagagcagccagggcagcgagttcctggaggagcccgacaagctggaggagaagaccgagctgaacctgagcaagggcagcctgaccaacgaccagctggagaacggcagcgagtggaagcccaccagcttcttcctgctgagccccagcgaccaggagatgaacgaggacttcagcctgcacagcagcagctgccccgtgaccaacgagatcaagccccccagctgcctgttccagaccgagttcagccagggcatcctgctgagcagcagccacagactgttcgaggaccagagattcggcagcagcctgttcaagatgagcagcgagatgcacagcctgcacaaccacctgcagagcccctggagcaccagcttcgtgcccgagaagagaaacaagaacgtgaaccagagcaccaagagaaagatccagagcagcctgagcagcgccagccccagcaaggccaccaagagctag

SEQ ID NO: 24395 - DNA, 663 bp, Artificial Sequence
  Description of Artificial Sequence: Synthetic coding sequence
atgagcgagggcgagagcaaggacagcagcggcagcgagtgccccgtgtgctacgagaagttcagagacctggagggcgccagcagaaccctgagctgcggccacgtgttctgccacgactgcctggtgaagtacctgctgagcaccagagtggacggccaggtgcagagaaccctggtgtgccccatctgcagatacgtgaccttcctgagcaagaagagcagcagatggcccagcatgctggacaagagcagccagaccctggccgtgcccgtgggcctgcccagcgtgccccccctggacagcctgggccacaccaaccccctggccgccagcagccccgcctggagacccccccccggccaggccagaccccccggcagccccggccagagcgcccagctgcccctggacctgctgcccagcctgcccagagagagccagatcttcgtgatcagcagacacggcatgcccctgggcgagcaggacagcgtgctgcccagaagaagcctggccgagctgagcgaggccagcctggcccccagaagcgccagagccttctgctgcagaagcagagccctgctgctgatcaccctgatcgccgtggtggccgtggtggccgccatcctgccctgggtgctgctggtgagaaagcaggcctag

SEQ ID NO: 24396 - DNA, 663 bp, Artificial Sequence; identical to SEQ ID NO: 24395
  Description of Artificial Sequence: Synthetic coding sequence

SEQ ID NO: 24397 - DNA, 471 bp, Artificial Sequence
  Description of Artificial Sequence: Synthetic coding sequence
atgcaggacgccgccgccggcggcccccccggcctgggcggcggcggcccccccgaggagagaaccgactgcatcatctgctgcagcgcctacgacctgagcggccacctgcccagaagactgtactgcggccacaccttctgccaggcctgcgtgagaagactggacacccccgcccccgagcagagatggatcccctgcccccagtgcagacagagcacccccacccccagaggcggcgtggccatgctggacctggacctggccgccttcctggccgtgaaggccgagagagagcccgccagactggagcccctgcccctgaccagcctgaagggcagcgccatcaccagacagcccgccggcctgtgccccgccctgggcccccagccccacttcccccagcccagatactgctgctggggctgcggcagcctgtgctgcccccccctgggcagccccgaggtgtag

SEQ ID NO: 24398 - DNA, 954 bp, Artificial Sequence
  Description of Artificial Sequence: Synthetic coding sequence
atgggctacgacgtgaccagattccagggcgacgtggacgaggacctgatctgccccatctgcagcggcgtgctggaggagcccgtgcaggccccccactgcgagcacgccttctgcaacgcctgcatcacccagtggttcagccagcagcagacctgccccgtggacagaagcgtggtgaccgtggcccacctgagacccgtgcccagaatcatgagaaacatgctgagcaagctgcagatcgcctgcgacaacgccgtgttcggctgcagcgccgtggtgagactggacaacctgatgagccacctgagcgactgcgagcacaaccccaagagacccgtgacctgcgagcagggctgcggcctggagatgcccaaggacgagctgcccaaccacaactgcatcaagcacctgagaagcgtggtgcagcagcagcagaccagaatcgccgagctggagaagaccagcgccgagcacaagcaccagctggccgagcagaagagagacatccagctgctgaaggcctacatgagagccatcagaagcgtgaaccccaacctgcagaacctggaggagaccatcgagtacaacgagatcctggagtgggtgaacagcctgcagcccgccagagtgaccagatggggcggcatgatcagcacccccgacgccgtgctgcaggccgtgatcaagagaagcctggtggagagcggctgccccgccagcatcgtgaacgagctgatcgagaacgcccacgagagaagctggccccagggcctggccaccctggagaccagacagatgaacagaagatactacgagaactacgtggccaagagaatccccggcaagcaggccgtggtggtgatggcctgcgagaaccagcacatgggcgacgacatggtgcaggagcccggcctggtgatgatcttcgcccacggcgtggaggagatctag

SEQ ID NO: 24399 - DNA, 741 bp, Artificial Sequence
  Description of Artificial Sequence: Synthetic coding sequence
atgagaaacatgctgagcaagctgcagatcgcctgcgacaacgccgtgttcggctgcagcgccgtggtgagactggacaacctgatgagccacctgagcgactgcgagcacaaccccaagagacccgtgacctgcgagcagggctgcggcctggagatgcccaaggacgagctgcccaaccacaactgcatcaagcacctgagaagcgtggtgcagcagcagcagaccagaatcgccgagctggagaagaccagcgccgagcacaagcaccagctggccgagcagaagagagacatccagctgctgaaggcctacatgagagccatcagaagcgtgaaccccaacctgcagaacctggaggagaccatcgagtacaacgagatcctggagtgggtgaacagcctgcagcccgccagagtgaccagatggggcggcatgatcagcacccccgacgccgtgctgcaggccgtgatcaagagaagcctggtggagagcggctgccccgccagcatcgtgaacgagctgatcgagaacgcccacgagagaagctggccccagggcctggccaccctggagaccagacagatgaacagaagatactacgagaactacgtggccaagagaatccccggcaagcaggccgtggtggtgatggcctgcgagaaccagcacatgggcgacgacatggtgcaggagcccggcctggtgatgatcttcgcccacggcgtggaggagatctag

SEQ ID NO: 24400 - DNA, 915 bp, Artificial Sequence
  Description of Artificial Sequence: Synthetic coding sequence
atgggctacgacgtgaccagattccagggcgacgtggacgaggacctgatctgccccatctgcagcggcgtgctggaggagcccgtgcaggccccccactgcgagcacgccttctgcaacgcctgcatcacccagtggttcagccagcagcagacctgccccgtgcccagaatcatgagaaacatgctgagcaagctgcagatcgcctgcgacaacgccgtgttcggctgcagcgccgtggtgagactggacaacctgatgagccacctgagcgactgcgagcacaaccccaagagacccgtgacctgcgagcagggctgcggcctggagatgcccaaggacgagctgcccaaccacaactgcatcaagcacctgagaagcgtggtgcagcagcagcagaccagaatcgccgagctggagaagaccagcgccgagcacaagcaccagctggccgagcagaagagagacatccagctgctgaaggcctacatgagagccatcagaagcgtgaaccccaacctgcagaacctggaggagaccatcgagtacaacgagatcctggagtgggtgaacagcctgcagcccgccagagtgaccagatggggcggcatgatcagcacccccgacgccgtgctgcaggccgtgatcaagagaagcctggtggagagcggctgccccgccagcatcgtgaacgagctgatcgagaacgcccacgagagaagctggccccagggcctggccaccctggagaccagacagatgaacagaagatactacgagaactacgtggccaagagaatccccggcaagcaggccgtggtggtgatggcctgcgagaaccagcacatgggcgacgacatggtgcaggagcccggcctggtgatgatcttcgcccacggcgtggaggagatctag

SEQ ID NO: 24401 - DNA, 573 bp, Artificial Sequence
  Description of Artificial Sequence: Synthetic coding sequence
atgggctacgacgtgaccagattccagggcgacgtggacgaggacctgatctgccccatctgcagcggcgtgctggaggagcccgtgcaggccccccactgcgagcacgccttctgcaacgcctgcatcacccagtggttcagccagcagcagacctgccccgtggacagaagcgtggtgaccgtggcccacctgagacccgtgcccagaatcatgagaaacatgctgagcaagctgcagatcgcctgcgacaacgccgtgttcggctgcagcgccgtggtgagactggacaacctgatgagccacctgagcgactgcgagcacaaccccaagagacccgtgacctgcgagcagggctgcggcctggagatgcccaaggacgagctgcccaaccacaactgcatcaagcacctgagaagcgtggtgcagcagcagcagaccagaatcgccgagctggagaagaccagcgccgagcacaagcaccagctggccgagcagaagagagacatccagctgctgaaggcctacatgagagccatcagaagcgtgaaccccaacctgcagaacctgtag

SEQ ID NO: 24402 - DNA, 441 bp, Artificial Sequence
  Description of Artificial Sequence: Synthetic coding sequence
atgagaaacatgctgagcaagctgcagatcgcctgcgacaacgccgtgttcggctgcagcgccgtggtgagactggacaacctgatgagccacctgagcgactgcgagcacaaccccaagagacccgtgacctgcgagcagggctgcggcctggagatgcccaaggacgagctgcccaaccacaactgcatcaagcacctgagaagcgtggtgcagcagcagcagaccagaatcgccgagctggagaagaccagcgccgagcacaagcaccagctggccgagcagaagagagacatccagctgctgaaggcctacatgagagccatcagaagcgtgaaccccaacctgcagaacctggaggagaccatcgagtacaacgagatcctggagtgggtgaacagcctgcagcccgccagagtgaccagatggggcggcatgtag

SEQ ID NO: 24403 - DNA, 606 bp, Artificial Sequence
  Description of Artificial Sequence: Synthetic coding sequence
atgggctacgacgtgaccagattccagggcgacgtggacgaggacctgatctgccccatctgcagcggcgtgctggaggagcccgtgcaggccccccactgcgagcacgccttctgcaacgcctgcatcacccagtggttcagccagcagcagacctgccccgtggacagaagcgtggtgaccgtggcccacctgagacccgtgcccagaatcatgagaaacatgctgagcaagctgcagatcgcctgcgacaacgccgtgttcggctgcagcgccgtggtgagactggacaacctgatgagccacctgagcgactgcgagcacaaccccaagagacccgtgacctgcgagcagggctgcggcctggagatgcccaaggacgagctgcccaaccacaactgcatcaagcacctgagaagcgtggtgcagcagcagcagaccagaatcgccgagctggagaagaccagcgccgagcacaagcaccagctggccgagcagaagagagacatccagctgctgaaggcctacatgagagccatcagaagcgtgaaccccaacctgcagaacctggaggagaccatcgagtacaacgagatcctggagtag

SEQ ID NO: 24404 - DNA, 954 bp, Artificial Sequence; identical to SEQ ID NO: 24398
  Description of Artificial Sequence: Synthetic coding sequence

SEQ ID NO: 24405 - DNA, 1299 bp, Artificial Sequence
  Description of Artificial Sequence: Synthetic coding sequence
atgagaccctgggccctggccgtgaccagatggccccccagcgcccccgtgggccagagaagattcagcgccggccccggcagcacccccggccagctgtggggcagccccggcctggagggccccctggccagcccccccgccagagacgagagactgcccagccagcagccccccagcagacccccccacctgcccgtggaggagagaagagccagcgcccccgccggcggcagccccagaatgctgcaccccgccacccagcagagccccttcatggtggacctgcacgagcaggtgcaccagggccccgtgcccctgagctacaccgtgaccaccgtgaccacccagggcttccccctgcccaccggccagcacatccccggctgcagcgcccagcagctgcccgcctgcagcgtgatgttcagcggccagcactaccccctgtgctgcctgcccccccccctgatccaggcctgcaccatgcagcagctgcccgtgccctaccaggcctacccccacctgatcagcagcgaccactacatcctgcacccccccccccccgccccccccccccagcccacccacatggcccccctgggccagttcgtgagcctgcagacccagcaccccagaatgcccctgcagagactggacaacgacgtggacctgagaggcgaccagcccagcctgggcagcttcacctacagcaccagcgcccccggccccgccctgagccccagcgtgcccctgcactacctgccccacgaccccctgcaccaggagctgagcttcggcgtgccctacagccacatgatgcccagaagactgagcacccagagatacagactgcagcagcccctgccccccccccccccccccccccccccccccccctactaccccagcttcctgccctacttcctgagcatgctgcccatgagccccaccgccatgggccccaccatcagcctggacctggacgtggacgacgtggagatggagaactacgaggccctgctgaacctggccgagagactgggcgacgccaagcccagaggcctgaccaaggccgacatcgagcagctgcccagctacagattcaaccccgacagccaccagagcgagcagaccctgtgcgtggtgtgcttcagcgacttcgaggccagacagctgctgagagtgctgccctgcaaccacgagttccacaccaagtgcgtggacaagtggctgaaggccaacagaacctgccccatctgcagagccgacgccagcgaggtgcccagagaggccgagtag

SEQ ID NO: 24406 - DNA, 1056 bp, Artificial Sequence
  Description of Artificial Sequence: Synthetic coding sequence
atgctgcaccccgccacccagcagagccccttcatggtggacctgcacgagcaggtgcaccagggccccgtgcccctgagctacaccgtgaccaccgtgaccacccagggcttccccctgcccaccggccagcacatccccggctgcagcgcccagcagctgcccgcctgcagcgtgatgttcagcggccagcactaccccctgtgctgcctgcccccccccctgatccaggcctgcaccatgcagcagctgcccgtgccctaccaggcctacccccacctgatcagcagcgaccactacatcctgcacccccccccccccgccccccccccccagcccacccacatggcccccctgggccagttcgtgagcctgcagacccagcaccccagaatgcccctgcagagactggacaacgacgtggacctgagaggcgaccagcccagcctgggcagcttcacctacagcaccagcgcccccggccccgccctgagccccagcgtgcccctgcactacctgccccacgaccccctgcaccaggagctgagcttcggcgtgccctacagccacatgatgcccagaagactgagcacccagagatacagactgcagcagcccctgccccccccccccccccccccccccccccccccctactaccccagcttcctgccctacttcctgagcatgctgcccatgagccccaccgccatgggccccaccatcagcctggacctggacgtggacgacgtggagatggagaactacgaggccctgctgaacctggccgagagactgggcgacgccaagcccagaggcctgaccaaggccgacatcgagcagctgcccagctacagattcaaccccgacagccaccagagcgagcagaccctgtgcgtggtgtgcttcagcgacttcgaggccagacagctgctgagagtgctgccctgcaaccacgagttccacaccaagtgcgtggacaagtggctgaaggccaacagaacctgccccatctgcagagccgacgccagcgaggtgcccagagaggccgagtag

SEQ ID NO: 24407 - DNA, 1707 bp, Artificial Sequence
  Description of Artificial Sequence: Synthetic coding sequence
atggactacagaagactgctgatgagcagagtggtgcccggccagttcgacgacgccgacagcagcgacagcgagaacagagacctgaagaccgtgaaggagaaggacgacatcctgttcgaggacctgcaggacaacgtgaacgagaacggcgagggcgagatcgaggacgaggaggaggagggctacgacgacgacgacgacgactgggactgggacgagggcgtgggcaagctggccaagggctacgtgtggaacggcggcagcaacccccaggccaacagacagaccagcgacagcagcagcgccaagatgagcacccccgccgacaaggtgctgagaaagttcgagaacaagatcaacctggacaagctgaacgtgaccgacagcgtgatcaacaaggtgaccgagaagagcagacagaaggaggccgacatgtacagaatcaaggacaaggccgacagagccaccgtggagcaggtgctggaccccagaaccagaatgatcctgttcaagatgctgaccagaggcatcatcaccgagatcaacggctgcatcagcaccggcaaggaggccaacgtgtaccacgccagcaccgccaacggcgagagcagagccatcaagatctacaagaccagcatcctggtgttcaaggacagagacaagtacgtgagcggcgagttcagattcagacacggctactgcaagggcaaccccagaaagatggtgaagacctgggccgagaaggagatgagaaacctgatcagactgaacaccgccgagatcccctgccccgagcccatcatgctgagaagccacgtgctggtgatgagcttcatcggcaaggacgacatgcccgcccccctgctgaagaacgtgcagctgagcgagagcaaggccagagagctgtacctgcaggtgatccagtacatgagaagaatgtaccaggacgccagactggtgcacgccgacctgagcgagttcaacatgctgtaccacggcggcggcgtgtacatcatcgacgtgagccagagcgtggagcacgaccacccccacgccctggagttcctgagaaaggactgcgccaacgtgaacgacttcttcatgagacacagcgtggccgtgatgaccgtgagagagctgttcgagttcgtgaccgaccccagcatcacccacgagaacatggacgcctacctgagcaaggccatggagatcgccagccagagaaccaaggaggagagaagcagccaggaccacgtggacgaggaggtgttcaagagagcctacatccccagaaccctgaacgaggtgaagaactacgagagagacatggacatcatcatgaagctgaaggaggaggacatggccatgaacgcccagcaggacaacatcctgtaccagaccgtgaccggcctgaagaaggacctgagcggcgtgcagaaggtgcccgccctgctggagaaccaggtggaggagagaacctgcagcgacagcgaggacatcggcagcagcgagtgcagcgacaccgacagcgaggagcagggcgaccacgccagacccaagaagcacaccaccgaccccgacatcgacaagaaggagagaaagaagatggtgaaggaggcccagagagagaagagaaagaacaagatccccaagcacgtgaagaagagaaaggagaagaccgccaagaccaagaagggcaagtag

SEQ ID NO: 24408 - DNA, 1659 bp, Artificial Sequence
  Description of Artificial Sequence: Synthetic coding sequence
atgggcaaggtgaacgtggccaagctgagatacatgagcagagacgacttcagagtgctgaccgccgtggagatgggcatgaagaaccacgagatcgtgcccggcagcctgatcgccagcatcgccagcctgaagcacggcggctgcaacaaggtgctgagagagctggtgaagcacaagctgatcgcctgggagagaaccaagaccgtgcagggctacagactgaccaacgccggctacgactacctggccctgaagaccctgagcagcagacaggtggtggagagcgtgggcaaccagatgggcgtgggcaaggagagcgacatctacatcgtggccaacgaggagggccagcagttcgccctgaagctgcacagactgggcagaaccagcttcagaaacctgaagaacaagagagactaccacaagcacagacacaacgtgagctggctgtacctgagcagactgagcgccatgaaggagttcgcctacatgaaggccctgtacgagagaaagttccccgtgcccaagcccatcgactacaacagacacgccgtggtgatggagctgatcaacggctaccccctgtgccagatccaccacgtggaggaccccgccagcgtgtacgacgaggccatggagctgatcgtgaagctggccaaccacggcctgatccacggcgacttcaacgagttcaacctgatcctggacgagagcgaccacatcaccatgatcgacttcccccagatggtgagcaccagccaccccaacgccgagtggtacttcgacagagacgtgaagtgcatcaaggacttcttcatgaagagattcagctacgagagcgagctgttccccaccttcaaggacatcagaagagaggacaccctggacgtggaggtgagcgccagcggctacaccaaggagatgcaggccgacgacgagctgctgcaccccctgggccccgacgacaagaacatcgagaccaaggagggcagcgagttcagcttcagcgacggcgaggtggccgagaaggccgaggtgtacggcagcgagaacgagagcgagagaaactgcctggaggagagcgagggctgctactgcagaagcagcggcgaccccgagcagatcaaggaggacagcctgagcgaggagagcgccgacgccagaagcttcgagatgaccgagttcaaccaggccctggaggagatcaagggccaggtggtggagaacaacagcgtgaccgagttcagcgaggagaagaacagaaccgagaactacaacagacaggacggccagagagtgcagggcggcgtgcccgccggcagcgacgagtacgaggacgagtgcccccacctgatcgccctgagcagcctgaacagagagttcagacccttcagagacgaggagaacgtgggcgccatgaaccagtacagaaccagaaccctgagcatcaccagcagcggcagcgccgtgagctgcagcaccatcccccccgagctggtgaagcagaaggtgaagagacagctgaccaagcagcagaagagcgccgtgagaagaagactgcagaagggcgaggccaacatcttcaccaagcagagaagagagaacatgcagaacatcaagagcagcctggaggccgccagcttctggggcgagtag

SEQ ID NO: 24409 - DNA, 1425 bp, Artificial Sequence
  Description of Artificial Sequence: Synthetic coding sequence
atgggcaaggtgaacgtggccaagctgagatacatgagcagagacgacttcagagtgctgaccgccgtggagatgggcatgaagaaccacgagatcgtgcccggcagcctgatcgccagcatcgccagcctgaagcacggcggctgcaacaaggtgctgagagagctggtgaagcacaagctgatcgcctgggagagaaccaagaccgtgcagggctacagactgaccaacgccggctacgactacctggccctgaagaccctgagcagcagacaggtggtggagagcgtgggcaaccagatgggcgtgggcaaggagagcgacatctacatcgtggccaacgaggagggccagcagttcgccctgaagctgcacagactgggcagaaccagcttcagaaacctgaagaacaagagagactaccacaagcacagacacaacgtgagctggctgtacctgagcagactgagcgccatgaaggagttcgcctacatgaaggccctgtacgagagaaagttccccgtgcccaagcccatcgactacaacagacacgccgtggtgatggagctgatcaacggctaccccctgtgccagatccaccacgtggaggaccccgccagcgtgtacgacgaggccatggagctgatcgtgaagctggccaaccacggcctgatccacggcgacttcaacgagttcaacctgatcctggacgagagcgaccacatcaccatgatcgacttcccccagatggtgagcaccagccaccccaacgccgagtggtacttcgacagagacgtgaagtgcatcaaggacttcttcatgaagagattcagctacgagagcgagctgttccccaccttcaaggacatcagaagagaggacaccctggacgtggaggtgagcgccagcggctacaccaaggagatgcaggccgacgacgagctgctgcaccccctgggccccgacgacaagaacatcgagaccaaggagggcagcgagttcagcttcagcgacggcgaggtggccgagaaggccgaggtgtacggcagcgagaacgagagcgagagaaactgcctggaggagagcgagggctgctactgcagaagcagcggcgaccccgagcagatcaaggaggacagcctgagcgaggagagcgccgacgccagaagcttcgagatgaccgagttcaaccaggccctggaggagatcaagggccaggtggtggagaacaacagcgtgaccgagttcagcgaggagaagaacagaaccgagaactacaacagacaggacggccagagagtgcagggcggcgtgcccgccggcagcgacgagtacgaggacgagtgcccccacctgatcgccctgagcagcctgaacagagagttcagacccttcagatacagactgctgagcatcgccttctag

SEQ ID NO: 24410 - DNA, 1560 bp, Artificial Sequence
  Description of Artificial Sequence: Synthetic coding sequence
atggacctggtgggcgtggccagccccgagcccggcaccgccgccgcctggggccccagcaagtgcccctgggccatcccccagaacaccatcagctgcagcctggccgacgtgatgagcgagcagctggccaaggagctgcagctggaggaggaggccgccgtgttccccgaggtggccgtggccgagggccccttcatcaccggcgagaacatcgacaccagcagcgacctgatgctggcccagatgctgcagatggagtacgacagagagtacgacgcccagctgagaagagaggagaagaagttcaacggcgacagcaaggtgagcatcagcttcgagaactacagaaaggtgcacccctacgaggacagcgacagcagcgaggacgaggtggactggcaggacaccagagacgacccctacagacccgccaagcccgtgcccacccccaagaagggcttcatcggcaagggcaaggacatcaccaccaagcacgacgaggtggtgtgcggcagaaagaacaccgccagaatggagaacttcgcccccgagttccaggtgggcgacggcatcggcatggacctgaagctgagcaaccacgtgttcaacgccctgaagcagcacgcctacagcgaggagagaagaagcgccagactgcacgagaagaaggagcacagcaccgccgagaaggccgtggaccccaagaccagactgctgatgtacaagatggtgaacagcggcatgctggagaccatcaccggctgcatcagcaccggcaaggagagcgtggtgttccacgcctacggcggcagcatggaggacgagaaggaggacagcaaggtgatccccaccgagtgcgccatcaaggtgttcaagaccaccctgaacgagttcaagaacagagacaagtacatcaaggacgacttcagattcaaggacagattcagcaagctgaaccccagaaagatcatcagaatgtgggccgagaaggagatgcacaacctggccagaatgcagagagccggcatcccctgccccaccgtggtgctgctgaagaagcacatcctggtgatgagcttcatcggccacgaccaggtgcccgcccccaagctgaaggaggtgaagctgaacagcgaggagatgaaggaggcctactaccagaccctgcacctgatgagacagctgtaccacgagtgcaccctggtgcacgccgacctgagcgagtacaacatgctgtggcacgccggcaaggtgtggctgatcgacgtgagccagagcgtggagcccacccacccccacggcctggagttcctgttcagagactgcagaaacgtgagccagttcttccagaagggcggcgtgaaggaggccctgagcgagagagagctgttcaacgccgtgagcggcctgaacatcaccgccgacaacgaggccgacttcctggccgagatcgaggccctggagaagatgaacgaggaccacgtgcagaagaacggcagaaaggccgccagcttcctgaaggacgacggcgacccccccctgctgtacgacgagtag

SEQ ID NO: 24411 - DNA, 1248 bp, Artificial Sequence
  Description of Artificial Sequence: Synthetic coding sequence
atgaacgtgaccagcatcgccctgagagccgagacctggctgctggccgcctggcacgtgaaggtgccccccatgtggctggaggcctgcatcaactggatccaggaggagaacaacaacgtgaacctgagccaggcccagatgaacaagcaggtgttcgagcagtggctgctgaccgacctgagagacctggagcaccccctgctgcccgacggcatcctggagatccccaagggcgagctgaacggcttctacgccctgcagatcaacagcctggtggacgtgagccagcccgcctacagccagatccagaagctgagaggcaagaacaccaccaacgacctggtgaccgccgaggcccaggtgacccccaagccctgggaggccaagcccagcagaatgctgatgctgcagctgaccgacggcatcgtgcagatccagggcatggagtaccagcccatccccatcctgcacagcgacctgccccccggcaccaagatcctgatctacggcaacatcagcttcagactgggcgtgctgctgctgaagcccgagaacgtgaaggtgctgggcggcgaggtggacgccctgctggaggagtacgcccaggagaaggtgctggccagactgatcggcgagcccgacctggtggtgagcgtgatccccaacaacagcaacgagaacatccccagagtgaccgacgtgctggaccccgccctgggccccagcgacgaggagctgctggccagcctggacgagaacgacgagctgaccgccaacaacgacaccagcagcgagagatgcttcaccaccggcagcagcagcaacaccatccccaccagacagagcagcttcgagcccgagttcgtgatcagccccagacccaaggaggagcccagcaacctgagcatccacgtgatggacggcgagctggacgacttcagcctggaggaggccctgctgctggaggagaccgtgcagaaggagcagatggagaccaaggagctgcagcccctgaccttcaacagaaacgccgacagaagcatcgagagattcagccacaaccccaacaccaccaacaacttcagcctgacctgcaagaacggcaacaacaactggagcgagaagaacgtgagcgagcagatgaccaacgaggacaagagcttcggctgccccagcgtgagagaccagaacagaagcatcttcagcgtgcactgcaacgtgcccctggcccacgacttcacctag

SEQ ID NO: 24412 - DNA, 1020 bp, Artificial Sequence
  Description of Artificial Sequence: Synthetic coding sequence
atgagcagcgagatgctgcccgccttcatcgagaccagcaacgtggacaagaagcagggcatcaacgaggaccaggaggagagccagaagcccagactgggcgagggctgcgagcccatcagcaagagacagatgaagaagctgatcaagcagaagcagtgggaggagcagagagagctgagaaagcagaagagaaaggagaagagaaagagaaagaagctggagagacagtgccagatggagcccaacagcgacggccacgacagaaagagagtgagaagagacgtggtgcacagcaccctgagactgatcatcgactgcagcttcgaccacctgatggtgctgaaggacatcaagaagctgcacaagcagatccagagatgctacgccgagaacagaagagccctgcaccccgtgcagttctacctgaccagccacggcggccagctgaagaagaacatggacgagaacgacaagggctgggtgaactggaaggacatccacatcaagcccgagcactacagcgagctgatcaagaaggaggacctgatctacctgaccagcgacagccccaacatcctgaaggagctggacgagagcaaggcctacgtgatcggcggcctggtggaccacaaccaccacaagggcctgacctacaagcaggccagcgactacggcatcaaccacgcccagctgcccctgggcaacttcgtgaagatgaacagcagaaaggtgctggccgtgaaccacgtgttcgagatcatcctggagtacctggagaccagagactggcaggaggccttcttcaccatcctgccccagagaaagggcgccgtgcccaccgacaaggcctgcgagagcgccagccacgacaaccagagcgtgagaatggaggagggcggcagcgacagcgacagcagcgaggaggagtacagcagaaacgagctggacagcccccacgaggagaagcaggacaaggagaaccacaccgagagcaccgtgaacagcctgccccactag

SEQ ID NO: 24413 - DNA, 1020 bp, Artificial Sequence; identical to SEQ ID NO: 24412
  Description of Artificial Sequence: Synthetic coding sequence

SEQ ID NO: 24414 - DNA, 1020 bp, Artificial Sequence; identical to SEQ ID NO: 24412
  Description of Artificial Sequence: Synthetic coding sequence

SEQ ID NO: 24415 - DNA, 621 bp, Artificial Sequence
  Description of Artificial Sequence: Synthetic coding sequence
atgagcagcgagatgctgcccgccttcatcgagaccagcaacgtggacaagaagcagggcatcaacgaggaccaggaggagagccagaagcccagactgggcgagggctgcgagcccatcagcaagagacagatgaagaagctgatcaagcagaagcagtgggaggagcagagagagctgagaaagcagaagagaaaggagaagagaaagagaaagaagctggagagacagtgccagatggagcccaacagcgacggccacgacagaaagagagtgagaagagacgtggtgcacagcaccctgagactgatcatcgactgcagcttcgaccacctgatggtgctgaaggacatcaagaagctgcacaagcagatccagagatgctacgccgagaacagaagagccctgcaccccgtgcagttctacctgaccagccacggcggccagctgaagaagaacatggacgagaacgacaagggctgggtgaactggaaggacatccacatcaagcccgagcactacagcgagctgatcaagaaggaggacctgatctacctgaccagcgacagccccaacatcctgaaggagctggacgagagcaaggcctacgtgatcggctag

SEQ ID NO: 24416 - DNA, 603 bp, Artificial Sequence
  Description of Artificial Sequence: Synthetic coding sequence
atgagcagcgagatgctgcccgccttcatcgagaccagcaacgtggacaagaagcagggcatcaacgaggaccaggaggagagccagaagcccagactgggcgagggctgcgagcccatcagcaagagacagatgaagaagctgatcaagcagaagcagtgggaggagcagagagagctgagaaagcagaagagaaaggagaagagaaagagaaagaagctggagagacagtgccagatggagcccaacagcgacggccacgacagaaagagagtgagaagagacgtggtgcacagcaccctgagactgatcatcgactgcagcttcgaccacctgatggtgctgaaggacatcaagaagctgcacaagcagatccagagatgctacgccgagaacagaagagccctgcaccccgtgcagttctacctgaccagccacggcggccagctgaagaagaacatggacgagaacgacaagggctgggtgaactggaaggacatccacatcaagcccgagcactacagcgagctgatcaagaaggaggacctgatctacctgaccagcgacagccccaacatcctgaaggagctggacgagagctag

SEQ ID NO: 24417 - DNA, 951 bp, Artificial Sequence
  Description of Artificial Sequence: Synthetic coding sequence
atggactggaagctggagggcagcacccagaaggtggagagccccgtgctgcagggccaggagggcatcctggaggagaccggcgaggacggcctgcccgagggcttccagctgctgcagatcgacgccgagggcgagtgccaggagggcgagatcctggccaccggcagcaccgcctggtgcagcaagaacgtgcagagaaagcagagacactgggagaagatcgtggccgccaagaagagcaagagaaagcaggagaaggagagaagaaaggccaacagagccgagaaccccggcatctgcccccagcacagcaagagattcctgagagccctgaccaaggacaagctgctggaggccaagcacagcggccccagactgtgcatcgacctgagcatgacccactacatgagcaagaaggagctgagcagactggccggccagatcagaagactgtacggcagcaacaagaaggccgacagacccttctggatctgcctgaccggcttcaccaccgacagccccctgtacgaggagtgcgtgagaatgaacgacggcttcagcagctacctgctggacatcaccgaggaggactgcttcagcctgttccccctggagaccctggtgtacctgacccccgacagcgagcacgccctggaggacgtggacctgaacaaggtgtacatcctgggcggcctggtggacgagagcatccagaagaaggtgaccttccagaaggccagagagtacagcgtgaagaccgccagactgcccatccaggagtacatggtgagaaaccagaacggcaagaactaccacagcgagatcctggccatcaaccaggtgttcgacatcctgagcacctacctggagacccacaactggcccgaggccctgaagaagggcgtgagcagcggcaagggctacatcctgagaaacagcgtggagtag

SEQ ID NO: 24418 - DNA, 690 bp, Artificial Sequence
  Description of Artificial Sequence: Synthetic coding sequence
atggactggaagctggagggcagcacccagaaggtggagagccccgtgctgcagggccaggagggcatcctggaggagaccggcgaggacggcctgcccgagggcttccagctgctgcagatcgacgccgagggcgagtgccaggagggcgagatcctggccaccggcagcaccgcctggtgcagcgagctgagcagactggccggccagatcagaagactgtacggcagcaacaagaaggccgacagacccttctggatctgcctgaccggcttcaccaccgacagccccctgtacgaggagtgcgtgagaatgaacgacggcttcagcagctacctgctggacatcaccgaggaggactgcttcagcctgttccccctggagaccctggtgtacctgacccccgacagcgagcacgccctggaggacgtggacctgaacaaggtgtacatcctgggcggcctggtggacgagagcatccagaagaaggtgaccttccagaaggccagagagtacagcgtgaagaccgccagactgcccatccaggagtacatggtgagaaaccagaacggcaagaactaccacagcgagatcctggccatcaaccaggagacccacaactggcccgaggccctgaagaagggcgtgagcagcggcaagggctacatcctgagaaacagcgtggagtag

SEQ ID NO: 24419 - DNA, 771 bp, Artificial Sequence
  Description of Artificial Sequence: Synthetic coding sequence
atggactggaagctggagggcagcacccagaaggtggagagccccgtgctgcagggccaggagggcatcctggaggagaccggcgaggacggcctgcccgagggcttccagctgctgcagatcgacgccgagggcgagtgccaggagggcgagatcctggccaccggcagcaccgcctggtgcagcaagaacgtgcagagaaagcagagacactgggagaagatcgtggccgccaagaagagcaagagaaagcaggagaaggagagaagaaaggccaacagagccgagaaccccggcatctgcccccagcacagcaagagattcctgagagccctgaccaaggacaagctgctggaggccaagcacagcggccccagactgtgcatcgacctgagcatgacccactacatgagcaagaagctggacatcaccgaggaggactgcttcagcctgttccccctggagaccctggtgtacctgacccccgacagcgagcacgccctggaggacgtggacctgaacaaggtgtacatcctgggcggcctggtggacgagagcatccagaagaaggtgaccttccagaaggccagagagtacagcgtgaagaccgccagactgcccatccaggagtacatggtgagaaaccagaacggcaagaactaccacagcgagatcctggccatcaaccaggagacccacaactggcccgaggccctgaagaagggcgtgagcagcggcaagggctacatcctgagaaacagcgtggagtag

SEQ ID NO: 24420 - DNA, 474 bp, Artificial Sequence
  Description of Artificial Sequence: Synthetic coding sequence
atgagcagcgaggagggcaagctgttcgtgggcggcctgaacttcaacaccgacgagcaggccctggaggaccacttcagcagcttcggccccatcagcgaggtggtggtggtgaaggacagagagacccagagaagcagaggcttcggcttcatcaccttcaccaaccccgagcacgccagcgtggccatgagagccatgaacggcgagagcctggacggcagacagatcagagtggaccacgccggcaagagcgccagaggcaccagaggcggcggcttcggcgcccacggcagaggcagaagctacagcagaggcggcggcgaccagggctacggcagcggcagatactacgacagcagacccggcggctacggctacggctacggcagaagcagagactacaacggcagaaaccagggcggctacgacagatacagcggcggcaactacagagacaactacgacaactag

SEQ ID NO: 24421 - DNA, 846 bp, Artificial Sequence
  Description of Artificial Sequence: Synthetic coding sequence
atgttccccgcccaggaggaggccgacagaaccgtgttcgtgggcaacctggaggccagagtgagagaggagatcctgtacgagctgttcctgcaggccggccccctgaccaaggtgaccatctgcaaggacagagagggcaagcccaagagcttcggcttcgtgtgcttcaagcaccccgagagcgtgagctacgccatcgccctgctgaacggcatcagactgtacggcagacccatcaacgtgcagtacagattcggcagcagcagaagcagcgagcccgccaaccagagcttcgagagctgcgtgaagatcaacagccacaactacagaaacgaggagatgctggtgggcagaagcagcttccccatgcagtacttccccatcaacaacaccagcctgccccaggagtacttcctgttccagaagatgcagtggcacgtgtacaaccccgtgctgcagctgccctactacgagatgaccgcccccctgcccaacagcgccagcgtgagcagcagcctgaaccacgtgcccgacctggaggccggccccagcagctacaagtggacccaccagcagcccagcgacagcgacctgtaccagatgaccgcccccctgcccaacagcgccagcgtgagcagcagcctgaaccacgtgcccgacctggaggccggccccagcagctacaagtggacccaccagcagcccagcgacagcgacctgtaccagatgaacaagagaaagagacagaagcagaccagcgacagcgacagcagcaccgacaacaacagaggcaacgagtgcagccagaagttcagaaagagcaagaagaagaagagatactag

SEQ ID NO: 24422 - DNA, 3006 bp, Artificial Sequence
  Description of Artificial Sequence: Synthetic coding sequence
atggccgtggtgatcagactgctgggcctgcccttcatcgccggccccgtggacatcagacacttcttcaccggcctgaccatccccgacggcggcgtgcacatcatcggcggcgagatcggcgaggccttcatcatcttcgccaccgacgaggacgccagaagagccatcagcagaagcggcggcttcatcaaggacagcagcgtggagctgttcctgagcagcaaggccgagatgcagaagaccatcgagatgaagagaaccgacagagtgggcagaggcagacccggcagcggcaccagcggcgtggacagcctgagcaacttcatcgagagcgtgaaggaggaggccagcaacagcggctacggcagcagcatcaaccaggacgccggcttccacaccaacggcaccggccacggcaacctgagacccagaaagaccagacccctgaaggccgagaacccctacctgttcctgagaggcctgccctacctggtgaacgaggacgacgtgagagtgttcttcagcggcctgtgcgtggacggcgtgatcttcctgaagcaccacgacggcagaaacaacggcgacgccatcgtgaagttcgccagctgcgtggacgccagcggcggcctgaagtgccacagaagcttcatgggcagcagattcatcgaggtgatgcagggcagcgagcagcagtggatcgagttcggcggcaacgccgtgaaggagggcgacgtgctgagaagaagcgaggagcacagcccccccagaggcatcaacgacagacacttcagaaagagaagccacagcaagagccccagaagaaccagaagcagaagccccctgggcttctacgtgcacctgaagaacctgagcctgagcatcgacgagagagacctgagaaacttcttcagaggcaccgacctgaccgacgagcagatcagattcctgtacaaggacgagaacagaaccagatacgccttcgtgatgttcaagaccctgaaggactacaacaccgccctgagcctgcacaagaccgtgctgcagtacagacccgtgcacatcgaccccatcagcagaaagcagatgctgaagttcatcgccagatacgagaagaagagaagcggcagcctggagagagacagacccggccacgtgagccagaagtacagccaggagggcaacagcggccagaagctgtgcatctacatcagaaacttccccttcgacgtgaccaaggtggaggtgcagaagttcttcgccgacttcctgctggccgaggacgacatctacctgctgtacgacgacaagggcgtgggcctgggcgaggccctggtgaagttcaagagcgaggagcaggccatgaaggccgagagactgaacagaagaagattcctgggcaccgaggtgctgctgagactgatcagcgaggcccagatccaggagttcggcgtgaacttcagcgtgatgagcagcgagaagatgcaggccagaagccagagcagagagagaggcgaccacagccacctgttcgacagcaaggacccccccatctacagcgtgggcgccttcgagaacttcagacaccagctggaggacctgagacagctggacaacttcaagcacccccagagagacttcagacagcccgacagacacccccccgaggacttcagacacagcagcgaggacttcagattcccccccgaggacttcagacacagccccgaggacttcagaagacccagagaggaggacttcagaagacccagcgaggaggacttcagaagaccctgggaggaggacttcagaagaccccccgaggacgacttcagacaccccagagaggaggactggagaagacccctggaggaggactggagaagacccctggaggaggacttcagaagaagccccaccgaggacttcagacagctgcccgaggaggacttcagacagccccccgaggaggacctgagatggctgcccgaggaggacttcagaagaccccccgaggaggactggagaagaccccccgaggaggacttcagaagacccctgcagggcgagtggagaagaccccccgaggacgacttcagaagaccccccgaggaggacttcagacacagccccgaggaggacttcagacagagcccccaggagcacttcagaagacccccccaggagcacttcagaagacccccccccgagcacttcagaagacccccccccgagcacttcagaagacccccccccgagcacttcagaagacccccccccgagcacttcagaagacccccccccgagcacttcagaagacccccccccgagcacttcagaagacccccccaggagcacttcagaagacccccccaggagcacttcagaagaagcagagaggaggacttcagacacccccccgacgaggacttcagaggcccccccgacgaggacttcagacacccccccgacgaggacttcagaagcccccaggaggaggacttcagatgccccagcgacgaggacttcagacagctgcccgaggaggacctgagagaggcccccgaggaggaccccagactgcccgacaacttcagaccccccggcgaggacttcagaagcccccccgacgacttcagaagccacagacccttcgtgaacttcggcagacccgagggcggcaagttcgacttcggcaagcacaacatgggcagcttccccgagggcagattcatgcccgaccccaagatcaactgcggcagcggcagagtgacccccatcaagatcatgaacctgcccttcaaggccaacgtgaacgagatcctggacttcttccacggctacagaatcatccccgacagcgtgagcatccagtacaacgagcagggcctgcccaccggcgaggccatcgtggccatgatcaactacaacgaggccatggccgccatcaaggacctgaacgacagacccgtgggccccagaaaggtgaagctgaccctgctgtag

SEQ ID NO: 24423 - DNA, 2646 bp, Artificial Sequence
  Description of Artificial Sequence: Synthetic coding sequence
atggccgtggtgatcagactgctgggcctgcccttcatcgccggccccgtggacatcagacacttcttcaccggcctgaccatccccgacggcggcgtgcacatcatcggcggcgagatcggcgaggccttcatcatcttcgccaccgacgaggacgccagaagagccatcagcagaagcggcggcttcatcaaggacagcagcgtggagctgttcctgagcagcaaggccgagatgcagaagaccatcgagatgaagagaaccgacagagtgggcagaggcagacccggcagcggcaccagcggcgtggacagcctgagcaacttcatcgagagcgtgaaggaggaggccagcaacagcggctacggcagcagcatcaaccaggacgccggcttccacaccaacggcaccggccacggcaacctgagacccagaaagaccagacccctgaaggccgagaacccctacctgttcctgagaggcctgccctacctggtgaacgaggacgacgtgagagtgttcttcagcggcctgtgcgtggacggcgtgatcttcctgaagcaccacgacggcagaaacaacggcgacgccatcgtgaagttcgccagctgcgtggacgccagcggcggcctgaagtgccacagaagcttcatgggcagcagattcatcgaggtgatgcagggcagcgagcagcagtggatcgagttcggcggcaacgccgtgaaggagggcgacgtgctgagaagaagcgaggagcacagcccccccagaggcatcaacgacagacacttcagaaagagaagccacagcaagagccccagaagaaccagaagcagaagccccctgggcttctacgtgcacctgaagaacctgagcctgagcatcgacgagagagacctgagaaacttcttcagaggcaccgacctgaccgacgagcagatcagattcctgtacaaggacgagaacagaaccagatacgccttcgtgatgttcaagaccctgaaggactacaacaccgccctgagcctgcacaagaccgtgctgcagtacagacccgtgcacatcgaccccatcagcagaaagcagatgctgaagttcatcgccagatacgagaagaagagaagcggcagcctggagagagacagacccggccacgtgagccagaagtacagccaggagggcaacagcggccagaagctgtgcatctacatcagaaacttccccttcgacgtgaccaaggtggaggtgcagaagttcttcgccgacttcctgctggccgaggacgacatctacctgctgtacgacgacaagggcgtgggcctgggcgaggccctggtgaagttcaagagcgaggagcaggccatgaaggccgagagactgaacagaagaagattcctgggcaccgaggtgctgctgagactgatcagcgaggcccagatccaggagttcggcgtgaacttcagcgtgatgagcagcgagaagatgcaggccagaagccagagcagagagagaggcgaccacagccacctgttcgacagcaaggacccccccatctacagcgtgggcgccttcgagaacttcagacaccagctggaggacctgagacagctggacaacttcaagcacccccagagagacttcagacagcccgacagacacccccccgaggacttcagacacagcagcgaggacttcagattcccccccgaggacttcagacacagccccgaggacttcagaagacccagagaggaggacttcagaagacccagcgaggaggacttcagaagaccctgggaggaggacttcagaagaccccccgaggacgacttcagacaccccagagaggaggactggagaagacccccccccgagcacttcagaagacccccccccgagcacttcagaagacccccccccgagcacttcagaagacccccccccgagcacttcagaagacccccccccgagcacttcagaagacccccccaggagcacttcagaagacccccccaggagcacttcagaagaagcagagaggaggacttcagacacccccccgacgaggacttcagaggcccccccgacgaggacttcagacacccccccgacgaggacttcagaagcccccaggaggaggacttcagatgccccagcgacgaggacttcagacagctgcccgaggaggacctgagagaggcccccgaggaggaccccagactgcccgacaacttcagaccccccggcgaggacttcagaagcccccccgacgacttcagaagccacagacccttcgtgaacttcggcagacccgagggcggcaagttcgacttcggcaagcacaacatgggcagcttccccgagggcagattcatgcccgaccccaagatcaactgcggcagcggcagagtgacccccatcaagatcatgaacctgcccttcaaggccaacgtgaacgagatcctggacttcttccacggctacagaatcatccccgacagcgtgagcatccagtacaacgagcagggcctgcccaccggcgaggccatcgtggccatgatcaactacaacgaggccatggccgccatcaaggacctgaacgacagacccgtgggccccagaaaggtgaagctgaccctgctgtag

SEQ ID NO: 24424 - DNA, 432 bp, Artificial Sequence
  Description of Artificial Sequence: Synthetic coding sequence
atggccgtggtgatcagactgctgggcctgcccttcatcgccggccccgtggacatcagacacttcttcaccggcctgaccatccccgacggcggcgtgcacatcatcggcggcgagatcggcgaggccttcatcatcttcgccaccgacgaggacgccagaagagccatcagcagaagcggcggcttcatcaaggacagcagcgtggagctgttcctgagcagcaaggccgagatgcagaagaccatcgagatgaagagaaccgacagagtgggcagaggcagacccggcagcggcaccagcggcgtggacagcctgagcaacttcatcgagagcgtgaaggaggaggccagcaacagcggctacggcagcagcatcaaccaggacgccggcttccacaccaacggcaccggccacggcaacctgagatag

SEQ ID NO: 24425 - DNA, 450 bp, Artificial Sequence
  Description of Artificial Sequence: Synthetic coding sequence
atggccgtggtgatcagactgctgggcctgcccttcatcgccggccccgtggacatcagacacttcttcaccggcctgaccatccccgacggcggcgtgcacatcatcggcggcgagatcggcgaggccttcatcatcttcgccaccgacgaggacgccagaagagccatcagcagaagcggcggcttcatcaaggacagcagcgtggagctgttcctgagcagcaaggccgagatgcagaagaccatcgagatgaagagaaccgacagagtgggcagaggcagacccggcagcggcaccagcggcgtggacagcctgagcaacttcatcgagagcgtgaaggaggaggccagcaacagcggctacggcagcagcatcaaccaggacgccggcttccacaccaacggcaccggccacggcaacctgagacccagaaagaccagaccctag

SEQ ID NO: 24426 - DNA, 369 bp, Artificial Sequence
  Description of Artificial Sequence: Synthetic coding sequence
atggccgtggtgatcagactgctgggcctgcccttcatcgccggccccgtggacatcagacacttcttcaccggcctgaccatccccgacggcggcgtgcacatcatcggcggcgagatcggcgaggccttcatcatcttcgccaccgacgaggacgccagaagagccatcagcagaagcggcggcttcatcaaggacagcagcgtggagctgttcctgagcagcaaggccgagatgcagaagaccatcgagatgaagagaaccgacagagtgggcagaggcagacccggcagcggcaccagcggcgtggacagcctgagcaacttcatcgagagcgtgaaggaggaggccagcaacagcggctactag

SEQ ID NO: 24427 - DNA, 249 bp, Artificial Sequence
  Description of Artificial Sequence: Synthetic coding sequence
atggccgtggtgatcagactgctgggcctgcccttcatcgccggccccgtggacatcagacacttcttcaccggcctgaccatccccgacggcggcgtgcacatcatcggcggcgagatcggcgaggccttcatcatcttcgccaccgacgaggacgccagaagagccatcagcagaagcggcggcttcatcaaggacagcagcgtggagctgttcctgagcagcaaggccgagatgcagaagacctag

SEQ ID NO: 24428 - DNA, 573 bp, Artificial Sequence
  Description of Artificial Sequence: Synthetic coding sequence
atggaggccgagaccaagaccctgcccctggagaacgccagcatcctgagcgagggcagcctgcaggagggccacagactgtggatcggcaacctggaccccaagatcaccgagtaccacctgctgaagctgctgcagaagttcggcaaggtgaagcagttcgacttcctgttccacaagagcggcgccctggagggccagcccagaggctactgcttcgtgaacttcgagaccaagcaggaggccgagcaggccatccagtgcctgaacggcaagctggccctgagcaagaagctggtggtgagatgggcccacgcccaggtgaagagatacgaccacaacaagaacgacaagatcctgcccatcagcctggagcccagcagcagcaccgagcccacccagagcaacctgagcgtgaccgccaagatcaaggccatcgaggccaagctgaagatgatggccgagaaccccgacgccgagtaccccgccgcccccgtgtacagctacttcaagccccccgacaagaagagaaccaccccctacagcagaaccgcctggaagagcagaagatag

SEQ ID NO: 24429 - DNA, 2943 bp, Artificial Sequence
  Description of Artificial Sequence: Synthetic coding sequence
atggtgagcaagatgatcatcgagaacttcgaggccctgaagagctggctgagcaagaccctggagcccatctgcgacgccgaccccagcgccctggccaagtacgtgctggccctggtgaagaaggacaagagcgagaaggagctgaaggccctgtgcatcgaccagctggacgtgttcctgcagaaggagacccagatcttcgtggagaagctgttcgacgccgtgaacaccaagagctacctgcccccccccgagcagcccagcagcggcagcctgaaggtggagttcttcccccaccaggagaaggacatcaagaaggaggagatcaccaaggaggaggagagagagaagaagttcagcagaagactgaaccacagccccccccagagcagcagcagatacagagagaacagaagcagagacgagagaaagaaggacgacagaagcagaaagagagactacgacagaaacccccccagaagagacagctacagagacagatacaacagaagaagaggcagaagcagaagctacagcagaagcagaagcagaagctggagcaaggagagactgagagagagagacagagacagaagcagaaccagaagcagaagcagaaccagaagcagagagagagacctggtgaagcccaagtacgacctggacagaaccgaccccctggagaacaactacacccccgtgagcagcgtgcccagcatcagcagcggccactaccccgtgcccaccctgagcagcaccatcaccgtgatcgcccccacccaccacggcaacaacaccaccgagagctggagcgagttccacgaggaccaggtggaccacaacagctacgtgagaccccccatgcccaagaagagatgcagagactacgacgagaagggcttctgcatgagaggcgacatgtgccccttcgaccacggcagcgaccccgtggtggtggaggacgtgaacctgcccggcatgctgcccttccccgcccagccccccgtggtggagggcccccccccccccggcctgcccccccccccccccatcctgacccccccccccgtgaacctgagaccccccgtgcccccccccggccccctgccccccagcctgccccccgtgaccggcccccccccccccctgccccccctgcagcccagcggcatggacgccccccccaacagcgccaccagcagcgtgcccaccgtggtgaccaccggcatccaccaccagcccccccccgccccccccagcctgttcaccgccgacacctacgacaccgacggctacaaccccgaggcccccagcatcaccaacaccagcagacccatgtacagacacagagtgcacgcccagagacccaacctgatcggcctgaccagcggcgacatggacctgccccccagagagaagccccccaacaagagcagcatgagaatcgtggtggacagcgagagcagaaagagaaccatcggcagcggcgagcccggcgtgcccaccaagaagacctggttcgacaagcccaacttcaacagaaccaacagccccggcttccagaagaaggtgcagttcggcaacgagaacaccaagctggagctgagaaaggtgccccccgagctgaacaacatcagcaagctgaacgagcacttcagcagattcggcaccctggtgaacctgcaggtggcctacaacggcgaccccgagggcgccctgatccagttcgccacctacgaggaggccaagaaggccatcagcagcaccgaggccgtgctgaacaacagattcatcaaggtgtactggcacagagagggcagcacccagcagctgcagaccaccagccccaagcccctggtgcagcagcccatcctgcccgtggtgaagcagagcgtgaaggagagactgggccccgtgcccagcagcaccatcgagcccgccgaggcccagagcgccagcagcgacctgccccaggtgctgagcaccagcaccggcctgaccaagaccgtgtacaaccccgccgccctgaaggccgcccagaagaccctgctggtgagcaccagcgccgtggacaacaacgaggcccagaagaagaagcaggaggccctgaagctgcagcaggacgtgagaaagagaaagcaggagatcctggagaagcacatcgagacccagaagatgctgatcagcaagctggagaagaacaagaccatgaagagcgaggacaaggccgagatcatgaagaccctggaggtgctgaccaagaacatcaccaagctgaaggacgaggtgaaggccgccagccccggcagatgcctgcccaagagcatcaagaccaagacccagatgcagaaggagctgctggacaccgagctggacctgtacaagaagatgcaggccggcgaggaggtgaccgagctgagaagaaagtacaccgagctgcagctggaggccgccaagagaggcatcctgagcagcggcagaggcagaggcatccacagcagaggcagaggcgccgtgcacggcagaggcagaggcagaggcagaggcagaggcgtgcccggccacgccgtggtggaccacagacccagagccctggagatcagcgccttcaccgagagcgacagagaggacctgctgccccacttcgcccagtacggcgagatcgaggactgccagatcgacgacagcagcctgcacgccgtgatcaccttcaagaccagagccgaggccgaggccgccgccgtgcacggcgccagattcaagggccaggacctgaagctggcctggaacaagcccgtgaccaacatcagcgccgtggagaccgaggaggtggagcccgacgaggaggagttccaggaggagagcctggtggacgacagcctgctgcaggacgacgacgaggaggaggaggacaacgagagcagaagctggagaagatag

SEQ ID NO: 24430 - DNA, 3024 bp, Artificial Sequence
  Description of Artificial Sequence: Synthetic coding sequence
atggtgagcaagatgatcatcgagaacttcgaggccctgaagagctggctgagcaagaccctggagcccatctgcgacgccgaccccagcgccctggccaagtacgtgctggccctggtgaagaaggacaagagcgagaaggagctgaaggccctgtgcatcgaccagctggacgtgttcctgcagaaggagacccagatcttcgtggagaagctgttcgacgccgtgaacaccaagagctacctgcccccccccgagcagcccagcagcggcagcctgaaggtggagttcttcccccaccaggagaaggacatcaagaaggaggagatcaccaaggaggaggagagagagaagaagttcagcagaagactgaaccacagccccccccagagcagcagcagatacagagagaacagaagcagagacgagagaaagaaggacgacagaagcagaaagagagactacgacagaaacccccccagaagagacagctacagagacagatacaacagaagaagaggcagaagcagaagctacagcagaagcagaagcagaagctggagcaaggagagactgagagagagagacagagacagaagcagaaccagaagcagaagcagaaccagaagcagagagagagacctggtgaagcccaagtacgacctggacagaaccgaccccctggagaacaactacacccccgtgagcagcgtgcccagcatcagcagcggccactaccccgtgcccaccctgagcagcaccatcaccgtgatcgcccccacccaccacggcaacaacaccaccgagagctggagcgagttccacgaggaccaggtggaccacaacagctacgtgagaccccccatgcccaagaagagatgcagagactacgacgagaagggcttctgcatgagaggcgacatgtgccccttcgaccacggcagcgaccccgtggtggtggaggacgtgaacctgcccggcatgctgcccttccccgcccagccccccgtggtggagggcccccccccccccggcctgcccccccccccccccatcctgacccccccccccgtgaacctgagaccccccgtgcccccccccggccccctgccccccagcctgccccccgtgaccggcccccccccccccctgccccccctgcagcccagcggcatggacgccccccccaacagcgccaccagcagcgtgcccaccgtggtgaccaccggcatccaccaccagcccccccccgccccccccagcctgttcaccgccgacacctacgacaccgacggctacaaccccgaggcccccagcatcaccaacaccagcagacccatgtacagacacagagtgcacgcccagagacccaacctgatcggcctgaccagcggcgacatggacctgccccccagagagaagccccccaacaagagcagcatgagaatcgtggtggacagcgagagcagaaagagaaccatcggcagcggcgagcccggcgtgcccaccaagaagacctggttcgacaagcccaacttcaacagaaccaacagccccggcttccagaagaaggtgcagttcggcaacgagaacaccaagctggagctgagaaaggtgccccccgagctgaacaacatcagcaagctgaacgagcacttcagcagattcggcaccctggtgaacctgcaggtggcctacaacggcgaccccgagggcgccctgatccagttcgccacctacgaggaggccaagaaggccatcagcagcaccgaggccgtgctgaacaacagattcatcaaggtgtactggcacagagagggcagcacccagcagctgcagaccaccagccccaaggtgatgcagcccctggtgcagcagcccatcctgcccgtggtgaagcagagcgtgaaggagagactgggccccgtgcccagcagcaccatcgagcccgccgaggcccagagcgccagcagcgacctgccccagaacgtgaccaagctgagcgtgaaggacagactgggcttcgtgagcaagcccagcgtgagcgccaccgagaaggtgctgagcaccagcaccggcctgaccaagaccgtgtacaaccccgccgccctgaaggccgcccagaagaccctgctggtgagcaccagcgccgtggacaacaacgaggcccagaagaagaagcaggaggccctgaagctgcagcaggacgtgagaaagagaaagcaggagatcctggagaagcacatcgagacccagaagatgctgatcagcaagctggagaagaacaagaccatgaagagcgaggacaaggccgagatcatgaagaccctggaggtgctgaccaagaacatcaccaagctgaaggacgaggtgaaggccgccagccccggcagatgcctgcccaagagcatcaagaccaagacccagatgcagaaggagctgctggacaccgagctggacctgtacaagaagatgcaggccggcgaggaggtgaccgagctgagaagaaagtacaccgagctgcagctggaggccgccaagagaggcatcctgagcagcggcagaggcagaggcatccacagcagaggcagaggcgccgtgcacggcagaggcagaggcagaggcagaggcagaggcgtgcccggccacgccgtggtggaccacagacccagagccctggagatcagcgccttcaccgagagcgacagagaggacctgctgccccacttcgcccagtacggcgagatcgaggactgccagatcgacgacagcagcctgcacgccgtgatcaccttcaagaccagagccgaggccgaggccgccgccgtgcacggcgccagattcaagggccaggacctgaagctggcctggaacaagcccgtgaccaacatcagcgccgtggagaccgaggaggtggagcccgacgaggaggagttccaggaggagagcctggtggacgacagcctgctgcaggacgacgacgaggaggaggaggacaacgagagcagaagctggagaagatag

SEQ ID NO: 24431 - DNA, 2952 bp, Artificial Sequence
  Description of Artificial Sequence: Synthetic coding sequence
atggtgagcaagatgatcatcgagaacttcgaggccctgaagagctggctgagcaagaccctggagcccatctgcgacgccgaccccagcgccctggccaagtacgtgctggccctggtgaagaaggacaagagcgagaaggagctgaaggccctgtgcatcgaccagctggacgtgttcctgcagaaggagacccagatcttcgtggagaagctgttcgacgccgtgaacaccaagagctacctgcccccccccgagcagcccagcagcggcagcctgaaggtggagttcttcccccaccaggagaaggacatcaagaaggaggagatcaccaaggaggaggagagagagaagaagttcagcagaagactgaaccacagccccccccagagcagcagcagatacagagagaacagaagcagagacgagagaaagaaggacgacagaagcagaaagagagactacgacagaaacccccccagaagagacagctacagagacagatacaacagaagaagaggcagaagcagaagctacagcagaagcagaagcagaagctggagcaaggagagactgagagagagagacagagacagaagcagaaccagaagcagaagcagaaccagaagcagagagagagacctggtgaagcccaagtacgacctggacagaaccgaccccctggagaacaactacacccccgtgagcagcgtgcccagcatcagcagcggccactaccccgtgcccaccctgagcagcaccatcaccgtgatcgcccccacccaccacggcaacaacaccaccgagagctggagcgagttccacgaggaccaggtggaccacaacagctacgtgagaccccccatgcccaagaagagatgcagagactacgacgagaagggcttctgcatgagaggcgacatgtgccccttcgaccacggcagcgaccccgtggtggtggaggacgtgaacctgcccggcatgctgcccttccccgcccagccccccgtggtggagggcccccccccccccggcctgcccccccccccccccatcctgacccccccccccgtgaacctgagaccccccgtgcccccccccggccccctgccccccagcctgccccccgtgaccggcccccccccccccctgccccccctgcagcccagcggcatggacgccccccccaacagcgccaccagcagcgtgcccaccgtggtgaccaccggcatccaccaccagcccccccccgccccccccagcctgttcaccgccgacacctacgacaccgacggctacaaccccgaggcccccagcatcaccaacaccagcagacccatgtacagacacagagtgcacgcccagagacccaacctgatcggcctgaccagcggcgacatggacctgccccccagagagaagccccccaacaagagcagcatgagaatcgtggtggacagcgagagcagaaagagaaccatcggcagcggcgagcccggcgtgcccaccaagaagacctggttcgacaagcccaacttcaacagaaccaacagccccggcttccagaagaaggtgcagttcggcaacgagaacaccaagctggagctgagaaaggtgccccccgagctgaacaacatcagcaagctgaacgagcacttcagcagattcggcaccctggtgaacctgcaggtggcctacaacggcgaccccgagggcgccctgatccagttcgccacctacgaggaggccaagaaggccatcagcagcaccgaggccgtgctgaacaacagattcatcaaggtgtactggcacagagagggcagcacccagcagctgcagaccaccagccccaaggtgatgcagcccctggtgcagcagcccatcctgcccgtggtgaagcagagcgtgaaggagagactgggccccgtgcccagcagcaccatcgagcccgccgaggcccagagcgccagcagcgacctgccccaggtgctgagcaccagcaccggcctgaccaagaccgtgtacaaccccgccgccctgaaggccgcccagaagaccctgctggtgagcaccagcgccgtggacaacaacgaggcccagaagaagaagcaggaggccctgaagctgcagcaggacgtgagaaagagaaagcaggagatcctggagaagcacatcgagacccagaagatgctgatcagcaagctggagaagaacaagaccatgaagagcgaggacaaggccgagatcatgaagaccctggaggtgctgaccaagaacatcaccaagctgaaggacgaggtgaaggccgccagccccggcagatgcctgcccaagagcatcaagaccaagacccagatgcagaaggagctgctggacaccgagctggacctgtacaagaagatgcaggccggcgaggaggtgaccgagctgagaagaaagtacaccgagctgcagctggaggccgccaagagaggcatcctgagcagcggcagaggcagaggcatccacagcagaggcagaggcgccgtgcacggcagaggcagaggcagaggcagaggcagaggcgtgcccggccacgccgtggtggaccacagacccagagccctggagatcagcgccttcaccgagagcgacagagaggacctgctgccccacttcgcccagtacggcgagatcgaggactgccagatcgacgacagcagcctgcacgccgtgatcaccttcaagaccagagccgaggccgaggccgccgccgtgcacggcgccagattcaagggccaggacctgaagctggcctggaacaagcccgtgaccaacatcagcgccgtggagaccgaggaggtggagcccgacgaggaggagttccaggaggagagcctggtggacgacagcctgctgcaggacgacgacgaggaggaggaggacaacgagagcagaagctggagaagatag

SEQ ID NO: 24432 - DNA, 807 bp, Artificial Sequence
  Description of Artificial Sequence: Synthetic coding sequence
atggccgccgccctgggcgccagcggcggcgccggcgccggcgacgacgacttcgaccagttcgacaagcccggcgccgagagaagctggagaagaagagccgccgacgaggactgggacagcgagctggaggacgacctgctgggcgaggacctgctgagcggcaagaagaaccagagcgacctgagcgacgaggagctgaacgacgacctgctgcagagcgacaacgaggacgaggagaacttcagcagccagggcgtgaccatcagcctgaacgccaccagcggcatggtgaccagcttcgagctgagcgacaacaccaacgaccagagcggcgagcaggagagcgagtacgagcaggagcagggcgaggacgagctggtgtaccacaagagcgacggcagcgagctgtacacccaggagtaccccgaggagggccagtacgagggccacgaggccgagctgaccgaggaccagatcgagtacgtggaggagcccgaggaggagcagctgtacaccgacgaggtgctggacatcgagatcaacgagcccctggacgagttcaccggcggcatggagaccctggagctgcagaaggacatcaaggaggagagcgacgaggaggaggaggacgacgaggagagcggcagactgagattcaagaccgagagaaaggagggcaccatcatcagactgagcgacgtgaccagagagagaagaaacatccccgagaccctgggcaacttcttcgcctgcctgcccagcagcttcaccctgatcagcaccagcagcatcgtgctgctgtag

SEQ ID NO: 24433 - DNA, 321 bp, Artificial Sequence
  Description of Artificial Sequence: Synthetic coding sequence
atgcacggcagaggcagaggcgtggccggccccatgggcagaggcagactgatgcccaacaagcagaacctgagagtggtggagtgcaagccccagccctgcgtggtgagcgtggagggcctgagcagcagcaccaccgacgcccagctgaagagcctgctgatgagcgtgggccccatccagagcctgcagatgctgccccagcagagaaaggccatcgccaagttcaaggagcccgcccacgccctggccttccagcagaagttccacagacacatgatcgacctgagccacatcaacgtggccctgatcgtggagtag

SEQ ID NO: 24434 - DNA, 3513 bp, Artificial Sequence
  Description of Artificial Sequence: Synthetic coding sequence
atggccgccgccctgggcgccagcggcggcgccggcgccggcgacgacgacttcgaccagttcgacaagcccggcgccgagagaagctggagaagaagagccgccgacgaggactgggacagcgagctggaggacgacctgctgggcgaggacctgctgagcggcaagaagaaccagagcgacctgagcgacgaggagctgaacgacgacctgctgcagagcgacaacgaggacgaggagaacttcagcagccagggcgtgaccatcagcctgaacgccaccagcggcatggtgaccagcttcgagctgagcgacaacaccaacgaccagagcggcgagcaggagagcgagtacgagcaggagcagggcgaggacgagctggtgtaccacaagagcgacggcagcgagctgtacacccaggagtaccccgaggagggccagtacgagggccacgaggccgagctgaccgaggaccagatcgagtacgtggaggagcccgaggaggagcagctgtacaccgacgaggtgctggacatcgagatcaacgagcccctggacgagttcaccggcggcatggagaccctggagctgcagaaggacatcaaggaggagagcgacgaggaggaggaggacgacgaggagagcggcagactgagattcaagaccgagagaaaggagggcaccatcatcagactgagcgacgtgaccagagagagaagaaacatccccgagaccctggagctgagcgccgaggccaaggccgccctgctggagttcgaggagagagagagacagcacaagcagggcagatacagcagcagaagaggcggcagaagaggcggccccctgatgtgcagaggcgtgggcgaccagagaagagagagcaccgagagaggcagaatgaaggaccacagacccgccctgctgcccacccagccccccgtggtgccccaggcccccccccccccccccccccccccccagcagcagcccatcagaagcctgttccagccccagcccctgcagcccctgctgcccgtgcagcacccccaccaccccagccccccccagggcatgcacatgcccccccagctggagacccccagaatgatgatgacccccccccccgtgaccccccagcagcccaagaacatccacatcaacccccacttcaagggcaccgtggtgacccccgtgcaggtgcccctgctgcccgtgcccagccagcccagacccgccgtgggcccccagagattccccggcccccccgagttcccccagcacacccccggccccgtgcccaacagcttcagccagccccccagactgcccctgcaggaccagtggagagcccccccccccccccaggacagagaccccttcttcctgggcgtgagcggcgagcccagattccccagccacctgttcctggagcagagaagcccccccccccccccccccccccccaccctgctgaacagcagccaccccgtgcccacccagagccccctgcccttcacccagcccggccccgccttcaaccagcagggccagcagcccgtgttccccagagagagacccgtgagacccgccctgcagccccccggccccgtgggcatcctgcacttcagccagcccggcagcgccaccaccagacccttcatcccccccagacagcccttcctgcccggccccggccagcccttcctgcccacccacacccagcccaacctgcagggccccctgcacccccccctgccccccccccaccagccccagccccagcagccccagcagcagccccccccccagcaccagcccccccaccagcccccccaccagccccccccccagcaccagccccccccccagcaccccccccagcaccccccccagcaccagcaccaccaccaccaccaccacctgagcgtgccccccccccccctgatgcccatgagccagccccagttcagaccccacgtgcagaccgcccagccccaggccagcagcagcagaatgcagtgcccccagagacagggcctgagacacaacaccaccagccagaacgtgagcaagagacccatgcagcagatgcagcccaccgcccccagaaacagcaacctgagagagctgcccatcgcccccagccacgtgatcgagatgagcagcagcagatgcagcgccacccccagcgcccaggtgaagcccatcgtgagcgccagcccccccagcagagccgtggccggcagcagaagcagccagggcaagaccgaggtgaaggtgaagcccgccagccccgtggcccagcccaaggaggaggccaagaccgagaccgagttccccgacgaggacgaggagaccagactgtacagactgaagatcgaggagcagaagagactgagagaggagatcctgaagcagaaggagctgagaagacagcagcaggccggcgccagaaagaaggagctgctggagagactggcccagcagcagcagcagctgtacgccccccccccccccgccgagcaggaggagcaggccctgagccccagccccaccaacggcaaccccctgctgcccttccccggcgcccaggtgagacagaacgtgaagaacagactgctggtgaagaaccaggacgtgagcatcagcaacgtgcagcccaagaccagcaacttcgtgcccagcagcgccaacatgcagtaccagggccagcagatgaaggccctgaagcacctgagacagaccagaaccgtgccccagagccagacccagcccctgcacaaggtgctgcccatcaagcccgccgacgtggaggagcccgccgtgccccagacccccagagtggccagcatccagggcagaccccaggacaccaagcccggcgtgaagagaaccgtgacccacagaaccaacagcggcggcggcgacggcccccacatcagcagcaaggtgagagtgatcaagctgagcggcggcggcggcgagagcgacggcttcttccaccccgagggccagccccagagactgccccagccccccgaggtgggcccccagcccgccagaaaggtgaccctgaccagaggcggcctgcagcagcccccccacctgcccgccggcccccacgcccacagccccgtgccccccggcatcaagagcatccagggcatccaccccgccaagaaggccatcatgcacggcagaggcagaggcgtggccggccccatgggcagaggcagactgatgcccaacaagcagaacctgagagtggtggagtgcaagccccagccctgcgtggtgagcgtggagggcctgagcagcagcaccaccgacgcccagctgaagagcctgctgatgagcgtgggccccatccagagcctgcagatgctgccccagcagagaaaggccatcgccaagttcaaggagcccgcccacgccctggccttccagcagaagttccacagacacatgatcgacctgagccacatcaacgtggccctgatcgtggagtag

SEQ ID NO: 24435 - DNA, 87 bp, Artificial Sequence
  Description of Artificial Sequence: Synthetic coding sequence
atgcacggcagaggcagaggcgtggccggccccatgggcagaggcagactgatgcccaacaagcagaacctgagagtggtggagtag

SEQ ID NO: 24436 - DNA, 1278 bp, Artificial Sequence
  Description of Artificial Sequence: Synthetic coding sequence
atgagcaagagaaagagaaagagaagcgtgcaggagggcgagaaccccgacgacggcgtgagaggcagcccccccgaggactacagactgggccaggtggccagcagcctgttcagaggcgagcaccacagcagaggcggcaccggcagactggccagcctgttcagcagcctggagccccagatccagcccgtgtacgtgcccgtgcccaagcagaccatcaagaagaccaagagaaacgaggaggaggagagcaccagccagatcgagagacccctgagccaggagcccgccaagaaggtgaaggccaagaagaagcacaccaacgccgagaagaagctggccgacagagagagcgccctggccagcgccgacctggaggaggagatccaccagaagcagggccagaagagaaagaacagccagcccggcgtgaaggtggccgacagaaagatcctggacgacaccgaggacaccgtggtgagccagagaaagaagatccagatcaaccaggaggaggagagactgaagaacgagagaaccgtgttcgtgggcaacctgcccgtgacctgcaacaagaagaagctgaagagcttcttcaaggagtacggccagatcgagagcgtgagattcagaagcctgatccccgccgagggcaccctgagcaagaagctggccgccatcaagagaaagatccaccccgaccagaagaacatcaacgcctacgtggtgttcaaggaggagagcgccgccacccaggccctgaagagaaacggcgcccagatcgccgacggcttcagaatcagagtggacctggccagcgagaccagcagcagagacaagagaagcgtgttcgtgggcaacctgccctacaaggtggaggagagcgccatcgagaagcacttcctggactgcggcagcatcatggccgtgagaatcgtgagagacaagatgaccggcatcggcaagggcttcggctacgtgctgttcgagaacaccgacagcgtgcacctggccctgaagctgaacaacagcgagctgatgggcagaaagctgagagtgatgagaagcgtgaacaaggagaagttcaagcagcagaacagcaaccccagactgaagaacgtgagcaagcccaagcagggcctgaacttcaccagcaagaccgccgagggccaccccaagagcctgttcatcggcgagaaggccgtgctgctgaagaccaagaagaagggccagaagaagagcggcagacccaagaagcagagaaagcagaagtag

SEQ ID NO: 24437 - DNA, 936 bp, Artificial Sequence
  Description of Artificial Sequence: Synthetic coding sequence
atgaagagagtgaacagctgcgtgaagagcgacgagcacgtgctggaggagctggagaccgagggcgagagacagctgaagagcctgctgcagcaccagctggacaccagcgtgagcatcgaggagtgcatgagcaagaaggagagcttcgcccccggcaccatgtacaagcccttcggcaaggaggccgccggcaccatgaccctgagccagttccagaccctgcacgagaaggaccaggagaccgccagcctgagagagctgggcctgaacgagaccgagatcctgatctggaagagccacgtgagcggcgagaagaagaccaagctgagagccacccccgaggccatccagaacagactgcaggacatcgaggagagaatcagcgagagacagagaatcctgtgcctgccccagagattcgccaagagcaagcagctgaccagaagagagatggagatcgagaagagcctgttccagggcgccgacagacacagcttcctgaaggccctgtactaccaggcctaccacaagaagaccagcgccgacaagtacatgaccagcatgaagagaaagatcaagctgggcaccaaggacgagccccagaagaagaacaagggcgaccccatgaacaacctggagagcttctaccaggagatgatcatgaagaagagactggaggagttccagctgatgagaggcctgaccagcttccccagagaggacttccagaacctgagctacgagggcaccaccagcgtgctgggcgccaagtggcagaagagaaccggcagaaccagcaccttcagcatcctgctggtgagcctgctgagcgagaccgtgttcaccagcagcgccatgtacggcatcccccacctgctgaccatgagcctgaagttcagcaccagaatcggcaagctgagcttcaccccctag

SEQ ID NO: 24438 - DNA, 1242 bp, Artificial Sequence
  Description of Artificial Sequence: Synthetic coding sequence
atgaagagagtgaacagctgcgtgaagagcgacgagcacgtgctggaggagctggagaccgagggcgagagacagctgaagagcctgctgcagcaccagctggacaccagcgtgagcatcgaggagtgcatgagcaagaaggagagcttcgcccccggcaccatgtacaagcccttcggcaaggaggccgccggcaccatgaccctgagccagttccagaccctgcacgagaaggaccaggagaccgccagcctgagagagctgggcctgaacgagaccgagatcctgatctggaagagccacgtgagcggcgagaagaagaccaagctgagagccacccccgaggccatccagaacagactgcaggacatcgaggagagaatcagcgagagacagagaatcctgtgcctgccccagagattcgccaagagcaagcagctgaccagaagagagatggagatcgagaagagcctgttccagggcgccgacagacacagcttcctgaaggccctgtactaccaggacgagccccagaagaagaacaagggcgaccccatgaacaacctggagagcttctaccaggagatgatcatgaagaagagactggaggagttccagctgatgagaggcgagcccttcgccagccacagcctggtgagcgccaccagcgtgggcgacagcggcaccgccgagagccccagcctgctgcaggacaagggcaagcaggccgcccagggcaagggccccagcctgcacgtggccaacgtgatcgacttcagccccgagcagtgctggaccggccccaagaagctgacccagcccatcgagttcgtgcccgaggacgagatccagagaaacagactgagcgaggaggagatcagaaagatccccatgttcagcagctacaaccccggcgagcccaacaaggtgctgtacctgaagaacctgagccccagagtgaccgagagagacctggtgagcctgttcgccagattccaggagaagaagggcccccccatccagttcagaatgatgaccggcagaatgagaggccaggccttcatcaccttccccaacaaggagatcgcctggcaggccctgcacctggtgaacggctacaagctgcacggcaagatcctggtgatcgagttcggcaagaacaagaagcagagaagcaacctgcaggccaccagcctgatcagctgcgccaccggcagcaccaccgagatcagcggcagctag

SEQ ID NO: 24439 - DNA, 618 bp, Artificial Sequence
  Description of Artificial Sequence: Synthetic coding sequence
atgaagagagtgaacagctgcgtgaagagcgacgagcacgtgctggaggagctggagaccgagggcgagagacagctgaagagcctgctgcagcaccagctggacaccagcgtgagcatcgaggagtgcatgagcaagaaggagagcttcgcccccggcaccatgtacaagcccttcggcaaggaggccgccggcaccatgaccctgagccagttccagaccctgcacgagaaggaccaggagaccgccagcctgagagagctgggcctgaacgagaccgagatcctgatctggaagagccacgtgagcggcgagaagaagaccaagctgagagccacccccgaggccatccagaacagactgcaggacatcgaggagagaatcagcgagagacagagaatcctgtgcctgccccagagattcgccaagagcaagcagctgaccagaagagagatggagatcgagaagagcctgttccagggcgccgacagacacagcttcctgaaggccctgtactaccaggcctaccacaagaagaccagcgccgacaagtacatgaccagcatgaagagaaagatcaagctgggcaccaagggcatcatccccaaccccccctag

SEQ ID NO: 24440 - DNA, 1218 bp, Artificial Sequence
  Description of Artificial Sequence: Synthetic coding sequence
atgaagagagtgaacagctgcgtgaagagcgacgagcacgtgctggaggagctggagaccgagggcgagagacagctgaagagcctgctgcagcaccagctggacaccagcgtgagcatcgaggagtgcatgagcaagaaggagagcttcgcccccggcaccatgtacaagcccttcggcaaggaggccgccggcaccatgaccctgagccagttccagaccctgcacgagaaggaccaggagaccgccagcctgagagagctgggcctgaacgagaccgagatcctgatctggaagagccacgtgagcggcgagaagaagaccaagctgagagccacccccgaggccatccagaacagactgcaggacatcgaggagagaatcagcgagagacagagaatcctgtgcctgccccagagattcgccaagagcaagcagctgaccagaagagagatggagatcgagaagagcctgttccagggcgccgacagacacagcttcctgaaggccctgtactaccaggacgagccccagaagaagaacaagggcgaccccatgaacaacctggagagcttctaccaggagatgatcatgaagaagagactggaggagttccagctgatgagaggcgagcccttcgccagccacagcctggtgagcgccaccagcgtgggcgacagcggcaccgccgagagccccagcctgctgcaggacaagggcaagcaggccgcccagggcaagggccccagcctgcacgtggccaacgtgatcgacttcagccccgagcagtgctggaccggccccaagaagctgacccagcccatcgagttcgtgcccgaggacgagatccagagaaacagactgagcgaggaggagatcagaaagatccccatgttcagcagctacaaccccggcgagcccaacaaggtgctgtacctgaagaacctgagccccagagtgaccgagagagacctggtgagcctgttcgccagattccaggagaagaagggcccccccatccagttcagaatgatgaccggcagaatgagaggccaggccttcatcaccttccccaacaaggagatcgcctggcaggccctgcacctggtgaacggctacaagctgcacggcaagatcctggtgatcgagttcggcaagaacaagaagcagagaagcaacctgcaggccaccagcctgatcagctgcgccaccggctag

SEQ ID NO: 24441 - DNA, 612 bp, Artificial Sequence
  Description of Artificial Sequence: Synthetic coding sequence
tgagtgaacagctgcgtgaagagcgacgagcacgtgctggaggagctggagaccgagggcgagagacagctgaagagcctgctgcagcaccagctggacaccagcgtgagcatcgaggagtgcatgagcaagaaggagagcttcgcccccggcaccatgtacaagcccttcggcaaggaggccgccggcaccatgaccctgagccagttccagaccctgcacgagaaggaccaggagaccgccagcctgagagagctgggcctgaacgagaccgagatcctgatctggaagagccacgtgagcggcgagaagaagaccaagctgagagccacccccgaggccatccagaacagactgcaggacatcgaggagagaatcagcgagagacagagaatcctgtgcctgccccagagattcgccaagagcaagcagctgaccagaagagagatggagatcgagaagagcctgttccagggcgccgacagacacagcttcctgaaggccctgtactaccaggcctaccacaagaagaccagcgccgacaagtacatgaccagcatgaagagaaagatcaagctgggcaccaagggcatcatccccgaggagccctag

SEQ ID NO: 24442 - DNA, 3159 bp, Artificial Sequence
  Description of Artificial Sequence: Synthetic coding sequence
atgatgcaggccaccgccgtggtggagaccgccagcggcaagggctaccacagcaacggcggcaacctgcagaaggacaagcccagcaaccccaagaaggagaacctgctgctgagcagcaacggctgcgacgaggtgaagctgaccttccccgacgacgactggaacagcagcaccctggagcagagagccaacaacaaggagatcagcaacatcgacaagatggacctgctggagcccttcttcagcgtgagccaggacaccaacaccgagagcacccagttccagagcagcgagctggaggacagcaccgactacgccttcctgaacaagacctacagcatcccctacagcgagagcaagctgaagaaggagagcctgacccccctgagcagcgagctggaccccgaggtgcagaagaaggaggaggtgttcttcaacatcctggagcaccaggacaagaccgtgggcctggagagaatctacaacatcagcgacgccaactacagagagagcgccgaggacacccagaagcacgacaccgacgaggacagccagcaggagtaccacagcgccgaggagcaggagtacatcagcaaccacctgagcttcgaccagaccaaggccctggacatcagcaaccccgaggtggtggagctgggcaacagcggctacgaggtgaagtgcgccagcaacgtggaggacaacagagtgaacagcggcagcggcagcatcatcagcttcgacagcctggacgtgtacggccaggaggagagcctgcacgtgagcaagttccagaacagcgtgatgctgagagagtaccacgacctgaagcacgagaagtacaaggagcaggagaccaacagcatgtaccacaccgtgttcgacggcagcgtgctgagaagcaacagccccggcaaccaggagagccagagcaagagcggcagcctgagcccccagaaggtgctgaagatgaagatctacaccgagaacatgaagagccagatcaacgagggcaaggacttctgcggcaacaagatcgtggagaacaagatcctgctgcacctggagaaccccagcaccctgccccaggacaaggccctggagaccctgctgcagccctgcaaggactgccagaccagctggaccagcgtgttcgacgacagcatcatcagcgcctgcggctactacgagagcctgcagaacaccgccgacagcgccctggacttcagcgccatgctgcccaagatcgccgtgagagacaaccaggccatcgaggacaacaccagcctgaaggtggcccacagcagcaccaccaagaagacctgcttccacaacatcggcgagatgtgcaccaagagcctgaccgacgccgccagctgcaccgtgaccatcaaccagaccgtggacgtgagcaccgacttcagagcctgcttcaccaccagcagagccaccagcgccagacccagcgtggtgagcaccagcagcaacaccgagatcaccatgatgaacaagaagagacccgacgagtggcagaacgagaagcagaagagcgtggcctgcagcaccgactggagctacagcgaggactgcatcgacacccagatggccatcaccaagggcagcggcaagagcctgagcgtggacagcctgaagcccaacggcaacttcctgaacaaggacttcctggagctgagaaaggcctgcggcatcaccgacctgaagaagcaccccgagagagagttccagctgttcaaggacaccgagaaggacctgcccagcatgtgctgccagaagatcatgcagagagccatcaaggccgagctgcacctgctgaacgtgcactaccagatgtgcagaagacactgctgcgacatctacaagctggtgatggagaacagagagggcctgaacatgaacctgagcagcaacagcgccaagaaggagctgggcagcgccctgctgagcctgctgggcgacctgaaggtgagatacgtgaccctgaaggagaagatccacaagggcatccccctggaggagctgccccccctgagcctggagagcaagctgctgagcaccttcagcaccttcgccagcagactgatgaagaaggagacccacgtgttcagcgaggccgacgccgagcaggacaaccagagagcccacgacgtggacgtgagcagcaacctgaagaagaccctgagccagatgagcctgagcagcgacaacagccacgccacccagaacatcagccccaagaaggacgacttcaagaacggcgacatcaacgccgacttcagccagctgaagctgggcgacaaggactgcagacactaccaggagaccagcgaggactggagcgacgccaaggagagcctgaccggcgtggacgtgagcggcacccagggcaaccaggtggagcaggacacctggaacctggacctgaccggcgagatgaagaacgtggagcccagccagagagacaagggctacctgatccacgtgggcggcctgtgccccagcgtgagcgaggccgacctgagaagccacttccagaagtaccaggtgagcgagatcagcatctacgacagcaccaactacagatacgccagcctggccttcaccaagaacagcgacgccaagatcgccgtgaaggagatgaacggcatcgagatcaacggcaagagcgtgaacgtgtggcccgtgaagatcctgggcgagtacaccagccccctgagcagcaagaacggcaacagaatcagcagcaacaacctggagaagagcaccaacaagcagatccacagcgagttcagcatcagcagactgcccagaaccagacccagacagctgggcagcgagcaggacagcgaggtgttccccagcgaccagggcgtgaagaagaactgcaagcagatcgagagcgccaagctgctgcccgacacccccgtgcagttcatcccccccaacaccctgaacctgagaagcttcaccaagatcatcaagagactggccgagctgcaccccgaggtgagcagagaccacatcatcaacgccctgcaggaggtgagaatcagacacaagggcttcctgaacggcctgagcatcaccaccatcgtggagatgaccagcagcctgctgaagaacagcgccagcagctag

SEQ ID NO: 24443 - DNA, 3159 bp, Artificial Sequence; identical to SEQ ID NO: 24442
  Description of Artificial Sequence: Synthetic coding sequence

SEQ ID NO: 24444 - DNA, 1602 bp, Artificial Sequence
  Description of Artificial Sequence: Synthetic coding sequence
atgaacgaggagaacatcgacggcaccaacggctgcagcaaggtgagaaccggcatccagaacgaggccgccctgctggccctgatggagaagaccggctacaacatggtgcaggagaacggccagagaaagttcggcggccccccccccggctgggagggcccccccccccccagaggctgcgaggtgttcgtgggcaagatccccagagacatgtacgaggacgagctggtgcccgtgttcgagagagccggcaagatctacgagttcagactgatgatggagttcagcggcgagaacagaggctacgccttcgtgatgtacaccaccaaggaggaggcccagctggccatcagaatcctgaacaactacgagatcagacccggcaagttcatcggcgtgtgcgtgagcctggacaactgcagactgttcatcggcgccatccccaaggagaagaagaaggaggagatcctggacgagatgaagaaggtgaccgagggcgtggtggacgtgatcgtgtaccccagcgccaccgacaagaccaagaacagaggcttcgccttcgtggagtacgagagccacagagccgccgccatggccagaagaaagctgatccccggcaccttccagctgtggggccacaccatccaggtggactgggccgaccccgagaaggaggtggacgaggagaccatgcagagagtgaaggtgctgtacgtgagaaacctgatgatcagcaccaccgaggagaccatcaaggccgagttcaacaagttcaagcccggcgccgtggagagagtgaagaagctgagagactacgccttcgtgcacttcttcaacagagaggacgccgtggccgccatgagcgtgatgaacggcaagtgcatcgacggcgccagcatcgaggtgaccctggccaagcccgtgaacaaggagaacacctggagacagcacctgaacggccagatcagccccaacagcgagaacctgatcgtgttcgccaacaaggaggagagccaccccaagaccctgggcaagctgcccaccctgcccgccagactgaacggccagcacagccccagcccccccgaggtggagagatgcacctaccccttctaccccggcaccaagctgacccccatcagcatgtacagcctgaagagcaaccacttcaacagcgccgtgatgcacctggactactactgcaacaagaacaactgggccccccccgagtactacctgtacagcaccaccagccaggacggcaaggtgctgctggtgtacaagatcgtgatccccgccatcgccaacggcagccagagctacttcatgcccgacaagctgtgcaccaccctggaggacgccaaggagctggccgcccagttcaccctgctgcacctggactacaacttccacagaagcagcatcaacagcctgagccccgtgagcgccaccctgagcagcggcacccccagcgtgctgccctacaccagcagaccctacagctaccccggctaccccctgagccccaccatcagcctggccaacggcagccacgtgggccagagactgtgcatcagcaaccaggccagcttcttctag

SEQ ID NO: 24445 - DNA, 1104 bp, Artificial Sequence
  Description of Artificial Sequence: Synthetic coding sequence
atggccagcagcggcggcgagctgggcagcctgttcgaccaccacgtgcagagagccgtgtgcgacaccagagccaagtacagagagggcagaagacccagagccgtgaaggtgtacaccatcaacctggagagccagtacctgctgatccagggcgtgcccgccgtgggcgtgatgaaggagctggtggagagattcgccctgtacggcgccatcgagcagtacaacgccctggacgagtaccccgccgaggacttcaccgaggtgtacctgatcaagttcatgaacctgcagagcgccagaaccgccaagagaaagatggacgagcagagcttcttcggcggcctgctgcacgtgtgctacgcccccgagttcgagaccgtggaggagaccagaaagaagctgcagatgagaaaggcctacgtggtgaagaccaccgagaacaaggaccactacgtgaccaagaagaagctggtgaccgagcacaaggacaccgaggacttcagacaggacttccacagcgagatgagcggcttctgcaaggccgccctgaacaccagcgccggcaacagcaacccctacctgccctacagctgcgagctgcccctgtgctacttcagcagcaagtgcatgtgcagcagcggcggccccgtggacagagcccccgacagcagcaaggacggcagaaaccaccacaagaccatgggccactacaaccacaacgacagcctgagaaagacccagatcaacagcctgaagaacagcgtggcctgccccggcgcccagaaggccatcaccagcagcgaggccgtggacagattcatgcccagaaccacccagctgcaggagagaaagagaagaagagaggacgacagaaagctgggcaccttcctgcagaccaaccccaccggcaacgagatcatgatcggccccctgctgcccgacatcagcaaggtggacatgcacgacgacagcctgaacaccaccgccaacctgatcagacacaagctgaaggaggtgatcagcagcgtgcccaagccccccgaggacaagcccgaggacgtgcacaccagccaccccctgaagcagagaagaagaatctag

SEQ ID NO: 24446 - DNA, 1083 bp, Artificial Sequence
  Description of Artificial Sequence: Synthetic coding sequence
atggccagcagcggcggcgagctgggcagcctgttcgaccaccacgtgcagagagccgtgtgcgacaccagagccaagtacagagagggcagaagacccagagccgtgaaggtgtacaccatcaacctggagagccagtacctgctgatccagggcgtgcccgccgtgggcgtgatgaaggagctggtggagagattcgccctgtacggcgccatcgagcagtacaacgccctggacgagtaccccgccgaggacttcaccgaggtgtacctgatcaagttcatgaacctgcagagcgccagaaccgccaagagaaagatggacgagcagagcttcttcggcggcctgctgcacgtgtgctacgcccccgagttcgagaccgtggaggagaccagaaagaagctgcagatgagaaaggcctacgtggtgaagaccaccgagaacaaggaccactacgtgaccaagaagaagctggtgaccgagcacaaggacaccgaggacttcagacaggacttccacagcgagatgagcggcttctgcaaggccgccctgaacaccagcgccggcaacagcaacccctacctgccctacagctgcgagctgcccctgtgctacttcagcagcaagtgcatgtgcagcagcggcggccccgtggacagagcccccgacagcagcaaggacggcagaaaccaccacaagaccatgggccactacaaccacaacgacagcctgagaaagacccagatcaacagcctgaagaacagcgtggcctgccccggcgcccagaaggccatcaccagcagcgaggccgtggacagattcatgcccagaaccacccagctgcaggagagaaagagaagaagagaggacgacagaaagctgggcaccttcctgcagaccaaccccaccggcaacgagatcatgatcggccccctgctgcccgacatcagcaaggtggacatgcacgacgacagcctgaacaccaccgccaacctgatcagacacaagctgaaggaggtgttccacctgtgccagagcctgcagagaaccagccagaagatgtacatccaggtgatccactag

SEQ ID NO: 24447 - DNA, 381 bp, Artificial Sequence
  Description of Artificial Sequence: Synthetic coding sequence
ggcaagatggccagcagcggcggcgagctgggcagcctgttcgaccaccacgtgcagagagccgtgtgcgacaccagagccaagtacagagagggcagaagacccagagccgtgaaggtgtacaccatcaacctggagagccagtacctgctgatccagggcgtgcccgccgtgggcgtgatgaaggagctggtggagagattcgccctgtacggcgccatcgagcagtacaacgccctggacgagtaccccgccgaggacttcaccgaggtgtacctgatcaagttcatgaacctgcagagcgccagaaccgccaagagaaagatggacgagcagagcttcttctggatcgccagctgcgtgctgtgcagcagaatctag

SEQ ID NO: 24448 - DNA, 969 bp, Artificial Sequence
  Description of Artificial Sequence: Synthetic coding sequence
atgaaccccctgaccaaggtgaagctgatcaacgagctgaacgagagagaggtgcagctgggcgtggccgacaaggtgagctggcacagcgagtacaaggacagcgcctggatcttcctgggcggcctgccctacgagctgaccgagggcgacatcatctgcgtgttcagccagtacggcgagatcgtgaacatcaacctggtgagagacaagaagaccggcaagagcaagggcttctgcttcctgtgctacgaggaccagagaagcaccatcctggccgtggacaacttcaacggcatcaagatcaagggcagaaccatcagagtggaccacgtgagcaactacagagcccccaaggacagcgaggagatcgacgacgtgaccagacagctgcaggagaagggctgcggcgccagaacccccagccccagcctgagcgagagcagcgaggacgagaagcccaccaagaagcacaagaaggacaagaaggagaagaagaagaagaagaaggagaaggagaaggccgacagagaggtgcaggccgagcagcccagcagcagcagccccagaagaaagaccgtgaaggagaaggacgacaccggccccaagaagcacagcagcaagaacagcgagagagcccagaagagcgagcccagagagggccagaagctgcccaagagcagaaccgcctacagcggcggcgccgaggacctggagagagagctgaagaaggagaagcccaagcacgagcacaagagcagcagcagaagagaggccagagaggagaagaccagaatcagagacagaggcagaagcagcgacgcccacagcagctggtacaacggcagaagcgagggcagaagctacagaagcagaagcagaagcagagacaagagccacagacacaagagagccagaagaagcagagagagagagagcagcaaccccagcgacagatggagacactag

SEQ ID NO: 24449 - DNA, 177 bp, Artificial Sequence
  Description of Artificial Sequence: Synthetic coding sequence
atgaaccccctgaccaaggtgaagctgatcaacgagctgaacgagagagaggtgcagctgggcgtggccgacaaggtgagctggcacagcgagtacaaggacagcgcctggatcttcctgggcggcctgccctacgagctgaccgagggcgacatcatctgcgtgttcagccagtag

SEQ ID NO: 24450 - DNA, 828 bp, Artificial Sequence
  Description of Artificial Sequence: Synthetic coding sequence
atgaaccccctgaccaaggtgaagctgatcaacgagctgaacgagagagaggtgcagctgggcgtggccgacaaggtgagctggcacagcgagtacaaggacagcgcctggatcttcctgggcggcctgccctacgagctgaccgagggcgacatcatctgcgtgttcagccagtacggcgagatcgtgaacatcaacctggtgagagacaagaagaccggcaagagcaagggcttctgcttcctgtgctacgaggaccagagaagcaccatcctggccgtggacaacttcaacggcatcaagatcaagggcagaaccatcagagtggaccacgtgagcaactacagagcccccaaggacagcgaggagatcgacgacgtgaccagacagctgcaggagaagggctgcggcgccagaacccccagccccagcctgagcgagagcagcgaggacgagaagcccaccaagaagcacaagaaggacaagaaggagaagaagaagaagaagaaggagaaggagaaggccgacagagaggtgcaggccgagcagcccagcagcagcagccccagaagaaagaccgtgaaggagaaggacgacaccggccccaagaagcacagcagcaagaacagcgagagagcccagaagagcgagcccagagagggccagaagctgcccaagagcagaaccgcctacagcggcggcgccgaggacctggagagagagctgaagaaggagaagcccaagcacgagcacaagagcagcagcagaagagaggccagagaggagaagaccagaatcagagacagaggcctgagatgcaccttctag

SEQ ID NO: 24451 - DNA, 3204 bp, Artificial Sequence
  Description of Artificial Sequence: Synthetic coding sequence
atgatggaggccgacagacccgagaagctgttcatcggcggcctgaacctgaagaccgacgagaaggccctgaaggccgagttcggcaagtacggccacatcatcaaggtgttcctgatgaaggacagaaagaccaacaagagcagaggcttcgccttcgtgaccttcgagagccccgccgacgccaaggccgccgccagagacatgaacggcaagtacctggacggcaaggccatcatggtggcccagaccatcaagcccgccttcaagagcagcagatgggtgccccccacccccggcagcggcagcagaagcagattcagccacagaaccagaggcggcggcagcagcccccagagaccccccagccagggcagacccgacgacggcagaggctacgccggctacttcgacctgtggccctacagagcccccatgcccagaaagagaggccccccccccagacactgggccagccccccccacaagagagccacccccagcagcctggcccacagcgtgggctgcggcatgagaggcaaggcccccaccgtgagcggccaggacggctacagcggcctgcagcccagaagatgggccggccccccccacaagagagccgtgcccagaagcagcctggccagaatcggcggcagcggcatgcccggcaaggcccccgccgtgtggggccaggacggctacagcggccccagagtgagagagcccctgcccccctgcagagaccccggcgacttcgtgcccgccctgagagactacagcagaagatactacggccacagcagcgtgcccgactacagacccctgagaggcgacggcaaccagaacggctacagaggcagagaccacgagtacaccgaccaccccagcaagggcagctacagagagcccctgaagagctacggcggcccctgcggcgccgcccccgtgtggggcaccccccccagctacggcggcggctgcagatacgaggagtaccagggcaacagccccgacgcctgcagcgagggcagaagcagcgaggccctgcccgtggtgctgcccgacgcctacagcagagaccacagccccaaggcctacagcggcggcagaagcagcagcagcaacggctacagcagaagcgacagatacggcgaggagggctgctacgaggagtacagaggcagaagccccgacgcccacagcggcggcagaaacagcagcagcaacagctacggccagagccaccactacggcggcgagggcagatacgaggagtacagaggcagaagccacgaggccagaagcggcggcagaagcaccgacgcccacagcagaggcagaagcgacgacgcctacagcggcggccacgacagcagcagctggagcgactgctgcggcggcggcggcagatacgaggagtaccagggcagaagcctggacgccaacagcggcggctgcagccccgaggcctacagcggcggccacgacaacagcagctggagcgacagatacggcgtgggcggccactacgaggagaacagaggccacagcctggacgccaacagcggcggcagaagccccgacacccacagcggcggccacagcagcagcagcaacagctacggccagagccacagatacggcggcgagggcagatacgagtacagaggcagaagccacgacgcccacagcggcggctgcagcgccgacgcctacagcggcggccacgacagcagcagccagagcaacagatacggcggcggcggctgctacgaggagtacagaggcagaagcctggacgccaacagcggcggcagaagccccaacgcctacagcggcggccacgacagcagcagctggagccacagatacggcggcggcggcagatacgaggagtacagaggcagaagcctggacgccaacagcggcggcagaagccccgacgcctacagcggcggccacgacagcagcggccagagcaactgctacggcggcggcggcagatacgaggagtacagaggcagactgctggacgccaacagcggcggcagaagccccgacgcctacagcggcggccacgacagcagcagccagagcaacagatacggcggcggcggcagatacgaggagtacagaggccacagcctggacgccaacagcggcggcagaagccccgacacctacagcagaggccacgacagcagcagccagagcgaccactacggcggcggcggcagaagcctggacgccaacagcagcggcagactgcccgacgcctacagcggcggccacgacagcagcagcagaagccacagatacggcggcggcggcagatacgaggagtacagaggcagaagcctggacgccaacagcggcggcagaagccccaacgcctacagcggcggccacaacagcagcagcagaaacgacccctgcagaggcggcggcagatacgaggagaacagaggccacagcctggacgccaacagcggcggccacagccccaacgcctacagcggcggcagagacagcagcagcaacagctacgacagaagccacagatacggcggcggcggccactacgaggagtacagaggcagaagccacgacacccacagcagaggcagaagccccgacgcccacagcggcgaccactacaccgaggcctacagcagaggcagagacagcttcagcaacagctacggcagaagcgaccactacggcagaggcggctgctacgaggagtaccagggcagaagccccaacgcctacggcggcggcagaggcctgaacagcagcaacaacagccacggcagaagccacagatacggcggcggcggcagatacgaggagtacagaggccccagccccgacgcccacagcggcggcagagacagcagcatcaagagctacggcctgagcgacagatacggcggcggcggccactacgaggagtaccagggcagcctgcccgacgcctacagcggcgaccacgacagaagcagcaacagctacggcagaagcgacagatacagcagaggcagagacagagtgggcagacccgacagaggcctgcccctgcccatggagaccggcagcccccccctgcacgacagctacagcagaagcggctgcagagtgcccagaggcggcggcagacagggcggcagattcgagagaggcgagggcagaagcagatactag

SEQ ID NO: 24452 - DNA, 1491 bp, Artificial Sequence
  Description of Artificial Sequence: Synthetic coding sequence
atggtggaggccgaccaccccggcaagctgttcatcggcggcctgaacagagagaccaacgagaagatgctgaaggccgtgttcggcaagcacggccccatcagcgaggtgctgctgatcaaggacagaaccagcaagagcagaggcttcgccttcatcaccttcgagaaccccgccgacgccaagaacgccgccaaggacatgaacggcaagagcctgcacggcaaggccatcaaggtggagcaggccaagaagcccagcttccagagcggcggcagaagaagaccccccgccagcagcagaaacagaagccccagcggcagcctgagaagcgccagaggcagcagaggcggcaccagaggctggctgcccagccaggagggccacctggacgacggcggctacacccccgacctgaagatgagctacagcagaggcctgatccccgtgaagagaggccccagcagcagaagcggcggccccccccccaagaagagcgcccccagcgccgtggccagaagcaacagctggatgggcagccagggccccatgagccagagaagagagaactacggcgtgccccccagaagagccaccatcagcagctggagaaacgacagaatgagcaccagacacgacggctacgccaccaacgacggcaaccaccccagctgccaggagaccagagactacgccccccccagcagaggctacgcctacagagacaacggccacagcaacagagacgagcacagcagcagaggctacagaaaccacagaagcagcagagagaccagagactacgccccccccagcagaggccacgcctacagagactacggccacagcagaagagacgagagctacagcagaggctacagaaacagaagaagcagcagagagaccagagagtacgccccccccagcagaggccacggctacagagactacggccacagcagaagacacgagagctacagcagaggctacagaaaccaccccagcagcagagagaccagagactacgcccccccccacagagactacgcctacagagactacggccacagcagctgggacgagcacagcagcagaggctacagctaccacgacggctacggcgaggccctgggcagagaccacagcgagcacctgagcggcagcagctacagagacgccctgcagagatacggcaccagccacggcgccccccccgccagaggccccagaatgagctacggcggcagcacctgccacgcctacagcaacaccagagacagatacggcagaagctgggagagctacagcagctgcggcgacttccactactgcgacagagagcacgtgtgcagaaaggaccagagaaacccccccagcctgggcagagtgctgcccgaccccagagaggcctacggcagcagcagctacgtggccagcatcgtggacggcggcgagagcagaagcgagaagggcgacagcagcagatactag

SEQ ID NO: 24453 - DNA, 1491 bp, Artificial Sequence
  Description of Artificial Sequence: Synthetic coding sequence
atggtggaggccgaccaccccggcaagctgttcatcggcggcctgaacagagagaccaacgagaagatgctgaaggccgtgttcggcaagcacggccccatcagcgaggtgctgctgatcaaggacagaaccagcaagagcagaggcttcgccttcatcaccttcgagaaccccgccgacgccaagaacgccgccaaggacatgaacggcaagagcctgcacggcaaggccatcaaggtggagcaggccaagaagcccagcttccagagcggcggcagaagaagaccccccgccagcagcagaaacagaagccccagcggcagcctgagaagcgccagaggcagcagaggcggcaccagaggctggctgcccagccaggagggccacctggacgacggcggctacacccccgacctgaagatgagctacagcagaggcctgatccccgtgaagagaggccccagcagcagaagcggcggccccccccccaagaagagcgcccccagcgccgtggccagaagcaacagctggatgggcagccagggccccatgagccagagaagagagaactacggcgtgccccccagaagagccaccatcagcagctggagaaacgacagaatgagcaccagacacgacggctacgccaccaacgacggcaaccaccccagctgccaggagaccagagactacgccccccccagcagaggctacgcctacagagacaacggccacagcaacagagacgagcacagcagcagaggctacagaaaccacagaagcagcagagagaccagagactacgccccccccagcagaggccacgcctacagagactacggccacagcagaagagacgagagctacagcagaggctacagaaacagaagaagcagcagagagaccagagagtacgccccccccagcagaggccacggctacagagactacggccacagcagaagacacgagagctacagcagaggctacagaaaccaccccagcagcagagagaccagagactacgcccccccccacagagactacgcctacagagactacggccacagcagctgggacgagcacagcagcagaggctacagctaccacgacggctacggcgaggccctgggcagagaccacagcgagcacctgagcggcagcagctacagagacgccctgcagagatacggcaccagccacggcgccccccccgccagaggccccagaatgagctacggcggcagcacctgccacgcctacagcaacaccagagacagatacggcagaagctgggagagctacagcagctgcggcgacttccactactgcgacagagagcacgtgtgcagaaaggaccagagaaacccccccagcctgggcagagtgctgcccgaccccagagaggcctgcggcagcagcagctacgtggccagcatcgtggacggcggcgagagcagaagcgagaagggcgacagcagcagatactag

SEQ ID NO: 24454 - DNA, 1491 bp, Artificial Sequence; identical to SEQ ID NO: 24453
  Description of Artificial Sequence: Synthetic coding sequence

SEQ ID NO: 24455 - DNA, 1380 bp, Artificial Sequence
  Description of Artificial Sequence: Synthetic coding sequence
atggtggaggccgaccaccccggcaagctgttcatcggcggcctgaacagagagaccaacgagaagatgctgaaggccgtgttcggcaagcacggccccatcagcgaggtgctgctgatcaaggacagaaccagcaagagcagaggcttcgccttcatcaccttcgagaaccccgccgacgccaagaacgccgccaaggacatgaacggcaagagcctgcacggcaaggccatcaaggtggagcaggccaagaagcccagcttccagagcggcggcagaagaagaccccccgccagcagcagaaacagaagccccagcggcagcctgagaagcgccagaggcagcagaggcggcaccagaggctggctgcccagccaggagggccacctggacgacggcggctacacccccgacctgaagatgagctacagcagaggcctgatccccgtgaagagaggccccagcagcagaagcggcggccccccccccaagaagagcgcccccagcgccgtggccagaagcaacagctggatgggcagccagggccccatgagccagagaagagagaactacggcgtgccccccagaagagccaccatcagcagctggagaaacgacagaatgagcaccagacacgacggctacgccaccaacgacggcaaccaccccagctgccaggagaccagagactacgccccccccagcagaggctacgcctacagagacaacggccacagcaacagagacgagcacagcagcagaggctacagaaaccacagaagcagcagagagaccagagactacgccccccccagcagaggccacgcctacagagactacggccacagcagaagagacgagagctacagcagaggctacagaaacagaagaagcagcagagagaccagagagtacgccccccccagcagaggccacggctacagagactacggccacagcagaagacacgagagctacagcagaggctacagctaccacgacggctacggcgaggccctgggcagagaccacagcgagcacctgagcggcagcagctacagagacgccctgcagagatacggcaccagccacggcgccccccccgccagaggccccagaatgagctacggcggcagcacctgccacgcctacagcaacaccagagacagatacggcagaagctgggagagctacagcagctgcggcgacttccactactgcgacagagagcacgtgtgcagaaaggaccagagaaacccccccagcctgggcagagtgctgcccgaccccagagaggcctgcggcagcagcagctacgtggccagcatcgtggacggcggcgagagcagaagcgagaagggcgacagcagcagatactag

SEQ ID NO: 24456 - DNA, 1380 bp, Artificial Sequence
  Description of Artificial Sequence: Synthetic coding sequence
atggtggaggccgaccaccccggcaagctgttcatcggcggcctgaacagagagaccaacgagaagatgctgaaggccgtgttcggcaagcacggccccatcagcgaggtgctgctgatcaaggacagaaccagcaagagcagaggcttcgccttcatcaccttcgagaaccccgccgacgccaagaacgccgccaaggacatgaacggcaagagcctgcacggcaaggccatcaaggtggagcaggccaagaagcccagcttccagagcggcggcagaagaagaccccccgccagcagcagaaacagaagccccagcggcagcctgagaagcgccagaggcagcagaggcggcaccagaggctggctgcccagccaggagggccacctggacgacggcggctacacccccgacctgaagatgagctacagcagaggcctgatccccgtgaagagaggccccagcagcagaagcggcggccccccccccaagaagagcgcccccagcgccgtggccagaagcaacagctggatgggcagccagggccccatgagccagagaagagagaactacggcgtgccccccagaagagccaccatcagcagctggagaaacgacagaatgagcaccagacacgacggctacgccaccaacgacggcaaccaccccagctgccaggagaccagagactacgccccccccagcagaggctacgcctacagagacaacggccacagcaacagagacgagcacagcagcagaggctacagaaaccacagaagcagcagagagaccagagactacgccccccccagcagaggccacgcctacagagactacggccacagcagaagagacgagagctacagcagaggctacagaaacagaagaagcagcagagagaccagagagtacgccccccccagcagaggccacggctacagagactacggccacagcagaagacacgagagctacagcagaggctacagctaccacgacggctacggcgaggccctgggcagagaccacagcgagcacctgagcggcagcagctacagagacgccctgcagagatacggcaccgcccacggcgccccccccgccagaggccccagaatgagctacggcggcagcacctgccacgcctacagcaacaccagagacagatacggcagaagctgggagagctacagcagctgcggcgacttccactactgcgacagagagcacgtgtgcagaaaggaccagagaaacccccccagcctgggcagagtgctgcccgaccccagagaggcctgcggcagcagcagctacgtggccagcatcgtggacggcggcgagagcagaagcgagaagggcgacagcagcagatactag

SEQ ID NO: 24457 - DNA, 1491 bp, Artificial Sequence
  Description of Artificial Sequence: Synthetic coding sequence
atggtggaggccgaccaccccggcaagctgttcatcggcggcctgaacagagagaccaacgagaagatgctgaaggccgtgttcggcaagcacggccccatcagcgaggtgctgctgatcaaggacagaaccagcaagagcagaggcttcgccttcatcaccttcgagaaccccgccgacgccaagaacgccgccaaggacatgaacggcaagagcctgcacggcaaggccatcaaggtggagcaggccaagaagcccagcttccagagcggcggcagaagaagaccccccgccagcagcagaaacagaagccccagcggcagcctgagaagcgccagaggcagcagaggcggcaccagaggctggctgcccagccaggagggccacctggacgacggcggctacacccccgacctgaagatgagctacagcagaggcctgatccccgtgaagagaggccccagcagcagaagcggcggccccccccccaagaagagcgcccccagcgccgtggccagaagcaacagctggatgggcagccagggccccatgagccagagaagagagaactacggcgtgccccccagaagagccaccatcagcagctggagaaacgacagaatgagcaccagacacgacggctacgccaccaacgacggcaaccaccccagctgccaggagaccagagactacgccccccccagcagaggctacgcctacagagacaacggccacagcaacagagacgagcacagcagcagaggctacagaaaccacagaagcagcagagagaccagagactacgccccccccagcagaggccacgcctacagagactacggccacagcagaagagacgagagctacagcagaggctacagaaacagaagaagcagcagagagaccagagagtacgccccccccagcagaggccacggctacagagactacggccacagcagaagacacgagagctacagcagaggctacagaaaccaccccagcagcagagagaccagagactacgcccccccccacagagactacgcctacagagactacggccacagcagctgggacgagcacagcagcagaggctacagctaccacgacggctacggcgaggccctgggcagagaccacagcgagcacctgagcggcagcagctacagagacgccctgcagagatacggcaccgcccacggcgccccccccgccagaggccccagaatgagctacggcggcagcacctgccacgcctacagcaacaccagagacagatacggcagaagctgggagagctacagcagctgcggcgacttccactactgcgacagagagcacgtgtgcagaaaggaccagagaaacccccccagcctgggcagagtgctgcccgaccccagagaggcctgcggcagcagcagctacgtggccagcatcgtggacggcggcgagagcagaagcgagaagggcgacagcagcagatactag

SEQ ID NO: 24458 - DNA, 1491 bp, Artificial Sequence; identical to SEQ ID NO: 24453
  Description of Artificial Sequence: Synthetic coding sequence

SEQ ID NO: 24459 - DNA, 630 bp, Artificial Sequence
  Description of Artificial Sequence: Synthetic coding sequence
atgagcaacctgaagcccgacggcgagcacggcggcagcaccggcaccggcagcggcgccggcagcggcggcgccctggaggaggaggtgagaaccctgttcgtgagcggcctgcccgtggacatcaagcccagagagctgtacctgctgttcagacccttcaagggctacgagggcagcctgatcaagctgaccgccagacagcccgtgggcttcgtgatcttcgacagcagagccggcgccgaggccgccaagaacgccctgaacggcatcagattcgaccccgagaacccccagaccctgagactggagttcgccaaggccaacaccaagatggccaagagcaagctgatggccacccccaaccccagcaacgtgcaccccgccctgggcgcccacttcatcgccagagacccctacgacctgatgggcgccgccctgatccccgccagccccgaggcctgggccccctaccccctgtacaccaccgagctgacccccgccatcagccacgccgccttcacctaccccaccgccaccgccgccgccgccgccctgcacgcccaggtgagatggtaccccagcagcgacaccacccagcagggctggaagtacagacagttctgctag

SEQ ID NO: 24460 - DNA, 1731 bp, Artificial Sequence
  Description of Artificial Sequence: Synthetic coding sequence
atggacgtgagattctaccccgccgccgccggcgaccccgccagcctggacttcgcccagtgcctgggctactacggctacagcaagttcggcaacaacaacaactacatgaacatggccgaggccaacaacgccttcttcgccgccagcgagcagaccttccacacccccagcctgggcgacgaggagttcgagatcccccccatcacccccccccccgagagcgaccccgccctgggcatgcccgacgtgctgctgcccttccaggccctgagcgaccccctgcccagccagggcagcgagttcaccccccagttccccccccagagcctggacctgcccagcatcaccatcagcagaaacctggtggagcaggacggcgtgctgcacagcagcggcctgcacatggaccagagccacacccaggtgagccagtacagacaggaccccagcctgatcatgagaagcatcgtgcacatgaccgacgccgccagaagcggcgtgatgccccccgcccagctgaccaccatcaaccagagccagctgagcgcccagctgggcctgaacctgggcggcgccagcatgccccacaccagccccagcccccccgccagcaagagcgccacccccagccccagcagcagcatcaacgaggaggacgccgacgaggccaacagagccatcggcgagaagagagccgcccccgacagcggcaagaagcccaagacccccaagaagaagaagaagaaggaccccaacgagccccagaagcccgtgagcgcctacgccctgttcttcagagacacccaggccgccatcaagggccagaaccccaacgccaccttcggcgaggtgagcaagatcgtggccagcatgtgggacagcctgggcgaggagcagaagcaggtgtacaagagaaagaccgaggccgccaagaaggagtacctgaaggccctggccgcctacagagccagcctggtgagcaaggccgccgccgagagcgccgaggcccagaccatcagaagcgtgcagcagaccctggccagcaccaacctgaccagcagcctgctgctgaacacccccctgagccagcacggcaccgtgagcgccagcccccagaccctgcagcagagcctgcccagaagcatcgcccccaagcccctgaccatgagactgcccatgaaccagatcgtgaccagcgtgaccatcgccgccaacatgcccagcaacatcggcgcccccctgatcagcagcatgggcaccaccatggtgggcagcgcccccagcacccaggtgagccccagcgtgcagacccagcagcaccagatgcagctgcagcagcagcagcagcagcagcagcagcagatgcagcagatgcagcagcagcagctgcagcagcaccagatgcaccagcagatccagcagcagatgcagcagcagcacttccagcaccacatgcagcagcacctgcagcagcagcagcagcacctgcagcagcagatcaaccagcagcagctgcagcagcagctgcagcagagactgcagctgcagcagctgcagcacatgcagcaccagagccagcccagccccagacagcacagccccgtggccagccagatcaccagccccatccccgccatcggcagcccccagcccgccagccagcagcaccagagccagatccagagccagacccagacccaggtgctgagccaggtgagcatcttctag

SEQ ID NO: 24461 - DNA, 1023 bp, Artificial Sequence
  Description of Artificial Sequence: Synthetic coding sequence
atggccgcccccctgctgcacaccagactgcccggcgacgccgccgccagccccagcgccgtgaagatgctgggcgccagcagaaccggcatcagcaacatgagagccctggagaacgacttcttcaacagcccccccagaaagaccgtgcagttcggcggcaccgtgaccgaggtgctgctgaagtacaagaccggcgagaccaacgacttcgagctgctgaagaaccagctgctggaccccgacatcaaggacgaccagatcatcaactggctgctggagttcagaagcagcatcatgtacctgaccaaggacttcgagcagctgatcagcatcatcctgagactgccctggctgaacagaagccagaccgtggtggaggagtacctggccttcctgggcaacctggtgagcgcccagaccgtgttcctgagaccctgcctgagcatgatcgccagccacttcgtgccccccagagtgatcatcaaggagggcgacgtggacgtgagcgacagcgacgacgaggacgacaacctgcccgccaacttcgacaccagccagagcctggccaacaacagcaagatctgcaccatcgagtgctacgtgcacaacctgctgagaatcagcgtgtacttccccaccctgagacacgagatcctggagctgatcatcgagaagctgctgaagctggacgtgaacgccagcagacagggcatcgaggacgccgaggagaccgccaaccagacctgcggcggcaccgacagcaccgagggcctgtgcaacatgggcttcgccgaggccttcctggagcccctgtggaagaagctgcaggaccccagcaaccccgccatcatcagacaggccgccggcaactacatcggcagcttcctggccagagccaagttcatccccctgatgatcagagagcagagacacagcgccatgctgctgagcatggaccacttcacccagcccgccaagctgtgcagcacccccctgttcctggacaccagcagcttctag

SEQ ID NO: 24462 - DNA, 1461 bp, Artificial Sequence
  Description of Artificial Sequence: Synthetic coding sequence
atggccgcccccctgctgcacaccagactgcccggcgacgccgccgccagccccagcgccgtgaagatgctgggcgccagcagaaccggcatcagcaacatgagagccctggagaacgacttcttcaacagcccccccagaaagaccgtgcagttcggcggcaccgtgaccgaggtgctgctgaagtacaagaccggcgagaccaacgacttcgagctgctgaagaaccagctgctggaccccgacatcaagagactgccctggctgaacagaagccagaccgtggtggaggagtacctggccttcctgggcaacctggtgagcgcccagaccgtgttcctgagaccctgcctgagcatgatcgccagccacttcgtgccccccagagtgatcatcaaggagggcgacgtggacgtgagcgacagcgacgacgaggacgacaacctgcccgccaacttcgacaccagccagagcctggccaacaacagcaagatctgcaccatcgagtgctacgtgcacaacctgctgagaatcagcgtgtacttccccaccctgagacacgagatcctggagctgatcatcgagaagctgctgaagctggacgtgaacgccagcagacagggcatcgaggacgccgaggagaccgccaaccagacctgcggcggcaccgacagcaccgagggcctgtgcaacatggtgagcagcctgctgatgaaggtggagatgaagttcatcatcatcaagggctggaagcagctggtgctgctgatcttcggcttcgccgaggccttcctggagcccctgtggaagaagctgcaggaccccagcaaccccgccatcatcagacaggccgccggcaactacatcggcagcttcctggccagagccaagttcatccccctgatcaccgtgaagagctgcctggacctgctggtgaactggctgcacatctacctgaacaaccaggacagcggcaccaaggccttctgcgacgtggccctgcacggccccttctacagcgcctgccaggccgtgttctacaccttcgtgttcagacacaagcagctgctgagcggcaacctgaaggagggcctgcagtacctgcagagcctgaacttcgagtggatcgtgatgagccagctgaaccccctgaagatctgcctgcccagcgtggtgaacttcttcgccgccatcaccaacaagtaccagctggtgttctgctacaccatcatcgagagaaacaacagacagatgctgcccgtgatcagaagcaccaccggcggcgacagcgtgcagacctgcaccaaccccctggacaccttcttccccttcgacccctgcgtgctgaagagaagcaagaagttcatcgaccccatctaccaggtgtgggaggacatgagcgccgaggagctgcaggagttcaagaagcccatgaagaagctgttctggagaatcatgtag

SEQ ID NO: 24463 - DNA, 939 bp, Artificial Sequence
  Description of Artificial Sequence: Synthetic coding sequence
atggagcccggcagcgtggagaacctgagcatcgtgtacagaagcagagacttcctggtggtgaacaagcactgggacgtgagaatcgacagcaaggcctggagagagaccctgaccctgcagaagcagctgagatacagattccccgagctggccgaccccgacacctgctacggcttcagattctgccaccagctggacttcagcaccagcggcgccctgtgcgtggccctgaacaaggccgccgccggcagcgcctacagatgcttcaaggagagaagagtgaccaaggcctacctggccctgctgagaggccacatccaggagagcagagtgaccatcagccacgccatcggcagaaacagcaccgagggcagagcccacaccatgtgcatcgagggcagccagggctgcgagaaccccaagcccagcctgaccgacctggtggtgctggagcacggcctgtacgccggcgaccccgtgagcaaggtgctgctgaagcccctgaccggcagaacccaccagctgagagtgcactgcagcgccctgggccaccccgtggtgggcgacctgacctacggcgaggtgagcggcagagaggacagacccttcagaatgatgctgcacgccttctacctgagaatccccaccgacaccgagtgcgtggaggtgtgcacccccgaccccttcctgcccagcctggacgcctgctggagcccccacaccctgctgcagagcctggaccagctggtgcaggccctgagagccacccccgaccccgaccccgaggacagaggccccagacccggcagccccagcgccctgctgcccggccccggcagacccccccccccccccaccaagccccccgagaccgaggcccagagaggcccctgcctgcagtggctgagcgagtggaccctggagcccgacagctag

SEQ ID NO: 24464 - DNA, 1638 bp, Artificial Sequence
  Description of Artificial Sequence: Synthetic coding sequence
atgtggctggacagaagaggctggctgagagtgctgggccactggagatacgacctgagaagacccagcttcaccagaacctggagcggcgacaagggccccatggccgagaccgtgagcacccaggtgggcaccgagggcggcctgagagccagccaccagcagaacggcgacgccggcggcgacgccaaggtggagctgagccccggcccccccaagcccgccggcagagaggtggagcccgcccccgtgggcggcgagcaccccagcgccgccgcccccggccccggcaagcacaagaagagaagaggcgccaccagagagagagtggtgcccccccccaagaagagaagaaccggcgtgagcttcggcgacgagcacttcgccgagaccagctactacttcgagggcggcctgagaaaggtgagaccctactacttcgacttcagaacctactgcaagggcagatgggtgggccacagcctgctgcacgtgttcagcaccgagttcagagcccagcccctggcctactacgaggccgccgtgagagccggcagactgcagctgaacgagaagcccgtgcaggacctgaacatcgtgctgaaggacaacgacttcctgagaaacaccgtgcacagacacgagccccccgtgaccgccgagcccatcagactgctggccgagaacgaggacgtggtggtggtggacaagcccagcagcatccccgtgcacccctgcggcagattcagacacaacaccgtgatcttcatcctgggcaaggagcaccagctgaaggagctgcaccccctgcacagactggacagactgaccagcggcgtgctgatgttcgccaagaccgccgccgtgagcgagagaatccacgagcaggtgagagacagacagctggagaaggagtacgtgtgcagagtggagggcgagttccccaccgaggaggtgacctgcaaggagcccatcctggtggtgagctacaaggtgggcgtgtgcagagtggaccccagaggcaagccctgcgagaccgtgttccagagactgagctacaacggccagagcagcgtggtgagatgcagacccctgaccggcagaacccaccagatcagagtgcacctgcagttcctgggccaccccatcctgaacgaccccatctacaacagcgtggcctggggccccagcagaggcagaggcggctacatccccaagaccaacgaggagctgctgagagacctggtggccgagcaccaggccaagcagagcctggacgtgctggacctgtgcgagggcgacctgagccccggcctgaccgacagcaccgcccccagcagcgagctgggcaaggacgacctggaggagctggccgccgccgcccagaagatggaggaggtggccgaggccgccccccaggagctggacaccatcgccctggccagcgagaaggccgtggagaccgacgtgatgaaccaggagaccgaccccctgtgcgccgagtgcagactggtgagacaggaccccctgccccaggacctggtgatgttcctgcacgccctgagatacaagggccccggcttcgagtacttcagccccatgcccgcctgggcccaggacgactggcagaaggactag

SEQ ID NO: 24465 - DNA, 1575 bp, Artificial Sequence
  Description of Artificial Sequence: Synthetic coding sequence
atgtggctggacagaagaggctggctgagagtgctgggccactggagatacgacctgagaagacccagcttcaccagaacctggagcggcgacaagggccccatggccgagaccgtgagcacccaggtgggcaccgagggcggcctgagagccagccaccagcagaacggcgacgccggcggcgacgccaaggtggagctgagccccggcccccccaagcccgccggcagagaggtggagcccgcccccgtggccagagagagagtggtgcccccccccaagaagagaagaaccggcgtgagcttcggcgacgagcacttcgccgagaccagctactacttcgagggcggcctgagaaaggtgagaccctactacttcgacttcagaacctactgcaagggcagatgggtgggccacagcctgctgcacgtgttcagcaccgagttcagagcccagcccctggcctactacgaggccgccgtgagagccggcagactgcagctgaacgagaagcccgtgcaggacctgaacatcgtgctgaaggacaacgacttcctgagaaacaccgtgcacagacacgagccccccgtgaccgccgagcccatcagactgctggccgagaacgaggacgtggtggtggtggacaagcccagcagcatccccgtgcacccctgcggcagattcagacacaacaccgtgatcttcatcctgggcaaggagcaccagctgaaggagctgcaccccctgcacagactggacagactgaccagcggcgtgctgatgttcgccaagaccgccgccgtgagcgagagaatccacgagcaggtgagagacagacagctggagaaggagtacgtgtgcagagtggagggcgagttccccaccgaggaggtgacctgcaaggagcccatcctggtggtgagctacaaggtgggcgtgtgcagagtggaccccagaggcaagccctgcgagaccgtgttccagagactgagctacaacggccagagcagcgtggtgagatgcagacccctgaccggcagaacccaccagatcagagtgcacctgcagttcctgggccaccccatcctgaacgaccccatctacaacagcgtggcctggggccccagcagaggcagaggcggctacatccccaagaccaacgaggagctgctgagagacctggtggccgagcaccaggccaagcagagcctggacgtgctggacctgtgcgagggcgacctgagccccggcctgaccgacagcaccgcccccagcagcgagctgggcaaggacgacctggaggagctggccgccgccgcccagaagatggaggaggtggccgaggccgccccccaggagctggacaccatcgccctggccagcgagaaggccgtggagaccgacgtgatgaaccaggagaccgaccccctgtgcgccgagtgcagactggtgagacaggaccccctgccccaggacctggtgatgttcctgcacgccctgagatacaagggccccggcttcgagtacttcagccccatgcccgcctgggcccaggacgactggcagaaggactag

SEQ ID NO: 24466 - DNA, 1056 bp, Artificial Sequence
  Description of Artificial Sequence: Synthetic coding sequence
atgagagccgtgctggccagagagatggacggcagaagagtgctgggcagattctggagcggctggagaagaggcctgggcgtgagacccgtgcccgaggacgccggcttcggcaccgaggccagacaccagagacagcccagaggcagctgccagagaagcggccccctgggcgaccagcccttcgccggcctgctgcccaagaacctgagcagagaggagctggtggacgccctgagagccgccgtggtggacagaaagggccccctggtgaccctgaacaagccccagggcctgcccgtgaccggcaagcccggcgagctgaccctgttcagcgtgctgcccgagctgagccagagcctgggcctgagagagcaggagctgcaggtggtgagagccagcggcaaggagagcagcggcctggtgctgctgagcagctgcccccagaccgccagcagactgcagaagtacttcacccacgccagaagagcccagagacccaccgccacctactgcgccgtgaccgacggcatccccgccgccagcgagggcaagatccaggccgccctgaagctggagcacatcgacggcgtgaacctgaccgtgcccgtgaaggcccccagcagaaaggacatcctggagggcgtgaagaagaccctgagccacttcagagtggtggccaccggcagcggctgcgccctggtgcagctgcagcccctgaccgtgttcagcagccagctgcaggtgcacatggtgctgcagctgtgccccgtgctgggcgaccacatgtacagcgccagagtgggcaccgtgctgggccagagattcctgctgcccgccgagaacaacaagccccagagacaggtgctggacgaggccctgctgagaagactgcacctgacccccagccaggccgcccagctgcccctgcacctgcacctgcacagactgctgctgcccggcaccagagccagagacacccccgtggagctgctggcccccctgcccccctacttcagcagaaccctgcagtgcctgggcctgagactgcagtag

SEQ ID NO: 24467 - DNA, 1011 bp, Artificial Sequence
  Description of Artificial Sequence: Synthetic coding sequence
atgagagccgtgctggccagagagatggacggcagaagagtgctgggcagattctggagcggctggagaagaggcctgggcgtgagacccgtgcccgaggacgccggcttcggcaccgaggccagacaccagagacagcccagaggcagctgccagagaagcggccccctgggcgaccagcccttcgccggcctgctgcccaagaacctgagcagagaggagctggtggacgccctgagagccgccgtggtggacagaaagggcaagcccggcgagctgaccctgttcagcgtgctgcccgagctgagccagagcctgggcctgagagagcaggagctgcaggtggtgagagccagcggcaaggagagcagcggcctggtgctgctgagcagctgcccccagaccgccagcagactgcagaagtacttcacccacgccagaagagcccagagacccaccgccacctactgcgccgtgaccgacggcatccccgccgccagcgagggcaagatccaggccgccctgaagctggagcacatcgacggcgtgaacctgaccgtgcccgtgaaggcccccagcagaaaggacatcctggagggcgtgaagaagaccctgagccacttcagagtggtggccaccggcagcggctgcgccctggtgcagctgcagcccctgaccgtgttcagcagccagctgcaggtgcacatggtgctgcagctgtgccccgtgctgggcgaccacatgtacagcgccagagtgggcaccgtgctgggccagagattcctgctgcccgccgagaacaacaagccccagagacaggtgctggacgaggccctgctgagaagactgcacctgacccccagccaggccgcccagctgcccctgcacctgcacctgcacagactgctgctgcccggcaccagagccagagacacccccgtggagctgctggcccccctgcccccctacttcagcagaaccctgcagtgcctgggcctgagactgcagtag

SEQ ID NO: 24468 - DNA, 864 bp, Artificial Sequence
  Description of Artificial Sequence: Synthetic coding sequence
atggccaccgtgatggccgccaccgccgccgagagagccgtgctggaggaggagttcagatggctgctgcacgacgaggtgcacgccgtgctgaagcagctgcaggacatcctgaaggaggccagcctgagattcaccctgcccggcagcggcaccgagggccccgccaagcaggagaacttcatcctgggcagctgcggcaccgaccaggtgaagggcgtgctgaccctgcagggcgacgccctgagccaggccgacgtgaacctgaagatgcccagaaacaaccagctgctgcacttcgccttcagagaggacaagcagtggaagctgcagcagatccaggacgccagaaaccacgtgagccaggccatctacctgctgaccagcagagaccagagctaccagttcaagaccggcgccgaggtgctgaagctgatggacgccgtgatgctgcagctgaccagagccagaaacagactgaccacccccgccaccctgaccctgcccgagatcgccgccagcggcctgaccagaatgttcgcccccgccctgcccagcgacctgctggtgaacgtgtacatcaacctgaacaagctgtgcctgaccgtgtaccagctgcacgccctgcagcccaacagcaccaagaacttcagacccgccggcggcgccgtgctgcacagccccggcgccatgttcgagtggggcagccagagactggaggtgagccacgtgcacaaggtggagtgcgtgatcccctggctgaacgacgccctggtgtacttcaccgtgagcctgcagctgtgccagcagctgaaggacaagatcagcgtgttcagcagctactggagctacagacccttctag

SEQ ID NO: 24469 - DNA, 6681 bp, Artificial Sequence
  Description of Artificial Sequence: Synthetic coding sequence
atggtgctggccggcctgatcagaaagctgggccaccagctggccgagatcagagagagagccctgaagagcatcctgtgcaagatcgagcacaacctgatctgctacgccgacctgatccaggagagacagctgttcctgcacctgctggagtggttcaacttccccagcgtgcccatgaaggaggaggtgctgaacctgctgagcagactggtgaagtacccccccgccgtgcagcacctggtggacgtgggcgccgtggagttcctgagcaagctgagaagcaacgtggagcccaacctgcaggccgagatcgacggcatcctggacggcctgttcctgctgcccagcgaggtgcccgccctgagcagcgccagctaccagaccaaccagaccgagctgagcaagaaccccgagatcctgaccggctacttcccccaggacaagagcaacttccagcagatggaggtgccccccagacccgtggtgaaccagaccgtgaagtgcctgaagttcagcaccttcccctggctgcccctgaccaccaccgacagacacgtgctgagcagcaacgagagcagcctgagaagcagcaaccacaccctgatctggaacacctgcgagctgctgaaggacgtgatcatgcaggacttccccgccgagatcttcctgcagagacccaagatcgtgcagagcctgctgagcctgctgaagctggccttcggcgacggcaagcacagactggccctgcagagcgtgagctgcctgcagcagctgtgcatgtacctgagaaacagactgaacttccacagagaccccggcttcttcagcaacaagcacgacaccgtgagccagaacagcagcctgagctactgccacgaggccagaggcacccaccacagccagaaccccagccccggcagcagcagccccagacccagcgtggtgggcagaaccggccagagacccagaggcgacggccaggactgggacgccgccagcagcagcggcagcagcagccacgcccacgtgaacagcagaatcagcgtgcacagccccctggacatgggccacatcgacctgcccgagctggagaccgaggacaccctggagctgcagttccagcagctgagcctgccccagttctgcgtgagcatcctggagagcgccgtgcccctgctgagaaccggcagcagacaggtgatcatcagagtgctggagctgctgaccgaggacatgaccctgatcggcgaggccatcagcaccgacatctgggacgacagcagcctgttcggcatcgacatgaaggagaagctgctgctggtgctgggcgccctgggcgagaccatgtgctaccacaagagcagcatcagcctggagcagcccgaggtgatgctggtgcaccacagaatggccttcatcagcatcagcctgttcgccgtgagactgctgcagaccctgctgcccgtggagaaggccagcgagttcctgagcgagcccatgagcaccgccctgttcctgctgagcctggacatgcccatcagcctggagtaccccaacatccacgaggccgtggtggcctacctggagcagctgaacagcgagaactacagcatctacaagagaaccgccgaggccgtgtacagcatcgagtgcacctgcaacttcctgagcgacatcggcaaggagggcgagaagaacctgctggagctggtggagctggccgaccaggccctgagaagcttcagctaccaccagcacttccccctgatcaaggagatcatcagcatctgcagcaagatctggaagagcgcccaggccagccccctgctgcagggcgagagccagaaggtgctgctgcacatgctgagccaccccctgcccagagtgaaggccgagacctaccactgctgcctggagatcaccaaggagtgcctgggcgtgcacaacgtgaccaagcccgtgagcagcctgtgcaacggcatccacttcctgctgcaccccaaggtgctgtacgagatcagcgtgttcggcatccaggagcccgagagcgaggtgaacaccgccgccaaggccatcctgctgtacctgctgcagggcagactgatgatgaccgccctgacctggaacaagttcatcgagagcctgtgccccgtgatccccatcctgcagggctacgccgacaccgaggaccccctgggcaactgcatcctgctgctgagcaaggccagcagcgacaccgaggagatgctgccctgcaccaccagactgaagagcatgctgagactgctgctggtgaagaagcccagcgtgagaagcctggccctgaagctgctggccttccacctgaccagcgaggagggcgccgacaccaagagacccctgatcgacgccagagtgctgagcagagtgaccgacctgttcatcggcaagaagcccatcgagctgagactggacgacagaagagagctggtgatcaagctggagaccgtggagaaggtgtacgagatcttcaccagcgacgacgtggacctggtgctgagaaagagcgccgccgagcagctggccgtgatcatgcaggacatcaagatgcacgccgtggtgaagaagctgtgcctgatcgacaagatcatcgagtacctgaacgagtgcgtgagccaggacggcaaggtggtggagtgcctggtgcagccctgcctgaccctgctgagaaaggtgctgtgcggcgaccccgtgatgagagtgagcctgagccagcagagcagcctgctgaccgtgctgttcagagtgagcctgatcttccacgaggactgcagcgtggtgaccgaggtgggcgccctgttctgcctgctgctgttcgacgaggtgagcagaatggacatgtggagcgtgaaccccagcaacaagcccagcctgcccagcgtgttcagcctgcccgtgagcgtgttcagaagataccacctgcccgtgcacgtgatcggccaccacgccgtgagcccctacagcatcgtgctgcccctgagcgccgactgcctggccctgaagcccgtgagcgacatgctgagaatcgcctggaacctgagctggtaccacggcagcgacaacctgctgaagcagatgaacagcgagaccaagacccaggagatcctggacgccctgaagctgagcaccgaggacatcctgaccctgaagatcacccacatggccagcggcctgcaggactgcctgcacagcatcgtgcaggccgccacccacagagaggtgagagccgccgtgaccagaatgagcttctacctgctgaacgacagactgagcctgaagggctgccccggcccctgcggcgtgaccctgaagagcctggcctggcacaccgccctgaacagattcctgcaggtgctgcccgcctgcaccgaggacgagaagctgctgatcgacatcatccacttcctgaacaagctgatcaaggagcagagaaagaacagcagcctggagctgctgaactggatcctggagctgctgctgagacacagcgccaaccccctgctggacctgctggtgctgaccgagagccaggccagagaggagaccgacgacatcagaaccgccgtgagacagcagctgcagaaggagctgatcgccctgttcgacaccctgctgctgaacttcatggaggtgaccgacagaaagtgcagcgagctgctgtacgtgttccagacccagctggccctgaagctgctgcagtgcctgaaggtgaccgacgccccccacttctacggcctgcccagcctggagagaaccctgagaggcatggccaacctgaccgccttccccggctggagcagccacagccccctgaccaagcccctggacatctgcgtgaagtacctgagcggcctgctggaggtgatcaccagcttctacgtggagagaggcggcaacgccatgagcttcatgggcaagggcgtgaccaagagcaccatcctgtgcctgctgcacctgagccacgagatgatggcccaggccggcagcctggagtggatgagcctgtggttcctgcccctgggcagccacagcgaggagcacatccccacccagcagggcctggcctggctgatccccctgtgggtggacagagaccccgaggtgagattcaccagcctgggcctgggcagcgccctgaccaccctggagaccggctgcgtggccctggccaacagctgccagaacatcagcggcggcctgtggggcaccgtggtgaacatcctgctggaccagagcgagtgcagcatggtgagaagagaggccgccttcatcctgcagaacctgctggtgatccccatgcccaccgagatcatcaaggactacacctggcagggcccctgcgtgcacgacgaggacagcggcctgagcctgatcggcaagcccgccctgcaggccctgctgtaccactgccacttctacgagcacctgaaccagatggtgaagcactgctacctgggcagatgcatgttcgacctgaacttcagcgccttcgacagaaacagcgagagcaacgacctgaacggcctggacgacagcttcaagttctggagagcccccagcagaaccagccaggacagagaccccagcagcctgagcaccagcgagaccaccgtggcccccagcctgggcagcaccgagttccagcccctggtgcagagcaccaccctgctgcccgaggccagccacgaccagttcgtggcccagggccaccaggagagcaccagccccagacccccccacgacagcagcctgagcgcccccctgcccaagctgtgcgtgttcgtgacccccagcctgctgagcgccatgtgcagcctgctggacaacctgctgaccatcgcccccagagacaccgccaaggccttcagacaggcccacctgatcgagctgctgtgcagcatcgccgacgccaccctgatccagacctgcgtgcaggagctgagagccctgctgcccagcagcccccccgccgagcacacccaggcccaggtgagcttcctgctggagtacctgagcagcctgagcagactgctgcagagctgcctgctggtggagcccgacctggtgatccaggacgagctggtgaagcccctgatcaccaacatcatcggcatcctgaccatctgcaccaaggacgtgctggacaaggagctgatcagcgccttctaccacacctggacccacctgttcaacctgctggccatgctgctgagaaaggccggcgccatcaccctgcccttcgtgaccgtggccctggccaagcactggaccgccgccatcgacatgttctgcacctgcgccggcctgagcgccacctgccccgccctgtacaccgccagcctgcagttcctgagcgtgctgctgaccgaggaggccaagggccacctgcaggccaagagcaagacccacctgtgctgcagccccaccgtggccagcctgctggacgacagccaggagaaccagaagagcctggagcagctgagcgacgtgatcctgcagtgctacgagggcaagagcagcaaggacatcctgaagagagtggccgccaacgccctgatgagcctgctggccgtgagcagaagagcccagaagcacgccctgaaggccaacctgatcgacaactgcatggagcagatgaagcacatcaacgcccagctgaacctggacagcctgagacccggcaaggccgccctgaagaagaaggaggacggcgtgatcaaggagctgagcatcgccatgcagctgctgagaaactgcctgtaccagaacgaggagtgcaaggaggccgccctggaggcccacctggtgcccgtgctgcacagcctgtggccctggatcctgatggacgacagcctgatgcagatcagcctgcagctgctgtgcgtgtacaccgccaacttccccaacggctgcagcagcctgtgctggagcagctgcggccagcaccccgtgcaggccacccacagaggcgccgtgagcaacagcctgatgctgtgcatcctgaagctggccagccagatgcccctggagaacaccaccgtgcagcagatggtgttcatgctgctgagcaacctggccctgagccacgactgcaagggcgtgatccagaagagcaacttcctgcagaacttcctgagcctggccctgcccaagggcggcaacaagcacctgagcaacctgaccatcctgtggctgaagctgctgctgaacatcagcagcggcgaggacggccagcagatgatcctgagactggacggctgcctggacctgctgaccgagatgagcaagtacaagcacaagagcagccccctgctgcccctgctgatcttccacaacgtgtgcttcagccccgccaacaagcccaagatcctggccaacgagaaggtgatcaccgtgctggccgcctgcctggagagcgagaaccagaacgcccagagaatcggcgccgccgccctgtgggccctgatctacaactaccagaaggccaagaccgccctgaagagccccagcgtgaagagaagagtggacgaggcctacagcctggccaagaagaccttccccaacagcgaggccaaccccctgaacgcctactacctgaagtgcctggagaacctggtgcagctgctgaacagcagctag

SEQ ID NO: 24470 - DNA, 4782 bp, Artificial Sequence
  Description of Artificial Sequence: Synthetic coding sequence
atggtgctggccggcctgatcagaaagctgggccaccagctggccgagatcagagagagagccctgaagagcatcctgtgcaagatcgagcacaacctgatctgctacgccgacctgatccaggagagacagctgttcctgcacctgctggagtggttcaacttccccagcgtgcccatgaaggaggaggtgctgaacctgctgagcagactggtgaagtacccccccgccgtgcagcacctggtggacgtgggcgccgtggagttcctgagcaagctgagaagcaacgtggagcccaacctgcaggccgagatcgacggcatcctggacggcctgttcctgctgcccagcgaggtgcccgccctgagcagcgccagctaccagaccaaccagaccgagctgagcaagaaccccgagatcctgaccggctacttcccccaggacaagagcaacttccagcagatggaggtgccccccagacccgtggtgaaccagaccgtgaagtgcctgaagttcagcaccttcccctggctgcccctgaccaccaccgacagacacgtgctgagcagcaacgagagcagcctgagaagcagcaaccacaccctgatctggaacacctgcgagctgctgaaggacgtgatcatgcaggacttccccgccgagatcttcctgcagagacccaagatcgtgcagagcctgctgagcctgctgaagctggccttcggcgacggcaagcacagactggccctgcagagcgtgagctgcctgcagcagctgtgcatgtacctgagaaacagactgaacttccacagagaccccggcttcttcagcaacaagcacgacaccgtgagccagaacagcagcctgagctactgccacgaggccagaggcacccaccacagccagaaccccagccccggcagcagcagccccagacccagcgtggtgggcagaaccggccagagacccagaggcgacggccaggactgggacgccgccagcagcagcggcagcagcagccacgcccacgtgaacagcagaatcagcgtgcacagccccctggacatgggccacatcgacctgcccgagctggagaccgaggacaccctggagctgcagttccagcagctgagcctgccccagttctgcgtgagcatcctggagagcgccgtgcccctgctgagaaccggcagcagacaggtgatcatcagagtgctggagctgctgaccgaggacatgaccctgatcggcgaggccatcagcaccgacatctgggacgacagcagcctgttcggcatcgacatgaaggagaagctgctgctggtgctgggcgccctgggcgagaccatgtgctaccacaagagcagcatcagcctggagcagcccgaggtgatgctggtgcaccacagaatggccttcatcagcatcagcctgttcgccgtgagactgctgcagaccctgctgcccgtggagaaggccagcgagttcctgagcgagcccatgagcaccgccctgttcctgctgagcctggacatgcccatcagcctggagtaccccaacatccacgaggccgtggtggcctacctggagcagctgaacagcgagaactacagcatctacaagagaaccgccgaggccgtgtacagcatcgagtgcacctgcaacttcctgagcgacatcggcaaggagggcgagaagaacctgctggagctggtggagctggccgaccaggccctgagaagcttcagctaccaccagcacttccccctgatcaaggagatcatcagcatctgcagcaagatctggaagagcgcccaggccagccccctgctgcagggcgagagccagaaggtgctgctgcacatgctgagccaccccctgcccagagtgaaggccgagacctaccactgctgcctggagatcaccaaggagtgcctgggcgtgcacaacgtgaccaagcccgtgagcagcctgtgcaacggcatccacttcctgctgcaccccaaggtgctgtacgagatcagcgtgttcggcatccaggagcccgagagcgaggtgaacaccgccgccaaggccatcctgctgtacctgctgcagggcagactgatgatgaccgccctgacctggaacaagttcatcgagagcctgtgccccgtgatccccatcctgcagggctacgccgacaccgaggaccccctgggcaactgcatcctgctgctgagcaaggccagcagcgacaccgaggagatgctgccctgcaccaccagactgaagagcatgctgagactgctgctggtgaagaagcccagcgtgagaagcctggccctgaagctgctggccttccacctgaccagcgaggagggcgccgacaccaagagacccctgatcgacgccagagtgctgagcagagtgaccgacctgttcatcggcaagaagcccatcgagctgagactggacgacagaagagagctggtgatcaagctggagaccgtggagaaggtgtacgagatcttcaccagcgacgacgtggacctggtgctgagaaagagcgccgccgagcagctggccgtgatcatgcaggacatcaagatgcacgccgtggtgaagaagctgtgcctgatcgacaagatcatcgagtacctgaacgagtgcgtgagccaggacggcaaggtggtggagtgcctggtgcagccctgcctgaccctgctgagaaaggtgctgtgcggcgaccccgtgatgagagtgagcctgagccagcagagcagcctgctgaccgtgctgttcagagtgagcctgatcttccacgaggactgcagcgtggtgaccgaggtgggcgccctgttctgcctgctgctgttcgacgaggtgagcagaatggacatgtggagcgtgaaccccagcaacaagcccagcctgcccagcgtgttcagcctgcccgtgagcgtgttcagaagataccacctgcccgtgcacgtgatcggccaccacgccgtgagcccctacagcatcgtgctgcccctgagcgccgactgcctggccctgaagcccgtgagcgacatgctgagaatcgcctggaacctgagctggtaccacggcagcgacaacctgctgaagcagatgaacagcgagaccaagacccaggagatcctggacgccctgaagctgagcaccgaggacatcctgaccctgaagatcacccacatggccagcggcctgcaggactgcctgcacagcatcgtgcaggccgccacccacagagaggtgagagccgccgtgaccagaatgagcttctacctgctgaacgacagactgagcctgaagggctgccccggcccctgcggcgtgaccctgaagagcctggcctggcacaccgccctgaacagattcctgcaggtgctgcccgcctgcaccgaggacgagaagctgctgatcgacatcatccacttcctgaacaagctgatcaaggagcagagaaagaacagcagcctggagctgctgaactggatcctggagctgctgctgagacacagcgccaaccccctgctggacctgctggtgctgaccgagagccaggccagagaggagaccgacgacatcagaaccgccgtgagacagcagctgcagaaggagctgatcgccctgttcgacaccctgctgctgaacttcatggaggtgaccgacagaaagtgcagcgagctgctgtacgtgttccagacccagctggccctgaagctgctgcagtgcctgaaggtgaccgacgccccccacttctacggcctgcccagcctggagagaaccctgagaggcatggccaacctgaccgccttccccggctggagcagccacagccccctgaccaagcccctggacatctgcgtgaagtacctgagcggcctgctggaggtgatcaccagcttctacgtggagagaggcggcaacgccatgagcttcatgggcaagggcgtgaccaagagcaccatcctgtgcctgctgcacctgagccacgagatgatggcccaggccggcagcctggagtggatgagcctgtggttcctgcccctgggcagccacagcgaggagcacatccccacccagcagggcctggcctggctgatccccctgtgggtggacagagaccccgaggtgagattcaccagcctgggcctgggcagcgccctgaccaccctggagaccggctgcgtggccctggccaacagctgccagaacatcagcggcggcctgtggggcaccgtggtgaacatcctgctggaccagagcgagtgcagcatggtgagaagagaggccgccttcatcctgcagaacctgctggtgatccccatgcccaccgagatcatcaaggactacacctggcagggcccctgcgtgcacgacgaggacagcggcctgagcctgatcggcaagcccgccctgcaggccctgctgtaccactgccacttctacgagcacctgaaccagatggtgaagcactgctacctgggcagatgcatgttcgacctgaacttcagcgccttcgacagaaacagcgagagcaacgacctgaacggcctggacgacagcttcaagttctggagagcccccagcagaaccagccaggacagagaccccagcagcctgagcaccagcgagaccaccgtggcccccagcctgggcagcaccgagttccagcccctggtgcagagcaccaccctgctgcccgaggccagccacgaccagttcgtggcccagggcaacagacacttcggcaccaacatccagttctag

SEQ ID NO: 24471 - DNA, 2640 bp, Artificial Sequence
  Description of Artificial Sequence: Synthetic coding sequence
atggtgctggccggcctgatcagaaagctgggccaccagctggccgagatcagagagagagccctgaagagcatcctgtgcaagatcgagcacaacctgatctgctacgccgacctgatccaggagagacagctgttcctgcacctgctggagtggttcaacttccccagcgtgcccatgaaggaggaggtgctgaacctgctgagcagactggtgaagtacccccccgccgtgcagcacctggtggacgtgggcgccgtggagttcctgagcaagctgagaagcaacgtggagcccaacctgcaggccgagatcgacggcatcctggacggcctgttcctgctgcccagcgaggtgcccgccctgagcagcgccagctaccagaccaaccagaccgagctgagcaagaaccccgagatcctgaccggctacttcccccaggacaagagcaacttccagcagatggaggtgccccccagacccgtggtgaaccagaccgtgaagtgcctgaagttcagcaccttcccctggctgcccctgaccaccaccgacagacacgtgctgagcagcaacgagagcagcctgagaagcagcaaccacaccctgatctggaacacctgcgagctgctgaaggacgtgatcatgcaggacttccccgccgagatcttcctgcagagacccaagatcgtgcagagcctgctgagcctgctgaagctggccttcggcgacggcaagcacagactggccctgcagagcgtgagctgcctgcagcagctgtgcatgtacctgagaaacagactgaacttccacagagaccccggcttcttcagcaacaagcacgacaccgtgagccagaacagcagcctgagctactgccacgaggccagaggcacccaccacagccagaaccccagccccggcagcagcagccccagacccagcgtggtgggcagaaccggccagagacccagaggcgacggccaggactgggacgccgccagcagcagcggcagcagcagccacgcccacgtgaacagcagaatcagcgtgcacagccccctggacatgggccacatcgacctgcccgagctggagaccgaggacaccctggagctgcagttccagcagctgagcctgccccagttctgcgtgagcatcctggagagcgccgtgcccctgctgagaaccggcagcagacaggtgatcatcagagtgctggagctgctgaccgaggacatgaccctgatcggcgaggccatcagcaccgacatctgggacgacagcagcctgttcggcatcgacatgaaggagaagctgctgctggtgctgggcgccctgggcgagaccatgtgctaccacaagagcagcatcagcctggagcagcccgaggtgatgctggtgcaccacagaatggccttcatcagcatcagcctgttcgccgtgagactgctgcagaccctgctgcccgtggagaaggccagcgagttcctgagcgagcccatgagcaccgccctgttcctgctgagcctggacatgcccatcagcctggagtaccccaacatccacgaggccgtggtggcctacctggagcagctgaacagcgagaactacagcatctacaagagaaccgccgaggccgtgtacagcatcgagtgcacctgcaacttcctgagcgacatcggcaaggagggcgagaagaacctgctggagctggtggagctggccgaccaggccctgagaagcttcagctaccaccagcacttccccctgatcaaggagatcatcagcatctgcagcaagatctggaagagcgcccaggccagccccctgctgcagggcgagagccagaaggtgctgctgcacatgctgagccaccccctgcccagagtgaaggccgagacctaccactgctgcctggagatcaccaaggagtgcctgggcgtgcacaacgtgaccaagcccgtgagcagcctgtgcaacggcatccacttcctgctgcaccccaaggtgctgtacgagatcagcgtgttcggcatccaggagcccgagagcgaggtgaacaccgccgccaaggccatcctgctgtacctgctgcagggcagactgatgatgaccgccctgacctggaacaagttcatcgagagcctgtgccccgtgatccccatcctgcagggctacgccgacaccgaggaccccctgggcaactgcatcctgctgctgagcaaggccagcagcgacaccgaggagatgctgccctgcaccaccagactgaagagcatgctgagactgctgctggtgaagaagcccagcgtgagaagcctggccctgaagctgctggccttccacctgaccagcgaggagggcgccgacaccaagagacccctgatcgacgccagagtgctgagcagagtgaccgacctgttcatcggcaagaagcccatcgagctgagactggacgacagaagagagctggtgatcaagctggagaccgtggagaaggtgtacgagatcttcaccagcgacgacgtggacctggtgctgagaaagagcgccgccgagcagctggccgtgatcatgcagggctgcagaatgttcggcaccaccatgccccacaccctggaggagggcttcatgtggtag

SEQ ID NO: 24472 - DNA, 438 bp, Artificial Sequence
  Description of Artificial Sequence: Synthetic coding sequence
atggccgagagcctgagaagccccagaagaagcctgtacaagctggtgggcagccccccctggaaggaggccttcagacagagatgcctggagagaatgagaaacagcagagacagactgctgaacagatacagacaggccggcagcagcggccccggcaacagccagaacagcttcctggtgcaggaggtgatggaggaggagtggaacgccctgcagagcgtggagaactgccccgaggacctggcccagctggaggagctgatcgacatggccgtgctggaggagatccagcaggagctgatcaaccaggagcagagcatcatcagcgagtacgagaagagcctgcagttcgacgagaagtgcctgagcatcatgctggccgagtgggaggccaaccccctgatctgccccgtgtgcaccaacctgctgagctag

SEQ ID NO: 24473 - DNA, 519 bp, Artificial Sequence
  Description of Artificial Sequence: Synthetic coding sequence
atggccgagagcctgagaagccccagaagaagcctgtacaagctggtgggcagccccccctggaaggaggccttcagacagagatgcctggagagaatgagaaacagcagagacagactgctgaacagatacagacaggccggcagcagcggccccggcaacagccagaacagcttcctggtgcaggaggtgatggaggaggagtggaacgccctgcagagcgtggagaactgccccgaggacctggcccagctggaggagctgatcgacatggccgtgctggaggagatccagcaggagctgatcaaccaggagcagagcatcatcagcgagtacgagaagagcctgcagttcgacgagaagtgcctgagcatcatgctggccgagtgggaggccaaccccctgatctgccccgtgtgcaccaagtacaacctgagaatcaccagcggcgtggtggtgtgccagtgcggcctgagcatccccagccacgcctgcgacacctgggccgtgatcctgtag

SEQ ID NO: 24474 - DNA, 660 bp, Artificial Sequence
  Description of Artificial Sequence: Synthetic coding sequence
atggccgagagcctgagaagccccagaagaagcctgtacaagctggtgggcagccccccctggaaggaggccttcagacagagatgcctggagagaatgagaaacagcagagacagactgctgaacagatacagacaggccggcagcagcggccccggcaacagccagaacagcttcctggtgcaggaggtgatggaggaggagtggaacgccctgcagagcgtggagaactgccccgaggacctggcccagctggaggagctgatcgacatggccgtgctggaggagatccagcaggagctgatcaaccaggagcagagcatcatcagcgagtacgagaagagcctgcagttcgacgagaagtgcctgagcatcatgctggccgagtgggaggccaaccccctgatctgccccgtgtgcaccaagtacaacctgagaatcaccagcggcgtggtggtgtgccagtgcggcctgagcatccccagccacagcagcgagctgaccgagcagaagctgagagcctgcctggagggcagcatcaacgagcacagcgcccactgcccccacacccccgagttcagcgtgaccggcggcaccgaggagaagagcagcctgctgatgagctgcctggcctgcgacacctgggccgtgatcctgtag

SEQ ID NO: 24475 - DNA, 696 bp, Artificial Sequence
  Description of Artificial Sequence: Synthetic coding sequence
atggccgagagcctgagaagccccagaagaagcctgtacaagctggtgggcagccccccctggaaggaggccttcagacagagatgcctggagagaatgagaaacagcagagacagactgctgaacagatacagacaggccggcagcagcggccccggcaacagccagaacagcttcctggtgcaggaggtgatggaggaggagtggaacgccctgcagagcgtggagaactgccccgaggacctggcccagctggaggagctgatcgacatggccgtgctggaggagatccagcaggagctgatcaaccaggagcagagcatcatcagcgagtacgagaagagcctgcagttcgacgagaagtgcctgagcatcatgctggccgagtgggaggccaaccccctgatctgccccgtgtgcaccaagtacaacctgagaatcaccagcggcgtggtggtgtgccagtgcggcctgagcatccccagccacagcagcgagctgaccgagcagaagctgagagcctgcctggagggcagcatcaacgagcacagcgcccactgcccccacacccccgagttcagcgtgaccggcggcaccgaggagaagagcagcctgctgatgagctgcctggtgagcgtgagctgggaccccctgtgcggcaagagagacctgtggctggtgctgttccccccctag

SEQ ID NO: 24476 - DNA, 321 bp, Artificial Sequence
  Description of Artificial Sequence: Synthetic coding sequence
atggccgagagcctgagaagccccagaagaagcctgtacaagctggtgggcagccccccctggaaggaggccttcagacagagatgcctggagagaatgagaaacagcagagacagactgctgaacagatacagacaggccggcagcagcggccccggcaacagccagaacagcttcctggtgcaggaggtgatggaggaggagtggaacgccctgcagagcgtggagaactgccccgaggacctggcccagctggaggagctgatcgacatggccgtgctggaggagatccagcaggagctgatcaaccagggcctgtag

SEQ ID NO: 24477 - DNA, 447 bp, Artificial Sequence
  Description of Artificial Sequence: Synthetic coding sequence
atggccgagagcctgagaagccccagaagaagcctgtacaagctggtgggcagccccccctggaaggaggccttcagacagagatgcctggagagaatgagaaacagcagagacagactgctgaacagatacagacaggccggcagcagcggccccggcaacagccagaacagcttcctggtgcaggaggtgatggaggaggagtggaacgccctgcagagcgtggagaactgccccgaggacctggcccagctggaggagctgatcgacatggccgtgctggaggagatccagcaggagctgatcaaccaggagcagagcatcatcagcgagtacgagaagagcctgcagttcgacgagaagtgcctgagcatcatgctggccgagtgggaggccaaccccctgatctgccccgtgtgcaccaagcccgtgatcctgggcctgtag

SEQ ID NO: 24478 - DNA, 321 bp, Artificial Sequence
  Description of Artificial Sequence: Synthetic coding sequence
atggccgagagcctgagaagccccagaagaagcctgtacaagctggtgggcagccccccctggaaggaggccttcagacagagatgcctggagagaatgagaaacagcagagacagactgctgaacagatacagacaggccggcagcagcggccccggcaacagccagaacagcttcctggtgcaggaggtgatggaggaggagtggaacgccctgcagagcgtggagaactgccccgaggacctggcccagctggaggagctgatcgacatggccgtgctggaggagatccagcaggagctgatcaaccaggtgttctag

SEQ ID NO: 24479 - DNA, 591 bp, Artificial Sequence
  Description of Artificial Sequence: Synthetic coding sequence
atggaggccgaggacgaggacgagaagtacctgcaggagtgcctgagcaagagcgacagcctgcagaagcagatcagccagaaggagaagcagctggtgcagctggagaccgacctgaagatcgagaaggagtggagacagaccctgcaggaggacctgcagaaggagaaggacgccctgagccacctgagaaacgagacccagcagatcatcagcctgaagaaggagttcctgaacctgcaggacgagaaccagcagctgaagaagatctaccacgagcaggagcaggccctgcaggagctgggcaacaagctgagcgagagcaagctgaagatcgaggacatcaaggaggccaacaaggccctgcagggcctggtgtggctgaaggacaaggaggccacccactgcaagctgtgcgagaaggagttcagcctgagcaagagaaagcaccactgcagaaactgcggcgagatcttctgcaacgcctgcagcgacaacgagctgcccctgcccagcagccccaagcccgtgagagtgtgcgacagctgccacgccctgctgatccagagatgcagcagcaacctgccctag

SEQ ID NO: 24480 - DNA, 699 bp, Artificial Sequence
  Description of Artificial Sequence: Synthetic coding sequence
atggccaccaaggaccccaccgccgtggagagagccaacctgctgaacatggccaagctgagcatcaagggcctgatcgagagcgccctgagcttcggcagaaccctggacagcgactacccccccctgcagcagttcttcgtggtgatggagcactgcctgaagcacggcctgaaggtgagaaagagcttcctgagctacaacaagaccatctggggccccctggagctggtggagaagctgtaccccgaggccgaggagatcggcgccagcgtgagagacctgcccggcctgaagacccccctgggcagagccagagcctggctgagactggccctgatgcagaagaagatggccgactacctgagatgcctgatcatccagagagacctgctgagcgagttctacgagtaccacgccctgatgatggaggaggagggcgccgtgatcgtgggcctgctggtgggcctgaacgtgatcgacgccaacctgtgcgtgaagggcgaggacctggacagccaggtgggcgtgatcgacttcagcatgtacctgaagaacgaggaggacatcggcaacaaggagagatacgacttccacaagctgttccacatcctgggcttcctgtacagcagcctgcagatcatcatcagaagcatctacctgcagtgcggcttcatcctgctgttcagccccctgtag

SEQ ID NO: 24481 - DNA, 1926 bp, Artificial Sequence
  Description of Artificial Sequence: Synthetic coding sequence
atgaccttccaggtgtggggctggagaagagaggacgccagccaggtgctggcctgggtgcccgacgccgagggcggcagaagaggcatgctgaccagaagaagcctggccaccaaggaccccaccgccgtggagagagccaacctgctgaacatggccaagctgagcatcaagggcctgatcgagagcgccctgagcttcggcagaaccctggacagcgactacccccccctgcagcagttcttcgtggtgatggagcactgcctgaagcacggcctgaaggtgagaaagagcttcctgagctacaacaagaccatctggggccccctggagctggtggagaagctgtaccccgaggccgaggagatcggcgccagcgtgagagacctgcccggcctgaagacccccctgggcagagccagagcctggctgagactggccctgatgcagaagaagatggccgactacctgagatgcctgatcatccagagagacctgctgagcgagttctacgagtaccacgccctgatgatggaggaggagggcgccgtgatcgtgggcctgctggtgggcctgaacgtgatcgacgccaacctgtgcgtgaagggcgaggacctggacagccaggtgggcgtgatcgacttcagcatgtacctgaagaacgaggaggacatcggcaacaaggagagaaacgtgcagatcgccgccatcctggaccagaagaactacgtggaggagctgaacagacagctgaacagcaccgtgagcagcctgcacagcagagtggacagcctggagaagagcaacaccaagctgatcgaggagctggccatcgccaagaacaacatcatcaagctgcaggaggagaaccaccagctgagaagcgagaacaagctgatcctgatgaagacccagcagcacctggaggtgaccaaggtggacgtggagaccgagctgcagacctacaagcacagcagacagggcctggacgagatgtacaacgaggccagaagacagctgagagacgagagccagctgagacaggacgtggagaacgagctggccgtgcaggtgagcatgaagcacgagatcgagctggccatgaagctgctggagaaggacatccacgagaagcaggacaccctgatcggcctgagacagcagctggaggaggtgaaggccatcaacatcgagatgtaccagaagctgcagggcagcgaggacggcctgaaggagaagaacgagatcatcgccagactggaggagaagaccaacaagatcaccgccgccatgagacagctggagcagagactgcagcaggccgagaaggcccagatggaggccgaggacgaggacgagaagtacctgcaggagtgcctgagcaagagcgacagcctgcagaagcagatcagccagaaggagaagcagctggtgcagctggagaccgacctgaagatcgagaaggagtggagacagaccctgcaggaggacctgcagaaggagaaggacgccctgagccacctgagaaacgagacccagcagatcatcagcctgaagaaggagttcctgaacctgcaggacgagaaccagcagctgaagaagatctaccacgagcaggagcaggccctgcaggagctgggcaacaagctgagcgagagcaagctgaagatcgaggacatcaaggaggccaacaaggccctgcagggcctggtgtggctgaaggacaaggaggccacccactgcaagctgtgcgagaaggagttcagcctgagcaagagaaagcaccactgcagaaactgcggcgagatcttctgcaacgcctgcagcgacaacgagctgcccctgcccagcagccccaagcccgtgagagtgtgcgacagctgccacgccctgctgatccagagatgcagcagcaacctgccctag

SEQ ID NO: 24482 - DNA, 1212 bp, Artificial Sequence
  Description of Artificial Sequence: Synthetic coding sequence
atggccaccaaggaccccaccgccgtggagagagccaacctgctgaacatggccaagctgagcatcaagggcctgatcgagagcgccctgagcttcggcagaaccctggacagcgactacccccccctgcagcagttcttcgtggtgatggagcactgcctgaagcacggcctgaaggtgagaaagagcttcctgagctacaacaagaccatctggggccccctggagctggtggagaagctgtaccccgaggccgaggagatcggcgccagcgtgagagacctgcccggcctgaacgagttctacgagtaccacgccctgatgatggaggaggagggcgccgtgatcgtgggcctgctggtgggcctgaacgtgatcgacgccaacctgtgcgtgaagggcgaggacctggacagccaggtgggcgtgatcgacttcagcatgtacctgaagaacgaggaggacatcggcaacaaggagagaaacgtgcagatcgccgccatcctggaccagaagaactacgtggaggagctgaacagacagctgaacagcaccgtgagcagcctgcacagcagagtggacagcctggagaagagcaacaccaagctgatcgaggagctggccatcgccaagaacaacatcatcaagctgcaggaggagaaccaccagctgagaagcgagaacaagctgatcctgatgaagacccagcagcacctggaggtgaccaaggtggacgtggagaccgagctgcagacctacaagcacagcagacagggcctggacgagatgtacaacgaggccagaagacagctgagagacgagagccagctgagacaggacgtggagaacgagctggccgtgcaggtgagcatgaagcacgagatcgagctggccatgaagctgctggagaaggacatccacgagaagcaggacaccctgatcggcctgagacagcagctggaggaggtgaaggccatcaacatcgagatgtaccagaagctgcagggcagcgaggacggcctgaaggagaagaacgagatcatcgccagactggaggagaagaccaacaagatcaccgccgccatgagacagctggagcagagcgacaacgacctgctgacccagaccagaaccatcgccatgagcctggtgaagtgcgccagcagcgacacccaggaccagtacaagctggtgaaggacatcagcttctag

SEQ ID NO: 24483 - DNA, 1140 bp, Artificial Sequence
  Description of Artificial Sequence: Synthetic coding sequence
atggtgagaaagagcttcctgagctacaacaagaccatctggggccccctggagctggtggagaagctgtaccccgaggccgaggagatcggcgccagcgtgagagacctgcccggcctgaagacccccctgggcagagccagagcctggctgagactggccctgatgcagaagaagatggccgactacctgagatgcctgatcatccagagagacctgctgagcgagttctacgagtaccacgccctgatgatggaggaggagggcgccgtgatcgtgggcctgctggtgggcctgaacgtgatcgacgccaacctgtgcgtgaagggcgaggacctggacagccaggtgggcgtgatcgacttcagcatgtacctgaagaacgaggaggacatcggcaacaaggagagaaacgtgcagatcgccgccatcctggaccagaagaactacgtggaggagctgaacagacagctgaacagcaccgtgagcagcctgcacagcagagtggacagcctggagaagagcaacaccaagctgatcgaggagctggccatcgccaagaacaacatcatcaagctgcaggaggagaaccaccagctgagaagcgagaacaagctgatcctgatgaagacccagcagcacctggaggtgaccaaggtggacgtggagaccgagctgcagacctacaagcacagcagacagggcctggacgagatgtacaacgaggccagaagacagctgagagacgagagccagctgagacaggacgtggagaacgagctggccgtgcaggtgagcatgaagcacgagatcgagctggccatgaagctgctggagaaggacatccacgagaagcaggacaccctgatcggcctgagacagcagctggaggaggtgaaggccatcaacatcgagatgtaccagaagctgcagggcagcgaggacggcctgaaggagaagaacgagatcatcgccagactggaggagaagaccaacaagatcaccgccgccatgagacagctggagcagagcgacaacgacctgctgacccagaccagaaccatcgccatgagcctggtgaagtgcgccagcagcgacacccaggaccagtacaagctggtgaaggacatcagcttctag

SEQ ID NO: 24484 - DNA, 2529 bp, Artificial Sequence
  Description of Artificial Sequence: Synthetic coding sequence
atgaagagaggcagactgcccagcagcagcgaggacagcgacgacaacggcagcctgagcaccacctggagccagaacagcagaagccagcacagaagaagcagctgcagcagacacgaggacagaaagcccagcgaggtgttcagaaccgacctgatcaccgccatgaagctgcacgacagctaccagctgaaccccgacgagtactacgtgctggccgacccctggagacaggagtgggagaagggcgtgcaggtgcccgtgagccccggcaccatcccccagcccgtggccagagtggtgagcgaggagaagagcctgatgttcatcagacccaagaagtacatcgtgagcagcggcagcgagccccccgagctgggctacgtggacatcagaaccctggccgacagcgtgtgcagatacgacctgaacgacatggacgccgcctggctggagctgaccaacgaggagttcaaggagatgggcatgcccgagctggacgagtacaccatggagagagtgctggaggagttcgagcagagatgctacgacaacatgaaccacgccatcgagaccgaggagggcctgggcatcgagtacgacgaggacgtggtgtgcgacgtgtgccagagccccgacggcgaggacggcaacgagatggtgttctgcgacaagtgcaacatctgcgtgcaccaggcctgctacggcatcctgaaggtgcccgagggcagctggctgtgcagaacctgcgccctgggcgtgcagcccaagtgcctgctgtgccccaagaagggcggcgccatgaagcccaccagaagcggcaccaagtgggtgcacgtgagctgcgccctgtggatccccgaggtgagcatcggcagccccgagaagatggagcccatcaccaaggtgagccacatccccagcagcagatgggccctggtgtgcagcctgtgcaacgagaagttcggcgccagcatccagtgcagcgtgaagaactgcagaaccgccttccacgtgacctgcgccttcgacagaggcctggagatgaagaccatcctggccgagaacgacgaggtgaagttcaagagctactgccccaagcacagcagccacagaaagcccgaggagagcctgggcaagggcgccgcccaggagaacggcgcccccgagtgcagccccagaaaccccctggagcccttcgccagcctggagcagaacagagaggaggcccacagagtgagcgtgagaaagcagaagctgcagcagctggaggacgagttctacaccttcgtgaacctgctggacgtggccagagccctgagactgcccgaggaggtggtggacttcctgtaccagtactggaagctgaagagaaaggtgaacttcaacaagcccctgatcacccccaagaaggacgaggaggacaacctggccaagagagagcaggacgtgctgttcagaagactgcagctgttcacccacctgagacaggacctggagagagtgagaaacctgacctacatggtgaccagaagagagaagatcaagagaagcgtgtgcaaggtgcaggagcagatcttcaacctgtacaccaagctgctggagcaggagagagtgagcggcgtgcccagcagctgcagcagcagcagcctggagaacatgctgctgttcaacagccccagcgtgggccccgacgcccccaagatcgaggacctgaagtggcacagcgccttcttcagaaagcagatgggcaccagcctggtgcacagcctgaagaagccccacaagagagaccccctgcagaacagccccggcagcgagggcaagaccctgctgaagcagcccgacctgtgcggcagaagagagggcatggtggtgcccgagagcttcctgggcctggagaagaccttcgccgaggccagactgatcagcgcccagcagaagaacggcgtggtgatgcccgaccacggcaagagaagagacaacagattccactgcgacctgatcaagggcgacctgaaggacaagagcttcaagcagagccacaagcccctgagaagcaccgacgtgagccagagacacctggacaacaccagagccgccaccagccccggcgtgggccagagcgcccccggcaccagaaaggagatcgtgcccaagtgcaacggcagcctgatcaaggtgaactacaaccagaccgccgtgaaggtgcccaccacccccgccagccccgtgaagaactggggcggcttcagaatccccaagaagggcgagagacagcagcagggcgaggcccacgacggcgcctgccaccagcacagcgactacccctacctgggcctgggcagagtgcccgccaaggagagagccaagagcaagctgaagagcgacaacgagaacgacggctacgtgcccgacgtggagatgagcgacagcgagagcgaggccagcgagaagaagtgcatccacaccagcagcaccatcagcagaagaaccgacatcatcagaagaagcatcctggccagctag

SEQ ID NO: 24485 - DNA, 1521 bp, Artificial Sequence
  Description of Artificial Sequence: Synthetic coding sequence
atggccgagaccccccccccccccaccgccggcgccgagagctgcagcgaggagcccgccagaggcggcgagtggagacccgaggagcccagaagagcccccgccggcggcaccgacagagagggcgaggccggccccccccccgccagccccgccggccagagcgagcccgacagccccgtggccgcccccttcttcctgctgtaccccggcgacggcggcgccggcttcggcgtgagaccccccccccagcagcagagaagctggagaaccccccccagccccggcagccccctgcccttcctgctgctgagctaccccagcggcggcggcggcagcagcggcagcggcaagcaccaccccaactacctgatggccaacgagagaatgaacctgatgaacatggccaagctgagcatcaagggcctgatcgagagcgccctgaacctgggcagaaccctggacagcgactacgcccccctgcagcagttcttcgtggtgatggagcactgcctgaagcacggcctgaaggccaagaagaccttcctgggccagaacaagagcttctggggccccctggagctggtggagaagctggtgcccgaggccgccgagatcaccgccagcgtgaaggacctgcccggcctgaagacccccgtgggcagaggcagagcctggctgagactggccctgatgcagaagaagctgagcgagtacatgaaggccctgatcaacaagaaggagctgctgagcgagttctacgagcccaacgccctgatgatggaggaggagggcgccatcatcgccggcctgctggtgggcctgaacgtgatcgacgccaacttctgcatgaagggcgaggacctggacagccaggtgggcgtgatcgacttcagcatgtacctgaaggacggcaacagcagcaagggcaccgagggcgacggccagatcaccgccatcctggaccagaagaactacgtggaggagctgaacagacacctgaacgccaccgtgaacaacctgcaggccaaggtggacgccctggagaagagcaacaccaagctgaccgaggagctggccgtggccaacaacagaatcatcaccctgcaggaggagatggagagagtgaaggaggagagcagctacatcctggagagcaacagaaagggccccaagcaggacagaaccgccgagggccaggccctgagcgaggccagaaagcacctgaaggaggagacccagctgagactggacgtggagaaggagctggagatgcagatcagcatgagacaggagatggagctggccatgaagatgctggagaaggacgtgtgcgagaagcaggacgccctggtgagcctgagacagcagctggacgacctgagagccctgaagcacgagctggccttcaagctgcagagcagcgacctgggcgtgaagcagaagagcgagctgaacagcagactggaggagaagaccaaccagatggccgccaccatcaagcagctggagcagagatag

SEQ ID NO: 24486 - DNA, 297 bp, Artificial Sequence
  Description of Artificial Sequence: Synthetic coding sequence
atggccgagaccccccccccccccaccgccggcgccgagagctgcagcgaggagcccgccagaggcggcgagtggagacccgaggagcccagaagagcccccgccggcggcaccgacagagagggcgaggccggccccccccccgccagccccgccggccagagcgagcccgacagccccgtggccgcccccttcttcctgctgtaccccggcgacggcggcgccggcttcggcgtgagaccccccccccagcagcagagaagctggagaaccccccccagccccggcagcccctag

SEQ ID NO: 24487 - DNA, 1362 bp, Artificial Sequence
  Description of Artificial Sequence: Synthetic coding sequence
atggacggcgagtggctgtgcctgagagagctggacgacatcagcctgacccccgaccccgagcccacccacgaggacagctgggaggacctgaccgacctggtggagcagatgagagacgacaccgaggaccccaactacctgatggccaacgagagaatgaacctgatgaacatggccaagctgagcatcaagggcctgatcgagagcgccctgaacctgggcagaaccctggacagcgactacgcccccctgcagcagttcttcgtggtgatggagcactgcctgaagcacggcctgaaggccaagaagaccttcctgggccagaacaagagcttctggggccccctggagctggtggagaagctggtgcccgaggccgccgagatcaccgccagcgtgaaggacctgcccggcctgaagacccccgtgggcagaggcagagcctggctgagactggccctgatgcagaagaagctgagcgagtacatgaaggccctgatcaacaagaaggagctgctgagcgagttctacgagcccaacgccctgatgatggaggaggagggcgccatcatcgccggcctgctggtgggcctgaacgtgatcgacgccaacttctgcatgaagggcgaggacctggacagccaggtgggcgtgatcgacttcagcatgtacctgaaggacggcaacagcagcaagggcaccgagggcgacggccagatcaccgccatcctggaccagaagaactacgtggaggagctgaacagacacctgaacgccaccgtgaacaacctgcaggccaaggtggacgccctggagaagagcaacaccaagctgaccgaggagctggccgtggccaacaacagaatcatcaccctgcaggaggagatggagagagtgaaggaggagagcagctacatcctggagagcaacagaaagggccccaagcaggacagaaccgccgagggccaggccctgagcgaggccagaaagcacctgaaggaggagacccagctgagactggacgtggagaaggagctggagatgcagatcagcatgagacaggagatggagctggccatgaagatgctggagaaggacgtgtgcgagaagcaggacgccctggtgagcctgagacagcagctggacgacctgagagccctgaagcacgagctggccttcaagctgcagagcagcgacctgggcgtgaagcagaagagcgagctgaacagcagactggaggagaagaccaaccagatggccgccaccatcaagcagctggagcagagcgagaaggacctggtgaagcaggccaagaccctgaacagcgccgccaacaagctgatccccaagcaccactag

SEQ ID NO: 24488 - DNA, 1863 bp, Artificial Sequence
  Description of Artificial Sequence: Synthetic coding sequence
atgagcgccctgaccccccccaccgacatgcccacccccaccaccgacaagatcacccaggccgccatggagaccatctacctgtgcaagttcagagtgagcatggacggcgagtggctgtgcctgagagagctggacgacatcagcctgacccccgaccccgagcccacccacgaggaccccaactacctgatggccaacgagagaatgaacctgatgaacatggccaagctgagcatcaagggcctgatcgagagcgccctgaacctgggcagaaccctggacagcgactacgcccccctgcagcagttcttcgtggtgatggagcactgcctgaagcacggcctgaaggccaagaagaccttcctgggccagaacaagagcttctggggccccctggagctggtggagaagctggtgcccgaggccgccgagatcaccgccagcgtgaaggacctgcccggcctgaagacccccgtgggcagaggcagagcctggctgagactggccctgatgcagaagaagctgagcgagtacatgaaggccctgatcaacaagaaggagctgctgagcgagttctacgagcccaacgccctgatgatggaggaggagggcgccatcatcgccggcctgctggtgggcctgaacgtgatcgacgccaacttctgcatgaagggcgaggacctggacagccaggtgggcgtgatcgacttcagcatgtacctgaaggacggcaacagcagcaagggcaccgagggcgacggccagatcaccgccatcctggaccagaagaactacgtggaggagctgaacagacacctgaacgccaccgtgaacaacctgcaggccaaggtggacgccctggagaagagcaacaccaagctgaccgaggagctggccgtggccaacaacagaatcatcaccctgcaggaggagatggagagagtgaaggaggagagcagctacatcctggagagcaacagaaagggccccaagcaggacagaaccgccgagggccaggccctgagcgaggccagaaagcacctgaaggaggagacccagctgagactggacgtggagaaggagctggagatgcagatcagcatgagacaggagatggagctggccatgaagatgctggagaaggacgtgtgcgagaagcaggacgccctggtgagcctgagacagcagctggacgacctgagagccctgaagcacgagctggccttcaagctgcagagcagcgacctgggcgtgaagcagaagagcgagctgaacagcagactggaggagaagaccaaccagatggccgccaccatcaagcagctggagcagagactgagacaggccgagagaagcagacagagcgccgagctggacaacagactgttcaagcaggacttcggcgacaagatcaacagcctgcagctggaggtggaggagctgaccagacagagaaaccagctggagctggagctgaagcaggagaaggagagaagactgcagaacgacagaagcatccccggcagaggcagccagaagagcgagagcaagatggacggcaagcacaagatgcaggaggagaacgtgaagctgaagaagcccctggaggagagccacagactgcagccccaccccatggacgagcaggaccagctgctgctgagcgagaagccccagctgtgccagctgtgccaggaggacggcagcctgaccaagaacgtgtgcaagaactgcagcggcaccttctgcgacgcctgcagcaccaacgagctgcccctgcccagcagcatcaagctggagagagtgtgcaacccctgccacaagcacctgatgaagcagtacagcaccagccccagctag

SEQ ID NO: 24489 - DNA, 1716 bp, Artificial Sequence
  Description of Artificial Sequence: Synthetic coding sequence
atggccgaggagggcgccatcctgaaggtgaccaaggacctgagagccgccgtgagcgccatcctgcagggctacggcgacggccagggccccgtgaccgacaccagcgccgagctgcacagactgtgcggctgcctggagctgctgctgcagttcgaccagaaggagcagaagagcttcctgggccccagaaaggactactgggacttcctgtgcaccgccctgagaagacagagaggcaacatggagcccatccacttcgtgagaagccaggacaagctgaagacccccctgggcaagggcagagccttcatcagattctgcctggccagaggccagctggccgaggccctgcagctgtgcctgctgaacagcgagctgaccagagagtggtacggccccagaagccccctgctgtgccccgagagacaggaggacatcctggacagcctgtacgccctgaacggcgtggccttcgagctggacctgcagcagcccgacctggacggcgcctggcccatgttcagcgagagcagatgcagcagcagcacccagacccagggcagaagacccagaaagaacaaggacgcccccaagaagatccccgccgcctacggcggccccgagaacgtgcagatcgaggacagccacaccagccaggccatctgcctgcaggacgcccccagcggccagcagctggccggcctgcccagaagccagcagcagagacacctgcccttcttcctggagaagaagggcgagagcagcagaaagcacagatacccccagagcatgtgggagcccgagggcaaggagctgcagctggaccaggaggagagagccccctggatcgagatcttcctgggcaacagcacccccagcacccagggccagggcaagggcgccatgggcacccagaaggaggtgatcggcatggaggccgaggtgaccggcgtgctgctggtggccgagggccagagaaccaccgagggcacccacaagaaggaggccgagtggagccacgtgcagagactgctgatgcccagccccagaggcgccgtggagggcgccgtgagcggcagcagacagggcagcggcggcagcagcatcctgggcgagccctgggtgctgcagggccacgccaccaaggaggacagcaccgtggagaacccccaggtgcagaccgaggtgaccctggtggccagaagagaggagcaggccgaggtgagcctgcaggacgagatcaagagcctgagactgggcctgagaaaggccgaggagcaggcccagagacaggagcagctgctgagagagcaggagggcgagctgcaggccctgagagagcagctgagcagatgccaggaggagagagccgagctgcaggcccagctggagcagaagcagcaggaggccgagagaagagacgccatgtaccaggaggagctgggcggccagagagacctggtgcaggccatgaagagaagagtgctggagctgatccaggagaaggacagactgtggcagagactgcagcacctgagcagcatggcccccgagtgctgcgtggcctgcagcaagatcttcggcagattcagcagaagatacccctgcagactgtgcggcggcctgctgtgccacgcctgcagcatggactacaagaagagagacagatgctgccccccctgcgcccagggcagagaggcccaggtgacctag

SEQ ID NO: 24490 - DNA, 1824 bp, Artificial Sequence
  Description of Artificial Sequence: Synthetic coding sequence
atggccgaggagggcgccatcctgaaggtgaccaaggacctgagagccgccgtgagcgccatcctgcagggctacggcgacggccagggccccgtgaccgacaccagcgccgagctgcacagactgtgcggctgcctggagctgctgctgcagttcgaccagaaggagcagaagagcttcctgggccccagaaaggactactgggacttcctgtgcaccgccctgagaagacagagaggcaacatggagcccatccacttcgtgagaagccaggacaagctgaagacccccctgggcaagggcagagccttcatcagattctgcctggccagaggccagctggccgaggccctgcagctgtgcctgctgaacagcgagctgaccagagagtggtacggccccagaagccccctgctgtgccccgagagacaggaggacatcctggacagcctgtacgccctgaacggcgtggccttcgagctggacctgcagcagcccgacctggacggcgcctggcccatgttcagcgagagcagatgcagcagcagcacccagacccagggcagaagacccagaaagaacaaggacgcccccaagaaggtgcccctgccctgcctgcacagcgagctgcccctgccccacctgctgggcatcctgaagatccccgccgcctacggcggccccgagaacgtgcagatcgaggacagccacaccagccaggccatctgcctgcaggacgcccccagcggccagcagctggccggcctgcccagaagccagcagcagagacacctgcccttcttcctggagaagaagggcgagagcagcagaaagcacagatacccccagagcatgtgggagcccgagggcaaggagctgcagctggaccaggaggagagagccccctggatcgagatcttcctgggcaacagcacccccagcacccagggccagggcaagggcgccatgggcacccagaaggaggtgatcggcatggaggccgaggtgaccggcgtgctgctggtggccgagggccagagaaccaccgagggcacccacaagaaggaggccgagtggagccacgtgcagagactgctgatgcccagccccagaggcgccgtggagggcgccgtgagcggcagcagacagggcagcggcggcagcagcatcctgggcgagccctgggtgctgcagggccacgccaccaaggaggacagcaccgtggagaacccccaggtgcagaccgaggtgaccctggtggccagaagagaggagcaggccgaggtgagcctgcaggacgagatcaagagcctgagactgggcctgagaaaggccgaggagcaggcccagagacaggagcagctgctgagagagcaggagggcgagctgcaggccctgagagagcagctgagcagatgccaggaggagagagccgagctgcaggcccagctggagcagaagcagcaggaggccgagagaagagacgccatgtaccaggaggagctgggcggccagagagacctggtgcaggccatgaagagaagagtgctggagctgatccaggagaaggacagactgtggcagagactgcagcacctgagcagcatggcccccgagtgctgcgtggcctgcagcaagatcttcggcagattcagcagaagatacccctgcagcgccagaaccagcctgggcagagaggagagcgagccccccggcgaggccgccatgtggagatggagactgtggagaggcagagccagcggccaccccagcggcgagggcagaccccccgagaccaaccagggccacagcaccggcagatag

SEQ ID NO: 24491 - DNA, 519 bp, Artificial Sequence
  Description of Artificial Sequence: Synthetic coding sequence
atggccgaggagggcgccatcctgaaggtgaccaaggacctgagagccgccgtgagcgccatcctgcagggctacggcgacggccagggccccgtgaccgacaccagcgccgagctgcacagactgtgcggctgcctggagctgctgctgcagttcgaccagaaggagcagaagagcttcctgggccccagaaaggactactgggacttcctgtgcaccgccctgagaagacagagaggcaacatggagcccatccacttcgtgagaagccaggacaagggcatggtgtggacccccgagcccagcgccctgcccagaacccccagaagacaccccggcctgagcctgtgcagccagtggggcggcctgagagtgggcccccccgccgccagacccggctggagcctggcccacgtgctgagagtgaccctgctgcagttccaccccaaccccggcaaggagacccagaagaagcagagatgccccaaggaggaccccagcagaatctggagagcctag

SEQ ID NO: 24492 - DNA, 1842 bp, Artificial Sequence
  Description of Artificial Sequence: Synthetic coding sequence
atggccgccgtggaggccgccgccgagcccgtgaccgtggtggccgccgtgggccccaaggccaaggacgaggaggaggaggaggaggagcccctgcccccctgcgaggccgtgagatgggcccccgtgggcgccgtggccgaggccagacccggcgccaccgccttcctggaggaggccaccgccgaggagcccggcgccgcccccggcagcccccccgacagccccggcagaaccctgagaagactgagagccgagagaagaagactggacagcgccctgctggccctgagcagccacttcgcccaggtgcagttcagactgagacaggtggtgagaggcgcccccgccgagcagcagagactgctgagagagctggaggacttcgccttcagaggctgcccccacgtgctgggctacgagggccccggcgaccccgccagcgacgagggcgacggcctgcccggcgacagaccctggctgagaggcgaggaccagagcgagcaggagaagcaggagagactggagacccagagagagaagcagaaggagctgatcctgcagctgaagacccagctggacgacctggagaccttcgcctaccaggagggcagctacgacagcctgccccagagcgtggtgctggagagacagagagtgatcatcgacgagctgatcaagaagctggacatgaacctgaacgaggacatcagcagcctgagcaccgaggagctgagacagagagtggacgccgccgtggcccagatcgtgaaccccgccagagtgaaggagcagctggtggagcagctgaagacccagatcagagacctggagatgttcatcaacttcatccaggacgaggtgggcagccccctgcagaccggcggcggccactgcgagtgcaaggccggcggcaagaccggcaacggctgcagcagaaccggcagcagcagaaccccccccggcaacagcaagaccaaggccgaggacgtgaagaaggtgagagagaccggcctgcacctgatgagaagagccctggccgtgctgcagatcttcgccgtgagccagttcggctgcgccaccggccagatcccccccaccctgtggcagagagtgcaggccgacagagactacagccccctgctgaagagactggaggtgagcgtggacagagtgaagcagctggccctgagacagcagccccacgaccacgtgatcaccagcgccaacctgcaggacctgagcctgggcggcaaggacgagctgaccatggccgtgagaaaggagctgaccgtggccgtgagagacctgctggcccacggcctgtacgccagcagccccggcatgagcctggtgatggcccccatcgcctgcctgctgcccgccttcagcagcgcccccgaggccatgcacccctgggagctgttcgtgaagtactaccacgccaagaacggcagagcctacgtggagagccccgccagaaagctgagccagagcttcgccctgcccgtgaccggcggcaccgtggtgacccccaagcagagcctgctgaccgccatccacatggtgctgaccgagcacgaccccttcaagagaagcgccgacagcgagctgaaggccctggtgtgcatggccctgaacgagcagagactggtgagctgggtgaacctgatctgcaagagcggcagcctgatcgagccccactaccagccctggagctacatggcccacaccggcttcgagagcgccctgaacctgctgagcagactgagcagcctgaagttcagcctgcccgtggacctggccgtgagacagctgaagaacatcaaggacgccttctag

SEQ ID NO: 24493 - DNA, 1422 bp, Artificial Sequence
  Description of Artificial Sequence: Synthetic coding sequence
atggccagcagaagcctgggcggcctgagcggcatcagaggcggcggcggcggcggcggcaagaagagcctgagcgccagaaacgccgccgtggagagaagaaacctgatcaccgtgtgcagattcagcgtgaagaccctgatcgacagaagctgcttcgagaccatcgacgacagcagccccgagttcaacaacttcgccgccatcctggagcagatcctgagccacagactgaaggagatcagccagagctgcagatggctggcccacctgcagatccccctgcagggccaggtgacctggttcggctacgagagccccagaagcttctgggactacatcagagtggcctgcagaaaggtgagccagaactgcatctgcagcatcgagaacatggagaacgtgagcagcagcagagccaagggcagagcctggatcagagtggccctgatggagaagcacctgagcgagtacatcagcaccgccctgagagacttcaagaccaccagaagattctacgaggacggcgccatcgtgctgggcgaggaggccaacatgctggccggcatgctgctgggcctgaacgccatcgacttcagcttctgcctgaagggcgagggcctggacggcagcttccccgccgtgatcgactacaccccctacctgaagtacatccagagcagcgacagcatcagcagcgacgaggaggagctgagaaccctgggcagcagcggcagcgagagcagcacccccgagaacgtgggcccccccttcctgatggacgagaacagctggttcaacaagtgcaagagagtgaagcagaagtaccagctgaccctggagcagaagggctacctggaggagctgctgagactgagagagaaccagctgagcgagagcgtgagccagaacaagatcctgctgcagagaatcgaggacagcgacctggcccacaagctggagaaggagcagctggagtacatcatcgtggagctgcaggaccagctgaccgtgctgaagaacaacgacctgagaagcagacaggagctgaccgcccacctgaccaaccagtggcccagccccggcgccctggacgtgaacgccgtggccctggacaccctgctgtacagaaagcacaacaagcagtggtacgagaagagctaccagagcctggaccagctgagcgccgaggtgagcctgagccagaccagcctggaccccggccagagccaggagggcgacggcaagcaggacaccctgaacgtgatgagcgagggcaaggaggacacccccagcctgctgggcctgtgcggcagcctgaccagcgtggccagctacaagagcctgaccagcctgaagagcaacgactacctggccagccccaccaccgagatgaccagccccggcctgacccccagctag

SEQ ID NO: 24494 - DNA, 1371 bp, Artificial Sequence
  Description of Artificial Sequence: Synthetic coding sequence
atggccagcagaagcctgggcggcctgagcggcatcagaggcggcggcggcggcggcggcaagaagagcctgagcgccagaaacgccgccgtggagagaagaaacctgatcaccgtgtgcagattcagcgtgaagaccctgatcgacagaagctgcttcgagaccatcgacgacagcagccccgagttcaacaacttcgccgccatcctggagcagatcctgagccacagactgaagggccaggtgacctggttcggctacgagagccccagaagcttctgggactacatcagagtggcctgcagaaaggtgagccagaactgcatctgcagcatcgagaacatggagaacgtgagcagcagcagagccaagggcagagcctggatcagagtggccctgatggagaagcacctgagcgagtacatcagcaccgccctgagagacttcaagaccaccagaagattctacgaggacggcgccatcgtgctgggcgaggaggccaacatgctggccggcatgctgctgggcctgaacgccatcgacttcagcttctgcctgaagggcgagggcctggacggcagcttccccgccgtgatcgactacaccccctacctgaagtacatccagagcagcgacagcatcagcagcgacgaggaggagctgagaaccctgggcagcagcggcagcgagagcagcacccccgagaacgtgggcccccccttcctgatggacgagaacagctggttcaacaagtgcaagagagtgaagcagaagtaccagctgaccctggagcagaagggctacctggaggagctgctgagactgagagagaaccagctgagcgagagcgtgagccagaacaagatcctgctgcagagaatcgaggacagcgacctggcccacaagctggagaaggagcagctggagtacatcatcgtggagctgcaggaccagctgaccgtgctgaagaacaacgacctgagaagcagacaggagctgaccgcccacctgaccaaccagtggcccagccccggcgccctggacgtgaacgccgtggccctggacaccctgctgtacagaaagcacaacaagcagtggtacgagaagagctaccagagcctggaccagctgagcgccgaggtgagcctgagccagaccagcctggaccccggccagagccaggagggcgacggcaagcaggacaccctgaacgtgatgagcgagggcaaggaggacacccccagcctgctgggcctgtgcggcagcctgaccagcgtggccagctacaagagcctgaccagcctgaagagcaacgactacctggccagccccaccaccgagatgaccagccccggcctgacccccagctag

SEQ ID NO: 24495 - DNA, 1224 bp, Artificial Sequence
  Description of Artificial Sequence: Synthetic coding sequence
atggccagcagaagcctgggcggcctgagcggcatcagaggcggcggcggcggcggcggcaagaagagcctgagcgccagaaacgccgccgtggagagaagaaacctgatcaccgtgtgcagattcagcgtgaagaccctgatcgacagaagctgcttcgagaccatcgacgacagcagccccgagttcaacaacttcgccgccatcctggagcagatcctgagccacagactgaagggccaggtgacctggttcggctacgagagccccagaagcttctgggactacatcagagtggcctgcagaaaggtgagccagaactgcatctgcagcatcgagaacatggagaacgtgagcagcagcagagccaagggcagagcctggatcagagtggccctgatggagaagcacctgagcgagtacatcagcaccgccctgagagacttcaagaccaccagaagattctacgaggacggcgccatcgtgctgggcgaggaggccaacatgctggccggcatgctgctgggcctgaacgccatcgacttcagcttctgcctgaagggcgagggcctggacggcagcttccccgccgtgatcgactacaccccctacctgaagtacatccagagcagcgacagcatcagcagcgacgaggaggagctgagaaccctgggcagcagcggcagcgagagcagcacccccgagaacgtgggcccccccttcctgatggacgagaacagctggttcaacaagtgcaagagagtgaagcagaagtaccagctgaccctggagcagaagggctacctggaggagctgctgagactgagagagaaccagctgagcgagagcgtgagccagaacaagatcctgctgcagagaatcgaggacagcgacctggcccacaagctggagaaggagcagctggagtacatcatcgtggagctgcaggaccagctgaagagctaccagagcctggaccagctgagcgccgaggtgagcctgagccagaccagcctggaccccggccagagccaggagggcgacggcaagcaggacaccctgaacgtgatgagcgagggcaaggaggacacccccagcctgctgggcctgtgcggcagcctgaccagcgtggccagctacaagagcctgaccagcctgaagagcaacgactacctggccagccccaccaccgagatgaccagccccggcctgacccccagctag

SEQ ID NO: 24496 - DNA, 156 bp, Artificial Sequence
  Description of Artificial Sequence: Synthetic coding sequence
atggtgatgatcttcaccctggtgaccgccgtgcaggagaagctgaacgagatcgtggaccagatcaagaccagaagagaggaggagaagaagcagaaggagaaggaggccgaggaggccgagaagcagctgttccacggcacccccgtgacctag

SEQ ID NO: 24497 - DNA, 444 bp, Artificial Sequence
  Description of Artificial Sequence: Synthetic coding sequence
atggtgatgatcttcaccctggtgaccgccgtgcaggagaagctgaacgagatcgtggaccagatcaagaccagaagagaggaggagaagaagcagaaggagaaggaggccgaggaggccgagaagcagctgttccacggcacccccgtgaccatcgagaacttcctgaactggaaggccaagttcgacgccgagctgctggagatcaagaagaagagaatgaaggaggaggagcaggccggcaagaacaagctgagcggcaagcagctgttcgagaccgaccacaacctggacaccagcgacatccagttcctggaggacgccggcaacaacgtggaggtggacgagagcctgttccaggagatggacgacctggagctggaggacgacgaggacgaccccgactacaaccccgccgaccccgagagcgacagcgccgactag

SEQ ID NO: 24498 - DNA, 732 bp, Artificial Sequence
  Description of Artificial Sequence: Synthetic coding sequence
atgaccgactacggcgaggagcagagaaacgagctggaggccctggagagcatctaccccgacagcttcaccgtgctgagcgagaacccccccagcttcaccatcaccgtgaccagcgaggccggcgagaacgacgagaccgtgcagaccaccctgaagttcacctacagcgagaagtaccccgacgaggcccccctgtacgagatcttcagccaggagaacctggaggacaacgacgtgagcgacatcctgaagctgctggccctgcaggccgaggagaacctgggcatggtgatgatcttcaccctggtgaccgccgtgcaggagaagctgaacgagatcgtggaccagatcaagaccagaagagaggaggagaagaagcagaaggagaaggaggccgaggaggccgagaagcagctgttccacggcacccccgtgaccatcgagaacttcctgaactggaaggccaagttcgacgccgagctgctggagatcaagaagaagagaatgaaggaggaggagcaggccggcaagaacaagctgagcggcaagcagctgttcgagaccgaccacaacctggacaccagcgacatccagttcctggaggacgccggcaacaacgtggaggtggacgagagcctgttccaggagatggacgacctggagctggaggacgacgaggacgaccccgactacaaccccgccgaccccgagagcgacagcgccgactag

SEQ ID NO: 24499 - DNA, 204 bp, Artificial Sequence
  Description of Artificial Sequence: Synthetic coding sequence
atggtgatgatcttcaccctggtgaccgccgtgcaggagaagctgaacgagatcgtggaccagatcaagaccagaagagaggaggagaagaagcagaaggagaaggaggccgaggaggccgagaagcagctgttccacggcacccccgtgaccatcgagaacttcctgaactggaaggccaagttcgacgccgagctgctgtag

SEQ ID NO: 24500 - DNA, 444 bp, Artificial Sequence; identical to SEQ ID NO: 24497
  Description of Artificial Sequence: Synthetic coding sequence

SEQ ID NO: 24501 - DNA, 219 bp, Artificial Sequence
  Description of Artificial Sequence: Synthetic coding sequence
atggtgatgatcttcaccctggtgaccgccgtgcaggagaagctgaacgagatcgtggaccagatcaagaccagaagagaggaggagaagaagcagaaggagaaggaggccgaggaggccgagaagcagctgttccacggcacccccgtgaccatcgagaacttcctgaactggaaggccaagttcgacgccgagctgctggagatcaagaagaagtag

SEQ ID NO: 24502 - DNA, 879 bp, Artificial Sequence
  Description of Artificial Sequence: Synthetic coding sequence
atgagcgccagcgtgaaggagagcctgcagctgcagctgctggagatggagatgctgttcagcatgttccccaaccagggcgaggtgaagctggaggacgtgaacgccctgaccaacatcaagagatacctggagggcaccagagaggccctgccccccaagatcgagttcgtgatcaccctgcagatcgaggagcccaaggtgaagatcgacctgcaggtgaccatgccccacagctacccctacgtggccctgcagctgttcggcagaagcagcgagctggacagacaccagcagctgctgctgaacaagggcctgaccagctacatcggcaccttcgaccccggcgagctgtgcgtgtgcgccgccatccagtggctgcaggacaacagcgccagctacttcctgaacagaaagctggtgtacgagcccagcacccaggccaagcccgtgaagaacaccttcctgagaatgtggatctacagccaccacatctaccagcaggacctgagaaagaagatcctggacgtgggcaagagactggacgtgaccggcttctgcatgaccggcaagcccggcatcatctgcgtggagggcttcaaggagcactgcgaggagttctggcacaccatcagataccccaactggaagcacatcagctgcaagcacgccgagagcgtggagaccgagggcaacggcgaggacctgagactgttccacagcttcgaggagctgctgctggaggcccacggcgactacggcctgagaaacgactaccacatgaacctgggccagttcctggagttcctgaagaagcacaagagcgagcacgtgttccagatcctgttcggcatcgagagcaagagcagcgacagctag

SEQ ID NO: 24503 - DNA, 717 bp, Artificial Sequence
  Description of Artificial Sequence: Synthetic coding sequence
atgctgtggtacctgaacctgttcgacttccacttcaaggtgaagatcgacctgcaggtgaccatgccccacagctacccctacgtggccctgcagctgttcggcagaagcagcgagctggacagacaccagcagctgctgctgaacaagggcctgaccagctacatcggcaccttcgaccccggcgagctgtgcgtgtgcgccgccatccagtggctgcaggacaacagcgccagctacttcctgaacagaaagctggtgtacgagcccagcacccaggccaagcccgtgaagaacaccttcctgagaatgtggatctacagccaccacatctaccagcaggacctgagaaagaagatcctggacgtgggcaagagactggacgtgaccggcttctgcatgaccggcaagcccggcatcatctgcgtggagggcttcaaggagcactgcgaggagttctggcacaccatcagataccccaactggaagcacatcagctgcaagcacgccgagagcgtggagaccgagggcaacggcgaggacctgagactgttccacagcttcgaggagctgctgctggaggcccacggcgactacggcctgagaaacgactaccacatgaacctgggccagttcctggagttcctgaagaagcacaagagcgagcacgtgttccagatcctgttcggcatcgagagcaagagcagcgacagctag

SEQ ID NO: 24504 - DNA, 960 bp, Artificial Sequence
  Description of Artificial Sequence: Synthetic coding sequence
atgaagatcgagctgagcatgcagccctggaaccccggctacagcagcgagggcgccaccgcccaggagacctacacctgccccaagatgatcgagatggagcaggccgaggcccagctggccgagctggacctgctggccagcatgttccccggcgagaacgagctgatcgtgaacgaccagctggccgtggccgagctgaaggactgcatcgagaagaagaccatggagggcagaagcagcaaggtgtacttcaccatcaacatgaacctggacgtgagcgacgagaagatggccatgttcagcctggcctgcatcctgcccttcaagtaccccgccgtgctgcccgagatcaccgtgagaagcgtgctgctgagcagaagccagcagacccagctgaacaccgacctgaccgccttcctgcagaagcactgccacggcgacgtgtgcatcctgaacgccaccgagtgggtgagagagcacgccagcggctacgtgagcagagacaccagcagcagccccaccaccggcagcaccgtgcagagcgtggacctgatcttcaccagactgtggatctacagccaccacatctacaacaagtgcaagagaaagaacatcctggagtgggccaaggagctgagcctgagcggcttcagcatgcccggcaagcccggcgtggtgtgcgtggagggcccccagagcgcctgcgaggagttctggagcagactgagaaagctgaactggaagagaatcctgatcagacacagagaggacatccccttcgacggcaccaacgacgagaccgagagacagagaaagttcagcatcttcgaggagaaggtgttcagcgtgaacggcgccagaggcaaccacatggacttcggccagctgtaccagttcctgaacaccaagggctgcggcgacgtgttccagatgttcttcggcgtggagggccagtag

SEQ ID NO: 24505 - DNA, 567 bp, Artificial Sequence
  Description of Artificial Sequence: Synthetic coding sequence
atgagcgccaacgaggaccaggagatggagctggaggccctgagaagcatctacgagggcgacgagagcttcagagagctgagccccgtgagcttccagtacagaatcggcgagaacggcgaccccaaggccttcctgatcgagatcagctggaccgagacctacccccagaccccccccatcctgagcatgaacgccttcttcaacaacaccatcagcagcgccgtgaagcagagcatcctggccaagctgcaggaggccgtggaggccaacctgggcaccgccatgacctacaccctgttcgagtacgccaaggacaacaaggagcagttcatggagaaccacaaccccatcaacagcgccaccagcatcagcaacatcatcagcatcgagacccccaacaccgcccccagcagcaagaagaaggacaagaaggagcagctgagcaaggcccagaagagaaagctggccgacaagaccgaccacaagggcgagctgcccagaggctggaactgggtggacgtggtgaagcacctgagcaagaccggcagcaaggacgacgagtag

SEQ ID NO: 24506 - DNA, 564 bp, Artificial Sequence
  Description of Artificial Sequence: Synthetic coding sequence
atgagcgccaacgaggaccaggagatggagctggaggccctgagaagcatctacgagggcgacgagagcttcagagagctgagccccgtgagcttccagtacagaatcggcgagaacggcgaccccaaggccttcctgatcgagatcagctggaccgagacctacccccagaccccccccatcctgagcatgaacgccttcttcaacaacaccatcagcagcgccgtgaagcagagcatcctggccaagctgcaggaggccgtggaggccaacctgggcaccgccatgacctacaccctgttcgagtacgccaaggacaacaaggagcagttcatggagaaccacaaccccatcaacagcgccaccagcatcagcaacatcatcagcatcgagacccccaacaccgcccccagcagcaagaagaaggacaagaaggagcagctgagcaaggcccagaagagaaagctggccgacaagaccgaccacaagggcgagctgcccagaggctggaactgggtggacgtggtgaagctgagcaagaccggcagcaaggacgacgagtag

SEQ ID NO: 24507 - DNA, 2988 bp, Artificial Sequence
  Description of Artificial Sequence: Synthetic coding sequence
atgagcagcctgcccagaagagccaaggtgcaggtgcaggacgtggtgctgaaggacgagttcagcagcttcagcgagctgagcagcgccagcgaggaggacgacaaggaggacagcgcctgggagccccagaagaaggtgcccagaagcagaaagcagcccccccccaaggagagcaagcccaagagaatgcccagagtgaagaagaacgccccccagatcagcgacggcagcgaggtggtggtggtgaaggaggagctgaacagcagcgtggccatcgccgacaccgccctggaggacagaaagaacaagctggacaccgtgcagaccctgaagaccgccaagaccaagcagaagtgcgccgcccagccccacaccgtgagaagaaccaagaagctgaaggtggaggaggagaccagcaaggccagcaacctggagggcgagagcaacagcagcgagacccccagcaccagcaccgtgtggggcggcacctgcaagaaggaggagaacgacgacgacttcaccttcggccagagcgccctgaagaagatcaagaccgagacctacccccagggccagcccgtgaagttccccgccaacgccaacagcaccaaggaggaggtggagatgaactgggacatggtgcaggtgctgagcgagagaaccaacatcgagccctgggtgtgcgccaacatcatcagactgttcaacgacgacaacaccatccccttcatcatcagatacagaaaggagctgatcaacaacctggacgccgacagcctgagagaggtgcagcagaccctggaggagctgagagccgtggccaagaaggtgcacagcaccatccagaagatcaagaaggagggcaagatgagcgagtgcctgctgaaggccatgctgaactgcaagaccttcgaggagctggagcacgtgagcgccccctacaagaccggcagcaagggcaccaaggcccagagagccagacagctgggcctggagggcgccgccagagccctgctggagaagcccggcgagctgagcctgctgagctacatcagacccgacgtgaagggcctgagcaccctgcaggacatcgagatcggcgtgcagcacatcctggccgacatgatcgccaaggacaaggacaccctggacttcatcagaaacctgtgccagaagagacacgtgtgcatccagagcagcctggccaaggtgagcagcaagaaggtgaacgagaaggacgtggacaagttcctgctgtaccagcacttcagctgcaacatcagaaacatccaccaccaccagatcctggccatcaacagaggcgagaacctgaaggtgctgaccgtgaaggtgaacatcagcgacggcgtgaaggacgagttctgcagatggtgcatccagaacagatggagacccagaagcttcgccagacccgagctgatgaagatcctgtacaacagcctgaacgacagcttcaagagactgatctaccccctgctgtgcagagagttcagagccaagctgaccagcgacgccgagaaggagagcgtgatgatgttcggcagaaacctgagacagctgctgctgaccagccccgtgcccggcagaaccctgatgggcgtggaccccggctacaagcacggctgcaagctggccatcatcagccccaccagccagatcctgcacaccgacgtggtgtacctgcactgcggccagggcttcagagaggccgagaagatcaagaccctgctgctgaacttcaactgcagcaccgtggtgatcggcaacggcaccgcctgcagagagaccgaggcctacttcgccgacctgatcatgaagaactacttcgcccccctggacgtggtgtactgcatcgtgagcgaggccggcgccagcatctacagcgtgagccccgaggccaacaaggagatgcccggcctggaccccaacctgagaagcgccgtgagcatcgccagaagagtgcaggaccccctggccgagctggtgaagatcgagcccaagcacatcggcgtgggcatgtaccagcacgacgtgagccagaccctgctgaaggccaccctggacagcgtggtggaggagtgcgtgagcttcgtgggcgtggacatcaacatctgcagcgaggtgctgctgagacacatcgccggcctgaacgccaacagagccaagaacatcatcgagtggagagagaagaacggccccttcatcaacagagagcagctgaagaaggtgaagggcctgggccccaagagcttccagcagtgcgccggcttcatcagaatcaaccaggactacatcagaaccttctgcagccagcagaccgagaccagcggccagatccagggcgtggccgtgaccagcagcgccgacgtggaggtgaccaacgagaagcagggcaagaagaagagcaagaccgccgtgaacgtgctgctgaagcccaaccccctggaccagacctgcatccaccccgagagctacgacatcgccatgagattcctgagcagcatcggcggcaccctgtacgaggtgggcaagcccgagatgcagcagaagatcaacagcttcctggagaaggagggcatggagaagatcgccgagagactgcagaccaccgtgcacaccctgcaggtgatcatcgacggcctgagccagcccgagagcttcgacttcagaaccgacttcgacaagcccgacttcaagagaagcatcgtgtgcctggaggacctgcagatcggcaccgtgctgaccggcaaggtggagaacgccaccctgttcggcatcttcgtggacatcggcgtgggcaagagcggcctgatccccatcagaaacgtgaccgaggccaagctgagcaagaccaagaagagaagaagcctgggcctgggccccggcgagagagtggaggtgcaggtgctgaacatcgacatccccagaagcagaatcaccctggacctgatcagagtgctgtag

SEQ ID NO: 24508 - DNA, 1545 bp, Artificial Sequence
  Description of Artificial Sequence: Synthetic coding sequence
atgaagatcctgtacaacagcctgaacgacagcttcaagagactgatctaccccctgctgtgcagagagttcagagccaagctgaccagcgacgccgagaaggagagcgtgatgatgttcggcagaaacctgagacagctgctgctgaccagccccgtgcccggcagaaccctgatgggcgtggaccccggctacaagcacggctgcaagctggccatcatcagccccaccagccagatcctgcacaccgacgtggtgtacctgcactgcggccagggcttcagagaggccgagaagatcaagaccctgctgctgaacttcaactgcagcaccgtggtgatcggcaacggcaccgcctgcagagagaccgaggcctacttcgccgacctgatcatgaagaactacttcgcccccctggacgtggtgtactgcatcgtgagcgaggccggcgccagcatctacagcgtgagccccgaggccaacaaggagatgcccggcctggaccccaacctgagaagcgccgtgagcatcgccagaagagtgcaggaccccctggccgagctggtgaagatcgagcccaagcacatcggcgtgggcatgtaccagcacgacgtgagccagaccctgctgaaggccaccctggacagcgtggtggaggagtgcgtgagcttcgtgggcgtggacatcaacatctgcagcgaggtgctgctgagacacatcgccggcctgaacgccaacagagccaagaacatcatcgagtggagagagaagaacggccccttcatcaacagagagcagctgaagaaggtgaagggcctgggccccaagagcttccagcagtgcgccggcttcatcagaatcaaccaggactacatcagaaccttctgcagccagcagaccgagaccagcggccagatccagggcgtggccgtgaccagcagcgccgacgtggaggtgaccaacgagaagcagggcaagaagaagagcaagaccgccgtgaacgtgctgctgaagcccaaccccctggaccagacctgcatccaccccgagagctacgacatcgccatgagattcctgagcagcatcggcggcaccctgtacgaggtgggcaagcccgagatgcagcagaagatcaacagcttcctggagaaggagggcatggagaagatcgccgagagactgcagaccaccgtgcacaccctgcaggtgatcatcgacggcctgagccagcccgagagcttcgacttcagaaccgacttcgacaagcccgacttcaagagaagcatcgtgtgcctggaggacctgcagatcggcaccgtgctgaccggcaaggtggagaacgccaccctgttcggcatcttcgtggacatcggcgtgggcaagagcggcctgatccccatcagaaacgtgaccgaggccaagctgagcaagaccaagaagagaagaagcctgggcctgggccccggcgagagagtggaggtgcaggtgctgaacatcgacatccccagaagcagaatcaccctggacctgatcagagtgctgtag

SEQ ID NO: 24509 - DNA, 306 bp, Artificial Sequence
  Description of Artificial Sequence: Synthetic coding sequence
atgaacatccccctgggcgagaaggtgatgctggacatcgtggccatgttcagacagtacagcggcgacgacggcagaatggacatgcccggcctggtgaacctgatgaaggagaacttccccaacttcctgagcggctgcgagaagagcgacatggactacctgagcaacgccctggagaagaaggacgacaacaaggacaagaaggtgaactacagcgagttcctgagcctgctgggcgacatcaccatcgaccaccacaagatcatgcacggcgtggccccctgcagcggcggcagccagtag

SEQ ID NO: 24510 - DNA, 306 bp, Artificial Sequence; identical to SEQ ID NO: 24509
  Description of Artificial Sequence: Synthetic coding sequence

SEQ ID NO: 24511 - DNA, 339 bp, Artificial Sequence
  Description of Artificial Sequence: Synthetic coding sequence
atgctgcccagcagcggcttcctgaaggccaagatgaacatccccctgggcgagaaggtgatgctggacatcgtggccatgttcagacagtacagcggcgacgacggcagaatggacatgcccggcctggtgaacctgatgaaggagaacttccccaacttcctgagcggctgcgagaagagcgacatggactacctgagcaacgccctggagaagaaggacgacaacaaggacaagaaggtgaactacagcgagttcctgagcctgctgggcgacatcaccatcgaccaccacaagatcatgcacggcgtggccccctgcagcggcggcagccagtag

SEQ ID NO: 24512 - DNA, 2715 bp, Artificial Sequence
  Description of Artificial Sequence: Synthetic coding sequence
atgcaggccagccccctgcagaccagccagcccaccccccccgaggagctgcacgccgccgcctacgtgttcaccaacgacggccagcagatgagaagcgacgaggtgaacctggtggccaccggccaccagagcaagaagaagcacagcagaaagagcaagagacacagcagcagcaagagaagaaagagcatgagcagctggctggacaagcaggaggacgccgccgtgacccacagcatctgcgaggagagaatcaacaacggccagcccgtggccgacaacgtgctgagcaccgcccccccctggcccgacgccaccatcgcccacaacatcagagaggagagaatggagaacggccagagcagaaccgacaaggtgctgagcaccgcccccccccagctggtgcacatggccgccgccggcatccccagcatgagcaccagagacctgcacagcaccgtgacccacaacatcagagaggagagaatggagaacggccagccccagcccgacaacgtgctgagcaccggccccaccggcctgatcaacatggccgccacccccatccccgccatgagcgccagagacctgtacgccaccgtgacccacaacgtgtgcgagcagaagatggagaacgtgcagcccgcccccgacaacgtgctgctgaccctgagacccagaagaatcaacatgaccgacaccggcatcagccccatgagcaccagagacccctacgccaccatcacctacaacgtgcccgaggagaagatggagaagggccagccccagcccgacaacatcctgagcaccgccagcaccggcctgatcaacgtggccggcgccggcacccccgccatcagcaccaacggcctgtacagcaccgtgccccacaacgtgtgcgaggagaagatggagaacgaccagccccagcccaacaacgtgctgagcaccgtgcagcccgtgatcatctacctgaccgccaccggcatccccggcatgaacaccagagaccagtacgccaccatcacccacaacgtgtgcgaggagagagtggtgaacaaccagcccctgcccagcaacgccctgagcaccgtgctgcccggcctggcctacctggccaccgccgacatgcccgccatgagcaccagagaccagcacgccaccatcatccacaacctgagagaggagaagaaggacaacagccagcccacccccgacaacgtgctgagcgccgtgacccccgagctgatcaacctggccggcgccggcatcccccccatgagcaccagagaccagtacgccaccgtgaaccaccacgtgcacgaggccagaatggagaacggccagagaaagcaggacaacgtgctgagcaacgtgctgagcggcctgatcaacatggccggcgccagcatccccgccatgagcagcagagacctgtacgccaccatcacccacagcgtgagagaggagaagatggagagcggcaagccccagaccgacaaggtgatcagcaacgacgccccccagctgggccacatggccgccggcggcatccccagcatgagcaccaaggacctgtacgccaccgtgacccagaacgtgcacgaggagagaatggagaacaaccagccccagcccagctacgacctgagcaccgtgctgcccggcctgacctacctgaccgtggccggcatccccgccatgagcaccagagaccagtacgccaccgtgacccacaacgtgcacgaggagaagatcaagaacggccaggccgccagcgacaacgtgttcagcaccgtgccccccgccttcatcaacatggccgccaccggcgtgagcagcatgagcaccagagaccagtacgccgccgtgacccacaacatcagagaggagaagatcaacaacagccagcccgcccccggcaacatcctgagcaccgcccccccctggctgagacacatggccgccgccggcatcagcagcaccatcaccagagacctgtacgtgaccgccacccacagcgtgcacgaggagaagatgaccaacggccagcaggcccccgacaacagcctgagcaccgtgccccccggctgcatcaacctgagcggcgccggcatcagctgcagaagcaccagagacctgtacgccaccgtgatccacgacatccaggaggaggagatggagaacgaccagaccccccccgacggcttcctgagcaacagcgacagccccgagctgatcaacatgaccggccactgcatgccccccaacgccctggacagcttcagccacgacttcaccagcctgagcaaggacgagctgctgtacaagcccgacagcaacgagttcgccgtgggcaccaagaactacagcgtgagcgccggcgacccccccgtgaccgtgatgagcctggtggagaccgtgcccaacaccccccagatcagccccgccatggccaagaagatcaacgacgacatcaagtaccagctgatgaaggaggtgagaagattcggccagaactacgagagaatcttcatcctgctggaggaggtgcagggcagcatgaaggtgaagagacagttcgtggagttcaccatcaaggaggccgccagattcaagaaggtggtgctgatccagcagctggagaaggccctgaaggagatcgacagccactgccacctgagaaaggtgaagcacatgagaaagagatag

SEQ ID NO: 24513 - DNA, 2715 bp, Artificial Sequence; identical to SEQ ID NO: 24512
  Description of Artificial Sequence: Synthetic coding sequence

SEQ ID NO: 24514 - DNA, 2715 bp, Artificial Sequence; identical to SEQ ID NO: 24512
  Description of Artificial Sequence: Synthetic coding sequence

SEQ ID NO: 24515 - DNA, 1587 bp, Artificial Sequence
  Description of Artificial Sequence: Synthetic coding sequence
atgcaggccagccccctgcagaccagccagcccaccccccccgaggagctgcacgccgccgcctacgtgttcaccaacgacggccagcagatgagaagcgacgaggtgaacctggtggccaccggccaccagagcaagaagaagcacagcagaaagagcaagagacacagcagcagcaagagaagaaagagcatgagcagctggctggacaagcaggaggacgccgccgtgacccacagcatctgcgaggagagaatcaacaacggccagcccgtggccgacaacgtgctgagcaccgcccccccctggcccgacgccaccatcgcccacaacatcagagaggagagaatggagaacggccagagcagaaccgacaaggtgctgagcaccgcccccccccagctggtgcacatggccgccgccggcatccccagcatgagcaccagagacctgcacgccaccgtgacccagaacgtgcacgaggagagaatggagaacaaccagccccagcccagctacgacctgagcaccgtgctgcccggcctgacctacctgaccgtggccggcatccccgccatgagcaccagagaccagtacgccaccgtgacccacaacgtgcacgaggagaagatcaagaacggccaggccgccagcgacaacgtgttcagcaccgtgccccccgccttcatcaacatggccgccaccggcgtgagcagcatgagcaccagagaccagtacgccgccgtgacccacaacatcagagaggagaagatcaacaacagccagcccgcccccggcaacatcctgagcaccgcccccccctggctgagacacatggccgccgccggcatcagcagcaccatcaccagagacctgtacgtgaccgccacccacagcgtgcacgaggagaagatgaccaacggccagcaggcccccgacaacagcctgagcaccgtgccccccggctgcatcaacctgagcggcgccggcatcagctgcagaagcaccagagacctgtacgccaccgtgatccacgacatccaggaggaggagatggagaacgaccagaccccccccgacggcttcctgagcaacagcgacagccccgagctgatcaacatgaccggccactgcatgccccccaacgccctggacagcttcagccacgacttcaccagcctgagcaaggacgagctgctgtacaagcccgacagcaacgagttcgccgtgggcaccaagaactacagcgtgagcgccggcgacccccccgtgaccgtgatgagcctggtggagaccgtgcccaacaccccccagatcagccccgccatggccaagaagatcaacgacgacatcaagtaccagctgatgaaggaggtgagaagattcggccagaactacgagagaatcttcatcctgctggaggaggtgcagggcagcatgaaggtgaagagacagttcgtggagttcaccatcaaggaggccgccagattcaagaaggtggtgctgatccagcagctggagaaggccctgaaggagatcgacagccactgccacctgagaaaggtgaagcacatgagaaagagatag

SEQ ID NO: 24516 - DNA, 2715 bp, Artificial Sequence; identical to SEQ ID NO: 24512
  Description of Artificial Sequence: Synthetic coding sequence

SEQ ID NO: 24517 - DNA, 225 bp, Artificial Sequence
  Description of Artificial Sequence: Synthetic coding sequence
agaggcagcagaggcagacaccactggagcggcggcgccgccgtgagcagcggctaccccagcaacatcgagaagaaggagtaccaggagcagagcgtgctgagctgctgcagcgagagaaaggacgccaaccccaagagcgtggtgtgcagcttcttcatgcaggagcagtgcaccaagggcgagaagcaggccgtggtgatcagcgacttcggcgagagctag

SEQ ID NO: 24518 - DNA, 2385 bp, Artificial Sequence
  Description of Artificial Sequence: Synthetic coding sequence
atggaggccgtgagcagagtgttccccgccctggccggccaggcccccgaggagcagggcgagatcatcaaggtgaaggtgaaggaggaggaccacacctgggaccaggagagcgccctgagaagaaacctgagctacaccagagagctgagcagacagagattcagacagttctgctaccaggagacccccggccccagagaggccctgagccagctgagagagctgtgcagacagtggctgaaccccgagatccacaccaaggagcagatcctggagctgctggtgctggagcagttcctgaccatcctgcccgaggagctgcagagctgggtgagagagcacaaccccgagagcggcgaggaggtggtgaccctgctggaggacctggagagagagctggacgagcccagacagcaggtgagccagggcacctacggccaggaggtgagcatggaggagatgatccccctggacagcgccaaggagagcctgggcacccagctgcagagcatggaggacagaatggagtgcgagagccccgagccccaccccctgcaggacaacggcagcttcctgtggttcagcatgatgagccagagcatgggcggcgacaacctgagcagcctggacaccaacgaggccgagatcgagcccgagaacatgagagagaagttcttcagaagcctggccagactgctggagaacaagagcaacaacaccaagatcttcagcaaggccaagtactgccagctgatcaaggaggtgaaggaggccaaggccaaggccaagaaggagagcgtggactacagaagactggccagattcgacgtgatcctggtgcagggcaacgagaagctgatcgaggccgtgaacggcgagaccgacaagatcagatactacctgcacagcgaggacctgttcgacatcctgcacaacacccacctgagcatcggccacggcggcagaaccagaatggagaaggagctgcaggccaagtacaagaacatcaccaaggaggtgatcatgctgtacctgaccctgtgcaagccctgccagcagaagaacagcaagctgaagaaggtgctgaccagcaagagcatcaaggaggtgagcagcagatgccaggtggacctgatcgacatgcagctgaaccccgacggcgagtacagattcatcctgcactaccaggacctgtgcaccaagctgaccttcctgagaagcctgaagagcaagagacccaccgaggtggcccacgccctgctggacatcttcaccatcatcggcgcccccagcgtgctgcagagcgacaacggcagagagttcagcagccaggtggtgagcgagctgagcaacatctggcccgagctgaagatcgtgcacggcaagagccagacctgccagagccagagcagcgccgagcagaccgaggacatcagaaagagaatcttcagctggatgcagaccaacaacagcagccactggaccgagttcctgtggttcatccagatgagccagaaccagccctaccacagaagcatgcagcagaccccctgcgagagcgccttcagcagcgaggccaagctgggcctgagccacagccagctgaccgaggagctggtggccagcctgcacaccgagaacgagctggaccaggccgacaaggagctggagaacaccctgagagcccagtacgaggagaacatcgagaccggcaccgacagcagcgacatcgaggagaacctgagcgtgacccccaaggtggccgagaagagcccccccgagagcagactgagattcctgagctgcgtggtgtgcgagaaggagtgcaccggcgtgaacagctgcatcagctgcgacggcaacatccacgccatctgcggcgtgcccagccagcacggcaccgagggctgcggcagacagatcacctgcagcctgtgctacgagaccagcaccatgaagagaaagcacgacgagatccagagaagcctgcccgtgaagcccagcaagatgctgaagcccagcggcacccccttcagccccgacaaggtgggcgactggatggccaagcaggccagcctggacttcttcgtgaagaagagacacgccttcagcgagcacagcagcagcaacaagagaaacgtgaacaacagaagctaccccgaggagggcaagaccaagagagtgcacgccagcttcaccagaaagtacgaccccagctacatcgagttcggcttcgtggccgtgatcgacggcgaggtgctgaagccccagtgcatcatctgcggcgacgtgctggccaacgaggccatgaagcccagcaagctgaagagacacctgtacagcaagcacaaggagatcagcagccagcccaaggagttctag

SEQ ID NO: 24519 - DNA, 1737 bp, Artificial Sequence
  Description of Artificial Sequence: Synthetic coding sequence
atgaacatcagcgtggacctggagaccaactacgccgagctggtgctggacgtgggcagagtgaccctgggcgagaacagcagaaagaagatgaaggactgcaagctgagaaagaagcagaacgagagcgtgagcagagccatgtgcgccctgctgaacagcggcggcggcgtgatcaaggccgagatcgagaacgaggactacagctacaccaaggacggcatcggcctggacctggagaacagcttcagcaacatcctgctgttcgtgcccgagtacctggacttcatgcagaacggcaactacttcctgatcttcgtgaagagctggagcctgaacaccagcggcctgagaatcaccaccctgagcagcaacctgtacaagagagacatcaccagcgccaaggtgatgaacgccaccgccgccctggagttcctgaaggacatgaagaagaccagaggcagactgtacctgagacccgagctgctggccaagagaccctgcgtggacatccaggaggagaacaacatgaaggccctggccggcgtgttcttcgacagaaccgagctggacagaaaggagaagctgaccttcaccgagagcacccacgtggagatcaagaacttcagcaccgagaagctgctgcagagaatcaaggagatcctgccccagtacgtgagcgccttcgccaacaccgacggcggctacctgttcatcggcctgaacgaggacaaggagatcatcggcttcaaggccgagatgagcgacctggacgacctggagagagagatcgagaagagcatcagaaagatgcccgtgcaccacttctgcatggagaagaagaagatcaactacagctgcaagttcctgggcgtgtacgacaagggcagcctgtgcggctacgtgtgcgccctgagagtggagagattctgctgcgccgtgttcgccaaggagcccgacagctggcacgtgaaggacaacagagtgatgcagctgaccagaaaggagtggatccagttcatggtggaggccgagcccaagttcagcagcagctacgaggaggtgatcagccagatcaacaccagcctgcccgccccccacagctggcccctgctggagtggcagagacagagacaccactgccccggcctgagcggcagaatcacctacacccccgagaacctgtgcagaaagctgttcctgcagcacgagggcctgaagcagctgatctgcgaggagatggacagcgtgagaaagggcagcctgatcttcagcagaagctggagcgtggacctgggcctgcaggagaaccacaaggtgctgtgcgacgccctgctgatcagccaggacagcccccccgtgctgtacaccttccacatggtgcaggacgaggagttcaagggctacagcacccagaccgccctgaccctgaagcagaagctggccaagatcggcggctacaccaagaaggtgtgcgtgatgaccaagatcttctacctgagccccgagggcatgaccagctgccagtacgacctgagaagccaggtgatctaccccgagagctactacttcaccagaagaaagtacctgctgaaggccctgttcaaggccctgaagagactgaagagcctgagagaccagttcagcttcgccgagaacctgtaccagatcatcggcatcgactgcttccagaagaacgacaagaagatgttcaagagctgcagaagactgacctag

SEQ ID NO: 24520 - DNA, 1737 bp, Artificial Sequence; identical to SEQ ID NO: 24519
  Description of Artificial Sequence: Synthetic coding sequence

SEQ ID NO: 24521 - DNA, 48 bp, Artificial Sequence
  Description of Artificial Sequence: Synthetic coding sequence
atgaacatcagcgtggacctggagaccaactacgccgagctggtgtag

SEQ ID NO: 24522 - DNA, 210 bp, Artificial Sequence
  Description of Artificial Sequence: Synthetic coding sequence
atgaacatcagcgtggacctggagaccaactacgccgagctggtgctggacgtgggcagagtgaccctgggcgagaacagcagaaagaagatgaaggactgcaagctgagaaagaagcagaacgagagcgtgagcagagccatgtgcgccctgctgaacagcggcggcggcgtgatcaaggccgagatcgagaacgaggactacagctag

SEQ ID NO: 24523 - DNA, 387 bp, Artificial Sequence
  Description of Artificial Sequence: Synthetic coding sequence
atgaacatcagcgtggacctggagaccaactacgccgagctggtgctggacgtgggcagagtgaccctgggcgagaacagcagaaagaagatgaaggactgcaagctgagaaagaagcagaacgagagcgtgagcagagccatgtgcgccctgctgaacagcggcggcggcgtgatcaaggccgagatcgagaacgaggactacagctacaccaaggacggcatcggcctggacctggagaacagcttcagcaacatcctgctgttcgtgcccgagtacctggacttcatgcagaacggcaactacttcctgatcttcgtgaagagctggagcctgaacaccagcggcctgagaatcaccaccctgagcagcaacctgtacaagtag

SEQ ID NO: 24524 - DNA, 1737 bp, Artificial Sequence; identical to SEQ ID NO: 24519
  Description of Artificial Sequence: Synthetic coding sequence

SEQ ID NO: 24525 - DNA, 1854 bp, Artificial Sequence
  Description of Artificial Sequence: Synthetic coding sequence
atggccatgaagatcatggagaagatcagaaacgtgttccactgcgaggcccacagaatcctgtacatctgcgagagccagttcctgagaaacttcatcagaaaggagttcctgagaggcaacggcctggccgccggcaagatgaacatcagcatcgacctggacaccaactacgccgagctggtgctgaacgtgggcagagtgaccctgggcgagaacaacagaaagaagatgaaggactgccagctgagaaagcagcagaacgagaacgtgagcagagccgtgtgcgccctgctgaacagcggcggcggcgtgatcaaggccgaggtggagaacaagggctacagctacaagaaggacggcatcggcctggacctggagaacagcttcagcaacatgctgcccttcgtgcccaacttcctggacttcatgcagaacggcaactacttccacatcttcgtgaagagctggagcctggagaccagcggcccccagatcgccaccctgagcagcagcctgtacaagagagacgtgaccagcgccaaggtgatgaacgccagcgccgccctggagttcctgaaggacatggagaagaccggcggcagagcctacctgagacccgagttccccgccaagagagcctgcgtggacgtgcaggaggagagcaacatggaggccctggccgccgacttcttcaacagaaccgagctgggctacaaggagaagctgaccttcaccgagagcacccacgtggagatcaagaacttcagcaccgagaagctgctgcagagaatcaccgagatcctgccccagtacgtgagcgccttcgccaacaccgacggcggctacctgttcgtgggcctgaacgaggacaaggaggtgatcggcttcaaggccgagaagagctacctgaccaagctggaggaggtgaccaagaacagcatcggcaagctgcccgtgcaccacttctgcgtggagaagggcaccatcaactacctgtgcaagttcctgggcgtgtacgacaagggcagactgtgcggctacgtgtacgccctgagagtggagagattctgctgcgccgtgttcgccaagaagcccgacagctggcacgtgaaggacaacagagtgaagcagctgaccgagaaggagtggatccagttcatggtggacagcgagcccgtgtgcgaggagctgcccagccccgccagcaccagcagccccgtgagccagagctaccccctgagagagtacatcaacttcaagatccagcccctgagataccacctgcccggcctgagcgagaagatcacctgcgcccccaagaccttctgcagaaacctgttcagccagcacgagggcctgaagcagctgatctgcgaggagatgggcagcgtgaacaagggcagcctgatcttcagcagaagctggagcctggacctgggcctgcaggagaaccacaaggtgctgtgcgacgccctgctgatcagccaggacaagccccccgtgctgtacaccttccacatggtgcaggacgaggagttcaaggactacagcacccagaccgcccagaccctgaagcagaagctggccaagatcggcggctacaccaagaaggtgtgcgtgatgaccaagatcttctacctgagccccgagggcaagaccagctgccagtacgacctgaacagccaggtgatctaccccgagagctactactggaccaccgcccagaccatgaaggacctggagaaggccctgagcaacatcctgcccaaggagaaccagatcttcctgttcgtgtgcctgttcagattctgcctgttcgtgtgctggttcgtgtgcttcttcctgagatag

SEQ ID NO: 24526 - DNA, 1860 bp, Artificial Sequence
  Description of Artificial Sequence: Synthetic coding sequence
atgcagctgagcgagggcctggccgcccacaccagaagagccggcaagtggaagagaacccaggtgcccctgctgggcgaggagtgcgccgacatggacctggccagaaaggagttcctgagaggcaacggcctggccgccggcaagatgaacatcagcatcgacctggacaccaactacgccgagctggtgctgaacgtgggcagagtgaccctgggcgagaacaacagaaagaagatgaaggactgccagctgagaaagcagcagaacgagaacgtgagcagagccgtgtgcgccctgctgaacagcggcggcggcgtgatcaaggccgaggtggagaacaagggctacagctacaagaaggacggcatcggcctggacctggagaacagcttcagcaacatgctgcccttcgtgcccaacttcctggacttcatgcagaacggcaactacttccacatcttcgtgaagagctggagcctggagaccagcggcccccagatcgccaccctgagcagcagcctgtacaagagagacgtgaccagcgccaaggtgatgaacgccagcgccgccctggagttcctgaaggacatggagaagaccggcggcagagcctacctgagacccgagttccccgccaagagagcctgcgtggacgtgcaggaggagagcaacatggaggccctggccgccgacttcttcaacagaaccgagctgggctacaaggagaagctgaccttcaccgagagcacccacgtggagatcaagaacttcagcaccgagaagctgctgcagagaatcaccgagatcctgccccagtacgtgagcgccttcgccaacaccgacggcggctacctgttcgtgggcctgaacgaggacaaggaggtgatcggcttcaaggccgagaagagctacctgaccaagctggaggaggtgaccaagaacagcatcggcaagctgcccgtgcaccacttctgcgtggagaagggcaccatcaactacctgtgcaagttcctgggcgtgtacgacaagggcagactgtgcggctacgtgtacgccctgagagtggagagattctgctgcgccgtgttcgccaagaagcccgacagctggcacgtgaaggacaacagagtgaagcagctgaccgagaaggagtggatccagttcatggtggacagcgagcccgtgtgcgaggagctgcccagccccgccagcaccagcagccccgtgagccagagctaccccctgagagagtacatcaacttcaagatccagcccctgagataccacctgcccggcctgagcgagaagatcacctgcgcccccaagaccttctgcagaaacctgttcagccagcacgagggcctgaagcagctgatctgcgaggagatgggcagcgtgaacaagggcagcctgatcttcagcagaagctggagcctggacctgggcctgcaggagaaccacaaggtgctgtgcgacgccctgctgatcagccaggacaagccccccgtgctgtacaccttccacatggtgcaggacgaggagttcaaggactacagcacccagaccgcccagaccctgaagcagaagctggccaagatcggcggctacaccaagaaggtgtgcgtgatgaccaagatcttctacctgagccccgagggcaagaccagctgccagtacgacctgaacagccaggtgatctaccccgagagctactactggaccaccgcccagaccatgaaggacctggagaaggccctgagcaacatcctgcccaaggagaaccagatcttcctgttcgtgtgcctgttcagattctgcctgttcgtgtgctggttcgtgtgcttcttcctgagatag

SEQ ID NO: 24527 - DNA, 2694 bp, Artificial Sequence
  Description of Artificial Sequence: Synthetic coding sequence
atggaggccaaccactgcagcctgggcgtgtaccccagctaccccgacctggtgatcgacgtgggcgaggtgaccctgggcgaggagaacagaaagaagctgcagaagacccagagagaccaggagagagccagagtgatcagagccgcctgcgccctgctgaacagcggcggcggcgtgatccagatggagatggccaacagagacgagagacccaccgagatgggcctggacctggaggagagcctgagaaagctgatccagtacccctacctgcaggccttcttcgagaccaagcagcacggcagatgcttctacatcttcgtgaagagctggagcggcgaccccttcctgaaggacggcagcttcaacagcagaatctgcagcctgagcagcagcctgtactgcagaagcggcaccagcgtgctgcacatgaacagcagacaggccttcgacttcctgaagaccaaggagagacagagcaagtacaacctgatcaacgagggcagcccccccagcaagatcatgaaggccgtgtaccagaacatcagcgagagcaaccccgcctacgaggtgttccagaccgacaccatcgagtacggcgagatcctgagcttccccgagagccccagcatcgagttcaagcagttcagcaccaagcacatccagcagtacgtggagaacatcatccccgagtacatcagcgccttcgccaacaccgagggcggctacctgttcatcggcgtggacgacaagagcagaaaggtgctgggctgcgccaaggagcaggtggaccccgacagcctgaagaacgtgatcgccagagccatcagcaagctgcccatcgtgcacttctgcagcagcaagcccagagtggagtacagcaccaagatcgtggaggtgttctgcggcaaggagctgtacggctacctgtgcgtgatcaaggtgaaggccttctgctgcgtggtgttcagcgaggcccccaagagctggatggtgagagagaagtacatcagacccctgaccaccgaggagtgggtggagaagatgatggacgccgaccccgagttcccccccgacttcgccgaggccttcgagagccagctgagcctgagcgacagccccagcctgtgcagacccgtgtacagcaagaagggcctggagcacaaggccgacctgcagcagcacctgttccccgtgccccccggccacctggagtgcacccccgagagcctgtggaaggagctgagcctgcagcacgagggcctgaaggagctgatccacaagcagatgagacccttcagccagggcatcgtgatcctgagcagaagctgggccgtggacctgaacctgcaggagaagcccggcgtgatctgcgacgccctgctgatcgcccagaacagcacccccatcctgtacaccatcctgagagagcaggacgccgagggccaggactactgcaccagaaccgccttcaccctgaagcagaagctggtgaacatgggcggctacaccggcaaggtgtgcgtgagagccaaggtgctgtgcctgagccccgagagcagcgccgaggccctggaggccgccgtgagccccatggactaccccgccagctacagcctggccggcacccagcacatggaggccctgctgcagagcctggtgatcgtgctgctgggcttcagaagcctgctgagcgaccagctgggctgcgaggtgctgaacctgctgaccgcccagcagtacgagatcttcagcagaagcctgagaaagaacagagagctgttcgtgcacggcctgcccggcagcggcaagaccatcatggccatgaagatcatggagaagatcagaaacgtgttccactgcgaggcccacagaatcctgtacgtgtgcgagaaccagcccctgagaaacttcatcagcgacagaaacatctgcagagccgagaccagagagaccttcctgagagagaagttcgagcacatccagcacatcgtgatcgacgaggcccagaacttcagaaccgaggacggcgactggtacagaaaggccaagaccatcacccagagagagaaggactgccccggcgtgctgtggatcttcctggactacttccagaccagccacctgggccacagcggcctgccccccctgagcgcccagtaccccagagaggagctgaccagagtggtgagaaacgccgacgagatcgccgagtacatccagcaggagatgcagctgatcatcgagaacccccccatcaacatcccccacggctacctggccatcctgagcgaggccaagtgggtgcccggcgtgcccggcaacaccaagatcatcaagaacttcaccctggagcagatcgtgacctacgtggccgacacctgcagatgcttcttcgagagaggctacagccccaaggacgtggccgtgctggtgagcaccgtgaccgaggtggagcagtaccagagcaagctgctgaaggccatgagaaagaagatggtggtgcagctgagcgacgcctgcgacatgctgggcgtgcacatcgtgctggacagcgtgagaagattcagcggcctggagagaagcatcgtgttcggcatccaccccagaaccgccgaccccgccatcctgcccaacatcctgatctgcctggccagcagagccaagcagcacctgtacatcttcctgtag

SEQ ID NO: 24528 - DNA, 1740 bp, Artificial Sequence
  Description of Artificial Sequence: Synthetic coding sequence
atggaggccaaccactgcagcctggcccccaagagctggatggtgagagagaagtacatcagacccctgaccaccgaggagtgggtggagaagatgatggacgccgaccccgagttcccccccgacttcgccgaggccttcgagagccagctgagcctgagcgacagccccagcctgtgcagacccgtgtacagcaagaagggcctggagcacaaggccgacctgcagcagcacctgttccccgtgccccccggccacctggagtgcacccccgagagcctgtggaaggagctgagcctgcagcacgagggcctgaaggagctgatccacaagcagatgagacccttcagccagggcatcgtgatcctgagcagaagctgggccgtggacctgaacctgcaggagaagcccggcgtgatctgcgacgccctgctgatcgcccagaacagcacccccatcctgtacaccatcctgagagagcaggacgccgagggccaggactactgcaccagaaccgccttcaccctgaagcagaagctggtgaacatgggcggctacaccggcaaggtgtgcgtgagagccaaggtgctgtgcctgagccccgagagcagcgccgaggccctggaggccgccgtgagccccatggactaccccgccagctacagcctggccggcacccagcacatggaggccctgctgcagagcctggtgatcgtgctgctgggcttcagaagcctgctgagcgaccagctgggctgcgaggtgctgaacctgctgaccgcccagcagtacgagatcttcagcagaagcctgagaaagaacagagagctgttcgtgcacggcctgcccggcagcggcaagaccatcatggccatgaagatcatggagaagatcagaaacgtgttccactgcgaggcccacagaatcctgtacgtgtgcgagaaccagcccctgagaaacttcatcagcgacagaaacatctgcagagccgagaccagagagaccttcctgagagagaagttcgagcacatccagcacatcgtgatcgacgaggcccagaacttcagaaccgaggacggcgactggtacagaaaggccaagaccatcacccagagagagaaggactgccccggcgtgctgtggatcttcctggactacttccagaccagccacctgggccacagcggcctgccccccctgagcgcccagtaccccagagaggagctgaccagagtggtgagaaacgccgacgagatcgccgagtacatccagcaggagatgcagctgatcatcgagaacccccccatcaacatcccccacggctacctggccatcctgagcgaggccaagtgggtgcccggcgtgcccggcaacaccaagatcatcaagaacttcaccctggagcagatcgtgacctacgtggccgacacctgcagatgcttcttcgagagaggctacagccccaaggacgtggccgtgctggtgagcaccgtgaccgaggtggagcagtaccagagcaagctgctgaaggccatgagaaagaagatggtggtgcagctgagcgacgcctgcgacatgctgggcgtgcacatcgtgctggacagcgtgagaagattcagcggcctggagagaagcatcgtgttcggcatccaccccagaaccgccgaccccgccatcctgcccaacatcctgatctgcctggccagcagagccaagcagcacctgtacatcttcctgtag

SEQ ID NO: 24529 - DNA, 321 bp, Artificial Sequence
  Description of Artificial Sequence: Synthetic coding sequence
atggaggccaaccactgcagcctgggcgtgtaccccagctaccccgacctggtgatcgacgtgggcgaggtgaccctgggcgaggagaacagaaagaagctgcagaagacccagagagaccaggagagagccagagtgatcagagccgcctgcgccctgctgaacagcggcggcggcgtgatccagatggagatggccaacagagacgagagacccaccgagatgggcctggacctggaggagagcctgagaaagctgatccagtacccctacctgcaggccttcttcgagaccaagcagcacggcagatgcttctactag

SEQ ID NO: 24530 - DNA, 2694 bp, Artificial Sequence; identical to SEQ ID NO: 24527
  Description of Artificial Sequence: Synthetic coding sequence

SEQ ID NO: 24531 - DNA, 1740 bp, Artificial Sequence; identical to SEQ ID NO: 24528
  Description of Artificial Sequence: Synthetic coding sequence

SEQ ID NO: 24532 - DNA, 2694 bp, Artificial Sequence; identical to SEQ ID NO: 24527
  Description of Artificial Sequence: Synthetic coding sequence

SEQ ID NO: 24533 - DNA, 2739 bp, Artificial Sequence
  Description of Artificial Sequence: Synthetic coding sequence
atggagagcctgaagaccgacaccgagatgccctaccccgaggtgatcgtggacgtgggcagagtgatcttcggcgaggagaacagaaagaagatgaccaacagctgcctgaagagaagcgagaacagcagaatcatcagagccatctgcgccctgctgaacagcggcggcggcgtgatcaaggccgagatcgacgacaagacctacagctaccagtgccacggcctgggccaggacctggagaccagcttccagaagctgctgcccagcggcagccagaagtacctggactacatgcagcagggccacaacctgctgatcttcgtgaagagctggagccccgacgtgttcagcctgcccctgagaatctgcagcctgagaagcaacctgtacagaagagacgtgaccagcgccatcaacctgagcgccagcagcgccctggagctgctgagagagaagggcttcagagcccagagaggcagacccagagtgaagaagctgcacccccagcaggtgctgaacagatgcatccaggaggaggaggacatgagaatcctggccagcgagttcttcaagaaggacaagctgatgtacaaggagaagctgaacttcaccgagagcacccacgtggagttcaagagattcaccaccaagaaggtgatccccagaatcaaggagatgctgccccactacgtgagcgccttcgccaacacccagggcggctacgtgctgatcggcgtggacgacaagagcaaggaggtggtgggctgcaagtgggagaaggtgaaccccgacctgctgaagaaggagatcgagaactgcatcgagaagctgcccaccttccacttctgctgcgagaagcccaaggtgaacttcaccaccaagatcctgaacgtgtaccagaaggacgtgctggacggctacgtgtgcgtgatccaggtggagcccttctgctgcgtggtgttcgccgaggcccccgacagctggatcatgaaggacaacagcgtgaccagactgaccgccgagcagtgggtggtgatgatgctggacacccagagcgccccccccagcctggtgaccgactacaacagctgcctgatcagcagcgccagcagcgccagaaagagccccggctaccccatcaaggtgcacaagttcaaggaggccctgcagagacacctgttccccgtgacccaggaggaggtgcagttcaagcccgagagcctgtgcaagaagctgttcagcgaccacaaggagctggagggcctgatgaagaccctgatccacccctgcagccagggcatcgtgatcttcagcagaagctgggccggcgacgtgggcttcagaaaggagcagaacgtgctgtgcgacgccctgctgatcgccgtgaacagccccgtggtgctgtacaccatcctgatcgaccccaactggcccggcggcctggagtacgccagaaacaccgcccaccagctgaagcagaagctgcagaccgtgggcggctacaccggcaaggtgtgcatcatccccagactgatccacctgagcagcacccagagcagacccggcgagatccccctgagataccccagaagctacagactggccgacgaggaggagatggaggacctgctgcaggccctggtggtggtgagcctgagcagcagaagcctgctgagcgaccagatgggctgcgagttcttcaacctgctgatcatggagcagagccagctgctgagcgagagcctgcagaagaccagagagctgttcatctactgcttccccggcgtgagaaagaccgccctggccatcaagatcatggagaagatcaaggacctgttccactgcaagcccaaggagatcctgtacgtgtgcgagagcgacagcctgaaggacttcgtgacccagcagaccacctgccaggccgtgaccagaaagaccttcatgcagggcgagttcctgaagatcaagcacatcgtgatggacgagaccgagaacttctgcagcaagtacggcaactggtacatgaaggccaagaacatcacccaccccaaggccaagggcaccggcagcgagaacctgcaccacggcatcctgtggctgttcctggaccccttccagatccaccacgccgacgtgaacggcctgcccccccccagcgcccagttccccagaaagaccatcaccagcggcatccactgcgccctggagatcgccaaggtgatgaaggaggagatgaagagaatcaaggagaacccccccagcaacatgagccccgacaccctggccctgttcagcgagaccgcctacgaggaggccacctgcgcccaggccctgcccggcgtgtgcgagaccaagaccaacctgaccaccgagcagatcgccaactacgtggccagaaagtgccacagcctgttccagtgcggctacctgcccaaggacatcgccatcctgtgcagaagaggcgaggacagaggcagatacagactggccctgctgaaggccatggagctgatcgagacccacagacccagcgaggtggtgttcagccccgccaccggcgtgtggggcagccacatcgtgctggacagcatccagcagttcagcggcctggagagaaccgtggtgttcggcctgagccccgagtgcgaccagagcgaggagttccacaagctgtgcttcgccagcagagccatcaagcacctgtacctgctgtacgagaagagagccgcctactag

SEQ ID NO: 24534 - DNA, 2676 bp, Artificial Sequence
  Description of Artificial Sequence: Synthetic coding sequence
atgagcctgagaatcgacgtggacaccaacttccccgagtgcgtggtggacgccggcaaggtgaccctgggcacccagcagagacaggagatggaccccagactgagagagaagcagaacgagatcatcctgagagccgtgtgcgccctgctgaacagcggcggcggcatcatcaaggccgagatcgagaacaagggctacaactacgagagacacggcgtgggcctggacgtgccccccatcttcagaagccacctggacaagatgcagaaggagaaccacttcctgatcttcgtgaagagctggaacaccgaggccggcgtgcccctggccaccctgtgcagcaacctgtaccacagagagagaaccagcaccgacgtgatggacagccaggaggccctggccttcctgaagtgcagaacccagacccccaccaacatcaacgtgagcaacagcctgggcccccaggccgcccagggcagcgtgcagtacgagggcaacatcaacgtgagcgccgccgccctgttcgacagaaagagactgcagtacctggagaagctgaacctgcccgagagcacccacgtggagttcgtgatgttcagcaccgacgtgagccactgcgtgaaggacagactgcccaagtgcgtgagcgccttcgccaacaccgagggcggctacgtgttcttcggcgtgcacgacgagacctgccaggtgatcggctgcgagaaggagaagatcgacctgaccagcctgagagccagcatcgacggctgcatcaagaagctgcccgtgcaccacttctgcacccagagacccgagatcaagtacgtgctgaacttcctggaggtgcacgacaagggcgccctgagaggctacgtgtgcgccatcaaggtggagaagttctgctgcgccgtgttcgccaaggtgcccagcagctggcaggtgaaggacaacagagtgagacagctgcccaccagagagtggaccgcctggatgatggaggccgaccccgacctgagcagatgccccgagatggtgctgcagctgagcctgagcagcgccacccccagaagcaagcccgtgtgcatccacaagaacagcgagtgcctgaaggagcagcagaagagatacttccccgtgttcagcgacagagtggtgtacacccccgagagcctgtacaaggagctgttcagccagcacaagggcctgagagacctgatcaacaccgagatgagacccttcagccagggcatcctgatcttcagccagagctgggccgtggacctgggcctgcaggagaagcagggcgtgatctgcgacgccctgctgatcagccagaacaacacccccatcctgtacaccatcttcagcaagtgggacgccggctgcaagggctacagcatgatcgtggcctacagcctgaagcagaagctggtgaacaagggcggctacaccggcagactgtgcatcacccccctggtgtgcgtgctgaacagcgacagaaaggcccagagcgtgtacagcagctacctgcagatctaccccgagagctacaacttcatgaccccccagcacatggaggccctgctgcagagcctggtgatcgtgctgctgggcttcaagagcttcctgagcgaggagctgggcagcgaggtgctgaacctgctgaccaacaagcagtacgagctgctgagcaagaacctgagaaagaccagagagctgttcgtgcacggcctgcccggcagcggcaagaccatcctggccctgagaatcatggagaagatcagaaacgtgttccactgcgagcccgccaacatcctgtacatctgcgagaaccagcccctgaagaagctggtgagcttcagcaagaagaacatctgccagcccgtgaccagaaagaccttcatgaagaacaacttcgagcacatccagcacatcatcatcgacgacgcccagaacttcagaaccgaggacggcgactggtacggcaaggccaagttcatcacccagaccgccagagacggccccggcgtgctgtggatcttcctggactacttccagacctaccacctgagctgcagcggcctgcccccccccagcgaccagtaccccagagaggagatcaacagagtggtgagaaacgccggccccatcgccaactacctgcagcaggtgatgcaggaggccagacagaaccccccccccaacctgccccccggcagcctggtgatgctgtacgagcccaagtgggcccagggcgtgcccggcaacctggagatcatcgaggacctgaacctggaggagatcctgatctacgtggccaacaagtgcagattcctgctgagaaacggctacagccccaaggacatcgccgtgctgttcaccaaggccagcgaggtggagaagtacaaggacagactgctgaccgccatgagaaagagaaagctgagccagctgcacgaggagagcgacctgctgctgcagatcggcgacgccagcgacgtgctgaccgaccacatcgtgctggacagcgtgtgcagattcagcggcctggagagaaacatcgtgttcggcatcaaccccggcgtggccccccccgccggcgcctacaacctgctgctgtgcctggccagcagagccaagagacacctgtacatcctgaaggccagcgtgtag

SEQ ID NO: 24535 - DNA, 1170 bp, Artificial Sequence
  Description of Artificial Sequence: Synthetic coding sequence
atgagcctgagaatcgacgtggacaccaacttccccgagtgcgtggtggacgccggcaaggtgaccctgggcacccagcagagacaggagatggaccccagactgagagagaagcagaacgagatcatcctgagagccgtgtgcgccctgctgaacagcggcggcggcatcatcaaggccgagatcgagaacaagggctacaactacgagagacacggcgtgggcctggacgtgccccccatcttcagaagccacctggacaagatgcagaaggagaaccacttcctgatcttcgtgaagagctggaacaccgaggccggcgtgcccctggccaccctgtgcagcaacctgtaccacagagagagaaccagcaccgacgtgatggacagccaggaggccctggccttcctgaagtgcagaacccagacccccaccaacatcaacgtgagcaacagcctgggcccccaggccgcccagggcagcgtgcagtacgagggcaacatcaacgtgagcgccgccgccctgttcgacagaaagagactgcagtacctggagaagctgaacctgcccgagagcacccacgtggagttcgtgatgttcagcaccgacgtgagccactgcgtgaaggacagactgcccaagtgcgtgagcgccttcgccaacaccgagggcggctacgtgttcttcggcgtgcacgacgagacctgccaggtgatcggctgcgagaaggagaagatcgacctgaccagcctgagagccagcatcgacggctgcatcaagaagctgcccgtgcaccacttctgcacccagagacccgagatcaagtacgtgctgaacttcctggaggtgcacgacaagggcgccctgagaggctacgtgtgcgccatcaaggtggagaagttctgctgcgccgtgttcgccaaggtgcccagcagctggcaggtgaaggacaacagagtgagacagctgcccaccagagagtggaccgcctggatgatggaggccgaccccgacctgagcagatgccccgagatggtgctgcagctgagcctgagcagcgccacccccagaagcaagcccgtgtgcatccacaagaacagcgagtgcctgaaggagcagcagaagagatacttccccgtgagcgccagaaagaccagcgccagccagtag

SEQ ID NO: 24536 - DNA, 1224 bp, Artificial Sequence
  Description of Artificial Sequence: Synthetic coding sequence
atgacccccatgaagagaagcgtgcagacccaggtgagcgagcccttcatggagagctggggcgaggagagcctgcccgagctgcccgccgagcagagcctgaccgagtacagcgacctggaggaggcccccagcgcccacaccctgtacgtgggccacctgaacccccagttcagcgtgcccgtgctggcctgcctgctgagagacaccctggagagactggagatgcccgtggccagagagcacatcgaggtggtgagaagacccagaaaggcctacgccctggtgcaggtgaccgtgcacagagacaccctggccagcctgccctggagactgcagaccgccctggaggagcacctgatcctgaaggagctggccgccagaggcaaggacctgctgctgagcgaggcccagggccccttcagccacagagaggagaaggaggaggaggaggaggacagcggcctgagccccggccccagccccggcagcggcgtgcccctgcccacctggcccacccacaccctgcccgacagaccccaggcccagcagctgcagagctgccagggcagacccagcggcgtgtgcagcgacagcgccatcgtgcaccagcagatcgtgggcaaggaccagctgttccagggcgccttcctgggcagcgagaccagaaacatggagttcaagagaggcagcggcgagtacctgagcctggccttcaagcaccacgtgagaagatacgtgtgcgccttcctgaacagcgagggcggcagcctgctggtgggcgtggaggacagcggcctggtgcagggcatcagatgcagccacagagacgaggacagagccagactgctggtggacagcatcctgcagggcttcaagccccagatcttccccgacgcctacaccctgaccttcatccccgtgatcagcaccagcgagaccagcgtgcccctgaaggtgatcagactgaccgtgcacacccccaaggcccagagccagccccagctgtaccagaccgaccagggcgaggtgttcctgagaagagacggcagcatccagggccccctgagcgccagcgccatccaggagtggtgcagacagagatggctggtggagctgggcaagctggaggagaagatgaaggccctgatgatggagaaggagcagctgcagcagcagctgcagcagcacggccccgtgagctgcacctgctgcgtgctgtag

SEQ ID NO: 24537 - DNA, 1224 bp, Artificial Sequence; identical to SEQ ID NO: 24536
  Description of Artificial Sequence: Synthetic coding sequence

SEQ ID NO: 24538 - DNA, 1047 bp, Artificial Sequence
  Description of Artificial Sequence: Synthetic coding sequence
atgacccccatgaagagaagcgtgcagacccaggtgagcgagcccttcatggagagctggggcgaggagagcctgcccgagctgcccgccgagcagagcctgaccgagtacagcgacctggaggaggcccccagcgcccacaccctgtacgtgggccacctgaacccccagttcagcgtgcccgtgctggcctgcctgctgagagacaccctggagagactggagatgcccgtggccagagagcacatcgaggtggtgagaagacccagaaaggcctacgccctggtgcaggtgaccgtgcacagagacaccctggccagcctgccctggagactgcagaccgccctggaggagcacctgatcctgaaggagctggccgccagaggcaaggacctgctgctgagcgaggcccagggccccttcagccacagagagcagatcgtgggcaaggaccagctgttccagggcgccttcctgggcagcgagaccagaaacatggagttcaagagaggcagcggcgagtacctgagcctggccttcaagcaccacgtgagaagatacgtgtgcgccttcctgaacagcgagggcggcagcctgctggtgggcgtggaggacagcggcctggtgcagggcatcagatgcagccacagagacgaggacagagccagactgctggtggacagcatcctgcagggcttcaagccccagatcttccccgacgcctacaccctgaccttcatccccgtgatcagcaccagcgagaccagcgtgcccctgaaggtgatcagactgaccgtgcacacccccaaggcccagagccagccccagctgtaccagaccgaccagggcgaggtgttcctgagaagagacggcagcatccagggccccctgagcgccagcgccatccaggagtggtgcagacagagatggctggtggagctgggcaagctggaggagaagatgaaggccctgatgatggagaaggagcagctgcagcagcagctgcagcagcacggccccgtgagctgcacctgctgcgtgctgtag

SEQ ID NO: 24539 - DNA, 1080 bp, Artificial Sequence
  Description of Artificial Sequence: Synthetic coding sequence
atgacccccatgaagagaagcgtgcagacccaggtgagcgagcccttcatggagagctggggcgaggagagcctgcccgagctgcccgccgagcagagcctgaccgagtacagcgacctggaggaggcccccagcgcccacaccctgtacgtgggccacctgaacccccagttcagcgtgcccgtgctggcctgcctgctgagagacaccctggagagactggagatgcccgtggccagagagcacatcgaggtggtgagaagacccagaaaggcctacgccctggtgcaggtgaccgtgcacagagacaccctggccagcctgccctggagactgcagaccgccctggaggagcacctgatcctgaaggagctggccgccagaggcaaggacctgctgctgagcgaggcccagggccccttcagccacagagaggagaaggaggaggaggaggaggacagcggcctgagccccggccccagccccggcagcggcgtgcccctgcccacctggcccacccacaccctgcccgacagaccccaggcccagcagctgcagagctgccagggcagacccagcggcgtgtgcagcgacagcgccatcgtgcaccagcagatcgtgggcaaggaccagctgttccagggcgccttcctgggcagcgagaccagaaacatggagttcaagagaggcagcggcgagtacctgagcctggccttcaagcaccacgtgagaagatacgtgtgcgccttcctgaacagcgagggcggcagcctgctggtgggcgtggaggacagcggcctggtgcagggcatcagatgcagccacagagacgaggacagagccagactgctggtggacagcatcctgcagggcttcaagccccagatcttccccgacgcctacaccctgaccttcatccccgtgatcagcaccagcgagaccagcgtgcccctgaagagatggctggtggagctgggcaagctggaggagaagatgaaggccctgatgatggagaaggagcagctgcagcagcagctgcagcagcacggccccgtgagctgcacctgctgcgtgctgtag

SEQ ID NO: 24540 - DNA, 1080 bp, Artificial Sequence; identical to SEQ ID NO: 24539
  Description of Artificial Sequence: Synthetic coding sequence

SEQ ID NO: 24541 - DNA, 1224 bp, Artificial Sequence; identical to SEQ ID NO: 24536
  Description of Artificial Sequence: Synthetic coding sequence

SEQ ID NO: 24542 - DNA, 1920 bp, Artificial Sequence
  Description of Artificial Sequence: Synthetic coding sequence
atgagcgccagcggcgtgctgagcttcacccagcagggctgggagcaggtgctggccaaggtgaagagagccgtggtgtacctggacgccgcctgcgccgagagcctgcactggggctgcggcagcaccagactgctggaggccgtgggcggccccgactgccacctgagagagttcgagcccgacgccatcggcggcggcgccaagcagcccaaggccgtgttcgtgctgagctgcctgctgaagggcagaaccgtggagatcctgagagacatcatctgcagaagccacttccagtactgcgtggtggtgaccaccgtgagccacgccgtgcacctgaccgccaaccacgtgcccgccgccgccgccgccgagatggagggccagcagcccgtgttcgagcagctggaggagaagctgtgcgagtggatgggcaacatgaactacaccgccgaggtgttccacgtgcccctgctgctggcccccgtggccccccacttcgccctgacccccgccttcgccagcctgttccccctgctgccccaggacgtgcacctgctgaacagcgccagacccgacaagagaaagctgggcagcctgggcgacgtggacagcaccaccctgacccccgagctgctgctgcagatcagatgcctggtgagcggcctgagcagcctgtgcgagcacctgggcgtgagagaggagtgcttcgccgtgggcagcctgagccaggtgatcgccgccgacctggccaactacgcccccgccaagaacagaaagaagaccgccgccggcagagccagcgtggtgttcgtggacagaaccctggacctgaccggcgccgtgggccaccacggcgacaacctggtggagaagatcatcagcgccctgccccagctgcccggccacaccaacgacgtgatggtgaacatgatcgccctgaccgccctgcacaccgaggaggagaactacaacgtggtggcccccggctgcctgagccagagcagcgacaccaccgccaaggccctgtgggaggccctgctgaacaccaagcacaaggaggccgtgatggaggtgagaagacacctggtggaggccgccagcagagagaacctgcccatcaagatgagcatgggcagagtgacccccggccagctgatgagctacatccagctgttcaagaacaacctgaaggccctgatgaaccactgcggcctgctgcagctgggcctggccaccgcccagaccctgaagcacccccagaccgccaagtgggacaacttcctggccttcgagagactgctgctgcagagcatcggcgagagcgccatgagcgtggtgctgaaccagctgctgcccatgatcaagcccgtgacccagagaaccaacgaggactacagccccgaggagctgctgatcctgctgatctacatctacagcgtgaccggcgagctgaccgtggacaaggacctgtgcgaggccgaggagaaggtgaagaaggccctggcccaggtgttctgcgaggagagcggcctgagccccctgctgcagaagatcaccgactgggacagcagcatcaacctgaccttccacaagagcaagatcgccgtggacgagctgttcaccagcctgagagacatcgccggcgccagaagcctgctgaagcagttcaagagcgtgtacgtgcccggcaaccacacccaccaggtgagcagaccccaccccagcgactaccccctgctgatcctgttcgtggtgggcggcgtgaccgtgagcgaggtgaagatggtgaaggacctggtggccagcctgaagcccggcacccaggtgatcgtgctgagcaccagactgctgaagcccctgaacatccccgagctgctgttcgccaccgacagactgcaccccgacctgggcttctag

SEQ ID NO: 24543 - DNA, 2055 bp, Artificial Sequence
  Description of Artificial Sequence: Synthetic coding sequence
atgagcgccagcggcgtgctgagcttcacccagcagggctgggagcaggtgctggccaaggtgaagagagccgtggtgtacctggacgccgcctgcgccgagagcctgcactggggctgcggcagcaccagactgctggaggccgtgggcggccccgactgccacctgagagagttcgagcccgacgccatcggcggcggcgccaagcagcccaaggccgtgttcgtgctgagctgcctgctgaagggcagaaccgtggagatcctgagagacatcatctgcagaagccacttccagtactgcgtggtggtgaccaccgtgagccacgccgtgcacctgaccgccaaccacgtgcccgccgccgccgccgccgagatggagggccagcagcccgtgttcgagcagctggaggagaagctgtgcgagtggatgggcaacatgaactacaccgccgaggtgttccacgtgcccctgctgctggcccccgtggccccccacttcgccctgacccccgccttcgccagcctgttccccctgctgccccaggacgtgcacctgctgaacagcgccagacccgacaagagaaagctgggcagcctgggcgacgtggacagcaccaccctgacccccgagctgctgctgcagatcagatgcctggtgagcggcctgagcagcctgtgcgagcacctgggcgtgagagaggagtgcttcgccgtgggcagcctgagccaggtgatcgccgccgacctggccaactacgcccccgccaagaacagaaagaagaccgccgccggcagagccagcgtggtgttcgtggacagaaccctggacctgaccggcgccgtgggccaccacggcgacaacctggtggagaagatcatcagcgccctgccccagctgcccggccacaccaacgacgtgatggtgaacatgatcgccctgaccgccctgcacaccgaggaggagaactacaacgtggtggcccccggctgcctgagccagagcagcgacaccaccgccaaggccctgtgggaggccctgctgaacaccaagcacaaggaggccgtgatggaggtgagaagacacctggtggaggccgccagcagagagaacctgcccatcaagatgagcatgggcagagtgacccccggccagctgatgagctacatccagctgttcaagaacaacctgaaggccctgatgaaccactgcggcctgctgcagctgggcctggccaccgcccagaccctgaagcacccccagaccgccaagtgggacaacttcctggccttcgagagactgctgctgcagagcatcggcgagagcgccatgagcgtggtgctgaaccagctgctgcccatgatcaagcccgtgacccagagaaccaacgaggactacagccccgaggagctgctgatcctgctgatctacatctacagcgtgaccggcgagctgaccgtggacaaggacctgtgcgaggccgaggagaaggtgaagaaggccctggcccaggtgttctgcgaggagagcggcctgagccccctgctgcagaagatcaccgactgggacagcagcatcaacctgaccttccacaagagcaagatcgccgtggacgagctgttcaccagcctgagagacatcgccggcgccagaagcctgctgaagcagttcaagagcgtgtacgtgcccggcaaccacacccaccaggccagctacaagcccctgctgaagcaggtggtggaggagatcttccaccccgagagacccgacagcgtggacatcgagcacatgagcagcggcctgaccgacctgctgaagaccggcttcagcatgttcatgaaggtgagcagaccccaccccagcgactaccccctgctgatcctgttcgtggtgggcggcgtgaccgtgagcgaggtgaagatggtgaaggacctggtggccagcctgaagcccggcacccaggtgatcgtgctgagcaccagactgctgaagcccctgaacatccccgagctgctgttcgccaccgacagactgcaccccgacctgggcttctag

SEQ ID NO: 24544 - DNA, 777 bp, Artificial Sequence
  Description of Artificial Sequence: Synthetic coding sequence
atgcagatcagcggcgccgtggcccccgccccccccagcagcggcctgggcttcggcccccccaccagcctggccagcgccagcggcagcttccccaacagcggcctgtacggcagctacccccagggccaggccccccccctgagccaggcccagggccaccccggcatccagaccccccagagaagcgcccccagccaggccagcagcttcaccccccccgccagcggcggccccagactgcccagcatgaccggccccctgctgcccggccagagcttcggcggccccagcgtgagccagcccaaccacgtgagcagccccccccaggccctgccccccggcacccagatgaccggccccctgggccccctgccccccatgcacagcccccagcagcccggctaccagccccagcagaacggcagcttcggccccgccagaggcccccagagcaactacggcggcccctaccccgccgcccccaccttcggcagccagcccggccccccccagcccctgccccccaagagactggaccccgacgccatccccagccccgccagcccctacgtggtggaccacggcgagagcggccccctgagatgcaacagatgcaaggcctacatgtgccccttcatgcagttcatcgagggcggcagaagattccagtgctgcttctgcagctgcatcaacgacggcagagtgggccagaagagccagcagagcgccctggccctgagccccaccatcagatgcagcaccagcatcatgtag

SEQ ID NO: 24545 - DNA, 1278 bp, Artificial Sequence
  Description of Artificial Sequence: Synthetic coding sequence
atggccagcagcagccccgacagcccctgcagctgcgactgcttcgtgagcgtgccccccgccagcgccatccccgccgtgatcttcgccaagaacagcgacagacccagagacgaggtgcaggaggtggtgttcgtgcccgccggcacccacacccccggcagcagactgcagtgcacctacatcgaggtggagcaggtgagcaagacccacgccgtgatcctgagcagacccagctggctgtggggcgccgagatgggcgccaacgagcacggcgtgtgcatcggcaacgaggccgtgtggaccaaggagcccgtgggcgagggcgaggccctgctgggcatggacctgctgagactggccctggagagaagcagcagcgcccaggaggccctgcacgtgatcaccggcctgctggagcactacggccagggcggcaactgcctggaggacgccgcccccttcagctaccacagcaccttcctgctggccgacagaaccgaggcctgggtgctggagaccgccggcagactgtgggccgcccagagaatccaggagggcgccagaaacatcagcaaccagctgagcatcggcaccgacatcagcgcccagcaccccgagctgagaacccacgcccaggccaagggctggtgggacggccagggcgccttcgacttcgcccagatcttcagcctgacccagcagcccgtgagaatggaggccgccaaggccagattccaggccggcagagagctgctgagacagagacagggcggcatcaccgccgaggtgatgatgggcatcctgagagacaaggagagcggcatctgcatggacagcggcggcttcagaaccaccgccagcatggtgagcgtgctgccccaggaccccacccagccctgcgtgcacttcctgaccgccacccccgaccccagcagaagcgtgttcaagcccttcatcttcggcatgggcgtggcccaggccccccaggtgctgagccccaccttcggcgcccaggaccccgtgagaaccctgcccagattccagacccaggtggacagaagacacaccctgtacagaggccaccaggccgccctgggcctgatggagagagaccaggacagaggccagcagctgcagcagaagcagcaggacctggagcaggagggcctggaggccacccagggcctgctggccggcgagtgggccccccccctgtgggagctgggcagcctgttccaggccttcgtgaagagagagagccaggcctacgcctag

SEQ ID NO: 24546 - DNA, 1137 bp, Artificial Sequence
  Description of Artificial Sequence: Synthetic coding sequence
atggccagcagcagccccgacagcccctgcagctgcgactgcttcgtgagcgtgccccccgccagcgccatccccgccgtgatcttcgccaagaacagcgacagacccagagacgaggtgcaggaggtggtgttcgtgcccgccggcacccacacccccggcagcagactgcagtgcacctacatcgaggtggagcaggtgagcaagacccacgccgtgatcctgagcagacccagctggctgtggggcgccgagatgggcgccaacgagcacggcgtgtgcatcggcaacgaggccgtgtggaccaaggagcccgtgggcgagggcgaggccctgctgggcatggacctgctgagactggccctggagagaagcagcagcgcccaggaggccctgcacgtgatcaccggcctgctggagcactacggccagggcggcaactgcctggaggacgccgcccccttcagctaccacagcaccttcctgctggccgacagaaccgaggcctgggtgctggagaccgccggcagactgtgggccgcccagagaatccaggagggcgccagaaacatcagcaaccagctgagcatcggcaccgacatcagcgcccagcaccccgagctgagaacccacgcccaggccaagggctggtgggacggccagggcgccttcgacttcgcccagatcttcagcctgacccagcagcccgtgagaatggaggccgccaaggccagattccaggccggcagagagctgctgagacagagacagggcggcatcaccgccgaggtgatgatgggcatcctgagagacaaggagagcggcatctgcatggacagcggcggcttcagaaccaccgccagcatggtgagcgtgctgccccaggaccccacccagccctgcgtgcacttcctgaccgccacccccgaccccagcagaagcgtgttcaagcccttcatcttcggcatgggcgtggcccaggccccccaggtgctgagccccaccttcggcgcccaggaccccgtgagaaccctgcccagattccagacccaggtggacagaagacacaccctgtacagaggccaccaggccgccctgggcctgatggagagagaccaggtgagccccagagagtag

SEQ ID NO: 24547 - DNA, 1275 bp, Artificial Sequence
  Description of Artificial Sequence: Synthetic coding sequence
atggagcccttcagctgcgacaccttcgtggccctgccccccgccaccgtggacaacagaatcatcttcggcaagaacagcgacagactgtacgacgaggtgcaggaggtggtgtacttccccgccgtggtgcacgacaacctgggcgagagactgaagtgcacctacatcgagatcgaccaggtgcccgagacctacgccgtggtgctgagcagacccgcctggctgtggggcgccgagatgggcgccaacgagcacggcgtgtgcatcggcaacgaggccgtgtggggcagagaggaggtgtgcgacgaggaggccctgctgggcatggacctggtgagactgggcctggagagagccgacaccgccgagaaggccctgaacgtgatcgtggacctgctggagaagtacggccagggcggcaactgcaccgagggcagaatggtgttcagctaccacaacagcttcctgatcgccgacagaaacgaggcctggatcctggagaccgccggcaagtactgggccgccgagaaggtgcaggagggcgtgagaaacatcagcaaccagctgagcatcaccaccaagatcgccagagagcaccccgacatgagaaactacgccaagagaaagggctggtgggacggcaagaaggagttcgacttcgccgccgcctacagctacctggacaccgccaagatgatgaccagcagcggcagatactgcgagggctacaagctgctgaacaagcacaagggcaacatcaccttcgagaccatgatggagatcctgagagacaagcccagcggcatcaacatggagggcgagttcctgaccaccgccagcatggtgagcatcctgccccaggacagcagcctgccctgcatccacttcttcaccggcacccccgaccccgagagaagcgtgttcaagcccttcatcttcgtgccccacatcagccagctgctggacaccagcagccccaccttcgagctggaggacctggtgaagaagaagagccacttcaagcccgacagaagacaccccctgtaccagaagcaccagcaggccctggaggtggtgaacaacaacgaggagaaggccaagatcatgctggacaacatgagaaagctggagaaggagctgttcagagagatggagagcatcctgcagaacaagcacctggacgtggagaagatcgtgaacctgttcccccagtgcaccaaggacgagatccagatctaccagagcaacctgagcgtgaaggtgagcagctag

SEQ ID NO: 24548 - DNA, 342 bp, Artificial Sequence
  Description of Artificial Sequence: Synthetic coding sequence
atggagcccttcagctgcgacaccttcgtggccctgccccccgccaccgtggacaacagaatcatcttcggcaagaacagcgacagactgtacgacgaggtgcaggaggtggtgtacttccccgccgtggtgcacgacaacctgggcgagagactgaagtgcacctacatcgagatcgaccaggtgcccgagacctacgccgtggtgctgagcagacccgcctggctgtggggcgccgagatgggcgccaacgagcacggcgtgtgcatcggcaacgaggccgtgtggggcagagaggaggtgtgcgacgaggaggccctgctgggcatggacctggtgtag

SEQ ID NO: 24549 - DNA, 408 bp, Artificial Sequence
  Description of Artificial Sequence: Synthetic coding sequence
atggagcccttcagctgcgacaccttcgtggccctgccccccgccaccgtggacaacagaatcatcttcggcaagaacagcgacagactgtacgacgaggtgcaggaggtggtgtacttccccgccgtggtgcacgacaacctgggcgagagactgaagtgcacctacatcgagatcgaccaggtgcccgagacctacgccgtggtgctgagcagacccgcctggctgtggggcgccgagatgggcgccaacgagcacggcgtgtgcatcggcaacgaggccgtgtggggcagagaggaggtgtgcgacgaggaggccctgctgggcatggacctggtgagactgggcctggagagagccgacaccgccgagaaggccctgaacgtgatcgtggacctgctggagtag

SEQ ID NO: 24550 - DNA, 33 bp, Artificial Sequence
  Description of Artificial Sequence: Synthetic coding sequence
atggagcccttcagctgcgacaccttcgtgtag

SEQ ID NO: 24551 - DNA, 651 bp, Artificial Sequence
  Description of Artificial Sequence: Synthetic coding sequence
atggagcccttcagctgcgacaccttcgtggccctgccccccgccaccgtggacaacagaatcatcttcggcaagaacagcgacagactgtacgacgaggtgcaggaggtggtgtacttccccgccgtggtgcacgacaacctgggcgagagactgaagtgcacctacatcgagatcgaccaggtgcccgagacctacgccgtggtgctgagcagacccgcctggctgtggggcgccgagatgggcgccaacgagcacggcgtgtgcatcggcaacgaggccgtgtggggcagagaggaggtgtgcgacgaggaggccctgctgggcatggacctggtgagactgggcctggagagagccgacaccgccgagaaggccctgaacgtgatcgtggacctgctggagaagtacggccagggcggcaactgcaccgagggcagaatggtgttcagctaccacaacagcttcctgatcgccgacagaaacgaggcctggatcctggagaccgccggcaagtactgggccgccgagaaggtgcaggagggcgtgagaaacatcagcaaccagctgagcatcaccaccaagatcgccagagagcaccccgacatgagaaactacgccaagagaaagggctggtgggacggcaagtag

SEQ ID NO: 24552 - DNA, 630 bp, Artificial Sequence
  Description of Artificial Sequence: Synthetic coding sequence
atggagcccttcagctgcgacaccttcgtggccctgccccccgccaccgtggacaacagaatcatcttcggcaagaacagcgacagactgtacgacgaggtgcaggaggtggtgtacttccccgccgtggtgcacgacaacctgggcgagagactgaagtgcacctacatcgagatcgaccaggtgcccgagacctacgccgtggtgctgagcagacccgcctggctgtggggcgccgagatgggcgccaacgagcacggcgtgtgcatcggcaacgaggccgtgtggggcagagaggaggtgtgcgacgaggaggccctgctgggcatggacctggtgagactgggcctggagagagccgacaccgccgagaaggccctgaacgtgatcgtggacctgctggagaagtacggccagggcggcaactgcaccgagggcagaatggtgttcagctaccacaacagcttcctgatcgccgacagaaacgaggcctggatcctggagaccgccggcaagtactgggccgccgagaaggtgcaggagggcgtgagaaacatcagcaaccagctgagcatcaccaccaagatcgccagagagcaccccgacatgagaaactacgccaagagatag

SEQ ID NO: 24553 - DNA, 1254 bp, Artificial Sequence
  Description of Artificial Sequence: Synthetic coding sequence
atgccccccctggccaccccccccagcgtgcacctgagcctgagagtggccggcagacccgacagactgtacgacgaggtgcaggaggtggtgtacttccccgccgtggtgcacgacaacctgggcgagagactgaagtgcacctacatcgagatcgaccaggtgcccgagacctacgccgtggtgctgagcagacccgcctggctgtggggcgccgagatgggcgccaacgagcacggcgtgtgcatcggcaacgaggccgtgtggggcagagaggaggtgtgcgacgaggaggccctgctgggcatggacctggtgagactgggcctggagagagccgacaccgccgagaaggccctgaacgtgatcgtggacctgctggagaagtacggccagggcggcaactgcaccgagggcagaatggtgttcagctaccacaacagcttcctgatcgccgacagaaacgaggcctggatcctggagaccgccggcaagtactgggccgccgagaaggtgcaggagggcgtgagaaacatcagcaaccagctgagcatcaccaccaagatcgccagagagcaccccgacatgagaaactacgccaagagaaagggctggtgggacggcaagaaggagttcgacttcgccgccgcctacagctacctggacaccgccaagatgatgaccagcagcggcagatactgcgagggctacaagctgctgaacaagcacaagggcaacatcaccttcgagaccatgatggagatcctgagagacaagcccagcggcatcaacatggagggcgagttcctgaccaccgccagcatggtgagcatcctgccccaggacagcagcctgccctgcatccacttcttcaccggcacccccgaccccgagagaagcgtgttcaagcccttcatcttcgtgccccacatcagccagctgctggacaccagcagccccaccttcgagctggaggacctggtgaagaagaagagccacttcaagcccgacagaagacaccccctgtaccagaagcaccagcaggccctggaggtggtgaacaacaacgaggagaaggccaagatcatgctggacaacatgagaaagctggagaaggagctgttcagagagatggagagcatcctgcagaacaagcacctggacgtggagaagatcgtgaacctgttcccccagtgcaccaaggacgagatccagatctaccagagcaacctgagcgtgaaggtgagcagctag

SEQ ID NO: 24554 - DNA, 3171 bp, Artificial Sequence
  Description of Artificial Sequence: Synthetic coding sequence
atggacagagcccccaccgagcagaacgtgaagctgagcgccgaggtggagcccttcatcccccagaagaagagccccgacaccttcatgatccccatggccctgcccaacgacaacggcagcgtgagcggcgtggagcccacccccatccccagctacctgatcacctgctaccccttcgtgcaggagaaccagagcaacagacagttccccctgtacaacaacgacatcagatggcagcagcccaaccccaaccccaccggcccctacttcgcctaccccatcatcagcgcccagccccccgtgagcaccgagtacacctactaccagctgatgcccgccccctgcgcccaggtgatgggcttctaccaccccttccccaccccctacagcaacaccttccaggccgccaacaccgtgaacgccatcaccaccgagtgcaccgagagacccagccagctgggccaggtgttccccctgagcagccacagaagcagaaacagcaacagaggcagcgtggtgcccaagcagcagctgctgcagcagcacatcaagagcaagagacccctggtgaagaacgtggccacccagaaggagaccaacgccgccggccccgacagcagaagcaagatcgtgctgctggtggacgccagccagcagaccgacttccccagcgacatcgccaacaagagcctgagcgagaccaccgccaccatgctgtggaagagcaagggcagaagaagaagagccagccaccccaccgccgagagcagcagcgagcagggcgccagcgaggccgacatcgacagcgacagcggctactgcagccccaagcacagcaacaaccagcccgccgccggcgccctgagaaaccccgacagcggcaccatgaaccacgtggagagcagcatgtgcgccggcggcgtgaactggagcaacgtgacctgccaggccacccagaagaagccctggatggagaagaaccagaccttcagcagaggcggcagacagaccgagcagagaaacaacagccaggacgaggacggcttccaggagctgaacgagaacggcaacgccaaggacgagaacatccagcagaagctgagcagcaaggtgctggacgacctgcccgagaacagccccatcaacatcgtgcagacccccatccccatcaccaccagcgtgcccaagagagccaagagccagaagaagaaggccctggccgccgccctggccaccgcccaggagtacagcgagatcagcatggagcagaagaagctgcaggaggccctgagcaaggccgccggcaagaagaacaagacccccgtgcagctggacctgggcgacatgctggccgccctggagaagcagcagcaggccatgaaggccagacagatcaccaacaccagacccctgagctacaccgtggtgaccgccgccagcttccacaccaaggacagcaccaacagaaagcccctgaccaagagccagccctgcctgaccagcttcaacagcgtggacatcgccagcagcaaggccaagaagggcaaggagaaggagatcgccaagctgaagagacccaccgccctgaagaaggtgatcctgaaggagagagaggagaagaagggcagactgaccgtggaccacaacctgctgggcagcgaggagcccaccgagatgcacctggacttcatcgacgacctgccccaggagatcgtgagccaggaggacaccggcctgagcatgcccagcgacaccagcctgagccccgccagccagaacagcccctactgcatgacccccgtgagccagggcagccccgccagcagcggcatcggcagccccatggccagcagcaccatcaccaagatccacagcaagagattcagagagtactgcaaccaggtgctgtgcaaggagatcgacgagtgcgtgaccctgctgctgcaggagctggtgagcttccaggagagaatctaccagaaggaccccgtgagagccaaggccagaagaagactggtgatgggcctgagagaggtgaccaagcacatgaagctgaacaagatcaagtgcgtgatcatcagccccaactgcgagaagatccagagcaagggcggcctggacgaggccctgtacaacgtgatcgccatggccagagagcaggagatccccttcgtgttcgccctgggcagaaaggccctgggcagatgcgtgaacaagctggtgcccgtgagcgtggtgggcatcttcaactacttcggcgccgagagcctgttcaacaagctggtggagctgaccgaggaggccagaaaggcctacaaggacatggtggccgccatggagcaggagcaggccgaggaggccctgaagaacgtgaagaaggtgccccaccacatgggccacagcagaaaccccagcgccgccagcgccatcagcttctgcagcgtgatcagcgagcccatcagcgaggtgaacgagaaggagtacgagaccaactggagaaacatggtggagaccagcgacggcctggaggccagcgagaacgagaaggaggtgagctgcaagcacagcaccagcgagaagcccagcaagctgcccttcgacaccccccccatcggcaagcagcccagcctggtggccaccggcagcaccaccagcgccaccagcgccggcaagagcaccgccagcgacaaggaggaggtgaagcccgacgacctggagtgggccagccagcagagcaccgagaccggcagcctggacggcagctgcagagacctgctgaacagcagcatcaccagcaccaccagcaccctggtgcccggcatgctggaggaggaggaggacgaggacgaggaggaggaggaggactacacccacgagcccatcagcgtggaggtgcagctgaacagcagaatcgagagctgggtgagcgagacccagagaaccatggagaccctgcagctgggcaagaccctgaacggcagcgaggaggacaacgtggagcagagcggcgaggaggaggccgaggcccccgaggtgctggagcccggcatggacagcgaggcctggaccgccgaccagcaggccagccccggccagcagaagagcagcaactgcagcagcctgaacaaggagcacagcgacagcaactacaccacccagaccacctag

SEQ ID NO: 24555 - DNA, 3306 bp, Artificial Sequence
  Description of Artificial Sequence: Synthetic coding sequence
atggacagagcccccaccgagcagaacgtgaagctgagcgccgaggtggagcccttcatcccccagaagaagagccccgacaccttcatgatccccatggccctgcccaacgacaacggcagcgtgagcggcgtggagcccacccccatccccagctacctgatcacctgctaccccttcgtgcaggagaaccagagcaacagacagttccccctgtacaacaacgacatcagatggcagcagcccaaccccaaccccaccggcccctacttcgcctaccccatcatcagcgcccagccccccgtgagcaccgagtacacctactaccagctgatgcccgccccctgcgcccaggtgatgggcttctaccaccccttccccaccccctacagcaacaccttccaggccgccaacaccgtgaacgccatcaccaccgagtgcaccgagagacccagccagctgggccaggtgttccccctgagcagccacagaagcagaaacagcaacagaggcagcgtggtgcccaagcagcagctgctgcagcagcacatcaagagcaagagacccctggtgaagaacgtggccacccagaaggagaccaacgccgccggccccgacagcagaagcaagatcgtgctgctggtggacgccagccagcagaccgacttccccagcgacatcgccaacaagagcctgagcgagaccaccgccaccatgctgtggaagagcaagggcagaagaagaagagccagccaccccaccgccgagagcagcagcgagcagggcgccagcgaggccgacatcgacagcgacagcggctactgcagccccaagcacagcaacaaccagcccgccgccggcgccctgagaaaccccgacagcggcaccatgaaccacgtggagagcagcatgtgcgccggcggcgtgaactggagcaacgtgacctgccaggccacccagaagaagccctggatggagaagaaccagaccttcagcagaggcggcagacagaccgagcagagaaacaacagccaggtgggcttcagatgcagaggccacagcaccagcagcgagagaagacagaacctgcagaagagacccgacaacaagcacctgagcagcagccagagccacagaagcgaccccaacagcgagagcctgtacttcgaggacgaggacggcttccaggagctgaacgagaacggcaacgccaaggacgagaacatccagcagaagctgagcagcaaggtgctggacgacctgcccgagaacagccccatcaacatcgtgcagacccccatccccatcaccaccagcgtgcccaagagagccaagagccagaagaagaaggccctggccgccgccctggccaccgcccaggagtacagcgagatcagcatggagcagaagaagctgcaggaggccctgagcaaggccgccggcaagaagaacaagacccccgtgcagctggacctgggcgacatgctggccgccctggagaagcagcagcaggccatgaaggccagacagatcaccaacaccagacccctgagctacaccgtggtgaccgccgccagcttccacaccaaggacagcaccaacagaaagcccctgaccaagagccagccctgcctgaccagcttcaacagcgtggacatcgccagcagcaaggccaagaagggcaaggagaaggagatcgccaagctgaagagacccaccgccctgaagaaggtgatcctgaaggagagagaggagaagaagggcagactgaccgtggaccacaacctgctgggcagcgaggagcccaccgagatgcacctggacttcatcgacgacctgccccaggagatcgtgagccaggaggacaccggcctgagcatgcccagcgacaccagcctgagccccgccagccagaacagcccctactgcatgacccccgtgagccagggcagccccgccagcagcggcatcggcagccccatggccagcagcaccatcaccaagatccacagcaagagattcagagagtactgcaaccaggtgctgtgcaaggagatcgacgagtgcgtgaccctgctgctgcaggagctggtgagcttccaggagagaatctaccagaaggaccccgtgagagccaaggccagaagaagactggtgatgggcctgagagaggtgaccaagcacatgaagctgaacaagatcaagtgcgtgatcatcagccccaactgcgagaagatccagagcaagggcggcctggacgaggccctgtacaacgtgatcgccatggccagagagcaggagatccccttcgtgttcgccctgggcagaaaggccctgggcagatgcgtgaacaagctggtgcccgtgagcgtggtgggcatcttcaactacttcggcgccgagagcctgttcaacaagctggtggagctgaccgaggaggccagaaaggcctacaaggacatggtggccgccatggagcaggagcaggccgaggaggccctgaagaacgtgaagaaggtgccccaccacatgggccacagcagaaaccccagcgccgccagcgccatcagcttctgcagcgtgatcagcgagcccatcagcgaggtgaacgagaaggagtacgagaccaactggagaaacatggtggagaccagcgacggcctggaggccagcgagaacgagaaggaggtgagctgcaagcacagcaccagcgagaagcccagcaagctgcccttcgacaccccccccatcggcaagcagcccagcctggtggccaccggcagcaccaccagcgccaccagcgccggcaagagcaccgccagcgacaaggaggaggtgaagcccgacgacctggagtgggccagccagcagagcaccgagaccggcagcctggacggcagctgcagagacctgctgaacagcagcatcaccagcaccaccagcaccctggtgcccggcatgctggaggaggaggaggacgaggacgaggaggaggaggaggactacacccacgagcccatcagcgtggaggtgcagctgaacagcagaatcgagagctgggtgagcgagacccagagaaccatggagaccctgcagctgggcaagaccctgaacggcagcgaggaggacaacgtggagcagagcggcgaggaggaggccgaggcccccgaggtgctggagcccggcatggacagcgaggcctggaccgccgaccagcaggccagccccggccagcagaagagcagcaactgcagcagcctgaacaaggagcacagcgacagcaactacaccacccagaccacctag

SEQ ID NO: 24556 - DNA, 288 bp, Artificial Sequence
  Description of Artificial Sequence: Synthetic coding sequence
atgaagggcagcagagccctgctgctggtggccctgaccctgttctgcatctgcagaatggccaccggcgaggacaacgacgagttcttcatggacttcctgcagaccctgctggtgggcacccccgaggagctgtacgagggcaccctgggcaagtacaacgtgaacgaggacgccaaggccgccatgaccgagctgaagagctgcagagacggcctgcagcccatgcacaaggccgagctggtgaagctgctggtgcaggtgctgggcagccaggacggcgcctag

SEQ ID NO: 24557 - DNA, 543 bp, Artificial Sequence
  Description of Artificial Sequence: Synthetic coding sequence
atggccagcgagagacccgagcccgaggtggaggaggccggccaggtgttcctgctgatgaagaaggactacagaatcagcagaaacgtgagactggcctggttcctgagccacctgcaccagaccgtgcaggccaccccccaggagatgctgctgcagagcgagcaggagctggaggtgctgagcgtgctgccccccggctggcagcccgacgagcccgtggtgcccagacccttcctgctggtgcccagcaccagagtgaccttcctggcctggcagtacagattcgtgatcgagctggacctgagccccagcaccggcatcgtggacgacagcaccggcgagatcctgttcgacgaggtgttccacgccctgagcagatgcctgggcggcctgctgagacccttcagagtgcccggcagctgcatcgacttccagcccgagatctacgtgaccatccaggcctacagcagcatcatcggcctgcagagccaccagagacagggcttcaccatgctggccagactgcccagcaacttctag

SEQ ID NO: 24558 - DNA, 507 bp, Artificial Sequence
  Description of Artificial Sequence: Synthetic coding sequence
atggccagcgagagacccgagcccgaggtggaggaggccggccaggtgttcctgctgatgaagaaggactacagaatcagcagaaacgtgagactggcctggttcctgagccacctgcaccagaccgtgcaggccaccccccaggagatgctgctgcagagcgagcaggagctggaggtgctgagcgtgctgccccccggctggcagcccgacgagcccgtggtgcccagacccttcctgctggtgcccagcaccagagtgaccttcctggcctggcagtacagattcgtgatcgagctggacctgagccccagcaccggcatcgtggacgacagcaccggcgagatcctgttcgacgaggtgttccacgccctgagcagatgcctgggcggcctgctgagacccttcagagtgcccggcagctgcatcgacttccagcccgagatctacgtgaccatccaggcctacagcagcatcatcggcctgcagagccaccagatgatctag

SEQ ID NO: 24559 - DNA, 7602 bp, Artificial Sequence
  Description of Artificial Sequence: Synthetic coding sequence
atggtgctggagctgcccatccagaacgagccccccggccaggccgccgccgaggagaagcacacctgcgtggtgcagtacatcctgttccccccccacagcaccagcaccaaggacagcttcagcaccgacgacgacaacgacgtggaggtggaggccctggagggcgacagcgagctgaacctggtgaccgaggtgtgggtggagccccagtacggcagagtgggccccggccccggcatctggaagcacctgcaggacctgacctacagcgagatcccccaggccctgcaccccagagacgccgcctgcatcggcagcatgctgagcttcgagtacctgatccagctgtgccagagcaaggagtggggccccctgccccccgagcccagagtgagcgacggcctggaccagggcggcgacacctgcgtgcacgagatccccttccacttcgacctgatgggcctgctgccccagtgccagcagctgcagatgttcttcctgctgctggccagaggcgccgagggccccctgctgggcgtgcacggcatccccaaggagcaggccgtgggcagcacccaggccaccggcgacagcgccttcaccagcctgagcgtgggcctgcccgagaccctgaagcccctgatcagcgcccagcccccccagtggagatgctacgccagactggtgaacccccagcacgtgttcctgaccttcctgcccgccaccttcagcgacgtgcagagactggccgcctgcggcctggagggccccccccaggaggagaccaagcccaagttcggcgactggagcggcgcccccagcctgaaggacctgggcggcaccggcatcaaggccaccaagagccacgtgcccgtgctgagcgtgaccctggccagcgacaacgcccagaaccagggcgagctgagcccccccttcagaagagacctgcaggcctacgccggcagacaggccagccagaccgagagcgccgacggccccagaaccagatgccccgtgtacatctacagctgcagcctggaggccctgagagagcagatggtgggcatgcagcccccccaggcccccagagacctgatcttcagaacccagttcctggaccaccccagccccagcagcgcctggatggagcccagatacaaggaggccgccaaccactgcgccctgctgcaggagcacgcccagagatgctacgtgagaggcctgttcagaagcctgcagcaggcccagagcgtgaccagccaggacctgctgaccgccgtggacgcctgcgaggagctgctgcaggagatcgacatcacccccttcctgctggccctgtgcggccacacctggggcctgccccacgccccccccagccccggccccctgagccccggccccttcagcagcagcatggaggagggcgccgagcccagagagagagccatcctggccagcgagagcagcatcgagaccgaggacctgagcgagcccgagttccagagcaccagagtgcccggcatccccgaccccggccccgagatcagcctgaccgacgtgtgccagctgagaggcgaggcccacggcgccctgcacagcgtgatccaggagaagttcctggagatcagcagactgcacttcagaaccgtgcccagcaacccccactacttcttctactgcccccccagcagcagaagagaggacgagggccccagagacaccgtggacagaaagatcagcgacctggagttcagcgaggccgagctgatgggcgaggagggcgacaccagcgcctgctgcgtggtgaccgagagcgaccccgagctggaggtggagtacagagagagcagagagagcgacctgggccccgccggcctggacagcgccagcctgagcgacgtggacaccgtgaaccccgacgaggacagcttcagcatcctgggcggcgacagccccaccggccccgagagcttcctgcacgacctgccccccctgttcctgcacctgacctgcagcgtgagactgagaggccagcacagcagcgtgcccgtgtgcagcctgcccacctgcctgggccaggtgctgagcagcctggagggcccccccgtgggcggcagagtgcccctgagagacctgagcgtgaccctggacgtgttcatgctgaccctgcccctggaggtggagctgcccaccgccagcgacccccagcaccacagaagcaccagcgagagcagcgccagcttccccagaagccccggccagcccagcagcctgagaagcgacgacggcctgggcccccccctgcccccccccgaggaggagagacaccccggcctgagcaacctggccaccccccacagactggccatcgagaccaccatgaacgagatcagatggctgctggaggacgagatggtgggcgccctgagaagaggcggcatcccccagagccccgccctgcacagagccgccgcccacatccacagcagccccggcagaagcacctgcctgagacagaccctgcccctgagcttcgtgttcggccccgagagaagcctgacccagttcaaggaggagttcagaagactgcacctgcccggccacgtgctgctggaggaccccgacagcggcttcttcttcgtggccgccggccagcagcccggcggcagccacggcgagcccagcagcgccgcctgggcctggcacagccacgaggacagagccgagggcatcgagggcgagaccctgaccgccagcccccaggcccccggcagccccgaggacagcgagggcgtgcccctgatcagcctgcccagagtgccccagggcggcagccagcccggccccagcagaggcctgagcctgatgagcagccagggcagcgtggacagcgaccacctgggctacgacggcggcagcagcggcagcgacagcgagggccccaacgacaccctgggcgagaaggcccccttcaccctgagaaccccccccggccccgcccccccccagcccagcctgagcggcctgcccggcccctgcctgcccgacttctggctgatcgtgagagtgctgcaggacagagtggaggtgtacgcccacgccagaagcctgatcagagaggacggcggccccggcaccgagtgcagacacctgcagcagctgctggtgagaagagtgggcgagatctgcagagaggtgaaccagagactgctgctgcaggacctgcacgacagccacgtgtgcaacagcctgctggtggccgagagcgaggaggacctgtggagaagcgagacccccttccacagcagacagagagcccccctgcccagcgacgactacgccgccgacgagagctgcgcccccagaggctacctggccgccaccatgcagttcgtgcccggccacttcagctgcgacgtggtgtggggcaccgtgatcagagtgcacagcagactgaagatgggccccagcatgggcgtgagcagagccatccaggccctgagaagcgtgctgaacgccttcagcgtggtgaacagaaagaacatgttcgtgtaccaggagagagccaccaaggccgtgtactacctgagactgctggagaccagctgcagcgacagaccctggaagggcgacgccctgccccccagcctggccctgagcagaagccaggagcccatctacagcgaggaggccagcggccccagaagccccctggacatggtgagcagcagaagcagcgacgccgccagacccgtgggccaggtggacagacacatccagctgctggtgcacggcgtgggccaggccggccccgagatcaccgacgagctggtgagagtgctgtgcagaagactggacgaggccaccctggacgtgatcaccgtgatgctggtgagaaactgcaagctgacccccgccgacgtggagttcatccagccccccggcagcctgcccagcgaggtgctgcacctggccctgcccaccagctgcagaccctggctgcccgccctggcctggtacctgagacagaacctgctgatcttcctgcacagccccaagtacaccgacagcaacagcagaaaccacttccagcaccccctgcccccccagggcggcctgcccgacctggacatctacctgtacaacaagcccggcggccagggcaccggcggcaagggcgtggcctgcatcaccctggccttcgtggacgagggcggcgcccccctgagcctggccctgtggccccccagcagccccggcccccccgaccccctgagagaggaggagttcgagcagctgacccaggtgatcagatgccccgtggtggtggacagcagcagcgcccagaacggcgcccccagactgagactggacgtgtgggagaagggcaacatcagcatcgtgcagctggaggagaagctgagaggcgccgccagacaggccctggccgacgccatcatcgagctgcagctgctgcccgccagcctgtgcaccgaggacacccccaccggcagcctgagaaacggcagcctggagaccaagagcagcgccggcagagccagcaccttcccccccgcccccgtgcccggcgagcccgtgaccccccccagcaaggccggcagaagaagcttctgggacatgctgagcaagaccgagtgcggcgacctgggcagccccaagaccaccgacgacatcgtgctggacagacccgaggacaccagaggcagaagaagacacaagaccgagagcgtgagaacccccggcggcgccgagagagcccccggcagcgacagcggcgcccagagacagaagagaagaaccacccagctggaggagggcgaggtgggcaccctgcaccccgtgttcgccagagtggcccagagatggatggagttcatggtgcagatcggctgcgccagcgtgagcagaagcagcgcccacatggtgagcagattcctgctgcccagcatcctgagcgagttcaccgccctggtgaccagcatggccggcgacaccagcgtgagaatcttcgagcagcacctgggcagcgagcccgagatcttcggcccctgcagccccggccagctgggccccagccccagacccgccgccgagagacacctgctgctgctgggcagaaacttcctgcagtggagaagacccacccagcaggccgccaaggccatgcagagattcgagcccggcggcgacggcagcagcggcagaaacgcccccagacagagactgctgctgctggaggtggtggacaagaagctgcagctgctgacctacaactgggcccccgacctgggcgccgccctgggcagagccctggtgagactggtgcagtggcagaacgccagagcccacctgatcttctgcctgctgagccagaagctgggcctgttccaccactacggccagctggacttccccgtgagagacgagaaggagcccaaccccttcctgctgcccaccatggaggtggagaccctgatcagaagcgccagcccccccctgagcagagagcagggcagactgagcggcagcagcagaggcggcggccccctgcccctggacaccttccccttcgacgaggccctgagagacatcaccgccgccagacccagcagcgtgctgggccccgtgcccagaccccccgaccccgtgacctaccacggccagcagttcctggagatcaagatggccgagagaagagagctggagagacagatgaagatggagaacctgttcgtgacctggcagcagagaagcacccccgccaccatgcccatcagcgccggcgagctggagaccctgaagcagagcagcagactggtgcactactgcgccaccgccatgctgttcgaccccgccgcctggctgcacggcccccccgagaccagcggcccccccgacggccagagaagacacagacccgagagcggcagcggcagcagagaggcccccaccagctgcgagagcctggacgtgagcccccccggcgccagagaggagccctggctgaaggagctgagcctggccttcctgcagcagtacgtgcagtacctgcagagcatcggcttcgtgctggtgcccctgagaccccccagccccgccagaagcaccagcagacccagagccatggccatcctgggcaccgagggcagaggcagcttcagctgccccaagaccaagaccgacggcagccccaagagcaccagcagccccgtgaccacctaccacctgcagagagccctgcccggcggcatcatcctgatggagctggccttccagggctgctacttctgcgtgaagcagttcgccctggagtgcagcagaatccccatgggccaggccgtgaacagccagctgagcatgctgttcaccgaggagtgcgacaaggtgagagacctgatgcacgtgcacagcttcagctacgacttccacctgagactggtgcaccagcacgtgctgggcgcccacctggtgctgagacacggctaccacctgaccaccttcctgagacacttcctggcccaccaccccgacggcccccacttcggcagaaaccacatctaccagggcaccctggagctgcccacccccctgatcgccgcccaccagctgtacaactacgtggccgaccacgccagcagctaccacatgaagcccctgagaatggccagacccggcggccccgagcacaacgagtacgccctggtgagcgcctggcacagcagcggcagctacctggacagcgagggcctgagacaccaggacgacttcgacgtgagcctgctggtgtgccactgcgccgcccccttcgaggagcagggcgaggccgagagacacgtgctgagactgcagttcttcgtggtgctgaccagccagagagagctgttccccagactgaccgccgacatgagaagattcagaaagccccccagactgccccccgagcccgaggcccccggcagcagcgccggcagccccggcgaggccagcggcctgatcctggcccccggccccgcccccctgttcccccccctggccgccgaggtgggcatggccagagccagactggcccagctggtgagactggccggcggccactgcagaagagacaccctgtggaagagactgttcctgctggagccccccggccccgacagactgagactgggcggcagactggccctggccgagctggaggagctgctggaggccgtgcacgccaagagcatcggcgacatcgacccccagctggactgcttcctgagcatgaccgtgagctggtaccagagcctgatcaaggtgctgctgagcagattcccccagagctgcagacacttccagagccccgacctgggcacccagtacctggtggtgctgaaccagaagttcaccgactgcttcgtgctggtgttcctggacagccacctgggcaagaccagcctgaccgtggtgttcagagagcccttccccgtgcagccccaggacagcgagagcccccccgcccagctggtgagcacctaccaccacctggagagcgtgatcaacaccgcctgcttcaccctgtggaccagactgctgtag

SEQ ID NO: 24560 - DNA, 537 bp, Artificial Sequence
  Description of Artificial Sequence: Synthetic coding sequence
atggccagcgagagacccgagcccgaggtggaggaggccggccaggtgttcctgctgatgaagaaggactacagaatcagcagaaacgtgagactggcctggttcctgagccacctgcaccagaccgtgcaggccaccccccaggagatgctgagcgagcaggagctggaggtgctgagcgtgctgccccccggctggcagcccgacgagcccgtggtgcccagacccttcctgctggtgcccagcaccagagtgaccttcctggcctggcagtacagattcgtgatcgagctggacctgagccccagcaccggcatcgtggacgacagcaccggcgagatcctgttcgacgaggtgttccacgccctgagcagatgcctgggcggcctgctgagacccttcagagtgcccggcagctgcatcgacttccagcccgagatctacgtgaccatccaggcctacagcagcatcatcggcctgcagagccaccagagacagggcttcaccatgctggccagactgcccagcaacttctag

SEQ ID NO: 24561 - DNA, 10128 bp, Artificial Sequence
  Description of Artificial Sequence: Synthetic coding sequence
atggccagcgagagacccgagcccgaggtggaggaggccggccaggtgttcctgctgatgaagaaggactacagaatcagcagaaacgtgagactggcctggttcctgagccacctgcaccagaccgtgcaggccaccccccaggagatgctgctgcagagcgagcaggagctggaggtgctgagcgtgctgccccccggctggcagcccgacgagcccgtggtgcccagacccttcctgctggtgcccagcaccagagtgaccttcctggcctggcagtacagattcgtgatcgagctggacctgagccccagcaccggcatcgtggacgacagcaccggcgagatcctgttcgacgaggtgttccacgccctgagcagatgcctgggcggcctgctgagacccttcagagtgcccggcagctgcatcgacttccagcccgagatctacgtgaccatccaggcctacagcagcatcatcggcctgcagagccaccaggtgctggtgcagggctgcctgctggaccccagccagagagaggtgttcctgcagcagatctacgagcagctgtgcctgttcgaggacaaggtggccaccatgctgcagcagcagtacgacccccagagccaggccgaggaccagagccccgacagcggcgacctgctgggcagaaaggtgggcgtgagcatggtgaccgccgacctgggcctggtgagcatgatcagacagggcatcctggccctgcagctgctgcccagcaacagcagcgccggcatcatcgtgatcaccgacggcgtgaccagcgtgcccgacgtggccgtgtgcgagaccctgctgaaccagctgagaagcggcaccgtggcctgcagcttcgtgcaggtgggcggcgtgtacagctacgactgcagcttcggccacgtgcccaacgtggagctgatgaagttcatcgccatggccaccttcggcagctacctgagcacctgccccgagcccgagcccggcaacctgggcctgaccgtgtaccacagagccttcctgctgtacagcttcctgagaagcggcgaggccctgaaccccgagtactactgcggcagccagcacagactgttcaacgagcacctggtgagcgccagcagcaaccccgccctggccctgagaagaaagaagcacaccgagaaggaggtgcccgccgacctggtgagcaccgtgagcgtgagactgagagagggctacagcgtgagagaggtgaccctggccaagggcggcagccagctggaggtgaagctggtgctgctgtggaagcacaacatgagaatcgagtacgtggccatggccccctggcccctggagcccgagggccccagagtgaccagagtggaggtgaccatggagggcggctacgacatcctgcacgacgtgagctgcgccctgagacagcccatcagaagcctgtacagaacccacgtgatcagaagattctggaacaccctgcagagcatcaaccagaccgaccagatgctggcccacctgcagagcttcagcagcgtgcccgagcacttcaccctgcccgacagcaccaagagcggcgtgcccctgttctacatcccccccggcagcaccacccccgtgctgagcctgcagcccagcggcagcgacagcagccacgcccagttcgccgcctactggaagcccgtgctgagcatggacgccaacagctggcagagatggctgcacatgcacagactggtgctgatcctggagcacgacacccccatccccaagcacctgcacacccccggcagcaacggcagatacagcaccatccagtgcagaatcagccacagcagcctgaccagcctgctgagagactggagcagcttcgtgctggtggagggctacagctacgtgaagctgctgagcagcgcccccgaccagccccccaacagcttctacatggtgagaatcatcagcaaggccccctgcatggtgctgagactgggcttccccatcggcacccccgcccccgccagacacaagatcgtgagcggcctgagagaggagatcctgagactgagattcccccacagagtgcagagcaaggagcccacccccaaggtgaagagaaagggcctgggcggcgccggcggcggcagcagccccagcaagagcccccccgtgctgggcccccagcaggccctgagcgacagaccctgcctggtggtgctgcacaagcccctggacaagctgctgatcagatacgagaagctgcccctggactacagagcccccttcctgctgaccctggagccccccggccccctgcccctggtgagcggcagaagcgccagcagcagcctggccagcctgagcagatacctgtaccaccagagatggctgtggagcgtgcccagcggcctggcccccgccctgcccctgagcgccatcgcccagctgctgagcatcctgaccgaggtgagactgagcgagggcttccacttcgcctgcagcggcgagggcatcatcaacatggtgctggagctgcccatccagaacgagccccccggccaggccgccgccgaggagaagcacacctgcgtggtgcagtacatcctgttccccccccacagcaccagcaccaaggacagcttcagcaccgacgacgacaacgacgtggaggtggaggccctggagggcgacagcgagctgaacctggtgaccgaggtgtgggtggagccccagtacggcagagtgggccccggccccggcatctggaagcacctgcaggacctgacctacagcgagatcccccaggccctgcaccccagagacgccgcctgcatcggcagcatgctgagcttcgagtacctgatccagctgtgccagagcaaggagtggggccccctgccccccgagcccagagtgagcgacggcctggaccagggcggcgacacctgcgtgcacgagatccccttccacttcgacctgatgggcctgctgccccagtgccagcagctgcagatgttcttcctgctgctggccagaggcgccgagggccccctgctgggcgtgcacggcatccccaaggagcaggccgtgggcagcacccaggccaccggcgacagcgccttcaccagcctgagcgtgggcctgcccgagaccctgaagcccctgatcagcgcccagcccccccagtggagatgctacgccagactggtgaacccccagcacgtgttcctgaccttcctgcccgccaccttcagcgacgtgcagagactggccgcctgcggcctggagggccccccccaggaggagaccaagcccaagttcggcgactggagcggcgcccccagcctgaaggacctgggcggcaccggcatcaaggccaccaagagccacgtgcccgtgctgagcgtgaccctggccagcgacaacgcccagaaccagggcgagctgagcccccccttcagaagagacctgcaggcctacgccggcagacaggccagccagaccgagagcgccgacggccccagaaccagatgccccgtgtacatctacagctgcagcctggaggccctgagagagcagatggtgggcatgcagcccccccaggcccccagagacctgatcttcagaacccagttcctggaccaccccagccccagcagcgcctggatggagcccagatacaaggaggccgccaaccactgcgccctgctgcaggagcacgcccagagatgctacgtgagaggcctgttcagaagcctgcagcaggcccagagcgtgaccagccaggacctgctgaccgccgtggacgcctgcgaggagctgctgcaggagatcgacatcacccccttcctgctggccctgtgcggccacacctggggcctgccccacgccccccccagccccggccccctgagccccggccccttcagcagcagcatggaggagggcgccgagcccagagagagagccatcctggccagcgagagcagcatcgagaccgaggacctgagcgagcccgagttccagagcaccagagtgcccggcatccccgaccccggccccgagatcagcctgaccgacgtgtgccagctgagaggcgaggcccacggcgccctgcacagcgtgatccaggagaagttcctggagatcagcagactgcacttcagaaccgtgcccagcaacccccactacttcttctactgcccccccagcagcagaagagaggacgagggccccagagacaccgtggacagaaagatcagcgacctggagttcagcgaggccgagctgatgggcgaggagggcgacaccagcgcctgctgcgtggtgaccgagagcgaccccgagctggaggtggagtacagagagagcagagagagcgacctgggccccgccggcctggacagcgccagcctgagcgacgtggacaccgtgaaccccgacgaggacagcttcagcatcctgggcggcgacagccccaccggccccgagagcttcctgcacgacctgccccccctgttcctgcacctgacctgcagcgtgagactgagaggccagcacagcagcgtgcccgtgtgcagcctgcccacctgcctgggccaggtgctgagcagcctggagggcccccccgtgggcggcagagtgcccctgagagacctgagcgtgaccctggacgtgttcatgctgaccctgcccctggaggtggagctgcccaccgccagcgacccccagcaccacagaagcaccagcgagagcagcgccagcttccccagaagccccggccagcccagcagcctgagaagcgacgacggcctgggcccccccctgcccccccccgaggaggagagacaccccggcctgagcaacctggccaccccccacagactggccatcgagaccaccatgaacgagatcagatggctgctggaggacgagatggtgggcgccctgagaagaggcggcatcccccagagccccgccctgcacagagccgccgcccacatccacagcagccccggcagaagcacctgcctgagacagaccctgcccctgagcttcgtgttcggccccgagagaagcctgacccagttcaaggaggagttcagaagactgcacctgcccggccacgtgctgctggaggaccccgacagcggcttcttcttcgtggccgccggccagcagcccggcggcagccacggcgagcccagcagcgccgcctgggcctggcacagccacgaggacagagccgagggcatcgagggcgagaccctgaccgccagcccccaggcccccggcagccccgaggacagcgagggcgtgcccctgatcagcctgcccagagtgccccagggcggcagccagcccggccccagcagaggcctgagcctgatgagcagccagggcagcgtggacagcgaccacctgggctacgacggcggcagcagcggcagcgacagcgagggccccaacgacaccctgggcgagaaggcccccttcaccctgagaaccccccccggccccgcccccccccagcccagcctgagcggcctgcccggcccctgcctgcccgacttctggctgatcgtgagagtgctgcaggacagagtggaggtgtacgcccacgccagaagcctgatcagagaggacggcggccccggcaccgagtgcagacacctgcagcagctgctggtgagaagagtgggcgagatctgcagagaggtgaaccagagactgctgctgcaggacctgcacgacagccacgtgtgcaacagcctgctggtggccgagagcgaggaggacctgtggagaagcgagacccccttccacagcagacagagagcccccctgcccagcgacgactacgccgccgacgagagctgcgcccccagaggctacctggccgccaccatgcagttcgtgcccggccacttcagctgcgacgtggtgtggggcaccgtgatcagagtgcacagcagactgaagatgggccccagcatgggcgtgagcagagccatccaggccctgagaagcgtgctgaacgccttcagcgtggtgaacagaaagaacatgttcgtgtaccaggagagagccaccaaggccgtgtactacctgagactgctggagaccagctgcagcgacagaccctggaagggcgacgccctgccccccagcctggccctgagcagaagccaggagcccatctacagcgaggaggccagcggccccagaagccccctggacatggtgagcagcagaagcagcgacgccgccagacccgtgggccaggtggacagacacatccagctgctggtgcacggcgtgggccaggccggccccgagatcaccgacgagctggtgagagtgctgtgcagaagactggacgaggccaccctggacgtgatcaccgtgatgctggtgagaaactgcaagctgacccccgccgacgtggagttcatccagccccccggcagcctgcccagcgaggtgctgcacctggccctgcccaccagctgcagaccctggctgcccgccctggcctggtacctgagacagaacctgctgatcttcctgcacagccccaagtacaccgacagcaacagcagaaaccacttccagcaccccctgcccccccagggcggcctgcccgacctggacatctacctgtacaacaagcccggcggccagggcaccggcggcaagggcgtggcctgcatcaccctggccttcgtggacgagggcggcgcccccctgagcctggccctgtggccccccagcagccccggcccccccgaccccctgagagaggaggagttcgagcagctgacccaggtgatcagatgccccgtggtggtggacagcagcagcgcccagaacggcgcccccagactgagactggacgtgtgggagaagggcaacatcagcatcgtgcagctggaggagaagctgagaggcgccgccagacaggccctggccgacgccatcatcgagctgcagctgctgcccgccagcctgtgcaccgaggacacccccaccggcagcctgagaaacggcagcctggagaccaagagcagcgccggcagagccagcaccttcccccccgcccccgtgcccggcgagcccgtgaccccccccagcaaggccggcagaagaagcttctgggacatgctgagcaagaccgagtgcggcgacctgggcagccccaagaccaccgacgacatcgtgctggacagacccgaggacaccagaggcagaagaagacacaagaccgagagcgtgagaacccccggcggcgccgagagagcccccggcagcgacagcggcgcccagagacagaagagaagaaccacccagctggaggagggcgaggtgggcaccctgcaccccgtgttcgccagagtggcccagagatggatggagttcatggtgcagatcggctgcgccagcgtgagcagaagcagcgcccacatggtgagcagattcctgctgcccagcatcctgagcgagttcaccgccctggtgaccagcatggccggcgacaccagcgtgagaatcttcgagcagcacctgggcagcgagcccgagatcttcggcccctgcagccccggccagctgggccccagccccagacccgccgccgagagacacctgctgctgctgggcagaaacttcctgcagtggagaagacccacccagcaggccgccaaggccatgcagagattcgagcccggcggcgacggcagcagcggcagaaacgcccccagacagagactgctgctgctggaggtggtggacaagaagctgcagctgctgacctacaactgggcccccgacctgggcgccgccctgggcagagccctggtgagactggtgcagtggcagaacgccagagcccacctgatcttctgcctgctgagccagaagctgggcctgttccaccactacggccagctggacttccccgtgagagacgagaaggagcccaaccccttcctgctgcccaccatggaggtggagaccctgatcagaagcgccagcccccccctgagcagagagcagggcagactgagcggcagcagcagaggcggcggccccctgcccctggacaccttccccttcgacgaggccctgagagacatcaccgccgccagacccagcagcgtgctgggccccgtgcccagaccccccgaccccgtgacctaccacggccagcagttcctggagatcaagatggccgagagaagagagctggagagacagatgaagatggagaacctgttcgtgacctggcagcagagaagcacccccgccaccatgcccatcagcgccggcgagctggagaccctgaagcagagcagcagactggtgcactactgcgccaccgccatgctgttcgaccccgccgcctggctgcacggcccccccgagaccagcggcccccccgacggccagagaagacacagacccgagagcggcagcggcagcagagaggcccccaccagctgcgagagcctggacgtgagcccccccggcgccagagaggagccctggctgaaggagctgagcctggccttcctgcagcagtacgtgcagtacctgcagagcatcggcttcgtgctggtgcccctgagaccccccagccccgccagaagcaccagcagacccagagccatggccatcctgggcaccgagggcagaggcagcttcagctgccccaagaccaagaccgacggcagccccaagagcaccagcagccccgtgaccacctaccacctgcagagagccctgcccggcggcatcatcctgatggagctggccttccagggctgctacttctgcgtgaagcagttcgccctggagtgcagcagaatccccatgggccaggccgtgaacagccagctgagcatgctgttcaccgaggagtgcgacaaggtgagagacctgatgcacgtgcacagcttcagctacgacttccacctgagactggtgcaccagcacgtgctgggcgcccacctggtgctgagacacggctaccacctgaccaccttcctgagacacttcctggcccaccaccccgacggcccccacttcggcagaaaccacatctaccagggcaccctggagctgcccacccccctgatcgccgcccaccagctgtacaactacgtggccgaccacgccagcagctaccacatgaagcccctgagaatggccagacccggcggccccgagcacaacgagtacgccctggtgagcgcctggcacagcagcggcagctacctggacagcgagggcctgagacaccaggacgacttcgacgtgagcctgctggtgtgccactgcgccgcccccttcgaggagcagggcgaggccgagagacacgtgctgagactgcagttcttcgtggtgctgaccagccagagagagctgttccccagactgaccgccgacatgagaagattcagaaagccccccagactgccccccgagcccgaggcccccggcagcagcgccggcagccccggcgaggccagcggcctgatcctggcccccggccccgcccccctgttcccccccctggccgccgaggtgggcatggccagagccagactggcccagctggtgagactggccggcggccactgcagaagagacaccctgtggaagagactgttcctgctggagccccccggccccgacagactgagactgggcggcagactggccctggccgagctggaggagctgctggaggccgtgcacgccaagagcatcggcgacatcgacccccagctggactgcttcctgagcatgaccgtgagctggtaccagagcctgatcaaggtgctgctgagcagattcccccagagctgcagacacttccagagccccgacctgggcacccagtacctggtggtgctgaaccagaagttcaccgactgcttcgtgctggtgttcctggacagccacctgggcaagaccagcctgaccgtggtgttcagagagcccttccccgtgcagccccaggacagcgagagcccccccgcccagctggtgagcacctaccaccacctggagagcgtgatcaacaccgcctgcttcaccctgtggaccagactgctgtag

SEQ ID NO: 24562 - DNA, 696 bp, Artificial Sequence
  Description of Artificial Sequence: Synthetic coding sequence
atggccggcatggtggacttccaggacgaggagcaggtgaagagcttcctggagaacatggaggtggagtgcaactaccactgctaccacgagaaggaccccgacggctgctacagactggtggactacctggagggcatcagaaagaacttcgacgaggccgccaaggtgctgaagttcaactgcgaggagaaccagcacagcgacagctgctacaagctgggcgcctactacgtgaccggcaagggcggcctgacccaggacctgaaggccgccgccagatgcttcctgatggcctgcgagaagcccggcaagaagagcatcgccgcctgccacaacgtgggcctgctggcccacgacggccaggtgaacgaggacggccagcccgacctgggcaaggccagagactactacaccagagcctgcgacggcggctacaccagcagctgcttcaacctgagcgccatgttcctgcagggcgcccccggcttccccaaggacatggacctggcctgcaagtacagcatgaaggcctgcgacctgggccacatctgggcctgcgccaacgccagcagaatgtacaagctgggcgacggcgtggacaaggacgaggccaaggccgaggtgctgaagaacagagcccagcagctgcacaaggagcagcagaagggcgtgcagcccctgaccttcggctag

SEQ ID NO: 24563 - DNA, 285 bp, Artificial Sequence
  Description of Artificial Sequence: Synthetic coding sequence
  Description of Combined DNA/RNA Molecule: Synthetic coding sequence
atggtgtacatcagcaacggccaggtgctggacagcagaagccagagcccctggagactgagcctgatcaccgacttcttctggggcatcgccgagttcgtggtgctgttcttcaagaccctgctgcagcaggacgtgaagaagagaagaagctacggcaacagcagcgacagcagatacgacgacggcagaggcccccccggcaacccccccagaagaatgggcagaatcaaccacctgagaggccccagccccccccccatggccggcggcugaggcagatag

SEQ ID NO: 24564 - DNA, 276 bp, Artificial Sequence
  Description of Artificial Sequence: Synthetic coding sequence
atggtgtacatcagcaacggccaggtgctggacagcagaagccagagcccctggagactgagcctgatcaccgacttcttctggggcatcgccgagttcgtggtgctgttcttcaagaccctgctgcagcaggacgtgaagaagagaagaagctacggcaacagcagcgacagcagatacgacgacggcagaggcccccccggcaacccccccagaagaatgggcagaatcaaccacctgagaggccccagccccccccccatggccggcggctag

SEQ ID NO: 24565 - DNA, 438 bp, Artificial Sequence
  Description of Artificial Sequence: Synthetic coding sequence
  Description of Combined DNA/RNA Molecule: Synthetic coding sequence
atgagcctgctgctgccccccctggccctgctgctgctgctggccgccctggtggcccccgccaccgccgccaccgcctacagacccgactggaacagactgagcggcctgaccagagccagagtggagacctgcggcggcugacagctgaacagactgaaggaggtgaaggccttcgtgacccaggacatccccttctaccacaacctggtgatgaagcacctgcccggcgccgaccccgagctggtgctgctgggcagaagatacgaggagctggagagaatccccctgagcgagatgaccagagaggagatcaacgccctggtgcaggagctgggcttctacagaaaggccgcccccgacgcccaggtgccccccgagtacgtgtgggcccccgccaagccccccgaggagaccagcgaccacgccgacctgtag

SEQ ID NO: 24566 - DNA, 438 bp, Artificial Sequence; identical to SEQ ID NO: 24565
  Description of Artificial Sequence: Synthetic coding sequence
  Description of Combined DNA/RNA Molecule: Synthetic coding sequence

SEQ ID NO: 24567 - DNA, 2010 bp, Artificial Sequence
  Description of Artificial Sequence: Synthetic coding sequence
  Description of Combined DNA/RNA Molecule: Synthetic coding sequence
atggccgtgtacagagccgccctgggcgccagcctggccgccgccagactgctgcccctgggcagatgcagccccagccccgcccccagaagcaccctgagcggcgccgccatggagcccgcccccagatggctggccggcctgagattcgacaacagagccctgagagccctgcccgtggaggcccccccccccggccccgagggcgcccccagcgcccccagacccgtgcccggcgcctgcttcaccagagtgcagcccacccccctgagacagcccagactggtggccctgagcgagcccgccctggccctgctgggcctgggcgccccccccgccagagaggccgaggccgaggccgccctgttcttcagcggcaacgccctgctgcccggcgccgagcccgccgcccactgctactgcggccaccagttcggccagttcgccggccagctgggcgacggcgccgccatgtacctgggcgaggtgtgcaccgccaccggcgagagatgggagctgcagctgaagggcgccggccccacccccttcagcagacaggccgacggcagaaaggtgctgagaagcagcatcagagagttcctgtgcagcgaggccatgttccacctgggcgtgcccaccaccagagccggcgcctgcgtgaccagcgagagcaccgtggtgagagacgtgttctacgacggcaaccccaagtacgagcagtgcaccgtggtgctgagagtggccagcaccttcatcagattcggcagcttcgagatcttcaagagcgccgacgagcacaccggcagagccggccccagcgtgggcagaaacgacatcagagtgcagctgctggactacgtgatcagcagcttctaccccgagatccaggccgcccacgccagcgacagcgtgcagagaaacgccgccttcttcagagaggtgaccagaagaaccgccagaatggtggccgagtggcagtgcgtgggcttctgccacggcgtgctgaacaccgacaacatgagcatcctgggcctgaccatcgactacggccccttcggcttcctggacagatacgaccccgaccacgtgtgcaacgccagcgacaacaccggcagatacgcctacagcaagcagcccgaggtgtgcagatggaacctgagaaagctggccgaggccctgcagcccgagctgcccctggagctgggcgaggccatcctggccgaggagttcgacgccgagttccagagacactacctgcagaagatgagaagaaagctgggcctggtgcaggtggagctggaggaggacggcgccctggtgagcaagctgctggagaccatgcacctgaccggcgccgacttcaccaacaccttctacctgctgagcagcttccccgtggagctggagagccccggcctggccgagttcctggccagactgatggagcagtgcgccagcctggaggagctgagactggccttcagaccccagatggaccccagacagctgagcatgatgctgatgctggcccagagcaacccccagctgttcgccctgatgggcaccagagccggcatcgccagagagctggagagagtggagcagcagagcagactggagcagctgagcgccgccgagctgcagagcagaaaccagggccactgggccgactggctgcaggcctacagagccagactggacaaggacctggagggcgccggcgacgccgccgcctggcaggccgagcacgtgagagtgatgcacgccaacaaccccaagtacgtgctgagaaactacatcgcccagaacgccatcgaggccgccgagagaggcgacttcagcgaggtgagaagagtgctgaagctgctggagaccccctaccactgcgaggccggcgccgccaccgacgccgaggccaccgaggccgacggcgccgacggcagacagagaagctacagcagcaagccccccctgtgggccgccgagctgtgcgtgaccugaagcagctag

SEQ ID NO: 24568 - DNA, 588 bp, Artificial Sequence
  Description of Artificial Sequence: Synthetic coding sequence
  Description of Combined DNA/RNA Molecule: Synthetic coding sequence
atgagactgctgctgctgctgctggtggccgccagcgccatggtgagaagcgaggccagcgccaacctgggcggcgtgcccagcaagagactgaagatgcagtacgccaccggccccctgctgaagttccagatctgcgtgagcugaggctacagaagagtgttcgaggagtacatgagagtgatcagccagagataccccgacatcagaatcgagggcgagaactacctgccccagcccatctacagacacatcgccagcttcctgagcgtgttcaagctggtgctgatcggcctgatcatcgtgggcaaggaccccttcgccttcttcggcatgcaggcccccagcatctggcagtggggccaggagaacaaggtgtacgcctgcatgatggtgttcttcctgagcaacatgatcgagaaccagtgcatgagcaccggcgccttcgagatcaccctgaacgacgtgcccgtgtggagcaagctggagagcggccacctgcccagcatgcagcagctggtgcagatcctggacaacgagatgaagctgaacgtgcacatggacagcatcccccaccacagaagctag

SEQ ID NO: 24569 - DNA, 1041 bp, Artificial Sequence
  Description of Artificial Sequence: Synthetic coding sequence
  Description of Combined DNA/RNA Molecule: Synthetic coding sequence
atgaacaaccaggccagaacccccgcccccagcagcgccagaaccagcaccagcgtgagagccagcacccccaccagaacccccacccccctgagaacccccacccccgtgagaaccagaacccccatcagaaccctgacccccgtgctgacccccagccccgccggcaccagccccctggtgctgacccccgcccccgcccagatccccaccctggtgcccacccccgccctggccagaatccccagactggtgcccccccccgcccccgcctggatccccacccccgtgcccacccccgtgcccgtgagaaaccccacccccgtgcccacccccgccagaaccctgaccccccccgtgagagtgcccgcccccgcccccgcccagctgctggccggcatcagagccgccctgcccgtgctggacagctacctggcccccgccctgcccctggaccccccccccgagcccgcccccgagctgcccctgctgcccgaggaggaccccgagcccgcccccagcctgaagctgatccccagcgtgagcagcgaggccggccccgcccccggccccctgcccaccagaacccccctggccgccaacagccccggccccaccctggacttcaccttcagagccgaccccagcgccatcggcctggccgacccccccatccccagccccgtgcccagccccatcctgggcaccatccccagcgccatcagcctgcagaactgcaccgagaccttccccagcagcagcgagaacttcgccctggacaagagagtgctgatcagagtgacctactgcggcctgugaagctacagcctgagatacatcctgctgaagaagagcctggagcagcagttccccaaccacctgctgttcgaggaggacagagccgcccaggccaccggcgagttcgaggtgttcgtgaacggcagactggtgcacagcaagaagagaggcgacggcttcgtgaacgagagcagactgcagaagatcgtgagcgtgatcgacgaggagatcaagaagagatag

SEQ ID NO: 24570 - DNA, 1041 bp, Artificial Sequence
  Description of Artificial Sequence: Synthetic coding sequence
atgaacaaccaggccagaacccccgcccccagcagcgccagaaccagcaccagcgtgagagccagcacccccaccagaacccccacccccctgagaacccccacccccgtgagaaccagaacccccatcagaaccctgacccccgtgctgacccccagccccgccggcaccagccccctggtgctgacccccgcccccgcccagatccccaccctggtgcccacccccgccctggccagaatccccagactggtgcccccccccgcccccgcctggatccccacccccgtgcccacccccgtgcccgtgagaaaccccacccccgtgcccacccccgccagaaccctgaccccccccgtgagagtgcccgcccccgcccccgcccagctgctggccggcatcagagccgccctgcccgtgctggacagctacctggcccccgccctgcccctggaccccccccccgagcccgcccccgagctgcccctgctgcccgaggaggaccccgagcccgcccccagcctgaagctgatccccagcgtgagcagcgaggccggccccgcccccggccccctgcccaccagaacccccctggccgccaacagccccggccccaccctggacttcaccttcagagccgaccccagcgccatcggcctggccgacccccccatccccagccccgtgcccagccccatcctgggcaccatccccagcgccatcagcctgcagaactgcaccgagaccttccccagcagcagcgagaacttcgccctggacaagagagtgctgatcagagtgacctactgcttcatccacagctacagcctgagatacatcctgctgaagaagagcctggagcagcagttccccaaccacctgctgttcgaggaggacagagccgcccaggccaccggcgagttcgaggtgttcgtgaacggcagactggtgcacagcaagaagagaggcgacggcttcgtgaacgagagcagactgcagaagatcgtgagcgtgatcgacgaggagatcaagaagagatag

SEQ ID NO: 24571 - DNA, 2250 bp, Artificial Sequence
  Description of Artificial Sequence: Synthetic coding sequence
atgggcagagccggcgccgccgccgtgatccccggcctggccctgctgtgggccgtgggcctgggcagcgccgcccccagcccccccagactgagactgagcttccaggagctgcaggcctggcacggcctgcagaccttcagcctggagagaacctgctgctaccaggccctgctggtggacgaggagagaggcagactgttcgtgggcgccgagaaccacgtggccagcctgaacctggacaacatcagcaagagagccaagaagctggcctggcccgcccccgtggagtggagagaggagtgcaactgggccggcaaggacatcggcaccgagtgcatgaacttcgtgaagctgctgcacgcctacaacagaacccacctgctggcctgcggcaccggcgccttccaccccacctgcgccttcgtggaggtgggccacagagccgaggagcccgtgctgagactggaccccggcagaatcgaggacggcaagggcaagagcccctacgaccccagacacagagccgccagcgtgctggtgggcgaggagctgtacagcggcgtggccgccgacctgatgggcagagacttcaccatcttcagaagcctgggccagagacccagcctgagaaccgagccccacgacagcagatggctgaacgagcccaagttcgtgaaggtgttctggatccccgagagcgagaaccccgacgacgacaagatctacttcttcttcagagagaccgccgtggaggccgcccccgccctgggcagactgagcgtgagcagagtgggccagatctgcagaaacgacgtgggcggccagagaagcctggtgaacaagtggaccaccttcctgaaggccagactggtgtgcagcgtgcccggcgtggagggcgacacccacttcgaccagctgcaggacgtgttcctgctgagcagcagagaccacagaacccccctgctgtacgccgtgttcagcaccagcagcagcatcttccagggcagcgccgtgtgcgtgtacagcatgaacgacgtgagaagagccttcctgggccccttcgcccacaaggagggccccatgcaccagtgggtgagctaccagggcagagtgccctaccccagacccggcatgtgccccagcaagaccttcggcaccttcagcagcaccaaggacttccccgacgacgtgatccagttcgccagaaaccaccccctgatgtacaacagcgtgctgcccaccggcggcagacccctgttcctgcaggtgggcgccaactacaccttcacccagatcgccgccgacagagtggccgccgccgacggccactacgacgtgctgttcatcggcaccgacgtgggcaccgtgctgaaggtgatcagcgtgcccaagggcagcagacccagcgccgagggcctgctgctggaggagctgcacgtgttcgaggacagcgccgccgtgaccagcatgcagatcagcagcaagagacaccagctgtacgtggccagcagaagcgccgtggcccagatcgccctgcacagatgcgccgcccacggcagagtgtgcaccgagtgctgcctggccagagacccctactgcgcctgggacggcgtggcctgcaccagattccagcccagcgccaagagaagattcagaagacaggacgtgagaaacggcgaccccagcaccctgtgcagcggcgacagcagcagacccgccctgctggagcacaaggtgttcggcgtggagggcagcagcgccttcctggagtgcgagcccagaagcctgcaggccagagtggagtggaccttccagagagccggcgtgaccgcccacacccaggtgctggccgaggagagaaccgagagaaccgccagaggcctgctgctgagaagactgagaagaagagacagcggcgtgtacctgtgcgccgccgtggagcagggcttcacccagcccctgagaagactgagcctgcacgtgctgagcgccacccaggccgagagactggccagagccgaggaggccgcccccgccgccccccccggccccaagctgtggtacagagacttcctgcagctggtggagcccggcggcggcggcagcgccaacagcctgagaatgtgcagaccccagcccgccctgcagagcctgcccctggagagcagaagaaagggcagaaacagaagaacccacgcccccgagcccagagccgagagaggccccagaagcgccacccactggtag

SEQ ID NO: 24572 - DNA, 444 bp, Artificial Sequence
  Description of Artificial Sequence: Synthetic coding sequence
atgggcggctgcatgcacagcacccaggacaagagcctgcacctggagggcgaccccaaccccagcgccgcccccaccagcacctgcgcccccagaaagatgcccaagagaatcagcatcagcaagcagctggccagcgtgaaggccctgagaaagtgcagcgacctggagaaggccatcgccaccaccgccctgatcttcagaaacagcagcgacagcgacggcaagctggagaaggccatcgccaaggacctgctgcagacccagttcagaaacttcgccgagggccaggagaccaagcccaagtacagagagatcctgagcgagctggacgagcacaccgagaacaagctggacttcgaggacttcatgatcctgctgctgagcatcaccgtgatgagcgacctgctgcagaacatcagaaacgtgaagatcatgaagtag

SEQ ID NO: 24573 - DNA, 279 bp, Artificial Sequence
  Description of Artificial Sequence: Synthetic coding sequence
atggagcagagcaaggtgctgatcaaggagggcggcgtgcagctgctgctgaccatcgtggacacccccggcttcggcgacgccgtggacaacagcaactgctggcagcccgccatcaactacatcgacagcaagttcgaggactacctgaacgccgagagcagagtgaacagatgccagatgcccggcaacagagtgcagtgctgcctgtacttcatcgcccccagcggccacggctggcagaccagaaacatggactactgcgtggagttccactag

SEQ ID NO: 24574 - DNA, 279 bp, Artificial Sequence; identical to SEQ ID NO: 24573
  Description of Artificial Sequence: Synthetic coding sequence

SEQ ID NO: 24575 - DNA, 1269 bp, Artificial Sequence
  Description of Artificial Sequence: Synthetic coding sequence
atggagccccccgccagcaaggtgcccgaggtgcccaccgcccccgccaccgacgccgcccccaagagagtggagatccagatgcccaagcccgccgaggcccccaccgcccccagccccgcccagaccctggagaacagcgagcccgcccccgtgagccagctgcagagcagactggagcccaagccccagccccccgtggccgaggccacccccagaagccaggaggccaccgaggccgcccccagctgcgtgggcgacatggccgacacccccagagacgccggcctgaagcaggcccccgccagcagaaacgagaaggcccccgtggacttcggctacgtgggcatcgacagcatcctggagcagatgagaagaaaggccatgaagcagggcttcgagttcaacatcatggtggtgggccagagcggcctgggcaagagcaccctgatcaacaccctgttcaagagcaagatcagcagaaagagcgtgcagcccaccagcgaggagagaatccccaagaccatcgagatcaagagcatcacccacgacatcgaggagaagggcgtgagaatgaagctgaccgtgatcgacacccccggcttcggcgaccacatcaacaacgagaactgctggcagcccatcatgaagttcatcaacgaccagtacgagaagtacctgcaggaggaggtgaacatcaacagaaagaagagaatccccgacaccagagtgcactgctgcctgtacttcatccccgccaccggccacagcctgagacccctggacatcgagttcatgaagagactgagcaaggtggtgaacatcgtgcccgtgatcgccaaggccgacaccctgaccctggaggagagagtgcacttcaagcagagaatcaccgccgacctgctgagcaacggcatcgacgtgtacccccagaaggagttcgacgaggacagcgaggacagactggtgaacgagaagttcagagagatgatccccttcgccgtggtgggcagcgaccacgagtaccaggtgaacggcaagagaatcctgggcagaaagaccaagtggggcaccatcgaggtggagaacaccacccactgcgagttcgcctacctgagagacctgctgatcagaacccacatgcagaacatcaaggacatcaccagcagcatccacttcgaggcctacagagtgaagagactgaacgagggcagcagcgccatggccaacggcatggaggagaaggagcccgaggcccccgagatgtag

SEQ ID NO: 24576 - DNA, 1269 bp, Artificial Sequence; identical to SEQ ID NO: 24575
  Description of Artificial Sequence: Synthetic coding sequence

SEQ ID NO: 24577 - DNA, 1008 bp, Artificial Sequence
  Description of Artificial Sequence: Synthetic coding sequence
atggccgacacccccagagacgccggcctgaagcaggcccccgccagcagaaacgagaaggcccccgtggacttcggctacgtgggcatcgacagcatcctggagcagatgagaagaaaggccatgaagcagggcttcgagttcaacatcatggtggtgggccagagcggcctgggcaagagcaccctgatcaacaccctgttcaagagcaagatcagcagaaagagcgtgcagcccaccagcgaggagagaatccccaagaccatcgagatcaagagcatcacccacgacatcgaggagaagggcgtgagaatgaagctgaccgtgatcgacacccccggcttcggcgaccacatcaacaacgagaactgctggcagcccatcatgaagttcatcaacgaccagtacgagaagtacctgcaggaggaggtgaacatcaacagaaagaagagaatccccgacaccagagtgcactgctgcctgtacttcatccccgccaccggccacagcctgagacccctggacatcgagttcatgaagagactgagcaaggtggtgaacatcgtgcccgtgatcgccaaggccgacaccctgaccctggaggagagagtgcacttcaagcagagaatcaccgccgacctgctgagcaacggcatcgacgtgtacccccagaaggagttcgacgaggacagcgaggacagactggtgaacgagaagttcagagagatgatccccttcgccgtggtgggcagcgaccacgagtaccaggtgaacggcaagagaatcctgggcagaaagaccaagtggggcaccatcgaggtggagaacaccacccactgcgagttcgcctacctgagagacctgctgatcagaacccacatgcagaacatcaaggacatcaccagcagcatccacttcgaggcctacagagtgaagagactgaacgagggcagcagcgccatggccaacggcatggaggagaaggagcccgaggcccccgagatgtag

SEQ ID NO: 24578 - DNA, 1707 bp, Artificial Sequence
  Description of Artificial Sequence: Synthetic coding sequence
atggagagagacagaatcagcgccctgaagagaagcttcgaggtggaggaggtggagacccccaacagcaccccccccagaagagtgcagacccccctgctgagagccaccgtggccagcagcacccagaagttccaggacctgggcgtgaagaacagcgagcccagcgccagacacgtggacagcctgagccagagaagccccaaggccagcctgagaagagtggagctgagcggccccaaggccgccgagcccgtgagcagaagaaccgagctgagcatcgacatcagcagcaagcaggtggagaacgccggcgccatcggccccagcagattcggcctgaagagagccgaggtgctgggccacaagacccccgagcccgcccccagaagaaccgagatcaccatcgtgaagccccaggagagcgcccacagaagaatggagccccccgccagcaaggtgcccgaggtgcccaccgcccccgccaccgacgccgcccccaagagagtggagatccagatgcccaagcccgccgaggcccccaccgcccccagccccgcccagaccctggagaacagcgagcccgcccccgtgagccagctgcagagcagactggagcccaagccccagccccccgtggccgaggccacccccagaagccaggaggccaccgaggccgcccccagctgcgtgggcgacatggccgacacccccagagacgccggcctgaagcaggcccccgccagcagaaacgagaaggcccccgtggacttcggctacgtgggcatcgacagcatcctggagcagatgagaagaaaggccatgaagcagggcttcgagttcaacatcatggtggtgggccagagcggcctgggcaagagcaccctgatcaacaccctgttcaagagcaagatcagcagaaagagcgtgcagcccaccagcgaggagagaatccccaagaccatcgagatcaagagcatcacccacgacatcgaggagaagggcgtgagaatgaagctgaccgtgatcgacacccccggcttcggcgaccacatcaacaacgagaactgctggcagcccatcatgaagttcatcaacgaccagtacgagaagtacctgcaggaggaggtgaacatcaacagaaagaagagaatccccgacaccagagtgcactgctgcctgtacttcatccccgccaccggccacagcctgagacccctggacatcgagttcatgaagagactgagcaaggtggtgaacatcgtgcccgtgatcgccaaggccgacaccctgaccctggaggagagagtgcacttcaagcagagaatcaccgccgacctgctgagcaacggcatcgacgtgtacccccagaaggagttcgacgaggacagcgaggacagactggtgaacgagaagttcagagagatgatccccttcgccgtggtgggcagcgaccacgagtaccaggtgaacggcaagagaatcctgggcagaaagaccaagtggggcaccatcgaggtggagaacaccacccactgcgagttcgcctacctgagagacctgctgatcagaacccacatgcagaacatcaaggacatcaccagcagcatccacttcgaggcctacagagtgaagagactgaacgagggcagcagcgccatggccaacggcatggaggagaaggagcccgaggcccccgagatgtag

SEQ ID NO: 24579 - DNA, 1368 bp, Artificial Sequence
  Description of Artificial Sequence: Synthetic coding sequence
atgggcgcctgcctgggcgcctgcagcctgctgagctgcgccagctgcctgtgcggcagcgccccctgcatcctgtgcagctgctgccccgccagcagaaacagcaccgtgagcagactgatcttcaccttcttcctgttcctgggcgtgctggtgagcatcatcatgctgagccccggcgtggagagccagctgtacaagctgccctgggtgtgcgaggagggcgccggcatccccaccgtgctgcagggccacatcgactgcggcagcctgctgggctacagagccgtgtacagaatgtgcttcgccaccgccgccttcttcttcttcttcaccctgctgatgctgtgcgtgagcagcagcagagaccccagagccgccatccagaacggcttctggttcttcaagttcctgatcctggtgggcctgaccgtgggcgccttctacatccccgacggcagcttcaccaacatctggttctacttcggcgtggtgggcagcttcctgttcatcctgatccagctggtgctgctgatcgacttcgcccacagctggaaccagagatggctgggcaaggccgaggagtgcgacagcagagcctggtacgccggcctgttcttcttcaccctgctgttctacctgctgagcatcgccgccgtggccctgatgttcatgtactacaccgagcccagcggctgccacgagggcaaggtgttcatcagcctgaacctgaccttctgcgtgtgcgtgagcatcgccgccgtgctgcccaaggtgcaggacgcccagcccaacagcggcctgctgcaggccagcgtgatcaccctgtacaccatgttcgtgacctggagcgccctgagcagcatccccgagcagaagtgcaacccccacctgcccacccagctgggcaacgagaccgtggtggccggccccgagggctacgagacccagtggtgggacgcccccagcatcgtgggcctgatcatcttcctgctgtgcaccctgttcatcagcctgagaagcagcgaccacagacaggtgaacagcctgatgcagaccgaggagtgcccccccatgctggacgccacccagcagcagcagcaggtggccgcctgcgagggcagagccttcgacaacgagcaggacggcgtgacctacagctacagcttcttccacttctgcctggtgctggccagcctgcacgtgatgatgaccctgaccaactggtacaagcccggcgagaccagaaagatgatcagcacctggaccgccgtgtgggtgaagatctgcgccagctgggccggcctgctgctgtacctgtggaccctggtggcccccctgctgctgagaaacagagacttcagctag

SEQ ID NO: 24580 - DNA, 294 bp, Artificial Sequence
  Description of Artificial Sequence: Synthetic coding sequence
atgaagggcatctgcagcgacgccatcctggtgctggccaccagcatgtggatggccttcgccatcgacttccccctgcccatggccagcgagagaggccagctggacaagaccatcgtggagtgcctgaagaacgtgaacaagtgctggttcctgagctacatcaagcccagcgagcccatctgcggcagcgaccaggtgacctacagcagcgactgccacctgtgcagcaagatcctgttcgagggcctgaacatcaccaagctgtacgacggccagtgcgagaacagctag

SEQ ID NO: 24581 - DNA, 1794 bp, Artificial Sequence
  Description of Artificial Sequence: Synthetic coding sequence
atgagcagcaccgtgaacaacggcgccgccagcatgcagagcacccccgacgccgccaacggcttcccccagcccagcagcagcagcggcacctggcccagagccgaggaggagctgagagccgccgagcccggcctggtgaagagagcccacagagagatcctggaccacgagagaaagagaagagtggagctgaagtgcatggagctgcaggagatgatggaggagcagggctacagcgaggaggagatcagacagaaggtgggcaccttcagacagatgctgatggagaaggagggcgtgctgaccagagaggacagacccggcggccacatcgtggccgagacccccagactgaccgagggcgccgagcccggcctggagtacgcccccttcgacgacgacgacggccccgtggactgcgactgccccgccagctgctacagaggccacagaggctacagaaccaagcactggagcagcagcagcgccagccccccccccaagaagaagaagaagaagaagggcggccacagaagaagcagaaagaagagaagactggagagcgagtgcagctgcggcagcagcagccccctgagaaagaagaagaagagcgtgaagaagcacagaagagacagaagcgacagcggcagcagaagaaagagaagacacagaagcagaagcagcaagtgcaagagaaaggagaagaacaaggagaagaagagaccccacaccgagagccccggcagaagaagccacagacacagcagcggcagcagccacagccccagcctgagcagccactacagcgacagcagaagccccagcagactgagccccaagcacagagacgagggcagaaagaccggcagccagagaagcagcggcagcagaagccccagccccagcggcggcagcggctggggcagcccccagagaaacggcggcagcggccagagaagcggcgcccacggcggcagacccggcagcgcccacagcccccccgacaagcccagcagccccagccccagagtgagagacaaggccgccgccgccgcccccaccccccccgccagaggcaaggagagccccagccccagaagcgcccccagcagccagggcagaggcggcagagccgccggcggcgccggcagaagaagaagaagaagaagaagaagaagaagaagcagaagcagcgccagcgcccccagaagaagaggcagaagaagacccagacccgccccccccagaggcagcagcagaagcctgagcagagccagaagcagcagcgacagcggcagcggcagaggcgcccccggccccggccccgagcccggcagcgagagaggccacggcggccacggcaagagagccaaggagagaccccccagagccagacccgccagcaccagccccagccccggcgcccacggcagaagaggcggccccgagggcaagagcagcagcagaagccccggcccccaccccagaagctggagcagcagcagaagccccagcaagagcagaagcagaagcgccgagaagagaccccacagccccagcagaagccccagccccaagaagcccctgagcagagacaaggacggcgagggcagagccagacacagcgaggccgaggccaccagagccagaagaagaagcagaagctacagccccatcagaaagagaagaagagacagccccagcttcatggagcccagaagaatcaccagcgccgccagcgtgctgttccacaccaccggccccgcccccctgcccccccccgccgcctag

SEQ ID NO: 24582 - DNA, 1962 bp, Artificial Sequence
  Description of Artificial Sequence: Synthetic coding sequence
atgagcagcaccgtgaacaacggcgccgccagcatgcagagcacccccgacgccgccaacggcttcccccagcccagcagcagcagcggcacctggcccagagccgaggaggagctgagagccgccgagcccggcctggtgaagagagcccacagagagatcctggaccacgagagaaagagaagagtggagctgaagtgcatggagctgcaggagatgatggaggagcagggctacagcgaggaggagatcagacagaaggtgggcaccttcagacagatgctgatggagaaggagggcgtgctgaccagagaggacagacccggcggccacatcgtggccgagacccccagactgaccgagggcgccgagcccggcctggagtacgcccccttcgacgacgacgacggccccgtggactgcgactgccccgccagctgctacagaggccacagaggctacagaaccaagcactggagcagcagcagcgccagccccccccccaagaagaagaagaagaagaagggcggccacagaagaagcagaaagaagagaagactggagagcgagtgcagctgcggcagcagcagccccctgagaaagaagaagaagagcgtgaagaagcacagaagagacagaagcgacagcggcagcagaagaaagagaagacacagaagcagaagcagcaagtgcaagagaaaggagaagaacaaggagaagaagagaccccacaccgagagccccggcagaagaagccacagacacagcagcggcagcagccacagccccagcctgagcagccactacagcgacagcagaagccccagcagactgagccccaagcacagagacgagggcagaaagaccggcagccagagaagcagcggcagcagaagccccagccccagcggcggcagcggctggggcagcccccagagaaacggcggcagcggccagagaagcggcgcccacggcggcagacccggcagcgcccacagcccccccgacaagcccagcagccccagccccagagtgagagacaaggccgccgccgccgcccccaccccccccgccagaggcaaggagagccccagccccagaagcgcccccagcagccagggcagaggcggcagagccgccggcggcgccggcagaagaagaagaagaagaagaagaagaagaagaagcagaagcagcgccagcgcccccagaagaagaggcagaagaagacccagacccgccccccccagaggcagcagcagaagcctgagcagagccagaagcagcagcgacagcggcagcggcagaggcgcccccggccccggccccgagcccggcagcgagagaggccacggcggccacggcaagagagccaaggagagaccccccagagccagacccgccagcaccagccccagccccggcgcccacggcagaagaggcggccccgagggcaagagcagcagcagaagccccggcccccaccccagaagctggagcagcagcagaagccccagcaagagcagaagcagaagcgccgagaagagaccccacagccccagcagaagccccagccccaagaagcccctgagcagagacaaggacggcgagggcagagccagacacagcgaggccgaggccaccagagccagaagaagaagcagaagctacagccccatcagaaagagaagaagagacagccccagcttcatggagcccagaagaatcaccagaagaagaaagagacccatcccctactacagacccagccccagcagcagcagcagctgcctgagcagcgactacagcaccagaagccacagcagaagccccagccccggccacagccacggcagctacagcagcagaagccacggcaccagaagcagaaccagaagccccagcagaacccccagccccagctaccacagcagaagcagcagcgagagcggcggcttctag

SEQ ID NO: 24583 - DNA, 1794 bp, Artificial Sequence; identical to SEQ ID NO: 24581
  Description of Artificial Sequence: Synthetic coding sequence

SEQ ID NO: 24584 - DNA, 1962 bp, Artificial Sequence; identical to SEQ ID NO: 24582
  Description of Artificial Sequence: Synthetic coding sequence

SEQ ID NO: 24585 - DNA, 2148 bp, Artificial Sequence
  Description of Artificial Sequence: Synthetic coding sequence
atgagcagccccaagagaagcagcaagcccagcatgagcctggcccccagcggcagcagcatgcccaccgccgaccccaagccccccgccagcctgaagagcaccaagagcgccacccccaacagaagcctggtgcccaccaagcccgccaccagcagaaacagcgtgatgagccccagcagcagcaagagcaccaagagcaccagcaccaagagagcccccagcaacagacccagcagcagaagcagagtgagaagcaaggccagaacccccagcagagtgagcaccgacaccagaaccagcaaggccagcaaggccagcgacgtgagatgccaccagagaagaggcacccacagcagaggcagaacccccggcagaagaggcagcagaagcagcaagagaagccccagcagagccagcacccccggcagaatcagaacccacggcgccagacccggcatggccagcagagtgagaacccccaccagccagcagaagggcagcagaggcaagagctacggcagacccagaaccagcaacagagagagaagcgacagccagcccagaaacctgagcaagaagagctacagaccccccggcggcagcggcatcggcagaagcagcgagctggccgtgacccccagcaccgccaagtgccagacccccaccggcatccccagcaaggagaagagcgacaaccccagccccagcagcagcagaaaggtgaagagctacggccagatgatcatccccagcagagagaagagctacagccccaccgagatgagcagcagagtgaagagctacaaccaggccagcaccagaagcagaccccagagccacagccagagcagaagccccagaagaagcagaagcggcagccagaagagaacccacagcagagtgagaagccacagctggaagagaaaccacagcagagccagaagcagaaccagaaagggcatcctgagccagatgggcagacacagccagagcagaagccacagcaagggcaagagccagaaccagagcagaacccccagaagaggcagaagccacaactggagcagaaaccccagcaaggagagaagccacagccacagcagaagcagcagcaaggagagagaccacagaggcagcagcagccccagaaaggagagcggcagaagccagagcggcagccccaacaagcagagagaccacagcagaagcagaagccccaacaaggccagagacagaagcagaagcagaagcccctacaaggccagagacagaagcagaagcagaagccccaacaaggccagagactgcagcagaagcagaagcccctacaaggccagagacagaagcagaagcagaagccccaacaaggccagagaccacagcagaagcagaagccccaacaaggccagagacagaagcagaagcagaagccccagcaaggagagagaccacagccagctgggcagccccagcaaggagagagaccacagaagaagcagaagccccagcaaggagagacagtgcagacagagcagaagcagcagcaaggagagagaccacagaagaagcagaagccccagcaaggagagacagagaagacagagcagaagccccaacaaggagagagacagaagccagagcagaagccccagcgaggagagagagcacagacagagcagaagccccagcaaggagagagacagaagaagatggagaagccccagcaaggagagagagagaagacagagcagaagcagcagcgaggagagagaccacagcagaagcagaagccccaacaagcagagcggctacagcagacccagagccagcagcaaggagaaggcccacagcagaagcagaacccccagcaaggagggcaaccacagccagagcagaaccagcagcaaggagagcgaccccagccagagcaccgtgcccagaagccccgactggaagagaagccccaccagaaccagcagcctgagccagaacagaacccccagcaagaccagcagccacagccccagcaccttccccagcggcggccagaccctgagccaggacgacagccaggccgacgccaccaccagcaaggccaccctgcccggcgagagaagcagcagcagcagcagcaagctggcctag

SEQ ID NO: 24586 - DNA, 2193 bp, Artificial Sequence
  Description of Artificial Sequence: Synthetic coding sequence
atgagcaccgtgaccagcagaaccaccagccccttcgcccccaccatgagcagccccaagagaagcagcaagcccagcatgagcctggcccccagcggcagcagcatgcccaccgccgaccccaagccccccgccagcctgaagagcaccaagagcgccacccccaacagaagcctggtgcccaccaagcccgccaccagcagaaacagcgtgatgagccccagcagcagcaagagcaccaagagcaccagcaccaagagagcccccagcaacagacccagcagcagaagcagagtgagaagcaaggccagaacccccagcagagtgagcaccgacaccagaaccagcaaggccagcaaggccagcgacgtgagatgccaccagagaagaggcacccacagcagaggcagaacccccggcagaagaggcagcagaagcagcaagagaagccccagcagagccagcacccccggcagaatcagaacccacggcgccagacccggcatggccagcagagtgagaacccccaccagccagcagaagggcagcagaggcaagagctacggcagacccagaaccagcaacagagagagaagcgacagccagcccagaaacctgagcaagaagagctacagaccccccggcggcagcggcatcggcagaagcagcgagctggccgtgacccccagcaccgccaagtgccagacccccaccggcatccccagcaaggagaagagcgacaaccccagccccagcagcagcagaaaggtgaagagctacggccagatgatcatccccagcagagagaagagctacagccccaccgagatgagcagcagagtgaagagctacaaccaggccagcaccagaagcagaccccagagccacagccagagcagaagccccagaagaagcagaagcggcagccagaagagaacccacagcagagtgagaagccacagctggaagagaaaccacagcagagccagaagcagaaccagaaagggcatcctgagccagatgggcagacacagccagagcagaagccacagcaagggcaagagccagaaccagagcagaacccccagaagaggcagaagccacaactggagcagaaaccccagcaaggagagaagccacagccacagcagaagcagcagcaaggagagagaccacagaggcagcagcagccccagaaaggagagcggcagaagccagagcggcagccccaacaagcagagagaccacagcagaagcagaagccccaacaaggccagagacagaagcagaagcagaagcccctacaaggccagagacagaagcagaagcagaagccccaacaaggccagagactgcagcagaagcagaagcccctacaaggccagagacagaagcagaagcagaagccccaacaaggccagagaccacagcagaagcagaagccccaacaaggccagagacagaagcagaagcagaagccccagcaaggagagagaccacagccagctgggcagccccagcaaggagagagaccacagaagaagcagaagccccagcaaggagagacagtgcagacagagcagaagcagcagcaaggagagagaccacagaagaagcagaagccccagcaaggagagacagagaagacagagcagaagccccaacaaggagagagacagaagccagagcagaagccccagcgaggagagagagcacagacagagcagaagccccagcaaggagagagacagaagaagatggagaagccccagcaaggagagagagagaagacagagcagaagcagcagcgaggagagagaccacagcagaagcagaagccccaacaagcagagcggctacagcagacccagagccagcagcaaggagaaggcccacagcagaagcagaacccccagcaaggagggcaaccacagccagagcagaaccagcagcaaggagagcgaccccagccagagcaccgtgcccagaagccccgactggaagagaagccccaccagaaccagcagcctgagccagaacagaacccccagcaagaccagcagccacagccccagcaccttccccagcggcggccagaccctgagccaggacgacagccaggccgacgccaccaccagcaaggccaccctgcccggcgagagaagcagcagcagcagcagcaagctggcctag

SEQ ID NO: 24587 - DNA, 1191 bp, Artificial Sequence
  Description of Artificial Sequence: Synthetic coding sequence
atgggcgccaacaccagcagaaagccccccgtgttcgacgagaacgaggacgtgaacttcgaccacttcgagatcctgagagccatcggcaagggcagcttcggcaaggtgtgcatcgtgcagaagaacgacaccaagaagatgtacgccatgaagtacatgaacaagcagaagtgcgtggagagaaacgaggtgagaaacgtgttcaaggagctgcagatcatgcagggcctggagcaccccttcctggtgaacctgtggtacagcttccaggacgaggaggacatgttcatggtggtggacctgctgctgggcggcgacctgagataccacctgcagcagaacgtgcacttcaaggaggagaccgtgaagctgttcatctgcgagctggtgatggccctggactacctgcagaaccagagaatcatccacagagacatgaagcccgacaacatcctgctggacgagcacggccacgtgcacatcaccgacttcaacatcgccgccatgctgcccagagagacccagatcaccaccatggccggcaccaagccctacatggcccccgagatgttcagcagcagaaagggcgccggctacagcttcgccgtggactggtggagcctgggcgtgaccgcctacgagctgctgagaggcagaagaccctaccacatcagaagcagcaccagcagcaaggagatcgtgcacaccttcgagaccaccgtggtgacctaccccagcgcctggagccaggagatggtgagcctgctgaagaagctgctggagcccaaccccgaccagagattcagccagctgagcgacgtgcagaacttcccctacatgaacgacatcaactgggacgccgtgttccagaagagactgatccccggcttcatccccaacaagggcagactgaactgcgaccccaccttcgagctggaggagatgatcctggagagcaagcccctgcacaagaagaagaagagactggccaagaaggagaaggacatgagaaagtgcgacagcagccagacctgcctgctgcaggagcacctggacagcgtgcagaaggagttcatcatcttcaacagagagaaggtgaacagagacttcaacaagagacagcccaacctggccctggagcagaccaaggacccccagggcgaggacggccagaacaacaacctgtag

SEQ ID NO: 24588 - DNA, 501 bp, Artificial Sequence
  Description of Artificial Sequence: Synthetic coding sequence
atgggcgccaacaccagcagaaagccccccgtgttcgacgagaacgaggacgtgaacttcgaccacttcgagatcctgagagccatcggcaagggcagcttcggcaaggtgtgcatcgtgcagaagaacgacaccaagaagatgtacgccatgaagtacatgaacaagcagaagtgcgtggagagaaacgaggtgagaaacgtgttcaaggagctgcagatcatgcagggcctggagcaccccttcctggtgaacctgtggtacagcttccaggacgaggaggacatgttcatggtggtggacctgctgctgggcggcgacctgagataccacctgcagcagaacgtgcacttcaaggaggagaccgtgaagctgttcatctgcgagctggtgatggccctggactacctgcagaaccagagaatcatccacagagacatgaagcccgacaacatcctgctggacgagcacgtgcagcagtacaccctgaagagccactag

SEQ ID NO: 24589 - DNA, 501 bp, Artificial Sequence
  Description of Artificial Sequence: Synthetic coding sequence
atgggcgccaacaccagcagaaagccccccgtgttcgacgagaacgaggacgtgaacttcgaccacttcgagatcctgagagccatcggcaagggcagcttcggcaaggtgtgcatcgtgcagaagaacgacaccaagaagatgtacgccatgaagtacatgaacaagcagaagtgcgtggagagaaacgaggtgagaaacgtgttcaaggagctgcagatcatgcagggcctggagcaccccttcctggtgaacctgtggtacagcttccaggacgaggaggacatgttcatggtggtggacctgctgctgggcggcgacctgagataccacctgcagcagaacgtgcacttcaaggaggagaccgtgaagctgttcatctgcgagctggtgatggccctggactacctgcagaaccagagaatcatccacagagacatgaagcccgacaacatcctgctggacgagcacgacacctggctgagctacaagagccactag

SEQ ID NO: 24590 - DNA, 1245 bp, Artificial Sequence
  Description of Artificial Sequence: Synthetic coding sequence
atgggcggcaaccacagccacaagccccccgtgttcgacgagaacgaggaggtgaacttcgaccacttccagatcctgagagccatcggcaagggcagcttcggcaaggtgtgcatcgtgcagaagagagacaccaagaagatgtacgccatgaagtacatgaacaagcagaagtgcatcgagagagacgaggtgagaaacgtgttcagagagctgcagatcatgcagggcctggagcaccccttcctggtgaacctgtggtacagcttccaggacgaggaggacatgttcatggtggtggacctgctgctgggcggcgacctgagataccacctgcagcagaacgtgcacttcaccgagggcaccgtgaagctgtacatctgcgagctggccctggccctggagtacctgcagagataccacatcatccacagagacatcaagcccgacaacatcctgctggacgagcacggccacgtgcacatcaccgacttcaacatcgccaccgtggtgaagggcgccgagagagccagcagcatggccggcaccaagccctacatggcccccgaggtgttccaggtgtacatggacagaggccccggctacagctaccccgtggactggtggagcctgggcatcaccgcctacgagctgctgagaggctggagaccctacgagatccacagcgtgacccccatcgacgagatcctgaacatgttcaaggtggagagagtgcactacagcagcacctggtgcaagggcatggtggccctgctgagaaagctgctgaccaaggaccccgagagcagagtgagcagcctgcacgacatccagagcgtgccctacctggccgacatgaactgggacgccgtgttcaagaaggccctgatgcccggcttcgtgcccaacaagggcagactgaactgcgaccccaccttcgagctggaggagatgatcctggagagcaagcccctgcacaagaagaagaagagactggccaagaacagaagcagagacggcaccaaggacagctgccccctgaacggccacctgcagcactgcctggagaccgtgagagaggagttcatcatcttcaacagagagaagctgagaagacagcagggccagggcagccagctgctggacaccgacagcagaggcggcggccaggcccagagcaagctgcaggacggctgcaacaacaacctgctgacccacacctgcaccagaggctgcagcagctag

SEQ ID NO: 24591 - DNA, 1104 bp, Artificial Sequence
  Description of Artificial Sequence: Synthetic coding sequence
atgtacgccatgaagtacatgaacaagcagaagtgcatcgagagagacgaggtgagaaacgtgttcagagagctgcagatcatgcagggcctggagcaccccttcctggtgaacctgtggtacagcttccaggacgaggaggacatgttcatggtggtggacctgctgctgggcggcgacctgagataccacctgcagcagaacgtgcacttcaccgagggcaccgtgaagctgtacatctgcgagctggccctggccctggagtacctgcagagataccacatcatccacagagacatcaagcccgacaacatcctgctggacgagcacggccacgtgcacatcaccgacttcaacatcgccaccgtggtgaagggcgccgagagagccagcagcatggccggcaccaagccctacatggcccccgaggtgttccaggtgtacatggacagaggccccggctacagctaccccgtggactggtggagcctgggcatcaccgcctacgagctgctgagaggctggagaccctacgagatccacagcgtgacccccatcgacgagatcctgaacatgttcaaggtggagagagtgcactacagcagcacctggtgcaagggcatggtggccctgctgagaaagctgctgaccaaggaccccgagagcagagtgagcagcctgcacgacatccagagcgtgccctacctggccgacatgaactgggacgccgtgttcaagaaggccctgatgcccggcttcgtgcccaacaagggcagactgaactgcgaccccaccttcgagctggaggagatgatcctggagagcaagcccctgcacaagaagaagaagagactggccaagaacagaagcagagacggcaccaaggacagctgccccctgaacggccacctgcagcactgcctggagaccgtgagagaggagttcatcatcttcaacagagagaagctgagaagacagcagggccagggcagccagctgctggacaccgacagcagaggcggcggccaggcccagagcaagctgcaggacggctgcaacaacaacctgctgacccacacctgcaccagaggctgcagcagctag

SEQ ID NO: 24592 - DNA, 1461 bp, Artificial Sequence
  Description of Artificial Sequence: Synthetic coding sequence
atgagaagcggcgccgagagaagaggcagcagcgccgccgccagccccggcagccccccccccggcagagccagacccgccggcagcgacgcccccagcgccctgcccccccccgccgccggccagcccagagccagagacagcggcgacgtgagaagccagcccagacccctgttccagtggagcaagtggaagaagagaatgggcagcagcatgagcgccgccaccgccagaagacccgtgttcgacgacaaggaggacgtgaacttcgaccacttccagatcctgagagccatcggcaagggcagcttcggcaaggtgtgcatcgtgcagaagagagacaccgagaagatgtacgccatgaagtacatgaacaagcagcagtgcatcgagagagacgaggtgagaaacgtgttcagagagctggagatcctgcaggagatcgagcacgtgttcctggtgaacctgtggtacagcttccaggacgaggaggacatgttcatggtggtggacctgctgctgggcggcgacctgagataccacctgcagcagaacgtgcagttcagcgaggacaccgtgagactgtacatctgcgagatggccctggccctggactacctgagaggccagcacatcatccacagagacgtgaagcccgacaacatcctgctggacgagagaggccacgcccacctgaccgacttcaacatcgccaccatcatcaaggacggcgagagagccaccgccctggccggcaccaagccctacatggcccccgagatcttccacagcttcgtgaacggcggcaccggctacagcttcgaggtggactggtggagcgtgggcgtgatggcctacgagctgctgagaggctggagaccctacgacatccacagcagcaacgccgtggagagcctggtgcagctgttcagcaccgtgagcgtgcagtacgtgcccacctggagcaaggagatggtggccctgctgagaaagctgctgaccgtgaaccccgagcacagactgagcagcctgcaggacgtgcaggccgcccccgccctggccggcgtgctgtgggaccacctgagcgagaagagagtggagcccggcttcgtgcccaacaagggcagactgcactgcgaccccaccttcgagctggaggagatgatcctggagagcagacccctgcacaagaagaagaagagactggccaagaacaagagcagagacaacagcagagacagcagccagagcgagaacgactacctgcaggactgcctggacgccatccagcaggacttcgtgatcttcaacagagagaagctgaagagaagccaggacctgcccagagagcccctgcccgcccccgagagcagagacgccgccgagcccgtggaggacgaggccgagagaagcgccctgcccatgtgcggccccatctgccccagcgccggcagcggctag

SEQ ID NO: 24593 - DNA, 537 bp, Artificial Sequence
  Description of Artificial Sequence: Synthetic coding sequence
tgaggcctggagggcgtggtggtggacggccaggtggagaccgccagagtgtggagaggcgacagacccggcaccgagggcaaggaggagagcggcatgctgagcgccgtgtggggcgccggcggccccggcgccggcggcgccgccagaggccagcccagcagaaaggagctgctgctgagacaccacctgtggagcggccccagatgcctgagcttccccctgggcagcctgcccgccagcctgctgggcctgcccggcgccaccagccacagaagctgcctgagccccaacctggccagcggcctggccgccagaggcacccagacccagagcgtgctgttcggcgaggtgagactgcccctggacggcggcgtgagaggcgccagaaagagaagcctgctgagagcccaccccagaaccggcatcctgcccggcagatgcggcatggtgtggaaggacaagaagctgcagcccagcggctgccacgagaaggccggcggcgtgttctgcggccccagcagaggcggcgtgtag

SEQ ID NO: 24594 - DNA, 834 bp, Artificial Sequence
  Description of Artificial Sequence: Synthetic coding sequence
cccttcttcagagccagaggcctggagggcgtggtggtggacggccaggtggagaccgccagagtgtggagaggcgacagacccggcaccgagggcaaggaggagagcggcatgctgagcgccgtgtggggcgccggcggccccggcgccggcggcgccgccagaggccagcccagcagaaaggagctgctgctgagacaccacctgtggagcggccccagatgcctgagcttccccctgggcagcctgcccgccagcctgctgggcctgcccggcgccaccagccacagaagctgcctgagccccaacctggccagcggcctggccgccagaggcacccagacccagagcgtgctgttcggcgaggtgagactgcccctggacggcggcgtgagaggcgccagaaagagaatgaacttcgaccacttccagatcctgagagccatcggcaagggcagcttcggcaaggtgagccccagagtgcccagaagaccccaggccagctgcagaaccgccctgtgcccccccggcgtgcactgcgccgaggccggccacggcgaggacgtgagacacgaggtgcacgagcaggccgccgtgcacagagccagaagaggcccccagagactgcccggcgccggcgaccccgccggcgacagagccagactgcccggcgagcccctggtgctgctgcccggcagaggcggccacgtgcacggcagaggccccgccaccggcagaggccccgccctgccccccgccgccgagagagccgtgctgagaggccacggcgaggccgtgcacctgagagacggcaccggcagcggcctgccctag

SEQ ID NO: 24595 - DNA, 1110 bp, Artificial Sequence
  Description of Artificial Sequence: Synthetic coding sequence
atgtacgccatgaagtacatgaacaagcagcagtgcatcgagagagacgaggtgagaaacgtgttcagagagctggagatcctgcaggagatcgagcacgtgttcctggtgaacctgtggtacagcttccaggacgaggaggacatgttcatggtggtggacctgctgctgggcggcgacctgagataccacctgcagcagaacgtgcagttcagcgaggacaccgtgagactgtacatctgcgagatggccctggccctggactacctgagaggccagcacatcatccacagagacgtgaagcccgacaacatcctgctggacgagagaggccacgcccacctgaccgacttcaacatcgccaccatcatcaaggacggcgagagagccaccgccctggccggcaccaagccctacatggcccccgagatcttccacagcttcgtgaacggcggcaccggctacagcttcgaggtggactggtggagcgtgggcgtgatggcctacgagctgctgagaggctggagaccctacgacatccacagcagcaacgccgtggagagcctggtgcagctgttcagcaccgtgagcgtgcagtacgtgcccacctggagcaaggagatggtggccctgctgagaaagctgctgaccgtgaaccccgagcacagactgagcagcctgcaggacgtgcaggccgcccccgccctggccggcgtgctgtgggaccacctgagcgagaagagagtggagcccggcttcgtgcccaacaagggcagactgcactgcgaccccaccttcgagctggaggagatgatcctggagagcagacccctgcacaagaagaagaagagactggccaagaacaagagcagagacaacagcagagacagcagccagagcgagaacgactacctgcaggactgcctggacgccatccagcaggacttcgtgatcttcaacagagagaagctgaagagaagccaggacctgcccagagagcccctgcccgcccccgagagcagagacgccgccgagcccgtggaggacgaggccgagagaagcgccctgcccatgtgcggccccatctgccccagcgccggcagcggctag

SEQ ID NO: 24596 - DNA, 1500 bp, Artificial Sequence
  Description of Artificial Sequence: Synthetic coding sequence
atgctgagcgccgtgtggggcgccggcggccccggcgccggcggcgccgccagaggccagcccagcagaaaggagctgctgctgagacaccacctgtggagcggccccagatgcctgagcttccccctgggcagcctgcccgccagcctgctgggcctgcccggcgccaccagccacagaagctgcctgagccccaacctggccagcggcctggccgccagaggcacccagacccagagcgtgctgttcggcgaggtgagactgcccctggacggcggcgtgagaggcgccagaaagagaatgaacttcgaccacttccagatcctgagagccatcggcaagggcagcttcggcaaggtgtgcatcgtgcagaagagagacaccgagaagatgtacgccatgaagtacatgaacaagcagcagtgcatcgagagagacgaggtgagaaacgtgttcagagagctggagatcctgcaggagatcgagcacgtgttcctggtgaacctgtggtacagcttccaggacgaggaggacatgttcatggtggtggacctgctgctgggcggcgacctgagataccacctgcagcagaacgtgcagttcagcgaggacaccgtgagactgtacatctgcgagatggccctggccctggactacctgagaggccagcacatcatccacagagacgtgaagcccgacaacatcctgctggacgagagaggccacgcccacctgaccgacttcaacatcgccaccatcatcaaggacggcgagagagccaccgccctggccggcaccaagccctacatggcccccgagatcttccacagcttcgtgaacggcggcaccggctacagcttcgaggtggactggtggagcgtgggcgtgatggcctacgagctgctgagaggctggagaccctacgacatccacagcagcaacgccgtggagagcctggtgcagctgttcagcaccgtgagcgtgcagtacgtgcccacctggagcaaggagatggtggccctgctgagaaagctgctgaccgtgaaccccgagcacagactgagcagcctgcaggacgtgcaggccgcccccgccctggccggcgtgctgtgggaccacctgagcgagaagagagtggagcccggcttcgtgcccaacaagggcagactgcactgcgaccccaccttcgagctggaggagatgatcctggagagcagacccctgcacaagaagaagaagagactggccaagaacaagagcagagacaacagcagagacagcagccagagcgagaacgactacctgcaggactgcctggacgccatccagcaggacttcgtgatcttcaacagagagaagctgaagagaagccaggacctgcccagagagcccctgcccgcccccgagagcagagacgccgccgagcccgtggaggacgaggccgagagaagcgccctgcccatgtgcggccccatctgccccagcgccggcagcggctag

SEQ ID NO: 24597 - DNA, 411 bp, Artificial Sequence
  Description of Artificial Sequence: Synthetic coding sequence
tgagccagaggcctggagggcgtggtggtggacggccaggtggagaccgccagagtgtggagaggcgacagacccggcaccgagggcaaggaggagagcggcatgctgagcgccgtgtggggcgccggcggccccggcgccggcggcgccgccagaggccagcccagcagaaaggagctgctgctgagacaccacctgtggagcggccccagatgcctgagcttccccctgggcagcctgcccgccagcctgctgggcctgcccggcgccaccagccacagaagctgcctgagccccaacctggccagcggcctggccgccagaggcacccagacccagagcgtgctgttcggcgaggtgagactgcccctggacggcggcgtgagaggcgccagaaagagaagaagctag

SEQ ID NO: 24598 - DNA, 942 bp, Artificial Sequence
  Description of Artificial Sequence: Synthetic coding sequence
atgcccggcctgctgctgtgcgagcccaccgagctgtacaacatcctgaaccaggccaccaagctgagcagactgaccgaccccaactacctgtgcctgctggacgtgagaagcaagtgggagtacgacgagagccacgtgatcaccgccctgagagtgaagaagaagaacaacgagtacctgctgcccgagagcgtggacctggagtgcgtgaagtactgcgtggtgtacgacaacaacagcagcaccctggagatcctgctgaaggacgacgacgacgacagcgacagcgacggcgacggcaaggacctggtgccccaggccgccatcgagtacggcagaatcctgaccagactgacccaccaccccgtgtacatcctgaagggcggctacgagagattcagcggcacctaccacttcctgagaacccagaagatcatctggatgccccaggagctggacgccttccagccctaccccatcgagatcgtgcccggcaaggtgttcgtgggcaacttcagccaggcctgcgaccccaagatccagaaggacctgaagatcaaggcccacgtgaacgtgagcatggacaccggccccttcttcgccggcgacgccgacaagctgctgcacatcagaatcgaggacagccccgaggcccagatcctgcccttcctgagacacatgtgccacttcatcgagatccaccaccacctgggcagcgtgatcctgatcttcagcacccagggcatcagcagaagctgcgccgccatcatcgcctacctgatgcacagcaacgagcagaccctgcagagaagctgggcctacgtgaagaagtgcaagaacaacatgtgccccaacagaggcctggtgagccagctgctggagtgggagaagaccatcctgggcgacagcatcaccaacatcatggaccccctgtactag

SEQ ID NO: 24599 - DNA, 654 bp, Artificial Sequence
  Description of Artificial Sequence: Synthetic coding sequence
atgcccggcctgctgctgtgcgagcccaccgagctgtacaacatcctgaaccaggccaccaagctgagcagactgaccgaccccaactacctgtgcctgctggacgtgagaagcaagtgggagtacgacgagagccacgtgatcaccgccctgagagtgaagaaggagctggacgccttccagccctaccccatcgagatcgtgcccggcaaggtgttcgtgggcaacttcagccaggcctgcgaccccaagatccagaaggacctgaagatcaaggcccacgtgaacgtgagcatggacaccggccccttcttcgccggcgacgccgacaagctgctgcacatcagaatcgaggacagccccgaggcccagatcctgcccttcctgagacacatgtgccacttcatcgagatccaccaccacctgggcagcgtgatcctgatcttcagcacccagggcatcagcagaagctgcgccgccatcatcgcctacctgatgcacagcaacgagcagaccctgcagagaagctgggcctacgtgaagaagtgcaagaacaacatgtgccccaacagaggcctggtgagccagctgctggagtgggagaagaccatcctgggcgacagcatcaccaacatcatggaccccctgtactag

SEQ ID NO: 24600 - DNA, 942 bp, Artificial Sequence; identical to SEQ ID NO: 24598
  Description of Artificial Sequence: Synthetic coding sequence

SEQ ID NO: 24601 - DNA, 339 bp, Artificial Sequence
  Description of Artificial Sequence: Synthetic coding sequence
atgcccggcctgctgctgtgcgagcccaccgagctgtacaacatcctgaaccaggccaccaagctgagcagactgaccgaccccaactacctgtgcctgctggacgtgagaagcaagtgggagtacgacgagagccacgtgatcaccgccctgagagtgaagaagaagaacaacgagtacctgctgcccgagagcgtggacctggagtgcgtgaagtactgcgtggtgtacgacaacaacagcagcaccctggagatcctgctgaaggacgacgacgacgacagcgacagcgacggcgacggcaagggcaccggctgcatcagcgccatcccccactag

SEQ ID NO: 24602 - DNA, 957 bp, Artificial Sequence
  Description of Artificial Sequence: Synthetic coding sequence
atgcccggcctgctgctgtgcgagcccaccgagctgtacaacatcctgaaccaggccaccaagctgagcagactgaccgaccccaactacctgtgcctgctggacgtgagaagcaagtgggagtacgacgagagccacgtgatcaccgccctgagagtgaagaagaagaacaacgagtacctgctgcccgagagcgtggacctggagtgcgtgaagtactgcgtggtgtacgacaacaacagcagcaccctggagatcctgctgaaggacgacgacgacgacagcgacagcgacggcgacggcaaggacctggtgccccaggccgccatcgagtacggcagaatcctgaccagactgacccaccaccccgtgtacatcctgaagggcggctacgagagattcagcggcacctaccacttcctgagaacccagaagatcatctggatgccccaggagctggacgccttccagccctaccccatcgagatcgtgcccggcaaggtgttcgtgggcaacttcagccaggcctgcgaccccaagatccagaaggacctgaagatcaaggcccacgtgaacgtgagcatggacaccggccccttcttcgccggcgacgccgacaagctgctgcacatcagaatcgaggacagccccgaggcccagatcctgcccttcctgagacacatgtgccacttcatcgaggtgctgggcctgtgccaggaggtgcagaagcagcacgtgagcaagagcggcatcggcgagcccgccgccggcatgggcgaggactacccctggagattccaccacaagcaccacggcagcgccctgctgatcttcagcgaggcccacagaagagtgctgaagagcctgacctggggccacttcgtgggcggcggccccgagtgcgtgtaccccggcctgagcggcagaagaagacccctgctgcccgagagcctgtag

SEQ ID NO: 24603 - DNA, 942 bp, Artificial Sequence; identical to SEQ ID NO: 24598
  Description of Artificial Sequence: Synthetic coding sequence

SEQ ID NO: 24604 - DNA, 942 bp, Artificial Sequence; identical to SEQ ID NO: 24598
  Description of Artificial Sequence: Synthetic coding sequence

SEQ ID NO: 24605 - DNA, 1311 bp, Artificial Sequence
  Description of Artificial Sequence: Synthetic coding sequence
atgaccgccgtgtacatgaacggcggcggcctggtgaacccccactacgccagatgggacagaagagacagcgtggagagcggctgccagaccgagagcagcaaggagggcgaggagggccagcccagacagctgacccccttcgagaagctgacccaggacatgagccaggacgagaaggtggtgagagagatcaccctgggcaagagaatcggcttctacagaatcagaggcgagatcggcagcggcaacttcagccaggtgaagctgggcatccacagcctgaccaaggagaaggtggccatcaagatcctggacaagaccaagctggaccagaagacccagagactgctgagcagagagatcagcagcatggagaagctgcaccaccccaacatcatcagactgtacgaggtggtggagaccctgagcaagctgcacctggtgatggagtacgccggcggcggcgagctgttcggcaagatcagcaccgagggcaagctgagcgagcccgagagcaagctgatcttcagccagatcgtgagcgccgtgaagcacatgcacgagaaccagatcatccacagagacctgaaggccgagaacgtgttctacaccagcaacacctgcgtgaaggtgggcgacttcggcttcagcaccgtgagcaagaagggcgagatgctgaacaccttctgcggcagccccccctacgccgcccccgagctgttcagagacgagcactacatcggcatctacgtggacatctgggccctgggcgtgctgctgtacttcatggtgaccggcaccatgcccttcagagccgagaccgtggccaagctgaagaagagcatcctggagggcacctacagcgtgcccccccacgtgagcgagccctgccacagactgatcagaggcgtgctgcagcagatccccaccgagagatacggcatcgactgcatcatgaacgacgagtggatgcagggcgtgccctaccccacccccctggagcccttccagctggaccccaagcacctgagcgagaccagcaccctgaaggaggaggagaacgaggtgaagagcaccctggagcacctgggcatcaccgaggagcacatcagaaacaaccagggcagagacgccagaagcagcatcaccggcgtgtacagaatcatcctgcacagagtgcagagaaagaaggccctggagagcgtgcccgtgatgatgctgcccgaccccaaggagagagacctgaagaagggcagcagagtgtacagaggcatcagacacaccagcaagttctgcagcatcctgtag

SEQ ID NO: 24606 - DNA, 1311 bp, Artificial Sequence; identical to SEQ ID NO: 24605
  Description of Artificial Sequence: Synthetic coding sequence

SEQ ID NO: 24607 - DNA, 1140 bp, Artificial Sequence
  Description of Artificial Sequence: Synthetic coding sequence
atggagcagctgagcagcgccaacaccagattcgccctggacctgttcctggccctgagcgagaacaaccccgccggcaacatcttcatcagccccttcagcatcagcagcgccatggccatggtgttcctgggcaccagaggcaacaccgccgcccagctgagcaagaccttccacttcaacaccgtggaggaggtgcacagcagattccagagcctgaacgccgacatcaacaagagaggcgccagctacatcctgaagctggccaacagactgtacggcgagaagacctacaacttcctgcccgagttcctggtgagcacccagaagacctacggcgccgacctggccagcgtggacttccagcacgccagcgaggacgccagaaagaccatcaaccagtgggtgaagggccagaccgagggcaagatccccgagctgctggccagcggcatggtggacaacatgaccaagctggtgctggtgaacgccatctacttcaagggcaactggaaggacaagttcatgaaggaggccaccaccaacgcccccttcagactgaacaagaaggacagaaagaccgtgaagatgatgtaccagaagaagaagttcgcctacggctacatcgaggacctgaagtgcagagtgctggagctgccctaccagggcgaggagctgagcatggtgatcctgctgcccgacgacatcgaggacgagagcaccggcctgaagaagatcgaggagcagctgaccctggagaagctgcacgagtggaccaagcccgagaacctggacttcatcgaggtgaacgtgagcctgcccagattcaagctggaggagagctacaccctgaacagcgacctggccagactgggcgtgcaggacctgttcaacagcagcaaggccgacctgagcggcatgagcggcgccagagacatcttcatcagcaagatcgtgcacaagagcttcgtggaggtgaacgaggagggcaccgaggccgccgccgccaccgccggcatcgccaccttctgcatgctgatgcccgaggagaacttcaccgccgaccaccccttcctgttcttcatcagacacaacagcagcggcagcatcctgttcctgggcagattcagcagcccctag

SEQ ID NO: 24608 - DNA, 687 bp, Artificial Sequence
  Description of Artificial Sequence: Synthetic coding sequence
atggtggacaacatgaccaagctggtgctggtgaacgccatctacttcaagggcaactggaaggacaagttcatgaaggaggccaccaccaacgcccccttcagactgaacaagaaggacagaaagaccgtgaagatgatgtaccagaagaagaagttcgcctacggctacatcgaggacctgaagtgcagagtgctggagctgccctaccagggcgaggagctgagcatggtgatcctgctgcccgacgacatcgaggacgagagcaccggcctgaagaagatcgaggagcagctgaccctggagaagctgcacgagtggaccaagcccgagaacctggacttcatcgaggtgaacgtgagcctgcccagattcaagctggaggagagctacaccctgaacagcgacctggccagactgggcgtgcaggacctgttcaacagcagcaaggccgacctgagcggcatgagcggcgccagagacatcttcatcagcaagatcgtgcacaagagcttcgtggaggtgaacgaggagggcaccgaggccgccgccgccaccgccggcatcgccaccttctgcatgctgatgcccgaggagaacttcaccgccgaccaccccttcctgttcttcatcagacacaacagcagcggcagcatcctgttcctgggcagattcagcagcccctag

SEQ ID NO: 24609 - DNA, 1026 bp, Artificial Sequence
  Description of Artificial Sequence: Synthetic coding sequence
atggccatggtgttcctgggcaccagaggcaacaccgccgcccagctgagcaagaccttccacttcaacaccgtggaggaggtgcacagcagattccagagcctgaacgccgacatcaacaagagaggcgccagctacatcctgaagctggccaacagactgtacggcgagaagacctacaacttcctgcccgagttcctggtgagcacccagaagacctacggcgccgacctggccagcgtggacttccagcacgccagcgaggacgccagaaagaccatcaaccagtgggtgaagggccagaccgagggcaagatccccgagctgctggccagcggcatggtggacaacatgaccaagctggtgctggtgaacgccatctacttcaagggcaactggaaggacaagttcatgaaggaggccaccaccaacgcccccttcagactgaacaagaaggacagaaagaccgtgaagatgatgtaccagaagaagaagttcgcctacggctacatcgaggacctgaagtgcagagtgctggagctgccctaccagggcgaggagctgagcatggtgatcctgctgcccgacgacatcgaggacgagagcaccggcctgaagaagatcgaggagcagctgaccctggagaagctgcacgagtggaccaagcccgagaacctggacttcatcgaggtgaacgtgagcctgcccagattcaagctggaggagagctacaccctgaacagcgacctggccagactgggcgtgcaggacctgttcaacagcagcaaggccgacctgagcggcatgagcggcgccagagacatcttcatcagcaagatcgtgcacaagagcttcgtggaggtgaacgaggagggcaccgaggccgccgccgccaccgccggcatcgccaccttctgcatgctgatgcccgaggagaacttcaccgccgaccaccccttcctgttcttcatcagacacaacagcagcggcagcatcctgttcctgggcagattcagcagcccctag

SEQ ID NO: 24610 - DNA, 654 bp, Artificial Sequence
  Description of Artificial Sequence: Synthetic coding sequence
atggtgctggtgaacgccatctacttcaagggccagtggcagaacaagttccaggtgagagagaccgtgaagagccccttccagctgagcgagggcaagaacgtgaccgtggagatgatgtaccagatcggcaccttcaagctggccttcgtgaaggagccccagatgcaggtgctggagctgccctacgtgaacaacaagctgagcatgatcatcctgctgcccgtgggcatcgccaacctgaagcagatcgagaagcagctgaacagcggcaccttccacgagtggaccagcagcagcaacatgatggagagagaggtggaggtgcacctgcccagattcaagctggagaccaagtacgagctgaacagcctgctgaagagcctgggcgtgaccgacctgttcaaccaggtgaaggccgacctgagcggcatgagccccaccaagggcctgtacctgagcaaggccatccacaagagctacctggacgtgagcgaggagggcaccgaggccgccgccgccaccggcgacagcatcgccgtgaagagcctgcccatgagagcccagttcaaggccaaccaccccttcctgttcttcatcagacacacccacaccaacaccatcctgttctgcggcaagctggccagcccctag

SEQ ID NO: 24611 - DNA, 573 bp, Artificial Sequence
  Description of Artificial Sequence: Synthetic coding sequence
atgggcagcctgagcaccgccaacgtggagttctgcctggacgtgttcaaggagctgaacagcaacaacatcggcgacaacatcttcttcagcagcctgagcctgctgtacgccctgagcatggtgctgctgggcgccagaggcgagaccgaggagcagctggagaagatcgagaagcagctgaacagcggcaccttccacgagtggaccagcagcagcaacatgatggagagagaggtggaggtgcacctgcccagattcaagctggagaccaagtacgagctgaacagcctgctgaagagcctgggcgtgaccgacctgttcaaccaggtgaaggccgacctgagcggcatgagccccaccaagggcctgtacctgagcaaggccatccacaagagctacctggacgtgagcgaggagggcaccgaggccgccgccgccaccggcgacagcatcgccgtgaagagcctgcccatgagagcccagttcaaggccaaccaccccttcctgttcttcatcagacacacccacaccaacaccatcctgttctgcggcaagctggccagcccctag

SEQ ID NO: 24612 - DNA, 1179 bp, Artificial Sequence
  Description of Artificial Sequence: Synthetic coding sequence
atgggcagcctgagcaccgccaacgtggagttctgcctggacgtgttcaaggagctgaacagcaacaacatcggcgacaacatcttcttcagcagcctgagcctgctgtacgccctgagcatggtgctgctgggcgccagaggcgagaccgaggagcagctggagaaggtgctgcacttcagccacaccgtggacagcctgaagcccggcttcaaggacagccccaagtgcagccaggccggcagaatccacagcgagttcggcgtggagttcagccagatcaaccagcccgacagcaactgcaccctgagcatcgccaacagactgtacggcaccaagaccatggccttccaccagcagtacctgagctgcagcgagaagtggtaccaggccagactgcagaccgtggacttcgagcagagcaccgaggagaccagaaagaccatcaacgcctgggtggagaacaagaccaacggcaaggtggccaacctgttcggcaagagcaccatcgaccccagcagcgtgatggtgctggtgaacgccatctacttcaagggccagtggcagaacaagttccaggtgagagagaccgtgaagagccccttccagctgagcgagggcaagaacgtgaccgtggagatgatgtaccagatcggcaccttcaagctggccttcgtgaaggagccccagatgcaggtgctggagctgccctacgtgaacaacaagctgagcatgatcatcctgctgcccgtgggcatcgccaacctgaagcagatcgagaagcagctgaacagcggcaccttccacgagtggaccagcagcagcaacatgatggagagagaggtggaggtgcacctgcccagattcaagctggagaccaagtacgagctgaacagcctgctgaagagcctgggcgtgaccgacctgttcaaccaggtgaaggccgacctgagcggcatgagccccaccaagggcctgtacctgagcaaggccatccacaagagctacctggacgtgagcgaggagggcaccgaggccgccgccgccaccggcgacagcatcgccgtgaagagcctgcccatgagagcccagttcaaggccaaccaccccttcctgttcttcatcagacacacccacaccaacaccatcctgttctgcggcaagctggccagcccctag

SEQ ID NO: 24613 - DNA, 1071 bp, Artificial Sequence
  Description of Artificial Sequence: Synthetic coding sequence
atgaccctggtgctgagcatgaacagattctgcgagcccatcgtgagcgagggcgccgccgagatcgccggctaccagaccctgtgggaggccgacagctacggcggccccagcccccccggccccgcccaggcccccctgcagggcgacagaggcgccggcccccccctggccggcagccactacagaggcatcagcaaccccatcaccaccagcaagatcacctacttcaagagaaagtacgtggaggaggaggacttccacccccccctgagcagctgcagccacaagaccatcagcatcttcgaggagagagcccacatcctgtacatgagcctggagaagctgaagttcatcgacgaccccgaggtgtacctgagaagaagcgtgctgatcaacaacctgatgaagagaatccacggcgagatcatcatgcagaacaactggtgcttccccgcctgcagcttcaacggcaccagcgcccaggagtggttcatggcccaggactgcccctacagaaagagacccagaatggccaaggaggagtgcgagaagttccacgcctgctgcttctaccaggagtgcggcggccactacctgaacctgcccctgagcgtgaacgccaacgtgggcagcgccagcaccgccgccagcagccccagcgccagcagcagcagcagcagcagcagcagcagcccccccctgcccctgcccagctgcagcagacaggtggacttcgacgtgggcagcgccagcatctacaagagcgacggccagatccccgccaacgagatcttcgtgaccaacgtgagaagcctgggcgtgcaggagaaggccaagctgaacgacgagaaggccaacgacgacaccaacagagacggcggccccctgagccacgagcccgtgggcaacgacctggccttcgagtgcaagggccagttctacgactacttcgagaccggctacaacgagagaaacaacgtgaacgagagctggaagaagagcctgagaaagaaggaggccagcccccccagcaacaagctgtgctgcagcaagggcagcaagatctag

SEQ ID NO: 24614 - DNA, 447 bp, Artificial Sequence
  Description of Artificial Sequence: Synthetic coding sequence
atgcaggaggtgggcgtgggcctgtaccccagcatcagcctgctgaaccacagctgcgaccccaactgcagcatcgtgttcaacggcccccacctgctgctgagagccgtgagagacatcgaggtgggcgaggagctgaccatctgctacctggacatgctgatgaccagcgaggagagaagaaagcagctgagagaccagtactgcttcgagtgcgactgcttcagatgccagacccaggacaaggacgccgacatgctgaccggcgacgagcaggtgtggaaggaggtgcaggagagcctgaagaagatcgaggagctgaaggcccactggaagtgggagcaggtgctggccatgtgccaggccatcatcagcagcaacagcgagagactgcccgacatcaacatctaccagctgaaggtgctggactgcgccatggacgcctag

SEQ ID NO: 24615 - DNA, 396 bp, Artificial Sequence
  Description of Artificial Sequence: Synthetic coding sequence
atgagatgcagccagtgcagagtggccaagtactgcagcgccaagtgccagaagaaggcctggcccgaccacaagagagagtgcaagtgcctgaagagctgcaagcccagatacccccccgacagcgtgagactgctgggcagagtggtgttcaagctgatggacggcgcccccagcgagagcgagaagctgtacagcttctacgacctggagagcaacatcaacaagctgaccgaggacaagaaggagggcctgagacagctggtgatgaccttccagcacttcatgagagaggagatccaggacgccagccagctgccccccgccttcgacctgttcgaggccttcgccaaggtgatctgcaacagcttcaccatctgcaacgccgagatgtag

SEQ ID NO: 24616 - DNA, 225 bp, Artificial Sequence
  Description of Artificial Sequence: Synthetic coding sequence
atgagatgcagccagtgcagagtggccaagtactgcagcgccaagtgccagaagaaggcctggcccgaccacaagagagagtgcaagtgcctgaagagctgcaagcccagatacccccccgacagcgtgagactgctgggcagagtggtgttcaagctgatggacggcgcccccagcgagagcgagaagctgtacagcttctacgacctggagagcaacatctag

SEQ ID NO: 24617 - DNA, 1110 bp, Artificial Sequence
  Description of Artificial Sequence: Synthetic coding sequence
atgagatgcagccagtgcagagtggccaagtactgcagcgccaagtgccagaagaaggcctggcccgaccacaagagagagtgcaagtgcctgaagagctgcaagcccagatacccccccgacagcgtgagactgctgggcagagtggtgttcaagctgatggacggcgcccccagcgagagcgagaagctgtacagcttctacgacctggagagcaacatcaacaagctgaccgaggacaagaaggagggcctgagacagctggtgatgaccttccagcacttcatgagagaggagatccaggacgccagccagctgccccccgccttcgacctgttcgaggccttcgccaaggtgatctgcaacagcttcaccatctgcaacgccgagatgcaggaggtgggcgtgggcctgtaccccagcatcagcctgctgaaccacagctgcgaccccaactgcagcatcgtgttcaacggcccccacctgctgctgagagccgtgagagacatcgaggtgggcgaggagctgaccatctgctacctggacatgctgatgaccagcgaggagagaagaaagcagctgagagaccagtactgcttcgagtgcgactgcttcagatgccagacccaggacaaggacgccgacatgctgaccggcgacgagcaggtgtggaaggaggtgcaggagagcctgaagaagatcgaggagctgaaggcccactggaagtgggagcaggtgctggccatgtgccaggccatcatcagcagcaacagcgagagactgcccgacatcaacatctaccagctgaaggtgctggactgcgccatggacgcctgcatcaacctgggcctgctggaggaggccctgttctacggcaccagaaccatggagccctacagaatcttcttccccggcagccaccccgtgagaggcgtgcaggtgatgaaggtgggcaagctgcagctgcaccagggcatgttcccccaggccatgaagaacctgagactggccttcgacatcatgagagtgacccacggcagagagcacagcctgatcgaggacctgatcctgctgctggaggagtgcgacgccaacatcagagccagctag

SEQ ID NO: 24618 - DNA, 1110 bp, Artificial Sequence; identical to SEQ ID NO: 24617
  Description of Artificial Sequence: Synthetic coding sequence

SEQ ID NO: 24619 - DNA, 777 bp, Artificial Sequence
  Description of Artificial Sequence: Synthetic coding sequence
atggaggaggacagagacaaggtgatctgcaacagcttcaccatctgcaacgccgagatgcaggaggtgggcgtgggcctgtaccccagcatcagcctgctgaaccacagctgcgaccccaactgcagcatcgtgttcaacggcccccacctgctgctgagagccgtgagagacatcgaggtgggcgaggagctgaccatctgctacctggacatgctgatgaccagcgaggagagaagaaagcagctgagagaccagtactgcttcgagtgcgactgcttcagatgccagacccaggacaaggacgccgacatgctgaccggcgacgagcaggtgtggaaggaggtgcaggagagcctgaagaagatcgaggagctgaaggcccactggaagtgggagcaggtgctggccatgtgccaggccatcatcagcagcaacagcgagagactgcccgacatcaacatctaccagctgaaggtgctggactgcgccatggacgcctgcatcaacctgggcctgctggaggaggccctgttctacggcaccagaaccatggagccctacagaatcttcttccccggcagccaccccgtgagaggcgtgcaggtgatgaaggtgggcaagctgcagctgcaccagggcatgttcccccaggccatgaagaacctgagactggccttcgacatcatgagagtgacccacggcagagagcacagcctgatcgaggacctgatcctgctgctggaggagtgcgacgccaacatcagagccagctag

SEQ ID NO: 24620 - DNA, 2415 bp, Artificial Sequence
  Description of Artificial Sequence: Synthetic coding sequence
atggacctgcccgtggacgagtggaagagctacctgctgcagaagtgggccagcctgcccaccagcgtgcaggtgaccatcagcaccgccgagaccctgagagacatcttcctgcacagcagcagcctgctgcagcccgaggacgagctgttcctgaagagactgagcaagggctacctggtgggcaaggacagcgacgcccccctgttctacagagaggagggcaacaagaagttccaggagaaggactacaccggcgccgccgtgctgtacagcaagggcgtgagccacagcagacccaacaccgaggacatgagcctgtgccacgccaacagaagcgccgccctgttccacctgggccagtacgagacctgcctgaaggacatcaacagagcccagacccacggctaccccgagagactgcagcccaagatcatgctgagaaaggccgagtgcctggtggccctgggcagactgcaggaggccagccagaccatcagcgacctggagagaaacttcaccgccacccccgccctggccgacgtgctgccccagaccctgcagagaaacctgcacagactgaagatgaagatgcaggagaaggacagcctgaccgagagcttccccgccgccctggccaagaccctggaggacgccgccctgagagaggagaacgagcagctgagcaacgccagcagcagcatcggcctgtgcgtggaccccctgaagggcagatgcctggtggccaccaaggacatcctgcccggcgagctgctggtgcaggaggacgccttcgtgagcgtgctgaaccccggcgagctgccccccccccaccacggcctggacagcaagtgggacaccagagtgaccaacggcgacctgtactgccacagatgcctgaagcacaccctggccaccgtgccctgcgacggctgcagctacgccaagtactgcagccaggagtgcctgcagcaggcctgggagctgtaccacagaaccgagtgccccctgggcggcctgctgctgaccctgggcgtgttctgccacatcgccctgagactgaccctgctggtgggcttcgaggacgtgagaaagatcatcaccaagctgtgcgacaagatcagcaacaaggacatctgcctgcccgagagcaacaaccaggtgaagaccctgaactacggcctgggcgagagcgagaagaacggcaacatcgtggagacccccatccccggctgcgacatcaacggcaagtacgagaacaactacaacgccgtgttcaacctgctgccccacaccgagaaccacagccccgagcacaagttcctgtgcgccctgtgcgtgagcgccctgtgcagacagctggaggccgccagcctgcaggccatccccaccgagagaatcgtgaacagcagccagctgaaggccgccgtgacccccgagctgtgccccgacgtgaccatctggggcgtggccatgctgagacacatgctgcagctgcagtgcaacgcccaggccatgaccaccatccagcacaccggccccaagggcagcatcgtgaccgacagcagacaggtgagactggccaccggcatcttccccgtgatcagcctgctgaaccacagctgcagccccaacaccagcgtgagcttcatcagcaccgtggccaccatcagagccagccagagaatcagaaagggccaggagatcctgcactgctacggcccccacaagagcagaatgggcgtggccgagagacagcagaagctgagaagccagtacttcttcgactgcgcctgccccgcctgccagaccgaggcccacagaatggccgccggccccagatgggaggccttctgctgcaacagctgcggcgcccccatgcagggcgacgacgtgctgagatgcggcagcagaagctgcgccgagagcgccgtgagcagagaccacctggtgagcagactgcaggacctgcagcagcaggtgagagtggcccagaagctgctgagagacggcgagctggagagagccgtgcagagactgagcggctgccagagagacgccgagagcttcctgtgggccgagcacgccgtggtgggcgagatcgccgacggcctggccagagcctgcgccgccctgggcgactggcagaagagcgccacccacctgcagagaagcctgtacgtggtggaggtgagacacggccccagcagcgtggagatgggccacgagctgttcaagctggcccagatcttcttcaacggcttcgccgtgcccgaggccctgagcaccatccagaaggccgaggaggtgctgagcctgcactgcggcccctgggacgacgagatccaggagctgcagaagatgaagagctgcctgctggacctgccccccacccccgtgggccccgccctgtag

SEQ ID NO: 24621 - DNA, 1059 bp, Artificial Sequence
  Description of Artificial Sequence: Synthetic coding sequence
atggccagaggcagaaagatgagcaagcccagagccgtggaggccgccgccgccgccgccgccgtggccgccaccgcccccggccccgagatggtggagagaagaggccccggcagacccagaaccgacggcgagaacgtgttcaccggccagagcaagatctacagctacatgagccccaacaagtgcagcggcatgagattccccctgcaggaggagaacagcgtgacccaccacgaggtgaagtgccagggcaagcccctggccggcatctacagaaagagagaggagaagagaaacgccggcaacgccgtgagaagcgccatgaagagcgaggagcagaagatcaaggacgccagaaagggccccctggtgcccttccccaaccagaagagcgaggccgccgagccccccaagaccccccccagcagctgcgacagcaccaacgccgccatcgccaagcaggccctgaagaagcccatcaagggcaagcaggcccccagaaagaaggcccagggcaagacccagcagaacagaaagctgaccgacttctaccccgtgagaagaagcagcagaaagagcaaggccgagctgcagagcgaggagagaaagagaatcgacgagctgatcgagagcggcaaggaggagggcatgaagatcgacctgatcgacggcaagggcagaggcgtgatcgccaccaagcagttcagcagaggcgacttcgtggtggagtaccacggcgacctgatcgagatcaccgacgccaagaagagagaggccctgtacgcccaggaccccagcaccggctgctacatgtactacttccagtacctgagcaagacctactgcgtggacgccaccagagagaccaacagactgggcagactgatcaaccacagcaagtgcggcaactgccagaccaagctgcacgacatcgacggcgtgccccacctgatcctgatcgccagcagagacatcgccgccggcgaggagctgctgtacgactacggcgacagaagcaaggccagcatcgaggcccacccctggctgaagcactag

SEQ ID NO: 24622 - DNA, 1059 bp, Artificial Sequence; identical to SEQ ID NO: 24621
  Description of Artificial Sequence: Synthetic coding sequence

SEQ ID NO: 24623 - DNA, 1323 bp, Artificial Sequence
  Description of Artificial Sequence: Synthetic coding sequence
atgcagaagggcaagggcagaaccagcagaatcagaagaagaaagctgtgcggcagcagcgagagcagaggcgtgaacgagagccacaagagcgagttcatcgagctgagaaagtggctgaaggccagaaagttccaggacagcaacctggcccccgcctgcttccccggcaccggcagaggcctgatgagccagaccagcctgcaggagggccagatgatcatcagcctgcccgagagctgcctgctgaccaccgacaccgtgatcagaagctacctgggcgcctacatcaccaagtggaagcccccccccagccccctgctggccctgtgcaccttcctggtgagcgagaagcacgccggccacagaagcctgtggaagccctacctggagatcctgcccaaggcctacacctgccccgtgtgcctggagcccgaggtggtgaacctgctgcccaagagcctgaaggccaaggccgaggagcagagagcccacgtgcaggagttcttcgccagcagcagagacttcttcagcagcctgcagcccctgttcgccgaggccgtggacagcatcttcagctacagcgccctgctgtgggcctggtgcaccgtgaacaccagagccgtgtacctgagacccagacagagagagtgcctgagcgccgagcccgacacctgcgccctggccccctacctggacctgctgaaccacagcccccacgtgcaggtgaaggccgccttcaacgaggagacccacagctacgagatcagaaccaccagcagatggagaaagcacgaggaggtgttcatctgctacggcccccacgacaaccagagactgttcctggagtacggcttcgtgagcgtgcacaacccccacgcctgcgtgtacgtgagcagagagatcctggtgaagtacctgcccagcaccgacaagcagatggacaagaagatcagcatcctgaaggaccacggctacatcgagaacctgaccttcggctgggacggccccagctggagactgctgaccgccctgaagctgctgtgcctggaggccgagaagttcacctgctggaagaaggtgctgctgggcgaggtgatcagcgacaccaacgagaagaccagcctggacatcgcccagaagatctgctactacttcatcgaggagaccaacgccgtgctgcagaaggtgagccacatgaaggacgagaaggaggccctgatcaaccagctgaccctggtggagagcctgtggaccgaggagctgaagatcctgagagccagcgccgagaccctgcacagcctgcagaccgccttcacctag

SEQ ID NO: 24624 - DNA, 852 bp, Artificial Sequence
  Description of Artificial Sequence: Synthetic coding sequence
atgaacgagagccacaagagcgagttcatcgagctgagaaagtggctgaaggccagaaagttccaggacagcaacctggcccccgcctgcttccccggcaccggcagaggcctgatgagccagaccagcctgcaggagggccagatgatcatcagcctgcccgagagctgcctgctgaccaccgacaccgtgatcagaagctacctgggcgcctacatcaccaagtggaagcccccccccagccccctgctggccctgtgcaccttcctggtgagcgagaagcacgccggccacagaagcctgtggaagccctacctggagatcctgcccaaggcctacacctgccccgtgtgcctggagcccgaggtggtgaacctgctgcccaagagcctgaaggccaaggccgaggagcagagagcccacgtgcaggagttcttcgccagcagcagagacttcttcagcagcctgcagcccctgttcgccgaggccgtggacagcatcttcagctacagcgccctgctgtgggcctggtgcaccgtgaacaccagagccgtgtacctgagacccagacagagagagtgcctgagcgccgagcccgacacctgcgccctggccccctacctggacctgctgaaccacagcccccacgtgcaggtgaaggccgccttcaacgaggagacccacagctacgagatcagaaccaccagcagatggagaaagcacgaggaggtgttcatctgctacggcccccacgacaaccagagactgttcctggagtacggcttcgtgagcgtgcacaacccccacgcctgcgtgtacgtgagcagaggctggaaccagctgtgcagctag

SEQ ID NO: 24625 - DNA, 852 bp, Artificial Sequence; identical to SEQ ID NO: 24624
  Description of Artificial Sequence: Synthetic coding sequence

SEQ ID NO: 24626 - DNA, 924 bp, Artificial Sequence
  Description of Artificial Sequence: Synthetic coding sequence
atgcagaagggcaagggcagaaccagcagaatcagaagaagaaagctgtgcggcagcagcgagagcagaggcgtgaacgagagccacaagagcgagttcatcgagctgagaaagtggctgaaggccagaaagttccaggacagcaacctggcccccgcctgcttccccggcaccggcagaggcctgatgagccagaccagcctgcaggagggccagatgatcatcagcctgcccgagagctgcctgctgaccaccgacaccgtgatcagaagctacctgggcgcctacatcaccaagtggaagcccccccccagccccctgctggccctgtgcaccttcctggtgagcgagaagcacgccggccacagaagcctgtggaagccctacctggagatcctgcccaaggcctacacctgccccgtgtgcctggagcccgaggtggtgaacctgctgcccaagagcctgaaggccaaggccgaggagcagagagcccacgtgcaggagttcttcgccagcagcagagacttcttcagcagcctgcagcccctgttcgccgaggccgtggacagcatcttcagctacagcgccctgctgtgggcctggtgcaccgtgaacaccagagccgtgtacctgagacccagacagagagagtgcctgagcgccgagcccgacacctgcgccctggccccctacctggacctgctgaaccacagcccccacgtgcaggtgaaggccgccttcaacgaggagacccacagctacgagatcagaaccaccagcagatggagaaagcacgaggaggtgttcatctgctacggcccccacgacaaccagagactgttcctggagtacggcttcgtgagcgtgcacaacccccacgcctgcgtgtacgtgagcagaggctggaaccagctgtgcagctag

SEQ ID NO: 24627 - DNA, 924 bp, Artificial Sequence; identical to SEQ ID NO: 24626
  Description of Artificial Sequence: Synthetic coding sequence

SEQ ID NO: 24628 - DNA, 1251 bp, Artificial Sequence
  Description of Artificial Sequence: Synthetic coding sequence
atgaacgagagccacaagagcgagttcatcgagctgagaaagtggctgaaggccagaaagttccaggacagcaacctggcccccgcctgcttccccggcaccggcagaggcctgatgagccagaccagcctgcaggagggccagatgatcatcagcctgcccgagagctgcctgctgaccaccgacaccgtgatcagaagctacctgggcgcctacatcaccaagtggaagcccccccccagccccctgctggccctgtgcaccttcctggtgagcgagaagcacgccggccacagaagcctgtggaagccctacctggagatcctgcccaaggcctacacctgccccgtgtgcctggagcccgaggtggtgaacctgctgcccaagagcctgaaggccaaggccgaggagcagagagcccacgtgcaggagttcttcgccagcagcagagacttcttcagcagcctgcagcccctgttcgccgaggccgtggacagcatcttcagctacagcgccctgctgtgggcctggtgcaccgtgaacaccagagccgtgtacctgagacccagacagagagagtgcctgagcgccgagcccgacacctgcgccctggccccctacctggacctgctgaaccacagcccccacgtgcaggtgaaggccgccttcaacgaggagacccacagctacgagatcagaaccaccagcagatggagaaagcacgaggaggtgttcatctgctacggcccccacgacaaccagagactgttcctggagtacggcttcgtgagcgtgcacaacccccacgcctgcgtgtacgtgagcagagagatcctggtgaagtacctgcccagcaccgacaagcagatggacaagaagatcagcatcctgaaggaccacggctacatcgagaacctgaccttcggctgggacggccccagctggagactgctgaccgccctgaagctgctgtgcctggaggccgagaagttcacctgctggaagaaggtgctgctgggcgaggtgatcagcgacaccaacgagaagaccagcctggacatcgcccagaagatctgctactacttcatcgaggagaccaacgccgtgctgcagaaggtgagccacatgaaggacgagaaggaggccctgatcaaccagctgaccctggtggagagcctgtggaccgaggagctgaagatcctgagagccagcgccgagaccctgcacagcctgcagaccgccttcacctag

SEQ ID NO: 24629 - DNA, 1323 bp, Artificial Sequence; identical to SEQ ID NO: 24623
  Description of Artificial Sequence: Synthetic coding sequence

SEQ ID NO: 24630 - DNA, 696 bp, Artificial Sequence
  Description of Artificial Sequence: Synthetic coding sequence
atgcagaagggcaagggcagaaccagcagaatcagaagaagaaagctgtgcggcagcagcgagagcagaggcgtgaacgagagccacaagagcgagttcatcgagctgagaaagtggctgaaggccagaaagttccaggacagcaacctggcccccgcctgcttccccggcaccggcagaggcctgatgagccagaccagcctgcaggagggccagatgatcatcagcctgcccgagagctgcctgctgaccaccgacaccgtgatcagaagctacctgggcgcctacatcaccaagtggaagcccccccccagccccctgctggccctgtgcaccttcctggtgagcgagaagcacgccggccacagaagcctgtggaagccctacctggagatcctgcccaaggcctacacctgccccgtgtgcctggagcccgaggtggtgaacctgctgcccaagagcctgaaggccaaggccgaggagcagagagcccacgtgcaggagttcttcgccagcagcagagacttcttcagcagcctgcagcccctgttcgccgaggccgtggacagcatcttcagctacagcgccctgctgtgggcctggtgcaccgtgaacaccagagccgtgtacctgagacccagacagagagagtgcctgagcgccgagcccgacacctgcgccctggccccctactag

SEQ ID NO: 24631 - DNA, 678 bp, Artificial Sequence
  Description of Artificial Sequence: Synthetic coding sequence
atgcagaagggcaagggcagaaccagcagaatcagaagaagaaagctgtgcggcagcagcgagagcagaggcgtgaacgagagccacaagagcgagttcatcgagctgagaaagtggctgaaggccagaaagttccaggacagcaacctggcccccgcctgcttccccggcaccggcagaggcctgatgagccagaccagcctgcaggagggccagatgatcatcagcctgcccgagagctgcctgctgaccaccgacaccgtgatcagaagctacctgggcgcctacatcaccaagtggaagcccccccccagccccctgctggccctgtgcaccttcctggtgagcgagaagcacgccggccacagaagcctgtggaagccctacctggagatcctgcccaaggcctacacctgccccgtgtgcctggagcccgaggtggtgaacctgctgcccaagagcctgaaggccaaggccgaggagcagagagcccacgtgcaggagttcttcgccagcagcagagacttcttcagcagcctgcagcccctgttcgccgaggccgtggacagcatcttcagctacagcgccctgctgtgggcctggtgcaccgtgaacaccagagccgtgtacctgagacccagacagagagagtgcctgagcgccgagcccgacacctag

SEQ ID NO: 24632 - DNA, 213 bp, Artificial Sequence
  Description of Artificial Sequence: Synthetic coding sequence
atgaacgagagccacaagagcgagttcatcgagctgagaaagtggctgaaggccagaaagttccaggacagcaacctggcccccgcctgcttccccggcaccggcagaggcctgatgagccagaccagcctgcaggagggccagatgatcatcagcctgcccgagagctgcctgctgaccaccgacaccgtgatcagaagctacctgggctag

SEQ ID NO: 24633 - DNA, 204 bp, Artificial Sequence
  Description of Artificial Sequence: Synthetic coding sequence
atgcagaagggcaagggcagaaccagcagaatcagaagaagaaagctgtgcggcagcagcgagagcagaggcgtgaacgagagccacaagagcgagttcatcgagctgagaaagtggctgaaggccagaaagttccaggacagcaacctggcccccgcctgcttccccggcaccggcagaggcctgatgagccagaccagctag

SEQ ID NO: 24634 - DNA, 375 bp, Artificial Sequence
  Description of Artificial Sequence: Synthetic coding sequence
atgaacgagagccacaagagcgagttcatcgagctgagaaagtggctgaaggccagaaagttccaggacagcaacctggcccccgcctgcttccccggcaccggcagaggcctgatgagccagaccagcctgcaggagggccagatgatcatcagcctgcccgagagctgcctgctgaccaccgacaccgtgatcagaagctacctgggcgcctacatcaccaagtggaagcccccccccagccccctgctggccctgtgcaccttcctggtgagcgagaagcacgccggccacagaagcctgtggaagccctacctggagatcctgcccaaggcctacacctgccccgtgtgcctggagcccgaggtggtgtag

SEQ ID NO: 24635 - DNA, 4035 bp, Artificial Sequence
  Description of Artificial Sequence: Synthetic coding sequence
atgagcagaggcaaggtgatcagactgcacagaagaaagcaggacaacatcagcggcggcgacagcagcgccaccgagagctgggacgaggagctgagccccagcaccgtgctgtacaccgccacccagcacacccccaccagcatcaccctgaccgtgagaagaaccaagcccaagaagagaaagaagagccccgagaagggcagagccgcccccaagaccaagaagatcaaggccttcagagagggcagcagaaagagcctgagaatgaagaacagccccagcgaggcccagaacctggacgagaacaccaccgagggctgggagaacagaatcagactgtggaccgaccagtacgaggaggccttcaccaaccagtacagcgccgacgtgcagaacgccctggagcagcacctgcacagcagcaaggagttcgtgggcaagcccaccatcctggacaccatcaacaagaccgagctggcctgcaacaacaccgtgatcggcagccagatgcagctgcagctgggcagagtgaccagagtgcagaagcacagaaagatcctgagagccgccagagacctggccctggacaccctgatcatcgagtacagaggcaaggtgatgctgagacagcagttcgaggtgaacggccacttcttcaagaagccctaccccttcgtgctgttctacagcaagttcaacggcgtggagatgtgcgtggacgccagaaccttcggcaacgacgccagattcatcagaagaagctgcacccccaacgccgaggtgagacacatgatcgccgacggcatgatccacctgtgcatctacgccgtgagcgccatcaccaaggacgccgaggtgaccatcgccttcgactacgagtacagcaactgcaactacaaggtggactgcgcctgccacaagggcaacagaaactgccccatccagaagagaaaccccaacgccaccgagctgcccctgctgccccccccccccagcctgcccaccatcggcgccgagaccagaagaagaaaggccagaagaaaggagctggagatggagcagcagaacgaggccagcgaggagaacaacgaccagcagagccaggaggtgcccgagaaggtgaccgtgagcagcgaccacgaggaggtggacaaccccgaggagaagcccgaggaggagaaggaggaggtgatcgacgaccaggagaacctggcccacagcagaagaaccagagaggacagaaaggtggaggccatcatgcacgccttcgagaacctggagaagagaaagaagagaagagaccagcccctggagcagagcaacagcgacgtggagatcaccaccaccaccagcgagacccccgtgggcgaggagaccaagaccgaggcccccgagagcgaggtgagcaacagcgtgagcaacgtgaccatccccagcaccccccagagcgtgggcgtgaacaccagaagaagcagccaggccggcgacatcgccgccgagaagctggtgcccaagcccccccccgccaagcccagcagacccagacccaagagcagaatcagcagatacagaaccagcagcgcccagagactgaagagacagaagcaggccaacgcccagcaggccgagctgagccaggccgccctggaggagggcggcagcaacagcctggtgacccccaccgaggccggcagcctggacagcagcggcgagaacagacccctgaccggcagcgaccccaccgtggtgagcatcaccggcagccacgtgaacagagccgccagcaagtaccccaagaccaagaagtacctggtgaccgagtggctgaacgacaaggccgagaagcaggagtgccccgtggagtgccccctgagaatcaccaccgaccccaccgtgctggccaccaccctgaacatgctgcccggcctgatccacagccccctgatctgcaccacccccaagcactacatcagattcggcagccccttcatccccgagagaagaagaagacccctgctgcccgacggcaccttcagcagctgcaagaagagatggatcaagcaggccctggaggagggcatgacccagaccagcagcgtgccccaggagaccagaacccagcacctgtaccagagcaacgagaacagcagcagcagcagcatctgcaaggacaacgccgacctgctgagccccctgaagaagtggaagagcagatacctgatggagcagaacgtgaccaagctgctgagacccctgagccccgtgaccccccccccccccaacagcggcagcaagagcccccagctggccacccccggcagcagccaccccggcgaggaggagtgcagaaacggctacagcctgatgttcagccccgtgaccagcctgaccaccgccagcagatgcaacacccccctgcagttcgagctgtgccacagaaaggacctggacctggccaaggtgggctacctggacagcaacaccaacagctgcgccgacagacccagcctgctgaacagcggccacagcgacctggccccccaccccagcctgggccccaccagcgagaccggcttccccagcagaagcggcgacggccaccagaccctggtgagaaacagcgaccaggccttcagaaccgagttcaacctgatgtacgcctacagccccctgaacgccatgcccagagccgacggcctgtacagaggcagccccctggtgggcgacagaaagcccctgcacctggacggcggctactgcagccccgccgagggcttcagcagcagatacgagcacggcctgatgaaggacctgagcagaggcagcctgagccccggcggcgagagagcctgcgagggcgtgcccagcgccccccagaaccccccccagagaaagaaggtgagcctgctggagtacagaaagagaaagcaggaggccaaggagaacagcgccggcggcggcggcgacagcgcccagagcaagagcaagagcgccggcgccggccagggcagcagcaacagcgtgagcgacaccggcgcccacggcgtgcagggcagcagcgccagaacccccagcagcccccacaagaagttcagccccagccacagcagcatgagccacctggaggccgtgagccccagcgacagcagaggcaccagcagcagccactgcagaccccaggagaacatcagcagcagatggatggtgcccaccagcgtggagagactgagagagggcggcagcatccccaaggtgctgagaagcagcgtgagagtggcccagaagggcgagcccagccccacctgggagagcaacatcaccgagaaggacagcgaccccgccgacggcgagggccccgagaccctgagcagcgccctgagcaagggcgccaccgtgtacagccccagcagatacagctaccagctgctgcagtgcgacagccccagaaccgagagccagagcctgctgcagcagagcagcagccccttcagaggccaccccacccagagccccggctacagctacagaaccaccgccctgagacccggcaacccccccagccacggcagcagcgagagcagcctgagcagcaccagctacagcagccccgcccaccccgtgagcaccgacagcctggcccccttcaccggcacccccggctacttcagcagccagccccacagcggcaacagcaccggcagcaacctgcccagaagaagctgccccagcagcgccgccagccccaccctgcagggccccagcgacagccccaccagcgacagcgtgagccagagcagcaccggcaccctgagcagcaccagcttcccccagaacagcagaagcagcctgcccagcgacctgagaaccatcagcctgcccagcgccggccagagcgccgtgtaccaggccagcagagtgagcgccgtgagcaacagccagcactacccccacagaggcagcggcggcgtgcaccagtacagactgcagcccctgcagggcagcggcgtgaagacccagaccggcctgagctag

SEQ ID NO: 24636 - DNA, 4329 bp, Artificial Sequence
  Description of Artificial Sequence: Synthetic coding sequence
atgagcatcgccatccccctgggcgtgaccaccagcgacaccagctacagcgacatggccgccggcagcgaccccgagagcgtggaggccagccccgccgtgaacgagaagagcgtgtacagcacccacaactacggcaccacccagagacacggctgcagaggcctgccctacgccaccatcatccccagaagcgacctgaacggcctgcccagccccgtggaggagagatgcggcgacagccccaacagcgagggcgagaccgtgcccacctggtgcccctgcggcctgagccaggacggcttcctgctgaactgcgacaagtgcagaggcatgagcagaggcaaggtgatcagactgcacagaagaaagcaggacaacatcagcggcggcgacagcagcgccaccgagagctgggacgaggagctgagccccagcaccgtgctgtacaccgccacccagcacacccccaccagcatcaccctgaccgtgagaagaaccaagcccaagaagagaaagaagagccccgagaagggcagagccgcccccaagaccaagaagatcaagaacagccccagcgaggcccagaacctggacgagaacaccaccgagggctgggagaacagaatcagactgtggaccgaccagtacgaggaggccttcaccaaccagtacagcgccgacgtgcagaacgccctggagcagcacctgcacagcagcaaggagttcgtgggcaagcccaccatcctggacaccatcaacaagaccgagctggcctgcaacaacaccgtgatcggcagccagatgcagctgcagctgggcagagtgaccagagtgcagaagcacagaaagatcctgagagccgccagagacctggccctggacaccctgatcatcgagtacagaggcaaggtgatgctgagacagcagttcgaggtgaacggccacttcttcaagaagccctaccccttcgtgctgttctacagcaagttcaacggcgtggagatgtgcgtggacgccagaaccttcggcaacgacgccagattcatcagaagaagctgcacccccaacgccgaggtgagacacatgatcgccgacggcatgatccacctgtgcatctacgccgtgagcgccatcaccaaggacgccgaggtgaccatcgccttcgactacgagtacagcaactgcaactacaaggtggactgcgcctgccacaagggcaacagaaactgccccatccagaagagaaaccccaacgccaccgagctgcccctgctgccccccccccccagcctgcccaccatcggcgccgagaccagaagaagaaaggccagaagaaaggagctggagatggagcagcagaacgaggccagcgaggagaacaacgaccagcagagccaggaggtgcccgagaaggtgaccgtgagcagcgaccacgaggaggtggacaaccccgaggagaagcccgaggaggagaaggaggaggtgatcgacgaccaggagaacctggcccacagcagaagaaccagagaggacagaaaggtggaggccatcatgcacgccttcgagaacctggagaagagaaagaagagaagagaccagcccctggagcagagcaacagcgacgtggagatcaccaccaccaccagcgagacccccgtgggcgaggagaccaagaccgaggcccccgagagcgaggtgagcaacagcgtgagcaacgtgaccatccccagcaccccccagagcgtgggcgtgaacaccagaagaagcagccaggccggcgacatcgccgccgagaagctggtgcccaagcccccccccgccaagcccagcagacccagacccaagagcagaatcagcagatacagaaccagcagcgcccagagactgaagagacagaagcaggccaacgcccagcaggccgagctgagccaggccgccctggaggagggcggcagcaacagcctggtgacccccaccgaggccggcagcctggacagcagcggcgagaacagacccctgaccggcagcgaccccaccgtggtgagcatcaccggcagccacgtgaacagagccgccagcaagtaccccaagaccaagaagtacctggtgaccgagtggctgaacgacaaggccgagaagcaggagtgccccgtggagtgccccctgagaatcaccaccgaccccaccgtgctggccaccaccctgaacatgctgcccggcctgatccacagccccctgatctgcaccacccccaagcactacatcagattcggcagccccttcatccccgagagaagaagaagacccctgctgcccgacggcaccttcagcagctgcaagaagagatggatcaagcaggccctggaggagggcatgacccagaccagcagcgtgccccaggagaccagaacccagcacctgtaccagagcaacgagaacagcagcagcagcagcatctgcaaggacaacgccgacctgctgagccccctgaagaagtggaagagcagatacctgatggagcagaacgtgaccaagctgctgagacccctgagccccgtgaccccccccccccccaacagcggcagcaagagcccccagctggccacccccggcagcagccaccccggcgaggaggagtgcagaaacggctacagcctgatgttcagccccgtgaccagcctgaccaccgccagcagatgcaacacccccctgcagttcgagctgtgccacagaaaggacctggacctggccaaggtgggctacctggacagcaacaccaacagctgcgccgacagacccagcctgctgaacagcggccacagcgacctggccccccaccccagcctgggccccaccagcgagaccggcttccccagcagaagcggcgacggccaccagaccctggtgagaaacagcgaccaggccttcagaaccgagttcaacctgatgtacgcctacagccccctgaacgccatgcccagagccgacggcctgtacagaggcagccccctggtgggcgacagaaagcccctgcacctggacggcggctactgcagccccgccgagggcttcagcagcagatacgagcacggcctgatgaaggacctgagcagaggcagcctgagccccggcggcgagagagcctgcgagggcgtgcccagcgccccccagaaccccccccagagaaagaaggtgagcctgctggagtacagaaagagaaagcaggaggccaaggagaacagcgccggcggcggcggcgacagcgcccagagcaagagcaagagcgccggcgccggccagggcagcagcaacagcgtgagcgacaccggcgcccacggcgtgcagggcagcagcgccagaacccccagcagcccccacaagaagttcagccccagccacagcagcatgagccacctggaggccgtgagccccagcgacagcagaggcaccagcagcagccactgcagaccccaggagaacatcagcagcagatggatggtgcccaccagcgtggagagactgagagagggcggcagcatccccaaggtgctgagaagcagcgtgagagtggcccagaagggcgagcccagccccacctgggagagcaacatcaccgagaaggacagcgaccccgccgacggcgagggccccgagaccctgagcagcgccctgagcaagggcgccaccgtgtacagccccagcagatacagctaccagctgctgcagtgcgacagccccagaaccgagagccagagcctgctgcagcagagcagcagccccttcagaggccaccccacccagagccccggctacagctacagaaccaccgccctgagacccggcaacccccccagccacggcagcagcgagagcagcctgagcagcaccagctacagcagccccgcccaccccgtgagcaccgacagcctggcccccttcaccggcacccccggctacttcagcagccagccccacagcggcaacagcaccggcagcaacctgcccagaagaagctgccccagcagcgccgccagccccaccctgcagggccccagcgacagccccaccagcgacagcgtgagccagagcagcaccggcaccctgagcagcaccagcttcccccagaacagcagaagcagcctgcccagcgacctgagaaccatcagcctgcccagcgccggccagagcgccgtgtaccaggccagcagagtgagcgccgtgagcaacagccagcactacccccacagaggcagcggcggcgtgcaccagtacagactgcagcccctgcagggcagcggcgtgaagacccagaccggcctgagctag

SEQ ID NO: 24637 - DNA, 4035 bp, Artificial Sequence; identical to SEQ ID NO: 24635
  Description of Artificial Sequence: Synthetic coding sequence

SEQ ID NO: 24638 - DNA, 4329 bp, Artificial Sequence; identical to SEQ ID NO: 24636
  Description of Artificial Sequence: Synthetic coding sequence

SEQ ID NO: 24639 - DNA, 489 bp, Artificial Sequence
  Description of Artificial Sequence: Synthetic coding sequence
atgagcatcgccatccccctgggcgtgaccaccagcgacaccagctacagcgacatggccgccggcagcgaccccgagagcgtggaggccagccccgccgtgaacgagaagagcgtgtacagcacccacaactacggcaccacccagagacacggctgcagaggcctgccctacgccaccatcatccccagaagcgacctgaacggcctgcccagccccgtggaggagagatgcggcgacagccccaacagcgagggcgagaccgtgcccacctggtgcccctgcggcctgagccaggacggcttcctgctgaactgcgacaagtgcagaggcatgagcagaggcaaggtgatcagactgcacagaagaaagcaggacaacatcagcggcggcgacagcagcgccaccgagagctgggacgaggagctgagccccagcaccgtgctgtacaccgccacccagcacacccccaccagcatcaccctgtag

SEQ ID NO: 24640 - DNA, 1731 bp, Artificial Sequence
  Description of Artificial Sequence: Synthetic coding sequence
atgcaggtgccccaggacggcgaggacctggccggccagccctggtaccacggcctgctgagcagacagaaggccgaggccctgctgcagcagaacggcgacttcctggtgagagccagcggcagcagaggcggcaaccccgtgatcagctgcagatggagaggcagcgccctgcacttcgaggtgttcagagtggccctgagacccagacccggcagacccaccgccctgttccagctggaggacgagcagttccccagcatccccgccctggtgcacagctacatgaccggcagaagacccctgagccaggccaccggcgccgtggtgagcagacccgtgacctggcagggccccctgagaagaagcttcagcgaggacaccctgatggacggccccgccagaatcgagcccctgagagccagaaagtggagcaacagccagcccgccgacctggcccacatgggcagaagcagagaggaccccgccggcatggaggccagcaccatgcccatcagcgccctgcccagaaccagcagcgaccccgtgctgctgaaggcccccgcccccctgggcaccgtggccgacagcctgagagccagcgacggccagctgcaggccaaggcccccaccaagccccccagaacccccagcttcgagctgcccgacgccagcgagagaccccccacctactgcgagctggtgcccagagtgcccagcgtgcagggcaccagccccagccagagctgccccgagcccgaggccccctggtgggaggccgaggaggacgaggaggaggagaacagatgcttcaccagaccccaggccgagatcagcttctgcccccacgacgcccccagctgcctgctgggcccccagaacagacccctggagccccaggtgctgcacaccctgagaggcctgttcctggagcaccaccccggcagcaccgccctgcacctgctgctggtggactgccaggccaccggcctgctgggcgtgaccagagaccagagaggcaacatgggcgtgagcagcggcctggagctgctgaccctgccccacggccaccacctgagactggagctgctggagagacaccagaccctggccctggccggcgccctggccgtgctgggctgcagcggccccctggaggagagagccgccgccctgagaggcctggtggagctggccctggccctgagacccggcgccgccggcgacctgcccggcctggccgccgtgatgggcgccctgctgatgccccaggtgagcagactggagcacacctggagacagctgagaagaagccacaccgaggccgccctggccttcgagcaggagctgaagcccctgatgagagccctggacgagggcgccggcccctgcgaccccggcgaggtggccctgccccacgtggcccccatggtgagactgctggagggcgaggaggtggccggccccctggacgagagctgcgagagactgctgagaaccctgcacggcgccagacacatggtgagagacgcccccaagttcagaaaggtggccgcccagagactgagaggcttcagacccaaccccgagctgagagaggccctgaccaccggcttcgtgagaagactgctgtggggcagcagaggcgccggcgcccccagagccgagagattcgagaagttccagagagtgctgggcgtgctgagccagagactggagcccgacagatag

SEQ ID NO: 24641 - DNA, 1452 bp, Artificial Sequence
  Description of Artificial Sequence: Synthetic coding sequence
atggagaagaccctgctggccaacctgggcaccaccgccagctgccccgccagagccagaaagtggagcaacagccagcccgccgacctggcccacatgggcagaagcagagaggaccccgccggcatggaggccagcaccatgcccatcagcgccctgcccagaaccagcagcgaccccgtgctgctgaaggcccccgcccccctgggcaccgtggccgacagcctgagagccagcgacggccagctgcaggccaaggcccccaccaagccccccagaacccccagcttcgagctgcccgacgccagcgagagaccccccacctactgcgagctggtgcccagagtgcccagcgtgcagggcaccagccccagccagagctgccccgagcccgaggccccctggtgggaggccgaggaggacgaggaggaggagaacagatgcttcaccagaccccaggccgagatcagcttctgcccccacgacgcccccagctgcctgctgggcccccagaacagacccctggagccccaggtgctgcacaccctgagaggcctgttcctggagcaccaccccggcagcaccgccctgcacctgctgctggtggactgccaggccaccggcctgctgggcgtgaccagagaccagagaggcaacatgggcgtgagcagcggcctggagctgctgaccctgccccacggccaccacctgagactggagctgctggagagacaccagaccctggccctggccggcgccctggccgtgctgggctgcagcggccccctggaggagagagccgccgccctgagaggcctggtggagctggccctggccctgagacccggcgccgccggcgacctgcccggcctggccgccgtgatgggcgccctgctgatgccccaggtgagaggcgagcagggcctggaggaggccggcgtgagagtgaccggcaagaccggcgaggaggcctgcagcgacctgttcagccaggtgagcagactggagcacacctggagacagctgagaagaagccacaccgaggccgccctggccttcgagcaggagctgaagcccctgatgagagccctggacgagggcgccggcccctgcgaccccggcgaggtggccctgccccacgtggcccccatggtgagactgctggagggcgaggaggtggccggccccctggacgagagctgcgagagactgctgagaaccctgcacggcgccagacacatggtgagagacgcccccaagttcagaaaggtggccgcccagagactgagaggcttcagacccaaccccgagctgagagaggccctgaccaccggcttcgtgagaagactgctgtggggcagcagaggcgccggcgcccccagagccgagagattcgagaagttccagagagtgctgggcgtgctgagccagagactggagcccgacagatag

SEQ ID NO: 24642 - DNA, 930 bp, Artificial Sequence
  Description of Artificial Sequence: Synthetic coding sequence
atgctgcccgaggacagcggcggcagccccgacgccgccgccagcgacaagcacatccagtggctgctgggcgccgacggcgaggtgtgggtgtggatcatgggcgagggccccggcgacaagccctacgaggagatcagcgaggagctgatcgccgagagagccagactgcaggcccagagagaggccgaggagctgtggagacagaaggaggccgagatcaccaagaagttcagagacgccctggccaacgagaaggccagaatcctggccgagaagtggaaggtggagatggaggacagaaaggccgccaaggtgctggaggagagaatccacgaggagttcaagagaaaggaggaggaggagagaaagagaggcgaggagcagatcagactgcaggaggagcagagagccaaggagctgtactggaccctgaagcaggcccagctgcactgccaggccagcgagaaggaggagagagagtgggaggagcagctgagaagaagcaaggccgccgacgaggagagaagcagaagagcccagagagccagagacgagtacagacaccacagcctgagagccatccagaagggcaccgtggccggcctgagcagcatgttcagagagctgggccagagccacgagcaggaggccagactgtaccaccacctgcccgaccccggcctgccccagcccctggccctgcccgtgagcagaacctgggagagacccctgagacccgtgagcagagacgtgatcgtgagatggttcaaggaggagcagctgcccagaagagccggcttcgagagaaacaccaagttcatcgccccctggttccacggcggcaactaccactgcttcagaagaagagtgaccagcggcaccctgagaaccgagggccagcccaccagactgcccagcgtggtgtag

SEQ ID NO: 24643 - DNA, 1074 bp, Artificial Sequence
  Description of Artificial Sequence: Synthetic coding sequence
atgctgcagcagatcctgcacgacatgtacatcgaccccgagctgctggccgagctgagcgacgtgcagaagcacatcctgttctacaagatgagagaggagcagctgagaagatggaaggagagagagacctgggaggccctggcccaggacgagggcctgagaccccccaagaccaagagagccgccagcgacaagcacatccagtggctgctgggcgccgacggcgaggtgtgggtgtggatcatgggcgagggccccggcgacaagccctacgaggagatcagcgaggagctgatcgccgagagagccagactgcaggcccagagagaggccgaggagctgtggagacagaaggaggccgagatcaccaagaagttcagagacgccctggccaacgagaaggccagaatcctggccgagaagtggaaggtggagatggaggacagaaaggccgccaaggtgctggaggagagaatccacgaggagttcaagagaaaggaggaggaggagagaaagagaggcgaggagcagatcagactgcaggaggagcagagagccaaggagctgtactggaccctgaagcaggcccagctgcactgccaggccagcgagaaggaggagagagagtgggaggagcagctgagaagaagcaaggccgccgacgaggagagaagcagaagagcccagagagccagagacgagtacagacaccacagcctgagagccatccagaagggcaccgtggccggcctgagcagcatgttcagagagctgggccagagccacgagcaggaggccagactgtaccaccacctgcccgaccccggcctgccccagcccctggccctgcccgtgagaacctgggagagacccctgagacccgtgagcagagacgtgatcgtgagatggttcaaggaggagcagctgcccagaagagccggcttcgagagaaacaccaagttcatcgccccctggttccacggcggcaactaccactgcttcagaagaagagtgaccagcggcaccctgagaaccgagggccagcccaccagactgcccagcgtggtgtag

SEQ ID NO: 24644 - DNA, 648 bp, Artificial Sequence
  Description of Artificial Sequence: Synthetic coding sequence
atgctgcagcagatcctgcacgacatgtacatcgaccccgagctgctggccgagctgagcgacgtgcagaagcacatcctgttctacaagatgagagaggagcagctgagaagatggaaggagagagagacctgggaggccctggcccaggacgagggcctgagaccccccaagaccaagagagccagcgacaagcacatccagtggctgctgggcgccgacggcgaggtgtgggtgtggatcatgggcgagggccccggcgacaagccctacgaggagatcagcgaggagctgatcgccgagagagccagactgcaggcccagagagaggccgaggagctgtggagacagaaggaggccgagatcaccaagaagttcagagacgccctggccaacgagaaggccagaatcctggccgagaagtggaaggtggagatggaggacagaaaggccgccaaggtgctggaggagagaatccacgaggagttcaagagaaaggaggaggaggagagaaagagaggcgaggagcagatcagactgcaggaggagcagagagccaaggagctgtactggaccctgaagcaggcccagctgcactgccaggccagcgagaaggaggagagagagtgggaggagcagtgcgagtag

SEQ ID NO: 24645 - DNA, 1296 bp, Artificial Sequence
  Description of Artificial Sequence: Synthetic coding sequence
atgctgcagcagatcctgcacgacatgtacatcgaccccgagctgctggccgagctgagcgacgtgcagaagcacatcctgttctacaagatgagagaggagcagctgagaagatggaaggagagagagacctgggaggccctggcccaggacgagggcctgagaccccccaagaccaagagagccagcgacaagcacatccagtggctgctgggcgccgacggcgaggtgtgggtgtggatcatgggcgagggccccggcgacaagccctacgaggagatcagcgaggagctgatcgccgagagagccagactgcaggcccagagagaggccgaggagctgtggagacagaaggaggccgagatcaccaagaagttcagagacgccctggccaacgagaaggccagaatcctggccgagaagtggaaggtggagatggaggacagaaaggccgccaaggtgctggaggagagaatccacgaggagttcaagagaaaggaggaggaggagagaaagagaggcgaggagcagatcagactgcaggaggagcagagagccaaggagctgtactggaccctgaagcaggcccagctgcactgccaggccagcgagaaggaggagagagagtgggaggagcagctgagaagaagcaaggccgccgacgaggagagaagcagaagagcccagagagccagagacgagtacagacaccacagcctgagagccatccagaagggcaccgtggccggcctgagcagcatgttcagagagctgggccagagccacgagcaggaggccagactgtaccaccacctgcccgaccccggcctgccccagcccctggccctgcccgtgagaacctgggagagacccctgagacccgtgagcagagacgtgatcgtgagatggttcaaggaggagcagctgcccagaagagccggcttcgagagaaacaccaagttcatcgccccctggttccacggcatcatcagcagagaggacgccgaggccctgctggagaacatgaccgagggcgccttcctggtgagagtgagcgagaagatctggggctacaccctgagctacagactgcagaagggcttcaagcacttcctggtggacgccagcggcgacttctacagcttcctgggcgtggaccccaacagacacgccaccctgaccgacctggtggacttccacaaggaggagatcatcaccgtgagcggcggcgagctgctgcaggagccctgcggccagagagacagcccccccgactaccacctgctgttcgagtag

SEQ ID NO: 24646 - DNA, 1020 bp, Artificial Sequence
  Description of Artificial Sequence: Synthetic coding sequence
atggcccacgccctgagaagaatcctgtacagcacctggtgccccgccgactgccagttcgccttcatggccagaaaccccagaagccccgccagcaagctgttctgccacctgttcgtgggcagccagcccggcgaggtgcagatcctgcacctgctgctgtgcagaagcttccagctggcctacctgctgcagcaccccgaggagagagcccagcccgagccctgccccggccccaccggcgaggtgcccctgaagcccctgagcagcagcggcggcctggtgagagagcccttcggcagagaccagctgagccagaacgtgcacgccctggtgagcttcagaagactgcccgccgagggcctggtgggcagcggcaaggagctgcccgagagcgagggcagagccagacacgccagactgggcaacccctactgcagccccaccctggtgagaaagaaggccatcagaagcaaggtgatcagaagcggcgcctacagaggctgcacctacgagacccagctgcagctgagcgccagagaggccttccccgccgcctgggaggcctggcccagaggccccggcggccacagctgcctggtggagagcgagggcagcctgaccgagaacatctgggccttcgccggcatcagcagaccctgcgccctggccctgctgagaagagacgtgctgggcgccttcctgctgtggcccgagctgggcgccagcggccagtggtgcctgagcgtgagaacccagtgcggcgtggtgccccaccaggtgttcagaaaccacctgggcagatactgcctggagcacctgcccgccgagttccccagcctggaggccctggtggagaaccacgccgtgaccgagagaagcctgttctgccccctggacatgggcagactgaaccccacctacgaggagcaggactgcggcccccccggcagaccccccagaaccctgagacccctgagccacgccaagagcgaggccgagctgcagggcctgggctag

SEQ ID NO: 24647 - DNA, 1272 bp, Artificial Sequence
  Description of Artificial Sequence: Synthetic coding sequence
atgcagaaggccggcgccggcggcagaagagccagcgactgcggcctggccccccacagacccagatgcatcaccaagttcgcccagtacgtgggcagcttccccgtggacgacctggacacccaggagagcgtgtggctggtgcagcagcagctgtgggccctgaaggactgccccagaagaagagccgtgatcctgaagttcagcctgcagggcctgaagatctacagcggcgagggcgaggtgctgctgatggcccacgccctgagaagaatcctgtacagcacctggtgccccgccgactgccagttcgccttcatggccagaaaccccagaagccccgccagcaagctgttctgccacctgttcgtgggcagccagcccggcgaggtgcagatcctgcacctgctgctgtgcagaagcttccagctggcctacctgctgcagcaccccgaggagagagcccagcccgagccctgccccggccccaccggcgaggtgcccctgaagcccctgagcagcagcggcggcctggtgagagagcccttcggcagagaccagctgagccagaacgtgcacgccctggtgagcttcagaagactgcccgccgagggcctggtgggcagcggcaaggagctgcccgagagcgagggcagagccagacacgccagactgggcaacccctactgcagccccaccctggtgagaaagaaggccatcagaagcaaggtgatcagaagcggcgcctacagaggctgcacctacgagacccagctgcagctgagcgccagagaggccttccccgccgcctgggaggcctggcccagaggccccggcggccacagctgcctggtggagagcgagggcagcctgaccgagaacatctgggccttcgccggcatcagcagaccctgcgccctggccctgctgagaagagacgtgctgggcgccttcctgctgtggcccgagctgggcgccagcggccagtggtgcctgagcgtgagaacccagtgcggcgtggtgccccaccaggtgttcagaaaccacctgggcagatactgcctggagcacctgcccgccgagttccccagcctggaggccctggtggagaaccacgccgtgaccgagagaagcctgttctgccccctggacatgggcagactgaaccccacctacgaggagcaggactgcggcccccccggcagaccccccagaaccctgagacccctgagccacgccaagagcgaggccgagctgcagggcctgggctag

SEQ ID NO: 24648 - DNA, 381 bp, Artificial Sequence
  Description of Artificial Sequence: Synthetic coding sequence
atgcagaaggccggcgccggcggcagaagagccagcgactgcggcctggccccccacagacccagatgcatcaccaagttcgcccagtacgtgggcagcttccccgtggacgacctggacacccaggagagcgtgtggctggtgcagcagcagctgtgggccctgaaggactgccccagaagaagagccgtgatcctgaagttcagcctgcagggcctgaagatctacagcggcgagggcgaggtgctgctgatggcccacgccctgagaagaatcctgtacagcacctggtgccccgccgactgccagttcgccttcatggccagaaaccccagaagccccgccagcaagctgttctgccacctgttcgtgggcagctag

SEQ ID NO: 24649 - DNA, 396 bp, Artificial Sequence
  Description of Artificial Sequence: Synthetic coding sequence
atgcagaaggccggcgccggcggcagaagagccagcgactgcggcctggccccccacagacccagatgcatcaccaagttcgcccagtacgtgggcagcttccccgtggacgacctggacacccaggagagcgtgtggctggtgcagcagcagctgtgggccctgaaggactgccccagaagaagagccgtgatcctgaagttcagcctgcagggcctgaagatctacagcggcgagggcgaggtgctgctgatggcccacgccctgagaagaatcctgtacagcacctggtgccccgccgactgccagttcgccttcatggccagaaaccccagaagccccgccagcaagctgttctgccacctgttcgtgggcagccagcccggcgaggtgtag

SEQ ID NO: 24650 - DNA, 213 bp, Artificial Sequence
  Description of Artificial Sequence: Synthetic coding sequence
atgcagaaggccggcgccggcggcagaagagccagcgactgcggcctggccccccacagacccagatgcatcaccaagttcgcccagtacgtgggcagcttccccgtggacgacctggacacccaggagagcgtgtggctggtgcagcagcagctgtgggccctgaaggactgccccagaagaagagccgtgatcctgaagttcagcctgtag

SEQ ID NO: 24651 - DNA, 528 bp, Artificial Sequence
  Description of Artificial Sequence: Synthetic coding sequence
atgtacgccagcagctaccccccccccccccagctgagccccagaagccacctgtgccccccccccccccaccccacccccccccagctgaacaacctgctgctgctggagggcagaaagagcagcctgcccagcgtggcccccaccggcagcgccagcgccgccgaggacagcgacctgctgacccagccctggtacagcggcaactgcgacagatacgccgtggagagcgccctgctgcacctgcagaaggacggcgcctacaccgtgagacccagcagcggcccccacggcagccagcccttcaccctggccgtgctgctgagaggcagagtgttcaacatccccatcagaagactggacggcggcagacactacgccctgggcagagagggcagaaacagagaggagctgttcagcagcgtggccgccatggtgcagcacttcatgtggcaccccctgcccctggtggacagacacagcggcagcagagagctgacctgcctgctgttccccaccaagccctag

SEQ ID NO: 24652 - DNA, 432 bp, Artificial Sequence
  Description of Artificial Sequence: Synthetic coding sequence
atgcccagcggccccctgcccagaaccagcgtggtgcccagacccaccaccgccccccaggagaccagaaacggcaccgccgacgccgccagcaaggagggcagaaagagcagcctgcccagcgtggcccccaccggcagcgccagcgccgccgaggacggcgcctacaccgtgagacccagcagcggcccccacggcagccagcccttcaccctggccgtgctgctgagaggcagagtgttcaacatccccatcagaagactggacggcggcagacactacgccctgggcagagagggcagaaacagagaggagctgttcagcagcgtggccgccatggtgcagcacttcatgtggcaccccctgcccctggtggacagacacagcggcagcagagagctgacctgcctgctgttccccaccaagccctag

SEQ ID NO: 24653 - DNA, 1896 bp, Artificial Sequence
  Description of Artificial Sequence: Synthetic coding sequence
atgaacggcgccggccccggccccgccgccgccgcccccgtgcccgtgcccgtgcccgtgcccgactggagacagttctgcgagctgcacgcccaggccgccgccgtggacttcgcccacaagttctgcagattcctgagagacaaccccgcctacgacacccccgacgccggcgccagcttcagcagacacttcgccgccaacttcctggacgtgttcggcgaggaggtgagaagagtgctggtggccggccccaccaccagaggcgccgccgtgagcgccgaggccatggagcccgagctggccgacaccagcgccctgaaggccgccccctacggccacagcagaagcagcgaggacgtgagcacccacgccgccaccaaggccagagtgagaaagggcttcagcctgagaaacatgagcctgtgcgtggtggacggcgtgagagacatgtggcacagaagagccagccccgagcccgacgccgccgccgcccccagaaccgccgagcccagagacaagtggaccagaagactgagactgagcagaaccctggccgccaaggtggagctggtggacatccagagagagggcgccctgagattcatggtggccgacgacgccgccgccggcagcggcggcagcgcccagtggcagaagtgcagactgctgctgagaagagccgtggccgaggagagattcagactggagttcttcgtgccccccaaggccagcagacccaaggtgagcatccccctgagcgccatcatcgaggtgagaaccaccatgcccctggagatgcccgagaaggacaacaccttcgtgctgaaggtggagaacggcgccgagtacatcctggagaccatcgacagcctgcagaagcacagctgggtggccgacatccagggctgcgtggaccccggccccggccccggcgacctggagggcagctggaccagaagctgcctgcaccccaagagagccagcgagcactgggagctgggcagagacggcagcgagagccccaagggctggggccccggcgccgtggcccacatctgcgaccccaacaccctgggcggccccgccgtggagaccggcttccaccacgtgggccaggccggcctggagctgcagaccagcagcgacccccccaacagcgccagcagaagcgccaccagcggcgagcagggcgccgagaccgaccccgaggccgagcccgagctggagctgagcgactacccctggttccacggcaccctgagcagagtgaaggccgcccagctggtgctggccggcggccccagaaaccacggcctgttcgtgatcagacagagcgagaccagacccggcgagtacgtgctgaccttcaacttccagggcaaggccaagcacctgagactgagcctgaacggccacggccagtgccacgtgcagcacctgtggttccagagcgtgctggacatgctgagacacttccacacccaccccatccccctggagagcggcggcagcgccgacatcaccctgagaagctacgtgagagcccaggaccccccccccgagcccggccccaccccccccgccgcccccgccagccccgcctgctggagcgacagccccggccagcactacttcagcagcctggccgccgccgcctgcccccccgccagccccagcgacgccgccggcgccagcagcagcagcgccagcagcagcagcgccgccagcggccccgccccccccagacccgtggagggccagctgagcgccagaagcagaagcaacagcgccgagagactgctggaggccgtggccgccaccgccgccgaggagccccccgaggccgcccccggcagagccagagccgtggagaaccagtacagcttctactag

SEQ ID NO: 24654 - DNA, 714 bp, Artificial Sequence
  Description of Artificial Sequence: Synthetic coding sequence
tgagagcagggcgccgagaccgaccccgaggccgagcccgagctggagctgagcgactacccctggttccacggcaccctgagcagagtgaaggccgcccagctggtgctggccggcggccccagaaaccacggcctgttcgtgatcagacagagcgagaccagacccggcgagtacgtgctgaccttcaacttccagggcaaggccaagcacctgagactgagcctgaacggccacggccagtgccacgtgcagcacctgtggttccagagcgtgctggacatgctgagacacttccacacccaccccatccccctggagagcggcggcagcgccgacatcaccctgagaagctacgtgagagcccaggaccccccccccgagcccggccccaccccccccgccgcccccgccagccccgcctgctggagcgacagccccggccagcactacttcagcagcctggccgccgccgcctgcccccccgccagccccagcgacgccgccggcgccagcagcagcagcgccagcagcagcagcgccgccagcggccccgccccccccagacccgtggagggccagctgagcgccagaagcagaagcaacagcgccgagagactgctggaggccgtggccgccaccgccgccgaggagccccccgaggccgcccccggcagagccagagccgtggagaaccagtacagcttctactag

SEQ ID NO: 24655 - DNA, 927 bp, Artificial Sequence
  Description of Artificial Sequence: Synthetic coding sequence
atgaacggcgccggccccggccccgccgccgccgcccccgtgcccgtgcccgtgcccgtgcccgactggagacagttctgcgagctgcacgcccaggccgccgccgtggacttcgcccacaagttctgcagattcctgagagacaaccccgcctacgacacccccgacgccggcgccagcttcagcagacacttcgccgccaacttcctggacgtgttcggcgaggaggtgagaagagtgctggtggccggccccaccaccagaggcgccgccgtgagcgccgaggccatggagcccgagctggccgacaccagcgccctgaaggccgccccctacggccacagcagaagcagcgaggacgtgagcacccacgccgccaccaaggccagagtgagaaagggcttcagcctgagaaacatgagcctgtgcgtggtggacggcgtgagagacatgtggcacagaagagccagccccgagcccgacgccgccgccgcccccagaaccgccgagcccagagacaagtggaccagaagactgagactgagcagaaccctggccgccaaggtggagctggtggacatccagagagagggcgccctgagattcatggtggccgacgacgccgccgccggcagcggcggcagcgcccagtggcagaagtgcagactgctgctgagaagagccgtggccgaggagagattcagactggagttcttcgtgccccccaaggccagcagacccaaggtgagcatccccctgagcgccatcatcgaggtgagaaccaccatgcccctggagatgcccgagaaggacaacaccttcgtgctgaaggtggagaacggcgccgagtacatcctggagaccatcgacagcctgcagaagcacagctgggtggccgacatccagggctgcgtggaccccggctag

SEQ ID NO: 24656 - DNA, 2016 bp, Artificial Sequence
  Description of Artificial Sequence: Synthetic coding sequence
atggaccccagctactgccccgcccacggcttccccagccaggacgccctgtggcccctgagcagccagcagtggagcagcgcccactacagcgagcccgccgccggcggctgcgacggcaccgaggccatgaacggcgccggccccggccccgccgccgccgcccccgtgcccgtgcccgtgcccgtgcccgactggagacagttctgcgagctgcacgcccaggccgccgccgtggacttcgcccacaagttctgcagattcctgagagacaaccccgcctacgacacccccgacgccggcgccagcttcagcagacacttcgccgccaacttcctggacgtgttcggcgaggaggtgagaagagtgctggtggccggccccaccaccagaggcgccgccgtgagcgccgaggccatggagcccgagctggccgacaccagcgccctgaaggccgccccctacggccacagcagaagcagcgaggacgtgagcacccacgccgccaccaaggccagagtgagaaagggcttcagcctgagaaacatgagcctgtgcgtggtggacggcgtgagagacatgtggcacagaagagccagccccgagcccgacgccgccgccgcccccagaaccgccgagcccagagacaagtggaccagaagactgagactgagcagaaccctggccgccaaggtggagctggtggacatccagagagagggcgccctgagattcatggtggccgacgacgccgccgccggcagcggcggcagcgcccagtggcagaagtgcagactgctgctgagaagagccgtggccgaggagagattcagactggagttcttcgtgccccccaaggccagcagacccaaggtgagcatccccctgagcgccatcatcgaggtgagaaccaccatgcccctggagatgcccgagaaggacaacaccttcgtgctgaaggtggagaacggcgccgagtacatcctggagaccatcgacagcctgcagaagcacagctgggtggccgacatccagggctgcgtggaccccggcctgtggcccggcgacctggagggcagctggaccagaagctgcctgcaccccaagagagccagcgagcactgggagctgggcagagacggcagcgagagccccaagggctggggccccggcgccgtggcccacatctgctggagcagaacccccgacctgaagagacacctgagcagccacatctacctgttcgtgcccctgagccccagcccccacgtgccccacaccgtgatccccaccagcggcgagcagggcgccgagaccgaccccgaggccgagcccgagctggagctgagcgactacccctggttccacggcaccctgagcagagtgaaggccgcccagctggtgctggccggcggccccagaaaccacggcctgttcgtgatcagacagagcgagaccagacccggcgagtacgtgctgaccttcaacttccagggcaaggccaaggccagccacctgagactgagcctgaacggccacggccagtgccacgtgcagcacctgtggttccagagcgtgctggacatgctgagacacttccacacccaccccatccccctggagagcggcggcagcgccgacatcaccctgagaagctacgtgagagcccaggaccccccccccgagcccggccccaccccccccgccgcccccgccagccccgcctgctggagcgacagccccggccagcactacttcagcagcctggccgccgccgcctgcccccccgccagccccagcgacgccgccggcgccagcagcagcagcgccagcagcagcagcgccgccagcggccccgccccccccagacccgtggagggccagctgagcgccagaagcagaagcaacagcgccgagagactgctggaggccgtggccgccaccgccgccgaggagccccccgaggccgcccccggcagagccagagccgtggagaaccagtacagcttctactag

SEQ ID NO: 24657 - DNA, 1899 bp, Artificial Sequence
  Description of Artificial Sequence: Synthetic coding sequence
atgaacggcgccggccccggccccgccgccgccgcccccgtgcccgtgcccgtgcccgtgcccgactggagacagttctgcgagctgcacgcccaggccgccgccgtggacttcgcccacaagttctgcagattcctgagagacaaccccgcctacgacacccccgacgccggcgccagcttcagcagacacttcgccgccaacttcctggacgtgttcggcgaggaggtgagaagagtgctggtggccggccccaccaccagaggcgccgccgtgagcgccgaggccatggagcccgagctggccgacaccagcgccctgaaggccgccccctacggccacagcagaagcagcgaggacgtgagcacccacgccgccaccaaggccagagtgagaaagggcttcagcctgagaaacatgagcctgtgcgtggtggacggcgtgagagacatgtggcacagaagagccagccccgagcccgacgccgccgccgcccccagaaccgccgagcccagagacaagtggaccagaagactgagactgagcagaaccctggccgccaaggtggagctggtggacatccagagagagggcgccctgagattcatggtggccgacgacgccgccgccggcagcggcggcagcgcccagtggcagaagtgcagactgctgctgagaagagccgtggccgaggagagattcagactggagttcttcgtgccccccaaggccagcagacccaaggtgagcatccccctgagcgccatcatcgaggtgagaaccaccatgcccctggagatgcccgagaaggacaacaccttcgtgctgaaggtggagaacggcgccgagtacatcctggagaccatcgacagcctgcagaagcacagctgggtggccgacatccagggctgcgtggaccccggcgacagcgaggaggacaccgagctgagctgcaccagaggcggctgcctggccagcagagtggccagctgcagctgcgagctgctgaccgacgccgtggacctgcccagaccccccgagaccaccgccgtgggcgccgtggtgaccgccccccacagcagaggcagagacgccgtgagagagagcctgatccacgtgcccctggagaccttcctgcagaccctggagagccccggcggcagcggcagcgacagcaacaacaccggcgagcagggcgccgagaccgaccccgaggccgagcccgagctggagctgagcgactacccctggttccacggcaccctgagcagagtgaaggccgcccagctggtgctggccggcggccccagaaaccacggcctgttcgtgatcagacagagcgagaccagacccggcgagtacgtgctgaccttcaacttccagggcaaggccaagcacctgagactgagcctgaacggccacggccagtgccacgtgcagcacctgtggttccagagcgtgctggacatgctgagacacttccacacccaccccatccccctggagagcggcggcagcgccgacatcaccctgagaagctacgtgagagcccaggaccccccccccgagcccggccccaccccccccgccgcccccgccagccccgcctgctggagcgacagccccggccagcactacttcagcagcctggccgccgccgcctgcccccccgccagccccagcgacgccgccggcgccagcagcagcagcgccagcagcagcagcgccgccagcggccccgccccccccagacccgtggagggccagctgagcgccagaagcagaagcaacagcgccgagagactgctggaggccgtggccgccaccgccgccgaggagccccccgaggccgcccccggcagagccagagccgtggagaaccagtacagcttctactag

SEQ ID NO: 24658 - DNA, 1236 bp, Artificial Sequence
  Description of Artificial Sequence: Synthetic coding sequence
atgaccgagatgagcgagaaggagaacgagcccgacgacgccgccacccacagcccccccggcaccgtgagcgccctgcaggagaccaagctgcagagattcaagagaagcctgagcctgaagaccatcctgagaagcaagagcctggagaacttcttcctgagaagcggcagcgagctgaagtgccccaccgaggtgctgctgaccccccccacccccctgcccccccccagccccccccccaccgccagcgacagaggcctggccacccccagccccagcccctgccccgtgcccagacccctggccgccctgaagcccgtgagactgcacagcttccaggagcacgtgttcaagagagccagcccctgcgagctgtgccaccagctgatcgtgggcaacagcaagcagggcctgagatgcaagatgtgcaaggtgagcgtgcacctgtggtgcagcgaggagatcagccaccagcagtgccccggcaagaccagcaccagcttcagaagaaacttcagcagccccctgctggtgcacgagcccccccccgtgtgcgccaccagcaaggagagcccccccaccggcgacagcggcaaggtggaccccgtgtacgagaccctgagatacggcaccagcctggccctgatgaacagaagcagcttcagcagcaccagcgagagccccaccagaagcctgagcgagagagacgagctgaccgaggacggcgagggcagcatcagaagcagcgaggagggccccggcgacagcgccagccccgtgttcaccgcccccgccgagagcgagggccccggccccgaggagaagagccccggccagcagctgcccaaggccaccctgagaaaggacgtgggccccatgtacagctacgtggccctgtacaagttcctgccccaggagaacaacgacctggccctgcagcccggcgacagaatcatgctggtggacgacagcaacgaggactggtggaagggcaagatcggcgacagagtgggcttcttccccgccaacttcgtgcagagagtgagacccggcgagaacgtgtggagatgctgccagcccttcagcggcaacaaggagcagggctacatgagcctgaaggagaaccagatctgcgtgggcgtgggcagaagcaaggacgccgacggcttcatcagagtgagcagcggcaagaagagaggcctggtgcccgtggacgccctgaccgagatctag

SEQ ID NO: 24659 - DNA, 1095 bp, Artificial Sequence
  Description of Artificial Sequence: Synthetic coding sequence
atgaccgagaaggaggtgctggagagccccaagcccagcttccccgccgagaccagacagagcggcctgcagagactgaagcagctgctgagaaagggcagcaccggcaccaaggagatggagctgccccccgagccccaggccaacggcgaggccgtgggcgccggcggcggccccatctactacatctacgaggaggaggaggaggaggaggaggaggaggaggagcccccccccgagccccccaagctggtgaacgacaagccccacaagttcaaggaccacttcttcaagaagcccaagttctgcgacgtgtgcgccagaatgatcgtgctgaacaacaagttcggcctgagatgcaagaactgcaagaccaacatccacgagcactgccagagctacgtggagatgcagagatgcttcggcaagatcccccccggcttccacagagcctacagcagccccctgtacagcaaccagcagtacgcctgcgtgaaggacctgagcgccgccaacagaaacgaccccgtgttcgagaccctgagaaccggcgtgatcatggccaacaaggagagaaagaagggccaggccgacaagaagaaccccgtggccgccatgatggaggaggagcccgagagcgccagacccgaggagggcaagccccaggacggcaaccccgagggcgacaagaaggccgagaagaagacccccgacgacaagcacaagcagcccggcttccagcagagccactacttcgtggccctgtacagattcaaggccctggagaaggacgacctggacttcccccccggcgagaagatcaccgtgatcgacgacagcaacgaggagtggtggagaggcaagatcggcgagaaggtgggcttcttcccccccaacttcatcatcagagtgagagccggcgagagagtgcacagagtgaccagaagcttcgtgggcaacagagagatcggccagatcaccctgaagaaggaccagatcgtggtgcagaagggcgacgaggccggcggctacgtgaaggtgtacaccggcagaaaggtgggcctgttccccaccgacttcctggaggagatctag

SEQ ID NO: 24660 - DNA, 507 bp, Artificial Sequence
  Description of Artificial Sequence: Synthetic coding sequence
atgaccgagaaggaggtgctggagagccccaagcccagcttccccgccgagaccagacagagcggcctgcagagactgaagcagctgctgagaaagggcagcaccggcaccaaggagatggagctgccccccgagccccaggccaacggcgaggccgtgggcgccggcggcggccccatctactacatctacgaggaggaggaggaggaggaggaggaggaggaggagcccccccccgagccccccaagctggtgaacgacaagccccacaagttcaaggaccacttcttcaagaagcccaagttctgcgacgtgtgcgccagaatgatcgtgctgaacaacaagttcggcctgagatgcaagaactgcaagaccaacatccacgagcactgccagagctacgtggagatgcagagatgcttcggcaagatcccccccggcttccacagagcctacagcagccccctgtacagcaaccagcagtacgcctgcgtgaaggacctgtag

SEQ ID NO: 24661 - DNA, 978 bp, Artificial Sequence
  Description of Artificial Sequence: Synthetic coding sequence
atggagctgccccccgagccccaggccaacggcgaggccgtgggcgccggcggcggccccatctactacatctacgaggaggaggaggaggaggaggaggaggaggaggagcccccccccgagccccccaagctggtgaacgacaagccccacaagttcaaggaccacttcttcaagaagcccaagttctgcgacgtgtgcgccagaatgatcgtgctgaacaacaagttcggcctgagatgcaagaactgcaagaccaacatccacgagcactgccagagctacgtggagatgcagagatgcttcggcaagatcccccccggcttccacagagcctacagcagccccctgtacagcaaccagcagtacgcctgcgtgaaggacctgagcgccgccaacagaaacgaccccgtgttcgagaccctgagaaccggcgtgatcatggccaacaaggagagaaagaagggccaggccgacaagaagaaccccgtggccgccatgatggaggaggagcccgagagcgccagacccgaggagggcaagccccaggacggcaaccccgagggcgacaagaaggccgagaagaagacccccgacgacaagcacaagcagcccggcttccagcagagccactacttcgtggccctgtacagattcaaggccctggagaaggacgacctggacttcccccccggcgagaagatcaccgtgatcgacgacagcaacgaggagtggtggagaggcaagatcggcgagaaggtgggcttcttcccccccaacttcatcatcagagtgagagccggcgagagagtgcacagagtgaccagaagcttcgtgggcaacagagagatcggccagatcaccctgaagaaggaccagatcgtggtgcagaagggcgacgaggccggcggctacgtgaaggtgtacaccggcagaaaggtgggcctgttccccaccgacttcctggaggagatctag

SEQ ID NO: 24662 - DNA, 4194 bp, Artificial Sequence
  Description of Artificial Sequence: Synthetic coding sequence
atgcccagcaagcccgagggcgccgccaagaccatcggcagctacgtgcccggccccagaagcagaagccccagcctgaacagactgggcggcgccggcgaggacggcaagagaccccagcccctgtggcacgtgggcagccccttcgccctgggcgccaacaaggacagcctgagcgccttcgagtaccccggccccaagagaaagctgtacagcgccgtgcccggcagactgttcgtggccgtgaagccctaccagccccaggtggacggcgagatccccctgcacagaggcgacagagtgaaggtgctgagcatcggcgagggcggcttctgggagggcagcgccagaggccacatcggctggttccccgccgagtgcgtggaggaggtgcagtgcaagcccagagacagccaggccgagaccagagccgacagaagcaagaagctgttcagacactacaccgtgggcagctacgacagcttcgacaccagcagcgactgcatcatcgaggagaagaccgtggtgctgcagaagaaggacaacgagggcttcggcttcgtgctgagaggcgccaaggccgacacccccatcgaggagttcacccccacccccgccttccccgccctgcagtacctggagagcgtggacgagggcggcgtggcctggcaggccggcctgagaaccggcgacttcctgatcgaggtgaacaacgagaacgtggtgaaggtgggccacagacaggtggtgaacatgatcagacagggcggcaaccacctggtgctgaaggtggtgaccgtgaccagaaacctggaccccgacgacaccgccagaaagaaggccccccccccccccaagagagcccccaccaccgccctgaccctgagaagcaagagcatgaccagcgagctggaggagctggtggacaaggccagcgtgagaaagaagaaggacaagcccgaggagatcgtgcccgccagcaagcccagcagagccgccgagaacatggccgtggagcccagagtggccaccatcaagcagagacccagcagcagatgcttccccgccggcagcgacatgaacagcgtgtacgagagacagggcatcgccgtgatgacccccaccgtgcccggcagccccaaggcccccttcctgggcatccccagaggcaccatgagaagacagaagagcatcgacagcagaatcttcctgagcggcatcaccgaggaggagagacagttcctggccccccccatgctgaagttcaccagaagcctgagcatgcccgacaccagcgaggacatccccccccccccccagagcgtgccccccagcccccccccccccagccccaccacctacaactgccccaagagccccacccccagagtgtacggcaccatcaagcccgccttcaaccagaacagcgccgccaaggtgagccccgccaccagaagcgacaccgtggccaccatgatgagagagaagggcatgtacttcagaagagagctggacagatacagcctggacagcgaggacctgtacagcagaaacgccggcccccaggccaacttcagaaacaagagaggccagatgcccgagaacccctacagcgaggtgggcaagatcgccagcaaggccgtgtacgtgcccgccaagcccgccagaagaaagggcatgctggtgaagcagagcaacgtggaggacagccccgagaagacctgcagcatccccatccccaccatcatcgtgaaggagcccagcaccagcagcagcggcaagagcagccagggcagcagcatggagatcgacccccaggcccccgagccccccagccagctgagacccgacgagagcctgaccgtgagcagccccttcgccgccgccatcgccggcgccgtgagagacagagagaagagactggaggccagaagaaacagccccgccttcctgagcaccgacctgggcgacgaggacgtgggcctgggcccccccgcccccagaaccagacccagcatgttccccgaggagggcgacttcgccgacgaggacagcgccgagcagctgagcagccccatgcccagcgccacccccagagagcccgagaaccacttcgtgggcggcgccgaggccagcgcccccggcgaggccggcagacccctgaacagcaccagcaaggcccagggccccgagagcagccccgccgtgcccagcgccagcagcggcaccgccggccccggcaactacgtgcaccccctgaccggcagactgctggaccccagcagccccctggccctggccctgagcgccagagacagagccatgaaggagagccagcagggccccaagggcgaggcccccaaggccgacctgaacaagcccctgtacatcgacaccaagatgagacccagcctggacgccggcttccccaccgtgaccagacagaacaccagaggccccctgagaagacaggagaccgagaacaagtacgagaccgacctgggcagagacagaaagggcgacgacaagaagaacatgctgatcgacatcatggacaccagccagcagaagagcgccggcctgctgatggtgcacaccgtggacgccaccaagctggacaacgccctgcaggaggaggacgagaaggccgaggtggagatgaagcccgacagcagccccagcgaggtgcccgagggcgtgagcgagaccgagggcgccctgcagatcagcgccgcccccgagcccaccaccgtgcccggcagaaccatcgtggccgtgggcagcatggaggaggccgtgatcctgcccttcagaatcccccccccccccctggccagcgtggacctggacgaggacttcatcttcaccgagcccctgcccccccccctggagttcgccaacagcttcgacatccccgacgacagagccgccagcgtgcccgccctgagcgacctggtgaagcagaagaagagcgacaccccccagagccccagcctgaacagcagccagcccaccaacagcgccgacagcaagaagcccgccagcctgagcaactgcctgcccgccagcttcctgcccccccccgagagcttcgacgccgtggccgacagcggcatcgaggaggtggacagcagaagcagcagcgaccaccacctggagaccaccagcaccatcagcaccgtgagcagcatcagcaccctgagcagcgagggcggcgagaacgtggacacctgcaccgtgtacgccgacggccaggccttcatggtggacaagccccccgtgccccccaagcccaagatgaagcccatcatccacaagagcaacgccctgtaccaggacgccctggtggaggaggacgtggacagcttcgtgatccccccccccgcccccccccccccccccggcagcgcccagcccggcatggccaaggtgctgcagcccagaaccagcaagctgtggggcgacgtgaccgagatcaagagccccatcctgagcggccccaaggccaacgtgatcagcgagctgaacagcatcctgcagcagatgaacagagagaagctggccaagcccggcgagggcctggacagccccatgggcgccaagagcgccagcctggcccccagaagccccgagatcatgagcaccatcagcggcaccagaagcaccaccgtgaccttcaccgtgagacccggcaccagccagcccatcaccctgcagagcagaccccccgactacgagagcagaaccagcggcaccagaagagcccccagccccgtggtgagccccaccgagatgaacaaggagaccctgcccgcccccctgagcgccgccaccgccagccccagccccgccctgagcgacgtgttcagcctgcccagccagccccccagcggcgacctgttcggcctgaaccccgccggcagaagcagaagccccagccccagcatcctgcagcagcccatcagcaacaagcccttcaccaccaagcccgtgcacctgtggaccaagcccgacgtggccgactggctggagagcctgaacctgggcgagcacaaggaggccttcatggacaacgagatcgacggcagccacctgcccaacctgcagaaggaggacctgatcgacctgggcgtgaccagagtgggccacagaatgaacatcgagagagccctgaagcagctgctggacagatag

SEQ ID NO: 24663 - DNA, 4011 bp, Artificial Sequence
  Description of Artificial Sequence: Synthetic coding sequence
atggagaacctgcccgccgtgaccaccgaggagcccacccccatgggcagaggccccgtgggccccagcggcggcggcagcaccagagaccaggtgagaaccgtggtgatgagacccagcgtgagctgggagaaggccggccccgaggaggccaaggcccccgtgagaggcgacgaggccccccccgccagagtggccggccccgccgccggcacccccccctgccagatgggcgtgtaccccaccgacctgaccctgcagctgctggccgtgagaagaaagagcagactgagagaccccggcctgcagcagaccctgagaggccagctgagactgctggagaacgacagcagagagatggccagagtgctgggcgagctgagcgccagactgctgagcatccacagcgaccaggacagaatcgtggtgaccttcaagaccttcgaggagatctggaagttcagcacctaccacgccctgggcttcacccaccactgcctggccaacctgctgatggaccaggccttctggctgctgctgcccagcgaggaggaggagaccgccatccaggtgcacgtggacgagaacgccctgagactgacccacgagagcctgctgatccaggagggccccttcttcgtgctgtgccccgaccaccacgtgagagtgatgaccggccccagagacgccggcaacggcccccaggccctgagacaggccagcggcgccccccagggcgaggccgcccccgagaccgacagcagcccccccagccccagcgtgagcagcgaggaggtggccgtggccgccgcccccgagcccctgatccccttccaccagtgggccctgagaatcccccaggaccccatcgacgacgccatgggcggccccgtgatgcccggcaaccccctgatggccgtgggcctggccagcgccctggccgacttccagggcagcggccccgaggagatgaccttcagaggcggcgacctgatcgagatcctgggcgcccaggtgcccagcctgccctggtgcgtgggcagacacgccgccagcggcagagtgggcttcgtgagaagcagcctgatcagcatgcagggccccgtgagcgagctggagagcgccatcttcctgaacgaggaggagaagagcttcttcagcgagggctgcttcagcgaggaggacgccagacagctgctgagaagaatgagcggcaccgacgtgtgcagcgtgtacagcctggacagcgtggaggaggccgagaccgagcagccccaggagaaggagatcccccccccctgcctgagcctggagccccaggagaccctgcagaaggtgaagaacgtgctggagcagtgcaagacctgccccggctgcccccaggagcccgccagctggggcctgtgcgccgccagcagcgacgtgagcctgcaggaccccgaggagcccagcttctgcctggaggccgaggacgactgggaggaccccgaggccctgagcagcctgctgctgttcctgaacgcccccggctacaaggccagcttcagaggcctgtacgacgtggccctgccctggctgagcagcgtgttcagaagcttcagcgacgaggaggagctgaccggcagactggcccaggccagaggcgccgccaagaaggccggcctgctgatggccctggccagactgtgcttcctgctgggcagactgtgcagcagaagactgaagctgagccaggccagagtgtacttcgaggaggccctgggcgccctggagggcagcttcggcgacctgttcctggtggtggccgtgtacgccaacctggccagcatctacagaaagcagaagaacagagagaagtgcgcccaggtggtgcccaaggccatggccctgctgctgggcacccccgaccacatctgcagcaccgaggccgagggcgagctgctgcagctggccctgagaagagccgtgggcggccagagcctgcaggccgaggccagagcctgcttcctgctggccagacaccacgtgcacctgaagcagcccgaggaggccctgcccttcctggagagactgctgctgctgcacagagacagcggcgcccccgaggccgcctggctgagcgactgctacctgctgctggccgacatctacagcagaaagtgcctgccccacctggtgctgagctgcgtgaaggtggccagcctgagaaccagaggcagcctggccggcagcctgagaagcgtgaacctggtgctgcagaacgccccccagccccacagcctgcccgcccagaccagccactacctgagacaggccctggccagcctgacccccggcaccggccaggccctgagaggccccctgtacaccagcctggcccagctgtacagccaccacggctgccacggccccgccatcaccttcatgacccaggccgtggaggccagcgccatcgccggcgtgagagccatcgtggaccacctggtggccctggcctggctgcacgtgctgcacggccagagccccgtggccctggacatcctgcagagcgtgagagacgccgtggtggccagcgaggaccaggagggcgtgatcgccaacatggtggccgtggccctgaagagaaccggcagaaccagacaggccgccgagagctactacagagccctgagagtggccagagacctgggccagcagagaaaccaggccgtgggcctggccaacttcggcgccctgtgcctgcacgccggcgccagcagactggcccagcactacctgctggaggccgtgagactgttcagcagactgcccctgggcgagtgcggcagagacttcacccacgtgctgctgcagctgggccacctgtgcaccagacagggccccgcccagcagggcaagggctactacgagtgggccctgctggtggccgtggagatgggccacgtggagagccagctgagagccgtgcagagactgtgccacttctacagcgccgtgatgcccagcgaggcccagtgcgtgatctaccacgagctgcagctgagcctggcctgcaaggtggccgacaaggtgctggagggccagctgctggagaccatcagccagctgtacctgagcctgggcaccgagagagcctacaagagcgccctggactacaccaagagaagcctgggcatcttcatcgacctgcagaagaaggagaaggaggcccacgcctggctgcaggccggcaagatctactacatcctgagacagagcgagctggtggacctgtacatccaggtggcccagaacgtggccctgtacaccggcgaccccaacctgggcctggagctgttcgaggccgccggcgacatcttcttcgacggcgcctgggagagagagaaggccgtgagcttctacagagacagagccctgcccctggccgtgaccaccggcaacagaaaggccgagctgagactgtgcaacaagctggtggccctgctggccaccctggaggagccccaggagggcctggagttcgcccacatggccctggccctgagcatcaccctgggcgacagactgaacgagagagtggcctaccacagactggccgccctgcagcacagactgggccacggcgagctggccgagcacttctacctgaaggccctgagcctgtgcaacagccccctggagttcgacgaggagaccctgtactacgtgaaggtgtacctggtgctgggcgacatcatcttctacgacctgaaggaccccttcgacgccgccggctactaccagctggccctggccgccgccgtggacctgggcaacaagaaggcccagctgaagatctacaccagactggccaccatctaccacaacttcctgctggacagagagaagagcctgttcttctaccagaaggccagaaccttcgccaccgagctgaacgtgagaagagtgaacctgccccccctgcccctgtgcggctgggccccctggctggcccccagccaccccagatag

SEQ ID NO: 24664 - DNA, 2469 bp, Artificial Sequence
  Description of Artificial Sequence: Synthetic coding sequence
cccaccagagccagcagcagcaagaagcagagaccccccagcagcggcagcagatgggccctgagaatcccccaggaccccatcgacgacgccatgggcggccccgtgatgcccggcaaccccctgatggccgtgggcctggccagcgccctggccgacttccagggcagcggccccgaggagatgaccttcagaggcggcgacctgatcgagatcctgggcgcccaggtgcccagcctgccctggtgcgtgggcagacacgccgccagcggcagagtgggcttcgtgagaagcagcctgatcagcatgcagggccccgtgagcgagctggagagcgccatcttcctgaacgaggaggagaagagcttcttcagcgagggctgcttcagcgaggaggacgccagacagctgctgagaagaatgagcggcaccgacgtgtgcagcgtgtacagcctggacagcgtggaggaggccgagaccgagcagccccaggagaaggagatcccccccccctgcctgagcctggagccccaggagaccctgcagaaggtgaagaacgtgctggagcagtgcaagacctgccccggctgcccccaggagcccgccagctggggcctgtgcgccgccagcagcgacgtgagcctgcaggaccccgaggagcccagcttctgcctggaggccgaggacgactgggaggaccccgaggccctgagcagcctgctgctgttcctgaacgcccccggctacaaggccagcttcagaggcctgtacgacgtggccctgccctggctgagcagcgtgttcagaagcttcagcgacgaggaggagctgaccggcagactggcccaggccagaggcgccgccaagaaggccggcctgctgatggccctggccagactgtgcttcctgctgggcagactgtgcagcagaagactgaagctgagccaggccagagtgtacttcgaggaggccctgggcgccctggagggcagcttcggcgacctgttcctggtggtggccgtgtacgccaacctggccagcatctacagaaagcagaagaacagagagaagtgcgcccaggtggtgcccaaggccatggccctgctgctgggcacccccgaccacatctgcagcaccgaggccgagggcgagctgctgcagctggccctgagaagagccgtgggcggccagagcctgcaggccgaggccagagcctgcttcctgctggccagacaccacgtgcacctgaagcagcccgaggaggccctgcccttcctggagagactgctgctgctgcacagagacagcggcgcccccgaggccgcctggctgagcgactgctacctgctgctggccgacatctacagcagaaagtgcctgccccacctggtgctgagctgcgtgaaggtggccagcctgagaaccagaggcagcctggccggcagcctgagaagcgtgaacctggtgctgcagaacgccccccagccccacagcctgcccgcccagaccagccactacctgagacaggccctggccagcctgacccccggcaccggccaggccctgagaggccccctgtacaccagcctggcccagctgtacagccaccacggctgccacggccccgccatcaccttcatgacccaggccgtggaggccagcgccatcgccggcgtgagagccatcgtggaccacctggtggccctggcctggctgcacgtgctgcacggccagagccccgtggccctggacatcctgcagagcgtgagagacgccgtggtggccagcgaggaccaggagggcgtgatcgccaacatggtggccgtggccctgaagagaaccggcagaaccagacaggccgccgagagctactacagagccctgagagtggccagagacctgggccagcagagaaaccaggccgtgggcctggccaacttcggcgccctgtgcctgcacgccggcgccagcagactggcccagcactacctgctggaggccgtgagactgttcagcagactgcccctgggcgagtgcggcagagacttcacccacgtgctgctgcagctgggccacctgtgcaccagacagggccccgcccagcagggcaagggctactacgagtgggccctgctggtggccgtggagatgggccacgtggagagccagctgagagccgtgcagagactgtgccacttctacagcgccgtgatgcccagcgaggcccagtgcgtgatctaccacgagctgcagctgagcctggcctgcaaggtggccgacaaggtgctggagggccagctgctggagaccatcagccagctgtacctgagcctgggcaccgagagaagcagccagccccagcagaagcagctgcacgccttctgggccgtgctgcccacctggtggctgctgagcagcgacctgtgcctgcccagagtgttcacccccggcctgcacctgagcccctag

SEQ ID NO: 24665 - DNA, 285 bp, Artificial Sequence
  Description of Artificial Sequence: Synthetic coding sequence
atggagaacctgcccgccgtgaccaccgaggagcccacccccatgggcagaggccccgtgggccccagcggcggcggcagcaccagagaccaggtgagaaccgtggtgatgagacccagcgtgagctgggagaaggccggccccgaggaggccaaggcccccgtgagaggcgacgaggccccccccgccagagtggccggccccgccgccggcacccccccctgccagatgggcgtgtaccccaccgacctgaccctgcagctgctggccgtgagaagaaagtag

SEQ ID NO: 24666 - DNA, 3195 bp, Artificial Sequence
  Description of Artificial Sequence: Synthetic coding sequence
atggaccaggccttctggctgctgctgcccagcgaggaggaggagaccgccatccaggtgcacgtggacgagaacgccctgagactgacccacgagagcctgctgatccaggagggccccttcttcgtgctgtgccccgaccaccacgtgagagtgatgaccggccccagagacgccggcaacggcccccaggccctgagacaggccagcggcgccccccagggcgaggccgcccccgagaccgacagcagcccccccagccccagcgtgagcagcgaggaggtggccgtggccgccgcccccgagcccctgatccccttccaccagtgggccctgagaatcccccaggaccccatcgacgacgccatgggcggccccgtgatgcccggcaaccccctgatggccgtgggcctggccagcgccctggccgacttccagggcagcggccccgaggagatgaccttcagaggcggcgacctgatcgagatcctgggcgcccaggtgcccagcctgccctggtgcgtgggcagacacgccgccagcggcagagtgggcttcgtgagaagcagcctgatcagcatgcagggccccgtgagcgagctggagagcgccatcttcctgaacgaggaggagaagagcttcttcagcgagggctgcttcagcgaggaggacgccagacagctgctgagaagaatgagcggcaccgacgtgtgcagcgtgtacagcctggacagcgtggaggaggccgagaccgagcagccccaggagaaggagatcccccccccctgcctgagcctggagccccaggagaccctgcagaaggtgaagaacgtgctggagcagtgcaagacctgccccggctgcccccaggagcccgccagctggggcctgtgcgccgccagcagcgacgtgagcctgcaggaccccgaggagcccagcttctgcctggaggccgaggacgactgggaggaccccgaggccctgagcagcctgctgctgttcctgaacgcccccggctacaaggccagcttcagaggcctgtacgacgtggccctgccctggctgagcagcgtgttcagaagcttcagcgacgaggaggagctgaccggcagactggcccaggccagaggcgccgccaagaaggccggcctgctgatggccctggccagactgtgcttcctgctgggcagactgtgcagcagaagactgaagctgagccaggccagagtgtacttcgaggaggccctgggcgccctggagggcagcttcggcgacctgttcctggtggtggccgtgtacgccaacctggccagcatctacagaaagcagaagaacagagagaagtgcgcccaggtggtgcccaaggccatggccctgctgctgggcacccccgaccacatctgcagcaccgaggccgagggcgagctgctgcagctggccctgagaagagccgtgggcggccagagcctgcaggccgaggccagagcctgcttcctgctggccagacaccacgtgcacctgaagcagcccgaggaggccctgcccttcctggagagactgctgctgctgcacagagacagcggcgcccccgaggccgcctggctgagcgactgctacctgctgctggccgacatctacagcagaaagtgcctgccccacctggtgctgagctgcgtgaaggtggccagcctgagaaccagaggcagcctggccggcagcctgagaagcgtgaacctggtgctgcagaacgccccccagccccacagcctgcccgcccagaccagccactacctgagacaggccctggccagcctgacccccggcaccggccaggccctgagaggccccctgtacaccagcctggcccagctgtacagccaccacggctgccacggccccgccatcaccttcatgacccaggccgtggaggccagcgccatcgccggcgtgagagccatcgtggaccacctggtggccctggcctggctgcacgtgctgcacggccagagccccgtggccctggacatcctgcagagcgtgagagacgccgtggtggccagcgaggaccaggagggcgtgatcgccaacatggtggccgtggccctgaagagaaccggcagaaccagacaggccgccgagagctactacagagccctgagagtggccagagacctgggccagcagagaaaccaggccgtgggcctggccaacttcggcgccctgtgcctgcacgccggcgccagcagactggcccagcactacctgctggaggccgtgagactgttcagcagactgcccctgggcgagtgcggcagagacttcacccacgtgctgctgcagctgggccacctgtgcaccagacagggccccgcccagcagggcaagggctactacgagtgggccctgctggtggccgtggagatgggccacgtggagagccagctgagagccgtgcagagactgtgccacttctacagcgccgtgatgcccagcgaggcccagtgcgtgatctaccacgagctgcagctgagcctggcctgcaaggtggccgacaaggtgctggagggccagctgctggagaccatcagccagctgtacctgagcctgggcaccgagagagcctacaagagcgccctggactacaccaagagaagcctgggcatcttcatcgacctgcagaagaaggagaaggaggcccacgcctggctgcaggccggcaagatctactacatcctgagacagagcgagctggtggacctgtacatccaggtggcccagaacgtggccctgtacaccggcgaccccaacctgggcctggagctgttcgaggccgccggcgacatcttcttcgacggcgcctgggagagagagaaggccgtgagcttctacagagacagagccctgcccctggccgtgaccaccggcaacagaaaggccgagctgagactgtgcaacaagctggtggccctgctggccaccctggaggagccccaggagggcctggagttcgcccacatggccctggccctgagcatcaccctgggcgacagactgaacgagagagtggcctaccacagactggccgccctgcagcacagactgggccacggcgagctggccgagcacttctacctgaaggccctgagcctgtgcaacagccccctggagttcgacgaggagaccctgtacacctag

SEQ ID NO: 24667 - DNA, 3783 bp, Artificial Sequence
  Description of Artificial Sequence: Synthetic coding sequence
atgggcgtgtaccccaccgacctgaccctgcagctgctggccgtgagaagaaagagcagactgagagaccccggcctgcagcagaccctgagaggccagctgagactgctggagaacgacagcagagagatggccagagtgctgggcgagctgagcgccagactgctgagcatccacagcgaccaggacagaatcgtggtgaccttcaagaccttcgaggagatctggaagttcagcacctaccacgccctgggcttcacccaccactgcctggccaacctgctgatggaccaggccttctggctgctgctgcccagcgaggaggaggagaccgccatccaggtgcacgtggacgagaacgccctgagactgacccacgagagcctgctgatccaggagggccccttcttcgtgctgtgccccgaccaccacgtgagagtgatgaccggccccagagacgccggcaacggcccccaggccctgagacaggccagcggcgccccccagggcgaggccgcccccgagaccgacagcagcccccccagccccagcgtgagcagcgaggaggtggccgtggccgccgcccccgagcccctgatccccttccaccagtgggccctgagaatcccccaggaccccatcgacgacgccatgggcggccccgtgatgcccggcaaccccctgatggccgtgggcctggccagcgccctggccgacttccagggcagcggccccgaggagatgaccttcagaggcggcgacctgatcgagatcctgggcgcccaggtgcccagcctgccctggtgcgtgggcagacacgccgccagcggcagagtgggcttcgtgagaagcagcctgatcagcatgcagggccccgtgagcgagctggagagcgccatcttcctgaacgaggaggagaagagcttcttcagcgagggctgcttcagcgaggaggacgccagacagctgctgagaagaatgagcggcaccgacgtgtgcagcgtgtacagcctggacagcgtggaggaggccgagaccgagcagccccaggagaaggagatcccccccccctgcctgagcctggagccccaggagaccctgcagaaggtgaagaacgtgctggagcagtgcaagacctgccccggctgcccccaggagcccgccagctggggcctgtgcgccgccagcagcgacgtgagcctgcaggaccccgaggagcccagcttctgcctggaggccgaggacgactgggaggaccccgaggccctgagcagcctgctgctgttcctgaacgcccccggctacaaggccagcttcagaggcctgtacgacgtggccctgccctggctgagcagcgtgttcagaagcttcagcgacgaggaggagctgaccggcagactggcccaggccagaggcgccgccaagaaggccggcctgctgatggccctggccagactgtgcttcctgctgggcagactgtgcagcagaagactgaagctgagccaggccagagtgtacttcgaggaggccctgggcgccctggagggcagcttcggcgacctgttcctggtggtggccgtgtacgccaacctggccagcatctacagaaagcagaagaacagagagaagtgcgcccaggtggtgcccaaggccatggccctgctgctgggcacccccgaccacatctgcagcaccgaggccgagggcgagctgctgcagctggccctgagaagagccgtgggcggccagagcctgcaggccgaggccagagcctgcttcctgctggccagacaccacgtgcacctgaagcagcccgaggaggccctgcccttcctggagagactgctgctgctgcacagagacagcggcgcccccgaggccgcctggctgagcgactgctacctgctgctggccgacatctacagcagaaagtgcctgccccacctggtgctgagctgcgtgaaggtggccagcctgagaaccagaggcagcctggccggcagcctgagaagcgtgaacctggtgctgcagaacgccccccagccccacagcctgcccgcccagaccagccactacctgagacaggccctggccagcctgacccccggcaccggccaggccctgagaggccccctgtacaccagcctggcccagctgtacagccaccacggctgccacggccccgccatcaccttcatgacccaggccgtggaggccagcgccatcgccggcgtgagagccatcgtggaccacctggtggccctggcctggctgcacgtgctgcacggccagagccccgtggccctggacatcctgcagagcgtgagagacgccgtggtggccagcgaggaccaggagggcgtgatcgccaacatggtggccgtggccctgaagagaaccggcagaaccagacaggccgccgagagctactacagagccctgagagtggccagagacctgggccagcagagaaaccaggccgtgggcctggccaacttcggcgccctgtgcctgcacgccggcgccagcagactggcccagcactacctgctggaggccgtgagactgttcagcagactgcccctgggcgagtgcggcagagacttcacccacgtgctgctgcagctgggccacctgtgcaccagacagggccccgcccagcagggcaagggctactacgagtgggccctgctggtggccgtggagatgggccacgtggagagccagctgagagccgtgcagagactgtgccacttctacagcgccgtgatgcccagcgaggcccagtgcgtgatctaccacgagctgcagctgagcctggcctgcaaggtggccgacaaggtgctggagggccagctgctggagaccatcagccagctgtacctgagcctgggcaccgagagagcctacaagagcgccctggactacaccaagagaagcctgggcatcttcatcgacctgcagaagaaggagaaggaggcccacgcctggctgcaggccggcaagatctactacatcctgagacagagcgagctggtggacctgtacatccaggtggcccagaacgtggccctgtacaccggcgaccccaacctgggcctggagctgttcgaggccgccggcgacatcttcttcgacggcgcctgggagagagagaaggccgtgagcttctacagagacagagccctgcccctggccgtgaccaccggcaacagaaaggccgagctgagactgtgcaacaagctggtggccctgctggccaccctggaggagccccaggagggcctggagttcgcccacatggccctggccctgagcatcaccctgggcgacagactgaacgagagagtggcctaccacagactggccgccctgcagcacagactgggccacggcgagctggccgagcacttctacctgaaggccctgagcctgtgcaacagccccctggagttcgacgaggagaccctgtactacgtgaaggtgtacctggtgctgggcgacatcatcttctacgacctgaaggaccccttcgacgccgccggctactaccagctggccctggccgccgccgtggacctgggcaacaagaaggcccagctgaagatctacaccagactggccaccatctaccacaacttcctgctggacagagagaagagcctgttcttctaccagaaggccagaaccttcgccaccgagctgaacgtgagaagagtgaacctgccccccctgcccctgtgcggctgggccccctggctggcccccagccaccccagatag

SEQ ID NO: 24668 - DNA, 1209 bp, Artificial Sequence
  Description of Artificial Sequence: Synthetic coding sequence
atgcccgacaagaccgccacccccgagagaccccccgcccccgagaacgcccccagcagcaagaagatccccgcccccgacaaggtgcccagccccgagaagaccctgaccctgggcgacaaggccagcatccccggcaacagcaccagcggcaagatccccgcccccgacaaggtgcccacccccgagaagatggtgacccccgaggacaaggccagcatccccgagaacagcatcatccccgaggagaccctgaccgtggacaagcccagcacccccgagagagtgttcagcgtggaggagagccccgccctggaggccccccccatggacaaggtgcccaaccccaagatggcccccctgggcgacgaggcccccaccctggagaaggtgctgacccccgagctgagcgaggaggaggtgagcaccagagacgacatccagttccaccacttcagcagcgaggaggccctgcagaaggtgaagtacttcgtggccaaggaggaccccagcagccaggaggaggcccacacccccgaggccccccccccccagccccccagcagcgagagatgcctgggcgagatgaagtgcaccctggtgagaggcgacagcagccccagacaggccgagctgaagagcggccccgccagcagacccgccctggagaagccccacccccacgaggaggccaccaccctgcccgaggaggcccccagcaacgacgagagaacccccgaggaggaggccccccccaacgagcagagacccctgagagaggaggtgctgcccaaggagggcgtggccagcaaggaggaggtgaccctgaaggaggagctgccccccaaggaggaggtggcccccaaggaggaggtgccccccatcgagagagccttcgcccagaagaccagacccatcaagcccccccccgacagccaggagaccctggccctgcccagcctggtgccccagaactacaccgagaacaagaacgagggcgtggacgtgaccagcctgagaggcgaggtggagagcctgagaagagccctggagctgatggaggtgcagctggagagaaagctgaccgacatctgggaggagctgaagagcgagaaggagcagagaagaagactggaggtgcaggtgatgcagggcacccagaagagccagacccccagagtgatccacacccagacccagacctactag

SEQ ID NO: 24669 - DNA, 1923 bp, Artificial Sequence
  Description of Artificial Sequence: Synthetic coding sequence
atggtgcagagcgagctgcagctgcagcccagagccggcggcagagccgaggccgccagctggggcgacagaggcaacgacaagggcggcctgggcaaccccgacatgcccagcgtgagccccggcccccagagaccccccaagctgagcagcctggcctacgacagcccccccgactacctgcagaccgtgagccaccccgaggtgtacagagtgctgttcgactaccagcccgaggcccccgacgagctggccctgagaagaggcgacgtggtgaaggtgctgagcaagaccaccgaggacaagggctggtgggagggcgagtgccagggcagaagaggcgtgttccccgacaacttcgtgctgccccccccccccatcaagaagctggtgcccagaaaggtggtgagcagagagagcgcccccatcaaggagcccaagaagctgatgcccaagaccagcctgcccaccgtgaagaagctggccaccgccaccaccggccccagcaaggccaagaccagcagaacccccagcagagacagccagaagctgaccagcagagacagcggccccaacggcggcttccagagcggcggcagctaccaccccggcagaaagagaagcaagacccagaccccccagcagagaagcgtgagcagccaggaggaggagcacagcagccccgtgaaggcccccagcgtgaagagaacccccatgcccgacaagaccgccacccccgagagaccccccgcccccgagaacgcccccagcagcaagaagatccccgcccccgacaaggtgcccagccccgagaagaccctgaccctgggcgacaaggccagcatccccggcaacagcaccagcggcaagatccccgcccccgacaaggtgcccacccccgagaagatggtgacccccgaggacaaggccagcatccccgagaacagcatcatccccgaggagaccctgaccgtggacaagcccagcacccccgagagagtgttcagcgtggaggagagccccgccctggaggccccccccatggacaaggtgcccaaccccaagatggcccccctgggcgacgaggcccccaccctggagaaggtgctgacccccgagctgagcgaggaggaggtgagcaccagagacgacatccagttccaccacttcagcagcgaggaggccctgcagaaggtgaagtacttcgtggccaaggaggaccccagcagccaggaggaggcccacacccccgaggccccccccccccagccccccagcagcgagagatgcctgggcgagatgaagtgcaccctggtgagaggcgacagcagccccagacaggccgagctgaagagcggccccgccagcagacccgccctggagaagccccacccccacgaggaggccaccaccctgcccgaggaggcccccagcaacgacgagagaacccccgaggaggaggccccccccaacgagcagagacccctgagagaggaggtgctgcccaaggagggcgtggccagcaaggaggaggtgaccctgaaggaggagctgccccccaaggaggaggtggcccccaaggaggaggtgccccccatcgagagagccttcgcccagaagaccagacccatcaagcccccccccgacagccaggagaccctggccctgcccagcctggtgccccagaactacaccgagaacaagaacgagggcgtggacgtgaccagcctgagaggcgaggtggagagcctgagaagagccctggagctgatggaggtgcagctggagagaaagctgaccgacatctgggaggagctgaagagcgagaaggagcagagaagaagactggaggtgcaggtgatgcagggcacccagaagagccagacccccagagtgatccacacccagacccagacctactag

SEQ ID NO: 24670 - DNA, 2271 bp, Artificial Sequence
  Description of Artificial Sequence: Synthetic coding sequence
atggaggtgctggtgctggccggctacagagcccagaaggaggacgagctgagcctggcccccggcgacgtggtgagacaggtgagatgggtgcccgccagaggctggctgagaggcgagttcggcggcagatacggcctgttccccgagagactggtgcaggagatccccgagaccctgagaggcagcggcgaggccagaagacccagatgcgccagaagaagaggccaccccgccaagcaccccagaccccagagatggtgcaaggtgaacttcagctacagccccgagcaggccgacgagctgaagctgcaggccggcgagatcgtggagatgatcaaggagatcgaggacggctggtggctgggcaagaagaacggccagctgggcgccttccccagcaacttcgtggagctgctggacagcggcccccccagcctgggcaaccccgacatgcccagcgtgagccccggcccccagagaccccccaagctgagcagcctggcctacgacagcccccccgactacctgcagaccgtgagccaccccgaggtgtacagagtgctgttcgactaccagcccgaggcccccgacgagctggccctgagaagaggcgacgtggtgaaggtgctgagcaagaccaccgaggacaagggctggtgggagggcgagtgccagggcagaagaggcgtgttccccgacaacttcgtgctgccccccccccccatcaagaagctggtgcccagaaaggtggtgagcagagagagcgcccccatcaaggagcccaagaagctgatgcccaagaccagcctgcccaccgtgaagaagctggccaccgccaccaccggccccagcaaggccaagaccagcagaacccccagcagagacagccagaagctgaccagcagagacagcggccccaacggcggcttccagagcggcggcagctaccaccccggcagaaagagaagcaagacccagaccccccagcagagaagcgtgagcagccaggaggaggagcacagcagccccgtgaaggcccccagcgtgaagagaacccccatgcccgacaagaccgccacccccgagagaccccccgcccccgagaacgcccccagcagcaagaagatccccgcccccgacaaggtgcccagccccgagaagaccctgaccctgggcgacaaggccagcatccccggcaacagcaccagcggcaagatccccgcccccgacaaggtgcccacccccgagaagatggtgacccccgaggacaaggccagcatccccgagaacagcatcatccccgaggagaccctgaccgtggacaagcccagcacccccgagagagtgttcagcgtggaggagagccccgccctggaggccccccccatggacaaggtgcccaaccccaagatggcccccctgggcgacgaggcccccaccctggagaaggtgctgacccccgagctgagcgaggaggaggtgagcaccagagacgacatccagttccaccacttcagcagcgaggaggccctgcagaaggtgaagtacttcgtggccaaggaggaccccagcagccaggaggaggcccacacccccgaggccccccccccccagccccccagcagcgagagatgcctgggcgagatgaagtgcaccctggtgagaggcgacagcagccccagacaggccgagctgaagagcggccccgccagcagacccgccctggagaagccccacccccacgaggaggccaccaccctgcccgaggaggcccccagcaacgacgagagaacccccgaggaggaggccccccccaacgagcagagacccctgagagaggaggtgctgcccaaggagggcgtggccagcaaggaggaggtgaccctgaaggaggagctgccccccaaggaggaggtggcccccaaggaggaggtgccccccatcgagagagccttcgcccagaagaccagacccatcaagcccccccccgacagccaggagaccctggccctgcccagcctggtgccccagaactacaccgagaacaagaacgagggcgtggacgtgaccagcctgagaggcgaggtggagagcctgagaagagccctggagctgatggaggtgcagctggagagaaagctgaccgacatctgggaggagctgaagagcgagaaggagcagagaagaagactggaggtgcaggtgatgcagggcacccagaagagccagacccccagagtgatccacacccagacccagacctactag

SEQ ID NO: 24671 - DNA, 1938 bp, Artificial Sequence
  Description of Artificial Sequence: Synthetic coding sequence
atgatcaaggagatcgaggacggctggtggctgggcaagaagaacggccagctgggcgccttccccagcaacttcgtggagctgctggacagcggcccccccagcctgggcaaccccgacatgcccagcgtgagccccggcccccagagaccccccaagctgagcagcctggcctacgacagcccccccgactacctgcagaccgtgagccaccccgaggtgtacagagtgctgttcgactaccagcccgaggcccccgacgagctggccctgagaagaggcgacgtggtgaaggtgctgagcaagaccaccgaggacaagggctggtgggagggcgagtgccagggcagaagaggcgtgttccccgacaacttcgtgctgccccccccccccatcaagaagctggtgcccagaaaggtggtgagcagagagagcgcccccatcaaggagcccaagaagctgatgcccaagaccagcctgcccaccgtgaagaagctggccaccgccaccaccggccccagcaaggccaagaccagcagaacccccagcagagacagccagaagctgaccagcagagacagcggccccaacggcggcttccagagcggcggcagctaccaccccggcagaaagagaagcaagacccagaccccccagcagagaagcgtgagcagccaggaggaggagcacagcagccccgtgaaggcccccagcgtgaagagaacccccatgcccgacaagaccgccacccccgagagaccccccgcccccgagaacgcccccagcagcaagaagatccccgcccccgacaaggtgcccagccccgagaagaccctgaccctgggcgacaaggccagcatccccggcaacagcaccagcggcaagatccccgcccccgacaaggtgcccacccccgagaagatggtgacccccgaggacaaggccagcatccccgagaacagcatcatccccgaggagaccctgaccgtggacaagcccagcacccccgagagagtgttcagcgtggaggagagccccgccctggaggccccccccatggacaaggtgcccaaccccaagatggcccccctgggcgacgaggcccccaccctggagaaggtgctgacccccgagctgagcgaggaggaggtgagcaccagagacgacatccagttccaccacttcagcagcgaggaggccctgcagaaggtgaagtacttcgtggccaaggaggaccccagcagccaggaggaggcccacacccccgaggccccccccccccagccccccagcagcgagagatgcctgggcgagatgaagtgcaccctggtgagaggcgacagcagccccagacaggccgagctgaagagcggccccgccagcagacccgccctggagaagccccacccccacgaggaggccaccaccctgcccgaggaggcccccagcaacgacgagagaacccccgaggaggaggccccccccaacgagcagagacccctgagagaggaggtgctgcccaaggagggcgtggccagcaaggaggaggtgaccctgaaggaggagctgccccccaaggaggaggtggcccccaaggaggaggtgccccccatcgagagagccttcgcccagaagaccagacccatcaagcccccccccgacagccaggagaccctggccctgcccagcctggtgccccagaactacaccgagaacaagaacgagggcgtggacgtgaccagcctgagaggcgaggtggagagcctgagaagagccctggagctgatggaggtgcagctggagagaaagctgaccgacatctgggaggagctgaagagcgagaaggagcagagaagaagactggaggtgcaggtgatgcagggcacccagaagagccagacccccagagtgatccacacccagacccagacctactag

SEQ ID NO: 24672 - DNA, 2649 bp, Artificial Sequence
  Description of Artificial Sequence: Synthetic coding sequence
atgctgctgggcgccagctggctgtgcgccagcaaggccgccgccgccgccgcccagagcgagggcgacgaggacagacccggcgagagaagaagaagaagagccgccgccaccgccgccggcgccggcgaggacatggacgagagcagcctgctggacctgctggagtgcagcgtgtgcctggagagactggacaccaccgccaaggtgctgccctgccagcacaccttctgcagaagatgcctggagagcatcgtgtgcagcagacacgagctgagatgccccgagtgcagaatcctggtgggctgcggcgtggacgagctgcccgccaacatcctgctggtgagactgctggacggcatcagacagagacccagagccggcaccagccccggcggcagcccccccgccagacccatccccggccagagcgccgcccccaccctggccggcggcggcggcggcgccgccggcagcacccccggcagccccgtgttcctgagcgccgccgccggcagcaccgccggcagcctgagagagctggccaccagcagaaccgcccccgccgccaagaacccctgcctgctgccctacggcaaggccctgtacagctacgagggcaaggagcccggcgacctgaagttcaacaagggcgacatcatcgtgctgagaagaaaggtggacgagcagtggtaccacggcgagctgcacggcacccagggcttcctgcccgccagctacatccagtgcatccagcccctgccccacgcccccccccagggcaaggccctgtacgacttcgagatgaaggacaaggaccaggacaaggactgcctgaccttcaccaaggacgagatcctgaccgtgctgagaagagtggacgagaactgggccgagggcatgctgggcgacaagatcggcatcttccccctgctgtacgtggagctgaacgacagcgccaagcagctgatcgagatggacaagccctgccccgccgccgccagcagctgcaacgccagcctgcccagcgacagcggcgccgtggccagcgtggcccccagccccaccctgagcagcagcggcgccgtgagcgccttccagagaagagtggacggcaagaagaacaccaagaagagacacagcttcaccgccctgagcgtgacccacagaagcagccaggccgccagccacagacacagcatggagatcagcgcccccgtgctgatcagcagcagcgaccccagagccgccgccagaatcggcgacctggcccacctgagctgcgccgcccccacccaggacgtgagcagcagcgccggcagcacccccaccgccgtgcccagagccgccagcgtgagcggcgagcagggcaccccccccaaggtgcagctgcccctgaacgtgtacctggccctgtacgcctacaagccccagaagagcgacgagctggagctgcacaagggcgagatgtacagagtgctggagaagtgccaggacggctggttcaagggcgccagcctgagaaccggcgtgagcggcgtgttccccggcaactacgtgacccccgtgagcagagtgcccgccggcggcgccggcccccccagaaacaacgtggtgggcggcagccccctggccaagggcatcaccaccaccatgcaccccggcagcggcagcctgagcagcctggccaccgccaccagacccgccctgcccatcaccaccccccaggcccacgcccagcaccccaccgccagcccccccaccggcagctgcctgagacacagcgcccagcccaccgccagccaggccagaagcaccatcagcaccgccgcccacagcgccgcccaggcccaggacagacccaccgccaccgtgagccccctgagaacccagaacagccccagcagactgcccgccaccagcctgagaccccacagcgtggtgagcccccagcacagccaccagccccccgtgcagatgtgccccagacccgccatccccctgaccagcgccgccagcgccatcaccccccccaacgtgagcgccgccaacctgaacggcgaggccggcggcggccccatcggcgtgctgagcaccagcagccccaccaacaccggctgcaagctggacgagaagaagagcgagaagaaggagaagaagagcggcctgctgaagctgctggccggcgccagcaccaagaagaagagcagaagcccccccagcgtgagccccacccacgacccccaggtggccgtggacgccctgctgcagggcgccgtgggccccgaggtgagcagcctgagcatccacggcagagccggcagctgccccatcgagagcgagatgcagggcgccatgggcatggagcccctgcacagaaaggccggcagcctggacctgaacttcaccagccccagcagacaggcccccctgagcatggccgccatcagacccgagcccaagctgctgcccagagagagatacagagtggtggtgagctaccccccccagagcgaggccgagatcgagctgaaggagggcgacatcgtgttcgtgcacaagaagagagaggacggctggtacaagggcaccctgcagagaaacggcagaaccggcctgttccccggcagcttcgtggagagcttctag

SEQ ID NO: 24673 - DNA, 2151 bp, Artificial Sequence
  Description of Artificial Sequence: Synthetic coding sequence
atgctgctgggcgccagctggctgtgcgccagcaaggccgccgccgccgccgcccagagcgagggcgacgaggacagacccggcgagagaagaagaagaagagccgccgccaccgccgccggcgccggcgaggacatggacgagagcagcctgctggacctgctggagtgcagcgtgtgcctggagagactggacaccaccgccaaggtgctgccctgccagcacaccttctgcagaagatgcctggagagcatcgtgtgcagcagacacgagctgagatgccccgagtgcagaatcctggtgggctgcggcgtggacgagctgcccgccaacatcctgctggtgagactgctggacggcatcagacagagacccagagccggcaccagccccggcggcagcccccccgccagacccatccccggccagagcgccgcccccaccctggccggcggcggcggcggcgccgccggcagcacccccggcagccccgtgttcctgagcgccgccgccggcagcaccgccggcagcctgagagagctggccaccagcagaaccgcccccgccgccaagaacccctgcctgctgccctacggcaaggccctgtacagctacgagggcaaggagcccggcgacctgaagttcaacaagggcgacatcatcgtgctgagaagaaaggtggacgagcagtggtaccacggcgagctgcacggcacccagggcttcctgcccgccagctacatccagtgcatccagcccctgccccacgcccccccccagggcaaggccctgtacgacttcgagatgaaggacaaggaccaggacaaggactgcctgaccttcaccaaggacgagatcctgaccgtgctgagaagagtggacgagaactgggccgagggcatgctgggcgacaagatcggcatcttccccctgctgtacgtggagctgaacgacagcgccaagcagctgatcgagatggacaagccctgccccgccgccgccagcagctgcaacgccagcctgcccagcgacagcggcgccgtggccagcgtggcccccagccccaccctgagcagcagcggcgccgtgagcgccttccagagaagagtggacggcaagaagaacaccaagaagagacacagcttcaccgccctgagcgtgacccacagaagcagccaggccgccagccacagacacagcatggagatcagcgcccccgtgctgatcagcagcagcgaccccagagccgccgccagaatcggcgacctggcccacctgagctgcgccgcccccacccaggacgtgagcagcagcgccggcagcacccccaccgccgtgcccagagccgccagcgtgagcggcgagcagggcaccccccccaaggtgcagctgcccctgaacgtgtacctggccctgtacgcctacaagccccagaagagcgacgagctggagctgcacaagggcgagatgtacagagtgctggagaagtgccaggacggctggttcaagggcgccagcctgagaaccggcgtgagcggcgtgttccccggcaactacgtgacccccgtgagcagagtgcccgccggcggcgccggcccccccagaaacaacgtggtgggcggcagccccctggccaagggcatcaccaccaccatgcaccccggcagcggcagcctgagcagcctggccaccgccaccagacccgccctgcccatcaccaccccccaggcccacgcccagcaccccaccgccagcccccccaccggcagctgcctgagacacagcgcccagcccaccgccagccaggccagaagcaccatcagcaccgccgcccacagcgccgcccaggcccaggacagacccaccgccaccgtgagccccctgagaacccagaacagccccagcagactgcccgccaccagcctgagaccccacagcgtggtgagcccccagcacagccaccagccccccgtgcagatgtgccccagacccgccatccccctgaccagcgccgccagcgccatcaccccccccaacgtgagcgccgccaacctgaacggcgaggccggcggcggccccatcggcgtgctgagcaccagcagccccaccaacaccggctgcaagctggacgagaagaagagcgagaagtag

SEQ ID NO: 24674 - DNA, 171 bp, Artificial Sequence
  Description of Artificial Sequence: Synthetic coding sequence
tgatacagagtggtggtgagctaccccccccagagcgaggccgagatcgagctgaaggagggcgacatcgtgttcgtgcacaagaagagagaggacggctggtacaagggcaccctgcagagaaacggcagaaccggcctgttccccggcagcttcgtggagagcttctag

SEQ ID NO: 24675 - DNA, 1029 bp, Artificial Sequence
  Description of Artificial Sequence: Synthetic coding sequence
atgaacaaccccatccccagcaacctgaagagcgaggccaagaaggccgccaagatcctgagagagttcaccgagatcaccagcagaaacggccccgacaagatcatccccgcccacgtgatcgccaaggccaagggcctggccatcctgagcgtgatcaaggccggcttcctggtgaccgccagaggcggcagcggcatcgtggtggccagactgcccgacggcaagtggagcgcccccagcgccatcggcatcgccggcctgggcggcggcttcgagatcggcatcgaggtgagcgacctggtgatcatcctgaactacgacagagccgtggaggccttcgccaagggcggcaacctgaccctgggcggcaacctgaccgtggccgtgggccccctgggcagaaacctggagggcaacgtggccctgagaagcagcgccgccgtgttcacctactgcaagagcagaggcctgttcgccggcgtgagcctggagggcagctgcctgatcgagagaaaggagaccaacagaaagttctactgccaggacatcagagcctacgacatcctgttcggcgacacccccagacccgcccaggccgaggacctgtacgagatcctggacagcttcaccgagaagtacgagaacgagggccagagaatcaacgccagaaaggccgccagagagcagagaaagagcagcgccaaggagctgccccccaagcccctgagcagaccccagcagagcagcgcccccgtgcagctgaacagcggcagccagagcaacagaaacgagtacaagctgtaccccggcctgagcagctaccacgagagagtgggcaacctgaaccagcccatcgaggtgaccgccctgtacagcttcgagggccagcagcccggcgacctgaacttccaggccggcgacagaatcaccgtgatcagcaagaccgacagccacttcgactggtgggagggcaagctgagaggccagaccggcatcttccccgccaactacgtgaccatgaactag

SEQ ID NO: 24676 - DNA, 684 bp, Artificial Sequence
  Description of Artificial Sequence: Synthetic coding sequence
atggtgagcgacctggtgatcatcctgaactacgacagagccgtggaggccttcgccaagggcggcaacctgaccctgggcggcaacctgaccgtggccgtgggccccctgggcagaaacctggagggcaacgtggccctgagaagcagcgccgccgtgttcacctactgcaagagcagaggcctgttcgccggcgtgagcctggagggcagctgcctgatcgagagaaaggagaccaacagaaagttctactgccaggacatcagagcctacgacatcctgttcggcgacacccccagacccgcccaggccgaggacctgtacgagatcctggacagcttcaccgagaagtacgagaacgagggccagagaatcaacgccagaaaggccgccagagagcagagaaagagcagcgccaaggagctgccccccaagcccctgagcagaccccagcagagcagcgcccccgtgcagctgaacagcggcagccagagcaacctgaaccagcccatcgaggtgaccgccctgtacagcttcgagggccagcagcccggcgacctgaacttccaggccggcgacagaatcaccgtgatcagcaagaccgacagccacttcgactggtgggagggcaagctgagaggccagaccggcatcttccccgccaactacgtgaccatgaactag

SEQ ID NO: 24677 - DNA, 684 bp, Artificial Sequence; identical to SEQ ID NO: 24676
  Description of Artificial Sequence: Synthetic coding sequence

SEQ ID NO: 24678 - DNA, 972 bp, Artificial Sequence
  Description of Artificial Sequence: Synthetic coding sequence
atgaacaaccccatccccagcaacctgaagagcgaggccaagaaggccgccaagatcctgagagagttcaccgagatcaccagcagaaacggccccgacaagatcatccccgcccacgtgatcgccaaggccaagggcctggccatcctgagcgtgatcaaggccggcttcctggtgaccgccagaggcggcagcggcatcgtggtggccagactgcccgacggcaagtggagcgcccccagcgccatcggcatcgccggcctgggcggcggcttcgagatcggcatcgaggtgagcgacctggtgatcatcctgaactacgacagagccgtggaggccttcgccaagggcggcaacctgaccctgggcggcaacctgaccgtggccgtgggccccctgggcagaaacctggagggcaacgtggccctgagaagcagcgccgccgtgttcacctactgcaagagcagaggcctgttcgccggcgtgagcctggagggcagctgcctgatcgagagaaaggagaccaacagaaagttctactgccaggacatcagagcctacgacatcctgttcggcgacacccccagacccgcccaggccgaggacctgtacgagatcctggacagcttcaccgagaagtacgagaacgagggccagagaatcaacgccagaaaggccgccagagagcagagaaagagcagcgccaaggagctgccccccaagcccctgagcagaccccagcagagcagcgcccccgtgcagctgaacagcggcagccagagcaacctgaaccagcccatcgaggtgaccgccctgtacagcttcgagggccagcagcccggcgacctgaacttccaggccggcgacagaatcaccgtgatcagcaagaccgacagccacttcgactggtgggagggcaagctgagaggccagaccggcatcttccccgccaactacgtgaccatgaactag

SEQ ID NO: 24679 - DNA, 1029 bp, Artificial Sequence; identical to SEQ ID NO: 24675
  Description of Artificial Sequence: Synthetic coding sequence

SEQ ID NO: 24680 - DNA, 741 bp, Artificial Sequence
  Description of Artificial Sequence: Synthetic coding sequence
atggtgagcgacctggtgatcatcctgaactacgacagagccgtggaggccttcgccaagggcggcaacctgaccctgggcggcaacctgaccgtggccgtgggccccctgggcagaaacctggagggcaacgtggccctgagaagcagcgccgccgtgttcacctactgcaagagcagaggcctgttcgccggcgtgagcctggagggcagctgcctgatcgagagaaaggagaccaacagaaagttctactgccaggacatcagagcctacgacatcctgttcggcgacacccccagacccgcccaggccgaggacctgtacgagatcctggacagcttcaccgagaagtacgagaacgagggccagagaatcaacgccagaaaggccgccagagagcagagaaagagcagcgccaaggagctgccccccaagcccctgagcagaccccagcagagcagcgcccccgtgcagctgaacagcggcagccagagcaacagaaacgagtacaagctgtaccccggcctgagcagctaccacgagagagtgggcaacctgaaccagcccatcgaggtgaccgccctgtacagcttcgagggccagcagcccggcgacctgaacttccaggccggcgacagaatcaccgtgatcagcaagaccgacagccacttcgactggtgggagggcaagctgagaggccagaccggcatcttccccgccaactacgtgaccatgaactag

SEQ ID NO: 24681 - DNA, 156 bp, Artificial Sequence
  Description of Artificial Sequence: Synthetic coding sequence
atgaacaaccccatccccagcaacctgaagagcgaggccaagaaggccgccaagatcctgagagagttcaccgagatcaccagcagaaacggccccgacaagatcatccccgcccacgtgatcgccaaggccaagggcctggccatcctgagctag

SEQ ID NO: 24682 - DNA, 1047 bp, Artificial Sequence
  Description of Artificial Sequence: Synthetic coding sequence
atgcccggcaagcagagcgaggagggccccgccgaggccggcgccagcgaggacagcgaggaggagggcctgggcggcctgaccctggaggagctgcagcagggccaggaggccgccagagccctggaggacatgatgaccctgagcgcccagaccctggtgagagccgaggtggacgagctgtacgaggaggtgagacccctgggccagggctgctacggcagagtgctgctggtgacccacagacagaagggcacccccctggccctgaagcagctgcccaagcccagaaccagcctgagaggcttcctgtacgagttctgcgtgggcctgagcctgggcgcccacagcgccatcgtgaccgcctacggcatcggcatcgagagcgcccacagctacagcttcctgaccgagcccgtgctgcacggcgacctgatggccttcatccagcccaaggtgggcctgccccagcccgccgtgcacagatgcgccgcccagctggccagcgccctggagtacatccacgccagaggcctggtgtacagagacctgaagcccgagaacgtgctggtgtgcgaccccgcctgcagaagattcaagctgaccgacttcggccacaccagacccagaggcaccctgctgagactggccggcccccccatcccctacaccgcccccgagctgtgcgcccccccccccctgcccgagggcctgcccatccagcccgccctggacgcctgggccctgggcgtgctgctgttctgcctgctgaccggctacttcccctgggacagacccctggccgaggccgaccccttctacgaggacttcctgatctggcaggccagcggccagcccagagacagaccccagccctggttcggcctggccgccgccgccgacgccctgctgagaggcctgctggacccccaccccagaagaagaagcgccgtgatcgccatcagagagcacctgggcagaccctggagacagagagagggcgaggccgaggccgtgggcgccgtggaggaggaggccggccagtag

SEQ ID NO: 24683 - DNA, 1047 bp, Artificial Sequence; identical to SEQ ID NO: 24682
  Description of Artificial Sequence: Synthetic coding sequence

SEQ ID NO: 24684 - DNA, 1182 bp, Artificial Sequence
  Description of Artificial Sequence: Synthetic coding sequence
atggccgagctgagacaggtgcccggcggcagagagaccccccagggcgagctgagacccgaggtggtggaggacgaggtgcccagaagccccgtggccgaggagcccggcggcggcggcagcagcagcagcgaggccaagctgagccccagagaggaggaggagctggaccccagaatccaggaggagctggagcacctgaaccaggccagcgaggagatcaaccaggtggagctgcagctggacgaggccagaaccacctacagaagaatcctgcaggagagcgccagaaagctgaacacccagggcagccacctgggcagctgcatcgagaaggccagaccctactacgaggccagaagactggccaaggaggcccagcaggagacccagaaggccgccctgagatacgagagagccgtgagcatgcacaacgccgccagagagatggtgttcgtggccgagcagggcgtgatggccgacaagaacagactggaccccacctggcaggagatgctgaaccacgccacctgcaaggtgaacgaggccgaggaggagagactgagaggcgagagagagcaccagagagtgaccagactgtgccagcaggccgaggccagagtgcaggccctgcagaagaccctgagaagagccatcggcaagagcagaccctacttcgagctgaaggcccagttcagccagatcctggaggagcacaaggccaaggtgaccgagctggagcagcaggtggcccaggccaagaccagatacagcgtggccctgagaaacctggagcagatcagcgagcagatccacgccagaagaagaggcggcctgcccccccaccccctgggccccagaagaagcagccccgtgggcgccgaggccggccccgaggacatggaggacggcgacagcggcatcgagggcgccgagggcgccggcctggaggagggcagcagcctgggccccggccccgcccccgacaccgacaccctgagcctgctgagcctgagaaccgtggccagcgacctgcagaagtgcgacagcgtggagcacctgagaggcctgagcgaccacgtgagcctggacggccaggagctgggcaccagaagcggcggcagaagaggcagcgacggcggcgccagaggcggcagacaccagagaagcgtgagcctgtag

SEQ ID NO: 24685 - DNA, 1086 bp, Artificial Sequence
  Description of Artificial Sequence: Synthetic coding sequence
atgtaccaggtgcccgacagacaggagagcttctggcagagcccctacctgctgagcttccccgagtgcctgaccagcttcccctgggaggagctggagcacctgaaccaggccagcgaggagatcaaccaggtggagctgcagctggacgaggccagaaccacctacagaagaatcctgcaggagagcgccagaaagctgaacacccagggcagccacctgggcagctgcatcgagaaggccagaccctactacgaggccagaagactggccaaggaggcccagcaggagacccagaaggccgccctgagatacgagagagccgtgagcatgcacaacgccgccagagagatggtgttcgtggccgagcagggcgtgatggccgacaagaacagactggaccccacctggcaggagatgctgaaccacgccacctgcaaggtgaacgaggccgaggaggagagactgagaggcgagagagagcaccagagagtgaccagactgtgccagcaggccgaggccagagtgcaggccctgcagaagaccctgagaagagccatcggcaagagcagaccctacttcgagctgaaggcccagttcagccagatcctggaggagcacaaggccaaggtgaccgagctggagcagcaggtggcccaggccaagaccagatacagcgtggccctgagaaacctggagcagatcagcgagcagatccacgccagaagaagaggcggcctgcccccccaccccctgggccccagaagaagcagccccgtgggcgccgaggccggccccgaggacatggaggacggcgacagcggcatcgagggcgccgagggcgccggcctggaggagggcagcagcctgggccccggccccgcccccgacaccgacaccctgagcctgctgagcctgagaaccgtggccagcgacctgcagaagtgcgacagcgtggagcacctgagaggcctgagcgaccacgtgagcctggacggccaggagctgggcaccagaagcggcggcagaagaggcagcgacggcggcgccagaggcggcagacaccagagaagcgtgagcctgtag

SEQ ID NO: 24686 - DNA, 2169 bp, Artificial Sequence
  Description of Artificial Sequence: Synthetic coding sequence
atgagaccccaggaccccgccctgtacccccaggccccccaccccctggccctgggcagagccagccaccccagccagagcagaaacaccccccccggcagacccagagccgccgccagatgcggccccagaagagcccccatcggccagagcggcagaggcagagagaagtggcccaccgccgccagcgccctgggcctgctgagaagatggagaagaagcaaggccagcgtgcccgccgacagcttcagaaccatcagccccgacagaagaggcgagaagagcgccagcgccgtgagcggcgacaccgccgccgccaccaccctgaagggcaccgccatccccgtgagaagcgtggtggccagccccagacccgtgaagggcaaggccggcagagagaccgccagactgagactgcagagactgcccgccgcccaggccgaggacaccggcgaggccgccgccgccgccgccgaggagcccctgctgcccgtgcccgaggacgaggaggaggcccagcccctgccccccgtgtgcgtgagcagaatgagaggcatgtggagagacgagaaggtgagcctgtactgcgacgaggtgctgcaggactgcaaggccgaggacgccgacgaggtgatgggcaagtacctgagcgagaagctgaagctgaaggacaagtggctgggcgtgtggaagaccaaccccagcgtgttcttcgtgaagtacgaggaggccagcatccccttcgtgggcatcctggtggaggtgacctgcgagccctaccaggacagcagcagcagattcaaggtgaccgtgagcgtggccgagcccttcagcagcaacatcgccaacatccccagagacctggtggacgagatcctggaggagctggagcacagcgtgcccctgctggaggtgtaccccgtggagggccaggacaccgacatccacgtgatcgccctggccctggaggtggtgagattcttctacgacttcctgtggagagactgggacgacgaggagagctgcgagaactacaccgccctgatcgaggagagaatcaacctgtggtgcgacatccaggacggcaccatccccggccccatcgcccagagattcaagaagaccctggagaagtacaagaacaagagagtggagctgatcgagtaccagagcaacatcaaggaggaccccagcgccgccgaggccgtggagtgctggaagaagtactacgagatcgtgatgctgtgcggcctgctgaagatgtgggaggacctgagactgagagtgcacggccccttcttccccagaatcctgagaagaagaaagggcaagagagagttcggcaagaccatcacccacatcgtggccaagatgatgaccaccgagatgatcaaggacctgagcagcgacaccctgctgcagcagcacggcgacctggacctggccctggacaactgctacagcggcgacaccgtgatcatcttccccggcgagtaccaggccgccaacctggccctgctgaccgacgacatcatcatcaagggcgtgggcaagagagaggagatcatgatcaccagcgagcccagcagagacagcttcgtggtgagcaaggccgacaacgtgaagctgatgcacctgagcctgatccagcagggcaccgtggacggcatcgtggtggtggagagcggccacatgaccctggagaactgcatcctgaagtgcgagggcaccggcgtgtgcgtgctgaccggcgccgccctgaccatcaccgacagcgagatcaccggcgcccagggcgccggcgtggagctgtaccccggcagcatcgccatcctggagagaaacgagatccaccactgcaacaacctgagaaccagcaacagcagcaagagcaccctgggcggcgtgaacatgaaggtgctgcccgcccccaagctgaagatgaccaacaaccacatctacagcaacaagggctacggcgtgagcatcctgcagcccatggagcagttcttcatcgtggccgaggaggccctgaacaagagagccagcagcggcgacaagaaggacgacaagatgctgttcaaggtgatgcagaacctgaacctggagatgaacaacaacaagatcgaggccaacgtgaagggcgacatcagaatcgtgaccagctag

SEQ ID NO: 24687 - DNA, 1962 bp, Artificial Sequence
  Description of Artificial Sequence: Synthetic coding sequence
atggccagcggcagcaaggccagcgtgcccgccgacagcttcagaaccatcagccccgacagaagaggcgagaagagcgccagcgccgtgagcggcgacaccgccgccgccaccaccctgaagggcaccgccatccccgtgagaagcgtggtggccagccccagacccgtgaagggcaaggccggcagagagaccgccagactgagactgcagagactgcccgccgcccaggccgaggacaccggcgaggccgccgccgccgccgccgaggagcccctgctgcccgtgcccgaggacgaggaggaggcccagcccctgccccccgtgtgcgtgagcagaatgagaggcatgtggagagacgagaaggtgagcctgtactgcgacgaggtgctgcaggactgcaaggccgaggacgccgacgaggtgatgggcaagtacctgagcgagaagctgaagctgaaggacaagtggctgggcgtgtggaagaccaaccccagcgtgttcttcgtgaagtacgaggaggccagcatccccttcgtgggcatcctggtggaggtgacctgcgagccctaccaggacagcagcagcagattcaaggtgaccgtgagcgtggccgagcccttcagcagcaacatcgccaacatccccagagacctggtggacgagatcctggaggagctggagcacagcgtgcccctgctggaggtgtaccccgtggagggccaggacaccgacatccacgtgatcgccctggccctggaggtggtgagattcttctacgacttcctgtggagagactgggacgacgaggagagctgcgagaactacaccgccctgatcgaggagagaatcaacctgtggtgcgacatccaggacggcaccatccccggccccatcgcccagagattcaagaagaccctggagaagtacaagaacaagagagtggagctgatcgagtaccagagcaacatcaaggaggaccccagcgccgccgaggccgtggagtgctggaagaagtactacgagatcgtgatgctgtgcggcctgctgaagatgtgggaggacctgagactgagagtgcacggccccttcttccccagaatcctgagaagaagaaagggcaagagagagttcggcaagaccatcacccacatcgtggccaagatgatgaccaccgagatgatcaaggacctgagcagcgacaccctgctgcagcagcacggcgacctggacctggccctggacaactgctacagcggcgacaccgtgatcatcttccccggcgagtaccaggccgccaacctggccctgctgaccgacgacatcatcatcaagggcgtgggcaagagagaggagatcatgatcaccagcgagcccagcagagacagcttcgtggtgagcaaggccgacaacgtgaagctgatgcacctgagcctgatccagcagggcaccgtggacggcatcgtggtggtggagagcggccacatgaccctggagaactgcatcctgaagtgcgagggcaccggcgtgtgcgtgctgaccggcgccgccctgaccatcaccgacagcgagatcaccggcgcccagggcgccggcgtggagctgtaccccggcagcatcgccatcctggagagaaacgagatccaccactgcaacaacctgagaaccagcaacagcagcaagagcaccctgggcggcgtgaacatgaaggtgctgcccgcccccaagctgaagatgaccaacaaccacatctacagcaacaagggctacggcgtgagcatcctgcagcccatggagcagttcttcatcgtggccgaggaggccctgaacaagagagccagcagcggcgacaagaaggacgacaagatgctgttcaaggtgatgcagaacctgaacctggagatgaacaacaacaagatcgaggccaacgtgaagggcgacatcagaatcgtgaccagctag

SEQ ID NO: 24688 - DNA, 1605 bp, Artificial Sequence
  Description of Artificial Sequence: Synthetic coding sequence
atgggcttcctgcagctggtgagactggacagcaacagcagaccccaggccgaggacgccgacgaggtgatgggcaagtacctgagcgagaagctgaagctgaaggacaagtggctgggcgtgtggaagaccaaccccagcgtgttcttcgtgaagtacgaggaggccagcatccccttcgtgggcatcctggtggaggtgacctgcgagccctaccaggacagcagcagcagattcaaggtgaccgtgagcgtggccgagcccttcagcagcaacatcgccaacatccccagagacctggtggacgagatcctggaggagctggagcacagcgtgcccctgctggaggtgtaccccgtggagggccaggacaccgacatccacgtgatcgccctggccctggaggtggtgagattcttctacgacttcctgtggagagactgggacgacgaggagagctgcgagaactacaccgccctgatcgaggagagaatcaacctgtggtgcgacatccaggacggcaccatccccggccccatcgcccagagattcaagaagaccctggagaagtacaagaacaagagagtggagctgatcgagtaccagagcaacatcaaggaggaccccagcgccgccgaggccgtggagtgctggaagaagtactacgagatcgtgatgctgtgcggcctgctgaagatgtgggaggacctgagactgagagtgcacggccccttcttccccagaatcctgagaagaagaaagggcaagagagagttcggcaagaccatcacccacatcgtggccaagatgatgaccaccgagatgatcaaggacctgagcagcgacaccctgctgcagcagcacggcgacctggacctggccctggacaactgctacagcggcgacaccgtgatcatcttccccggcgagtaccaggccgccaacctggccctgctgaccgacgacatcatcatcaagggcgtgggcaagagagaggagatcatgatcaccagcgagcccagcagagacagcttcgtggtgagcaaggccgacaacgtgaagctgatgcacctgagcctgatccagcagggcaccgtggacggcatcgtggtggtggagagcggccacatgaccctggagaactgcatcctgaagtgcgagggcaccggcgtgtgcgtgctgaccggcgccgccctgaccatcaccgacagcgagatcaccggcgcccagggcgccggcgtggagctgtaccccggcagcatcgccatcctggagagaaacgagatccaccactgcaacaacctgagaaccagcaacagcagcaagagcaccctgggcggcgtgaacatgaaggtgctgcccgcccccaagctgaagatgaccaacaaccacatctacagcaacaagggctacggcgtgagcatcctgcagcccatggagcagttcttcatcgtggccgaggaggccctgaacaagagagccagcagcggcgacaagaaggacgacaagatgctgttcaaggtgatgcagaacctgaacctggagatgaacaacaacaagatcgaggccaacgtgaagggcgacatcagaatcgtgaccagctag

SEQ ID NO: 24689 - DNA, 1617 bp, Artificial Sequence
  Description of Artificial Sequence: Synthetic coding sequence
atgcccgccctgctgctgctggtgctgctggccagcagcgccggccaggccagagccagacccagcaacgccaccagcgccgagcccgccggccccctgcccgccctgctggcccacctgagaagactgaccggcgccctgaccggcggcggcggcgccgccagccccggcgccaacggcaccagaaccggccccgccggcggcgccggcgccgccgccagagcccccccccccgccgagctgtgccacggctactacgacgtgatgggccagtacgacgccaccttcaactgcagcaccggcagctacagattctgctgcggcacctgccactacagattctgctgcgagcacagacacatgagactggcccaggccagctgcagcaactacgacacccccagatgggccaccacccccccccccctggccggcggcgccggcggcgccggcggcgccggcggcggccccggccccggccaggccggctggctggagggcggcagaaccggcggcgccggcggcagaggcggcgagggccccggcggcagcaccgcctacgtggtgtgcggcgtgatcagcttcgccctggccgtgggcgtgggcgccaaggtggccttcagcaaggccagcagagcccccagagcccacagagacatcaacgtgcccagagccctggtggacatcctgagacaccaggccggccccggcaccagacccgacagagccagaagcagcagcctgacccccggcatcggcggccccgacagcatgccccccagaacccccaagaacctgtacaacaccgtgaagacccccaacctggactggagagccctgcccccccccagccccagcctgcactacagcaccctgagctgcagcagaagcttccacaacctgagccacctgccccccagctacgaggccgccgtgaagagcgagctgaacagatacagcagcctgaagagactggccgagaaggacctggacgaggcctacctgaagagaagacccctggagctgcccagaggcaccctgcccctgcacgccctgagaagacccggcaccggcggcggctacagaatggaggcctggggcggccccgaggagctgggcctggcccccgcccccaaccccagaagagtgatgagccaggagcacctgctgggcgacggcggcagaagcagatacgagttcaccctgcccagagccagactggtgagccaggagcacctgctgctgagcagccccgaggccctgagacagagcagagagcacctgctgagcccccccagaagccccgccctgccccccgaccccaccgccagagccagcctggccgccagccacagcaacctgctgctgggccccggcggcccccccacccccctgagaggcctgcccccccccagcagcctgcacgcccaccaccaccacgccctgcacggcagcccccagcccgcctggatgagcgacgccggcggcggcggcggcaccctggccagaagaccccccttccagagacagggcaccctggagcagctgcagttcatccccggccaccacctgccccagcacctgagaaccgccagcaagaacgaggtgaccgtgtag

SEQ ID NO: 24690 - DNA, 960 bp, Artificial Sequence
  Description of Artificial Sequence: Synthetic coding sequence
atgggctggagaagaaagagagtgccccagagaggcagaaaggccccccccccccagctgcacggcaacatcaacaacctgtacttccccatcagatggagagacagactgcactgggacagccccaaccccgccgccgagtgccagagacacgaggtgaccctggtgagcagaaagcccggccccggcagaatcacctgggacgagctggccgccagcggcctgcccagctgcgacgccgccgtgaacctggccggcgagaacatcctgaaccccctgagaagatggaacgagaccttccagaaggaggtgatcggcagcagactggagaccacccagctgctggccaaggccatcaccaaggccccccagccccccaaggcctgggtgctggtgaccggcgtggcctactaccagcccagcctgaccgccgagtacgacgaggacagccccggcggcgacttcgacttcttcagcaacctggtgaccaagtgggaggccgccgccagactgcccggcgacagcaccagacaggtggtggtgagaagcggcgtggtgctgggcagaggcggcggcgccatgggccacatgctgctgcccttcagactgggcctgggcggccccatcggcagcggccaccagttcttcccctggatccacatcggcgacctggccggcatcctgacccacgccctggaggccaaccacgtgcacggcgtgctgaacggcgtggcccccagcagcgccaccaacgccgagttcgcccagaccctgggcgccgccctgggcagaagagccttcatccccctgcccagcgccgtggtgcaggccgtgttcggcagacagagagccatcatgctgctggagggccagaaggtgatcccccagagaaccctggccaccggctaccagtacagcttccccgagctgggcgccgccctgaaggagatcgtggcctag

SEQ ID NO: 24691 - DNA, 597 bp, Artificial Sequence
  Description of Artificial Sequence: Synthetic coding sequence
atggccctgagccccaacggcgagatcctgagagccagagaggcctactaccagcccagcctgaccgccgagtacgacgaggacagccccggcggcgacttcgacttcttcagcaacctggtgaccaagtgggaggccgccgccagactgcccggcgacagcaccagacaggtggtggtgagaagcggcgtggtgctgggcagaggcggcggcgccatgggccacatgctgctgcccttcagactgggcctgggcggccccatcggcagcggccaccagttcttcccctggatccacatcggcgacctggccggcatcctgacccacgccctggaggccaaccacgtgcacggcgtgctgaacggcgtggcccccagcagcgccaccaacgccgagttcgcccagaccctgggcgccgccctgggcagaagagccttcatccccctgcccagcgccgtggtgcaggccgtgttcggcagacagagagccatcatgctgctggagggccagaaggtgatcccccagagaaccctggccaccggctaccagtacagcttccccgagctgggcgccgccctgaaggagatcgtggcctag

SEQ ID NO: 24692 - DNA, 882 bp, Artificial Sequence
  Description of Artificial Sequence: Synthetic coding sequence
atgagagtgctggtgggcggcggcaccggcttcatcggcaccgccctgacccagctgctgaacgccagaggccacgaggtgaccctggtgagcagaaagcccggccccggcagaatcacctgggacgagctggccgccagcggcctgcccagctgcgacgccgccgtgaacctggccggcgagaacatcctgaaccccctgagaagatggaacgagaccttccagaaggaggtgatcggcagcagactggagaccacccagctgctggccaaggccatcaccaaggccccccagccccccaaggcctgggtgctggtgaccggcgtggcctactaccagcccagcctgaccgccgagtacgacgaggacagccccggcggcgacttcgacttcttcagcaacctggtgaccaagtgggaggccgccgccagactgcccggcgacagcaccagacaggtggtggtgagaagcggcgtggtgctgggcagaggcggcggcgccatgggccacatgctgctgcccttcagactgggcctgggcggccccatcggcagcggccaccagttcttcccctggatccacatcggcgacctggccggcatcctgacccacgccctggaggccaaccacgtgcacggcgtgctgaacggcgtggcccccagcagcgccaccaacgccgagttcgcccagaccctgggcgccgccctgggcagaagagccttcatccccctgcccagcgccgtggtgcaggccgtgttcggcagacagagagccatcatgctgctggagggccagaaggtgatcccccagagaaccctggccaccggctaccagtacagcttccccgagctgggcgccgccctgaaggagatcgtggcctag

SEQ ID NO: 24693 - DNA, 468 bp, Artificial Sequence
  Description of Artificial Sequence: Synthetic coding sequence
ttccacgtggccagctacggcatgagcggcgccgagaagctgcagaaggagcagatcgagagcatcaacgtgggcggcaccaagctggtgatcgacgtgtgcgtgagaagaagagtgcccagactgatctacaccagcaccgtgaacgtggccttcggcggcaagcccatcgagcagggcgacgaggacagcgtgccctacttccccctggacgagcacgtggaccactacagcagaaccaaggccatcgccgaccagctgaccctgatggccaacggcatgcccctgcccggcggcggcaccctgagaacctgcgtgctgagaccccccggcatctacggccccgaggagcagagacacctgcccagagtggccggccacatcaagaagagactgttcatgttcagattcggcgaccacaaggccagaatgaactgggtgcacgtgcacaacctggtgcaggcctag

SEQ ID NO: 24694 - DNA, 4482 bp, Artificial Sequence
  Description of Artificial Sequence: Synthetic coding sequence
atggagaacagacccggcagcttccagtacgtgcccgtgcagctgcagggcggcgccccctggggcttcaccctgaagggcggcctggagcactgcgagcccctgaccgtgagcaagatcgaggacggcggcaaggccgccctgagccagaagatgagaaccggcgacgagctggtgaacatcaacggcacccccctgtacggcagcagacaggaggccctgatcctgatcaagggcagcttcagaatcctgaagctgatcgtgagaagaagaaacgcccccgtgagcagaccccacagctggcacgtggccaagctgctggagggctgccccgaggccgccaccaccatgcacttccccagcgaggccttcagcctgagctggcacagcggctgcaacaccagcgacgtgtgcgtgcagtggtgccccctgagcagacactgcagcaccgagaagagcagcagcatcggcagcatggagagcctggagcagcccggccaggccacctacgagagccacctgctgcccatcgaccagaacatgtaccccaaccagagagacagcgcctacagcagcttcagcgccagcagcaacgccagcgactgcgccctgagcctgagacccgaggagcccgccagcaccgactgcatcatgcagggccccggccccaccaaggcccccagcggcagacccaacgtggccgagaccagcggcggcagcagaagaaccaacggcggccacctgacccccagcagccagatgagcagcagaccccaggagggctaccagagcggccccgccaaggccgtgagaggccccccccagccccccgtgagaagagacagcctgcaggccagcagagcccagctgctgaacggcgagcagagaagagccagcgagcccgtggtgcccctgccccagaaggagaagctgagcctggagcccgtgctgcccgccagaaaccccaacagattctgctgcctgagcggccacgaccaggtgaccagcgagggccaccagaactgcgagttcagccagccccccgagagcagccagcagggcagcgagcacctgctgatgcaggccagcaccaaggccgtgggcagccccaaggcctgcgacagagccagcagcgtggacagcaaccccctgaacgaggccagcgccgagctggccaaggccagcttcggcagacccccccacctgatcggccccaccggccacagacacagcgcccccgagcagctgctggccagccacctgcagcacgtgcacctggacaccagaggcagcaagggcatggagctgccccccgtgcaggacggccaccagtggaccctgagccccctgcacagcagccacaagggcaagaagagcccctgcccccccaccggcggcacccacgaccagagcagcaaggagagaaagaccagacaggtggacgacagaagcctggtgctgggccaccagagccagagcagccccccccacggcgaggccgacggccaccccagcgagaagggcttcctggaccccaacagaaccagcagagccgccagcgagctggccaaccagcagcccagcgccagcggcagcctggtgcagcaggccaccgactgcagcagcaccaccaaggccgccagcggcaccgaggccggcgaggagggcgacagcgagcccaaggagtgcagcagaatgggcggcagaagaagcggcggcaccagaggcagaagcatccagaacagaagaaagagcgagagattcgccaccaacctgagaaacgagatccagagaagaaaggcccagctgcagaagagcaagggccccctgagccagctgtgcgacaccaaggagcccgtggaggagacccaggagccccccgagagcccccccctgaccgccagcaacaccagcctgctgagcagctgcaagaagccccccagccccagagacaagctgttcaacaagagcatgatgctgagagccagaagcagcgagtgcctgagccaggcccccgagagccacgagagcagaaccggcctggagggcagaatcagccccggccagagacccggccagagcagcctgggcctgaacacctggtggaaggcccccgaccccagcagcagcgaccccgagaaggcccacgcccactgcggcgtgagaggcggccactggagatggagccccgagcacaacagccagcccctggtggccgccgccatggagggccccagcaaccccggcgacaacaaggagctgaaggccagcaccgcccaggccggcgaggacgccatcctgctgcccttcgccgacagaagaaagttcttcgaggagagcagcaagagcctgagcaccagccacctgcccggcctgaccacccacagcaacaagaccttcacccagagacccaagcccatcgaccagaacttccagcccatgagcagcagctgcagagagctgagaagacaccccatggaccagagctaccacagcgccgaccagccctaccacgccaccgaccagagctaccacagcatgagccccctgcagagcgagacccccacctacagcgagtgcttcgccagcaagggcctggagaacagcatgtgctgcaagcccctgcactgcggcgacttcgactaccacagaacctgcagctacagctgcagcgtgcagggcgccctggtgcacgacccctgcatctactgcagcggcgagatctgccccgccctgctgaagagaaacatgatgcccaactgctacaactgcagatgccaccaccaccagtgcatcagatgcagcgtgtgctaccacaacccccagcacagcgccctggaggacagcagcctggcccccggcaacacctggaagcccagaaagctgaccgtgcaggagttccccggcgacaagtggaaccccatcaccggcaacagaaagaccagccagagcggcagagagatggcccacagcaagaccagcttcagctgggccacccccttccacccctgcctggagaaccccgccctggacctgagcagctacagagccatcagcagcctggacctgctgggcgacttcaagcacgccctgaagaagagcgaggagaccagcgtgtacgaggagggcagcagcctggccagcatgccccaccccctgagaagcagagccttcagcgagagccacatcagcctggccccccagagcaccagagcctggggccagcacagaagagagctgttcagcaagggcgacgagacccagagcgacctgctgggcgccagaaagaaggccttccccccccccagaccccccccccccaactgggagaagtacagactgttcagagccgcccagcagcagaagcagcagcagcagcagcagaagcagcaggaggaggaggaggaggaggaggaggaggaggaggaggaggaggaggaggaggaggaggaggccgaggaggaggaggaggagctgcccccccagtacttcagcagcgagaccagcggcagctgcgccctgaaccccgaggaggtgctggagcagccccagcccctgagcttcggccacctggagggcagcagacagggcagccagagcgtgcccgccgagcaggagagcttcgccctgcacagcagcgacttcctgccccccatcagaggccacctgggcagccagcccgagcaggcccagcccccctgctactacggcatcggcggcctgtggagaaccagcggccaggaggccaccgagagcgccaagcaggagttccagcacttcagcccccccagcggcgcccccggcatccccaccagctacagcgcctactacaacatcagcgtggccaaggccgagctgctgaacaagctgaaggaccagcccgagatggccgagatcggcctgggcgaggaggaggtggaccacgagctggcccagaagaagatccagctgatcgagagcatcagcagaaagctgagcgtgctgagagaggcccagagaggcctgctggaggacatcaacgccaacagcgccctgggcgaggaggtggaggccaacctgaaggccgtgtgcaagagcaacgagttcgagaagtaccacctgttcgtgggcgacctggacaaggtggtgaacctgctgctgagcctgagcggcagactggccagagtggagaacgccctgaacagcatcgacagcgaggccaaccaggagaagctggtgctgatcgagaagaagcagcagctgaccggccagctggccgacgccaaggagctgaaggagcacgtggacagaagagagaagctggtgttcggcatggtgagcagatacctgccccaggaccagctgcaggactaccagcacttcgtgaagatgaagagcgccctgatcatcgagcagagagagctggaggagaagatcaagctgggcgaggagcagctgaagtgcctgagagagagcctgctgctgggccccagcaacttctag

SEQ ID NO: 24695 - DNA, 1365 bp, Artificial Sequence
  Description of Artificial Sequence: Synthetic coding sequence
atggtgcccggccaggcccagccccagagccccgagatgctgctgctgcccctgctgctgcccgtgctgggcgccggcagcctgaacaaggaccccagctacagcctgcaggtgcagagacaggtgcccgtgcccgagggcctgtgcgtgatcgtgagctgcaacctgagctaccccagagacggctgggacgagagcaccgccgcctacggctactggttcaagggctggaccagccccaagaccggcgcccccgtggccaccaacaaccagagcagagaggtggagatgagcaccagagacagattccagctgaccggcgaccccggcaagggcagctgcagcctggtgatcagagacgcccagagagaggacgaggcctggtacttcttcagagtggagagaggcagcagagtgagacacagcttcgtgaacaacctgttcagcgtgagcgcccccgccctgacccagaagcccgacgtgtacatccccgagaccctggagcccggccagcccgtgaccgtgatctgcgtgttcaactgggccttcaagaagtgccccgcccccagcttcagctggaccggcgccgccctgagccccagaagaaccagacccagcaccagccacttcagcgtgctgagcttcacccccagcccccaggaccacgacaccgacctgacctgccacgtggacttcagcagaaagggcgtgagcgcccagagaaccgtgagactgagagtggcctacgcccccaaggacctgatcatcagcatcagccacgacaacaccagcgccctggagctgcagggcaacgtgatctacctggaggtgcagaagggccagttcctgagactgctgtgcgccgccgacagccagccccccgccaccctgagctgggtgctgcaggacagagtgctgagcagcagccacccctggggccccagaaccctgggcctggagctgagaggcgtgagagccggcgacagcggcagatacacctgcagagccgagaacagactgggcagccagcagagagccctggacctgagcgtgcagtacccccccgagaacctgagagtgatggtgagccaggccaacagaaccgtgctggagaacctgagaaacggcaccagcctgagagtgctggagggccagagcctgagactggtgtgcgtgacccacagcagcccccccgccagactgagctggaccagatggggccagaccgtgggccccagccagcccagcgaccccggcgtgctggagctgcccagagtgcagatggagcacgagggcgagttcacctgccacgccagacaccccctgggcagccagagagtgagcctgagcttcagcgtgcactag

SEQ ID NO: 24696 - DNA, 1446 bp, Artificial Sequence
  Description of Artificial Sequence: Synthetic coding sequence
atgctgctgctgcccctgctgctgcccgtgctgggcgccggcagcctgaacaaggaccccagctacagcctgcaggtgcagagacaggtgcccgtgcccgagggcctgtgcgtgatcgtgagctgcaacctgagctaccccagagacggctgggacgagagcaccgccgcctacggctactggttcaagggctggaccagccccaagaccggcgcccccgtggccaccaacaaccagagcagagaggtggagatgagcaccagagacagattccagctgaccggcgaccccggcaagggcagctgcagcctggtgatcagagacgcccagagagaggacgaggcctggtacttcttcagagtggagagaggcagcagagtgagacacagcttcgtgaacaacctgttcagcgtgagcgcccccgccctgacccagaagcccgacgtgtacatccccgagaccctggagcccggccagcccgtgaccgtgatctgcgtgttcaactgggccttcaagaagtgccccgcccccagcttcagctggaccggcgccgccctgagccccagaagaaccagacccagcaccagccacttcagcgtgctgagcttcacccccagcccccaggaccacgacaccgacctgacctgccacgtggacttcagcagaaagggcgtgagcgcccagagaaccgtgagactgagagtggccagcctggagctgcagggcaacgtgatctacctggaggtgcagaagggccagttcctgagactgctgtgcgccgccgacagccagccccccgccaccctgagctgggtgctgcaggacagagtgctgagcagcagccacccctggggccccagaaccctgggcctggagctgagaggcgtgagagccggcgacagcggcagatacacctgcagagccgagaacagactgggcagccagcagagagccctggacctgagcgtgcagtacccccccgagaacctgagagtgatggtgagccaggccaacagaaccgtgctggagaacctgagaaacggcaccagcctgagagtgctggagggccagagcctgagactggtgtgcgtgacccacagcagcccccccgccagactgagctggaccagatggggccagaccgtgggccccagccagcccagcgaccccggcgtgctggagctgcccagagtgcagatggagcacgagggcgagttcacctgccacgccagacaccccctgggcagccagagagtgagcctgagcttcagcgtgcactgcaagagcggccccatgaccggcgtggtgctggtggccgtgggcgaggtggccatgaagatcctgctgctgtgcctgtgcctgatcctgctgagagtgagaagctgcagaagaaaggccgccagagccgccctgggcatggaggccgccgacgccgtgaccgactag

SEQ ID NO: 24697 - DNA, 924 bp, Artificial Sequence
  Description of Artificial Sequence: Synthetic coding sequence
atggccgccgccgtggccgccgccctggccagactgctggccgccttcctgctgctggccgcccaggtggcctgcgagtacggcatggtgcacgtggtgagccaggccggcggccccgagggcaaggactactgcatcctgtacaacccccagtgggcccacctgccccacgacctgagcaaggccagcttcctgcagctgagaaactggaccgccagcctgctgtgcagcgccgccgacctgcccgccagaggcttcagcaaccagatccccctggtggccagaggcaactgcaccttctacgagaaggtgagactggcccagggcagcggcgccagaggcctgctgatcgtgagcagagagagactggtgccccccggcggcaacaagacccagtacgacgagatcggcatccccgtggccctgctgagctacaaggacatgctggacatcttcaccagattcggcagaaccgtgagagccgccctgtacgcccccaaggagcccgtgctggactacaacatggtgatcatcttcatcatggccgtgggcaccgtggccatcggcggctactgggccggcagcagagacgtgaagaagagatacatgaagcacaagagagacgacggccccgagaagcaggaggacgaggccgtggacgtgacccccgtgatgacctgcgtgttcgtggtgatgtgctgcagcatgctggtgctgctgtactacttctacgacctgctggtgtacgtggtgatcggcatcttctgcctggccagcgccaccggcctgtacagctgcctggccccctgcgtgagaagactgcccagcggcaagaagagaccccaggccagaatgctgctgctggccctgttctgcgtggccgtgagcgtggtgtggggcgtgttcagaaacgaggaccagtag

SEQ ID NO: 24698 - DNA, 1533 bp, Artificial Sequence
  Description of Artificial Sequence: Synthetic coding sequence
atggccgccgccgtggccgccgccctggccagactgctggccgccttcctgctgctggccgcccaggtggcctgcgagtacggcatggtgcacgtggtgagccaggccggcggccccgagggcaaggactactgcatcctgtacaacccccagtgggcccacctgccccacgacctgagcaaggccagcttcctgcagctgagaaactggaccgccagcctgctgtgcagcgccgccgacctgcccgccagaggcttcagcaaccagatccccctggtggccagaggcaactgcaccttctacgagaaggtgagactggcccagggcagcggcgccagaggcctgctgatcgtgagcagagagagactggtgccccccggcggcaacaagacccagtacgacgagatcggcatccccgtggccctgctgagctacaaggacatgctggacatcttcaccagattcggcagaaccgtgagagccgccctgtacgcccccaaggagcccgtgctggactacaacatggtgatcatcttcatcatggccgtgggcaccgtggccatcggcggctactgggccggcagcagagacgtgaagaagagatacatgaagcacaagagagacgacggccccgagaagcaggaggacgaggccgtggacgtgacccccgtgatgacctgcgtgttcgtggtgatgtgctgcagcatgctggtgctgctgtactacttctacgacctgctggtgtacgtggtgatcggcatcttctgcctggccagcgccaccggcctgtacagctgcctggccccctgcgtgagaagactgttcggcaagtgcagaatccccaacaacagcctgccctacttccacaagagaccccaggccagaatgctgctgctggccctgttctgcgtggccgtgagcgtggtgtggggcgtgttcagaaacgaggaccagtgggcctgggtgctgcaggacgccctgggcatcgccttctgcctgtacatgctgaagaccatcagactgcccaccttcaaggcctgcaccctgctgctgctggtgctgttcctgtacgacatcttcttcgtgttcatcacccccttcctgaccaagagcggcagcagcatcatggtggaggtggccaccggccccagcgacagcgccaccagagagaagctgcccatggtgctgaaggtgcccagactgaacagcagccccctggccctgtgcgacagacccttcagcctgctgggcttcggcgacatcctggtgcccggcctgctggtggcctactgccacagattcgacatccaggtgcagagcagcagagtgtacttcgtggcctgcaccatcgcctacggcgtgggcctgctggtgaccttcgtggccctggccctgatgcagagaggccagcccgccctgctgtacctggtgccctgcaccctggtgaccagctgcgccgtggccctgtggagaagagagctgggcgtgttctggaccggcagcggcttcgccgtgaacaccagcctgctgtag

SEQ ID NO: 24699 - DNA, 522 bp, Artificial Sequence
  Description of Artificial Sequence: Synthetic coding sequence
atggccgccatggccagcctgggcgccctggccctgctgctgctgagcagcctgagcagatgcagcgccgaggcctgcctggagccccagatcacccccagctactacaccaccagcgacgccgtgatcagcaccgagaccgtgttcatcgtggagatcagcctgacctgcaagaacagagtgcagaacatggccctgtacgccgacgtgggcggcaagcagttccccgtgaccagaggccaggacgtgggcagataccaggtgagctggagcctggaccacaagagcgcccacgccggcacctacgaggtgagattcttcgacgaggagagctacagcctgctgagaaaggcccagagaaacaacgaggacatcagcatcatcccccccctgttcaccgtgagcgtggaccacagaggcacctggaacggcccctgggtgagcaccgaggtgctggccgccgccatcggcctggtgatctactacctggccttcagcgccaagagccacatccaggcctag

SEQ ID NO: 24700 - DNA, 522 bp, Artificial Sequence; identical to SEQ ID NO: 24699
  Description of Artificial Sequence: Synthetic coding sequence

SEQ ID NO: 24701 - DNA, 522 bp, Artificial Sequence; identical to SEQ ID NO: 24699
  Description of Artificial Sequence: Synthetic coding sequence

SEQ ID NO: 24702 - DNA, 2961 bp, Artificial Sequence
  Description of Artificial Sequence: Synthetic coding sequence
atgcccagagccacctgggccaacagcaaggagagaagctgggccgagagcgagagaggccccagagacaccggcaacggcggcagcaaggccgagagacacatccaggagatcgagaccggcagaggcggcgacagagccaaggcccacagaagacagagaatgagactgagaggcaccgagagagccagcctgggccccggcagaagactgggcgacagcagaggcaccgacatgcccggcgccagagcccagggcctggccgccgccatgaccgaggagagcgaggagaccgtgctgtacatcgagcacagatacgtgtgcagcgagtgcaaccagctgtacggcagcctggaggaggtgctgatgcaccagaacagccacgtgccccagcagcacttcgagctggtgggcgtggccgaccccggcgtgaccgtggccaccgacaccgccagcggcaccggcctgtaccagaccctggtgcaggagagccagtaccagtgcctggagtgcggccagctgctgatgagccccagccagctgctggagcaccaggagctgcacctgaagatgatggccccccaggaggccgtgcccgccgagcccagccccaaggccccccccctgagcagcagcaccatccactacgagtgcgtggactgcaaggccctgttcgccagccaggagctgtggctgaaccacagacagacccacctgagagccacccccaccaaggcccccgcccccgtggtgctgggcagccccgtggtgctgggcccccccgtgggccaggccagagtggccgtggagcacagctacagaaaggccgaggagggcggcgagggcgccaccgtgcccagcgccgccgccaccaccaccgaggtggtgaccgaggtggagctgctgctgtacaagtgcagcgagtgcagccagctgttccagctgcccgccgacttcctggagcaccaggccacccacttccccgcccccgtgcccgagagccaggagcccgccctgcagcaggaggtgcaggccagcagccccgccgaggtgcccgtgagccagcccgaccccctgcccgccagcgaccacagctacgagctgagaaacggcgaggccatcggcagagacagaagaggcagaagagccagaagaaacaacagcggcgaggccggcggcgccgccacccaggagctgttctgcagcgcctgcgaccagctgttcctgagcccccaccagctgcagcagcacctgagaagccacagagagggcgtgttcaagtgccccctgtgcagcagagtgttccccagccccagcagcctggaccagcacctgggcgaccacagcagcgagagccacttcctgtgcgtggactgcggcctggccttcggcaccgaggccctgctgctggcccacagaagagcccacacccccaaccccctgcacagctgcccctgcggcaagaccttcgtgaacctgaccaagttcctgtaccacagaagaacccacggcgtgggcggcgtgcccctgcccaccacccccgtgccccccgaggagcccgtgatcggcttccccgagcccgcccccgccgagaccggcgagcccgaggcccccgagccccccgtgagcgaggagaccagcgccggccccgccgcccccggcacctacagatgcctgctgtgcagcagagagttcggcaaggccctgcagctgaccagacaccagagattcgtgcacagactggagagaagacacaagtgcagcatctgcggcaagatgttcaagaagaagagccacgtgagaaaccacctgagaacccacaccggcgagagacccttcccctgccccgactgcagcaagcccttcaacagccccgccaacctggccagacacagactgacccacaccggcgagagaccctacagatgcggcgactgcggcaaggccttcacccagagcagcaccctgagacagcacagactggtgcacgcccagcacttcccctacagatgccaggagtgcggcgtgagattccacagaccctacagactgctgatgcacagataccaccacaccggcgagtacccctacaagtgcagagagtgccccagaagcttcctgctgagaagactgctggaggtgcaccagctggtggtgcacgccggcagacagccccacagatgccccagctgcggcgccgccttccccagcagcctgagactgagagagcacagatgcgccgccgccgccgcccaggcccccagaagattcgagtgcggcacctgcggcaagaaggtgggcagcgccgccagactgcaggcccacgaggccgcccacgccgccgccggccccggcgaggtgctggccaaggagccccccgcccccagagcccccagagccaccagagcccccgtggccagccccgccgccctgggcagcaccgccaccgccagccccgccgcccccgccagaagaagaggcctggagtgcagcgagtgcaagaagctgttcagcaccgagaccagcctgcaggtgcacagaagaatccacaccggcgagagaccctacccctgccccgactgcggcaaggccttcagacagagcacccacctgaaggaccacagaagactgcacaccggcgagagacccttcgcctgcgaggtgtgcggcaaggccttcgccatcagcatgagactggccgagcacagaagaatccacaccggcgagagaccctacagctgccccgactgcggcaagagctacagaagcttcagcaacctgtggaagcacagaaagacccaccagcagcagcaccaggccgccgtgagacagcagctggccgaggccgaggccgccgtgggcctggccgtgatggagaccgccgtggaggccctgcccctggtggaggccatcgagatctaccccctggccgaggccgagggcgtgcagatcagcggctag

SEQ ID NO: 24703 - DNA, 447 bp, Artificial Sequence
  Description of Artificial Sequence: Synthetic coding sequence
atgttcagaagacccgtgctgcaggtgctgagacagttcgtgagacacgagagcgagaccaccaccagcctggtgctggagagaagcctgaacagagtgcacctgctgggcagagtgggccaggaccccgtgctgagacaggtggagggcaagaaccccgtgaccatcttcagcctggccaccaacgagatgtggagaagcggcgacagcgaggtgtaccagctgggcgacgtgagccagaagaccacctggcacagaatcagcgtgttcagacccggcctgagagacgtggcctaccagtacgtgaagaagggcagcagaatctacctggagggcaagatcgactacggcgagtacatggacaagaacaacgtgagaagacaggccaccaccatcatcgccgacaacatcatcttcctgagcgaccagaccaaggagaaggagtag

SEQ ID NO: 24704 - DNA, 447 bp, Artificial Sequence; identical to SEQ ID NO: 24703
  Description of Artificial Sequence: Synthetic coding sequence

SEQ ID NO: 24705 - DNA, 408 bp, Artificial Sequence
  Description of Artificial Sequence: Synthetic coding sequence
atgttcagaagacccgtgctgcaggtgctgagacagttcgtgagacacgagagcgagaccaccaccagcctggtgctggagagaagcctgaacagagtgcacctgctgggcagagtgggccaggaccccgtgctgagacaggtggagggcaagaaccccgtgaccatcttcagcctggccaccaacgagatgtggagaagcggcgacagcgaggtgtaccagctgggcgacgtgagccagaagaccacctggcacagaatcagcgtgttcagacccggcctgagagacgtggcctaccagtacgtgaagaagggcagcagaatctacctggagggcaagatcgactacggcgagtacatggacaagaacaacgtgagaagacaggccaccaccatcatcgccgactag

SEQ ID NO: 24706 - DNA, 447 bp, Artificial Sequence; identical to SEQ ID NO: 24703
  Description of Artificial Sequence: Synthetic coding sequence

SEQ ID NO: 24707 - DNA, 576 bp, Artificial Sequence
  Description of Artificial Sequence: Synthetic coding sequence
atgggctacaagctgcaggacctgaccgacgtgcagatcatggccagactgcaggaggagaacaagctgagaagaagcatgcccaacctggccagaatgcccagcaccaccgccatcagcagcaacatcagcagccccgtgaccgtgagaaacagccagagcttcgacagcagcctgcacggcgccggcaacggcatcagcagaatccagagctgcatccccagccccggccagctgcagcacagagtgcacagcgtgggccacttccccgtgagcatcagacagcccctgaaggccaccgcctacgtgagccccaccgtgcagggcagcagcaacatgcccctgagcaacggcctgcagctgtacagcaacaccggcatccccacccccaacaaggccgccgccagcggcatcatgggcagaagcgccctgcccagacccagcctggccatcaacggcagcaacctgcccagaagcaagatcgcccagcccgtgagaagcttcctgcagccccccaagcccctgagcagcctgagcaccctgagagacggcaactggagagacggctgctactag

SEQ ID NO: 24708 - DNA, 918 bp, Artificial Sequence
  Description of Artificial Sequence: Synthetic coding sequence
atgggctacaagctgcaggacctgaccgacgtgcagatcatggccagactgcaggaggagagcctgagacaggactacgccagcaccagcgccagcgtgagcagacacagcagcagcgtgagcctgagcagcggcaagaagggcacctgcagcgaccaggagtacgaccagtacagcctggaggacgaggaggagttcgaccacctgccccccccccagcccagactgcccagatgcagccccttccagagaggcatcccccacagccagaccttcagcagcatcagagagtgcagaagaagccccagcagccagtacttccccagcaacaactaccagcagcagcagtactacagcccccaggcccagacccccgaccagcagcccaacagaaccaacggcgacaagctgagaagaagcatgcccaacctggccagaatgcccagcaccaccgccatcagcagcaacatcagcagccccgtgaccgtgagaaacagccagagcttcgacagcagcctgcacggcgccggcaacggcatcagcagaatccagagctgcatccccagccccggccagctgcagcacagagtgcacagcgtgggccacttccccgtgagcatcagacagcccctgaaggccaccgcctacgtgagccccaccgtgcagggcagcagcaacatgcccctgagcaacggcctgcagctgtacagcaacaccggcatccccacccccaacaaggccgccgccagcggcatcatgggcagaagcgccctgcccagacccagcctggccatcaacggcagcaacctgcccagaagcaagatcgcccagcccgtgagaagcttcctgcagccccccaagcccctgagcagcctgagcaccctgagagacggcaactggagagacggctgctactag

SEQ ID NO: 24709 - DNA, 918 bp, Artificial Sequence; identical to SEQ ID NO: 24708
  Description of Artificial Sequence: Synthetic coding sequence

SEQ ID NO: 24710 - DNA, 255 bp, Artificial Sequence
  Description of Artificial Sequence: Synthetic coding sequence
atgtacagataccagagctgcagatggaagaacaccctgttcctgtgcgtgagcggctacaccagcagaggcagccccctgagcccccagagcagcatcgacagcgagctgagcaccagcgagctggaggacgacagcatcagcatgggctacaagctgcaggacctgaccgacgtgcagatcatggccagactgcaggaggagagcctgagacaggactacgccagcaccagcgccagcgtgagcagacactag

SEQ ID NO: 24711 - DNA, 1707 bp, Artificial Sequence
  Description of Artificial Sequence: Synthetic coding sequence
atgatggccgagcaggtgaagtgcgccagcgccggcgtgagcagcggcgccggcagcggccccgtggtgaacgccgagctggaggtgaagaagctgcaggagctggtgagaaagctggagaagcagaacgagcagctgagaagcagagccgccagcgccgccgccgccccccacctgctgctgctgcccccccccccccccgccgcccccccccccgccggcctgcagcccctgggccccagaagcccccccgccgccaccgccaccgccgccgccagcggcggcctgggccccgccttccccggcaccttctgcctgcccagccccgcccccagcctgctgtgcagcctggcccagccccccgaggcccccttcgtgtacttcaagcccgccgccggcttcttcggcgccggcggcggcggccccgagcccggcggcgccggcaccccccccggcgccgccgccgccccccccagccccccccccaccctgctggacgaggtggagctgctggacctggagagcgtggccgcctggagagacgaggacgactacacctggctgtacatcggcagcagcaagaccttcaccagcagcgagaagagcctgacccccctgcagtggtgcagacacgtgctggacaaccccacccccgagatggaggccgccagaagaagcctgtgcttcagactggagcagggctacaccagcagaggcagccccctgagcccccagagcagcatcgacagcgagctgagcaccagcgagctggaggacgacagcatcagcatgggctacaagctgcaggacctgaccgacgtgcagatcatggccagactgcaggaggagagcctgagacaggactacgccagcaccagcgccagcgtgagcagacacagcagcagcgtgagcctgagcagcggcaagaagggcacctgcagcgaccaggagtacgaccagtacagcctggaggacgaggaggagttcgaccacctgccccccccccagcccagactgcccagatgcagccccttccagagaggcatcccccacagccagaccttcagcagcatcagagagtgcagaagaagccccagcagccagtacttccccagcaacaactaccagcagcagcagtactacagcccccaggcccagacccccgaccagcagcccaacagaaccaacggcgacaagctgagaagaagcatgcccaacctggccagaatgcccagcaccaccgccatcagcagcaacatcagcagccccgtgaccgtgagaaacagccagagcttcgacagcagcctgcacggcgccggcaacggcatcagcagaatccagagctgcatccccagccccggccagctgcagcacagagtgcacagcgtgggccacttccccgtgagcatcagacagcccctgaaggccaccgcctacgtgagccccaccgtgcagggcagcagcaacatgcccctgagcaacggcctgcagctgtacagcaacaccggcatccccacccccaacaaggccgccgccagcggcatcatgggcagaagcgccctgcccagacccagcctggccatcaacggcagcaacctgcccagaagcaagatcgcccagcccgtgagaagcttcctgcagccccccaagcccctgagcagcctgagcaccctgagagacggcaactggagagacggctgctactag

SEQ ID NO: 24712 - DNA, 1050 bp, Artificial Sequence
  Description of Artificial Sequence: Synthetic coding sequence
atggaggccgccagaagaagcctgtgcttcagactggagcagggctacaccagcagaggcagccccctgagcccccagagcagcatcgacagcgagctgagcaccagcgagctggaggacgacagcatcagcatgggctacaagctgcaggacctgaccgacgtgcagatcatggccagactgcaggaggagagcctgagacaggactacgccagcaccagcgccagcgtgagcagacacagcagcagcgtgagcctgagcagcggcaagaagggcacctgcagcgaccaggagtacgaccagtacagcctggaggacgaggaggagttcgaccacctgccccccccccagcccagactgcccagatgcagccccttccagagaggcatcccccacagccagaccttcagcagcatcagagagtgcagaagaagccccagcagccagtacttccccagcaacaactaccagcagcagcagtactacagcccccaggcccagacccccgaccagcagcccaacagaaccaacggcgacaagctgagaagaagcatgcccaacctggccagaatgcccagcaccaccgccatcagcagcaacatcagcagccccgtgaccgtgagaaacagccagagcttcgacagcagcctgcacggcgccggcaacggcatcagcagaatccagagctgcatccccagccccggccagctgcagcacagagtgcacagcgtgggccacttccccgtgagcatcagacagcccctgaaggccaccgcctacgtgagccccaccgtgcagggcagcagcaacatgcccctgagcaacggcctgcagctgtacagcaacaccggcatccccacccccaacaaggccgccgccagcggcatcatgggcagaagcgccctgcccagacccagcctggccatcaacggcagcaacctgcccagaagcaagatcgcccagcccgtgagaagcttcctgcagccccccaagcccctgagcagcctgagcaccctgagagacggcaactggagagacggctgctactag

SEQ ID NO: 24713 - DNA, 723 bp, Artificial Sequence
  Description of Artificial Sequence: Synthetic coding sequence
atgggctacaagctgcaggacctgaccgacgtgcagatcatggccagactgcaggaggagagcctgagacaggactacgccagcaccagcgccagcgtgagcagacacagcagcagcgtgagcctgagcagcggcaagaagggcacctgcagcgaccaggagtacgaccagtacagcctggaggacgaggaggagttcgaccacctgccccccccccagcccagactgcccagatgcagccccttccagagaggcatcccccacagccagaccttcagcagcatcagagagtgcagaagaagccccagcagccagtacttccccagcaacaactaccagcagcagcagtactacagcccccaggcccagacccccgaccagcagcccaacagaaccaacggcgacaagctgagaagaagcatgcccaacctggccagaatgcccagcaccaccgccatcagcagcaacatcagcagccccgtgaccgtgagaaacagccagagcttcgacagcagcctgcacggcgccggcaacggcatcagcagaatccagagctgcatccccagccccggccagctgcagcacagagtgcacagcgtgggccacttccccgtgagcatcagacagcccctgaaggccaccgcctacgtgagccccaccgtgcagggcagcagcaacatgcccctgagcaacggcctgcagctgtacagcaacaccggctag

SEQ ID NO: 24714 - DNA, 1707 bp, Artificial Sequence; identical to SEQ ID NO: 24711
  Description of Artificial Sequence: Synthetic coding sequence

SEQ ID NO: 24715 - DNA, 444 bp, Artificial Sequence
  Description of Artificial Sequence: Synthetic coding sequence
atgggctacaagctgcaggacctgaccgacgtgcagatcatggccagactgcaggaggagagcctgagacaggactacgccagcaccagcgccagcgtgagcagacacagcagcagcgtgagcctgagcagcggcaagaagggcacctgcagcgaccaggagtacgaccagtacagcctggaggacgaggaggagttcgaccacctgccccccccccagcccagactgcccagatgcagccccttccagagaggcatcccccacagccagaccttcagcagcatcagagagtgcagaagaagccccagcagccagtacttccccagcaacaactaccagcagcagcagtactacagcccccaggcccagacccccgaccagcagcccaacagaaccaacggcgacaagctgagaagaagcatgcccaacctggccagaatgtag

SEQ ID NO: 24716 - DNA, 39 bp, Artificial Sequence
  Description of Artificial Sequence: Synthetic coding sequence
atgggctacaagctgcaggacctgaccgacgtgcagtag

SEQ ID NO: 24717 - DNA, 1281 bp, Artificial Sequence
  Description of Artificial Sequence: Synthetic coding sequence
atggtgggcgtgggcctgtgcctgagactgctgctgttcttcagattcaagagaaccctggacagaatctgcgtgctgttcctgctgggctggcacagaaagcccagaagcgacggcagcctgttcatcgagagactgtacatcggcagcagcaagaccttcaccagcagcgagaagagcctgacccccctgcagtggtgcagacacgtgctggacaaccccacccccgagatggaggccgccagaagaagcctgtgcttcagactggagcagggctacaccagcagaggcagccccctgagcccccagagcagcatcgacagcgagctgagcaccagcgagctggaggacgacagcatcagcatgggctacaagctgcaggacctgaccgacgtgcagatcatggccagactgcaggaggagagcctgagacaggactacgccagcaccagcgccagcgtgagcagacacagcagcagcgtgagcctgagcagcggcaagaagggcacctgcagcgaccaggagtacgaccagtacagcctggaggacgaggaggagttcgaccacctgccccccccccagcccagactgcccagatgcagccccttccagagaggcatcccccacagccagaccttcagcagcatcagagagtgcagaagaagccccagcagccagtacttccccagcaacaactaccagcagcagcagtactacagcccccaggcccagacccccgaccagcagcccaacagaaccaacggcgacaagctgagaagaagcatgcccaacctggccagaatgcccagcaccaccgccatcagcagcaacatcagcagccccgtgaccgtgagaaacagccagagcttcgacagcagcctgcacggcgccggcaacggcatcagcagaatccagagctgcatccccagccccggccagctgcagcacagagtgcacagcgtgggccacttccccgtgagcatcagacagcccctgaaggccaccgcctacgtgagccccaccgtgcagggcagcagcaacatgcccctgagcaacggcctgcagctgtacagcaacaccggcatccccacccccaacaaggccgccgccagcggcatcatgggcagaagcgccctgcccagacccagcctggccatcaacggcagcaacctgcccagaagcaagatcgcccagcccgtgagaagcttcctgcagccccccaagcccctgagcagcctgagcaccctgagagacggcaactggagagacggctgctactag

SEQ ID NO: 24718 - DNA, 408 bp, Artificial Sequence
  Description of Artificial Sequence: Synthetic coding sequence
atgggctacaagctgcaggacctgaccgacgtgcagatcatggccagactgcaggaggagagcctgagacaggactacgccagcaccagcgccagcgtgagcagacacagcagcagcgtgagcctgagcagcggcaagaagggcacctgcagcgaccaggagtacgaccagtacagcctggaggacgaggaggagttcgaccacctgccccccccccagcccagactgcccagatgcagccccttccagagaggcatcccccacagccagaccttcagcagcatcagagagtgcagaagaagccccagcagccagtacttccccagcaacaactaccagcagcagcagtactacagcccccaggcccagacccccgaccagcagcccaacagaaccaacggcggctag

SEQ ID NO: 24719 - DNA, 2538 bp, Artificial Sequence
  Description of Artificial Sequence: Synthetic coding sequence
atgctgagcggcgtgtggttcctgagcgtgctgaccgtggccggcatcctgcagaccgagagcagaaagaccgccaaggacatctgcaagatcagatgcctgtgcgaggagaaggagaacgtgctgaacatcaactgcgagaacaagggcttcaccaccgtgagcctgctgcagcccccccagtacagaatctaccagctgttcctgaacggcaacctgctgaccagactgtaccccaacgagttcgtgaactacagcaacgccgtgaccctgcacctgggcaacaacggcctgcaggagatcagaaccggcgccttcagcggcctgaagaccctgaagagactgcacctgaacaacaacaagctggagatcctgagagaggacaccttcctgggcctggagagcctggagtacctgcaggccgactacaactacatcagcgccatcgaggccggcgccttcagcaagctgaacaagctgaaggtgctgatcctgaacgacaacctgctgctgagcctgcccagcaacgtgttcagattcgtgctgctgacccacctggacctgagaggcaacagactgaaggtgatgcccttcgccggcgtgctggagcacatcggcggcatcatggagatccagctggaggagaacccctggaactgcacctgcgacctgctgcccctgaaggcctggctggacaccatcaccgtgttcgtgggcgagatcgtgtgcgagacccccttcagactgcacggcaaggacgtgacccagctgaccagacaggacctgtgccccagaaagagcgccagcgacagcagccagagaggcagccacgccgacacccacgtgcagagactgagccccaccatgaaccccgccctgaaccccaccagagcccccaaggccagcagaccccccaagatgagaaacagacccacccccagagtgaccgtgagcaaggacagacagagcttcggccccatcatggtgtaccagaccaagagccccgtgcccctgacctgccccagcagctgcgtgtgcaccagccagagcagcgacaacggcctgaacgtgaactgccaggagagaaagttcaccaacatcagcgacctgcagcccaagcccaccagccccaagaagctgtacctgaccggcaactacctgcagaccgtgtacaagaacgacctgctggagtacagcagcctggacctgctgcacctgggcaacaacagaatcgccgtgatccaggagggcgccttcaccaacctgaccagcctgagaagactgtacctgaacggcaactacctggaggtgctgtaccccagcatgttcgacggcctgcagagcctgcagtacctgtacctggagtacaacgtgatcaaggagatcaagcccctgaccttcgacgccctgatcaacctgcagctgctgttcctgaacaacaacctgctgagaagcctgcccgacaacatcttcggcggcaccgccctgaccagactgaacctgagaaacaaccacttcagccacctgcccgtgaagggcgtgctggaccagctgcccgccttcatccagatcgacctgcaggagaacccctgggactgcacctgcgacatcatgggcctgaaggactggaccgagcacgccaacagccccgtgatcatcaacgaggtgacctgcgagagccccgccaagcacgccggcgagatcctgaagttcctgggcagagaggccatctgccccgacagccccaacctgagcgacggcaccgtgctgagcatgaaccacaacaccgacacccccagaagcctgagcgtgagccccagcagctaccccgagctgcacaccgaggtgcccctgagcgtgctgatcctgggcctgctggtggtgttcatcctgagcgtgtgcttcggcgccggcctgttcgtgttcgtgctgaagagaagaaagggcgtgcccagcgtgcccagaaacaccaacaacctggacgtgagcagcttccagctgcagtacggcagctacaacaccgagacccacgacaagaccgacggccacgtgtacaactacatccccccccccgtgggccagatgtgccagaaccccatctacatgcagaaggagggcgaccccgtggcctactacagaaacctgcaggagttcagctacagcaacctggaggagaagaaggaggagcccgccacccccgcctacaccatcagcgccaccgagctgctggagaagcaggccacccccagagagcccgagctgctgtaccagaacatcgccgagagagtgaaggagctgcccagcgccggcctggtgcactacaacttctgcaccctgcccaagagacagttcgcccccagctacgagagcagaagacagaaccaggacagaatcaacaagaccgtgctgtacggcacccccagaaagtgcttcgtgggccagagcaagcccaaccaccccctgctgcaggccaagccccagagcgagcccgactacctggaggtgctggagaagcagaccgccatcagccagctgtag

SEQ ID NO: 24720 - DNA, 2538 bp, Artificial Sequence; identical to SEQ ID NO: 24719
  Description of Artificial Sequence: Synthetic coding sequence

SEQ ID NO: 24721 - DNA, 2538 bp, Artificial Sequence; identical to SEQ ID NO: 24719
  Description of Artificial Sequence: Synthetic coding sequence

SEQ ID NO: 24722 - DNA, 333 bp, Artificial Sequence
  Description of Artificial Sequence: Synthetic coding sequence
atggccagaggcaaccagagagagctggccagacagaagaacatgaagaagacccaggagatcagcaagggcaagagaaaggaggacagcctgaccgccagccagagaaagcagagcagcggcggccagaagagcgagagcaagatgagcgccggcccccacctgcccctgaaggcccccagagagaacccctgcttccccctgcccgccgccggcggcagcagatactacctggcctacggcagcatcacccccatcagcgccttcgtgttcgtggtgttcttcagcgtgttcttccccagcttctacgaggacttctgctgctggatctag

SEQ ID NO: 24723 - DNA, 189 bp, Artificial Sequence
  Description of Artificial Sequence: Synthetic coding sequence
atggccagaggcaaccagagagagctggccagacagaagaacatgaagaagacccaggagatcagcaagggcaagagaaaggaggacagcctgaccgccagccagagaaagcagagagacagcgagatcatgcaggagaagcagaaggccgccaacgagaagaagagcatgcagaccagagagaagtag

SEQ ID NO: 24724 - DNA, 915 bp, Artificial Sequence
  Description of Artificial Sequence: Synthetic coding sequence
atgagcagcatcaagcacctggtgtacgccgtgatcagattcctgagagagcagagccagatggacacctacaccagcgacgagcaggagagcctggaggtggccatccagtgcctggagaccgtgttcaagatcagccccgaggacacccacctggccgtgagccagcccctgaccgagatgttcaccagcagcttctgcaagaacgacgtgctgcccctgagcaacagcgtgcccgaggacgtgggcaaggccgaccagctgaaggacgagggcaacaaccacatgaaggaggagaactacgccgccgccgtggactgctacacccaggccatcgagctggaccccaacaacgccgtgtactactgcaacagagccgccgcccagagcaagctgggccactacaccgacgccatcaaggactgcgagaaggccatcgccatcgacagcaagtacagcaaggcctacggcagaatgggcctggccctgaccgccctgaacaagttcgaggaggccgtgaccagctaccagaaggccctggacctggaccccgagaacgacagctacaagagcaacctgaagatcgccgagcagaagctgagagaggtgagcagccccaccggcaccggcctgagcttcgacatggccagcctgatcaacaaccccgccttcatcagcatggccgccagcctgatgcagaacccccaggtgcagcagctgatgagcggcatgatgaccaacgccatcggcggccccgccgccggcgtgggcggcctgaccgacctgagcagcctgatccaggccggccagcagttcgcccagcagatccagcagcagaaccccgagctgatcgagcagctgagaaaccacatcagaagcagaagcttcagcagcagcgccgaggagcacagctag

SEQ ID NO: 24725 - DNA, 588 bp, Artificial Sequence
  Description of Artificial Sequence: Synthetic coding sequence
atgagcagcatcaagcacctggtgtacgccgtgatcagattcctgagagagcagagccagatggacacctacaccagcgacgagcaggagagcctggaggtggccatccagtgcctggagaccgtgttcaagatcagccccgaggacacccacctggccgtgagccagcccctgaccgagatgttcaccagcagcttctgcaagaacgacgtgctgcccctgagcaacagcgtgcccgaggacgtgggcaaggccgaccagctgaaggacgagggcaacaaccacatgaaggaggagaactacgccgccgccgtggactgctacacccaggccatcgagctggaccccaacaacgccgtgtactactgcaacagagccgccgcccagagcaagctgggccactacaccgacgccatcaaggactgcgagaaggccatcgccatcgacagcaagtacagcaaggcctacggcagaatgggcctggccctgaccgccctgaacaagttcgaggaggccgtgaccagctaccagaaggccctggacctggaccccgagaacgacagctacaagagcaacctgaagatctag

SEQ ID NO: 24726 - DNA, 237 bp, Artificial Sequence
  Description of Artificial Sequence: Synthetic coding sequence
atgcagccccaggagagccacgtgcactacagcagatgggaggacggcagcagagacggcgtgagcctgggcgccgtgagcagcaccgaggaggccagcagatgcagaagaatcagccagagactgtgcaccggcaagctgggcatcgccatgaaggtgctgggcggcgtggccctgttctggatcatcttcatcctgggctacctgaccggctactacgtgcacaagtgcaagtag

SEQ ID NO: 24727 - DNA, 189 bp, Artificial Sequence; identical to SEQ ID NO: 18961
  Description of Artificial Sequence: Synthetic coding sequence

SEQ ID NO: 24728 - DNA, 279 bp, Artificial Sequence
  Description of Artificial Sequence: Synthetic coding sequence
atggcctacagcggccagggccagaaggtgcagaaggtgatggtgcagcccatcaacctgatcttcagatacctgcagaacagaagccagatccaggtgtggctgtacgagcaggtgaacatgcagatcgagggctgcatcatcggcttcgacgagtacatgaacctggtgctggacgacgccgaggagatccacagcaagaccaagagcagaaagcagctgggcagaatcatgctgaagggcgacaacatcaccctgctgcagagcgtgagcaactag

SEQ ID NO: 24729 - DNA, 297 bp, Artificial Sequence
  Description of Artificial Sequence: Synthetic coding sequence
atgcaggtgcccctgacccccctgtgggagctgggcctgggcagagtggtggagaacgccgacgccctggccatcgccatcgtgctgaacaaccagtggagcctggtgcccaacagaggcatcctgtacttcctgcccgtgagcatgaagctgggcggcgacagagtgagctgccagttcctgaccgccaccagccaccagtggctgcacagcgtgagcctgacccagcacatggcccaggagtgcctgcccagcgtgagcgtgagcaccgccgccatccccagatgctggagctag

SEQ ID NO: 24730 - DNA, 423 bp, Artificial Sequence
  Description of Artificial Sequence: Synthetic coding sequence
atgagaagatgcctgagagtgaagaccagaagaggccagctgggcctggccagcagctgcttcgagcagcacagctgcttcagccccagagtgaacagaatcctgagcgccgtgcagaacaccctgtgcaccggccccagcagccaggcccccccccagcccccccaggccagcccccccgccgccgccgaccacagcagaacccccagcctgctggccagcagccacagcgccagcggcggcgagagcctgttccagctgtacatcgccagcctggcctggccccagaactgctgcgtgctggagagctgcagaagaatccccctgggcggcctgagcagcatggagaacagaagacccctgctgagaaagggcagactgctgagaggccagatccaccacagccagaccaacgagctgtag

SEQ ID NO: 24731 - DNA, 2814 bp, Artificial Sequence
  Description of Artificial Sequence: Synthetic coding sequence
atgatcagcgcccccgacgtggtggccttcaccaaggaggaggagtacgaggaggagccctacaacgagcccgccctgcccgaggagtacagcgtgcccctgttccccttcgccagccagggcgccaacccctggagcaagctgagcggcgccaagttcagcagagacttcatcctgatcagcgagttcagcgagcaggtgggcccccagcccctgctgaccatccccaacgacaccaaggtgttcggcaccttcgacctgaactacttcagcctgagaatcatgagcgtggactaccaggccagcttcgtgggccacccccccggcagcgcctaccccaagctgaacttcgtggaggacagcaaggtggtgctgggcgacagcaaggagggcgccttcgcctacgtgcaccacctgaccctgtacgacctggaggccagaggcttcgtgagacccttctgcatggcctacatcagcgccgaccagcacaagatcatgcagcagttccaggagctgagcgccgagttcagcagagccagcgagtgcctgaagaccggcaacagaaaggccttcgccggcgagctggagaagaagctgaaggacctggactacaccagaaccgtgctgcacaccgagaccgagatccagaagaaggccaacgacaagggcttctacagcagccaggccatcgagaaggccaacgagctggccagcgtggagaagagcatcatcgagcaccaggacctgctgaagcagatcagaagctacccccacagaaagctgaagggccacgacctgtgccccggcgagatggagcacatccaggaccaggccagccaggccagcaccaccagcaaccccgacgagagcgccgacaccgacctgtacacctgcagacccgcctacacccccaagctgatcaaggccaagagcaccaagtgcttcgacaagaagctgaagaccctggaggagctgtgcgacaccgagtacttcacccagaccctggcccagctgagccacatcgagcacatgttcagaggcgacctgtgctacctgctgaccagccagatcgacagagccctgctgaagcagcagcacatcaccaacttcctgttcgaggacttcgtggaggtggacgacagaatggtggagaagcaggagagcatccccagcaagcccagccaggacagaccccccagcagcagcctggaggagtgccccatccccaaggtgctgatcagcgtgggcagctacaagagcagcgtggagagcgtgctgatcaagatggagcaggagctgggcgacgaggagtacaaggaggtggaggtgaccgagctgagcagcttcgacccccaggagaacctggactacctggacatggacatgaagggcagcatcagcagcggcgagagcatcgaggtgctgggcaccgagaagagcaccagcgtgctgagcaagagcgacagccaggccagcctgaccgtgcccctgagcccccaggtggtgagaagcaaggccgtgagccacagaaccatcagcgaggacagcatcgaggtgctgagcacctgccccagcgaggccctgatccccgacgacttcaaggccagctaccccagcgccatcaacgaggaggagagctaccccgacggcaacgagggcgccatcagattccaggccagcatcagcccccccgagctgggcgagaccgaggagggcagcatcgagaacacccccagccagatcgacagcagctgctgcatcggcaaggagagcgacggccagctggtgctgcccagcacccccgcccacacccacagcgacgaggacggcgtggtgagcagccccccccagagacacagacagaaggaccagggcttcagagtggacttcagcgtggagaacgccaaccccagcagcagagacaacagctgcgagggcttccccgcctacgagctggaccccagccacctgctggccagcagagacatcagcaagaccagcctggacaactacagcgacaccaccagctacgtgagcagcgtggccagcaccagcagcgacagaatccccagcgcctaccccgccggcctgagcagcgacagacacaagaagagagccggccagaacgccctgaagttcatcagacagtaccccttcgcccaccccgccatctacagcctgctgagcggcagaaccctggtggtgctgggcgaggacgaggccatcgtgagaaagctggtgaccgccctggccatcttcgtgcccagctacggctgctacgccaagcccgtgaagcactgggccagcagccccctgcacatcatggacttccagaagtggaagctgatcggcctgcagagagtggccagccccgccggcgccggcaccctgcacgccctgagcagatacagcagatacaccagcatcctggacctggacaacaagaccctgagatgccccctgtacagaggcaccctggtgcccagactggccgaccacagaacccagatcaagagaggcagcacctactacctgcacgtgcagagcatgctgacccagctgtgcagcaaggccttcctgtacaccttctgccaccacctgcacctgcccacccacgacaaggagaccgaggagctggtggccagcagacagatgagcttcctgaagctgaccctgggcctggtgaacgaggacgtgagagtggtgcagtacctggccgagctgctgaagctgcactacatgcaggagagccccggcaccagccaccccatgctgagattcgactacgtgcccagcttcctgtacaagatctag

SEQ ID NO: 24732 - DNA, 954 bp, Artificial Sequence
  Description of Artificial Sequence: Synthetic coding sequence
atgagaaagaccagcaacagctgcatcatggagaacggccaccagcccggcgccggccccggcgacggcccccccgagatcgcccagaacttcagcgcccccgacccccccagacccagacccgtgagcctgagcctgagactgccccaccagcccgtgaccgccatcaccagagtgagcgacagattcagcggcgagaccagcgccgccgccctgagccccatgagcgccgccaccctgggcggcctgaaccccagccccagcgaggtgatcaccccctggacccccagccccagcgagaagaacagcagcttcacctggagcgtgcccagcagcggctacggcgccgtgaccgccagcaagcacagcaacagcccccccctggtgacccccccccagagccccgtgagcccccagccccccgccatcacccaggtgcacagacagggcgagagaagaagagagctggtgagaagccagaccctgcccagaaccagcgaggcccaggccagaaaggccctgttcgagaagtgggagcaggagaccgccgccggcaagggcaagggcgaggccagagccagactgaagagaagccagagcttcggcgtggccagcgccagcagcatcaagcagatcctgctggagtggtgcagaagcaagaccctgggctaccagcacgtggacctgcagaacttcagcagcagctggagcgacggcatggccttctgcgccctggtgcacagcttcttccccgacgccttcgactacaacagcctgagccccacccagagacagaagaacttcgagctggccttcaccatggccgagaacctggccaactgcgagagactgatcgaggtggaggacatgatggtgatgggcagaaagcccgaccccatgtgcgtgttcacctacgtgcagagcctgtacaaccacctgagaagattcgagtag

SEQ ID NO: 24733 - DNA, 1386 bp, Artificial Sequence
  Description of Artificial Sequence: Synthetic coding sequence
atggagcccgcccccgacgcccaggaggccagaaccgtgagagaggccctgggcagatacgaggccgccctggagggcgccgtgagagccctgcacgaggacatgagaggcctgcagagaggcgtggagagaagagtggccgaggccatgagactggccggccccctggccagaaccgtggccgacctgcagagagacaaccagagactgcaggcccagctggagagactgaccagacaggtggaggccctgggcctggccagcggcatgagccccgtgcccggcacccccggcacccccagccccccccccgcccccggcgtgcccgacagagcccccagactgggcagcgccagattcgccagccacgccaccttcagcctgagcggcagaggccagagcctggaccacgacgaggccagcgagagcgagatgagaaagaccagcaacagctgcatcatggagaacggccaccagcccggcgccggccccggcgacggcccccccgagatcgcccagaacttcagcgcccccgacccccccagacccagacccgtgagcctgagcctgagactgccccaccagcccgtgaccgccatcaccagagtgagcgacagattcagcggcgagaccagcgccgccgccctgagccccatgagcgccgccaccctgggcggcctgaaccccagccccagcgaggtgatcaccccctggacccccagccccagcgagaagaacagcagcttcacctggagcgtgcccagcagcggctacggcgccgtgaccgccagcaagcacagcaacagcccccccctggtgacccccccccagagccccgtgagcccccagccccccgccatcacccaggtgcacagacagggcgagagaagaagagagctggtgagaagccagaccctgcccagaaccagcgaggcccaggccagaaaggccctgttcgagaagtgggagcaggagaccgccgccggcaagggcaagggcgaggccagagccagactgaagagaagccagagcttcggcgtggccagcgccagcagcatcaagcagatcctgctggagtggtgcagaagcaagaccctgggctaccagcacgtggacctgcagaacttcagcagcagctggagcgacggcatggccttctgcgccctggtgcacagcttcttccccgacgccttcgactacaacagcctgagccccacccagagacagaagaacttcgagctggccttcaccatggccgagaacctggccaactgcgagagactgatcgaggtggaggacatgatggtgatgggcagaaagcccgaccccatgtgcgtgttcacctacgtgcagagcctgtacaaccacctgagaagattcgagtag

SEQ ID NO: 24734 - DNA, 216 bp, Artificial Sequence
  Description of Artificial Sequence: Synthetic coding sequence
atggccgacgagaagcccaaggagggcgtgaagaccgagaacaacgaccacatcaacctgaaggtggccggccaggacggcagcgtggtgcagttcaagatcaagagacacacccccctgagcaagctgatgaaggcctactgcgagagacagctggagatggaggacgaggacaccatcgacgtgttccagcagcagaccggcggcgtgtactag

SEQ ID NO: 24735 - DNA, 288 bp, Artificial Sequence
  Description of Artificial Sequence: Synthetic coding sequence
atggccgacgagaagcccaaggagggcgtgaagaccgagaacaacgaccacatcaacctgaaggtggccggccaggacggcagcgtggtgcagttcaagatcaagagacacacccccctgagcaagctgatgaaggcctactgcgagagacagggcctgagcatgagacagatcagattcagattcgacggccagcccatcaacgagaccgacacccccgcccagctggagatggaggacgaggacaccatcgacgtgttccagcagcagaccggcggcgtgtactag

SEQ ID NO: 24736 - DNA, 1257 bp, Artificial Sequence
  Description of Artificial Sequence: Synthetic coding sequence
atggccgccagcatgtgcgacgtgttcagcttctgcgtgggcgtggccggcagagccagagtgagcgtggaggtgagattcgtgagcagcgccaagggcaagggcctgttcgccacccagctgatcagaaagggcgagaccatcttcgtggagagacccctggtggccgcccagttcctgtggaacgccctgtacagatacagagcctgcgaccactgcctgagagccctggagaaggccgaggagaacgcccagagactgaccggcaagcccggccaggtgctgccccaccccgagctgtgcaccgtgagaaaggacctgcaccagaactgcccccactgccaggtgatgtactgcagcgccgagtgcagactggccgccaccgagcagtaccaccaggtgctgtgccccggccccagccaggacgaccccctgcaccccctgaacaagctgcaggaggcctggagaagcatccactacccccccgagaccgccagcatcatgctgatggccagaatggtggccaccgtgaagcaggccaaggacaaggacagatggatcagactgttcagccagttctgcaacaagaccgccaacgaggaggaggagatcgtgcacaagctgctgggcgacaagttcaagggccagctggagctgctgagaagactgttcaccgaggccctgtacgaggaggccgtgagccagtggttcacccccgacggcttcagaagcctgttcgccctggtgggcaccaacggccagggcatcggcaccagcagcctgagccagtgggtgcacgcctgcgacaccctggagctgaagccccaggacagagagcagctggacgccttcatcgaccagctgtacaaggacatcgaggccgccaccggcgagttcctgaactgcgagggcagcggcctgttcgtgctgcagagctgctgcaaccacagctgcgtgcccaacgccgagaccagcttccccgagaacaacttcctgctgcacgtgaccgccctggaggacatcaagcccggcgaggagatctgcatcagctacctggactgctgccagagagagagaagcagacacagcagacacaagatcctgagagagaactacctgttcgtgtgcagctgccccaagtgcctggccgaggccgacgagcccaacgtgaccagcgaggaggaggaggaggaggaggaggaggaggagggcgagcccgaggacgccgagctgggcgacgagatgaccgacgtgtag

SEQ ID NO: 24737 - DNA, 285 bp, Artificial Sequence
  Description of Artificial Sequence: Synthetic coding sequence
atggagcaggccagagaccacctgcacctgagatggaccaccgagcagcacatgcccgaggtggaggtgcaggtgaagtacagaaccgccgccctgagcaaccaggagtgccagctgtacctgagacacagccagcagcagcaggtgctggtggtggacttccaggccaagctgagacaggtgttcatcaccgagacccccagatgcggcaagaagccctactggaacaacgaggaggccgagagcaagcagaaccccggcagcatctactgcctgctgctgtag

SEQ ID NO: 24738 - DNA, 1128 bp, Artificial Sequence
  Description of Artificial Sequence: Synthetic coding sequence
atggccggcttcaacatgggcggcgacctgagagagcccgccgccagcatcccccccggcagcctggccgccgtgggcatcagctggttcctgtacatcatcttcgtgttcctgctgggcgccatctgcaccagagaggccctgagatacgacttcctgatcgccgagaaggtgagcctgatgggcttcctgttcctgctgggcctgtacatcagcagcctggccagctgcatgggcggcctgtacggcgcccccagaatcctgcagtgcatcgcccaggagaaggtgatccccgccctggcctgcctgggccagggcaagggccccaacaagacccccgtggccgccatctgcctgaccagcctggtgaccatggccttcgtgttcgtgggccaggtgaacgtgctggcccccatcgtgaccatcaacttcatgctgacctacgtggccgtggactacagctacttcagcctgagcatgtgcagctgcagcctgacccccgtgcccgagcccgtgctgagagagggcgccgagggcctgcactgcagcgagcacctgctgctggagaaggcccccagctacggcagcgagggccccgcccagagagtgctggagggcaccctgctggagttcaccaaggacatggaccagctgctgcagctgaccagaaagctggagagcagccagcccagacagggcgagggcaacagaacccccgagagccagaagagaaagagcaagaaggccaccaagcagaccctgcaggacagcttcctgctggacctgaagagcccccccagcttccccgtggagatcagcgacagactgcccgccgccagctgggagggccaggagagctgctggaacaagcagaccagcaagagcgagggcacccagcccgagggcacctacggcgagcagctggtgcccgagctgtgcaaccagagcgagagcagcggcgagggcgacctgagaagcccccaggagcagatcatcctggcccccagcctggccaaggtggacatggagatgacccagctgacccaggagaacgccgacttcgccaccagagacagataccaccacagcagcctggtgaacagagagcagctgatgccccactactag

SEQ ID NO: 24739 - DNA, 2232 bp, Artificial Sequence
  Description of Artificial Sequence: Synthetic coding sequence
atgctgcccctggagagaaccatcacctacagagacatgagcagcttcatccaggtgaagaaccacttcaacgtggtgaacgtgacctgcgtgagctacagaagcacctgcttcagagacatgagaagattcatcctggacgccctggcccagccccagccctggtggaagacccagctgttcatgtgggagcccgtgctgttcggcacctgggacggcgtgttcaccagctgcatgatcaacatcttcggcgtggtgctgttcctgagaaccggctggctggtgggcaacaccggcgtgctgctgggcatgttcctggtgagcttcgtgatcctggtggccctggtgaccgtgctgagcggcatcggcgtgggcgagagaagcagcatcggcagcggcggcgtgtacagcatgatcagcagcgtgctgggcggccagaccggcggcaccatcggcctgctgtacgtgttcggccagtgcgtggccggcgccatgtacatcaccggcttcgccgagagcatcagcgacctgctgggcctgggcaacatctgggccgtgagaggcatcagcgtggccgtgctgctggccctgctgggcatcaacctggccggcgtgaagtggatcatcagactgcagctgctgctgctgttcctgctggccgtgagcaccctggacttcgtggtgggcagcttcacccacctggaccccgagcacggcttcatcggctacagccccgagctgctgcagaacaacaccctgcccgactacagccccggcgagagcttcttcaccgtgttcggcgtgttcttccccgccgccaccggcgtgatggccggcttcaacatgggcggcgacctgagagagcccgccgccagcatcccccccggcagcctggccgccgtgggcatcagctggttcctgtacatcatcttcgtgttcctgctgggcgccatctgcaccagagaggccctgagatacgacttcctgatcgccgagaaggtgagcctgatgggcttcctgttcctgctgggcctgtacatcagcagcctggccagctgcatgggcggcctgtacggcgcccccagaatcctgcagtgcatcgcccaggagaaggtgatccccgccctggcctgcctgggccagggcaagggccccaacaagacccccgtggccgccatctgcctgaccagcctggtgaccatggccttcgtgttcgtgggccaggtgaacgtgctggcccccatcgtgaccatcaacttcatgctgacctacgtggccgtggactacagctacttcagcctgagcatgtgcagctgcagcctgacccccgtgcccgagcccgtgctgagagagggcgccgagggcctgcactgcagcgagcacctgctgctggagaaggcccccagctacggcagcgagggccccgcccagagagtgctggagggcaccctgctggagttcaccaaggacatggaccagctgctgcagctgaccagaaagctggagagcagccagcccagacagggcgagggcaacagaacccccgagagccagaagagaaagagcaagaaggccaccaagcagaccctgcaggacagcttcctgctggacctgaagagcccccccagcttccccgtggagatcagcgacagactgcccgccgccagctgggagggccaggagagctgctggaacaagcagaccagcaagagcgagggcacccagcccgagggcacctacggcgagcagctggtgcccgagctgtgcaaccagagcgagagcagcggcgaggacttcttcctgaagagcagactgcaggagcaggacgtgtggagaagaagcaccagcttctacacccacatgtgcaacccctgggtgagcctgctgggcgccgtgggcagcctgctgatcatgttcgtgatccagtgggtgtacaccctggtgaacatgggcgtggccgccatcgtgtacttctacatcggcagagccagccccggcctgcacctgggcagcgccagcaacttcagcttcttcagatggatgagaagcctgctgctgcccagctgcagaagcctgagaagcccccaggagcagatcatcctggcccccagcctggccaaggtggacatggagatgacccagctgacccaggagaacgccgacttcgccaccagagacagataccaccacagcagcctggtgaacagagagcagctgatgccccactactag

SEQ ID NO: 24740 - DNA, 1548 bp, Artificial Sequence
  Description of Artificial Sequence: Synthetic coding sequence
atgagaagagccgccgccggcggcctggccgtgggccagctgcccggcgagggccccgccggcgaggagggcgccgccctgggcaaggccatgagaggcggcggctgcagcccccacagccccagcggctgcctgagcggcgtgatggccggcttcaacatgggcggcgacctgagagagcccgccgccagcatcccccccggcagcctggccgccgtgggcatcagctggttcctgtacatcatcttcgtgttcctgctgggcgccatctgcaccagagaggccctgagatacgacttcctgatcgccgagaaggtgagcctgatgggcttcctgttcctgctgggcctgtacatcagcagcctggccagctgcatgggcggcctgtacggcgcccccagaatcctgcagtgcatcgcccaggagaaggtgatccccgccctggcctgcctgggccagggcaagggccccaacaagacccccgtggccgccatctgcctgaccagcctggtgaccatggccttcgtgttcgtgggccaggtgaacgtgctggcccccatcgtgaccatcaacttcatgctgacctacgtggccgtggactacagctacttcagcctgagcatgtgcagctgcagcctgacccccgtgcccgagcccgtgctgagagagggcgccgagggcctgcactgcagcgagcacctgctgctggagaaggcccccagctacggcagcgagggccccgcccagagagtgctggagggcaccctgctggagttcaccaaggacatggaccagctgctgcagctgaccagaaagctggagagcagccagcccagacagggcgagggcaacagaacccccgagagccagaagagaaagagcaagaaggccaccaagcagaccctgcaggacagcttcctgctggacctgaagagcccccccagcttccccgtggagatcagcgacagactgcccgccgccagctgggagggccaggagagctgctggaacaagcagaccagcaagagcgagggcacccagcccgagggcacctacggcgagcagctggtgcccgagctgtgcaaccagagcgagagcagcggcgaggacttcttcctgaagagcagactgcaggagcaggacgtgtggagaagaagcaccagcttctacacccacatgtgcaacccctgggtgagcctgctgggcgccgtgggcagcctgctgatcatgttcgtgatccagtgggtgtacaccctggtgaacatgggcgtggccgccatcgtgtacttctacatcggcagagccagccccggcctgcacctgggcagcgccagcaacttcagcttcttcagatggatgagaagcctgctgctgcccagctgcagaagcctgagaagcccccaggagcagatcatcctggcccccagcctggccaaggtggacatggagatgacccagctgacccaggagaacgccgacttcgccaccagagacagataccaccacagcagcctggtgaacagagagcagctgatgccccactactag

SEQ ID NO: 24741 - DNA, 723 bp, Artificial Sequence
  Description of Artificial Sequence: Synthetic coding sequence
atgcagaccacctacgtgctgcagagcctgcacctgagaatccccgagatcagcaacatcaccaccaccccccacaccctgcccgccgcctggctgaccatgttcgacgccgtgctgatcctgctgctgatccccctgaaggacaagctggtggaccccatcctgagaagacacggcctgctgcccagcagcctgaagagaatcgccgtgggcatgttcttcgtgatgtgcagcgccttcgccgccggcatcctggagagcaagagactgaacctggtgaaggagaagaccatcaaccagaccatcggcaacgtggtgtaccacgccgccgacctgagcctgtggtggcaggtgccccagtacctgctgatcggcatcagcgagatcttcgccagcatcgccggcctggagttcgcctacagcgccgcccccaagagcatgcagagcgccatcatgggcctgttcttcttcttcagcggcgtgggcagcttcgtgggcagcggcctgctggccctggtgagcatcaaggccatcggctggatgagcagccacaccgacttcggcaacatcaacggctgctacctgaactactacttcttcctgctggccgccatccagggcgccaccctgctgctgttcctgatcatcagcgtgaagtacgaccaccacagagaccaccagagaagcagagccaacggcgtgcccaccagcagaagagcctag

SEQ ID NO: 24742 - DNA, 1572 bp, Artificial Sequence
  Description of Artificial Sequence: Synthetic coding sequence
atgacccagaacaagctgaagctgtgcagcaaggccaacgtgtacaccgaggtgcccgacggcggctggggctgggccgtggccgtgagcttcttcttcgtggaggtgttcacctacggcatcatcaagaccttcggcgtgttcttcaacgacctgatggacagcttcaacgagagcaacagcagaatcagctggatcatcagcatctgcgtgttcgtgctgaccttcagcgcccccctggccaccgtgctgagcaacagattcggccacagactggtggtgatgctgggcggcctgctggtgagcaccggcatggtggccgccagcttcagccaggaggtgagccacatgtacgtggccatcggcatcatcagcggcctgggctactgcttcagcttcctgcccaccgtgaccatcctgagccagtacttcggcaagagaagaagcatcgtgaccgccgtggccagcaccggcgagtgcttcgccgtgttcgccttcgcccccgccatcatggccctgaaggagagaatcggctggagatacagcctgctgttcgtgggcctgctgcagctgaacatcgtgatcttcggcgccctgctgagacccatcttcatcagaggccccgccagccccaagatcgtgatccaggagaacagaaaggaggcccagtacatgctggagaacgagaagaccagaaccagcatcgacagcatcgacagcggcgtggagctgaccaccagccccaagaacgtgcccacccacaccaacctggagctggagcccaaggccgacatgcagcaggtgctggtgaagaccagccccagacccagcgagaagaaggcccccctgctggacttcagcatcctgaaggagaagagcttcatctgctacgccctgttcggcctgttcgccaccctgggcttcttcgcccccagcctgtacatcatccccctgggcatcagcctgggcatcgaccaggacagagccgccttcctgctgagcaccatggccatcgccgaggtgttcggcagaatcggcgccggcttcgtgctgaacagagagcccatcagaaagatctacatcgagctgatctgcgtgatcctgctgaccgtgagcctgttcgccttcaccttcgccaccgagttctggggcctgatgagctgcagcatcttcttcggcttcatggtgggcaccatcggcggcacccacatccccctgctggccgaggacgacgtggtgggcatcgagaagatgagcagcgccgccggcgtgtacatcttcatccagagcatcgccggcctggccggcccccccctggccggcctgctggtggaccagagcaagatctacagcagagccttctacagctgcgccgccggcatggccctggccgccgtgtgcctggccctggtgagaccctgcaagatgggcctgtgccagcaccaccacagcggcgagaccaaggtggtgagccacagaggcaagaccctgcaggacatccccgaggacttcctggagatggacctggccaagaacgagcacagagtgcacgtgcagatggagcccgtgtag

SEQ ID NO: 24743 - DNA, 453 bp, Artificial Sequence
  Description of Artificial Sequence: Synthetic coding sequence
atgagatgcgccgagggcgcctggtggttcagccccgacggccccgccggcagcgccgccagcatctggcccgccgagggcgccgagggcctgcccggccagctgggcagagacagactggaggtggtgtacagcgtgcccgacaacgtgcccggccagaacggcagcagaagacccctggtgtgcaagatcaccggcaagtgcctgagcgtgtgcagcgaggagaacgccaaggccggcggctgcagcgccttccccctgctgctgagccagctgggcgccagaatgaccggcagagagcacgcccacaagggccccgagctgaccacccccgacagcggcctgcccagaccccccaaccccgccctggccggcttcagagccctggcccagcacagcccccccctgggcaccagcacccccagcgccgtgctgctgagcgccgccacctag

SEQ ID NO: 24744 - DNA, 453 bp, Artificial Sequence; identical to SEQ ID NO: 24743
  Description of Artificial Sequence: Synthetic coding sequence

SEQ ID NO: 24745 - DNA, 762 bp, Artificial Sequence
  Description of Artificial Sequence: Synthetic coding sequence
atgggcgagctgcccggcagcgagggcatgtgggagaactgccccctgggctgggtgaagaagaaggccagcggcaccctggcccccctggacttcctgctgcagagaaagagactgtggctgtgggccagcgagcccgtgagaccccagccccagggcatccacagattcagagaggccagaagacagttctgcagaatgagaggcagcagactgaccggcggcagaaagggcttcggcagcagcggcctgagattcggcagaggcggcttcagcgaggaggtgatgccccagcccgtgctgaaggccatgagatgcgccgagggcgcctggtggttcagccccgacggccccgccggcagcgccgccagcatctggcccgccgagggcgccgagggcctgcccggccagctgggcagagacagactggaggtggtgtacagcgtgcccgacaacgtgcccggccagaacggcagcagaagacccctggtgtgcaagatcaccggcaagtgcctgagcgtgtgcagcgaggagaacgccaaggccggcggctgcagcgccttccccctgctgctgagccagctgggcgccagaatgaccggcagagagcacgcccacaagggccccgagctgaccacccccgacagcggcctgcccagaccccccaaccccgccctggccggcttcagagccctggcccagcacagcccccccctgggcaccagcacccccagcgccgtgctgctgagcgccgccacctag

SEQ ID NO: 24746 - DNA, 825 bp, Artificial Sequence
  Description of Artificial Sequence: Synthetic coding sequence
atggacagacccggcttcgtggccgccctggtggccggcggcgtggccggcgtgagcgtggacctgatcctgttccccctggacaccatcaagaccagactgcagagcccccagggcttcagcaaggccggcggcttccacggcatctacgccggcgtgcccagcgccgccatcggcagcttccccaacgccgccgccttcttcatcacctacgagtacgtgaagtggttcctgcacgccgacagcagcagctacctgacccccatgaagcacatgctggccgccagcgccggcgaggtggtggcctgcctgatcagagtgcccagcgaggtggtgaagcagagagcccaggtgagcgccagcaccagaaccttccagatcttcagcaacatcctgtacgaggagggcatccagggcctgtacagaggctacaagagcaccgtgctgagagagatccccttcagcctggtgcagttccccctgtgggagagcctgaaggccctgtggagctggagacaggaccacgtggtggacagctggcagagcgccgtgtgcggcgccttcgccggcggcttcgccgccgccgtgaccacccccctggacgtggccaagaccagaatcaccctggccaaggccggcagcagcaccgccgacggcaacgtgctgagcgtgctgcacggcgtgtggagaagccagggcctggccggcctgttcgccggcgtgttccccagaatggccgccatcagcctgggcggcttcatcttcctgggcgcctacgacagaacccacagcctgctgctggaggtgggcagaaagagcccctag

SEQ ID NO: 24747 - DNA, 927 bp, Artificial Sequence
  Description of Artificial Sequence: Synthetic coding sequence
ctgctggtggccctgctgggcggcggcctgcccgccggcttcgtgggccccctgagcagaatggcctaccaggccagcaacctgcccagcctggagctggtgatctgcagatgcctgttccacctgcccatcgccctgctgctgaagctgagaggcgaccccctgctgggcccccccgacatcagaggcagaacctgcttctgcgccctgctgaacgtgctgaacatcggctgcgcctacagcgccgtgcaggtggtgcccaccggcaacgccgccaccgtgagaaagcacagcagcaccgtgtgcagcgccatcctgaccctgtgcctggagagccaggtgctgagcggctacgactggtgcggcctgctgggcagcatcctgggcctgatcatcatcgtgggccccggcctgtggaccctgcaggagggcaccaccggcgtgtacaccggcctgggctacgtgcaggccttcctgggcggcctggccctgagcctgggcctgctggtgtacagaagcctgcacttccccagctgcctgcccaccgtggccttcctgagcggcctggtgggcctgctgggcagcgtgcccggcctgttcgtgctgcagagccccgtgctgcccagcgacctgctgagctggagctgcgtgggcgccgtgggcatcctgaccctggtgagcttcacctgcgtgggctacgccgtgaccaaggcccaccccgccctggtgtgcgccgtgctgcacagcgaggtggtgatggccctgatcctgcagtacttcatgctgcacgagaccgtggcccccagcgacatcatgggcgccggcgtggtgctgggcagcatcgccatcatcaccgccagaaacctgatctgcgagagaaccggcaaggtggaggagcagagactgaagaccaagaagaagaagtag

SEQ ID NO: 24748 - DNA, 1017 bp, Artificial Sequence
  Description of Artificial Sequence: Synthetic coding sequence
atggccggcagccacccctacctgaacccccccgacagcacccaccccagcccccccagcgccccccccagcctgagatggcaccagtgctgccagcccagcgacgccaccaacggcctgctggtggccctgctgggcggcggcctgcccgccggcttcgtgggccccctgagccacatggcctaccaggccagcaacctgcccagcctggagctgctgatctgcagatgcctgttccacctgcccatcgccctgctgctgaagctgagaggcgaccccctgctgggcccccccgacatcagaggcagagcctacttctacgccctgctgaacgtgctgagcatcggctgcgcctacagcgccgtgcaggtggtgcccgccggcaacgccgccaccgtgagaaagggcagcagcaccgtgtgcagcgccgtgctgaccctgtgcctggagagccagggcctgagcggctacgactggtgcggcctgctgggcagcatcctgggcctgatcatcatcgtgggccccggcctgtggaccctgcaggagggcatcaccggcgtgtacaccgccctgggctacggccaggccttcgtgggcggcctggccctgagcctgggcctgctggtgtacagaagcctgcacttccccagctgcctgcccaccgtggccttcctgagcggcctggtgggcctgctgggcagcgtgcccggcctgttcgtgctgcagccccccgtgctgcccagcgacctgcccagctggagctgcgtgggcgccgtgggcatcctggccctggtgagcttcacctgcgtgagctacgccgtgaccaaggcccaccccgccctggtgtgcgccgtgctgcacagcgaggtggtggtggccctgatcctgcagtactacatgctgcacgagaccgtggcccccagcgacatcgtgggcgccggcgtggtgctgggcagcatcgccatcatcaccgcctggaacctgagctgcgagagagagggcaaggtggaggagtag

SEQ ID NO: 24749 - DNA, 1308 bp, Artificial Sequence
  Description of Artificial Sequence: Synthetic coding sequence
atggagggccagacccccggcagcagaggcctgcccgagaagccccaccccgccaccgccgccgccaccctgagcagcatgggcgccgtgttcatcctgatgaagagcgccctgggcgccggcctgctgaacttcccctgggccttcagcaaggccggcggcgtggtgcccgccttcctggtggagctggtgagcctggtgttcctgatcagcggcctggtgatcctgggctacgccgccgccgtgagcggccaggccacctaccagggcgtggtgagaggcctgtgcggccccgccatcggcaagctgtgcgaggcctgcttcctgctgaacctgctgatgatcagcgtggccttcctgagagtgatcggcgaccagctggagaagctgtgcgacagcctgctgagcggcaccccccccgccccccagccctggtacgccgaccagagattcaccctgcccctgctgagcgtgctggtgatcctgcccctgagcgcccccagagagatcgccttccagaagtacaccagcatcctgggcaccctggccgcctgctacctggccctggtgatcaccgtgcagtactacctgtggccccagggcctggtgagagagagccaccccagcctgagccccgccagctggaccagcgtgttcagcgtgttccccaccatctgcttcggcttccagtgccacgaggccgccgtgagcatctactgcagcatgagaaagagaagcctgagccactgggccctggtgagcgtgctgagcctgctggcctgctgcctgatctacagcctgaccggcgtgtacggcttcctgaccttcggcaccgaggtgagcgccgacgtgctgatgagctaccccggcaacgacatggtgatcatcgtggccagagtgctgttcgccgtgagcatcgtgaccgtgtaccccatcgtgctgttcctgggcagaagcgtgatgcaggacttctggagaagaagctgcctgggcggctggggccccagcgccctggccgaccccagcggcctgtgggtgagaatgcccctgaccatcctgtgggtgaccgtgaccctggccatggccctgttcatgcccgacctgagcgagatcgtgagcatcatcggcggcatcagcagcttcttcatcttcatcttccccggcctgtgcctgatctgcgccatgggcgtggagcccatcggccccagagtgaagtgctgcctggaggtgtggggcgtggtgagcgtgctggtgggcaccttcatcttcggccagagcaccgccgccgccgtgtgggagatgttctag

SEQ ID NO: 24750 - DNA, 2397 bp, Artificial Sequence
  Description of Artificial Sequence: Synthetic coding sequence
atgggcaaggccagccccgccagcggcctgagcagacccaagaccctggtgagccccctgagaagcaaccagtggagcctgcagaagggcctgcccgagcagtactacagcctgacctggttcctgagccccatcctgggcctgatcttcacccccctgatcggcagcgccagcgacagatgcaccctgagctggggcagaagaagacccttcatcctggccctgtgcgtgggcgtgctgttcggcgtggccctgttcctgaacggcagcgccatcggcctggccctgggcgacgtgcccaacagacagcccatcggcatcgtgctgaccgtgctgggcgtggtggtgctggacttcagcgccgacgccaccgagggccccatcagagcctacctgctggacgtggtggacagcgaggagcaggacatggccctgaacatccacgccttcagcgccggcctgggcggcgccatcggctacgtgctgggcggcctggactggacccagaccttcctgggcagctggttcagaacccagaaccaggtgctgttcttcttcgccgccatcatcttcaccgtgagcgtggccctgcacctgttcagcatcgacgaggagcagtacagcccccagcaggagagaagcgccgaggagcccggcgccctggacggcggcgagccccacggcgtgcccgccttccccgacgaggtgcagagcgagcacgagctggccctggactaccccgacgtggacatcatgagaagcaagagcgacagcgccctgcacgtgcccgacaccgccctggacctggagcccgagctgctgttcctgcacgacatcgagcccagcatcttccacgacgccagctaccccgccacccccagaagcaccagccaggagctggccaagaccaagctgcccagactggccaccttcctgaaggaggccgccaaggaggacgagaccctgctggacaaccacctgaacgaggccaaggtgcccaacggcagcggcagccccaccaaggacgccctgggcggctacaccagagtggacaccaagcccagcgccaccagcagcagcatgagaagaagaagacacgccttcagaagacaggccagcagcaccttcagctactacggcaagctgggcagccactgctacagatacagaagagccaacgccgtggtgctgatcaagcccagcagaagcatgagcgacctgtacgacatgcagaagagacagagacagcacagacacagaaaccagagcggcgccaccaccagcagcggcgacaccgagagcgaggagggcgagggcgagaccaccgtgagactgctgtggctgagcatgctgaagatgcccagagagctgatgagactgtgcctgtgccacctgctgacctggttcagcgtgatcgccgaggccgtgttctacaccgacttcatgggccaggtgatcttcgagggcgaccccaaggcccccagcaacagcaccgcctggcaggcctacaacgccggcgtgaagatgggctgctggggcctggtgatctacgccgccaccggcgccatctgcagcgccctgctgcagaagtacctggacaactacgacctgagcgtgagagtgatctacgtgctgggcaccctgggcttcagcgtgggcaccgccgtgatggccatgttccccaacgtgtacgtggccatggtgaccatcagcaccatgggcatcgtgagcatgagcatcagctactgcccctacgccctgctgggccagtaccacgacatcaagcagtacatccaccacagccccggcaacagcaagagaggcttcggcatcgactgcgccatcctgagctgccaggtgtacatcagccagatcctggtggccagcgccctgggcggcgtggtggacgccgtgggcaccgtgagagtgatccccatggtggccagcgtgggcagcttcctgggcttcctgaccgccaccttcctggtgatctaccccaacgtgagcgaggaggccaaggaggagcagaagggcctgagcagccccctggccggcgagggcagagccggcggcaacagcgagaagcccaccgtgctgaagctgaccagaaaggagggcctgcagggccccgtggagaccgagagactgcaggtgctgaccagcgtgagaagcagacacatcggctggtgcagaagctgctggagagtgttcttcttcatgatcatcctggagaagaagttcagcttcccccagtgcggcagcctgagaagaatgacctacctgctgttcctgagcgagctggacaccctgtgccccggccagccctgcccctgggccgccaccgcccaccagagctgggaggaggccggccccggcggcctgggcagaagacagtag

SEQ ID NO: 24751 - DNA, 2253 bp, Artificial Sequence
  Description of Artificial Sequence: Synthetic coding sequence
atgttcggcagagagttctgctacgccatggagaccgccctggtgacccccatcctgctgcagatcggcctgcccgagcagtactacagcctgacctggttcctgagccccatcctgggcctgatcttcacccccctgatcggcagcgccagcgacagatgcaccctgagctggggcagaagaagacccttcatcctggccctgtgcgtgggcgtgctgttcggcgtggccctgttcctgaacggcagcgccatcggcctggccctgggcgacgtgcccaacagacagcccatcggcatcgtgctgaccgtgctgggcgtggtggtgctggacttcagcgccgacgccaccgagggccccatcagagcctacctgctggacgtggtggacagcgaggagcaggacatggccctgaacatccacgccttcagcgccggcctgggcggcgccatcggctacgtgctgggcggcctggactggacccagaccttcctgggcagctggttcagaacccagaaccaggtgctgttcttcttcgccgccatcatcttcaccgtgagcgtggccctgcacctgttcagcatcgacgaggagcagtacagcccccagcaggagagaagcgccgaggagcccggcgccctggacggcggcgagccccacggcgtgcccgccttccccgacgaggtgcagagcgagcacgagctggccctggactaccccgacgtggacatcatgagaagcaagagcgacagcgccctgcacgtgcccgacaccgccctggacctggagcccgagctgctgttcctgcacgacatcgagcccagcatcttccacgacgccagctaccccgccacccccagaagcaccagccaggagctggccaagaccaagctgcccagactggccaccttcctgaaggaggccgccaaggaggacgagaccctgctggacaaccacctgaacgaggccaaggtgcccaacggcagcggcagccccaccaaggacgccctgggcggctacaccagagtggacaccaagcccagcgccaccagcagcagcatgagaagaagaagacacgccttcagaagacaggccagcagcaccttcagctactacggcaagctgggcagccactgctacagatacagaagagccaacgccgtggtgctgatcaagcccagcagaagcatgagcgacctgtacgacatgcagaagagacagagacagcacagacacagaaaccagagcggcgccaccaccagcagcggcgacaccgagagcgaggagggcgagggcgagaccaccgtgagactgctgtggctgagcatgctgaagatgcccagagagctgatgagactgtgcctgtgccacctgctgacctggttcagcgtgatcgccgaggccgtgttctacaccgacttcatgggccaggtgatcttcgagggcgaccccaaggcccccagcaacagcaccgcctggcaggcctacaacgccggcgtgaagatgggctgctggggcctggtgatctacgccgccaccggcgccatctgcagcgccctgctgcagaagtacctggacaactacgacctgagcgtgagagtgatctacgtgctgggcaccctgggcttcagcgtgggcaccgccgtgatggccatgttccccaacgtgtacgtggccatggtgaccatcagcaccatgggcatcgtgagcatgagcatcagctactgcccctacgccctgctgggccagtaccacgacatcaagcagtacatccaccacagccccggcaacagcaagagaggcttcggcatcgactgcgccatcctgagctgccaggtgtacatcagccagatcctggtggccagcgccctgggcggcgtggtggacgccgtgggcaccgtgagagtgatccccatggtggccagcgtgggcagcttcctgggcttcctgaccgccaccttcctggtgatctaccccaacgtgagcgaggaggccaaggaggagcagaagggcctgagcagccccctggccggcgagggcagagccggcggcaacagcgagaagcccaccgtgctgaagctgaccagaaaggagggcctgcagggccccgtggagaccgagagcgtgacccccgccggcatcgacgtgtgccagatcagcagccactggctggtgccccagctgctggagagcatcttcctgtacgactacttcagaaagaagatcttcttcagcaccatgtggttcagctag

SEQ ID NO: 24752 - DNA, 2427 bp, Artificial Sequence
  Description of Artificial Sequence: Synthetic coding sequence
atgaagatggccccccagaacgccgaccccgagagcatgcaggtgcaggagctgagcgtgcccctgcccgacccccagaaggccggcggcgccgaggccgagaactgcgagaccatcagcgagggcagcatcgacagaatccccatgagactgtgggtgatgcacggcgccgtgatgttcggcagagagttctgctacgccatggagaccgccctggtgacccccatcctgctgcagatcggcctgcccgagcagtactacagcctgacctggttcctgagccccatcctgggcctgatcttcacccccctgatcggcagcgccagcgacagatgcaccctgagctggggcagaagaagacccttcatcctggccctgtgcgtgggcgtgctgttcggcgtggccctgttcctgaacggcagcgccatcggcctggccctgggcgacgtgcccaacagacagcccatcggcatcgtgctgaccgtgctgggcgtggtggtgctggacttcagcgccgacgccaccgagggccccatcagagcctacctgctggacgtggtggacagcgaggagcaggacatggccctgaacatccacgccttcagcgccggcctgggcggcgccatcggctacgtgctgggcggcctggactggacccagaccttcctgggcagctggttcagaacccagaaccaggtgctgttcttcttcgccgccatcatcttcaccgtgagcgtggccctgcacctgttcagcatcgacgaggagcagtacagcccccagcaggagagaagcgccgaggagcccggcgccctggacggcggcgagccccacggcgtgcccgccttccccgacgaggtgcagagcgagcacgagctggccctggactaccccgacgtggacatcatgagaagcaagagcgacagcgccctgcacgtgcccgacaccgccctggacctggagcccgagctgctgttcctgcacgacatcgagcccagcatcttccacgacgccagctaccccgccacccccagaagcaccagccaggagctggccaagaccaagctgcccagactggccaccttcctgaaggaggccgccaaggaggacgagaccctgctggacaaccacctgaacgaggccaaggtgcccaacggcagcggcagccccaccaaggacgccctgggcggctacaccagagtggacaccaagcccagcgccaccagcagcagcatgagaagaagaagacacgccttcagaagacaggccagcagcaccttcagctactacggcaagctgggcagccactgctacagatacagaagagccaacgccgtggtgctgatcaagcccagcagaagcatgagcgacctgtacgacatgcagaagagacagagacagcacagacacagaaaccagagcggcgccaccaccagcagcggcgacaccgagagcgaggagggcgagggcgagaccaccgtgagactgctgtggctgagcatgctgaagatgcccagagagctgatgagactgtgcctgtgccacctgctgacctggttcagcgtgatcgccgaggccgtgttctacaccgacttcatgggccaggtgatcttcgagggcgaccccaaggcccccagcaacagcaccgcctggcaggcctacaacgccggcgtgaagatgggctgctggggcctggtgatctacgccgccaccggcgccatctgcagcgccctgctgcagaagtacctggacaactacgacctgagcgtgagagtgatctacgtgctgggcaccctgggcttcagcgtgggcaccgccgtgatggccatgttccccaacgtgtacgtggccatggtgaccatcagcaccatgggcatcgtgagcatgagcatcagctactgcccctacgccctgctgggccagtaccacgacatcaagcagtacatccaccacagccccggcaacagcaagagaggcttcggcatcgactgcgccatcctgagctgccaggtgtacatcagccagatcctggtggccagcgccctgggcggcgtggtggacgccgtgggcaccgtgagagtgatccccatggtggccagcgtgggcagcttcctgggcttcctgaccgccaccttcctggtgatctaccccaacgtgagcgaggaggccaaggaggagcagaagggcctgagcagccccctggccggcgagggcagagccggcggcaacagcgagaagcccaccgtgctgaagctgaccagaaaggagggcctgcagggccccgtggagaccgagagcgtgacccccgccggcatcgacgtgtgccagatcagcagccactggctggtgccccagctgctggagagcatcttcctgtacgactacttcagaaagaagatcttcttcagcaccatgtggttcagctag

SEQ ID NO: 24753 - DNA, 2154 bp, Artificial Sequence
  Description of Artificial Sequence: Synthetic coding sequence
atgggcaaggccagccccgccagcggcctgagcagacccaagaccctggtgagccccctgagaagcaaccagtggagcctgcagaagggcctgcccgagcagtactacagcctgacctggttcctgagccccatcctgggcctgatcttcacccccctgatcggcagcgccagcgacagatgcaccctgagctggggcagaagaagacccttcatcctggccctgtgcgtgggcgtgctgttcggcgtggccctgttcctgaacggcagcgccatcggcctggccctgggcgacgtgcccaacagacagcccatcggcatcgtgctgaccgtgctgggcgtggtggtgctggacttcagcgccgacgccaccgagggccccatcagagcctacctgctggacgtggtggacagcgaggagcaggacatggccctgaacatccacgccttcagcgccggcctgggcggcgccatcggctacgtgctgggcggcctggactggacccagaccttcctgggcagctggttcagaacccagaaccaggtgctgttcttcttcgccgccatcatcttcaccgtgagcgtggccctgcacctgttcagcatcgacgaggagcagtacagcccccagcaggagagaagcgccgaggagcccggcgccctggacggcggcgagccccacggcgtgcccgccttccccgacgaggtgcagagcgagcacgagctggccctggactaccccgacgtggacatcatgagaagcaagagcgacagcgccctgcacgtgcccgacaccgccctggacctggagcccgagctgctgttcctgcacgacatcgagcccagcatcttccacgacgccagctaccccgccacccccagaagcaccagccaggagctggccaagaccaagctgcccagactggccaccttcctgaaggaggccgccaaggaggacgagaccctgctggacaaccacctgaacgaggccaaggtgcccaacggcagcggcagccccaccaaggacgccctgggcggctacaccagagtggacaccaagcccagcgccaccagcagcagcatgagaagaagaagacacgccttcagaagacaggccagcagcaccttcagctactacggcaagctgggcagccactgctacagatacagaagagccaacgccgtggtgctgatcaagcccagcagaagcatgagcgacctgtacgacatgcagaagagacagagacagcacagacacagaaaccagagcggcgccaccaccagcagcggcgacaccgagagcgaggagggcgagggcgagaccaccgtgagactgctgtggctgagcatgctgaagatgcccagagagctgatgagactgtgcctgtgccacctgctgacctggttcagcgtgatcgccgaggccgtgttctacaccgacttcatgggccaggtgatcttcgagggcgaccccaaggcccccagcaacagcaccgcctggcaggcctacaacgccggcgtgaagatgggctgctggggcctggtgatctacgccgccaccggcgccatctgcagcgccctgctgcagaagtacctggacaactacgacctgagcgtgagagtgatctacgtgctgggcaccctgggcttcagcgtgggcaccgccgtgatggccatgttccccaacgtgtacgtggccatggtgaccatcagcaccatgggcatcgtgagcatgagcatcagctactgcccctacgccctgctgggccagtaccacgacatcaagcagtacatccaccacagccccggcaacagcaagagaggcttcggcatcgactgcgccatcctgagctgccaggtgtacatcagccagatcctggtggccagcgccctgggcggcgtggtggacgccgtgggcaccgtgagagtgatccccatggtggccagcgtgggcagcttcctgggcttcctgaccgccaccttcctggtgatctaccccaacgtgagcgaggaggccaaggaggagcagaagggcctgagcagccccctggccggcgagggcagagccggcggcaacagcgagaagcccaccgtgctgaagctgaccagaaaggagggcctgcagggccccgtggagaccgagagcgtggtgtag

SEQ ID NO: 24754 - DNA, 1338 bp, Artificial Sequence
  Description of Artificial Sequence: Synthetic coding sequence
atggccgcccccacccccgccagacccgtgctgacccacctgctggtggccctgttcggcatgggcagctgggccgccgtgaacggcatctgggtggagctgcccgtggtggtgaaggagctgcccgagggctggagcctgcccagctacgtgagcgtgctggtggccctgggcaacctgggcctgctggtggtgaccctgtggagaagactggcccccggcaaggacgagcaggtgcccatcagagtggtgcaggtgctgggcatggtgggcaccgccctgctggccagcctgtggcaccacgtggcccccgtggccggccagctgcacagcgtggccttcctggccctggccttcgtgctggccctggcctgctgcgccagcaacgtgaccttcctgcccttcctgagccacctgccccccagattcctgagaagcttcttcctgggccagggcctgagcgccctgctgccctgcgtgctggccctggtgcagggcgtgggcagactggagtgcccccccgcccccatcaacggcacccccggcccccccctggacttcctggagagattccccgccagcaccttcttctgggccctgaccgccctgctggtggccagcgccgccgccttccagggcctgctgctgctgctgccccccccccccagcgtgcccaccggcgagctgggcagcggcctgcaggtgggcgcccccggcgccgaggaggaggtggaggagagcagccccctgcaggagccccccagccaggccgccggcaccacccccggccccgaccccaaggcctaccagctgctgagcgccagaagcgcctgcctgctgggcctgctggccgccaccaacgccctgaccaacggcgtgctgcccgccgtgcagagcttcagctgcctgccctacggcagactggcctaccacctggccgtggtgctgggcagcgccgccaaccccctggcctgcttcctggccatgggcgtgctgtgcagaagcctggccggcctgggcggcctgagcctgctgggcgtgttctgcggcggctacctgatggccctggccgtgctgagcccctgcccccccctggtgggcaccagcgccggcgtggtgctggtggtgctgagctgggtgctgtgcctgggcgtgttcagctacgtgaaggtggccgccagcagcctgctgcacggcggcggcagacccgccctgctggccgccggcgtggccatccaggtgggcagcctgctgggcgccgtggccatgttcccccccaccagcatctaccacgtgttccacagcagaaaggactgcgccgacccctgcgacagctag

SEQ ID NO: 24755 - DNA, 1338 bp, Artificial Sequence; identical to SEQ ID NO: 24754
  Description of Artificial Sequence: Synthetic coding sequence

SEQ ID NO: 24756 - DNA, 1338 bp, Artificial Sequence; identical to SEQ ID NO: 24754
  Description of Artificial Sequence: Synthetic coding sequence

SEQ ID NO: 24757 - DNA, 1923 bp, Artificial Sequence
  Description of Artificial Sequence: Synthetic coding sequence
atgaagatcagcaccacccagatcgagagaagattcgagatcagcagcagcctggtgggcctgatcgacggcagcttcgagatcggcaacctgttcgtgatcgtgttcgtgagctacttcggcagcaagctgcacagacccaagctgatcggcatcggctgcttcctgatgggcaccggcagcatcctgatggccctgccccacttcttcatgggctactacagatacagcaaggagaccaacatcgaccccagcgagaacagcaccagcaacctgcccaactgcctgatcaaccagatgctgagcctgaacagaacccccagcgagatcatcgagagaggctgcgtgaaggagagcggcagccacatgtggatctacgtgttcatgggcaacatgctgagaggcatcggcgagacccccatcgtgcccctgggcatcagctacatcgacgacttcgccaaggagggccacagcagcctgtacctgggcaccgtgaacgtgatgggcatgaccggcctggtgttcgccttcatgctgggcagcctgttcgccaagatgtacgtggacatcggctacgtggacctgagcaccatcagaatcacccccaaggacagcagatgggtgggcgcctggtggctgggcttcctggtgagcggcatcgtgagcatcatcagcagcatccccttcttcttcctgcccctgaaccccaacaagccccagaaggagagaaaggtgagcctgttcctgcacgtgctgaagaccaacgacaagagaaaccagatcgccaacctgaccaacagaagaaagtacatcaccaagaacgtgaccggcttcttccagagcctgaagagcatcctgaccaaccccctgtacgtgatcttcgtgatcttcaccctgctgcacatgagcagctacatcgccagcctgacctacatcatcaagatggtggagcagcagtacggctggagcgccagcaagaccaacttcctgctgggcgtgctggccctgcccgccgtggccatcggcatgttcagcggcggctacatcatcaagaagttcaagctgagcctggtgggcctggccaagctggccttctgcagcgccaccgtgcacctgctgagccaggtgctgtacttcttcctgatctgcgagagcaagagcgtggccggcctgaccctgacctacgacggcaacagccccgtgagaagccacgtggacgtgcccctgagctactgcaacagcgagtgcaactgcgacgagagccagtgggagcccgtgtgcggcaacaacggcatcacctacctgagcccctgcctggccggctgcaagagcagcagcggcaacaaggagcccatcgtgttctacaactgcagctgcgtggaggtgatcggcctgcagaacaagaactacagcgcccacctgggcgagtgccccagagacgacgcctgcaccagaaagagctacgtgtacttcgtgatccaggtgctggacgccttcctgtgcgccgtgggcctgaccagctacagcgtgctggtgatcagaatcgtgcagcccgagctgaaggccctggccatcggcttccacagcatgatcatgagaagcctgggcggcatcctggtgcccatctacttcggcgccctgatcgacaccacctgcatgaagtggagcaccaacagctgcggcgccagaggcgcctgcagaatctacaacagcacctacctgggcagagccttcttcggcctgaaggtggccctgatcttccccgtgctggtgctgctgaccgtgttcatcttcgtggtgagaaagaagagccacggcaaggacaccaaggtgctggagaacgagagacaggtgatggacgaggccaacctggagttcctgaacgacagcgagcacttcgtgcccagcgccgaggagcagtag

SEQ ID NO: 24758 - DNA, 2064 bp, Artificial Sequence
  Description of Artificial Sequence: Synthetic coding sequence
atggaccagcaccagcacctgaacaagaccgccgagagcgccagcagcgagaagaagaagaccagaagatgcaacggcttcaagatgttcctggccgccctgagcttcagctacatcgccaaggccctgggcggcatcatcatgaagatcagcatcacccagatcgagagaagattcgacatcagcagcagcctggccggcctgatcgacggcagcttcgagatcggcaacctgctggtgatcgtgttcgtgagctacttcggcagcaagctgcacagacccaagctgatcggcatcggctgcctgctgatgggcaccggcagcatcctgaccagcctgccccacttcttcatgggctactacagatacagcaaggagaccaacatcgaccccagcgagaacagcaccagcaacctgcccaactgcctgatcaaccagatgctgagcctgaacagaacccccagcgagatcatcgagagaggctgcgtgaaggagagcggcagccacatgtggatctacgtgttcatgggcaacatgctgagaggcatcggcgagacccccatcgtgcccctgggcatcagctacatcgacgacttcgccaaggagggccacagcagcctgtacctgggcaccgtgaacgtgatgggcatgaccggcctggtgttcgccttcatgctgggcagcctgttcgccaagatgtacgtggacatcggctacgtggacctgagcaccatcagaatcacccccaaggacagcagatgggtgggcgcctggtggctgggcttcctggtgagcggcatcgtgagcatcatcagcagcatccccttcttcttcctgcccctgaaccccaacaagccccagaaggagagaaaggtgagcctgttcctgcacgtgctgaagaccaacgacaagagaaaccagatcgccaacctgaccaacagaagaaagtacatcaccaagaacgtgaccggcttcttccagagcctgaagagcatcctgaccaaccccctgtacgtgatcttcgtgatcttcaccctgctgcacatgagcagctacatcgccagcctgacctacatcatcaagatggtggagcagcagtacggctggagcgccagcaagaccaacttcctgctgggcgtgctggccctgcccgccgtggccatcggcatgttcagcggcggctacatcatcaagaagttcaagctgagcctggtgggcctggccaagctggccttctgcagcgccaccgtgcacctgctgagccaggtgctgtacttcttcctgatctgcgagagcaagagcgtggccggcctgaccctgacctacgacggcaacagccccgtgagaagccacgtggacgtgcccctgagctactgcaacagcgagtgcaactgcgacgagagccagtgggagcccgtgtgcggcaacaacggcatcacctacctgagcccctgcctggccggctgcaagagcagcagcggcaacaaggagcccatcgtgttctacaactgcagctgcgtggaggtgatcggcctgcagaacaagaactacagcgcccacctgggcgagtgccccagagacgacgcctgcaccagaaagagctacgtgtacttcgtgatccaggtgctggacgccttcctgtgcgccgtgggcctgaccagctacagcgtgctggtgatcagaatcgtgcagcccgagctgaaggccctggccatcggcttccacagcatgatcatgagaagcctgggcggcatcctggtgcccatctacttcggcgccctgatcgacaccacctgcatgaagtggagcaccaacagctgcggcgccagaggcgcctgcagaatctacaacagcacctacctgggcagagccttcttcggcctgaaggtggccctgatcttccccgtgctggtgctgctgaccgtgttcatcttcgtggtgagaaagaagagccacggcaaggacaccaaggtgctggagaacgagagacaggtgatggacgaggccaacctggagttcctgaacgacagcgagcacttcgtgcccagcgccgaggagcagtag

SEQ ID NO: 24759 - DNA, 813 bp, Artificial Sequence
  Description of Artificial Sequence: Synthetic coding sequence
atgggcttctggtgcagaatgagcgagaaccaggagcaggaggaggtgatcaccgtgagagtgcaggaccccagagtgcagaacgagggcagctggaacagctacgtggactacaagatcttcctgcacaccaacagcaaggccttcaccgccaagaccagctgcgtgagaagaagatacagagagttcgtgtggctgagaaagcagctgcagagaaacgccggcctggtgcccgtgcccgagctgcccggcaagagcaccttcttcggcaccagcgacgagttcatcgagaagagaagacagggcctgcagcacttcctggagaaggtgctgcagagcgtggtgctgctgagcgacagccagctgcacctgttcctgcagagccagctgagcgtgcccgagatcgaggcctgcgtgcagggcagaagcaccatgaccgtgagcgacgccatcctgagatacgccatgagcaactgcggctgggcccaggaggagagacagagcagcagccacctggccaagggcgaccagcccaagagctgctgcttcctgcccagaagcggcagaagaagcagccccagccccccccccagcgaggagaaggaccacctggaggtgtgggcccccgtggtggacagcgaggtgcccagcctggagagccccaccctgccccccctgagcagccccctgtgctgcgacttcggcagacccaaggagggcaccagcaccctgcagagcgtgagaagagccgtgggcggcgaccacgccgtgcccctggaccccggccagctggagaccgtgctggagaagtag

SEQ ID NO: 24760 - DNA, 813 bp, Artificial Sequence; identical to SEQ ID NO: 24759
  Description of Artificial Sequence: Synthetic coding sequence

SEQ ID NO: 24761 - DNA, 630 bp, Artificial Sequence
  Description of Artificial Sequence: Synthetic coding sequence
atgagagcccccggcaccctgatgtggatcatcagatacagcagcatgcccgtgcccgagctgcccggcaagagcaccttcttcggcaccagcgacgagttcatcgagaagagaagacagggcctgcagcacttcctggagaaggtgctgcagagcgtggtgctgctgagcgacagccagctgcacctgttcctgcagagccagctgagcgtgcccgagatcgaggcctgcgtgcagggcagaagcaccatgaccgtgagcgacgccatcctgagatacgccatgagcaactgcggctgggcccaggaggagagacagagcagcagccacctggccaagggcgaccagcccaagagctgctgcttcctgcccagaagcggcagaagaagcagccccagccccccccccagcgaggagaaggaccacctggaggtgtgggcccccgtggtggacagcgaggtgcccagcctggagagccccaccctgccccccctgagcagccccctgtgctgcgacttcggcagacccaaggagggcaccagcaccctgcagagcgtgagaagagccgtgggcggcgaccacgccgtgcccctggaccccggccagctggagaccgtgctggagaagtag

SEQ ID NO: 24762 - DNA, 381 bp, Artificial Sequence
  Description of Artificial Sequence: Synthetic coding sequence
atgaccgtgagcgacgccatcctgagatacgccatgagcaactgcggctgggcccaggaggagagacagagcagcagccacctggccaagggcgaccagcccaagagctgctgcttcctgcccagaagcggcagaagaagcagccccagccccccccccagcgaggagaaggaccacctggaggtgtgggcccccgtggtggacagcgaggtgcccagcctggagagccccaccctgccccccctgagcagccccctgtgctgcgacttcggcagacccaaggagggcaccagcaccctgcagagcgtgagaagagccgtgggcggcgaccacgccgtgcccctggaccccggccagctggagaccgtgctggagaagtag

SEQ ID NO: 24763 - DNA, 477 bp, Artificial Sequence
  Description of Artificial Sequence: Synthetic coding sequence
atgagcgacaccgccgtggccgacaccagaagactgaacagcaagccccaggacctgaccgacgcctacggcccccccagcaacttcctggagatcgacatcttcaacccccagaccgtgggcgtgggcagagccagattcaccacctacgagaccaacctgcccatcttcaagctgaaggagagctgcgtgagaagaagatacagcgacttcgagtggctgaagaacgagctggagagagacagcaagatcgtggtgccccccctgcccggcaaggccctgaagagacagctgcccttcagaggcgacgagggcatcttcgaggagagcttcatcgaggagagaagacagggcctggagcagttcatcaacaagatcgccggccaccccctggcccagaacgagagatgcctgcacatgttcctgcaggaggaggccatcgacagaaactacgtgcccggcaaggtgagacagtag

SEQ ID NO: 24764 - DNA, 489 bp, Artificial Sequence
  Description of Artificial Sequence: Synthetic coding sequence
atgagcgacaccgccgtggccgacaccagaagactgaacagcaagccccaggacctgaccgacgcctacggcccccccagcaacttcctggagatcgacatcttcaacccccagaccgtgggcgtgggcagagccagattcaccacctacgaggtgagaatgagaaccaacctgcccatcttcaagctgaaggagagctgcgtgagaagaagatacagcgacttcgagtggctgaagaacgagctggagagagacagcaagatcgtggtgccccccctgcccggcaaggccctgaagagacagctgcccttcagaggcgacgagggcatcttcgaggagagcttcatcgaggagagaagacagggcctggagcagttcatcaacaagatcgccggccaccccctggcccagaacgagagatgcctgcacatgttcctgcaggaggaggccatcgacagaaactacgtgcccggcaaggtgagacagtag

SEQ ID NO: 24765 - DNA, 3327 bp, Artificial Sequence
  Description of Artificial Sequence: Synthetic coding sequence
atgagcagcgtgaagagacccagaggcagaccccccagcagcaagaagagcgacggcagcggcacctacaccaagctgcagaacacccaggtgagagtgatgagcgagaagaagcagagaaagaaggtggagagcgagagcaagcaggagaaggccaacagaatcatcagcgaggccatcgccaaggccaaggagagaggcgagagaaacatccccagagtgatgagccccgagaacttccccaccgccagcgtggagggcaaggaggagaagaagggcagaagaatgaagagcaagcccaaggacaaggacagcaagaagaccaagacctgcagcaagctgaaggagaagaccaagatcggcaagctgatcatcaccctgggcaagaagcagaagagaaagaacgagagcagcgacgagatcagcgacgccgagcagatgccccagcacaccctgaaggaccaggacagccagaagagaagaagcaacagacagatcaagagaaagaagtacgccgaggacatcgagggcaagcagagcgaggaggaggtgaagggcagcatgaagatcaagaagaacagcgcccccctgcccggcgagcagcccctgcagctgttcgtggagaaccccagcgaggaggacgccgccatcgtggacaagatcctgagcagcagaaccgtgaagaaggagatcagccccggcgtgatgatcgacaccgaggagttcttcgtgaagtacaagaactacagctacctgcactgcgagtgggccaccgaggagcagctgctgaaggacaagagaatccagcagaagatcaagagattcaagctgagacaggcccagagagcccacttcttcgccgacatggaggaggagcccttcaaccccgactacgtggaggtggacagagtgctggaggtgagcttctgcgaggacaaggacaccggcgagcccgtgatctactacctggtgaagtggtgcagcctgccctacgaggacagcacctgggagctgaaggaggacgtggacctggccaagatcgaggagttcgagcagctgcaggccagcagacccgacaccagaagactggacagaccccccagcaacatctggaagaagatcgaccagagcagagactacaagaacggcaaccagctgagagagtaccagctggagggcctgaactggctgctgttcaactggtacaacagaagaaactgcatcctggccgacgagatgggcctgggcaagaccatccagagcatcaccttcctgtacgagatcctgctgaccggcatcagaggccccttcctgatcatcgcccccctgagcaccatcgccaactgggagagagagttcagaacctggaccgacatcaacgtggtggtgtaccacggcagcctgatcagcagacagatgatccagcagtacgagatgtacttcagagacagccagggcagaatcatcagaggcgcctacagattccaggccatcatcaccaccttcgagatgatcctgggcggctgcggcgagctgaacgccatcgagtggagatgcgtgatcatcgacgaggcccacagactgaagaacaagaactgcaagctgctggagggcctgaagctgatgaacctggagcacaaggtgctgctgaccggcacccccctgcagaacaccgtggaggagctgttcagcctgctgcacttcctggagcccctgagattccccagcgagagcaccttcatgcaggagttcggcgacctgaagaccgaggagcaggtgcagaagctgcaggccatcctgaagcccatgatgctgagaagactgaaggaggacgtggagaagaagctggcccccaaggaggagaccatcatcgaggtggagctgaccaacatccagaagaagtactacagagccatcctggagaagaacttcagcttcctgagcaagggcgccggccagaccaacgtgcccaacctggtgaacaccatgatggagctgagaaagtgctgcaaccacccctacctgatcaagggcgccgaggagaagatcctgggcgagttcagagacacctacaaccccgccgccagcgacttccacctgcaggccatgatccagagcgccggcaagctggtgctgatcgacaagctgctgcccaagatgaaggccggcggccacaaggtgctgatcttcagccagatggtgagatgcctggacatcctggaggactacctgatccacaagagatacctgtacgagagaatcgacggcagagtgagaggcaacctgagacaggccgccatcgacagattcagcaagcccgacagcgacagattcgtgttcctgctgtgcaccagagccggcggcctgggcatcaacctgaccgccgccgacacctgcatcatcttcgacagcgactggaacccccagaacgacctgcaggcccaggccagatgccacagaatcggccagaacaaggccgtgaaggtgtacagactggtgaccagaaacagctacgagagagagatgttcgacagagccagcctgaagctgggcctggacaaggccgtgctgcagagcatgagcggcagagagagcaacgtgggcggcatccagcagctgagcaagaaggagatcgaggacctgctgagaagaggcgcctacggcgccatcatggaggaggaggacgagggcagcaagttctgcgaggaggacatcgaccagatcctgctgagaagaaccaagaccatcaccatcgagagcgagggcagaggcagcaccttcgccaaggccagcttcgtggccagcggcaacagaaccgacatcagcctggacgaccccaacttctggcagaagtgggccaagaaggccgagatcgacatcgaggccatcagcggcagaaacagcctggtgatcgacacccccagaatcagaaagcagaccagacccttcagcgccaccaaggacgagctggccgagctgagcgaggccgagagcgagggcgacgagaagcccaagctgagaagaccctgcgacagaagcaacggctacggcagaaccgagtgcttcagagtggagaagaacctgctggtgtacggctggggcagatggagagagatcctgagccacggcagattcaagagacagctgaacgagcacgacgtggagatcatctgcagagccctgctggcctactgcctggtgcactacagaggcgacgagaagatcaagggcttcatctgggacctgatcacccccaccgaggacggccagaccagagagctgcagaaccacctgggcctgagcgcccccgtgcccagaggcagatag

SEQ ID NO: 24766 - DNA, 1128 bp, Artificial Sequence
  Description of Artificial Sequence: Synthetic coding sequence
atgagcggcagccagaacaacgacaagagacagttcctgctggagagactgctggacgccgtgaagcagtgccagatcagattcggcggcagaaaggagatcgccagcgacagcgacagcagagtgacctgcctgtgcgcccagttcgaggccgtgctgcagcacggcctgaagagaagcagaggcctggccctgaccgccgccgccatcaagcaggccgccggcttcgccagcaagaccgagaccgagcccgtgttctggtactacgtgaaggaggtgctgaacaagcacgagctgcagagattctacagcctgagacacatcgccagcgacgtgggcagaggcagagcctggctgagatgcgccctgaacgagcacagcctggagagatacctgcacatgctgctggccgacagatgcagactgagcaccttctacgaggactggagcttcgtgatggacgaggagagaagcagcatgctgcccaccatggccgccggcctgaacagcatcctgttcgccatcaacatcgacaacaaggacctgaacggccagagcaagttcgcccccaccgtgagcgacctgctgaaggagagcacccagaacgtgaccagcctgctgaaggagagcacccagggcgtgagcagcctgttcagagagatcaccgccagcagcgccgtgagcatcctgatcaagcccgagcaggagaccgaccccctgcccgtggtgagcagaaacgtgagcgccgacgccaagtgcaagaaggagagaaagaagaagaagaaggtgaccaacatcatcagcttcgacgacgaggaggacgagcagaacagcggcgacgtgttcaagaagacccccggcgccggcgagagcagcgaggacaacagcgacagaagcagcgtgaacatcatgagcgccttcgagagccccttcggccccaacagcaacggcagccagagcagcaacagctggaagatcgacagcctgagcctgaacggcgagttcggctaccagaagctggacgtgaagagcatcgacgacgaggacgtggacgagaacgaggacgacgtgtacggcaacagcagcggcagaaagcacagaggccacagcgagagccccgagaagtag

SEQ ID NO: 24767 - DNA, 1287 bp, Artificial Sequence
  Description of Artificial Sequence: Synthetic coding sequence
atgcacagctgggcccccctgaaggtgctgcacaacgacagcgacatcctgttccccgtgagcggcgtgggcagctacagccccgccgacgcccccctgggcagcctggagaacggcaccggccccgaggaccacgtgctgcccgaccccggcctgagatacagcgtggaggccagcagccccggccacggcagccccctgagcagcctgctgcccagcgccagcgtgcccgagagcatgaccatcagcgagctgagacaggccaccgtggccatgatgaacagaaaggacgagctggaggaggagaacagaagcctgagaaacctgctggacggcgagatggagcacagcgccgccctgagacaggaggtggacaccctgaagagaaaggtggccgagcaggaggagagacagggcatgaaggtgcaggccctggccagagagaacgaggtgctgaaggtgcagctgaagaagtacgtgggcgccgtgcagatgctgaagagagagggccagaccgccgaggtgcccaacctgtggagcgtggacggcgaggtgaccgtggccgagcagaagcccggcgagatcgccgaggagctggccagcagctacgagagaaagctgatcgaggtggccgagatgcacggcgagctgatcgagttcaacgagagactgcacagagccctggtggccaaggaggccctggtgagccagatgagacaggagctgatcgacctgagaggccccgtgcccggcgacctgagccagaccagcgaggaccagagcctgagcgacttcgagatcagcaacagagccctgatcaacgtgtggatccccagcgtgttcctgagaggcaaggccgccaacgccttccacgtgtaccaggtgtacatcagaatcaaggacgacgagtggaacatctacagaagatacaccgagttcagaagcctgcaccacaagctgcagaacaagtacccccaggtgagagcctacaacttcccccccaagaaggccatcggcaacaaggacgccaagttcgtggaggagagaagaaagcagctgcagaactacctgagaagcgtgatgaacaaggtgatccagatggtgcccgagttcgccgccagccccaagaaggagaccctgatccagctgatgcccttcttcgtggacatcaccccccccggcgagcccgtgaacagcagacccaaggccgccagcagattccccaagctgagcagaggccagcccagagagaccagaaacgtggagccccagagcggcgacctgtag

SEQ ID NO: 24768 - DNA, 1227 bp, Artificial Sequence
  Description of Artificial Sequence: Synthetic coding sequence
atgcacagctgggcccccctgaaggtgctgcacaacgacagcgacatcctgttccccgtgagcggcgtgggcagctacagccccgccgacgcccccctgggcagcctggagaacggcaccggccccgaggaccacgtgctgcccgaccccggcctgagatacagcgtggaggccagcagccccggccacggcagccccctgagcagcctgctgcccagcgccagcgtgcccgagagcatgaccatcagcgagctgagacaggccaccgtggccatgatgaacagaaaggacgagctggaggaggagaacagaagcctgagaaacctgctggacggcgagatggagcacagcgccgccctgagacaggaggtggacaccctgaagagaaaggtggccgagcaggaggagagacagggcatgaaggtgcaggccctggccagagagaacgaggtgctgaaggtgcagctgaagaagtacgtgggcgccgtgcagatgctgaagagagagggccagaccgccgaggtgcccaacctgtggagcgtggacggcgaggtgaccgtggccgagcagaagcccggcgagatcgccgaggagctggccagcagctacgagagaaagctgatcgaggtggccgagatgcacggcgagctgatcgagttcaacgagagactgcacagagccctggtggccaaggaggccctggtgagccagatgagacaggagctgatcgacctgagaggccccgtgcccggcgacctgagccagaccagcgaggaccagagcctgagcgacttcgagatcagcaacagagccctgatcaacgtgtggatccccagcgtgttcctgagaggcaaggccgccaacgccttccacgtgtaccaggtgtacatcagaatcaaggacgacgagtggaacatctacagaagatacaccgagttcagaagcctgcaccacaagctgcagaacaagtacccccaggtgagagcctacaacttcccccccaagaaggccatcggcaacaaggacgccaagttcgtggaggagagaagaaagcagctgcagaactacctgagaagcgtgatgaacaaggtgatccagatggtgcccgagttcgccgccagccccaagaaggagaccctgatccagctgatgcccttcttcgtggactggatcagcctgttcggcaacggcagagacagcagcagagaggagttcagcagcagctag

SEQ ID NO: 24769 - DNA, 750 bp, Artificial Sequence
  Description of Artificial Sequence: Synthetic coding sequence
atggacgaggagagaagcagcatgctgcccaccatggccgccggccccaacagcatcctgttcgccatcaacatcgacaacaaggacctgaacggccagagcaagttcgcccccaccgtgagcgacctgctgaaggagagcacccagaacgtgaccctgctgaaggagagcacccagggcgtgagcagcgtgttcagagagatcaccgccagcagcgccatcagcatcctgatcaagcccgagcaggagaccgaccccctgcccgtggtgagcagaaacgtgagcgccgacgccaagtgcaagaaggagagaaagaagaagaagcaggtgaccaacatcatcagcttcgacgacgaggaggacgagcagaacagcggcgacatgttcaagaagacccccggcgccggcgagagcagcgaggacaacagcgaccacagcagcgtgaacatcatgagcgccttcgagagccccttcggccccaacagcaacggcagccagagcagcaacagctggaagatcgacagcctgagcctgaacagagagttcggctaccagaagctggacgtgaagagcatcgacgacgaggacgtggacgagaacgaggacgacgtgtacggcaacagcagcggcagaaagcacagaggccacagcgagagccccgagaagaacggcgcccacagcgtgacccaggccggcgtgcagtggcacgacctgagcagcctgcagcccctgccccccggcttcaagtag

SEQ ID NO: 24770 - DNA, 750 bp, Artificial Sequence; identical to SEQ ID NO: 24769
  Description of Artificial Sequence: Synthetic coding sequence

SEQ ID NO: 24771 - DNA, 807 bp, Artificial Sequence
  Description of Artificial Sequence: Synthetic coding sequence
atgctgctggccgacagatgcagactgagcaccttctacgaggactggagcttcgtgatggacgaggagagaagcagcatgctgcccaccatggccgccggccccaacagcatcctgttcgccatcaacatcgacaacaaggacctgaacggccagagcaagttcgcccccaccgtgagcgacctgctgaaggagagcacccagaacgtgaccctgctgaaggagagcacccagggcgtgagcagcgtgttcagagagatcaccgccagcagcgccatcagcatcctgatcaagcccgagcaggagaccgaccccctgcccgtggtgagcagaaacgtgagcgccgacgccaagtgcaagaaggagagaaagaagaagaagcaggtgaccaacatcatcagcttcgacgacgaggaggacgagcagaacagcggcgacatgttcaagaagacccccggcgccggcgagagcagcgaggacaacagcgaccacagcagcgtgaacatcatgagcgccttcgagagccccttcggccccaacagcaacggcagccagagcagcaacagctggaagatcgacagcctgagcctgaacagagagttcggctaccagaagctggacgtgaagagcatcgacgacgaggacgtggacgagaacgaggacgacgtgtacggcaacagcagcggcagaaagcacagaggccacagcgagagccccgagaagaacggcgcccacagcgtgacccaggccggcgtgcagtggcacgacctgagcagcctgcagcccctgccccccggcttcaagtag

SEQ ID NO: 24772 - DNA, 351 bp, Artificial Sequence
  Description of Artificial Sequence: Synthetic coding sequence
atgctgctggccgacagatgcagactgagcaccttctacgaggactggagcttcgtgatggacgaggagagaagcagcatgctgcccaccatggccgccggccccaacagcatcctgttcgccatcaacatcgacaacaaggacctgaacggccagagcaagttcgcccccaccgtgagcgacctgctgaaggagagcacccagaacgtgaccctgctgaaggagagcacccagggcgtgagcagcgtgttcagagagatcaccgccagcagcgccatcagcatcctgatcaagcccgagcaggagaccgaccccctgcccgtggtgagcagaaacgtgagcgccggctag

SEQ ID NO: 24773 - DNA, 1323 bp, Artificial Sequence
  Description of Artificial Sequence: Synthetic coding sequence
atgaagatgcacttctgcatccccgtgagccagcagagaagcgacgccctgggcggcagatacgtgctgtacagcgtgcacctggacggcttcctgttctgcagagtgagatacagccagctgcacggctggaacgagcagctgagaagagtgttcggcaactgcctgccccccttcccccccaagtactacctggccatgaccaccgccatggccgacgagagaagagaccagctggagcagtacctgcagaacgtgaccatggaccccaacgtgctgagaagcgacgtgttcgtggagttcctgaagctggcccagctgaacaccttcgacatcgccaccaagaaggcctacctggacatcttcctgcccaacgagcagagcatcagaatcgagatcatcaccagcgacaccgccgagagagtgctggaggtggtgagccacaagatcggcctgtgcagagagctgctgggctacttcggcctgttcctgatcagattcggcaaggagggcaagctgagcgtggtgaagaagctggccgacttcgagctgccctacgtgagcctgggcagcagcgaggtggagaactgcaaggtgggcctgagaaagtggtacatggcccccagcctggacagcgtgctgatggactgcagagtggccgtggacctgctgtacatgcaggccatccaggacatcgagaagggctgggccaagcccacccaggcccagagacagaagctggaggccttccagaaggaggacagccagaccaagttcctggagctggccagagaggtgagacactacggctacctgcagctggacccctgcacctgcgactaccccgagagcggcagcggcgccgtgctgagcgtgggcaacaacgagatcagctgctgcatcaccctgcccgacagccagacccaggacatcgtgttccagatgagcagagtgaagtgctggcaggtgaccttcctgggcaccctgctggacaccgacggcccccagagaaccctgaaccagaacctggagctgagattccagtacagcgaggacagctgctggcagtggttcgtgatctacaccaagcaggccttcctgctgagcagctgcctgaagaagatgatcagcgagaagatggtgaagctggccgccgagaacaccgagatgcagatcgaggtgcccgagcagagcaagagcaagaagtaccacatccagcagagccagcagaaggactacagcagcttcctgagcagaaagagcaagatcaagatcgccaaggacgactgcgtgttcggcaacatcaaggaggaggacctgtag

SEQ ID NO: 24774 - DNA, 1026 bp, Artificial Sequence
  Description of Artificial Sequence: Synthetic coding sequence
atgctgggcaacaccgagaactggaacaccttcgacatcgccaccaagaaggcctacctggacatcttcctgcccaacgagcagagcatcagaatcgagatcatcaccagcgacaccgccgagagagtgctggaggtggtgagccacaagatcggcctgtgcagagagctgctgggctacttcggcctgttcctgatcagattcggcaaggagggcaagctgagcgtggtgaagaagctggccgacttcgagctgccctacgtgagcctgggcagcagcgaggtggagaactgcaaggtgggcctgagaaagtggtacatggcccccagcctggacagcgtgctgatggactgcagagtggccgtggacctgctgtacatgcaggccatccaggacatcgagaagggctgggccaagcccacccaggcccagagacagaagctggaggccttccagaaggaggacagccagaccaagttcctggagctggccagagaggtgagacactacggctacctgcagctggacccctgcacctgcgactaccccgagagcggcagcggcgccgtgctgagcgtgggcaacaacgagatcagctgctgcatcaccctgcccgacagccagacccaggacatcgtgttccagatgagcagagtgaagtgctggcaggtgaccttcctgggcaccctgctggacaccgacggcccccagagaaccctgaaccagaacctggagctgagattccagtacagcgaggacagctgctggcagtggttcgtgatctacaccaagcaggccttcctgctgagcagctgcctgaagaagatgatcagcgagaagatggtgaagctggccgccgagaacaccgagatgcagatcgaggtgcccgagcagagcaagagcaagaagtaccacatccagcagagccagcagaaggactacagcagcttcctgagcagaaagagcaagatcaagatcgccaaggacgactgcgtgttcggcaacatcaaggaggaggacctgtag

SEQ ID NO: 24775 - DNA, 1212 bp, Artificial Sequence
  Description of Artificial Sequence: Synthetic coding sequence
atggagacctacgccgaggtgggcaaggagggcaagcccagctgcgccagcgtggacctgcagggcgacagcagcctgcaggtggagatcagcgacgccgtgagcgagagagacaaggtgaagttcaccgtgcagaccaagagctgcctgccccacttcgcccagaccgagttcagcgtggtgagacagcacgaggagttcatctggctgcacgacgcctacgtggagaacgaggagtacgccggcctgatcatcccccccgccccccccagacccgacttcgaggccagcagagagaagctgcagaagctgggcgagggcgacagcagcgtgaccagagaggagttcgccaagatgaagcaggagctggaggccgagtacctggccatcttcaagaagaccgtggccatgcacgaggtgttcctgcagagactggccgcccaccccaccctgagaagagaccacaacttcttcgtgttcctggagtacggccaggacctgagcgtgagaggcaagaacagaaaggagctgctgggcggcttcctgagaaacatcgtgaagagcgccgacgaggccctgatcaccggcatgagcggcctgaaggaggtggacgacttcttcgagcacgagagaaccttcctgctggagtaccacaccagaatcagagacgcctgcctgagagccgacagagtgatgagagcccacaagtgcctggccgacgactacatccccatcagcgccgccctgagcagcctgggcacccaggaggtgaaccagctgagaaccagcttcctgaagctggccgagctgttcgagagactgagaaagctggagggcagagtggccagcgacgaggacctgaagctgagcgacatgctgagatactacatgagagacagccaggccgccaaggacctgctgtacagaagactgagagccctggccgactacgagaacgccaacaaggccctggacaaggccagaaccagaaacagagaggtgagacccgccgagagccaccagcagctgtgctgccagagattcgagagactgagcgacagcgccaagcaggagctgatggacttcaagagcagaagagtgagcagcttcagaaagaacctgatcgagctggccgagctggagctgaagcacgccaaggccagcaccctgatcctgagaaacaccctggtggccctgaagggcgagccctag

SEQ ID NO: 24776 - DNA, 384 bp, Artificial Sequence
  Description of Artificial Sequence: Synthetic coding sequence
atggagacctacgccgaggtgggcaaggagggcaagcccagctgcgccagcgtggacctgcagggcgacagcagcctgcaggtggagatcagcgacgccgtgagcgagagagacaaggtgaagttcaccgtgcagaccaagagctgcctgccccacttcgcccagaccgagttcagcgtggtgagacagcacgaggagttcatctggctgcacgacgcctacgtggagggcaaggccaccgagatcggcagaggcggccagctgtgccacagcggcagagtgtgccaggacgaggccggcgccggcagcgtgagcgcccccagcttcccctgccacccccagagccccgacgtgttccccagctacctgcccatgaacgtgtag

SEQ ID NO: 24777 - DNA, 1725 bp, Artificial Sequence
  Description of Artificial Sequence: Synthetic coding sequence
atggccctgaagggcagagccctgtacgacttccacagcgagaacaaggaggagatcagcatccagcaggacgaggacctggtgatcttcagcgagaccagcctggacggctggctgcagggccagaacagcagaggcgagaccggcctgttccccgccagctacgtggagatcgtgagaagcggcatcagcaccaaccacgccgactacagcagcagccccgccggcagccccggcgcccaggtgagcctgtacaacagccccagcgtggccagccccgccagaagcggcggcggcagcggcttcctgagcaaccagggcagcttcgaggaggacgacgacgacgactgggacgactgggacgacggctgcaccgtggtggaggagcccagagccggcggcctgggcaccaacggccacccccccctgaacctgagctaccccggcgcctaccccagccagcacatggccttcagacccaagccccccctggagagacaggacagcctggccagcgccaagagaggcagcgtggtgggcagaaacctgaacagattcagctgcttcgtgagaagcggcgtggaggccttcatcctgggcgacgtgcccatgatggccaagatcgccgagacctacagcatcgagatgggccccagaggcccccagtggaaggccaacccccaccccttcgcctgcagcgtggaggaccccaccaagcagaccaagttcaagggcatcaagagctacatcagctacaagctgacccccacccacgccgccagccccgtgtacagaagatacaagcacttcgactggctgtacaacagactgctgcacaagttcaccgtgatcagcgtgccccacctgcccgagaagcaggccaccggcagattcgaggaggacttcatcgagaagagaaagagaagactgatcctgtggatggaccacatgaccagccaccccgtgctgagccagtacgagggcttccagcacttcctgagctgcctggacgacaagcagtggaagatgggcaagagaagagccgagaaggacgagatggtgggcgccagcttcctgctgaccttccagatccccaccgagcaccaggacctgcaggacgtggaggacagagtggacaccttcaaggccttcagcaagaagatggacgacagcgtgctgcagctgagcaccgtggccagcgagctggtgagaaagcacgtgggcggcttcagaaaggagttccagaagctgggcagcgccttccaggccatcagccacagcttccagatggacccccccttctgcagcgaggccctgaacagcgccatcagccacaccggcagaacctacgaggccatcggcgagatgttcgccgagcagcccaagaacgacctgttccagatgctggacaccctgagcctgtaccagggcctgctgagcaacttccccgacatcatccacctgcagaagggcgccttcgccaaggtgaaggagagccagagaatgagcgacgagggcagaatggtgcaggacgaggccgacggcatcagaagaagatgcagagtggtgggcttcgccctgcaggccgagatgaaccacttccaccagagaagagagctggacttcaagcacatgatgcagaactacctgagacagcagatcctgttctaccagagagtgggccagcagctggagaagaccctgagaatgtacgacaacctgtag

SEQ ID NO: 24778 - DNA, 312 bp, Artificial Sequence
  Description of Artificial Sequence: Synthetic coding sequence
atgggccagcagagcagcgtgagaagactgaagagaagcgtgccctgcgagagcaacgaggccaacgaggccaacgaggccaacaagaccatgcccgagacccccaccggcgacagcgacccccagcccgcccccaagaagatgaagaccagcgagagcagcaccatcctggtggtgagatacagaagaaacgtgaagagaaccagccccgaggagctgctgaacgaccacgccagagagaacagaatcaaccccgaccagatggaggaggaggagttcatcgagatcaccaccgagagacccaagaagtag

SEQ ID NO: 24779 - DNA, 294 bp, Artificial Sequence
  Description of Artificial Sequence: Synthetic coding sequence
atggacaagcagagcagcgccggcggcgtgaagagaagcgtgccctgcgacagcaacgaggccaacgagatgatgcccgagaccagcagcggctacagcgacccccagcccgcccccaagaagctgaagaccagcgagagcagcaccatcctggtggtgagatacagaagaaacttcaagagaaccagccccgaggagctggtgaacgaccacgccagaaagaacagaatcaaccccctgcagatggaggaggaggagttcatggagatcatggtggagatccccgccaagtag

SEQ ID NO: 24780 - DNA, 219 bp, Artificial Sequence
  Description of Artificial Sequence: Synthetic coding sequence
atggagcagcccaccagcagcatcaacggcgagaagagaaagagcccctgcgagagcaacaacgagaacgacgagatgcaggagacccccaacagagacctggcccccgagcccagcctgaagaagatgaagaccagcgagtacagcaccgtgctggccttctgctacagaaaggccaagaagatccacagcaaccagctggagaacgaccagagctag

SEQ ID NO: 24781 - DNA, 543 bp, Artificial Sequence
  Description of Artificial Sequence: Synthetic coding sequence
atggagcagcccaccagcagcaccaacggcgagaagagaaagagcccctgcgagagcaacaacaagaagaacgacgagatgcaggaggcccccaacagagtgctggcccccaagcagagcctgcagaagaccaagaccatcgagtacctgaccatcatcgtgtactactacagaaagcacaccaagatcaacagcaaccagctggagaaggaccagagcagagagaacagcatcaaccccgtgcaggaggaggaggacgagggcctggacagcgccgagggcagcagccaggaggacgaggacctggacagcagcgagggcagcagccaggaggacgaggacctggacagcagcgagggcagcagccaggaggacgaggacctggacagcagcgagggcagcagccaggaggacgaggacctggacagcagcgagggcagcagccaggaggacgaggacctggacccccccgagggcagcagccaggaggacgaggacctggacagcagcgagggcagcagccaggagggcggcgaggactag

SEQ ID NO: 24782 - DNA, 426 bp, Artificial Sequence
  Description of Artificial Sequence: Synthetic coding sequence
atggagcagcccaccagcagcaccaacggcgagaagaccaagagcccctgcgagagcaacaacaagaagaacgacgagatgcaggaggtgcccaacagagtgctggcccccgagcagagcctgaagaagaccaagaccagcgagtaccccatcatcttcgtgtactacctgagaaagggcaagaagatcaacagcaaccagctggagaacgagcagagccaggagaacagcatcaaccccatccagaaggaggaggacgagggcgtggacctgagcgagggcagcagcaacgaggacgaggacctgggcccctgcgagggccccagcaaggaggacaaggacctggacagcagcgagggcagcagccaggaggacgaggacctgggcctgagcgagggcagcagccaggacagcggcgaggactag

SEQ ID NO: 24783 - DNA, 300 bp, Artificial Sequence
  Description of Artificial Sequence: Synthetic coding sequence
atggaggagcccaccagcagcaccaacgagaacaagatgaagagcccctgcgagagcaacaagagaaaggtggacaagaagaagaagaacctgcacagagccagcgcccccgagcagagcctgaaggagaccgagaaggccaagtaccccaccctggtgttctactgcagaaagaacaagaagagaaacagcaaccagctggagaacaaccagcccaccgagagcagcaccgaccccatcaaggagaagggcgacctggacatcagcgccggcagcccccaggacggcggccagaactag

SEQ ID NO: 24784 - DNA, 219 bp, Artificial Sequence
  Description of Artificial Sequence: Synthetic coding sequence
atggagaagcccaccagcagcaccaacggcgagaagagaaagagcccctgcgacagcaacagcaagaacgacgagatgcaggagacccccaacagagacctggtgctggagcccagcctgaagaagatgaagaccagcgagtacagcaccgtgctggtgctgtgctacagaaagaccaagaagatccacagcaaccagctggagaacgaccagagctag

SEQ ID NO: 24785 - DNA, 1011 bp, Artificial Sequence
  Description of Artificial Sequence: Synthetic coding sequence
atgcagaagcactacaccgtggcctggttcctgtacagcgcccccggcgtggaccccagccccccctgcagaagcctgggctggaagagaaagagagagtggagcgacgagagcgaggaggagcccgagaaggagctggcccccgagcccgaggagacctgggtggtggagaccctgtgcggcctgaagatgaagctgaagcagcagagagtgagccccatcctgctggagcaccacaaggacttcaacagccagctggcccccggcgtggaccccagccccccccacagaagcttctgctggaagagaaagatggagtggtgggacaagagcgaggagagcgaggaggagcccagaaaggtgctggcccccgagcccgaggagatctgggtggccgagatgctgtgcggcctgaagatgaagctgaagagaagaagagtgagcctggtgctgcccgagcaccacgaggccttcaacagactgctggaggaccccgtgatcaagagattcctggcctgggacaaggacctgagagtgagcgacaagtacctgctggccatggtgatcgcctacttcagcagagccggcttccccagctggcagtaccagagactgcacttcttcctggccctgtacctggccaacgacatggaggaggacgacgaggacagcaagcagaacatcttccacttcctgtacggcaagaacagaagcagaatccccctgctgagaaagagaagattccagctgtacagaagcatgaaccccagagccagaaagaacagaagccacatccccctggtgagaaagagaagattccagctgagaagatgcatgaaccccagagccagaaagaacagaagccagatcgtgctgttccagaagagaagattccacttcttctgcagcatgagctgcagagcctgggtgagccccgaggagctggaggagatccaggcctacgaccccgagcactgggtgtgggccagagacagagccagactgagctag

SEQ ID NO: 24786 - DNA, 777 bp, Artificial Sequence
  Description of Artificial Sequence: Synthetic coding sequence
atggagtggtgggacgagagcgaggagagcctggaggaggagcccagaaaggtgctggcccccgagcccgaggagatctgggtggccgagatgctgtgcggcctgaagatgaagctgaagagaagaagagtgagcctggtgctgcccgagcaccacgaggccttcaacagactgctggaggaccccgtgatcaagagattcctggcctgggacaaggacctgagagtgagcgacaagtacctgctggccatggtgatcgcctacttcagcagagccggcttccccagctggcagtaccagagaatccacttcttcctggccctgtacctggccaacgacatggaggaggacgacgaggacagcaagcagaacatcttccacttcctgtacagaaagaacagaagcagaatccccctgctgagaaagccctggttccagctgggccacagcatgaaccccagagccagaaagaacagaagcagaatccccctgctgagaaagagaagattccagctgtacagaagcaccaaccccagagccagaaagaacagaagcagaatccccctgctgagaaagagaagattccagctgtacagaagcatgaacagcagagccagaaagaacagaagccagatcgtgctgttccagaagagaagattccacttcttctgcagcatgagctgcagagcctgggtgagccccgaggagctggaggagatccaggcctacgaccccgagcactgggtgtgggccagagacagagcccacctgagctag

SEQ ID NO: 24787 - DNA, 777 bp, Artificial Sequence; identical to SEQ ID NO: 24786
  Description of Artificial Sequence: Synthetic coding sequence

SEQ ID NO: 24788 - DNA, 1209 bp, Artificial Sequence
  Description of Artificial Sequence: Synthetic coding sequence
atggacagaaccgagaccagattcagaaagagaggccagatcaccggcaagatcaccaccagcagacagccccacccccagaacgagcagagcccccagagaagcaccagcggctaccccctgcaggaggtggtggacgacgagatgctgggccccagcgcccccggcgtggaccccagccccccctgcagaagcctgggctggaagagaaagagagagtggagcgacgagagcgaggaggagcccgagaaggagctggcccccgagcccgaggagacctgggtggtggagatgctgtgcggcctgaagatgaagctgaagcagcagagagtgagccccatcctgcccgagcaccacaaggacttcaacagccagctggcccccggcgtggaccccagccccccccacagaagcttctgctggaagagaaagatggagtggtgggacgagagcgaggagagcctggaggaggagcccagaaaggtgctggcccccgagcccgaggagatctgggtggccgagatgctgtgcggcctgaagatgaagctgaagagaagaagagtgagcctggtgctgcccgagcaccacgaggccttcaacagactgctggaggaccccgtgatcaagagattcctggcctgggacaaggacctgagagtgagcgacaagtacctgctggccatggtgatcgcctacttcagcagagccggcttccccagctggcagtaccagagaatccacttcttcctggccctgtacctggccaacgacatggaggaggacgacgaggacagcaagcagaacatcttccacttcctgtacagaaagaacagaagcagaatccccctgctgagaaagccctggttccagctgggccacagcatgaaccccagagccagaaagaacagaagcagaatccccctgctgagaaagagaagattccagctgtacagaagcaccaaccccagagccagaaagaacagaagcagaatccccctgctgagaaagagaagattccagctgtacagaagcatgaacagcagagccagaaagaacagaagccagatcgtgctgttccagaagagaagattccacttcttctgcagcatgagctgcagagcctgggtgagccccgaggagctggaggagatccaggcctacgaccccgagcactgggtgtgggccagagacagagcccacctgagctag

SEQ ID NO: 24789 - DNA, 1650 bp, Artificial Sequence
  Description of Artificial Sequence: Synthetic coding sequence
atgaccagccaccagccccagccccaggaggagcagagcccccagagaagcaccagcggctaccccctgcaggaggtggtggacgacgaggtgagcggccccagcgcccccggcgtggaccccagcccccccagaagaagcctgggctgcaagagaaagagagagtgcctggacgagagcgacgacgagcccgagaaggagctggcccccgagcccgaggagacctgggtggccgagaccctgtgcggcctgaagatgaaggccaagagaagaagagtgagcctggtgctgcccgagtactacgaggccttcaacagactgctggcccccggcgtggaccccagcccccccagaagaagcctgggctgcaagagaaagagagagtgcctggacgagagcgacgacgagcccgagaaggagctggcccccgagcccgaggagacctgggtggccgagaccctgtgcggcctgaagatgaaggccaagagaagaagagtgagcctggtgctgcccgagtactacgaggccttcaacagactgctggcccccggcgtggaccccagcccccccagaagaagcctgggctgcaagagaaagagagagtgcctggacgagagcgacgacgagcccgagaaggagctggcccccgagcccgaggagacctgggtggccgagaccctgtgcggcctgaagatgaaggccaagagaagaagagtgagcctggtgctgcccgagtactacgaggccttcaacagactgctggcccccggcgtggaccccagcccccccagaagaagcctgggctgcaagagaaagagagagtgcctggacgagagcgacgacgagcccgagaaggagctggcccccgagcccgaggagacctgggtggccgagaccctgtgcggcctgaagatgaaggccaagagaagaagagtgagcctggtgctgcccgagtactacgaggccttcaacagactgctggcccccggcgtggaccccagcccccccagaagaagcctgggctgcaagagaaagagagagtgcctggacgagagcgacgacgagcccgagaaggagctggcccccgagcccgaggagacctgggtggccgagaccctgtgcggcctgaagatgaaggccaagagaagaagagtgagcctggtgctgcccgagtactacgaggccttcaacagactgctggaggaccccgtgatcaagagattcctggcctgggacaaggacctgagagtgagcgacaagtacctgctggccatggtgatcgcctacttcagcagagccggcctgcccagctggcagtaccagagaatccacttcttcctggccctgtacctggccaacgacatggaggaggacgacgaggcccccaagcagaagatcttctacttcctgtacggcaagacccacagccacatccccctgagacccaagcactggttccagctgtgcagacccatgaaccccagagccagaaagaactgcagccagatcgccctgttccagaagagaagattccagttcttctgcagcatgagatgcagagcctgggtgagccccgaggagctggaggagatccaggcctacgaccccgagcactgggtgtgggccagagacagagcccacctgagctag

SEQ ID NO: 24790 - DNA, 519 bp, Artificial Sequence
  Description of Artificial Sequence: Synthetic coding sequence
atgaaggccaagagaagaagagtgagcctggtgctgcccgagtactacgaggccttcaacagactgctggaggaccccgtgatcaagagattcctggcctgggacaaggacctgagagtgagcgacaagtacctgctggccatggtgatcgcctacttcagcagagccggcctgcccagctggcagtaccagagaatccacttcttcctggccctgtacctggccaacgacatggaggaggacgacgaggcccccaagcagaagatcttctacttcctgtacggcaagacccacagccacatccccctgagacccaagcactggttccagctgtgcagacccatgaaccccagagccagaaagaactgcagccagatcgccctgttccagaagagaagattccagttcttctgcagcatgagatgcagagcctgggtgagccccgaggagctggaggagatccaggcctacgaccccgagcactgggtgtgggccagagacagagcccacctgagctag

SEQ ID NO: 24791 - DNA, 714 bp, Artificial Sequence
  Description of Artificial Sequence: Synthetic coding sequence
atggccagcggccaggccagaccccccttcgaggaggagagcccccagcccagcaccaccgtgagaagccccgaggtggtggtggacgacgaggtgcccggccccagcgccccctggatcgaccccagcccccagccccagagcctgggcctgaagagaaagagcgagtggagcgacgagagcgaggaggagctggaggaggagctggagctggagagagcccccgagcccgaggacacctgggtggtggagaccctgtgcggcctgaagatgaagctgaagagaaagagagccagcagcgtgctgcccgagcaccacgaggccttcaacagactgctgggcgaccccgtggtgcagaagttcctggcctgggacaaggacctgagagtgagcgacaagtacctgctggccatggtgatcgcctacttcagcagagccggcctgttcagctggcagtaccagagaatccacttcttcctggccctgtacctggccagcgacatggaggaggacaaccaggcccccaagcaggacatcttcagcttcctgtacggcaagaactacagccagagacccctgttccacaagctgagataccagctgctgtgcagcatgagatggagaacctgggtgagccccgaggagatggaggagatccaggcctacgaccccgagcactgggtgtgggccagagacagaaccctgatcagctag

SEQ ID NO: 24792 - DNA, 1209 bp, Artificial Sequence
  Description of Artificial Sequence: Synthetic coding sequence
atggacagaaccgagaccagattcagaaagagaggccagatcaccggcaagatcaccaccagcagacagccccacccccagaacgagcagagcccccagagaagcaccagcggctaccccctgcaggaggtggtggacgacgagatgctgggccccagcgcccccggcgtggaccccagccccccctgcagaagcctgggctggaagagaaagagagagtggagcgacgagagcgaggaggagcccgagaaggagctggcccccgagcccgaggagacctgggtggtggagatgctgtgcggcctgaagatgaagctgaagcagcagagagtgagcagcatcctgcccgagcaccacaaggacttcaacagccagctggcccccggcgtggaccccagccccccccacagaagcttctgctggaagagaaagatggagtggtgggacgagagcgaggagagcctggaggaggagcccagaaaggtgctggcccccgagcccgaggagatctgggtggccgagatgctgtgcggcctgaagatgaagctgaagagaagaagagtgagcctggtgctgcccgagcaccacgaggccttcaacagactgctggaggaccccgtgatcaagagattcctggcctgggacaaggacctgagagtgagcgacaagtacctgctggccatggtgatcgcctacttcagcagagccggcttccccagctggcagtaccagagaatccacttcttcctggccctgtacctggccaacgacatggaggaggacgacgaggacagcaagcagaacatcttccacttcctgtacagaaagaacagaagcagaatccccctgctgagaaagccctggttccagctgggccacagcatgaaccccagagccagaaagaacagaagcagaatccccctgctgagaaagagaagattccagctgtacagaagcaccaaccccagagccagaaagaacagaagcagaatccccctgctgagaaagagaagattccagctgtacagaagcatgaacagcagagccagaaagaacagaagccagatcgtgctgttccagaagagaagattccacttcttctgcagcatgagctgcagagcctgggtgagccccgaggagctggaggagatccaggcctacgaccccgagcactgggtgtgggccagagacagagcccacctgagctag

SEQ ID NO: 24793 - DNA, 777 bp, Artificial Sequence; identical to SEQ ID NO: 24786
  Description of Artificial Sequence: Synthetic coding sequence

SEQ ID NO: 24794 - DNA, 1209 bp, Artificial Sequence; identical to SEQ ID NO: 24792
  Description of Artificial Sequence: Synthetic coding sequence

SEQ ID NO: 24795 - DNA, 1545 bp, Artificial Sequence
  Description of Artificial Sequence: Synthetic coding sequence
atgagcgagatcctgtgccagtggctgaacaaggagctgaaggtgagcagaaccgtgagccccaagagcttcgccaaggccttcagcagcggctacctgctgggcgaggtgctgcacaagttcgagctgcaggacgacttcagcgagttcctggacagcagagtgagcagcgccaagctgaacaacttcagcagactggagcccaccctgaacctgctgggcgtgcagttcgaccagaacgtggcccacggcatcatcaccgagaagcccggcgtggccaccaagctgctgtaccagctgtacatcgccctgcagaagaagaagaagagcggcctgaccggcgtggagatgcagaccatgcagagactgaccaacctgagactgcagaacatgaagagcgacaccttccaggagagactgagacacatgatccccagacagaccgacttcaacctgatgagaatcacctacagattccaggagaagtacaagcacgtgaaggaggacctggcccacctgcacttcgagaagctggagagattccagaagctgaaggaggagcagagatgcttcgacatcgagaagcagtacctgaacagaagaagacagaacgagatcatggccaagatccaggccgccatcatccagatccccaagcccgccagcaacagaaccctgaaggccctggaggcccagaagatgatgaagaagaagaaggaggccgaggacgtggccgacgagatcaagaagttcgaggccctgatcaagaaggacctgcaggccaaggagagcgccagcaagaccagcctggacaccgccggccagaccaccaccgacctgctgaacacctacagcgacgacgagtacatcaagaagatccagaagagactggaggaggacgccttcgccagagagcagagagagaagagaagaagaaagctgctgatggaccagctgatcgcccacgaggcccaggaggaggcctacagagaggagcagctgatcaacagactgatgagacagagccagcaggagagaagaatcgccgtgcagctgatgcacgtgagacacgagaaggaggtgctgtggcagaacagaatcttcagagagaagcagcacgaggagagaagactgaaggacttccaggacgccctggacagagaggccgccctggccaagcaggccaagatcgacttcgaggagcagttcctgaaggagaagagattccacgaccagatcgccgtggagagagcccaggccagatacgagaagcactacagcgtgtgcgccgagatcctggaccagatcgtggacctgagcaccaaggtggccgactacagaatgctgaccaacaacctgatcccctacaagctgatgcacgactggaaggagctgttcttcaacgccaagcccatctacgagcaggccagcgtgaagaccctgcccgccaaccccagcagagagcagctgaccgagctggagaagagagacctgctggacaccaacgactacgaggagtacaaggtgcccaccgacatgaagtag

SEQ ID NO: 24796 - DNA, 1860 bp, Artificial Sequence
  Description of Artificial Sequence: Synthetic coding sequence
atgcccagccagatcggcgacagaaagtggctgcacggcctgcaggccgccctgcagaacttcctgaagggctaccccgccatcgtgagacagctgcacagcgccggcagaggcaagagcgacaccagccagaagaagcccaaggagctgctggagagcctgctgcaggccgacatcgtgaagttcgcccacttcctgctggacgtgatgaacgtgctgagcatcctgagctgcgtgaacaagaacagaaacagcagcatcgccgacatcttcgccaccctggagagcatgctggagatgctgcagatgtaccagaccagactgggccccaaggagagaatggtggacagcgccacccacttccacggcaactgcctgagaggcaaggagaacatcagcgccgtgagaaacatcgtgctgacccacctgatcaagagactgcagggctgcttcagagacgccagccagaacgtggtgagagccaccgtgatcggcagcttcaagctgtggcccaccaagatcaaccaggagttcggcgagaaggaggtgagcatcctgaccgcccactacgagcccgtgctggaggccgccaacgtgaagctgagcgaggtggacaccgagtggagcatgctgaagctggagatctacgccagattccagaacatcagaaagctgacctgggacttcgtgaacagcatctacctgcacaagtaccccaacatcctgaccctggtggacctggtgctgaccctgcccgccagcagcgccgaggccgagcacggcttcagccagatgaagtggaccaagagccacatgcacgccaagatcaaggccgagagcatcatcggcaacaaggccttcaccgacatcctgatcgacctggtgaccctgaacctgggcaccaacaacttccccagcaactggatgcacctgacccagcccgagctgcaggagctgaccagcctgctgaccgtgaacagcgagttcgtggactggagaaagttcctgctggtgaccagcatgccctggcccatccccctggaggaggagctgctggagaccctgcagaagttcaaggccgtggacaaggagcagctgggcaccatcaccttcgagcagtacatgcaggccggcctgtggttcaccggcgacgaggacatcaagatccccgagaaccccctggagcccctgcccttcaacagacaggagcacctgatcgagttcttcttcagactgttcgccgactacgagaaggaccccccccagctggactacacccagatgctgctgtacttcgcctgccaccccgacaccgtggagggcgtgtacagagccctgagcgtggccgtgggcacccacgtgttccagcaggtgaaggccagcatccccagcgccgagaagaccagcagcaccgacgccggccccgccgaggagttccccgagcccgaggagaacgccgccagagaggagagaaagctgaaggacgacaccgagaagagagagcagaaggacgaggagatccccgagaacgccaacaacgagaagatgagcatggagaccctgctgaaggtgttcaagggcggcagcgaggcccaggacagcaacagattcgccagccacctgaagatcgagaacatctacgccgagggcttcatcaagaccttccaggacctgggcgccaagaacctggagcccatcgaggtggccgtgctgctgaagcaccccttcatccaggacctgatcagcaactacagcgactacaagttccccgacatcaagatcatcctgcagagaagcgagcacgtgcagggcagcgacggcgagagaagccccagcagacacaccgaggagaagaagtag

SEQ ID NO: 24797 - DNA, 5469 bp, Artificial Sequence
  Description of Artificial Sequence: Synthetic coding sequence
atgagcgagatcctgtgccagtggctgaacaaggagctgaaggtgagcagaaccgtgagccccaagagcttcgccaaggccttcagcagcggctacctgctgggcgaggtgctgcacaagttcgagctgcaggacgacttcagcgagttcctggacagcagagtgagcagcgccaagctgaacaacttcagcagactggagcccaccctgaacctgctgggcgtgcagttcgaccagaacgtggcccacggcatcatcaccgagaagcccggcgtggccaccaagctgctgtaccagctgtacatcgccctgcagaagaagaagaagagcggcctgaccggcgtggagatgcagaccatgcagagactgaccaacctgagactgcagaacatgaagagcgacaccttccaggagagactgagacacatgatccccagacagaccgacttcaacctgatgagaatcacctacagattccaggagaagtacaagcacgtgaaggaggacctggcccacctgcacttcgagaagctggagagattccagaagctgaaggaggagcagagatgcttcgacatcgagaagcagtacctgaacagaagaagacagaacgagatcatggccaagatccaggccgccatcatccagatccccaagcccgccagcaacagaaccctgaaggccctggaggcccagaagatgatgaagaagaagaaggaggccgaggacgtggccgacgagatcaagaagttcgaggccctgatcaagaaggacctgcaggccaaggagagcgccagcaagaccagcctggacaccgccggccagaccaccaccgacctgctgaacacctacagcgacgacgagtacatcaagaagatccagaagagactggaggaggacgccttcgccagagagcagagagagaagagaagaagaaagctgctgatggaccagctgatcgcccacgaggcccaggaggaggcctacagagaggagcagctgatcaacagactgatgagacagagccagcaggagagaagaatcgccgtgcagctgatgcacgtgagacacgagaaggaggtgctgtggcagaacagaatcttcagagagaagcagcacgaggagagaagactgaaggacttccaggacgccctggacagagaggccgccctggccaagcaggccaagatcgacttcgaggagcagttcctgaaggagaagagattccacgaccagatcgccgtggagagagcccaggccagatacgagaagcactacagcgtgtgcgccgagatcctggaccagatcgtggacctgagcaccaaggtggccgactacagaatgctgaccaacaacctgatcccctacaagctgatgcacgactggaaggagctgttcttcaacgccaagcccatctacgagcaggccagcgtgaagaccctgcccgccaaccccagcagagagcagctgaccgagctggagaagagagacctgctggacaccaacgactacgaggagtacaagaacatggtgggcgagtgggccctgcccgaggagatggtggacaacctgccccccagcaacaactgcatcctgggccacatcctgcacagactggccgagaagagcctgccccccagagccgagagcaccacccccgagctgcccagcttcgccgtgaagggctgcctgctgggcaagaccctgagcggcaagaccaccatcctgagaagcctgcagaaggacttccccatccagatcctgagcatcgacaccctggtgcaggaggccatccaggccttccacgacaacgagaaggtgagcgaggtgctgcccatccagaagaacgacgaggaggacgccctgcccgtgctgcaggaggagatcaaggagagccaggacccccagcacgtgttcagcgccggccccgtgagcgacgaggtgctgcccgagaccgagggcgagaccatgctgagcgccaacgccgacaagacccccaaggccgaggaggtgaagagcagcgacagcttcctgaagctgaccaccagagcccagctgggcgccaagagcgagcagctgctgaagaagggcaagagcatccccgacgtgctgctggtggacatcatcgtgaacgccatcaacgagatccccgtgaaccaggactgcatcctggacggcttccccatgaccctgaaccaggcccagctgctggaggaggccctgaccggctgcaacagaaacctgaccgaggtggagagaaagaaggcccagaagagcaccctggccatcgaccccgccaccagcaaggagatccccctgcccagccccgccttcgacttcgtgatcctgctggacgtgagcgacaccagcagcatgagcagaatgaacgacatcatcgccgaggagctgagctacaagaccgcccacgaggacatcagccagagagtggccgccgagaaccaggacaaggacggcgaccagaacctgagagaccagatccagcacagaatcatcggcttcctggacaactggcccctgctggagcagtggttcagcgagcccgagaacatcctgatcaagatcaacgccgagatcgacaaggagagcctgtgcgagaaggtgaaggagatcctgaccaccgagatcgccaagaagaagaacaaggtggagaagaagctggaggagaaggaggccgagaagaaggccgccgccagcctggccgagctgcccctgcccacccccccccccgcccccccccccgagcccgagaaggagaaggagatccaccagagccacgtggccagcaagacccccaccgccaagggcaagccccagagcgaggccccccacggcaagcaggagagcctgcaggagggcaagggcaagaagggcgagaccgccctgaagagaaagggcagccccaagggcaagagcagcggcggcaaggtgcccgtgaagaagagccccgccgacagcaccgacaccagccccgtggccatcgtgccccagccccccaagcccggcagcgaggagtgggtgtacgtgaacgagcccgtgcccgaggagatgcccctgttcctggtgccctactgggagctgatcgagaacagctacatcaacaccatcaagaccgtgctgagacacctgagagaggaccagcacaccgtgctggcctacctgtacgagatcagaaccagcttccaggagttcctgaagagacccgaccacaagcaggacttcgtggcccagtggcaggccgacttcaacagcctgcccgacgacctgtgggacgacgaggagaccaaggccgagctgcaccagagagtgaacgacctgagagacagactgtgggacatctgcgacgccagaaaggaggaggccgagcaggagagactggacatcatcaacgagagctggctgcaggacaccctgggcatgaccatgaaccacttcttcagcctgatgcaggccgagctgaacagattccaggacaccaagagactgctgcaggactactactggggcatggagagcaagatccccgtggaggacaacaagagattcaccagaatccccctggtgcagctggacagcaaggacaacagcgagagccagctgagaatccccctggtgcccagaatcagcatcagcctggagaccgtgacccccaagcccaagaccaagagcgtgctgaagggcaagatggacaacagcctggagaacgtggagagcaacttcgaggccgacgagaagctggtgatggacacctggcagcaggccagcctggccgtgagccacatggtggccgccgagatccaccagagactgatggaggaggagaaggagaaccagcccgccgaccccaaggagaagagcccccagatgggcgccaacaagaaggtgaagaaggagccccccaagaagaagcaggaggacaagaagcccaagggcaagagcccccccatggccgaggccacccccgtgatcgtgaccaccgaggagatcgccgagatcaagagaaagaacgagctgagagtgaagatcaaggaggagcacctggccgccctgcagttcgaggagatcgccacccagttcagactggagctgatcaagaccaaggccctggccctgctggaggacctggtgaccaaggtggtggacgtgtacaagctgatggagaagtggctgggcgagagatacctgaacgagatggccagcaccgagaagctgaccgacgtggccagataccacatcgagaccagcaccaagatccagaacgagctgtacctgagccaggaggacttcttcatcaacggcaacatcaaggtgttccccgaccccccccccagcatcagacccccccccgtggagaaggaggaggacggcaccctgaccatcgagcagctggacagcctgagagaccagttcctggacatggcccccaagggcatcatcggcaacaaggccttcaccgacatcctgatcgacctggtgaccctgaacctgggcaccaacaacttccccagcaactggatgcacctgacccagcccgagctgcaggagctgaccagcctgctgaccgtgaacagcgagttcgtggactggagaaagttcctgctggtgaccagcatgccctggcccatccccctggaggaggagctgctggagaccctgcagaagttcaaggccgtggacaaggagcagctgggcaccatcaccttcgagcagtacatgcaggccggcctgtggttcaccggcgacgaggacatcaagatccccgagaaccccctggagcccctgcccttcaacagacaggagcacctgatcgagttcttcttcagactgttcgccgactacgagaaggaccccccccagctggactacacccagatgctgctgtacttcgcctgccaccccgacaccgtggagggcgtgtacagagccctgagcgtggccgtgggcacccacgtgttccagcaggtgaaggccagcatccccagcgccgagaagaccagcagcaccgacgccggccccgccgaggagttccccgagcccgaggagaacgccgccagagaggagagaaagctgaaggacgacaccgagaagagagagcagaaggacgaggagatccccgagaacgccaacaacgagaagatgagcatggagaccctgctgaaggtgttcaagggcggcagcgaggcccaggacagcaacagattcgccagccacctgaagatcgagaacatctacgccgagggcttcatcaagaccttccaggacctgggcgccaagaacctggagcccatcgaggtggccgtgctgctgaagcaccccttcatccaggacctgatcagcaactacagcgactacaagttccccgacatcaagatcatcctgcagagaagcgagcacgtgcagggcagcgacggcgagagaagccccagcagacacaccgaggagaagaagtag

SEQ ID NO: 24798 - DNA, 1410 bp, Artificial Sequence
  Description of Artificial Sequence: Synthetic coding sequence
atggacaacagaaacacccagatgtacaccgaggaggagaagaccgtgaaccccttcctgcccagcacccccggccccaagaaggccaagggcggcggcgaggccgtggagacccaccccgcccccggccccctgcccccccccgaggtgagagacatcggcgagagaagagagcccgacagagcccagcagcagccccagaagcccgccgtggccgccggcacccagagcctgggcaacttcagacagggcttcatgaagtgcctgctggaggtggagaagatggaggccagccacagaagagccagcaaggccagaagccagaccgcccagaagagccccagaaccctgacccccgtgcccaccagcgcccccagcctgccccagacccccgccagcgtgcccgccagcggccccagctgggccagactgcccgcccccggccccgagcccgcccccatgggcgcccccgtgcccaccagcatgccctgccccgtgctgctgggccccgccctggacctgggctggagaagaatggagctgctgcaccagagcagcgagagaaccctgagctacgccaaggccagacaggagcccgaggagcagagcctgcagaagctgtaccagaacagagagaagagcgaggagcagctgaccctgaagcaggaggaggccttcagaagctacttcgagatcttcaacggccccggcgaggtggacgcccagagcctgaagaacatcctgctgctgatgggcttcagcgtgaccctggcccaggtggaggacgccctgatgagcgccgacgtgaacggcgacggcagagtggacttcaaggacttcctggccgtgatgaccgacaccagaagattcttctgcagcgtggagcagaacgccctgagcgacatggccccccacaacccccacaccctgctgttcgagatcctgagcctgctggtggagatgctggccctgcccgaggccgtgctggaggagatcaccaactactaccagaagaagctgaaggagggcacctgcaaggcccaggagatggaggccgccgtgggcagactgagactgcagaagctgccctacaacccccagcaggaggagagcagcgaggtgcccgagagaaaggtgctgagcatcctgagcagactgaagcagcagaactacgcccccaacctgcagagcccctacgcccaggtgccctgcatcctgctgtgcccccagctggacaagaagatggtgagaagacagcccagcaaccactacgccctggaccagtgcaccccccccggcctggaccccgacatcagaagccccttcttccagagcggcagccagggcaacagagagcacaacagcgacagcagaaagtggctgagcagcgtgcccgccagaacccactag

SEQ ID NO: 24799 - DNA, 603 bp, Artificial Sequence
  Description of Artificial Sequence: Synthetic coding sequence
atggacaacagaaacacccagatgtacaccgagggcagaaccaaggcccccggcacccagcccagccccggcctgagaatcaccatcaagagagccggcgtggagcccatcatccccggcgtgagcaaggtgatgttccccgacgccagcgaggtgggcagcaagaagcacctgagcagcgccagcagaggccccgagaagggccccagactgagagacgccttcgagaagggccccagcgagctgagaatccaggagcagggcccccccgccagacccggcaagaagcagcccagctgggtgccccaggagggcagccaggagctgcaggccggccaggaccagagcgagctgggcctgctgcccagctgggtgcccgaggtgcccgagggcctgcagcagctgggcagcggcaaggagatcaagggccagcagggcagacagagaaacagaggcatcggcgaggaccagccccccgagagctgccaggccggccacggcggcagcagactgctgatccccgccctgctggaggccgagggcggcagaagccccgaggtgaagaccagcctggccaacatggtgaagccctgcctgtactag

SEQ ID NO: 24800 - DNA, 1341 bp, Artificial Sequence
  Description of Artificial Sequence: Synthetic coding sequence
atggcccagcccggcgccgtggagcacgcctgccaccccagcaccctgggcggccagggcggcggcagcctggaggaggtgagagacatcggcgagagaagagagcccgacagagcccagcagcagccccagaagcccgccgtggccgccggcacccagagcctgggcaacttcagacagggcttcatgaagtgcctgctggaggtggagaagatggaggccagccacagaagagccagcaaggccagaagccagaccgcccagaagagccccagaaccctgacccccgtgcccaccagcgcccccagcctgccccagacccccgccagcgtgcccgccagcggccccagctgggccagactgcccgcccccggccccgagcccgcccccatgggcgcccccgtgcccaccagcatgccctgccccgtgctgctgggccccgccctggacctgggctggagaagaatggagctgctgcaccagagcagcgagagaaccctgagctacgccaaggccagacaggagcccgaggagcagagcctgcagaagctgtaccagaacagagagaagagcgaggagcagctgaccctgaagcaggaggaggccttcagaagctacttcgagatcttcaacggccccggcgaggtggacgcccagagcctgaagaacatcctgctgctgatgggcttcagcgtgaccctggcccaggtggaggacgccctgatgagcgccgacgtgaacggcgacggcagagtggacttcaaggacttcctggccgtgatgaccgacaccagaagattcttctgcagcgtggagcagaacgccctgagcgacatggccccccacaacccccacaccctgctgttcgagatcctgagcctgctggtggagatgctggccctgcccgaggccgtgctggaggagatcaccaactactaccagaagaagctgaaggagggcacctgcaaggcccaggagatggaggccgccgtgggcagactgagactgcagaagctgccctacaacccccagcaggaggagagcagcgaggtgcccgagagaaaggtgctgagcatcctgagcagactgaagcagcagaactacgcccccaacctgcagagcccctacgcccaggtgccctgcatcctgctgtgcccccagctggacaagaagatggtgagaagacagcccagcaaccactacgccctggaccagtgcaccccccccggcctggaccccgacatcagaagccccttcttccagagcggcagccagggcaacagagagcacaacagcgacagcagaaagtggctgagcagcgtgcccgccagaacccactag

SEQ ID NO: 24801 - DNA, 810 bp, Artificial Sequence
  Description of Artificial Sequence: Synthetic coding sequence
atgaagagaagcctgaacgagaacagcgccagaagcaccgccggctgcctgcccgtgcccctgttcaaccagaagaagagaaacagacagcccctgaccagcaaccccctgaaggacgacagcggcatcagcacccccagcgacaactacgacttcccccccctgcccaccgactgggcctgggaggccgtgaaccccgagctggcccccgtgatgaagaccgtggacaccggccagatcccccacagcgtgagcagacccctgagaagccaggacagcgtgttcaacagcatccagagcaacaccggcagaagccagggcggctggagctacagagacggcaacaagaacaccagcctgaagacctggaacaagaacgacttcaagccccagtgcaagagaaccaacctggtggccaacgacggcaagaacagctgccccgtgagcagcggcgcccagcagcagaagcagctgagaatccccgagccccccaacctgagcagaaacaaggagaccgagctgctgagacagacccacagcagcaagatcagcggctgcaccatgagaggcctggacaagaacagcgccctgcagaccctgaagcccaacttccagcagaaccagtacaagaagcagatgctggacgacatccccgaggacaacaccctgaaggagaccagcctgtaccagctgcagttcaaggagaaggccagcagcctgagaatcatcagcgccgtgatcgagagcatgaagtactggagagagcacgcccagaagaccgtgctgctgttcgaggtgctgggcagctag

SEQ ID NO: 24802 - DNA, 963 bp, Artificial Sequence
  Description of Artificial Sequence: Synthetic coding sequence
atgaagagaagcctgaacgagaacagcgccagaagcaccgccgactgggcctgggaggccgtgaaccccgagctggcccccgtgatgaagaccgtggacaccggccagatcccccacagcgtgagcagacccctgagaagccaggacagcgtgttcaacagcatccagagcaacaccggcagaagccagggcggctggagctacagagacggcaacaagaacaccagcctgaagacctggaacaagaacgacttcaagccccagtgcaagagaaccaacctggtggccaacgacggcaagaacagctgccccgtgagcagcggcgcccagcagcagaagcagctgagaatccccgagccccccaacctgagcagaaacaaggagaccgagctgctgagacagacccacagcagcaagatcagcggctgcaccatgagaggcctggacaagaacagcgccctgcagaccctgaagcccaacttccagcagaaccagtacaagaagcagatgctggacgacatccccgaggacaacaccctgaaggagaccagcctgtaccagctgcagttcaaggagaaggccagcagcctgagaatcatcagcgccgtgatcgagagcatgaagtactggagagagcacgcccagaagaccgtgctgctgttcgaggtgctggccgtgctggacagcgccgtgacccccggcccctactacagcaagaccttcctgatgagagacggcaagaacaccctgccctgcgtgttctacgagatcgacagagagctgcccagactgatcagaggcagagtgcacagatgcgtgggcaactacgaccagaagaagaacatcttccagtgcgtgagcgtgagacccgccagcgtgagcgagcagaagaccttccaggccttcgtgaagatcgccgacgtggagatgcagtactacatcaacgtgatgaacgagacctag

SEQ ID NO: 24803 - DNA, 1092 bp, Artificial Sequence
  Description of Artificial Sequence: Synthetic coding sequence
atgaagagaagcctgaacgagaacagcgccagaagcaccgccggctgcctgcccgtgcccctgttcaaccagaagaagagaaacagacagcccctgaccagcaaccccctgaaggacgacagcggcatcagcacccccagcgacaactacgacttcccccccctgcccaccgactgggcctgggaggccgtgaaccccgagctggcccccgtgatgaagaccgtggacaccggccagatcccccacagcgtgagcagacccctgagaagccaggacagcgtgttcaacagcatccagagcaacaccggcagaagccagggcggctggagctacagagacggcaacaagaacaccagcctgaagacctggaacaagaacgacttcaagccccagtgcaagagaaccaacctggtggccaacgacggcaagaacagctgccccgtgagcagcggcgcccagcagcagaagcagctgagaatccccgagccccccaacctgagcagaaacaaggagaccgagctgctgagacagacccacagcagcaagatcagcggctgcaccatgagaggcctggacaagaacagcgccctgcagaccctgaagcccaacttccagcagaaccagtacaagaagcagatgctggacgacatccccgaggacaacaccctgaaggagaccagcctgtaccagctgcagttcaaggagaaggccagcagcctgagaatcatcagcgccgtgatcgagagcatgaagtactggagagagcacgcccagaagaccgtgctgctgttcgaggtgctggccgtgctggacagcgccgtgacccccggcccctactacagcaagaccttcctgatgagagacggcaagaacaccctgccctgcgtgttctacgagatcgacagagagctgcccagactgatcagaggcagagtgcacagatgcgtgggcaactacgaccagaagaagaacatcttccagtgcgtgagcgtgagacccgccagcgtgagcgagcagaagaccttccaggccttcgtgaagatcgccgacgtggagatgcagtactacatcaacgtgatgaacgagacctag

SEQ ID NO: 24804 - DNA, 1044 bp, Artificial Sequence
  Description of Artificial Sequence: Synthetic coding sequence
atgaagagaagcctgaacgagaacagcgccagaagcaccgccggctgcctgcccgtgcccctgttcaaccagaagaagagaaacagacagcccctgaccagcaaccccctgaaggacgacagcgactgggcctgggaggccgtgaaccccgagctggcccccgtgatgaagaccgtggacaccggccagatcccccacagcgtgagcagacccctgagaagccaggacagcgtgttcaacagcatccagagcaacaccggcagaagccagggcggctggagctacagagacggcaacaagaacaccagcctgaagacctggaacaagaacgacttcaagccccagtgcaagagaaccaacctggtggccaacgacggcaagaacagctgccccgtgagcagcggcgcccagcagcagaagcagctgagaatccccgagccccccaacctgagcagaaacaaggagaccgagctgctgagacagacccacagcagcaagatcagcggctgcaccatgagaggcctggacaagaacagcgccctgcagaccctgaagcccaacttccagcagaaccagtacaagaagcagatgctggacgacatccccgaggacaacaccctgaaggagaccagcctgtaccagctgcagttcaaggagaaggccagcagcctgagaatcatcagcgccgtgatcgagagcatgaagtactggagagagcacgcccagaagaccgtgctgctgttcgaggtgctggccgtgctggacagcgccgtgacccccggcccctactacagcaagaccttcctgatgagagacggcaagaacaccctgccctgcgtgttctacgagatcgacagagagctgcccagactgatcagaggcagagtgcacagatgcgtgggcaactacgaccagaagaagaacatcttccagtgcgtgagcgtgagacccgccagcgtgagcgagcagaagaccttccaggccttcgtgaagatcgccgacgtggagatgcagtactacatcaacgtgatgaacgagacctag

SEQ ID NO: 24805 - DNA, 1092 bp, Artificial Sequence; identical to SEQ ID NO: 24803
  Description of Artificial Sequence: Synthetic coding sequence

SEQ ID NO: 24806 - DNA, 1092 bp, Artificial Sequence; identical to SEQ ID NO: 24803
  Description of Artificial Sequence: Synthetic coding sequence

SEQ ID NO: 24807 - DNA, 1275 bp, Artificial Sequence
  Description of Artificial Sequence: Synthetic coding sequence
atgggcagcagcagcctgagcgaggactacagacagtgcctggagagagagctgagaagaggcagagccggcgtgtgcggcgaccccagcctgagagccgtgctgtggcagatcctggtggaggacttcgacctgcacggcgccctgcaggacgacgccctggccctgctgaccgacggcctgtggggcagagccgacctggcccccgccctgagaggcctggccagagccttcgagctgctggagctggccgccgtgcacctgtacctgctgccctggagaaaggagttcaccaccatcaagaccttcagcggcggctacgtgcacgtgctgaagggcgtgctgagcgacgacctgctgctgaagagcttccagaagatgggctacgtgagaagagacagccacagactgatggtgaccgccctgccccccgcctgccagctggtgcaggtggccctgggctgcttcgccctgagactggagtgcgagatcctgggcgaggtgctggcccagctgggcaccagcgtgctgcccgccgaggagctgctgcaggccagaagagccagcggcgacgtggccagctgcgtggcctggctgcagcagagactggcccaggacgaggagcccccccccctgccccccagaggcagccccgccgcctacagagcccccctggacctgtacagagacctgcaggaggacgagggcagcgaggacgccagcctgtacggcgagcccagccccggccccgacagcccccccgccgagctggcctacagaccccccctgtgggagcagagcgccaagctgtggggcaccggcggcagagcctgggagccccccgccgaggagctgccccaggccagcagccccccctacggcgccctggaggagggcctggagcccgagcccagcgccttcagcttcctgagcctgagaagagagctgagcagacccggcgacctggccacccccgagagcagcgccgccgccagccccagaagaatcagagccgagggcgtgcccgccagcgcctacagaagcgtgagcgagccccccggctaccaggcccacagctgcctgagccccggcgccctgcccaccctgtgctgcgacacctgcagacagctgcacgccgcccactgcgccgccctgcccgcctgcagacccggccacagcctgagagtgctgctgggcgacgcccagagaagactgtggctgcagagagcccagatggacaccctgctgtacaacagccccggcgccagaccctag

SEQ ID NO: 24808 - DNA, 459 bp, Artificial Sequence
  Description of Artificial Sequence: Synthetic coding sequence
atgggcagcagcagcctgagcgaggactacagacagtgcctggagagagagctgagaagaggcagagccggcgtgtgcggcgaccccagcctgagagccgtgctgtggcagatcctggtggaggacttcgacctgcacggcgccctgcaggacgacgccctggccctgctgaccgacggcctgtggggcagagccgacctggcccccgccctgagaggcctggccagagccttcgagctgctggagctggccgccgtgcacctgtacctgctgccctggagaaaggagttcaccaccatcaagaccttcagcggcggctacgtgcacgtgctgaagggcgtgctgagcgacgacctgctgctgaagagcttccagaagatgggctacgtgagaagagacagccacagactgatgctgtgctggagccagagcgccggcctgtgcagagtgcacggctag

SEQ ID NO: 24809 - DNA, 552 bp, Artificial Sequence
  Description of Artificial Sequence: Synthetic coding sequence
atgaagaaggtgaagaagaagagaagcgaggccagaagacacagagacagcaccagccagcacgccagcagcaacagcaccagccagcagcccagccccgagagcaccccccagcagcccagccccgagagcaccccccagcacagcagcctggagaccaccagcagacagcccgccttccaggccctgcccgcccccgagatcagaagaagcagctgctgcctgctgagccccgacgccaacgtgaaggccgccccccagagcagaaaggccggccccctgatcagagccggcccccacagctgcagctgcgccacctgcccctgcagcagcgcctgctggagaagactgggcctgtgccacagcagaatcttcgacgtgctgctgcccagagactggcagatggcccccggcagaggcctgcccaacctgctgaccttctacagaaagagcagcagaaagcccagcagccacagaaacgcctgcccccccagccccagaaactgcggctgcggcagcggcggcagcagaagctgcctgctgcaccactag

SEQ ID NO: 24810 - DNA, 579 bp, Artificial Sequence
  Description of Artificial Sequence: Synthetic coding sequence
atgaagaaggtgaagaagaagagaagcgaggccagaagacacagagacagcaccagccagcacgccagcagcaacagcaccagccagcagcccagccccgagagcaccccccagcagcccagccccgagagcaccccccagcagcccagccccgagagcaccccccagcacagcagcctggagaccaccagcagacagcccgccttccaggccctgcccgcccccgagatcagaagaagcagctgctgcctgctgagccccgacgccaacgtgaaggccgccccccagagcagaaaggccggccccctgatcagagccggcccccacagctgcagctgcgccacctgcccctgcagcagcgcctgctggagaagactgggcctgtgccacagcagaatcttcgacgtgctgctgcccagagactggcagatggcccccggcagaggcctgcccaacctgctgaccttctacagaaagagcagcagaaagcccagcagccacagaaacgcctgcccccccagccccagaaactgcggctgcggcagcggcggcagcagaagctgcctgctgcaccactag

SEQ ID NO: 24811 - DNA, 579 bp, Artificial Sequence; identical to SEQ ID NO: 24810
  Description of Artificial Sequence: Synthetic coding sequence

SEQ ID NO: 24812 - DNA, 579 bp, Artificial Sequence; identical to SEQ ID NO: 24810
  Description of Artificial Sequence: Synthetic coding sequence

SEQ ID NO: 24813 - DNA, 579 bp, Artificial Sequence; identical to SEQ ID NO: 24810
  Description of Artificial Sequence: Synthetic coding sequence

SEQ ID NO: 24814 - DNA, 21 bp, Artificial Sequence
  Description of Artificial Sequence: Synthetic coding sequence
tgatgcctgctgcaccactag

SEQ ID NO: 24815 - DNA, 1005 bp, Artificial Sequence
  Description of Artificial Sequence: Synthetic coding sequence
atgcccctggaggtggtggtggagctgcagatcagagccatcagctgccccggcgtgttcctgcccggcaagcaggacgtgtacctgggcgtgtacctgatgaaccagtacctggagaccaacagcttccccagcgccttccccatcatgatccaggagagcatgagattcgagaagggcatcgcccccaagatcgagttcagcaccagaaccgccatcagagagtgcgtgttcctgcacagaaacagattcctggaggagagacacgagagcagaagacccctgagcaccagccacgagcccatcttccccctgaacaccatcaagatgaagctgaaggagaacaacctgaacagactgcccaagggcatgcaggccagagcccccagccagtacagcaccagacacttcttccaggaccagcccgcccagctgaacctgggcaacaacttcaagatcagcggcggcagcaagccccccttcgtggtgagacacgtggacagcgccaagcccttcggcgagaacatcagcgagcaccacctgagaagaagcagaagaaagagcaagttcagcgacttccccttccccaccagaagagccagcagcctggacagcctggccgccaacgtgaaggtgatcaaggagcccgacgagagaatcgtgctgagaagcgacagcagcagctgcctggacagcagccagttcggcaagagcagcagcagcaagcagggcgacgccgacttccacggcaaggccagcttcgccacctaccagcacagcaccagccccggccccctggaccagcccctgctgagagagagattccaccccggcagccagagcacctggaagaacatccacgagagagtgtgcagcctgctgaccagccacagagcccagctgcaccagaacaaggaggacagcaccagcgaggtgaactacatcatcgagagacccagctaccccctgaagaagtacagcctgcacgagcagagatacttctag

SEQ ID NO: 24816 - DNA, 903 bp, Artificial Sequence
  Description of Artificial Sequence: Synthetic coding sequence
atgagccccagcatgctgaccggcaacagccccagaggctgcagactgcccagcatcagcagcaccacctgcggcagacagctggagaaggtgcccgagaagagagacagcggcatgaccgaggtggagagaacctacagcgccaactgcagcgacttcctggagagcaagggctgcttcgccaacaccacccccagcggcaagagcgtgagcagcagcagcagcgtggagaccggccccagcgtgagcgagccccccggcctgcccagagtgagcgcctacgtggacaccaccgccgacctggacagaaagctgagcttcagccacagcgaccacagcagcgagatgagcctgcccgaggtgcagaaggacaagtaccccgaggagttcagcctgctgaagctgcagaccaaggacggccacagacccgagtggaccttctaccccagattcagcagcaacatccacacctaccacgtgggcaagcagtgcttcttcaacggcgtgttcctgggcaacaagagaagcctgagcgagagaaccgtggacaagtgcttcggcagaaagaagtacgacatcgaccccagaaacggcatccccaagctgacccccggcgacaacccctacatgtaccccgagcagagcaagggcttccacaaggccggcagcatgctgccccccgtgaacttcagcatcgtgccctacgagaagaagttcgacaccttcatccccctggagcccctgccccagatccccaacctgcccttctgggtgaaggagaaggccaacagcctgaagaacgagatccaggaggtggaggagctggacaactggcagcccgccgtgcccctgatgcacatgctgcacctgagcggcgccctggacttccccagacagagctag

SEQ ID NO: 24817 - DNA, 903 bp, Artificial Sequence; identical to SEQ ID NO: 24816
  Description of Artificial Sequence: Synthetic coding sequence

SEQ ID NO: 24818 - DNA, 1338 bp, Artificial Sequence
  Description of Artificial Sequence: Synthetic coding sequence
atgagcccccccggcatgtggcagcccggcgtgcagcagcccggcatcagccagcaggtgcccagccaccccgacatgagccagcccggcatgagccagcaggtgcccagccagcccggcatcagacagcccgacaccagccagagctgcaagaaccagaccgacatgagccagcccgacgccaaccagagcagcctgagcgacagcaaccagaccggcatcatccagcccagccccagcctgctgggcatgaaccagatggacatgaaccagtggagcgccagcctgtacgagatgaaccaggtggacatgaagcagcccagcatgagccaggccggcatgagacagagcggcaccaacctgcccgacatcaaccagcccggcatgaagcagcccggcacctggcagctgggcagaagccagcccggcatgtggccccagagcctgagcgagctggtgctgagcgaggccagcatcagccagcccggccccccccagagagcccccagccagagcggccccagacagagcagcaccagccaggccggcaccaaccagagcggcatcagccagcccgtgatgtggcagctggacatgagacagagcggcggcagccagcccagcatgagacaggtgggcaccagccagagcggcaccagccagatcggcatgagccagcccggcacctggcagaccggcctgagccagcccgtgcccagacagcccaacaagagcccccccggcatgtggcagagaggcatgtggcagcccggcatgagccagcaggtgcccagccagctgggcatgagacagcccggcaccagccagagcagcaagaaccagaccggcatgagccaccccggcagaggccagcccggcatctgggagcccggccccagccagcccggcctgagccagcaggacctgaaccagctggtgctgagccagcccggcctgagccagcccggcagaagccagcccagcgtgagccagatgggcatgagacagaccagcatggactacttccagatcagacacgccgaggccggcgactgccccgagatcctgagactgatcaaggagctggccgcctgcgagaacatgctggacgccatggagctgaccgccgccgacctgctgagagacggcttcggcgacaaccccctgttctactgcctgatcgccgaggtgaacgaccagcagaagcccagcggcaagctgaccgtgggcttcgccatgtactacttcacctacgacagctggaccggcaaggtgctgtacctggaggacttctacgtgacccaggcctaccaggacagccaccacaacagcatgtag

SEQ ID NO: 24819 - DNA, 1527 bp, Artificial Sequence
  Description of Artificial Sequence: Synthetic coding sequence
atgagcccccccggcatgtggcagcccggcgtgcagcagcccggcatcagccagcaggtgcccagccaccccgacatgagccagcccggcatgagccagcaggtgcccagccagcccggcatcagacagcccgacaccagccagagctgcaagaaccagaccgacatgagccagcccgacgccaaccagagcagcctgagcgacagcaaccagaccggcatcatccagcccagccccagcctgctgggcatgaaccagatggacatgaaccagtggagcgccagcctgtacgagatgaaccaggtggacatgaagcagcccagcatgagccaggccggcatgagacagagcggcaccaacctgcccgacatcaaccagcccggcatgaagcagcccggcacctggcagctgggcagaagccagcccggcatgtggccccagagcctgagcgagctggtgctgagcgaggccagcatcagccagcccggccccccccagagagcccccagccagagcggccccagacagagcagcaccagccaggccggcaccaaccagagcggcatcagccagcccgtgatgtggcagctggacatgagacagagcggcggcagccagcccagcatgagacaggtgggcaccagccagagcggcaccagccagatcggcatgagccagcccggcacctggcagaccggcctgagccagcccgtgcccagacagcccaacaagagcccccccggcatgtggcagagaggcatgtggcagcccggcatgagccagcaggtgcccagccagctgggcatgagacagcccggcaccagccagagcagcaagaaccagaccggcatgagccaccccggcagaggccagcccggcatctgggagcccggccccagccagcccggcctgagccagcaggacctgaaccagctggtgctgagccagcccggcctgagccagcccggcagaagccagcccagcgtgagccagatgggcatgagacagaccagcatggactacttccagatcagacacgccgaggccggcgactgccccgagatcctgagactgatcaaggagctggccgcctgcgagaacatgctggacgccatggagctgaccgccgccgacctgctgagagacggcttcggcgacaaccccctgttctactgcctgatcgccgaggtgaacgaccagcagaagcccagcggcaagctgaccgtgggcttcgccatgtactacttcacctacgacagctggaccggcaaggtgctgtacctggaggacttctacgtgacccaggcctaccagggcctgggcatcggcgccgagatgctgaagagactgagccagatcgccatcaccacccagtgcaactgcatgcacttcctggtggtgatctggaaccaggccagcatcaactactacaccagcagaggcgccctggacctgagcagcgaggagggctggcacctgttcagattcaacagagaggagctgctggacatggcctgggaggagtag

SEQ ID NO: 24820 - DNA, 1899 bp, Artificial Sequence
  Description of Artificial Sequence: Synthetic coding sequence
atgaaccagagcggcaccaaccagagcagcctgagcgacagcaaccaggccggcatcaaccagcccagcaccaacagcctgggcatgaaccagatggacatgaaccagggcagcgccagcctgtacgagatgaaccaggtggacatgaagcagcccagcatgagccaggccggcatgagacagagcggcaccaacctgcccgacatcaaccagcccgacatgaagcagcccgacacctggcagctgggcagaagccagcccggcatgctgcagcaggagctgagccagctggtgctgagcaaggccggcatcagccagcccgaccccagccagcccggccccagccagagcggccccagccagagcagaatgagacagatcggcaccaaccagagcggcatgagccagcccgtgatgcagcagctggacagccagagcggcggcagccagcccagcatgagacaggtgggcaccagccagctgggcaccagccagatcggcatgagccagcccggcacctggcagaccggcctgagccagcccgtgctgagacagcccaacatgagcccccccggcatgtggcagcccggcgtgcagcagcccggcatcagccagcaggtgcccagccaccccgacatgagccagcccggcatgagccagcaggtgcccagccagcccggcatcagacagcccgacaccagccagagctgcaagaaccagaccgacatgagccagcccgacgccaaccagagcagcctgagcgacagcaaccagaccggcatcatccagcccagccccagcctgctgggcatgaaccagatggacatgaaccagtggagcgccagcctgtacgagatgaaccaggtggacatgaagcagcccagcatgagccaggccggcatgagacagagcggcaccaacctgcccgacatcaaccagcccggcatgaagcagcccggcacctggcagctgggcagaagccagcccggcatgtggccccagagcctgagcgagctggtgctgagcgaggccagcatcagccagcccggccccccccagagagcccccagccagagcggccccagacagagcagcaccagccaggccggcaccaaccagagcggcatcagccagcccgtgatgtggcagctggacatgagacagagcggcggcagccagcccagcatgagacaggtgggcaccagccagagcggcaccagccagatcggcatgagccagcccggcacctggcagaccggcctgagccagcccgtgcccagacagcccaacaagagcccccccggcatgtggcagagaggcatgtggcagcccggcatgagccagcaggtgcccagccagctgggcatgagacagcccggcaccagccagagcagcaagaaccagaccggcatgagccaccccggcagaggccagcccggcatctgggagcccggccccagccagcccggcctgagccagcaggacctgaaccagctggtgctgagccagcccggcctgagccagcccggcagaagccagcccagcgtgagccagatgggcatgagacagaccagcatggactacttccagatcagacacgccgaggccggcgactgccccgagatcctgagactgatcaaggagctggccgcctgcgagaacatgctggacgccatggagctgaccgccgccgacctgctgagagacggcttcggcgacaaccccctgttctactgcctgatcgccgaggtgaacgaccagcagaagcccagcggcaagctgaccgtgggcttcgccatgtactacttcacctacgacagctggaccggcaaggtgctgtacctggaggacttctacgtgacccaggcctaccaggacagccaccacaacagcatgtag

SEQ ID NO: 24821 - DNA, 192 bp, Artificial Sequence
  Description of Artificial Sequence: Synthetic coding sequence
atgaccagaatcaagatcagcgtgtgcatctgcttcagatacttcgagttctgcttcttctacgccctgaacatcctgttccagaaggtgagcgaggccaacagccagaccgagctgctgctgagaccccactgcaagaacatcctgttcaacgtgagcttcatgatcgacctgcaggccgcccacttctag

SEQ ID NO: 24822 - DNA, 1062 bp, Artificial Sequence
  Description of Artificial Sequence: Synthetic coding sequence
atgggcagcctgtacagcgagtacctgaaccccaacaaggtgcaggagcactacaactacaccaaggagaccctggagacccaggagaccaccagcagacaggtggccagcgccttcatcgtgatcctgtgctgcgccatcgtggtggagaacctgctggtgctgatcgccgtggccagaaacagcaagttccacagcgccatgtacctgttcctgggcaacctggccgccagcgacctgctggccggcgtggccttcgtggccaacaccctgctgagcggcagcgtgaccctgagactgacccccgtgcagtggttcgccagagagggcagcgccttcatcaccctgagcgccagcgtgttcagcctgctggccatcgccatcgagagacacgtggccatcgccaaggtgaagctgtacggcagcgacaagagctgcagaatgctgctgctgatcggcgccagctggctgatcagcctggtgctgggcggcctgcccatcctgggctggaactgcctgggccacctggaggcctgcagcaccgtgctgcccctgtacgccaagcactacgtgctgtgcgtggtgaccatcttcagcatcatcctgctggccatcgtggccctgtacgtgagaatctactgcgtggtgagaagcagccacgccgacatggccgccccccagaccctggccctgctgaagaccgtgaccatcgtgctgggcgtgttcatcgtgtgctggctgcccgccttcagcatcctgctgctggactacgcctgccccgtgcacagctgccccatcctgtacaaggcccactacttcttcgccgtgagcaccctgaacagcctgctgaaccccgtgatctacacctggagaagcagagacctgagaagagaggtgctgagacccctgcagtgctggagacccggcgtgggcgtgcagggcagaagaagaggcggcacccccggccaccacctgctgcccctgagaagcagcagcagcctggagagaggcatgcacatgcccaccagccccaccttcctggagggcaacaccgtggtgtag

SEQ ID NO: 24823 - DNA, 789 bp, Artificial Sequence
  Description of Artificial Sequence: Synthetic coding sequence
atgctggccctggaggccgcccagctggacggcccccacttcagctgcctgtaccccgacggcgtgttctacgacctggacagctgcaagcacagcagctaccccgacagcgagggcgcccccgacagcctgtgggactggaccgtggccccccccgtgcccgccaccccctacgaggccttcgaccccgccgccgccgccttcagccacccccaggccgcccagctgtgctacgagccccccacctacagccccgccggcaacctggagctggcccccagcctggaggcccccggccccggcctgcccgcctaccccaccgagaacttcgccagccagaccctggtgccccccgcctacgccccctaccccagccccgtgctgagcgaggaggaggacctgcccctggacagccccgccctggaggtgagcgacagcgagagcgacgaggccctggtggccggccccgagggcaagggcagcgaggccggcaccagaaagaagctgagactgtaccagttcctgctgggcctgctgaccagaggcgacatgagagagtgcgtgtggtgggtggagcccggcgccggcgtgttccagttcagcagcaagcacaaggagctgctggccagaagatggggccagcagaagggcaacagaaagagaatgacctaccagaagctggccagagccctgagaaactacgccaagaccggcgagatcagaaaggtgaagagaaagctgacctaccagttcgacagcgccctgctgcccgccgtgagaagagcctag

SEQ ID NO: 24824 - DNA, 768 bp, Artificial Sequence
  Description of Artificial Sequence: Synthetic coding sequence
atggccagcagcgacctggagcagctgtgcagccacgtgaacgagaagatcggcaacatcaagaagaccctgagcctgagaaactgcggccaggagcccaccctgaagaccgtgctgaacaagatcggcgacgagatcatcgtgatcaacgagctgctgaacaagctggagctggagatccagtaccaggagcagaccaacaacagcctgaaggagctgtgcgagagcctggaggaggactacaaggacatcgagcacctgaaggagaacgtgcccagccacctgccccaggtgaccgtgacccagagctgcgtgaagggcagcgacctggaccccgaggagcccatcaaggtggaggagcccgagcccgtgaagaagccccccaaggagcagagaagcatcaaggagatgcccttcatcacctgcgacgagttcaacggcgtgcccagctacatgaagagcagactgacctacaaccagatcaacgacgtgatcaaggagatcaacaaggccgtgatcagcaagtacaagatcctgcaccagcccaagaagagcatgaacagcgtgaccagaaacctgtaccacagattcatcgacgaggagaccaaggacaccaagggcagatacttcatcgtggaggccgacatcaaggagttcaccaccctgaaggccgacaagaagttccacgtgctgctgaacatcctgagacactgcagaagactgagcgaggtgagaggcggcggcctgaccagatacgtgatcacctag

SEQ ID NO: 24825 - DNA, 381 bp, Artificial Sequence
  Description of Artificial Sequence: Synthetic coding sequence
atgagcaccatcaacatggaggccgaggtggacaagctggagctgatgttccagaaggccgagagcgacctggactacatccagtacagactggagtacgagatcaagaccaaccaccccgacagcgccagcgagaagaaccccgtgaccctgctgaaggagctgagcgtgatcaagagccagtaccagaccctgtacgccagattcaagcccgtggccgtggagcagaaggagaccaagagcagaatctgcgccggcatgaccaagaccatgaacgtgatccagaagctgcagaagcagaccgacctggacctgagccccctgaccaaggaggagaagaccgccgccgagcagttcaagagccacgtgcccgacctgtag

SEQ ID NO: 24826 - DNA, 777 bp, Artificial Sequence
  Description of Artificial Sequence: Synthetic coding sequence
atgaagacccccaacgcccaggaggccgagggccagcagaccagagccgccgccggcagagccaccggcagcgccaacatgaccaagaagaaggtgagccagaagaagcagagaggcagacccagcagccagcccagaagaaacatcgtgggctgcagaatcagccacggctggaaggagggcgacgagcccatcacccagtggaagggcaccgtgctggaccaggtgcccatcaaccccagcctgtacctggtgaagtacgacggcatcgactgcgtgtacggcctggagctgcacagagacgagagagtgctgagcctgaagatcctgagcgacagagtggccagcagccacatcagcgacgccaacctggccaacaccatcatcggcaaggccgtggagcacatgttcgagggcgagcacggcagcaaggacgagtggagaggcatggtgctggcccaggcccccatcatgaaggcctggttctacatcacctacgagaaggaccccgtgctgtacatgtaccagctgctggacgactacaaggagggcgacctgagaatcatgcccgagagcagcgagagcccccccaccgagagagagcccggcggcgtggtggacggcctgatcggcaagcacgtggagtacaccaaggaggacggcagcaagagaatcggcatggtgatccaccaggtggagaccaagcccagcgtgtacttcatcaagttcgacgacgacttccacatctacgtgtacgacctggtgaagaagagctag

SEQ ID NO: 24827 - DNA, 777 bp, Artificial Sequence; identical to SEQ ID NO: 24826
  Description of Artificial Sequence: Synthetic coding sequence

SEQ ID NO: 24828 - DNA, 234 bp, Artificial Sequence
  Description of Artificial Sequence: Synthetic coding sequence
atgaagacccccttcggcaaggccgccgccggccagagaagcagaaccggcgccggccacggcagcgtgagcgtgaccatgatcaagagaaaggccgcccacaagaagcacagaagcagacccaccagccagcccagaggcaacatcgtgggctgcagaatccagcacggctggaaggacggcgacgagcccctgacccagtggaagggcaccgtgctggaccagctgctgtag

SEQ ID NO: 24829 - DNA, 777 bp, Artificial Sequence
  Description of Artificial Sequence: Synthetic coding sequence
atgaagacccccttcggcaaggccgccgccggccagagaagcagaaccggcgccggccacggcagcgtgagcgtgaccatgatcaagagaaaggccgcccacaagaagcacagaagcagacccaccagccagcccagaggcaacatcgtgggctgcagaatccagcacggctggaaggacggcgacgagcccctgacccagtggaagggcaccgtgctggaccaggtgcccgtgaaccccagcctgtacctgatcaagtacgacggcttcgactgcgtgtacggcctggagctgcacagagacgagagagtgagcagcctggaggtgctgcccaacagagtggccagcagcagaatcagcgacacccacctggccgagatcatggtgggcaaggccgtggagcacatcttcgagaccgaggagggcagcaagaacgagtggagaggcatggtgctggcccaggcccccgtgatgaacacctggttctacatcacctacgagaaggaccccgtgctgtacatgtaccagctgctggacgactacaaggacggcgacctgagaatcctgcaggacagcaacgacagccccctggccgagagagagcccggcgaggtgatcgacagcctggtgggcaagcaggtggagtacgccaaggacgacggcagcaagagaaccggcatggtgatccaccaggtggaggccaagcccagcgtgtacttcatcaagttcgacgacgacttccacatctacgtgtacgacctggtgaagaccagctag

SEQ ID NO: 24830 - DNA, 750 bp, Artificial Sequence
  Description of Artificial Sequence: Synthetic coding sequence
atgagcccccccaccgtgccccccatgggcgtggacggcgtgagcgcctacctgatgaagaagagacacacccacagaaagcagagaagaaagcccaccttcctgaccagaagaaacatcgtgggctgcagaatccagcacggctggaaggagggcaacgagcccgtggagcagtggaagggcaccgtgctggagcaggtgagcgtgaagcccaccctgtacatcatcaagtacgacggcaaggacagcgtgtacggcctggagctgcacagagacaagagagtgctggccctggagatcctgcccgagagagtgcccacccccagaatcgacagcagactggccgacagcctgatcggcaaggccgtggagcacgtgttcgagggcgagcacggcaccaaggacgagtggaagggcatggtgctggccagagcccccgtgatggacacctggttctacatcacctacgagaaggaccccgtgctgtacatgtacaccctgctggacgactacaaggacggcgacctgagaatcatccccgacagcaactactacttccccaccgccgagcaggagcccggcgaggtggtggacagcctggtgggcaagcaggtggagcacgccaaggacgacggcagcaagagaaccggcatcttcatccaccaggtggtggccaagcccagcgtgtacttcatcaagttcgacgacgacatccacatctacgtgtacggcctggtgaagaccccctag

SEQ ID NO: 24831 - DNA, 696 bp, Artificial Sequence
  Description of Artificial Sequence: Synthetic coding sequence
atgaagaagagacacacccacagaaagcagagaagaaagcccaccttcctgaccagaagaaacatcgtgggctgcagaatccagcacggctggaaggagggcaacgagcccgtggagcagtggaagggcaccgtgctggagcaggtgagcgtgaagcccaccctgtacatcatcaagtacgacggcaaggacagcgtgtacggcctggagctgcacagagacaagagagtgctggccctggagatcctgcccgagagagtgcccacccccagaatcgacagcagactggccgacagcctgatcggcaaggccgtggagcacgtgttcgagggcgagcacggcaccaaggacgagtggaagggcatggtgctggccagagcccccgtgatggacacctggttctacatcacctacgagaaggaccccgtgctgtacatgtacaccctgctggacgactacaaggacggcgacctgagaatcatccccgacagcaactactacttccccaccgccgagcaggagcccggcgaggtggtggacagcctggtgggcaagcaggtggagcacgccaaggacgacggcagcaagagaaccggcatcttcatccaccaggtggtggccaagcccagcgtgtacttcatcaagttcgacgacgacatccacatctacgtgtacggcctggtgaagaccccctag

SEQ ID NO: 24832 - DNA, 792 bp, Artificial Sequence
  Description of Artificial Sequence: Synthetic coding sequence
atgggccagaccgccctggccggcggcagcagcagcacccccaccccccaggccctgtaccccgacctgagctgccccgagggcctggaggagctgctgagcgcccccccccccgacctgggcgcccagagaagacacggctggaaccccaaggactgcagcgagaacatcgaggtgaaggagggcggcctgtacttcgagagaagacccgtggcccagagcaccgacggcgccagaggcaagagaggctacagcagaggcctgcacgcctgggagatcagctggcccctggagcagagaggcacccacgccgtggtgggcgtggccaccgccctggcccccctgcagaccgaccactacgccgccctgctgggcagcaacagcgagagctggggctgggacatcggcagaggcaagctgtaccaccagagcaagggccccggcgccccccagtaccccgccggcacccagggcgagcagctggaggtgcccgagagactgctggtggtgctggacatggaggagggcaccctgggctacgccatcggcggcacctacctgggccccgccttcagaggcctgaagggcagaaccctgtaccccgccgtgagcgccgtgtggggccagtgccaggtgagaatcagatacctgggcgagagaagagccgagccccacagcctgctgcacctgagcagactgtgcgtgagacacaacctgggcgacaccagactgggccaggtgagcgccctgcccctgccccccgccatgaagagatacctgctgtaccagtag

SEQ ID NO: 24833 - DNA, 792 bp, Artificial Sequence; identical to SEQ ID NO: 24832
  Description of Artificial Sequence: Synthetic coding sequence

SEQ ID NO: 24834 - DNA, 2424 bp, Artificial Sequence
  Description of Artificial Sequence: Synthetic coding sequence
atgagactgagccccgcccccctgaagctgagcagaacccccgccctgctggccctggccctgcccctggccgccgccctggccttcagcgacgagaccctggacaaggtgcccaagagcgagggctactgcagcagaatcctgagagcccagggcaccagaagagagggctacaccgagttcagcctgagagtggagggcgaccccgacttctacaagcccggcaccagctacagagtgaccctgagcgccgccccccccagctacttcagaggcttcaccctgatcgccctgagagagaacagagagggcgacaaggaggaggaccacgccggcaccttccagatcatcgacgaggaggagacccagttcatgagcaactgccccgtggccgtgaccgagagcacccccagaagaagaaccagaatccaggtgttctggatcgccccccccgccggcaccggctgcgtgatcctgaaggccagcatcgtgcagaagagaatcatctacttccaggacgagggcagcctgaccaagaagctgtgcgagcaggacagcaccttcgacggcgtgaccgacaagcccatcctggactgctgcgcctgcggcaccgccaagtacagactgaccttctacggcaactggagcgagaagacccaccccaaggactaccccagaagagccaaccactggagcgccatcatcggcggcagccacagcaagaactacgtgctgtgggagtacggcggctacgccagcgagggcgtgaagcaggtggccgagctgggcagccccgtgaagatggaggaggagatcagacagcagagcgacgaggtgctgaccgtgatcaaggccaaggcccagtggcccgcctggcagcccctgaacgtgagagccgcccccagcgccgagttcagcgtggacagaaccagacacctgatgagcttcctgaccatgatgggccccagccccgactggaacgtgggcctgagcgccgaggacctgtgcaccaaggagtgcggctgggtgcagaaggtggtgcaggacctgatcccctgggacgccggcaccgacagcggcgtgacctacgagagccccaacaagcccaccatcccccaggagaagatcagacccctgaccagcctggaccacccccagagccccttctacgaccccgagggcggcagcatcacccaggtggccagagtggtgatcgagagaatcgccagaaagggcgagcagtgcaacatcgtgcccgacaacgtggacgacatcgtggccgacctggcccccgaggagaaggacgaggacgacacccccgagacctgcatctacagcaactggagcccctggagcgcctgcagcagcagcacctgcgacaagggcaagagaatgagacagagaatgctgaaggcccagctggacctgagcgtgccctgccccgacacccaggacttccagccctgcatgggccccggctgcagcgacgaggacggcagcacctgcaccatgagcgagtggatcacctggagcccctgcagcatcagctgcggcatgggcatgagaagcagagagagatacgtgaagcagttccccgaggacggcagcgtgtgcaccctgcccaccgaggagaccgagaagtgcaccgtgaacgaggagtgcagccccagcagctgcctgatgaccgagtggggcgagtgggacgagtgcagcgccacctgcggcatgggcatgaagaagagacacagaatgatcaagatgaaccccgccgacggcagcatgtgcaaggccgagaccagccaggccgagaagtgcatgatgcccgagtgccacaccatcccctgcctgctgagcccctggagcgagtggagcgactgcagcgtgacctgcggcaagggcatgagaaccagacagagaatgctgaagagcctggccgagctgggcgactgcaacgaggacctggagcaggtggagaagtgcatgctgcccgagtgccccatcgactgcgagctgaccgagtggagccagtggagcgagtgcaacaagagctgcggcaagggccacgtgatcagaaccagaatgatccagatggagccccagttcggcggcgccccctgccccgagaccgtgcagagaaagaagtgcagaatcagaaagtgcctgagaaaccccagcatccagaagctgagatggagagaggccagagagagcagaagaagcgagcagctgaaggaggagagcgagggcgagcagttccccggctgcagaatgagaccctggaccgcctggagcgagtgcaccaagctgtgcggcggcggcatccaggagagatacatgaccgtgaagaagagattcaagagcagccagttcaccagctgcaaggacaagaaggagatcagagcctgcaacgtgcacccctgctag

SEQ ID NO: 24835 - DNA, 1329 bp, Artificial Sequence
  Description of Artificial Sequence: Synthetic coding sequence
atgagaagaaccagaagacccagattcgtgctgatgaacaagatggacgacctgaacctgcactacagattcctgaactggagaagaagaatcagagagatcagagaggtgagagccttcagataccaggagagattcaagcacatcctggtggacggcgacaccctgagctaccacggcaacagcggcgaggtgggctgctacgtggccagcagacccctgaccaaggacagcaactacttcgaggtgagcatcgtggacagcggcgtgagaggcaccatcgccgtgggcctggtgccccagtactacagcctggaccaccagcccggctggctgcccgacagcgtggcctaccacgccgacgacggcaagctgtacaacggcagagccaagggcagacagttcggcagcaagtgcaacagcggcgacagaatcggctgcggcatcgagcccgtgagcttcgacgtgcagaccgcccagatcttcttcaccaagaacggcaagagagtgggcagcaccatcatgcccatgagccccgacggcctgttccccgccgtgggcatgcacagcctgggcgaggaggtgagactgcacctgaacgccgagctgggcagagaggacgacagcgtgatgatggtggacagctacgaggacgagtggggcagactgcacgacgtgagagtgtgcggcaccctgctggagtacctgggcaagggcaagagcatcgtggacgtgggcctggcccaggccagacaccccctgagcaccagaagccactacttcgaggtggagatcgtggaccccggcgagaagtgctacatcgccctgggcctggccagaaaggactaccccaagaacagacaccccggctggagcagaggcagcgtggcctaccacgccgacgacggcaagatcttccacggcagcggcgtgggcgaccccttcggccccagatgctacaagggcgacatcatgggctgcggcatcatgttccccagagactacatcctggacagcgagggcgacagcgacgacagctgcgacaccgtgatcctgagccccaccgccagagccgtgagaaacgtgagaaacgtgatgtacctgcaccaggagggcgaggaggaggaggaggaggaggaggaggaggaggacggcgaggagatcgagcccgagcacgagggcagaaaggtggtggtgttcttcaccagaaacggcaagatcatcggcaagaaggacgccgtggtgcccagcggcggcttcttccccaccatcggcatgctgagctgcggcgagaaggtgaaggtggacctgcaccccctgagcggctag

SEQ ID NO: 24836 - DNA, 1359 bp, Artificial Sequence
  Description of Artificial Sequence: Synthetic coding sequence
atgaacagcggcatcctgcaggtgttccagagagccctgacctgccccatctgcatgaactacttcctggaccccgtgaccatcgactgcggccacagcttctgcagaccctgcctgtacctgaactggcaggacaccgccgtgctggcccagtgcagcgagtgcaagaagaccaccagacagagaaacctgaacaccgacatctgcctgaagaacatggccttcatcgccagaaaggccagcctgagacagttcctgagcagcgaggagcagatctgcggcatgcacagagagaccaagaagatgttctgcgaggtggacaagagcctgctgtgcctgccctgcagcaacagccaggagcacagaaaccacatccactgccccatcgagtgggccgccgaggagagaagagaggagctgctgaagaagatgcagagcctgtgggagaaggcctgcgagaacctgagaaacctgaacatggagaccaccagaaccagatgctggaaggactacgtgagcctgagaatcgaggccatcagagccgagtaccagaagatgcccgccttcctgcacgaggaggagcagcaccacctggagagactgagaaaggagggcgaggacatcttccagcagctgaacgagagcaaggccagaatggagcacagcagagagctgctgagaggcatgtacgaggacctgaagcagatgtgccacaaggccgacgtggagctgctgcaggccttcggcgacatcctgcacagatacgagagcctgctgctgcaggtgagcgagcccgtgaaccccgagctgagcgccggccccatcaccggcctgctggacagcctgagcggcttcagagtggacttcaccctgcagcccgagagagccaacagccacatcttcctgtgcggcgacctgagaagcatgaacgtgggctgcgacccccaggacgaccccgacatcaccggcaagagcgagtgcttcctggtgtggggcgcccaggccttcaccagcggcaagtactactgggaggtgcacatgggcgacagctggaactgggccttcggcgtgtgcaacaactactggaaggagaagagacagaacgacaagatcgacggcgaggagggcctgttcctgctgggctgcgtgaaggaggacacccactgcagcctgttcaccaccagccccctggtggtgcagtacgtgcccagacccaccagcaccgtgggcctgttcctggactgcgagggcagaaccgtgagcttcgtggacgtggaccagagcagcctgatctacaccatccccaactgcagcttcagcccccccctgagacccatcttctgctgcagccacttctag

SEQ ID NO: 24837 - DNA, 591 bp, Artificial Sequence
  Description of Artificial Sequence: Synthetic coding sequence
atggccaccagcgtgctgtgctgcctgagatgctgcagagacggcggcaccggccacatccccctgaaggagatgcccgccgtgcagctggacacccagcacatgggcaccgacgtggtgatcgtgaagaacggcagaagaatctgcggcaccggcggctgcctggccagcgcccccctgcaccagaacaagagctacttcgagttcaagatccagagcaccggcatctggggcatcggcgtggccacccagaaggtgaacctgaaccagatccccctgggcagagacatgcacagcctggtgatgagaaacgacggcgccctgtaccacaacaacgaggagaagaacagactgcccgccaacagcctgccccaggagggcgacgtggtgggcatcacctacgaccacgtggagctgaacgtgtacctgaacggcaagaacatgcactgccccgccagcggcatcagaggcaccgtgtaccccgtggtgtacgtggacgacagcgccatcctggactgccagttcagcgagttctaccacacccccccccccggcttcgagaagatcctgttcgagcagcagatcttctag

SEQ ID NO: 24838 - DNA, 474 bp, Artificial Sequence
  Description of Artificial Sequence: Synthetic coding sequence
atggccaccagcgtgctgtgctgcctgagatgctgcagagacggcggcaccggccacatccccctgaaggagatgcccgccgtgcagctggacacccagcacatgggcatctggggcatcggcgtggccacccagaaggtgaacctgaaccagatccccctgggcagagacatgcacagcctggtgatgagaaacgacggcgccctgtaccacaacaacgaggagaagaacagactgcccgccaacagcctgccccaggagggcgacgtggtgggcatcacctacgaccacgtggagctgaacgtgtacctgaacggcaagaacatgcactgccccgccagcggcatcagaggcaccgtgtaccccgtggtgtacgtggacgacagcgccatcctggactgccagttcagcgagttctaccacacccccccccccggcttcgagaagatcctgttcgagcagcagatcttctag

SEQ ID NO: 24839 - DNA, 1059 bp, Artificial Sequence
  Description of Artificial Sequence: Synthetic coding sequence
atggacttcagagagatcctgatgatcgccagcaagggccagggcgtgaacaacgtgcccaagagatacagcctggccgtgggcccccccaagaaggaccccaaggtgaagggcgtgcagagcgccgccgtgcaggccttcctgaagagaaaggaggaggagctgagaagaaaggccctggaggagaagagaagaaaggaggagctggtgaagaagagaatcgagctgaagcacgacaagaaggccagagccatggccaagagaaccaaggacaacttccacggctacaacggcatccccatcgaggagaagagcaagaagagacaggccaccgagagccacaccagccagggcaccgacagagagtacgagatggaggaggagaacgagttcctggagtacaaccacgccgagagcgagcaggagtacgaggaggagcaggagccccccaaggtggagagcaagcccaaggtgcccctgaagagcgcccccccccccatgaacttcaccgacctgctgagactggccgagaagaagcagttcgagcccgtggagatcaaggtggtgaagaagagcgaggagagacccatgaccgccgaggagctgagagagagagagttcctggagagaaagcacagaagaaagaagctggagaccgacggcaagctgccccccaccgtgagcaagaaggcccccagccagaaggagagcgtgggcaccaagctgagcaagggcagcggcgacagacaccccagcagcaagggcatgcccctgccccacgccgagaagaagagcagacccagcatggccaacgagaagcacctggccctgagcagcagcaagagcatgcccggcgagagaatcaaggccggcagcggcaacagcagccagcccagcctgagagagggccacgacaagcccgtgttcaacggcgccggcaagccccacagcagcaccagcagccccaagcacgtgtggaaggagaacaagtacatgaagagagactggctgttctacttccagtgcatcgagtacatcagactgctgttcatcttctag

SEQ ID NO: 24840 - DNA, 2058 bp, Artificial Sequence
  Description of Artificial Sequence: Synthetic coding sequence
atggacttcagagagatcctgatgatcgccagcaagggccagggcgtgaacaacgtgcccaagagatacagcctggccgtgggcccccccaagaaggaccccaaggtgaagggcgtgcagagcgccgccgtgcaggccttcctgaagagaaaggaggaggagctgagaagaaaggccctggaggagaagagaagaaaggaggagctggtgaagaagagaatcgagctgaagcacgacaagaaggccagagccatggccaagagaaccaaggacaacttccacggctacaacggcatccccatcgaggagaagagcaagaagagacaggccaccgagagccacaccagccagggcaccgacagagagtacgagatggaggaggagaacgagttcctggagtacaaccacgccgagagcgagcaggagtacgaggaggagcaggagccccccaaggtggagagcaagcccaaggtgcccctgaagagcgcccccccccccatgaacttcaccgacctgctgagactggccgagaagaagcagttcgagcccgtggagatcaaggtggtgaagaagagcgaggagagacccatgaccgccgaggagctgagagagagagagttcctggagagaaagcacagaagaaagaagctggagaccgacggcaagctgccccccaccgtgagcaagaaggcccccagccagaaggagagcgtgggcaccaagctgagcaagggcagcggcgacagacaccccagcagcaagggcatgcccctgccccacgccgagaagaagagcagacccagcatggccaacgagaagcacctggccctgagcagcagcaagagcatgcccggcgagagaatcaaggccggcagcggcaacagcagccagcccagcctgagagagggccacgacaagcccgtgttcaacggcgccggcaagccccacagcagcaccagcagccccagcgtgcccaagaccagcgccagcagaacccagaagagcgccgtggagcacaaggccaagaagagcctgagccaccccagccacagcagacccggccccatggtgaccccccacaacaaggccaagagccccggcgtgagacagcccggcagcagcagcagcagcgcccccggccagcccagcaccggcgtggccagacccaccgtgagcagcggccccgtgcccagaagacagaacggcagcagcagcagcggccccgagagaagcatcagcggcagcaagaagcccaccaacgacagcaaccccagcagaagaaccgtgagcggcacctgcggccccggccagcccgccagcagcagcggcggccccggcagacccatcagcggcagcgtgagcagcgccagacccctgggcagcagcagaggccccggcagacccgtgagcagcccccacgagctgagaagacccgtgagcggcctgggcccccccggcagaagcgtgagcggccccggcagaagcatcagcggcagcatccccgccggcagaaccgtgagcaacagcgtgcccggcagacccgtgagcagcctgggccccggccagaccgtgagcagcagcggccccaccatcaagcccaagtgcaccgtggtgagcgagaccatcagcagcaagaacatcatcagcagaagcagcaacggccagatgaacggcatgaagccccccctgagcggctacagagccgcccagggcccccagagactgcccttccccaccggctacaagagacagagagagtacgaggaggaggacgacgacgacgacgagtacgacagcgagatggaggacttcatcgaggacgagggcgagccccaggaggagatcagcaagcacatcagagagatcttcggctacgacagaaagaagtacaaggacgagagcgactacgccctgagatacatggagagcagctggaaggagcagcagaaggaggaggccaagagcctgagactgggcatgcaggaggacctggaggagatgagaagagaggaggaggagatgcagagaagaagagccaagaagctgaagagaagatag

SEQ ID NO: 24841 - DNA, 1488 bp, Artificial Sequence
  Description of Artificial Sequence: Synthetic coding sequence
atgcagtggagccccacccccggcgccagcgcctgcctgggctgggccagcagcctggcctgcagcaccgcccccaccctgctgggcagagccggcagaggccccctgatggccgccaagtggttcaaggagttccccctgaacctgaagaccgtgagcgagagagccaagcccggcggcggcggcggcaagctgagaaagaacagcgaggccggcggcgccggccccggccccggcaagggcagaaagaacagcgccgccgagctgggcagcggcagagccggcgtgggccccaaggacagcagactgagcagagacagcctgcagggcctgatccaggccgccgccggcaagggcagaaagaacagcagagccaccgaggaggagccccacagaggcgccaccaagagcagcggctgcagcacctacatcaacagactgatcaaggtggacacccaggagaagaacggcaagagcaactaccccagcagcagcagcagcagcagcagcagcagcagcagcgccagcagcagccccagcagcctgggccccgagctggacaagggcaagatcatcaagcagcaggagaccgtgatcatcctggaggactacgccgacccctacgacgccaagagaaccaagggccagagagacgccgagagagtgggcgagaacgacggctacatggagccctacgacgcccagcagatgatcaccgagatcagaagaagaggcagcaaggaccccctggtgaaggccctgcagctgctggacagcccctgcgagcccgccgacggcggcctgaagagcgagaccctggccaagagaagaagcagcaaggacctgctgggcaagcccccccagctgtacgacaccccctacgagcccgccgagggcggccccagagccgagggcaaggccagaccccccgacagcagactgcccgagaacgacgagagacccgccgccgagtacgagcagccctgggagtggaagaaggagcagatcgtgagagccctgagcgtgcagttcgagggcgccgagagacccagcttcagagaggagaccgtgagacagcaccacagacagaagagctggacccagaagatcctgaagcccgccctgagcgaccacagcgagggcgagaaggtggaccccggcctgcccctggagaagcagccctggtaccacggcgccatcagcagagccgaggccgagagcagactgcagccctgcaaggaggccggctacctggtgagaaacagcgagagcggcaacagcagatacagcatcgccctgaagaccagccagggctgcgtgcacatcatcgtggcccagaccaaggacaacaagtacaccctgaaccagaccagcgccgtgttcgacagcatccccgaggtggtgcactactacagcaacgagaagctgcccttcaagggcgccgagcacatgaccctgctgtaccccgtgcacagcaagctgcactag

SEQ ID NO: 24842 - DNA, 1272 bp, Artificial Sequence
  Description of Artificial Sequence: Synthetic coding sequence
atgcagcaggagggcggccccgtgagaagcgccccctgcagaaccggcaccctggagggcagcagacagggcagccccggccacagaaagagagccagccccaagggcagcctgagcagcgcccagccccacagctggatgctgacccccagccccctgaacagccactgcgcccacagagagcccatcagcagcagcccccagcccgtggccaacggccccaagcagaagaagaagagcaactggagaagcaccaccagactgagaatcatcagactgagagacagactggagcccagacccctggccatcctggaggactacgccgaccccttcgacgtgcaggagaccggcgagggcagcgccggcgccagcggcgcccccgagaaggtgcccgagaacgacggctacatggagccctacgaggcccagaagatgatggccgagatcagaggcagcaaggagaccgccacccagcccctgcccctgtacgacaccccctacgagcccgaggaggacggcgccaccgccgagggcgagggcgccccctggcccagagagagcagactgcccgaggacgacgagagaccccccgaggagtacgaccagccctgggagtggaagaaggagagaatcagcaaggccttcgccgtggacatcaaggtgatcaaggacctgccctggcccccccccgtgggccagctggacagcagccccagcctgcccgacggcgacagagacatcagcggccccgccagccccctgcccgagcccagcctggaggacagcagcgcccagttcgagggccccgagaagagctgcctgagccccggcagagaggagaagggcagactgccccccagactgagcgccggcaaccccaagagcgccaagcccctgagcatggagcccagcagccccctgggcgagtggaccgaccccgccctgcccctggagaaccaggtgtggtaccacggcgccatcagcagaaccgacgccgagaacctgctgagactgtgcaaggaggccagctacctggtgagaaacagcgagaccagcaagaacgacttcagcctgagcctgaagagcagccagggcttcatgcacatgaagctgagcagaaccaaggagcacaagtacgtgctgggccagaacagcccccccttcagcagcgtgcccgagatcgtgcaccactacgccagcagaaagctgcccatcaagggcgccgagcacatgagcctgctgtaccccgtggccatcagaaccctgtag

SEQ ID NO: 24843 - DNA, 1302 bp, Artificial Sequence
  Description of Artificial Sequence: Synthetic coding sequence
atggtggcccagagcctgagcgacgcccaccacgccctgaccatcatgctgagcgagagactgtggctgggcctggagctgctgaacttcaccagaagaaagatcagcagcgacccccccccctacaacttcctggaggccagagaggccgccctgggccacagatggagaatgcagcaggagggcggccccgtgagaagcgccccctgcagaaccggcaccctggagggcagcagacagggcagccccggccacagaaagagagccagccccaagggcagcctgagcagcgcccagccccacagctggatgctgacccccagccccctgaacagccactgcgcccacagagagcccatcagcagcagcccccagcccgtggccaacggccccaagcagaagaagaagagcaactggagaagcaccaccagactgagaatcatcagactgagagacagactggagcccagacccctggccatcctggaggactacgccgaccccttcgacgtgcaggagaccggcgagggcagcgccggcgccagcggcgcccccgagaaggtgcccgagaacgacggctacatggagccctacgaggcccagaagatgatggccgagatcagaggcagcaaggagaccgccacccagcccctgcccctgtacgacaccccctacgagcccgaggaggacggcgccaccgccgagggcgagggcgccccctggcccagagagagcagactgcccgaggacgacgagagaccccccgaggagtacgaccagccctgggagtggaagaaggagagaatcagcaaggccttcgccgcccagttcgagggccccgagaagagctgcctgagccccggcagagaggagaagggcagactgccccccagactgagcgccggcaaccccaagagcgccaagcccctgagcatggagcccagcagccccctgggcgagtggaccgaccccgccctgcccctggagaaccaggtgtggtaccacggcgccatcagcagaaccgacgccgagaacctgctgagactgtgcaaggaggccagctacctggtgagaaacagcgagaccagcaagaacgacttcagcctgagcctgaagagcagccagggcttcatgcacatgaagctgagcagaaccaaggagcacaagtacgtgctgggccagaacagcccccccttcagcagcgtgcccgagatcgtgcaccactacgccagcagaaagctgcccatcaagggcgccgagcacatgagcctgctgtaccccgtggccatcagaaccctgtag

SEQ ID NO: 24844 - DNA, 1110 bp, Artificial Sequence
  Description of Artificial Sequence: Synthetic coding sequence
atgcagcaggagggcggccccgtgagaagcgccccctgcagaaccggcaccctggagggcagcagacagggcagccccggccacagaaagagagccagccccaagggcagcctgagcagcgcccagccccacagctggatgctgacccccagccccctgaacagccactgcgcccacagagagcccatcagcagcagcccccagcccgtggccaacggccccaagcagaagaagaagagcaactggagaagcaccaccagactgagaatcatcagactgagagacagactggagcccagacccctggccatcctggaggactacgccgaccccttcgacgtgcaggagaccggcgagggcagcgccggcgccagcggcgcccccgagaaggtgcccgagaacgacggctacatggagccctacgaggcccagaagatgatggccgagatcagaggcagcaaggagaccgccacccagcccctgcccctgtacgacaccccctacgagcccgaggaggacggcgccaccgccgagggcgagggcgccccctggcccagagagagcagactgcccgaggacgacgagagaccccccgaggagtacgaccagccctgggagtggaagaaggagagaatcagcaaggccttcgccgtggacatcaaggtgatcaaggacctgccctggcccccccccgtgggccagctggacagcagccccagcctgcccgacggcgacagagacatcagcggccccgccagccccctgcccgagcccagcctggaggacagcagcgcccagttcgagggccccgagaagagctgcctgagccccggcagagaggagaagggcagactgccccccagactgagcgccggcaaccccaagagcgccaagcccctgagcatggagcccagcagccccctgggcgagtggaccgaccccgccctgcccctggagaaccaggtgtggtaccacggcgccatcagcagaaccgacgccgagaacctgagcggctgcgccaagagacccgccacctggtgcgccaccgtgagacccgccagaatgaccagccccagccccagcagagccgccagagacagctgcacctag

SEQ ID NO: 24845 - DNA, 1101 bp, Artificial Sequence
  Description of Artificial Sequence: Synthetic coding sequence
atgctgctgagcggcgccccccccgccgccccccccgcccccccccccgacatcctggccgcctacagactgcagagagagagagacttcgaggacccctacagcggcggcagcagcggcagcgccgccctggccacccccgtggcccccggccccacccccccccccagacacggcagccccccccacagactgatcagagtggagacccccggcccccccgccccccccgccgacgagagaatcagcggcccccccgccagcagcgacagactggccatcctggaggactacgccgaccccttcgacgtgcaggagaccggcgagggcagcgccggcgccagcggcgcccccgagaaggtgcccgagaacgacggctacatggagccctacgaggcccagaagatgatggccgagatcagaggcagcaaggagaccgccacccagcccctgcccctgtacgacaccccctacgagcccgaggaggacggcgccaccgccgagggcgagggcgccccctggcccagagagagcagactgcccgaggacgacgagagaccccccgaggagtacgaccagccctgggagtggaagaaggagagaatcagcaaggccttcgccgcccagttcgagggccccgagaagagctgcctgagccccggcagagaggagaagggcagactgccccccagactgagcgccggcaaccccaagagcgccaagcccctgagcatggagcccagcagccccctgggcgagtggaccgaccccgccctgcccctggagaaccaggtgtggtaccacggcgccatcagcagaaccgacgccgagaacctgctgagactgtgcaaggaggccagctacctggtgagaaacagcgagaccagcaagaacgacttcagcctgagcctgaagagcagccagggcttcatgcacatgaagctgagcagaaccaaggagcacaagtacgtgctgggccagaacagcccccccttcagcagcgtgcccgagatcgtgcaccactacgccagcagaaagctgcccatcaagggcgccgagcacatgagcctgctgtaccccgtggccatcagaaccctgtag

SEQ ID NO: 24846 - DNA, 690 bp, Artificial Sequence
  Description of Artificial Sequence: Synthetic coding sequence
atgaccccccagctgctgctggccctggtgctgtgggccagctgccccccctgcagcggcagaaagggcccccccgccgccctgaccctgcccagagtgcagtgcagagccagcagataccccatcgccgtggactgcagctggaccctgccccccgcccccaacagcaccagccccgtgagcttcatcgccacctacagactgggcatggccgccagaggccacagctggccctgcctgcagcagacccccaccagcaccagctgcaccatcaccgacgtgcagctgttcagcatggccccctacgtgctgaacgtgaccgccgtgcacccctggggcagcagcagcagcttcgtgcccttcatcaccgagcacatcatcaagcccgacccccccgagggcgtgagactgagccccctggccgagagacagctgcaggtgcagtgggagccccccggcagctggcccttccccgagatcttcagcctgaagtactggatcagatacaagagacagggcgccgccagattccacagagtgggccccatcgaggccaccagcttcatcctgagagccgtgagacccagagccagatactacgtgcaggtggccgcccaggacctgaccgactacggcgagctgagcgactggagcctgcccgccaccgccaccatgagcctgggcaagtag

SEQ ID NO: 24847 - DNA, 1023 bp, Artificial Sequence
  Description of Artificial Sequence: Synthetic coding sequence
atggccaagtggctgagagactacctgagcttcggcggcagaagaccccccccccagccccccacccccgactacaccgagagcgacatcctgagagcctacagagcccagaagaacctggacttcgaggacccctacgaggacgccgagagcagactggagcccgaccccgccggccccggcgacagcaagaaccccggcgacgccaagtacggcagccccaagcacagactgatcaaggtggaggccgccgacatggccagagccaaggccctgctgggcggccccggcgaggagctggaggccgacaccgagtacctggaccccttcgacgcccagccccaccccgccccccccgacgacggctacatggagccctacgacgcccagtgggtgatgagcgagctgcccggcagaggcgtgcagctgtacgacaccccctacgaggagcaggaccccgagaccgccgacggcccccccagcggccagaagcccagacagagcagaatgccccaggaggacgagagacccgccgacgagtacgaccagccctgggagtggaagaaggaccacatcagcagagccttcgccgtgcagttcgacagccccgagtgggagagaacccccggcagcgccaaggagctgagaagacccccccccagaagcccccagcccgccgagagagtggaccccgccctgcccctggagaagcagccctggttccacggccccctgaacagagccgacgccgagagcctgctgagcctgtgcaaggagggcagctacctggtgagactgagcgagaccaacccccaggactgcagcctgagcctgagaagcagccagggcttcctgcacctgaagttcgccagaaccagagagaaccaggtggtgctgggccagcacagcggccccttccccagcgtgcccgagctggtgctgcactacagcagcagacccctgcccgtgcagggcgccgagcacctggccctgctgtaccccgtggtgacccagaccccctag

SEQ ID NO: 24848 - DNA, 3552 bp, Artificial Sequence
  Description of Artificial Sequence: Synthetic coding sequence
atgggcaacgcccccagccaggaccccgagagaagcagcccccccatgctgagcgccgacgacgccgagtaccccagagagtacagaaccctgggcggcggcggcggcggcggcagcggcggcagaagattcagcaacgtgggcctggtgcacaccagcgagagaagacacaccgtgatcgccgcccagagcctggaggccctgagcggcctgcagaaggccgacgccgacagaaagagagacgccttcatggaccacctgaagagcaagtacccccagcacgccctggccctgagaggccagcaggacagaatgagagagcagcccaactactggagcttcaagaccagaagcagcagacacacccagggcgcccagcccggcctggccgaccaggccgccaagctgagctacgccagcgccgagagcctggagaccatgagcgaggccgagctgcccctgggcttcagcagaatgaacagattcagacagagcctgcccctgagcagaagcgccagccagaccaagctgagaagccccggcgtgctgttcctgcagttcggcgaggagaccagaagagtgcacatcacccacgaggtgagcagcctggacaccctgcacgccctgatcgcccacatgttcccccagaagctgaccatgggcatgctgaagagccccaacaccgccatcctgatcaaggacgaggccagaaacgtgttctacgagctggaggacgtgagagacatccaggacagaagcatcatcaagatctacagaaaggagcccctgtacgccgccttccccggcagccacctgaccaacggcgacctgagaagagagatggtgtacgccagcagagagagcagccccaccagaagactgaacaacctgagccccgccccccacctggccagcggcagccccccccccggcctgcccagcggcctgcccagcggcctgcagagcggcagccccagcagaagcagactgagctacgccggcggcagaccccccagctacgccggcagccccgtgcaccacgccgccgagagactgggcggcgcccccgccgcccagggcgtgagccccagccccagcgccatcctggagagaagagacgtgaagcccgacgaggacctggccagcaaggccggcggcatggtgctggtgaagggcgagggcctgtacgccgacccctacggcctgctgcacgagggcagactgagcctggccgccgccgccggcgaccccttcgcctaccccggcgccggcggcctgtacaagagaggcagcgtgagaagcctgagcacctacagcgccgccgccctgcagagcgacctggaggacagcctgtacaaggccgccggcggcggcggccccctgtacggcgacggctacggcttcagactgccccccagcagcccccagaagctggccgacgtggccgccccccccggcggccccccccccccccacagcccctacagcggcccccccagcagaggcagccccgtgagacagagcttcagaaaggacagcggcagcagcagcgtgttcgccgagagccccggcggcaagaccagaagcgccggcagcgccagcaccgccggcgccccccccagcgagctgttccccggccccggcgagagaagcctggtgggcttcggcccccccgtgcccgccaaggacaccgagaccagagagagaatggaggccatggagaagcagatcgccagcctgaccggcctggtgcagagcgccctgctgagaggcagcgagcccgagacccccagcgagaagatcgagggcagcaacggcgccgccacccccagcgccccctgcggcagcggcggcagaagcagcggcgccacccccgtgagcggcccccccccccccagcgccagcagcacccccgccggccagcccaccgccgtgagcagactgcagatgcagctgcacctgagaggcctgcagaacagcgccagcgacctgagaggccagctgcagcagctgagaaagctgcagctgcagaaccaggagagcgtgagagccctgctgaagagaaccgaggccgagctgagcatgagagtgagcgaggccgccagaagacaggaggaccccctgcagagacagagaaccctggtggaggaggagagactgagatacctgaacgacgaggagctgatcacccagcagctgaacgacctggagaagagcgtggagaagatccagagagacgtgagccacaaccacagactggtgcccggccccgagctggaggagaaggccctggtgctgaagcagctgggcgagaccctgaccgagctgaaggcccacttccccggcctgcagagcaagatgagagtggtgctgagagtggaggtggaggccgtgaagttcctgaaggaggagccccagagactggacggcctgctgaagagatgcagaggcgtgaccgacaccctggcccagatcagaagacaggtggacgagggcgtgtggcccccccccaacaacctgctgagccagagccccaagaaggtgaccgccgagaccgacttcaacaagagcgtggacttcgagatgcccccccccagcccccccctgaacctgcacgagctgagcggccccgccgagggcgccagcctgacccccaagggcggcaaccccaccaagggcctggacacccccggcaagagaagcgtggacaaggccgtgagcgtggaggccgccgagagagactgggaggagaagagagccgccctgacccagtacagcgccaaggacatcaacagactgctggaggagacccaggccgagctgctgaaggccatccccgacctggactgcgccagcaaggcccaccccggccccgcccccacccccgaccacaagccccccaaggccccccacggccagaaggccgcccccagaaccgagcccagcggcagaagaggcagcgacgagctgaccgtgcccagatacagaaccgagaagcccagcaagagcccccccccccccccccccagaagaagcttccccagcagccacggcctgaccaccaccagaaccggcgaggtggtggtgaccagcaagaaggacagcgccttcatcaagaaggccgagagcgaggagctggaggtgcagaagccccaggtgaagctgagaagagccgtgagcgaggtggccagacccgccagcaccccccccatcatggccagcgccatcaaggacgaggacgacgaggacagaatcatcgccgagctggagagcggcggcggcagcgtgccccccatgaaggtggtgacccccggcgccagcagactgaaggccgcccagggccaggccggcagccccgacaagagcaagcacggcaagcagagagccgagtacatgagaatccaggcccagcagcaggccaccaagcccagcaaggagatgagcggcagcaacgagaccagcagccccgtgagcgagaagcccagcgccagcagaaccagcatccccgtgctgaccagcttcggcgccagaaacagcagcatcagcttctag

SEQ ID NO: 24849 - DNA, 3108 bp, Artificial Sequence
  Description of Artificial Sequence: Synthetic coding sequence
atgagcgaggccgagctgcccctgggcttcagcagaatgaacagattcagacagagcctgcccctgagcagaagcgccagccagaccaagctgagaagccccggcgtgctgttcctgcagttcggcgaggagaccagaagagtgcacatcacccacgaggtgagcagcctggacaccctgcacgccctgatcgcccacatgttcccccagaagctgaccatgggcatgctgaagagccccaacaccgccatcctgatcaaggacgaggccagaaacgtgttctacgagctggaggacgtgagagacatccaggacagaagcatcatcaagatctacagaaaggagcccctgtacgccgccttccccggcagccacctgaccaacggcgacctgagaagagagatggtgtacgccagcagagagagcagccccaccagaagactgaacaacctgagccccgccccccacctggccagcggcagccccccccccggcctgcccagcggcctgcccagcggcctgcagagcggcagccccagcagaagcagactgagctacgccggcggcagaccccccagctacgccggcagccccgtgcaccacgccgccgagagactgggcggcgcccccgccgcccagggcgtgagccccagccccagcgccatcctggagagaagagacgtgaagcccgacgaggacctggccagcaaggccggcggcatggtgctggtgaagggcgagggcctgtacgccgacccctacggcctgctgcacgagggcagactgagcctggccgccgccgccggcgaccccttcgcctaccccggcgccggcggcctgtacaagagaggcagcgtgagaagcctgagcacctacagcgccgccgccctgcagagcgacctggaggacagcctgtacaaggccgccggcggcggcggccccctgtacggcgacggctacggcttcagactgccccccagcagcccccagaagctggccgacgtggccgccccccccggcggccccccccccccccacagcccctacagcggcccccccagcagaggcagccccgtgagacagagcttcagaaaggacagcggcagcagcagcgtgttcgccgagagccccggcggcaagaccagaagcgccggcagcgccagcaccgccggcgccccccccagcgagctgttccccggccccggcgagagaagcctggtgggcttcggcccccccgtgcccgccaaggacaccgagaccagagagagaatggaggccatggagaagcagatcgccagcctgaccggcctggtgcagagcgccctgctgagaggcagcgagcccgagacccccagcgagaagatcgagggcagcaacggcgccgccacccccagcgccccctgcggcagcggcggcagaagcagcggcgccacccccgtgagcggcccccccccccccagcgccagcagcacccccgccggccagcccaccgccgtgagcagactgcagatgcagctgcacctgagaggcctgcagaacagcgccagcgacctgagaggccagctgcagcagctgagaaagctgcagctgcagaaccaggagagcgtgagagccctgctgaagagaaccgaggccgagctgagcatgagagtgagcgaggccgccagaagacaggaggaccccctgcagagacagagaaccctggtggaggaggagagactgagatacctgaacgacgaggagctgatcacccagcagctgaacgacctggagaagagcgtggagaagatccagagagacgtgagccacaaccacagactggtgcccggccccgagctggaggagaaggccctggtgctgaagcagctgggcgagaccctgaccgagctgaaggcccacttccccggcctgcagagcaagatgagagtggtgctgagagtggaggtggaggccgtgaagttcctgaaggaggagccccagagactggacggcctgctgaagagatgcagaggcgtgaccgacaccctggcccagatcagaagacaggtggacgagggcgtgtggcccccccccaacaacctgctgagccagagccccaagaaggtgaccgccgagaccgacttcaacaagagcgtggacttcgagatgcccccccccagcccccccctgaacctgcacgagctgagcggccccgccgagggcgccagcctgacccccaagggcggcaaccccaccaagggcctggacacccccggcaagagaagcgtggacaaggccgtgagcgtggaggccgccgagagagactgggaggagaagagagccgccctgacccagtacagcgccaaggacatcaacagactgctggaggagacccaggccgagctgctgaaggccatccccgacctggactgcgccagcaaggcccaccccggccccgcccccacccccgaccacaagccccccaaggccccccacggccagaaggccgcccccagaaccgagcccagcggcagaagaggcagcgacgagctgaccgtgcccagatacagaaccgagaagcccagcaagagcccccccccccccccccccagaagaagcttccccagcagccacggcctgaccaccaccagaaccggcgaggtggtggtgaccagcaagaaggacagcgccttcatcaagaaggccgagagcgaggagctggaggtgcagaagccccaggtgaagctgagaagagccgtgagcgaggtggccagacccgccagcaccccccccatcatggccagcgccatcaaggacgaggacgacgaggacagaatcatcgccgagctggaggtgttcgagagaagcagcgtgagcagcctgccccccacccccagaagacagctgatccccaccctgctgagcccccaggacctgggcccccccggcggcagcgcccccggccccaccagaaagagcggcggcggcagcgtgccccccatgaaggtggtgacccccggcgccagcagactgaaggccgcccagggccaggccggcagccccgacaagagcaagcacggcaagcagagagccgagtacatgagaatccaggcccagcagcaggtgtag

SEQ ID NO: 24850 - DNA, 2766 bp, Artificial Sequence
  Description of Artificial Sequence: Synthetic coding sequence
atgggcatgctgaagagccccaacaccgccatcctgatcaaggacgaggccagaaacgtgttctacgagctggaggacgtgagagacatccaggacagaagcatcatcaagatctacagaaaggagcccctgtacgccgccttccccggcagccacctgaccaacggcgacctgagaagagagatggtgtacgccagcagagagagcagccccaccagaagactgaacaacctgagccccgccccccacctggccagcggcagccccccccccggcctgcccagcggcctgcccagcggcctgcagagcggcagccccagcagaagcagactgagctacgccggcggcagaccccccagctacgccggcagccccgtgcaccacgccgccgagagactgggcggcgcccccgccgcccagggcgtgagccccagccccagcgccatcctggagagaagagacgtgaagcccgacgaggacctggccagcaaggccggcggcatggtgctggtgaagggcgagggcctgtacgccgacccctacggcctgctgcacgagggcagactgagcctggccgccgccgccggcgaccccttcgcctaccccggcgccggcggcctgtacaagagaggcagcgtgagaagcctgagcacctacagcgccgccgccctgcagagcgacctggaggacagcctgtacaaggccgccggcggcggcggccccctgtacggcgacggctacggcttcagactgccccccagcagcccccagaagctggccgacgtggccgccccccccggcggccccccccccccccacagcccctacagcggcccccccagcagaggcagccccgtgagacagagcttcagaaaggacagcggcagcagcagcgtgttcgccgagagccccggcggcaagaccagaagcgccggcagcgccagcaccgccggcgccccccccagcgagctgttccccggccccggcgagagaagcctggtgggcttcggcccccccgtgcccgccaaggacaccgagaccagagagagaatggaggccatggagaagcagatcgccagcctgaccggcctggtgcagagcgccctgctgagaggcagcgagcccgagacccccagcgagaagatcgagggcagcaacggcgccgccacccccagcgccccctgcggcagcggcggcagaagcagcggcgccacccccgtgagcggcccccccccccccagcgccagcagcacccccgccggccagcccaccgccgtgagcagactgcagatgcagctgcacctgagaggcctgcagaacagcgccagcgacctgagaggccagctgcagcagctgagaaagctgcagctgcagaaccaggagagcgtgagagccctgctgaagagaaccgaggccgagctgagcatgagagtgagcgaggccgccagaagacaggaggaccccctgcagagacagagaaccctggtggaggaggagagactgagatacctgaacgacgaggagctgatcacccagcagctgaacgacctggagaagagcgtggagaagatccagagagacgtgagccacaaccacagactggtgcccggccccgagctggaggagaaggccctggtgctgaagcagctgggcgagaccctgaccgagctgaaggcccacttccccggcctgcagagcaagatgagagtggtgctgagagtggaggtggaggccgtgaagttcctgaaggaggagccccagagactggacggcctgctgaagagatgcagaggcgtgaccgacaccctggcccagatcagaagacaggtggacgagggcgtgtggcccccccccaacaacctgctgagccagagccccaagaaggtgaccgccgagaccgacttcaacaagagcgtggacttcgagatgcccccccccagcccccccctgaacctgcacgagctgagcggccccgccgagggcgccagcctgacccccaagggcggcaaccccaccaagggcctggacacccccggcaagagaagcgtggacaaggccgtgagcgtggaggccgccgagagagactgggaggagaagagagccgccctgacccagtacagcgccaaggacatcaacagactgctggaggagacccaggccgagctgctgaaggccatccccgacctggactgcgccagcaaggcccaccccggccccgcccccacccccgaccacaagccccccaaggccccccacggccagaaggccgcccccagaaccgagcccagcggcagaagaggcagcgacgagctgaccgtgcccagatacagaaccgagaagcccagcaagagcccccccccccccccccccagaagaagcttccccagcagccacggcctgaccaccaccagaaccggcgaggtggtggtgaccagcaagaaggacagcgccttcatcaagaaggccgagagcgaggagctggaggtgcagaagccccaggtgaagctgagaagagccgtgagcgaggtggccagacccgccagcaccccccccatcatggccagcgccatcaaggacgaggacgacgaggacagaatcatcgccgagctggagagcggcggcggcagcgtgccccccatgaaggtggtgacccccggcgccagcagactgaaggccgcccagggccaggccggcagccccgacaagagcaagcacggcaagcagagagccgagtacatgagaatccaggcccagcagcaggtgtag

SEQ ID NO: 24851 - DNA, 1356 bp, Artificial Sequence
  Description of Artificial Sequence: Synthetic coding sequence
atggtgagcagagaccaggcccacctgggccccaagtacgtgggcctgtgggacttcaagagcagaaccgacgaggagctgagcttcagagccggcgacgtgttccacgtggccagaaaggaggagcagtggtggtgggccaccctgctggacgaggccggcggcgccgtggcccagggctacgtgccccacaactacctggccgagagagagaccgtggagagcgagccctggttcttcggctgcatcagcagaagcgaggccgtgagaagactgcaggccgagggcaacgccaccggcgccttcctgatcagagtgagcgagaagcccagcgccgactacgtgctgagcgtgagagacacccaggccgtgagacactacaagatctggagaagagccggcggcagactgcacctgaacgaggccgtgagcttcctgagcctgcccgagctggtgaactaccacagagcccagagcctgagccacggcctgagactggccgccccctgcagaaagcacgagcccgagcccctgccccactgggacgactgggagagacccagagaggagttcaccctgtgcagaaagctgggcagcggctacttcggcgaggtgttcgagggcctgtggaaggacagagtgcaggtggccatcaaggtgatcagcagagacaacctgctgcaccagcagatgctgcagagcgagatccaggccatgaagaagctgagacacaagcacatcctggccctgtacgccgtggtgagcgtgggcgaccccgtgtacatcatcaccgagctgatggccaagggcagcctgctggagctgctgagagacagcgacgagaaggtgctgcccgtgagcgagctgctggacatcgcctggcaggtggccgagggcatgtgctacctggagagccagaactacatccacagagacctggccgccagaaacatcctggtgggcgagaacaccctgtgcaaggtgggcgacttcggcctggccagactgatcaaggaggacgtgtacctgagccacgaccacaacatcccctacaagtggaccgcccccgaggccctgagcagaggccactacagcaccaagagcgacgtgtggagcttcggcatcctgctgcacgagatgttcagcagaggccaggtgccctaccccggcatgagcaaccacgaggccttcctgagagtggacgccggctacagaatgccctgccccctggagtgcccccccagcgtgcacaagctgatgctgacctgctggtgcagagaccccgagcagagaccctgcttcaaggccctgagagagagactgagcagcttcaccagctacgagaaccccacctag

SEQ ID NO: 24852 - DNA, 468 bp, Artificial Sequence
  Description of Artificial Sequence: Synthetic coding sequence
atggccgtgcccggctgcaacaaggacagcgtgagagccggctgcaagaagtgcggctaccccggccacctgaccttcgagtgcagaaacttcctgagagtggaccccaagagagacatcgtgctggacgtgagcagcaccagcagcgaggacagcgacgaggagaacgaggagctgaacaagctgcaggccctgcaggagaagagaatcaacgaggaggaggagaagaagaaggagaagagcaaggagaagatcaagctgaagaagaagagaaagagaagctacagcagcagcagcaccgaggaggacaccagcaagcagaagaagcagaagtaccagaagaaggagaagaagaaggagaagaagagcaagagcaagaagggcaagcaccacaagaaggagaagaagaagagaaagaaggagaagcacagcagcacccccaacagcagcgagttcagcagaaagtag

SEQ ID NO: 24853 - DNA, 1704 bp, Artificial Sequence
  Description of Artificial Sequence: Synthetic coding sequence
atgagcgccagcaccggcggcggcggcgacagcggcggcagcggcggcagcagcagcagcagccaggccagctgcggccccgagagcagcggcagcgagctggccctggccacccccgtgccccagatgctgcagggcctgctgggcagcgacgacgaggagcaggaggaccccaaggactactgcaagggcggctaccaccccgtgaagatcggcgacgtgttcaacggcagataccacgtggtgagaaagctgggctggggccacttcagcaccgtgtggctgtgctgggacatccagagaaagagattcgtggccctgaaggtggtgaagagcgccggccactacaccgagaccgccgtggacgagatcaagctgctgaagtgcgtgagagacagcgaccccagcgaccccaagagagagaccatcgtgcagctgatcgacgacttcagaatcagcggcgtgaacggcgtgcacgtgtgcatggtgctggaggtgctgggccaccagctgctgaagtggatcatcaagagcaactaccagggcctgcccgtgccctgcgtgaagagcatcgtgagacaggtgctgcacggcctggactacctgcacaccaagtgcaagatcatccacaccgacatcaagcccgagaacatcctgctgtgcgtgggcgacgcctacatcagaagactggccgccgaggccaccgagtggcagcaggccggcgcccccccccccagcagaagcatcgtgagcaccgccccccaggaggtgctgcagaccggcaagctgagcaagaacaagagaaagaagatgagaagaaagagaaagcagcagaagagactgctggaggagagactgagagacctgcagagactggaggccatggaggccgccacccaggccgaggacagcggcctgagactggacggcggcagcggcagcaccagcagcagcggctgccaccccggcggcgccagagccggccccagccccgccagcagcagccccgcccccggcggcggcagaagcctgagcgccggcagccagaccagcggcttcagcggcagcctgttcagccccgccagctgcagcatcctgagcggcagcagcaaccagagagagaccggcggcctgctgagccccagcacccccttcggcgccagcaacctgctggtgaaccccctggagccccagaacgccgacaagatcaagatcaagatcgccgacctgggcaacgcctgctgggtgcacaagcacttcaccgaggacatccagaccagacagtacagagccgtggaggtgctgatcggcgccgagtacggcccccccgccgacatctggagcaccgcctgcatggccttcgagctggccaccggcgactacctgttcgagccccacagcggcgaggactacagcagagacgaggaccacatcgcccacatcgtggagctgctgggcgacatcccccccgccttcgccctgagcggcagatacagcagagagttcttcaacagaagaggcgagctgagacacatccacaacctgaagcactggggcctgtacgaggtgctgatggagaagtacgagtggcccctggagcaggccacccagttcagcgccttcctgctgcccatgatggagtacatccccgagaagagagccagcgccgccgactgcctgcagcacccctggctgaacccctag

SEQ ID NO: 24854 - DNA, 1602 bp, Artificial Sequence
  Description of Artificial Sequence: Synthetic coding sequence
atgagcgccagcaccggcggcggcggcgacagcggcggcagcggcggcagcagcagcagcagccaggccagctgcggccccgagagcagcggcagcgagctggccctggccacccccgtgccccagatgctgcagggcctgctgggcagcgacgacgaggagcaggaggaccccaaggactactgcaagggcggctaccaccccgtgaagatcggcgacgtgttcaacggcagataccacgtggtgagaaagctgggctggggccacttcagcaccgtgtggctgtgctgggacatccagagaaagagattcgtggccctgaaggtggtgaagagcgccggccactacaccgagaccgccgtggacgagatcaagctgctgaagtgcgtgagagacagcgaccccagcgaccccaagagagagaccatcgtgcagctgatcgacgacttcagaatcagcggcgtgaacggcgtgcacgtgtgcatggtgctggaggtgctgggccaccagctgctgaagtggatcatcaagagcaactaccagggcctgcccgtgccctgcgtgaagagcatcgtgagacaggtgctgcacggcctggactacctgcacaccaagtgcaagatcatccacaccgacatcaagcccgagaacatcctgctgtgcgtgggcgacgcctacatcagaagactggccgccgaggccaccgagtggcagcaggccggcgcccccccccccagcagaagcatcgtgagcaccgccccccaggaggtgctgaccggcaagctgagcaagaacaagagaaagaagatgagaagaaagagaaagcagcagaagagactgctggaggagagactgagagacctgcagagactggaggccatggaggccgccacccaggccgaggacagcggcctgagactggacggcggcagcggcagcaccagcagcagcggcttcagcggcagcctgttcagccccgccagctgcagcatcctgagcggcagcagcaaccagagagagaccggcggcctgctgagccccagcacccccttcggcgccagcaacctgctggtgaaccccctggagccccagaacgccgacaagatcaagatcaagatcgccgacctgggcaacgcctgctgggtgcacaagcacttcaccgaggacatccagaccagacagtacagagccgtggaggtgctgatcggcgccgagtacggcccccccgccgacatctggagcaccgcctgcatggccttcgagctggccaccggcgactacctgttcgagccccacagcggcgaggactacagcagagacgaggaccacatcgcccacatcgtggagctgctgggcgacatcccccccgccttcgccctgagcggcagatacagcagagagttcttcaacagaagaggcgagctgagacacatccacaacctgaagcactggggcctgtacgaggtgctgatggagaagtacgagtggcccctggagcaggccacccagttcagcgccttcctgctgcccatgatggagtacatccccgagaagagagccagcgccgccgactgcctgcagcacccctggctgaacccctag

SEQ ID NO: 24855 - DNA, 120 bp, Artificial Sequence
  Description of Artificial Sequence: Synthetic coding sequence
atgaccggcttcttcaagggcgccgaggacagatacagcagccacctgtggagaccccagggcggccccagaagcaagggccccggccccagaagctggaacaccgagagcctgagatag

SEQ ID NO: 24856 - DNA, 1023 bp, Artificial Sequence
  Description of Artificial Sequence: Synthetic coding sequence
atggtgaccctgagaaagagaaccctgaaggtgctgaccttcctggtgctgttcatcttcctgaccagcttcttcctgaactacagccacaccatggtggccaccacctggttccccaagcagatggtgctggagctgagcgagaacctgaagagactgatcaagcacagaccctgcacctgcacccactgcatcggccagagaaagctgagcgcctggttcgacgagagattcaaccagaccatgcagcccctgctgaccgcccagaacgccctgctggaggacgacacctacagatggtggctgagactgcagagagagaagaagcccaacaacctgaacgacaccatcaaggagctgttcagagtggtgcccggcaacgtggaccccatgctggagaagagaagcgtgggctgcagaagatgcgccgtggtgggcaacagcggcaacctgagagagagcagctacggccccgagatcgacagccacgacttcgtgctgagaatgaacaaggcccccaccgccggcttcgaggccgacgtgggcaccaagaccacccaccacctggtgtaccccgagagcttcagagagctgggcgacaacgtgagcatgatcctggtgcccttcaagaccatcgacctggagtgggtggtgagcgccatcaccaccggcaccatcagccacacctacatccccgtgcccgccaagatcagagtgaagcaggacaagatcctgatctaccaccccgccttcatcaagtacgtgttcgacaactggctgcagggccacggcagataccccagcaccggcatcctgagcgtgatcttcagcatgcacgtgtgcgacgaggtggacctgtacggcttcggcgccgacagcaagggcaactggcaccactactgggagaacaaccccagcgccggcgccttcagaaagaccggcgtgcacgacgccgacttcgagagcaacgtgaccgccaccctggccagcatcaacaagatcagaatcttcaagggcagatag

SEQ ID NO: 24857 - DNA, 1023 bp, Artificial Sequence; identical to SEQ ID NO: 24856
  Description of Artificial Sequence: Synthetic coding sequence

SEQ ID NO: 24858 - DNA, 150 bp, Artificial Sequence
  Description of Artificial Sequence: Synthetic coding sequence
atggtgaccctgagaaagagaaccctgaaggtgctgaccttcctggtgctgttcatcttcctgaccagcttcttcctgaactacagccacaccatggtggccaccacctggttccccaagcagatggtgctggagctgagcgagaactag

SEQ ID NO: 24859 - DNA, 1023 bp, Artificial Sequence; identical to SEQ ID NO: 24856
  Description of Artificial Sequence: Synthetic coding sequence

SEQ ID NO: 24860 - DNA, 1023 bp, Artificial Sequence; identical to SEQ ID NO: 24856
  Description of Artificial Sequence: Synthetic coding sequence

SEQ ID NO: 24861 - DNA, 219 bp, Artificial Sequence
  Description of Artificial Sequence: Synthetic coding sequence
atggtgaccctgagaaagagaaccctgaaggtgctgaccttcctggtgctgttcatcttcctgaccagcttcttcctgaactacagccacaccatggtggccaccacctggttccccaagcagatggtgctggagctgagcgagaacctgaagagactgatcaagcacagaccctgcacctgcacccactgcatcggccagagaaagctgagcgcctag

SEQ ID NO: 24862 - DNA, 144 bp, Artificial Sequence
  Description of Artificial Sequence: Synthetic coding sequence
atggtgaccctgagaaagagaaccctgaaggtgctgaccttcctggtgctgttcatcttcctgaccagcttcttcctgaactacagccacaccatggtggccaccacctggttccccaagcagatggtgctggagctgagctag

SEQ ID NO: 24863 - DNA, 1221 bp, Artificial Sequence
  Description of Artificial Sequence: Synthetic coding sequence
atgatccacaccaacctgaagaagaagttcagctgctgcgtgctggtgttcctgctgttcgccgtgatctgcgtgtggaaggagaagaagaagggcagctactacgacagcttcaagctgcagaccaaggagttccaggtgctgaagagcctgggcaagctggccatgggcagcgacagccagagcgtgagcagcagcagcacccaggacccccacagaggcagacagaccctgggcagcctgagaggcctggccaaggccaagcccgaggccagcttccaggtgtggaacaaggacagcagcagcaagaacctgatccccagactgcagaagatctggaagaactacctgagcatgaacaagtacaaggtgagctacaagggccccggccccggcatcaagttcagcgccgaggccctgagatgccacctgagagaccacgtgaacgtgagcatggtggaggtgaccgacttccccttcaacaccagcgagtgggagggctacctgcccaaggagagcatcagaaccaaggccggcccctggggcagatgcgccgtggtgagcagcgccggcagcctgaagagcagccagctgggcagagagatcgacgaccacgacgccgtgctgagattcaacggcgcccccaccgccaacttccagcaggacgtgggcaccaagaccaccatcagactgatgaacagccagctggtgaccaccgagaagagattcctgaaggacagcctgtacaacgagggcatcctgatcgtgtgggaccccagcgtgtaccacagcgacatccccaagtggtaccagaaccccgactacaacttcttcaacaactacaagacctacagaaagctgcaccccaaccagcccttctacatcctgaagccccagatgccctgggagctgtgggacatcctgcaggagatcagccccgaggagatccagcccaacccccccagcagcggcatgctgggcatcatcatcatgatgaccctgtgcgaccaggtggacatctacgagttcctgcccagcaagagaaagaccgacgtgtgctactactaccagaagttcttcgacagcgcctgcaccatgggcgcctaccaccccctgctgtacgagaagaacctggtgaagcacctgaaccagggcaccgacgaggacatctacctgctgggcaaggccaccctgcccggcttcagaaccatccactgctag

SEQ ID NO: 24864 - DNA, 228 bp, Artificial Sequence
  Description of Artificial Sequence: Synthetic coding sequence
atgatccacaccaacctgaagaagaagttcagctgctgcgtgctggtgttcctgctgttcgccgtgatctgcgtgtggaaggagaagaagaagggcagctactacgacagcttcaagctgcagaccaaggagttccaggtgctgaagagcctgggcaagctggccatgggcagcgacagccagagcgtgagcagcagcagcacccaggacccccacagaggcagatag

SEQ ID NO: 24865 - DNA, 342 bp, Artificial Sequence
  Description of Artificial Sequence: Synthetic coding sequence
atgatccacaccaacctgaagaagaagttcagctgctgcgtgctggtgttcctgctgttcgccgtgatctgcgtgtggaaggagaagaagaagggcagctactacgacagcttcaagctgcagaccaaggagttccaggtgctgaagagcctgggcaagctggccatgggcagcgacagccagagcgtgagcagcagcagcacccaggacccccacagaggcagacagaccctgggcagcctgagaggcctggccaaggccaagcccgaggccagcttccaggtgtggaacaaggacagcagcagcaagaacctgatccccagactgcagaagatctggtag

SEQ ID NO: 24866 - DNA, 384 bp, Artificial Sequence
  Description of Artificial Sequence: Synthetic coding sequence
atgatccacaccaacctgaagaagaagttcagctgctgcgtgctggtgttcctgctgttcgccgtgatctgcgtgtggaaggagaagaagaagggcagctactacgacagcttcaagctgcagaccaaggagttccaggtgctgaagagcctgggcaagctggccatgggcagcgacagccagagcgtgagcagcagcagcacccaggacccccacagaggcagacagaccctgggcagcctgagaggcctggccaaggccaagcccgaggccagcttccaggtgtggaacaaggacagcagcagcaagaacctgatccccagactgcagaagatctggaagaactacctgagcatgaacaagtacaaggtgagctacaagtag

SEQ ID NO: 24867 - DNA, 129 bp, Artificial Sequence
  Description of Artificial Sequence: Synthetic coding sequence
atgatccacaccaacctgaagaagaagttcagctgctgcgtgctggtgttcctgctgttcgccgtgatctgcgtgtggaaggagaagaagaagggcagctactacgacagcttcaagctgcagacctag

SEQ ID NO: 24868 - DNA, 294 bp, Artificial Sequence
  Description of Artificial Sequence: Synthetic coding sequence
atgatccacaccaacctgaagaagaagttcagctgctgcgtgctggtgttcctgctgttcgccgtgatctgcgtgtggaaggagaagaagaagggcagctactacgacagcttcaagctgcagaccaaggagttccaggtgctgaagagcctgggcaagctggccatgggcagcgacagccagagcgtgagcagcagcagcacccaggacccccacagaggcagacagaccctgggcagcctgagaggcctggccaaggccaagcccgaggccagcttccaggtgtggaactag

SEQ ID NO: 24869 - DNA, 138 bp, Artificial Sequence
  Description of Artificial Sequence: Synthetic coding sequence
atgatccacaccaacctgaagaagaagttcagctgctgcgtgctggtgttcctgctgttcgccgtgatctgcgtgtggaaggagaagaagaagggcagctactacgacagcttcaagctgcagaccaaggagttctag

SEQ ID NO: 24870 - DNA, 276 bp, Artificial Sequence
  Description of Artificial Sequence: Synthetic coding sequence
atgatccacaccaacctgaagaagaagttcagctgctgcgtgctggtgttcctgctgttcgccgtgatctgcgtgtggaaggagaagaagaagggcagctactacgacagcttcaagctgcagaccaaggagttccaggtgctgaagagcctgggcaagctggccatgggcagcgacagccagagcgtgagcagcagcagcacccaggacccccacagaggcagacagaccctgggcagcctgagaggcctggccaaggccaagcccgaggcctag

SEQ ID NO: 24871 - DNA, 1221 bp, Artificial Sequence; identical to SEQ ID NO: 24863
  Description of Artificial Sequence: Synthetic coding sequence

SEQ ID NO: 24872 - DNA, 297 bp, Artificial Sequence
  Description of Artificial Sequence: Synthetic coding sequence
atgatccacaccaacctgaagaagaagttcagctgctgcgtgctggtgttcctgctgttcgccgtgatctgcgtgtggaaggagaagaagaagggcagctactacgacagcttcaagctgcagaccaaggagttccaggtgctgaagagcctgggcaagctggccatgggcagcgacagccagagcgtgagcagcagcagcacccaggacccccacagaggcagacagaccctgggcagcctgagaggcctggccaaggccaagcccgaggccagcttccaggtgtggaacaagtag

SEQ ID NO: 24873 - DNA, 528 bp, Artificial Sequence
  Description of Artificial Sequence: Synthetic coding sequence
atgaacagccagctggtgaccaccgagaagagattcctgaaggacagcctgtacaacgagggcatcctgatcgtgtgggaccccagcgtgtaccacagcgacatccccaagtggtaccagaaccccgactacaacttcttcaacaactacaagacctacagaaagctgcaccccaaccagcccttctacatcctgaagccccagatgccctgggagctgtgggacatcctgcaggagatcagccccgaggagatccagcccaacccccccagcagcggcatgctgggcatcatcatcatgatgaccctgtgcgaccaggtggacatctacgagttcctgcccagcaagagaaagaccgacgtgtgctactactaccagaagttcttcgacagcgcctgcaccatgggcgcctaccaccccctgctgtacgagaagaacctggtgaagcacctgaaccagggcaccgacgaggacatctacctgctgggcaaggccaccctgcccggcttcagaaccatccactgctag

SEQ ID NO: 24874 - DNA, 78 bp, Artificial Sequence
  Description of Artificial Sequence: Synthetic coding sequence
atgatccacaccaacctgaagaagaagttcagctgctgcgtgctggtgttcctgctgttcgccgtgatctgcgtgtag

SEQ ID NO: 24875 - DNA, 876 bp, Artificial Sequence
  Description of Artificial Sequence: Synthetic coding sequence
atggagaagctggccgccagcaccgagccccagggccccagacccgtgctgggcagagagagcgtgcaggtgcccgacgaccaggacttcagaagcttcagaagcgagtgcgaggccgaggtgggctggaacctgacctacagcagagccggcgtgagcgtgtgggtgcaggccgtggagatggacagaaccctgcacaagatcaagtgcagaatggagtgctgcgacgtgcccgccgagaccctgtacgacgtgctgcacgacatcgagtacagaaagaagtgggacagcaacgtgatcgagaccttcgacatcgccagactgaccgtgaacgccgacgtgggctactacagctggagatgccccaagcccctgaagaacagagacgtgatcaccctgagaagctggctgcccatgggcgccgactacatcatcatgaactacagcgtgaagcaccccaagtacccccccagaaaggacctggtgagagccgtgagcatccagaccggctacctgatccagagcaccggccccaagagctgcgtgatcacctacctggcccaggtggaccccaagggcagcctgcccaagtgggtggtgaacaagagcagccagttcctggcccccaaggccatgaagaagatgtacaaggcctgcctgaagtaccccgagtggaagcagaagcacctgccccacttcaagccctggctgcaccccgagcagagccccctgcccagcctggccctgagcgagctgagcgtgcagcacgccgacagcctggagaacatcgacgagagcgccgtggccgagagcagagaggagagaatgggcggcgccggcggcgagggcagcgacgacgacaccagcctgacctag

SEQ ID NO: 24876 - DNA, 270 bp, Artificial Sequence
  Description of Artificial Sequence: Synthetic coding sequence
atggagaagctggccgccagcaccgagccccagggccccagacccgtgctgggcagagagagcgtgcaggtgcccgacgaccaggacttcagaagcttcagaagcgagtgcgaggccgaggtgggctggaacctgacctacagcagagccggcgtgagcgtgtgggtgcaggccgtggagatggacagaaccctgcacaagatcaagtgcagaatggagtgctgcgacgtgcccgccgagaccctgtacgacgtgctgcacgacatctag

SEQ ID NO: 24877 - DNA, 759 bp, Artificial Sequence
  Description of Artificial Sequence: Synthetic coding sequence
atggagaagctggccgccagcaccgagccccagggccccagacccgtgctgggcagagagagcgtgcaggtgcccgacgaccaggacttcagaagcttcagaagcgagtgcgaggccgaggtgggctggaacctgacctacagcagagccggcgtgagcgtgtgggtgcaggccgtggagatggacagaaccctgcacaagatcaagtgcagaatggagtgctgcgacgtgcccgccgagaccctgtacgacgtgctgcacgacatcgagtacagaaagaagtgggacagcaacgtgatcgagaccttcgacatcgccagactgaccgtgaacgccgacgtgggctactacagctggagatgccccaagcccctgaagaacagagacgtgatcaccctgagaagctggctgcccatgggcgccgactacatcatcatgaactacagcgtgaagcaccccaagtacccccccagaaaggacctggtgagagccgtgagcatccagaccggctacctgatccagagcaccggccccaagagctgcgtgatcacctacctggcccaggtggaccccaagggcagcctgcccaagtgggtggtgaacaagagcagccagttcctggcccccaaggccatgaagaagatgtacaaggcctgcctgaagtaccccgagtggaagcagaagcacctgccccacttcaagccctggctgcaccccgagcagagccccctgcccagcctggccctgagcgagctgtag

SEQ ID NO: 24878 - DNA, 39 bp, Artificial Sequence
  Description of Artificial Sequence: Synthetic coding sequence
atggagaagctggccgccagcaccgagccccagggctag

SEQ ID NO: 24879 - DNA, 576 bp, Artificial Sequence
  Description of Artificial Sequence: Synthetic coding sequence
atggagaagctggccgccagcaccgagccccagggccccagacccgtgctgggcagagagagcgtgcaggtgcccgacgaccaggacttcagaagcttcagaagcgagtgcgaggccgaggtgggctggaacctgacctacagcagagccggcgtgagcgtgtgggtgcaggccgtggagatggacagaaccctgcacaagatcaagtgcagaatggagtgctgcgacgtgcccgccgagaccctgtacgacgtgctgcacgacatcgagtacagaaagaagtgggacagcaacgtgatcgagaccttcgacatcgccagactgaccgtgaacgccgacgtgggctactacagctggagatgccccaagcccctgaagaacagagacgtgatcaccctgagaagctggctgcccatgggcgccgactacatcatcatgaactacagcgtgaagcaccccaagtacccccccagaaaggacctggtgagagccgtgagcatccagaccggctacctgatccagagcaccggccccaagagctgcgtgatcacctacctggcccaggtggacccctag

SEQ ID NO: 24880 - DNA, 876 bp, Artificial Sequence; identical to SEQ ID NO: 24875
  Description of Artificial Sequence: Synthetic coding sequence

SEQ ID NO: 24881 - DNA, 417 bp, Artificial Sequence
  Description of Artificial Sequence: Synthetic coding sequence
atggagaagctggccgccagcaccgagccccagggccccagacccgtgctgggcagagagagcgtgcaggtgcccgacgaccaggacttcagaagcttcagaagcgagtgcgaggccgaggtgggctggaacctgacctacagcagagccggcgtgagcgtgtgggtgcaggccgtggagatggacagaaccctgcacaagatcaagtgcagaatggagtgctgcgacgtgcccgccgagaccctgtacgacgtgctgcacgacatcgagtacagaaagaagtgggacagcaacgtgatcgagaccttcgacatcgccagactgaccgtgaacgccgacgtgggctactacagctggagatgccccaagcccctgaagaacagagacgtgatcaccctgagaagctggctgccctag

SEQ ID NO: 24882 - DNA, 14103 bp, Artificial Sequence
  Description of Artificial Sequence: Synthetic coding sequence
atggccaacgtgcaggtggccgtgagagtgagacccctgagcaagagagagaccaaggagggcggcagaatcatcgtggaggtggacggcaaggtggccaagatcagaaacctgaaggtggacaacagacccgacggcttcggcgacagcagagagaaggtgatggccttcggcttcgactactgctactggagcgtgaaccccgaggacccccagtacgccagccaggacgtggtgttccaggacctgggcatggaggtgctgagcggcgtggccaagggctacaacatctgcctgttcgcctacggccagaccggcagcggcaagacctacaccatgctgggcacccccgccagcgtgggcctgacccccagaatctgcgagggcctgttcgtgagagagaaggactgcgccagcctgcccagcagctgcagaatcaaggtgagcttcctggagatctacaacgagagagtgagagacctgctgaagcagagcggccagaagaagagctacaccctgagagtgagagagcaccccgagatgggcccctacgtgcagggcctgagccagcacgtggtgaccaactacaagcaggtgatccagctgctggaggagggcatcgccaacagaatcaccgccgccacccacgtgcacgaggccagcagcagaagccacgccatcttcaccatccactacacccaggccatcctggagaacaacctgcccagcgagatggccagcaagatcaacctggtggacctggccggcagcgagagagccgaccccagctactgcaaggacagaatcgccgagggcgccaacatcaacaagagcctggtgaccctgggcatcgtgatcagcaccctggcccagaacagccaggtgttcagcagctgccagagcctgaacagcagcgtgagcaacggcggcgacagcggcatcctgagcagccccagcggcaccagcagcggcggcgcccccagcagaagacagagctacatcccctacagagacagcgtgctgacctggctgctgaaggacagcctgggcggcaacagcaagaccatcatggtggccaccgtgagccccgcccacaccagctacagcgagaccatgagcaccctgagatacgccagcagcgccaagaacatcatcaacaagcccagagtgaacgaggacgccaacctgaagctgatcagagagctgagagaggagatcgagagactgaaggccctgctgctgagcttcgagctgagaaacttcagcagcctgagcgacgagaacctgaaggagctggtgctgcagaacgagctgaagatcgaccagctgaccaaggactggacccagaagtggaacgactggcaggccctgatggagcactacagcgtggacatcaacagaagaagagccggcgtggtgatcgacagcagcctgccccacctgatggccctggaggacgacgtgctgagcaccggcgtggtgctgtaccacctgaaggagggcaccaccaagatcggcagaatcgacagcgaccaggagcaggacatcgtgctgcagggccagtggatcgagagagaccactgcaccatcaccagcgcctgcggcgtggtggtgctgagacccgccagaggcgccagatgcaccgtgaacggcagagaggtgaccgccagctgcagactgacccagggcgccgtgatcaccctgggcaaggcccagaagttcagattcaaccaccccgccgaggccgccgtgctgagacagagaagacaggtgggcgaggccgccgccggcagaggcagcctggagtggctggacctggacggcgacctggccgccagcagactgggcctgagccccctgctgtggaaggagagaagagccctggaggagcagtgcgacgaggaccaccagacccccagagacggcgagaccagccacagagcccagatccagcagcagcagagctacgtggaggacctgagacaccagatcctggccgaggagatcagagccgccaaggagctggagttcgaccaggcctggatcagccagcagatcaaggagaaccagcagtgcctgctgagagaggagacctggctggccagcctgcagcagcagcagcaggaggaccaggtggccgagaaggagctggaggccagcgtggccctggacgcctggctgcagaccgaccccgagatccagcccagccccttcgtgcagagccagaagagagtggtgcacctgcagctgctgagaagacacaccctgagagccgccgagagaaacgtgagaagaaagaaggtgagcttccagctggagagaatcatcaagaagcagagactgctggaggcccagaagagactggagaagctgaccaccctgtgctggctgcaggacgacagcacccaggagcccccctaccaggtgctgagccccgacgccaccgtgcccagacccccctgcagaagcaagctgaccagctgcagcagcctgagcccccagagactgtgcagcaagcacatgccccagctgcacagcatcttcctgagctgggaccccagcaccaccctgccccccagacccgaccccacccaccagaccagcgagaagaccagcagcgaggagcacctgccccaggccgccagctaccccgccagaaccggctgcctgagaaagaacggcctgcacagcagcggccacggccagccctgcaccgccagagccgccctggccagaaagggcgccagcgcccccgacgcctgcctgaccatgagccccaacagcgtgggcatccaggagatggagatgggcgtgaagcagccccaccagatggtgagccagggcctggccagcctgagaaagagcgccaacaagctgaagcccagacacgagcccaagatcttcaccagcaccacccagaccagaggcgccaagggcctggccgaccccagccacacccaggccggctggagaaaggagggcaacctgggcacccacaaggccgccaagggcgccagctgcaacagcctgtacccccacggccccagacagaccgccggccacggcaaggccgtgaagaccttctggaccgagtacaagccccccagccccagcagagccagcaagagacaccagagagtgctggccaccagagtgagaaacatcaccaagaagagcagccacctgcccctgggcagccccctgaagagacagcagaacaccagagaccccgacaccatggtgcccctgaccgacttcagccccgtgatggaccacagcagagagaaggacaacgacctgagcgacaccgacagcaactacagcctggacagcctgagctgcgtgtacgccaaggccctgatcgagcccctgaagcccgaggagagaaagtgggacttccccgagcccgagaacagcgagagcgacgacagccagctgagcgaggacagcctggccgagaagagataccagagccccaagaacagactgggcggcaacagacccaccaacaacagaggccagcccagaaccagaaccagagccagcgtgagaggcttcaccgccgccagcgacagcgacctgctggcccagacccacagaagcttcagcctggacagcctgatcgacgccgaggaggagctgggcgaggaccagcaggaggagcccttccccggcagcgccgacgagatccccaccgagaccttctggcacctggaggacagcagcctgcccgtgatggaccaggaggccatctgcagactgggccccatcaactacagaaccgccgccagactggacgccgtgctgcccatgagcagcagcttctacctggacccccagttccagccccactgcgagctgcagccccactgcgagctgcagccccactgcgagctgcagccccactgcgagcaggccgagagccaggtggagcccagctacagcgagcaggccgacagcctgcagggcatgcagctgagcagagagagccccctgatgagcatggacagctggttcagctgcgacagcaagatcaaccccagcagcccccccggcatcgtgggcagcctgtgccccagccccgacatgcaggagttccacagctgcaagggcgagagacccggctactggcccaacaccgaggagctgaagcccagcgacgccgagaccgtgctgccctacagcagcaagctgcaccagggcagcaccgagctgctgtgcagcgccagagacgagcacaccgccagcgccgccgacaccagcagactgagcctgtggggcatccagagactgatccagcccggcgccgacggcaccttccagggcagatgcatccccgacatgacccagcagggcagcagcgaggccagccacaacagcagcgtgagcaacgtgctggccgccagcgccaccaccctgacccacgtgggcagcacccacgagagagactggagcgccctgcagcagaagtacctgctggagctgagctgccccgtgctggaggccatcggcgcccccaagcccgcctacccctacctggaggaggacagcggcagcctggcccaggccagcagcaagggcggcgacaccctgctgcccgtgggccccagagtgagcagcaacctgaacctgaacaacttccccgtgcacctgagcagaatcagaagactgagagccgagaaggagcaggacagcctgaacgccaagctggagggcgtgagcgacttcttcagcaccagcgagaaggaggccagctacgacgagacctacagcgccgacctggagagcctgagcgccagcagaagcaccaacgcccaggtgttcgccaccgagaacgccatccccgacagcatgaccgaggcctgcgaggtgaagcagaacaacctggaggagtgcctgcagagctgcagaaagcccggcctgatgaccagcagcgacgaggacttcttccagaagaacgcctgccacagcaacgtgaccaccgccaccaaggccgaccactggagccagggctgggcccccctgagaaagaacagcgccgtgcagcccggccagctgagccccgacagccactaccccctggaggaggagaagaccgactgccaggagagcagcaaggaggccgtgagaagacacatcaacgtgagcttcgccctgcccagcggccccgagctgtacctgcacagcgccccctggaaccccctgagcagcagcctgcagccccccctgctggagaccttctacgtgaccaagagcagagacgccctgaccgagaccgccctggagatccccgcctgcagagaggtgagagtgcccagccccccccccagagaggcctggggcttcggccacaaccaccaggccctgcagggcgcctacctgaagaacaacctgcccgtgctgctgcagaaccagaacagcaagatcgccagcagccagcaggtgaccgccgagatccccgtggacctgaacaccagagaggtgatcagagagagcggcaagtgccccggcaacatcaccgaggagagccacgacagcgtgtacagcagcgtgacccagaacagacacttcctgcccagcaccagcaccaaggtgtgcgagttcgagaaccaggtggtgatcctgaacaagaagcacagcttccccgccctggagggcggcgaggtgaccgcccagagctgctgcggcgccagcagcgacagcaccgagagcggcaagagcctgctgttcagagagagcgaggccagagaggaggaggagctggaccagaacaccgtgctgagacagaccatcaacgtgagcctggagaaggacatgcccggcgagagcgccgtgagcctgaagagcagaagcgtggacagaagagtgagcagccccgtgatggtggcccagggcggcggccccacccccaagtgggagggcaagaacgagaccggcctgctggagaagggcctgagacccaaggacagcagcgaggagttcaagctgcccggcaccaagcccgcctacgagagattccagctggtggcctgcccccaggagagaaaccccagcgagtgcaagagccaggagatgctgaaccccaacagagagcccagcggcaagaagcagaacaagagagtgaacaacaccgacgagatggccagactgatcagaagcgtgatgcagctggagaacggcatcctggagatcgagagcaagcagaacaagcaggtgcacgccagccacacccccggcaccgacaaggagctggtgttccaggaccagaaggagcaggagaagaccgaccacgccttcagacccgacagcagcggcaaccccctgcccagcaaggaccagcccagcagccccagacagaccgacgacaccgtgttcagagacagcgaggccggcgccatggaggtgaacagcatcggcaaccacccccaggtgcagaagatcacccccaaccccttcagaagcagagagggcgtgagagagagcgagcccgtgagagagcacacccaccccgccggcagcgacagacccgccagagacatctgcgacagcctgggcaagcacaccacctgcagagagttcaccaacaccagcctgcacccccagagaatgaaggccctggccagagccctgcccctgcagcccagactggagagaagcagcaagaacaacggccagttcgtgaaggccagcgccagcctgaagggccagccctggggcctgggcagcctggaggagctggagaccgtgaagggcttccaggagagccaggtggccgagcacgtgagcagcagcaaccaggaggagcccaaggcccagggcaaggtggaggagatgcccatgcagagaggcggcagcctgcaggaggagaacaaggtgacccagaagttccccagcctgagccagctgtgcagagacaccttcttcagacaggagaccgtgagccccctgctgagcagaaccgagttctgcaccgcccccctgcaccaggacctgagcaacaccctgcccctgaacagccccagatggcccagaagatgcctgcacgtgcccgtggccctgggcatcagcagcctggactgcgtgctggacctgaccatgctgaagatccacaacagccccctggtgaccggcgtggagcaccaggaccagagcaccgagaccagaagccacagccccgagggcaacgtgagaggcagaagcagcgaggcccacaccgcctggtgcggcagcgtgagaagcatggccatgggcagccacagccagagcggcgtgcccgagagcatccccctgggcaccgaggacagaatcagcgccagcaccagcccccaggaccacggcaaggacctgagaatcaccctgctgggcttcagcaccagcgaggacttcgccagcgaggccgaggtggccgtgcagaaggagatcagagtgagcagcctgaacaaggtgagcagccagcccgagaagagagtgagcttcagcctggaggaggacagcgaccaggccagcaagcccagacagaaggccgagaaggagaccgaggacgtgggcctgaccagcggcgtgagcctggcccccgtgagcctgcccagagtgcccagccccgagcccagactgctggagcccagcgaccacgccagcatgtgcctggccatcctggaggagatcagacaggccaaggcccagagaaagcagctgcacgacttcgtggccagaggcaccgtgctgagctactgcgagaccctgctggagcccgagtgcagcagcagagtggccggcagaccccagtgcaagcagatcgaccagagcagcagcgaccagaccagaaacgagggcgaggcccccggcttccacgtggccagcctgagcgccgaggccggccagatcgacctgctgcccgacgagagaaaggtgcaggccaccagcctgagcgccgacagcttcgagagcctgcccaacaccgagaccgacagagagccctgggaccccgtgcaggccttcagccacgccgcccccgcccaggacagaaagagaagaaccggcgagctgagacagttcgccggcgccagcgagcccttcatctgccacagcagcagcagcgagatcatcgagaagaagaaggacgccaccagaacccccagcagcgccgaccccctggcccccgacagccccagaagcagcgcccccgtggaggaggtgagaagagtggtgagcaagaaggtggtggccgccctgcccagccaggccccctacgacgaccccagagtgaccctgcacgagctgagccagagcgtgccccaggagaccgccgagggcatcccccccggcagccaggacagcagccccgagcaccaggagcccagaaccctggacaccacctacggcgaggtgagcgacaacctgctggtgaccgcccagggcgagaagaccgcccacttcgagagccagagcgtgacctgcgacgtgcagaacagcaccagcgccagcggccccaagcaggaccacgtgcagtgccccgaggccagcaccggcttcgaggagggcagagccagccccaagcaggacaccatcctgcccggcgccctgaccagagtggccctggaggcccccacccagcagtgcgtgcagtgcaaggagagcgtgggcagcggcctgaccgaggtgtgcagagccggcagcaagcacagcagacccatccccctgcccgaccagagacccagcgccaaccccggcggcatcggcgaggaggccccctgcagacaccccagagaggccctggacggccccgtgttcagcagaaaccccgagggcagcagaaccctgagccccagcagaggcaaggagagcagaaccctgccctgcagacagccctgcagcagccagcccgtggccacccacgcctacagcagccacagcagcaccctgctgtgcttcagagacggcgacctgggcaaggagcccttcaaggccgccccccacaccatccaccccccctgcgtggtgcccagcagagcctacgagatggacgagaccggcgagatcagcagaggccccgacgtgcacctgacccacggcctggagcccaaggacgtgaacagagagttcagactgaccgagagcagcacctgcgagcccagcaccgtggccgccgtgctgagcagagcccagggctgcagaagccccagcgcccccgacgtgagaaccggcagcttcagccacagcgccaccgacggcagcgtgggcctgatcggcgtgcccgagaagaaggtggccgagaagcaggccagcaccgagctggaggccgccagcttccccgccggcatgtacagcgagcccctgagacagttcagagacagcagcgtgggcgaccagaacgcccaggtgtgccagaccaaccccgagccccccgccaccacccagggcccccacaccctggacctgagcgagggcagcgccgagagcaagctggtggtggagccccagcacgagtgcctggagaacaccaccagatgcttcctggagaagccccagttcagcaccgagctgagagaccacaacagactggacagccaggccaagttcgtggccagactgaagcacacctgcagcccccaggaggacagcccctggcaggaggaggagcagcacagagaccaggccagcggcggcggcgagggcttcgcccagggcgtgaaccccctgcccgacgaggacggcctggacggctgccagatcctggacgccggcagagaggaggtggccgtggccaagccccccgtgagcaagatcctgagccagggcttcaaggaccccgccaccgtgagcctgagacagaacgagaccccccagcccgccgcccagagaagcggccacctgtacaccggcagagagcagcccgcccccaaccacagaggcagcctgcccgtgaccaccatcttcagcggccccaagcacagcagaagcagccccaccccccagttcagcgtggtgggcagcagcagaagcctgcaggagctgaacctgagcgtggagccccccagccccaccgacgaggacacccagggccccaacagactgtggaacccccacctgagaggctacagcagcggcaagagcgtggccagaaccagcctgcaggccgaggacagcaaccagaaggccagcagcagactggacgacggcaccaccgaccacagacacctgaagcccgccacccccccctaccccatgcccagcaccctgagccacatgcccacccccgacttcaccaccagctggatgagcggcaccctggagcaggcccagcagggcaagagagagaagctgggcgtgcaggtgagacccgagaactggtgcagccagatggacaagggcatgctgcacttcggcagcagcgacatcagcccctacgccctgccctggagacccgaggagcccgccagaatcagctggaagcagtacatgagcggcagcgccgtggacgtgagctgcagccagaagccccagggcctgaccctgagcaacgtggccagatgcagcagcatggacaacggcctggaggaccagaacagccccttccacagccacctgagcacctacgccaacatctgcgacctgagcaccacccacagcagcaccgagaacgcccagggcagcaacgaggcctgggaggtgttcagaggcagcagcagcatcgccctgggcgacccccacatccccaccagccccgagggcgtggcccccaccagcggccacgacagaagaccccagttcagaggccccagcggcgaggccgactgcctgagaagcaagccccccctggccaagggcagcgccgccggccccgtggacgagatcatgctgctgtaccccagcgaggccggctgccccgtgggccagaccagaaccaacaccttcgagcagggcacccagaccctgggcagcagaagacactggagcagcaccgacatcagcttcgcccagcccgaggccagcgccgtgagcgccttcgacctggccagctggaccagcatgcacaacctgagcctgcacctgagccagctgctgcacagcaccagcgagctgctgggcagcctgagccagcccgacgtggccagaagagagcagaacaccaagagagacatccccgacaaggccccccaggccctgatgatggacggcagcacccagaccaccgtggacgagggcagccagaccgacctgaccctgcccaccctgtgcctgcagaccagcgaggccgagccccagggcgccaacgtgatcctggagggcctgggcagcgacaccagcaccgtgagccaggaggagggcgacgtgcccggcgtgccccagaagagagaggccgaggagaccgcccagaagatggcccagctgctgtacctgcaggaggagagcaccccctacaagccccagagccccagcatccccagcagccacctgagattccagaaggcccccgtgggccagcacctgcccagcgtgagccccagcgtgagcgacgccttcctgccccccagcagccagcccgaggagagctactgcctggtggtgagcagccccagccccagcagcccccacagccccggcctgttccccagcaccagcgagtaccccggcgacagcagagtgcagaagaagctgggccccaccagcgccctgttcgtggacagagccagcagccccatcctgaccctgagcgccagcacccaggagcccggcctgagccccggcagcctgaccctgagcgcccccagcacccaccccgtggagggccaccagaagctggacagcagccccgaccccgtggacgcccccagaacccccatggacaactacagccagaccaccgacgagctgggcggcagccagagaggcagaagcagcctgcagagaagcaacggcagaagcttcctggagctgcacagcccccacagcccccagcagagccccaagctgcagttcagcttcctgggccagcacccccagcagctgcagcccagaaccaccatcggcgtgcagagcagactgctgcccccccccctgagacacagaagccagagactgggcaacagcttcgtgcccgagaaggtggccagccccgagcactgccccctgagcggcagagagcccagccagtggcagagcagaaccgagaacggcggcgagagcagcgccagccccggcgagccccagagaaccctggacagacccagcagctggggcggcctgcagcacctgagcccctgccccgtgagcgagctgaccgacaccgccggcctgagaggcagcgccctgggcctgccccaggcctgccagcccgaggagctgctgtgcttcagctgccagatgtgcatggcccccgagcaccagcaccacagcctgagagacctgcccgtgcacaacaagttcagcaactggtgcggcgtgcagaagggcagccccggcggcctggacatgaccgaggaggagctgggcgccagcggcgacctgagcagcgagaagcaggagcagagccccccccagccccccaacgaccacagccaggacagcgagtggagcaagagagagcagatccccctgcaggtgggcgcccagaacctgagcctgagcgtggagctgaccgaggccaagctgcaccacggcttcggcgaggccgacgccctgctgcaggtgctgcagagcggcaccggcgaggccctggccgccgacgagcccgtgaccagcacctggaaggagctgtacgccagacagaagaaggccatcgagaccctgagaagagagagagccgagagactgggcaacttctgcagaaccagaagcctgagcccccagaagcagctgagcctgctgcccaacaaggacctgttcatctgggacctggacctgcccagcagaagaagagagtacctgcagcagctgagaaaggacgtggtggagaccaccagaagccccgagagcgtgagcagaagcgcccacacccccagcgacatcgagctgatgctgcaggactaccagcaggcccacgaggaggccaaggtggagatcgccagagccagagaccagctgagagagagaaccgagcaggagaagctgagaatccaccagaagatcatcagccagctgctgaaggaggaggacaagctgcacaccctggccaacagcagcagcctgtgcaccagcagcaacggcagcctgagcagcggcatgaccagcggctacaacagcagccccgccctgagcggccagctgcagttccccgagaacatgggccacaccaacctgcccgacagcagagacgtgtggatcggcgacgagagaggcggccacagcgccgtgagaaagaacagcgcctacagccacagagccagcctgggcagctgctgctgcagccccagcagcctgagcagcctgggcacctgcttcagcagcagctaccaggacctggccaagcacgtggtggacaccagcatggccgacgtgatggccgcctgcagcgacaacctgcacaacctgttcagctgccaggccaccgccggctggaactaccagggcgaggagcaggccgtgcagctgtactacaaggtgttcagccccaccagacacggcttcctgggcgccggcgtggtgagccagcccctgagcagagtgtgggccgccgtgagcgaccccaccgtgtggcccctgtactacaagcccatccagaccgccagactgcaccagagagtgaccaacagcatcagcctggtgtacctggtgtgcaacaccaccctgtgcgccctgaagcagcccagagacttctgctgcgtgtgcgtggaggccaaggagggccacctgagcgtgatggccgcccagagcgtgtacgacaccagcatgcccagacccagcagaaagatggtgagaggcgagatcctgcccagcgcctggatcctgcagcccatcaccgtggagggcaaggaggtgaccagagtgatctacctggcccaggtggagctgggcgcccccggcttccccccccagctgctgagcagcttcatcaagagacagcccctggtgatcgccagactggccagcttcctgggcagatag

SEQ ID NO: 24883 - DNA, 570 bp, Artificial Sequence
  Description of Artificial Sequence: Synthetic coding sequence
atgaccctggccgcctacaaggagaagatgaaggagctgcccctggtgagcctgttctgcagctgcttcctggccgaccccctgaacaagagcagctacaagtacgaggccgacaccgtggacctgaactggtgcgtgatcagcgacatggaggtgatcgagctgaacaagtgcaccagcggccagagcttcgaggtgatcctgaagccccccagcttcgacggcgtgcccgagttcaacgccagcctgcccagaagaagagaccccagcctggaggagatccagaagaagctggaggccgccgaggagagaagaaagtaccaggaggccgagctgctgaagcacctggccgagaagagagagcacgagagagaggtgatccagaaggccatcgaggagaacaacaacttcatcaagatggccaaggagaagctggcccagaagatggagagcaacaaggagaacagagaggcccacctggccgccatgctggagagactgcaggagaaggacaagcacgccgaggaggtgagaaagaacaaggagctgaaggaggaggccagcagatag

SEQ ID NO: 24884 - DNA, 651 bp, Artificial Sequence
  Description of Artificial Sequence: Synthetic coding sequence
atgaccctggccgcctacaaggagaagatgaaggagctgcccctggtgagcctgttctgcagctgcttcctggccgaccccctgaacaagagcagctacaagtacgagggctggtgcggcagacagtgcagaagaaaggacgagagccagagaaaggacagcgccgactggagagagagaagagcccaggccgacaccgtggacctgaactggtgcgtgatcagcgacatggaggtgatcgagctgaacaagtgcaccagcggccagagcttcgaggtgatcctgaagccccccagcttcgacggcgtgcccgagttcaacgccagcctgcccagaagaagagaccccagcctggaggagatccagaagaagctggaggccgccgaggagagaagaaagtaccaggaggccgagctgctgaagcacctggccgagaagagagagcacgagagagaggtgatccagaaggccatcgaggagaacaacaacttcatcaagatggccaaggagaagctggcccagaagatggagagcaacaaggagaacagagaggcccacctggccgccatgctggagagactgcaggagaaggacaagcacgccgaggaggtgagaaagaacaaggagctgaaggaggaggccagcagatag

SEQ ID NO: 24885 - DNA, 945 bp, Artificial Sequence
  Description of Artificial Sequence: Synthetic coding sequence
atgagcttcctggtgagcaagcccgagagaatcagaaccaacgacgccagcagcgagagcatcgccagcttcagcaagcaggaggtgatgagcagcttcctgcccgagggcggctgctacgagctgctgaccgtgatcggcaagggcttcgaggacctgatgaccgtgaacctggccagatacaagcccaccggcgagtacgtgaccgtgagaagaatcaacctggaggcctgcagcaacgagatggtgaccttcctgcagggcgagctgcacgtgagcaagctgttcaaccaccccaacatcgtgccctacagagccaccttcatcgccgacaacgagctgtgggtggtgaccagcttcatggcctacggcagcgccaaggacctgatctgcacccacttcatggacggcatgaacgagctggccatcgcctacatcctgcagggcgtgctgaaggccctggactacatccaccacatgggctacgtgcacagaagcgtgaaggccagccacatcctgatcagcgtggacggcaaggtgtacctgagcggcctgagaagcaacctgagcatgatcagccacggccagagacagagagtggtgcacgacttccccaagtacagcgtgaaggtgctgccctggctgagccccgaggtgctgcagcagaacctgcagggctacgacgccaagagcgacatctacagcgtgggcatcaccgcctgcgagctggccaacggccacgtgcccttcaaggacatgcccgccacccagatgctgctggagaagctgaacggcaccgtgccctgcctgctggacaccagcaccatccccgccgaggagctgaccatgagccccagcagaagcgtggccaacagcggcctgagcgacagcctgaccaccagcacccccagacccagcaacggccccgtgcccgcccccagctag

SEQ ID NO: 24886 - DNA, 2073 bp, Artificial Sequence
  Description of Artificial Sequence: Synthetic coding sequence
atgggcgccgtggccagagcccacggcggcctgagagtggccagagccagagagagcgtggccggcggcagacacagaggcgccggcagacccggcgccagagccgccggcgccgccgccggcctggtgagagccgaggccggcggcagaagagccggcagaggcagaagacccggcagaggcctgcccaccggcggcggcggcctggccgccgccgccgtgggcagagaggtggcccagggcctgtgcgacgccatcagactggacggcggcctggacctgctgctgagactgctgcaggcccccgagctggagaccagagtgcaggccgccagactgctggagcagatcctggtggccgagaacagagacagagtggccagaatcggcctgggcgtgatcctgaacctggccaaggagagagagcccgtggagctggccagaagcggcagcggcatcctggagcacatgttcaagcacagcgaggagacctgccagagactggtggccgccggcggcctggacgccgtgctgtactggtgcagaagaaccgaccccgccctgctgagacactgcgccctggccctgggcaactgcgccctgcacggcggccaggccgtgcagagaagaatggtggagaagagagccgccgagtggctgttccccctggccttcagcaaggaggacgagctgctgagcctgcacgcctgcctggccgtggccgtgctggccaccaacaaggaggtggagagagaggtggagagaagcggcaccctggccctggtggagcccctggtggccagcctggaccccggcagattcgccagatgcctggtggacgccagcgacaccagccagggcagaggccccgacgacctgcagagactggtgcccctgctggacagcaacagactggaggcccagtgcatcggcgccttctacctgtgcgccgaggccgccatcaagagcctgcagggcaagaccaaggtgttcagcgacatcggcgccatccagagcctgaagagactggtgagctacagcaccaacggcaccaagagcgccctggccaagagagccctgagactgctgggcgaggaggtgcccagacccatcctgcccagcgtgcccagctggaaggaggccgaggtgcagacctggctgcagcagatcggcttcagcaagtactgcgagagcttcagagagcagcaggtggacggcgacctgctgctgagactgaccgaggaggagctgcagaccgacctgggcatgaagagcggcatcaccagaaagagattcttcagagagctgaccgagctgaagaccttcgccaactacagcacctgcgacagaagcaacctggccgactggctgggcagcctggaccccagattcagacagtacacctacggcctggtgagctgcggcctggacagaagcctgctgcacagagtgagcgagcagcagctgctggaggactgcggcatccacctgggcgtgcacagagccagaatcctgaccgccgccagagagatgctgcacagccccctgccctgcaccggcggcaagcccagcggcgacacccccgacgtgttcatcagctacagaagaaacagcggcagccagctggccagcctgctgaaggtgcacctgcagctgcacggcttcagcgtgttcatcgacgtggagaagctggaggccggcaagttcgaggacaagctgatccagagcgtgatgggcgccagaaacttcgtgctggtgctgagccccggcgccctggacaagtgcatgcaggaccacgactgcaaggactgggtgcacaaggagatcgtgaccgccctgagctgcggcaagaacatcgtgcccatcatcgacggcttcgagtggcccgagccccaggtgctgcccgaggacatgcaggccgtgctgaccttcaacggcatcaagtggagccacgagtaccaggaggccaccatcgagaagatcatcagattcctgcagggcagaagcagcagagacagcagcgccggcagcgacaccagcctggagggcgccgcccccatgggccccacctag

SEQ ID NO: 24887 - DNA, 2169 bp, Artificial Sequence
  Description of Artificial Sequence: Synthetic coding sequence
atggtgctgaccctgctgctgagcgcctacaagctgtgcagattcttcgccatgagcggccccagaagaggcgccgagagactggccgtgcccggccccgacggcggcggcggcaccggcccctggtgggccgccggcggccccggccccagagtgagccccggcgccggcaccgaggtgcaggacgccctggagagagccctgcccgagctgcagcaggccctgagcgccctgaagcaggccggcggcgccagagccgtgggcgccggcctggccgaggtgttccagctggtggaggaggcctggctgctggccgtgggcagagaggtggcccagggcctgtgcgacgccatcagactggacggcggcctggacctgctgctgagactgctgcaggcccccgagctggagaccagagtgcaggccgccagactgctggagcagatcctggtggccgagaacagagacagagtggccagaatcggcctgggcgtgatcctgaacctggccaaggagagagagcccgtggagctggccagaagcggcagcggcatcctggagcacatgttcaagcacagcgaggagacctgccagagactggtggccgccggcggcctggacgccgtgctgtactggtgcagaagaaccgaccccgccctgctgagacactgcgccctggccctgggcaactgcgccctgcacggcggccaggccgtgcagagaagaatggtggagaagagagccgccgagtggctgttccccctggccttcagcaaggaggacgagctgctgagcctgcacgcctgcctggccgtggccgtgctggccaccaacaaggaggtggagagagaggtggagagaagcggcaccctggccctggtggagcccctggtggccagcctggaccccggcagattcgccagatgcctggtggacgccagcgacaccagccagggcagaggccccgacgacctgcagagactggtgcccctgctggacagcaacagactggaggcccagtgcatcggcgccttctacctgtgcgccgaggccgccatcaagagcctgcagggcaagaccaaggtgttcagcgacatcggcgccatccagagcctgaagagactggtgagctacagcaccaacggcaccaagagcgccctggccaagagagccctgagactgctgggcgaggaggtgcccagacccatcctgcccagcgtgcccagctggaaggaggccgaggtgcagacctggctgcagcagatcggcttcagcaagtactgcgagagcttcagagagcagcaggtggacggcgacctgctgctgagactgaccgaggaggagctgcagaccgacctgggcatgaagagcggcatcaccagaaagagattcttcagagagctgaccgagctgaagaccttcgccaactacagcacctgcgacagaagcaacctggccgactggctgggcagcctggaccccagattcagacagtacacctacggcctggtgagctgcggcctggacagaagcctgctgcacagagtgagcgagcagcagctgctggaggactgcggcatccacctgggcgtgcacagagccagaatcctgaccgccgccagagagatgctgcacagccccctgccctgcaccggcggcaagcccagcggcgacacccccgacgtgttcatcagctacagaagaaacagcggcagccagctggccagcctgctgaaggtgcacctgcagctgcacggcttcagcgtgttcatcgacgtggagaagctggaggccggcaagttcgaggacaagctgatccagagcgtgatgggcgccagaaacttcgtgctggtgctgagccccggcgccctggacaagtgcatgcaggaccacgactgcaaggactgggtgcacaaggagatcgtgaccgccctgagctgcggcaagaacatcgtgcccatcatcgacggcttcgagtggcccgagccccaggtgctgcccgaggacatgcaggccgtgctgaccttcaacggcatcaagtggagccacgagtaccaggaggccaccatcgagaagatcatcagattcctgcagggcagaagcagcagagacagcagcgccggcagcgacaccagcctggagggcgccgcccccatgggccccacctag

SEQ ID NO: 24888 - DNA, 1254 bp, Artificial Sequence
  Description of Artificial Sequence: Synthetic coding sequence
atggccagcagcaagctgagagagcccgtggacgaggtgttcgacctggacctggccgtgcccgagaccgccagactggacagcagcctgcacaaggccagagcccagctgctggccaagggcagaagacacagacccagcagaagcagactgagagacagcgccagcagcgccgaggacggcgagggcagcgacggccccggcggcaaggtgaccgacggctgcggcagccccctgcacagactgagaagccccctgcacagcggccccggcagccccgccggcggcagcttctgcctggacccccccggcctgagaagaagcctggacgaggacgagcccccccccagccccctgaccagatacagacccctgcacaacgccgccagccacgagggcctggccgccgccagctgcagcccccccagaagcgcccccagcagcgacagcagccccagcttcgtgagaagacaccccagagccgagccccacagcgaggacgacagcagagacgccagcccccccgagcccgccagccccaccatcggcctggacaagaagaccagaagaaagttcctggacctgggcgtgaccctgagaagagccagcaccggcaagagcagaaaggagaagggcagcaacagactgagcatgggcagcagagagagcgtggagggcagcggcagaagcggcggcagccccttcctgcccttcagctggttcaccgacagcggcaagggcagcgccagcagcggcagcaccaccagccccacctgcagccccaagcacgagggcttcagccccaagaagagcgccagccaggagagcaccctgagcgacgacagcaccccccccagcagcagccccaagatccccagcggcccctggcaggaggccaagtgcagctacccctaccacaccctgagccagagcagcgacgagttcctggacgagcccctgccccccgtgcaccactggaccagccagcaggtgggccagtggctgcagagcctgaacctggagcagtacgccgccgagttcgccgccagacaggtggacggcccccagctgctgcagctggacggcagcaagctgaagagcctgggcctgagcaacagccacgacagagccctggtgaagagaaagctgaaggagatggccgccgccgccgagaaggagagaaaggcccaggagaaggccgccagacagagagagaagctgagaagaagagagcaggaggccaagaagagctag

SEQ ID NO: 24889 - DNA, 1338 bp, Artificial Sequence
  Description of Artificial Sequence: Synthetic coding sequence
atggccagcagcaagctgagagagcccgtggacgaggtgttcgacctggacctggccgtgcccgagaccgccagactggacagcagcctgcacaaggccagagcccagctgctggccaagggcagaagacacagacccagcagaagcagactgagagacagcgccagcagcgccgaggacggcgagggcagcgacggccccggcggcaaggtgaccgacggctgcggcagccccctgcacagactgagaagccccctgcacagcggccccggcagccccgccggcggcagcttctgcctggacccccccggcctgagaagaagcctggacgaggacgagcccccccccagccccctgaccagatacagacccctgcacaacgccgccagccacgagggcctggccgccgccagctgcagcccccccagaagcgcccccagcagcgacagcagccccagcttcgtgagaagacaccccagagccgagccccacagcgaggacgacagcagagacgccagcccccccgagcccgccagccccaccatcggcctggacaagaagaccagaagaaagttcctggacctgggcgtgaccctgagaagagccagcaccggcaagagcagaaaggagaagggcagcaacagactgagcatgggcagcagagagagcgtggagggcagcggcagaagcggcggcagccccttcctgcccttcagctggttcaccgacagcggcaagggcagcgccagcagcggcagcaccaccagccccacctgcagccccaagcacgagggcttcagccccaagaagagcgccagccaggcccagctgctggcccacgcccaggaggccctgagcaacagctggtgcctggtgcaggacttcggcagcacccagatcggcatggagagcaccctgagcgacgacagcaccccccccagcagcagccccaagatccccagcggcccctggcaggaggccaagtgcagctacccctaccacaccctgagccagagcagcgacgagttcctggacgagcccctgccccccgtgcaccactggaccagccagcaggtgggccagtggctgcagagcctgaacctggagcagtacgccgccgagttcgccgccagacaggtggacggcccccagctgctgcagctggacggcagcaagctgaagagcctgggcctgagcaacagccacgacagagccctggtgaagagaaagctgaaggagatggccgccgccgccgagaaggagagaaaggcccaggagaaggccgccagacagagagagaagctgagaagaagagagcaggaggccaagaagagctag

SEQ ID NO: 24890 - DNA, 42 bp, Artificial Sequence
  Description of Artificial Sequence: Synthetic coding sequence
atggccagcagcaagctgagagagcccgtggacgaggtgtag

SEQ ID NO: 24891 - DNA, 978 bp, Artificial Sequence
  Description of Artificial Sequence: Synthetic coding sequence
atgagcgacctgcaggccgccgagggccccggcagctggagccccaccgccagacccggcagcgccggcggcgtgggcgactgccagggcgtggagggcagccaggccgccgccagcgagaacgaggacctggagaacaaggacaccagcctgctggccagcgccaccgaccccgagccctgcagcagcccccacagaccccagatggtgagccccgtgagcaaggacgccaccgaggacctgagaaaggccaccggccccctggaggcccaggccctggtgaagcaggacctgctgcccgccgaccaggcccaggtgctgaacgagatggccaagtaccaggtgccccagagaagcggcgacatcgtgatgatccagagcgagcacaccggcgccatcgacgtgctgagcgccgacctggagagcgccgacctgctgggcgaccacagaaaggtgagcccccccctgatggcccccccctgcatctggaccttcgccaaggtgaaggagttcaagagcaagctgggcaaggagaagaacagcagactggtggtgaagagaggcgaggtggtgaccatcagagtgcccacccaccccgagggcaagagagtgtgctgggagttcgccaccgacgactacgacatcggcttcggcgtgtacttcgactggacccccgtgaccagcaccgacatcaccgtgcaggtgagcgacagcagcgacgacgaggacgaggaggaggaggaggaggaggagatcgaggagcccgtgcccgccggcgacgtggagagaggcagcagaagcagcctgagaggcagatacggcgaggtgatgcccgtgtacagaagagacagccacagagacgtgcaggccggcagccacgactaccccggcgagggcatctacctgctgaagttcgacaacagctacagcctgctgagaaacaagaccctgtacttccacatctactacaccagctag

SEQ ID NO: 24892 - DNA, 666 bp, Artificial Sequence
  Description of Artificial Sequence: Synthetic coding sequence
atggagacctggagcgtggagcaggtgtgcagctggctggtggagaagaacctgggcgagctggtgcacagattccaggaggaggaggtgagcggcgccgccctgctggccctgaacgacagaatggtgcagcagctggtgaagaagatcggccaccaggccgtgctgatggacctgatcaagaagtacaagcagaacacccagggcctgaagagccccgagaaccccaagaaggccgccctggtgatgcagaccgaggccgccagagactacagagacgaggagagcagcagccccgccagacacggcgagcagatgcccagcttctaccccgccgagaacctggacaacggcctgatcgaccagagagtgctgaagcagagaagaaacgtgaagcagatcctggccagaagcaaggccctgcagtggaccaagagctacgtgctgcccgagttcccctacgacgtgaagtgcatgctggccgagcagaagtgccccgaccacagcatgagaatcagaatcatcgagttcctgcaggccgacatgaccaagtacctggagggcagcctgtaccccagcacccagcagtacaacgacgtggtgaacgccctgctgcaggcccaccccttcctggacgaggacggctgcggcttcgccggcgtgtag

SEQ ID NO: 24893 - DNA, 1563 bp, Artificial Sequence
  Description of Artificial Sequence: Synthetic coding sequence
atggagacctggagcgtggagcaggtgtgcagctggctggtggagaagaacctgggcgagctggtgcacagattccaggaggaggaggtgagcggcgccgccctgctggccctgaacgacagaatggtgcagcagctggtgaagaagatcggccaccaggccgtgctgatggacctgatcaagaagtacaagcagaacacccagggcctgaagagccccgagaaccccaagaaggccgccctggtgatgcagaccgaggccgccagagactacagagacgaggagagcagcagccccgccagacacggcgagcagatgcccagcttctaccccgccgagaacctggacaacggcctgatcgaccagagagtgctgaagcagagaagaaacgtgaagcagatcctggccagaagcaaggccctgcagtggaccaagagctacgtgctgcccgagttcccctacgacgtgaagtgcatgctggccgagcagaagtgccccgaccacagcatgagaatcagaatcatcgagttcctgcaggccgacatgaccaagtacctggagggcagcctgtaccccagcacccagcagtacaacgacgtggtgaacgccctgctgcaggcccaccccttcctggacgaggacggctgcggcttcttcctgtggaagagagccctgaaggacagattcaagtacgtgagaagacccatcgaggacgacgagcaggtgatcagaaacaagtgcaagttcggccacagaagaggccagaccagaaagagcctggccgacatcagattcgacgagatcaagctggtgcagatcaaggaggaggccgtgtgcttcgacagcgagctggacgagcacatcaagtggttccagcaggagtacgtgaagaccgagaaggactggagagagatcgacaagagaatgagccagaccctggagatcagaagaaagatgatcggcagcagaacccccctgaaggacatcctgaagctgttccccttcctgaagtgcccctaccagatgttcagagagttccagctgctgaccagaaccgacatctacaagaagaccagacacatcctggagagctacagcgagaacatcctgaccagcttcagcgtggtggacaaccccatcaacatcgtgctgcaggagaagatgaagcactacaccgacgaggacatgctgaagtacatgaagatgaccgccacctgcctgctgctgcccgacgtgttcggcgacgaccccagcctgttcgtgatcatgaacgagcaggtgcaggtgagcacccccgtgctggaggtgaagaaccccttcaacatggaggtgtgcgagttcagcctgtacctggagagagagagactgaccaaggtggacgactgcgtgaccgccctggccgccctggtggccgccttccacgtgttcagaatcgagtgccccagaagactgagccagaccttcaacttcctggagaccctgatcttcgacatgcacagcccctacttccccagcctgaaggagaaggagaacgaggtgggcttccagcaccccctgacctag

SEQ ID NO: 24894 - DNA, 1563 bp, Artificial Sequence; identical to SEQ ID NO: 24893
  Description of Artificial Sequence: Synthetic coding sequence

SEQ ID NO: 24895 - DNA, 1563 bp, Artificial Sequence; identical to SEQ ID NO: 24893
  Description of Artificial Sequence: Synthetic coding sequence

SEQ ID NO: 24896 - DNA, 522 bp, Artificial Sequence
  Description of Artificial Sequence: Synthetic coding sequence
atggagacctggagcgtggagcaggtgtgcagctggctggtggagaagaacctgggcgagctggtgcacagattccaggaggaggaggtgagcggcgccgccctgctggccctgaacgacagaatggtgcagcagctggtgaagaagatcggccaccaggccgtgctgatggacctgatcaagaagtacaagcagaacacccagggcctgaagagccccgagaaccccaagaaggccgccctggtgatgcagaccgaggccgccagagactacagagacgaggagagcagcagccccgccagacacggcgagcagatgcccagcttctaccccgccgagaacctggacaacggcctgatcgaccagagagtgctgaagcagagaagaaacgtgaagcagatcctggccagaagcaaggccctgcagtggaccaagagctacgtgctgcccgagttcccctacgacgtgaagtgcatgctggccgagcagaagtgccccgaccacagcatgagaatcagatag

SEQ ID NO: 24897 - DNA, 2085 bp, Artificial Sequence
  Description of Artificial Sequence: Synthetic coding sequence
atgatgttcagagaccaggtgggcatcctggccggctggttcaagggctggaacgagtgcgagcagaccgtggccctgctgagcctgctgaagagagtgaccagaacccaggccagattcctgcagctgtgcctggagcacagcctggccgactgcaacgacatccacctgctggagagcgaggccaacagcgccgccatcgtgagccagtggcagcaggagagcaaggagaaggtggtgagcctgctgctgagccacctgcccctgctgcagcccggcaacaccgaggccaagagcgagtacatgagactgctgcagaaggtgctggcctacagcatcgagagcaacgccttcatcgaggagagcagacagctgctgagctacgccctgatccaccccgccaccaccctggaggacagaaacgccctggccctgtggctgagccacctggaggagagactggccagcggcttcagaagcagacccgagcccagctaccacagcagacagggcagcgacgagtggggcggccccgccgagctgggccccggcgaggccggccccggctggcaggacaagccccccagagagaacggccacgtgcccttccaccccagcagcagcgtgccccccgccatcaacagcatcggcagcaacgccaacaccggcctgccctgccagatccaccccagccccctgaagagaagcatgagcctgatccccaccagcccccaggtgcccggcgagtggcccagccccgaggagctgggcgccagagccgccttcaccacccccgaccacgcccccctgagcccccagagcagcgtggccagcagcggcagcgagcagaccgaggagcagggcagcagcagaaacaccttccaggaggacggcagcggcatgaaggacgtgcccagctggctgaagagcctgagactgcacaagtacgccgccctgttcagccagatgagctacgaggagatgatgaccctgaccgagcagcacctggagagccagaacgtgaccaagggcgccagacacaagatcgccctgagcatccagaagctgagagagagacagagcgtgctgaagagcctggagaaggacgtgctggagggcggcaacctgagaaacgccctgcaggagctgcagcagatcatcatcacccccatcaaggcctacagcgtgctgcaggccaccgtggccgccgccaccaccacccccaccgccaaggacggcgcccccggcgagccccccctgcccggcgccgagccccccctggcccaccccggcaccgacaagggcaccgaggccaaggacccccccgccgtggagaactacccccccccccccgcccccgcccccaccgacggcagcgagcccgcccccgcccccgtggccgacggcgacatccccagccagttcaccagagtgatgggcaaggtgtgcacccagctgctggtgagcagacccgacgaggagaacatcaccagctacctgcagctgatcgagaagtgcctgacccacgaggccttcaccgagacccagaagaagagactgctgagctggaagcagcaggtgctgaagctgctgagaaccttccccagaaaggccgccctggagatgcagaactacagacagcagaagggctgggccttcggcagcaacagcctgcccatcgccggcagcgtgggcatgggcgtggccagaagaacccagagacagttccccatgccccccagagccctgccccccggcagaatgggcctgctgagccccagcggcatcggcggcgtgagccccagacacgccctgaccagccccagcctgggcggccagggcagacagaacctgtggttcgccaaccccggcggcagcaacagcatgcccagccagagcagaagcagcgtgcagagaacccacagcctgcccgtgcacagcagcccccaggccatcctgatgttcccccccgactgccccgtgcccggccccgacctggagatcaaccccaccctggagagcctgtgcctgagcatgaccgagcacgccctgggcgacggcaccgacaagaccagcaccatctag

SEQ ID NO: 24898 - DNA, 1992 bp, Artificial Sequence
  Description of Artificial Sequence: Synthetic coding sequence
atgatgttcagagaccaggtgggcatcctggccggctggttcaagggctggaacgagtgcgagcagaccgtggccctgctgagcctgctgaagagagtgaccagaacccaggccagattcctgcagctgtgcctggagcacagcctggccgactgcaacgacatccacctgctggagagcgaggccaacagcgccgccatcgtgagccagtggcagcaggagagcaaggagaaggtggtgagcctgctgctgagccacctgcccctgctgcagcccggcaacaccgaggccaagagcgagtacatgagactgctgcagaaggtgctggcctacagcatcgagagcaacgccttcatcgaggagagcagacagctgctgagctacgccctgatccaccccgccaccaccctggaggacagaaacgccctggccctgtggctgagccacctggaggagagactggccagcggcttcagaagcagacccgagcccagctaccacagcagacagggcagcgacgagtggggcggccccgccgagctgggccccggcgaggccggccccggctggcaggacaagccccccagagagaacggccacgtgcccttccaccccagcagcagcgtgccccccgccatcaacagcatcggcagcaacgccaacaccggcctgccctgccagatccaccccagccccctgaagagaagcatgagcctgatccccaccagcccccaggtgcccggcgagtggcccagccccgaggagctgggcgccagagccgccttcaccacccccgaccacgcccccctgagcccccagagcagcgtggccagcagcggcagcgagcagaccgaggagcagggcagcagcagaaacaccttccaggaggacggcagcggcatgaaggacgtgcccagctggctgaagagcctgagactgcacaagtacgccgccctgttcagccagatgagctacgaggagatgatgaccctgaccgagcagcacctggagagccagaacgtgaccaagggcgccagacacaagatcgccctgagcatccagaagctgagagagagacagagcgtgctgaagagcctggagaaggacgtgctggagggcggcaacctgagaaacgccctgcaggagctgcagcagatcatcatcacccccatcaaggcctacagcgtgctgcaggccaccgtggccgccgccaccaccacccccaccgccaaggacggcgcccccggcgagccccccctgcccggcgccgagccccccctggcccaccccggcaccgacaagggcaccgaggccaaggacccccccgccgtggagaactacccccccccccccgcccccgcccccaccgacggcagcgagcccgcccccgcccccgtggccgacggcgacatccccagccagttcaccagagtgatgggcaaggtgtgcacccagctgctggtgagcagacccgacgaggagaacatcaccagctacctgcagctgatcgagaagtgcctgacccacgaggccttcaccgagacccagaagaagagactgctgagctggaagcagcaggtgctgaagctgctgagaaccttccccagaaaggccgccctggagatgcagaactacagacagcagaagggctgggccttcggcagcaacagcctgcccatcgccggcagcgtgggcatgggcgtggccagaagaacccagagacagttccccatgccccccagagccctgccccccggcagaatgggcctgctgagccccagcggcatcggcggcgtgagccccagacacgccctgaccccccagccctggagacccggccccaccgagcccgtggtgtgccagccctggagacagcagcagcacgcccagagcgagccccagctgtgcgccgcccaccccctggcccccggccccctggtgacccccggccacagccacgtgcccagcagactgcccggcagctgggcctag

SEQ ID NO: 24899 - DNA, 522 bp, Artificial Sequence
  Description of Artificial Sequence: Synthetic coding sequence
atgtgcaccaacatcgtgtacgagtggctgaaggccctgcagctgccccagtacgccgagagcttcgtggacaacggctacgacgacctggaggtgtgcaagcagatcggcgaccccgacctggacgccatcggcgtgctggcccccgcccacagaagaagaatcctggaggccgtgagaagactgagagagcaggacgccaacgccgccggcctgtacttcaccctggagccccagcccgccccccccggcccccccgccgacgccgtgcccaccggcagaagaggcgagccctgcggcggccccgcccagggcaccagaggcgacagcagaggccacaccaccgcccccagaagcagagagctggtgagctaccccaagctgaagctgaagatcatgatcagagacaagctggtgagagacggcatccacctgagcaagcccccctacagcagaaaggtgcccatggccggcatcctggagtacctgatgaactggcccaagagcagccagagcagatag

SEQ ID NO: 24900 - DNA, 1341 bp, Artificial Sequence
  Description of Artificial Sequence: Synthetic coding sequence
atggccgtgaaccccctgctgacccccaccggccagcagaccatccccctgatccccagccccttcggcccccccaccgtggacagagacgtgctgcccagcaccgtggcccccaccgaccccagacagttctgcgtgcccagccagttcggcagcagcgtgctgcccaacaccaacatggccaacgtgctgagcagcagaatctaccccggctggggcatcctgccccccgagagcatcaaggccgtggccagaagaaacgagatgatccagagacaccacaccgccagaaccgagatggagatgtacgccatctaccagcagagaagaatggagaagatcaaccccaagggcctggccggcctgggcatccccttcctgtacggcagcagcgtgcccgccgcccccgccgcctaccacggcagaagcatgctgcccgccggcgacctgcacttccacagaagcaccctgagaaacctgcagggcaaccccatgctggccgccaccgccccccacttcgaggagagctggggccagagatgcagaagactgagaaagaacaccggcaaccagaaggccctggacagcgacgccgagagcagcaagagccaggccgaggagaagatcctgggccagacccacgccgtgccctacgaggaggaccactacgccaaggaccccgacatcgaggcccccagcaaccagaagagcagcgagaccaacgagaagcccaccaccgccctggccaacacctgcggcgagctggagcccacccacagaaagccctggggcagccacaccaccaccctgaaggccaaggcctgggacgacggcaaggaggaggccagcgagcagatcttcgccacctgcgacgagaagaacggcgtgtgcccccccgtgcccagacccagcctgcccggcacccacgccctggtgaccatcggcggcaacctgagcctggacgaggacatccagaagtggaccgtggacgacgtgcacagcttcatcagaagcctgcccggctgcagcgactacgcccaggtgttcaaggaccacgccatcgacggcgagaccctgcccctgctgaccgaggagcacctgagaggcaccatgggcctgaagctgggccccgccctgaagatccagagccaggtgagccagcacgtgggcagcatgttctacaagaagaccctgagcttccccatcagacaggccttcgaccagcccgccgacaccagccccctgctggaccccaacagctggagcgacaccatgaacatcttctgcccccaggacaccatcatccccaagggcatcgagagaggcagcatgagaaactag

SEQ ID NO: 24901 - DNA, 1341 bp, Artificial Sequence; identical to SEQ ID NO: 24900
  Description of Artificial Sequence: Synthetic coding sequence

SEQ ID NO: 24902 - DNA, 2781 bp, Artificial Sequence
  Description of Artificial Sequence: Synthetic coding sequence
atgaagaagaccagaagcaccaccctgagaagagcctggcccagcagcgacttcagcgacagagccagcgacagaatgagaagcagaagcgagaaggactacagactgcacaagagattccccgccgccttcgccccccaggccagcagaggctacatgaccagcggcgacgtgagccccatcagcatgagccccatcagccagagccagttcatccccctgggcgagatcctgtgcctggccatcagcgccatgaacagcgccagaaagcccgtgacccaggaggccctgatggagcacctgaccacctgcttccccggcgtgcccacccccagccaggagatcctgagacacaccctgaacaccctggtgagagagagaaagatctaccccacccccgacggctacttcatcgtgaccccccagacctacttcatcacccccagcctgatcagaaccaacagcaagtggtaccacctggacgagagaatccccgacagaagccagtgcaccagcccccagcccggcaccatcacccccagcgccagcggctgcgtgagagagagaaccctgcccagaaaccactgcgacagctgccactgctgcagagaggacgtgcacagcacccacgcccccaccctgcagagaaagagcgccaaggactgcaaggacccctactgcccccccagcctgtgccaggtgccccccaccgagaagagcaagagcaccgtgaacttcagctacaagaccgagaccctgagcaagcccaaggacagcgagaagcagagcaagaagttcggcctgaagctgttcagactgagcttcaagaaggacaagaccaagcagctggccaacttcagcgcccagttcccccccgaggagtggcccctgagagacgaggacacccccgccaccatccccagagaggtggagatggagatcatcagaagaatcaaccccgacctgaccgtggagaacgtgatgagacacaccgccctgatgaagaagctggaggaggagaaggcccagagaagcaaggccggcagcagcgcccaccacagcggcagaagcaagaagagcagaacccacagaaagagccacggcaagagcagaagccacagcaagaccagagtgagcaagggcgaccccagcgacggcagccacctggacatccccgccgagagagagtacgacttctgcgaccccctgaccagagtgcccagagagggctgcttcatcatcgagcacaagggcgacaacttcatcatgcacagcaacaccaacgtgctggagagccacttccccatgacccccgagtgggacgtgagcggcgagctggccaagagaagaaccgagatgcccttccccgagcccagcagaggcagcagccacagcaaggtgcacagaagccacagccacacccaggacagaagaagcagaaacgagagaagcaacaaggccaaggagagaagcagaagcatggacaacagcaagggccccctgggcgccagcagcctgggcacccccgaggacctggccgagggctgcagccaggacgaccagacccccagccagagctacatcgacgacagcaccctgagacccgcccagaccgtgagcctgcagagagcccacatcagcagcaccagctacaaggaggtgtgcatccccgagatcgtgagcggcagcaaggagcccagcagcgcctgcagcctgctggagcccggcaagccccccgagagcctgcccagctacggcgagctgaacagctgccccaccaagaccgccaccgacgactacttccagtgcaacaccagcagcgagaccgtgctgaccgcccccagccccctgggcaagaacaaggaggaccacgacaccctgaccctggccgagggcgtgaagaagctgagccccagcgacagacaggtgccccacagcagcagagagcccgtgggccacaaggaggagagccccaagggccccggcggcggccccgccgccagcggcggcgtggccgagggcatcgccaacggcagactggtgcagcaccacggcgccgagcccagcagcctggacaagagaaaggagatcttcagcaaggacaccctgttcaagcccctgcacagcaccctgagcgtgaacagctaccacaagagcagcctgagcctgctgaagagccaccccaagacccccgccgacaccctgcccggcagatgcgagaagctggagcccagcctgggcaccagcgccgcccaggccatgcccgccagccagagacagcaggagagcggcggcaaccaggaggccagcttcgactactacaacgtgagcgacgacgacgacagcgaggagggcgccaacaagaacaccgaggaggagaagaacagagaggacgtgggcaccatgcagtggctgctggagagagagaaggagagagacctgcagagaaagttcgagaagaacctgaccctgctggcccccaaggagaccgacagcagcagcaaccagagagccacccacagcgccagactggacagcatggacagcagcagcatcaccgtggacagcggcttcaacagccccagaaccagagagagcctggccagcaacaccagcagcatcgtggagagcaacagaagacagaaccccgccctgagccccgcccacggcggcgccggccccgccttcaacttcagagccagcgccgagccccccaccaacgaggccgagaagctgcagaagcccagcaactgcctgcaggccagcgtgaccagcgtgtag

SEQ ID NO: 24903 - DNA, 2592 bp, Artificial Sequence
  Description of Artificial Sequence: Synthetic coding sequence
atgaagaagaccagaagcaccaccctgagaagagcctggcccagcagcgacttcagcgacagagccagcgacagaatgagaagcagaagcgagaaggactacagactgcacaagagattccccgccgccttcgccccccaggccagcagaggctacatgaccagcggcgacgtgagccccatcagcatgagccccatcagccagagccagttcatccccctgggcgagatcctgtgcctggccatcagcgccatgaacagcgccagaaagcccgtgacccaggaggccctgatggagcacctgaccacctgcttccccggcgtgcccacccccagccaggagatcctgagacacaccctgaacaccctggtgagagagagaaagatctaccccacccccgacggctacttcatcgtgaccccccagacctacttcatcacccccagcctgatcagaaccaacagcaagtggtaccacctggacgagagaatccccgacagaagccagtgcaccagcccccagcccggcaccatcacccccagcgccagcggctgcgtgagagagagaaccctgcccagaaaccactgcgacagctgccactgctgcagagaggacgtgcacagcacccacgcccccaccctgcagagaaagagcgccaaggactgcaaggacccctactgcccccccagcctgtgccaggtgccccccaccgagaagagcaagagcaccgtgaacttcagctacaagaccgagaccctgagcaagcccaaggacagcgagaagcagagcaagaagttcggcctgaagctgttcagactgagcttcaagaaggacaagaccaagcagctggccaacttcagcgcccagttcccccccgaggagtggcccctgagagacgaggacacccccgccaccatccccagagaggtggagatggagatcatcagaagaatcaaccccgacctgaccgtggagaacgtgatgagacacaccgccctgatgaagaagctggaggaggagaaggcccagagaagcaaggccggcagcagcgcccaccacagcggcagaagcaagaagagcagaacccacagaaagagccacggcaagagcagaagccacagcaagaccagagtgagcaagggcgaccccagcgacggcagccacctggacatccccgccgagagagagtacgacttctgcgaccccctgaccagagtgcccagagagggctgcttcatcatcgagcacaagggcgacaacttcatcatgcacagcaacaccaacgtgctggagagccacttccccatgacccccgagtgggacgtgagcggcgagctggccaagagaagaaccgagatgcccttccccgagcccagcagaggcagcagccacagcaaggtgcacagaagccacagccacacccaggacagaagaagcagaaacgagagaagcaacaaggccaaggagagaagcagaagcatggacaacagcaagggccccctgggcgccagcagcctgggcacccccgaggacctggccgagggctgcagccaggacgaccagacccccagccagagctacatcgacgacagcaccctgagacccgcccagaccgtgagcctgcagagagcccacatcagcagcaccagctacaaggaggtgtgcatccccgagatcgtgagcggcagcaaggagcccagcagcgcctgcagcctgctggagcccggcaagccccccgagagcctgcccagctacggcgagctgaacagctgccccaccaagaccgccaccgacgactacttccagtgcaacaccagcagcgagaccgtgctgaccgcccccagccccctgggcaagaacaaggaggaccacgacaccctgaccctggccgagggcgtgaagaagctgagccccagcgacagacaggtgccccacagcagcagagagcccgtgggccacaaggaggagagccccaagggccccggcggcggccccgccgccagcggcggcgtggccgagggcatcgccaacggcagactggtgcagcaccacggcgccgagcccagcagcctggacaagagaaaggagatcttcagcaaggacaccctgttcaagcccctgcacagcaccctgagcgtgaacagctaccacaagagcagcctgagcctgctgaagagccaccccaagacccccgccgacaccctgcccggcagatgcgagaagctggagcccagcctgggcaccagcgccgcccaggccatgcccgccagccagagacagcaggagagcggcggcaaccaggaggccagcttcgactactacaacgtgagcgacgacgacgacagcgaggagggcgccaacaagaacaccgaggaggagaagaacagagaggacgtgggcaccatgcagtggctgctggagagagagaaggagagagacctgcagagaaagttcgagaagaacctgaccctgctggcccccaaggagaccgacagcagcagcaaccagagagccacccacagcgccagactggacagcatggacagcagcagcatcaccgtggacagcggcttcaacagccccagaaactag

SEQ ID NO: 24904 - DNA, 4155 bp, Artificial Sequence
  Description of Artificial Sequence: Synthetic coding sequence
atgagccagctgcagctgtggctgcagttcgaggccctgaacaagggcatggcccccggcagcccccagaccagagccgcccagagcagctgcagcatcgccgccctgcaggtgctgcagaagagcgacgccgtgctgagaggccccgaggacagcagctacttcgaggacttcagcaacatcagcatcttcagcagcagcgtggacagcctgagcgacatcgtggacacccccgacttcctgcccgccgacagcctgaaccaggtgagcaccatctgggacgacaaccccgcccccagcacccacgacaaggtgagcgcccccggcgcccccagccagcccagacccaccagcgtggccagccccgccagagacccccacggccccgtgagactgagaggccccaccagctgcgacctgagcagactggccagagccgacatcctgctgcccttccagctgttccagctgagcagacccttcgccggcttcgaggacttcctgcccagccacagcacccccctgctggtgagctaccaggagcagagcgtgcagagccagcccgaggaggaggacgaggccgaggaggaggaggccgaggagctgggccacaccgagacctacgccgactacgtgcccagcaagagcaagatcggcaagcagcaccccgacagagtggtggagaccagcaccctgagcagcgtgcccccccccgacatcacctacaccctggccctgcccagcgacagcggcgccctgagcgccctgcagctggaggccatcacctacgcctgccagcagcacgaggtgctgctgcccagcggccagagagccggcttcctgatcggcgacggcgccggcgtgggcaagggcagaaccgtggccggcgtgatcctggagaaccacctgagaggcagaaagaaggccctgtggttcagcgtgagcaacgacctgaagtacgacgccgagagagacctgagagacatcgaggccaccggcatcgccgtgcacgccctgagcaaggtgggcgccgtgctgggcaaggtgggcggcaaggtgggcaccgtgccctgcaagatcaagtacggcgacaccaccaccagcgagggcgtgctgttcgccacctacagcgccctgatcggcgagagccaggccggcggccagcacagaaccagactgagacagatcctggactggtgcggcgaggccttcgagggcgtgatcgtgttcgacgagtgccacaaggccaagaacgccggcagcaccaagatgggcaaggccgtgctggacctgcagaacaagctgcccctggccagagtggtgtacgccagcgccaccggcgccagcgagcccagaaacatgatctacatgagcagactgggcatctggggcgagggcacccccttcagaaacttcgaggagttcctgcacgccatcgagaagagaggcgtgggcgccatggagatcgtggccatggacatgaaggtgagcggcatgtacatcgccagacagctgagcttcagcggcgtgaccttcagaatcgaggagatccccctggcccccgccttcgagtgcgtgtacaacagagccgccctgctgtgggccgaggccctgaacgtgttccagcaggccgccgactggatcggcctggagagcagaaagagcctgtggggccagttctggagcgcccaccagagattcttcaagtacctgtgcatcgccgccaaggtgagaagactggtggagctggccagagaggagctggccagagacaagtgcgtggtgatcggcctgcagagcaccggcgaggccagaaccagagaggtgctgggcgagaacgacggccacctgaactgcttcgtgagcgccgccgagggcgtgttcctgagcctgatccagaagcacttccccagcaccaagagaaagagagacagaggcgccggcagcaagagaaagcccggcgtgatcagaatcagcgacgacagcagcaccgagagcgaccccggcctggacagcgacttcaacagcagccccgagagcctggtggacgacgacgtggtgatcgtggacgccgtgggcctgcccagcgacgacagaggccccctgtgcctgctgcagagagacccccacggccccggcgtgctggagagagtggagagactgaagcaggacctgctggacaaggtgagaagactgggcagagagctgcccgtgaacaccctggacgagctgatcgaccagctgggcggcccccagagagtggccgagatgaccggcagaaagggcagagtggtgagcagacccgacggcaccgtggccttcgagagcagagccgagcagggcctgagcatcgaccacgtgaacctgagagagaagcagagattcatgagcggcgagaagctggtggccatcatcagcgaggccagcagcagcggcgtgagcctgcaggccgacagaagagtgcagaaccagagaagaagagtgcacatgaccctggagctgccctggagcgccgacagagccatccagcagttcggcagaacccacagaagcaaccaggtgagcgcccccgagtacgtgttcctgatcagcgagctggccggcgagagaagattcgccagcatcgtggccaagagactggagagcctgggcgccctgacccacggcgacagaagagccaccgagagcagagacctgagcaagtacaacttcgagaacaagtacggcaccagagccctgcactgcgtgctgaccaccatcctgagccagaccgagaacaaggtgcccgtgccccagggctaccccggcggcgtgcccaccttcttcagagacatgaagcagggcctgctgagcgtgggcatcggcggcagagagagcagaaacggctgcctggacgtggagaaggactgcagcatcaccaagttcctgaacagaatcctgggcctggaggtgcacaagcagaacgccctgttccagtacttcagcgacaccttcgaccacctgatcgagatggacaagagagagggcaagtacgacatgggcatcctgggcgagcacagatgcagaggcgtggtgtgggtggacctggcccccggcatcgaggagatctacgaggagagccagcaggtgttcctggcccccggccacccccaggacggccaggtggtgttctacaagatcagcgtggacagaggcctgaagtgggaggacgccttcgccaagagcctggccctgaccggcccctacgacggcttctacctgagctacaaggtgagaggcaacaagcccagctgcctgctggccgagcagaacagaggccagttcttcaccgtgtacaagcccaacatcggcagacagagccagctggaggccctggacagcctgagaagaaagttccacagagtgaccgccgaggaggccaaggagccctgggagagcggctacgccctgagcctgacccactgcagccacagcgcctggaacagacactgcagactggcccaggagggcaaggactgcctgcagggcctgagactgagacaccactacatgctgtgcggcgccctgctgagagtgtggggcagaatcgccgccgtgatggccgacgtgagcagcagcagctacctgcagatcgtgagactgaagaccaaggacagaaagaagcaggtgggcatcaagatccccgagggctgcgtgagaagagtgctgcaggagctgagactgatggacgccgacgtgaagagaagacaggcccccgccctgggctgccccgccccccccgcccccagacccctggccctgccctgcggccccggcgaggtgctggacctgacctacagcccccccgccgaggccttccccccccccccccacttcagcttccccgcccccctgagcctggacgccggccccggcgtggtgcccctgggcacccccgacgcccaggccgaccccgccgccctggcccaccagggctgcgacatcaacttcaaggaggtgctggaggacatgctgagaagcctgcacgccggcccccccagcgagggcgccctgggcgagggcgccggcgccggcggcgccgccggcggcggccccgagagacagagcgtgatccagttcagcccccccttccccggcgcccaggcccccctgtag

SEQ ID NO: 24905 - DNA, 4101 bp, Artificial Sequence
  Description of Artificial Sequence: Synthetic coding sequence
atgctggccgtgggccccgccatggacagagactacccccagcacgagcccccccccgccggcagcctgctgtacagccccccccccctgcagagcgccatgctgcactgcccctactggaacaccttcagcctgcccccctaccccgccttcagcagcgacagcagacccttcatgagcagcgccagcttcctgggcagccagccctgccccgacaccagctacgcccccgtggccaccgccagcagcctgccccccaagacctgcgacttcgcccaggacagcagctacttcgaggacttcagcaacatcagcatcttcagcagcagcgtggacagcctgagcgacatcgtggacacccccgacttcctgcccgccgacagcctgaaccaggtgagcaccatctgggacgacaaccccgcccccagcacccacgacaagctgttccagctgagcagacccttcgccggcttcgaggacttcctgcccagccacagcacccccctgctggtgagctaccaggagcagagcgtgcagagccagcccgaggaggaggacgaggccgaggaggaggaggccgaggagctgggccacaccgagacctacgccgactacgtgcccagcaagagcaagatcggcaagcagcaccccgacagagtggtggagaccagcaccctgagcagcgtgcccccccccgacatcacctacaccctggccctgcccagcgacagcggcgccctgagcgccctgcagctggaggccatcacctacgcctgccagcagcacgaggtgctgctgcccagcggccagagagccggcttcctgatcggcgacggcgccggcgtgggcaagggcagaaccgtggccggcgtgatcctggagaaccacctgagaggcagaaagaaggccctgtggttcagcgtgagcaacgacctgaagtacgacgccgagagagacctgagagacatcgaggccaccggcatcgccgtgcacgccctgagcaagatcaagtacggcgacaccaccaccagcgagggcgtgctgttcgccacctacagcgccctgatcggcgagagccaggccggcggccagcacagaaccagactgagacagatcctggactggtgcggcgaggccttcgagggcgtgatcgtgttcgacgagtgccacaaggccaagaacgccggcagcaccaagatgggcaaggccgtgctggacctgcagaacaagctgcccctggccagagtggtgtacgccagcgccaccggcgccagcgagcccagaaacatgatctacatgagcagactgggcatctggggcgagggcacccccttcagaaacttcgaggagttcctgcacgccatcgagaagagaggcgtgggcgccatggagatcgtggccatggacatgaaggtgagcggcatgtacatcgccagacagctgagcttcagcggcgtgaccttcagaatcgaggagatccccctggcccccgccttcgagtgcgtgtacaacagagccgccctgctgtgggccgaggccctgaacgtgttccagcaggccgccgactggatcggcctggagagcagaaagagcctgtggggccagttctggagcgcccaccagagattcttcaagtacctgtgcatcgccgccaaggtgagaagactggtggagctggccagagaggagctggccagagacaagtgcgtggtgatcggcctgcagagcaccggcgaggccagaaccagagaggtgctgggcgagaacgacggccacctgaactgcttcgtgagcgccgccgagggcgtgttcctgagcctgatccagaagcacttccccagcaccaagagaaagagagacagaggcgccggcagcaagagaaagagaagacccagaggcagaggcgccaaggcccccagactggcctgcgagaccgccggcgtgatcagaatcagcgacgacagcagcaccgagagcgaccccggcctggacagcgacttcaacagcagccccgagagcctggtggacgacgacgtggtgatcgtggacgccgtgggcctgcccagcgacgacagaggccccctgtgcctgctgcagagagacccccacggccccggcgtgctggagagagtggagagactgaagcaggacctgctggacaaggtgagaagactgggcagagagctgcccgtgaacaccctggacgagctgatcgaccagctgggcggcccccagagagtggccgagatgaccggcagaaagggcagagtggtgagcagacccgacggcaccgtggccttcgagagcagagccgagcagggcctgagcatcgaccacgtgaacctgagagagaagcagagattcatgagcggcgagaagctggtggccatcatcagcgaggccagcagcagcggcgtgagcctgcaggccgacagaagagtgcagaaccagagaagaagagtgcacatgaccctggagctgccctggagcgccgacagagccatccagcagttcggcagaacccacagaagcaaccaggtgagcgcccccgagtacgtgttcctgatcagcgagctggccggcgagagaagattcgccagcatcgtggccaagagactggagagcctgggcgccctgacccacggcgacagaagagccaccgagagcagagacctgagcaagtacaacttcgagaacaagtacggcaccagagccctgcactgcgtgctgaccaccatcctgagccagaccgagaacaaggtgcccgtgccccagggctaccccggcggcgtgcccaccttcttcagagacatgaagcagggcctgctgagcgtgggcatcggcggcagagagagcagaaacggctgcctggacgtggagaaggactgcagcatcaccaagttcctgaacagaatcctgggcctggaggtgcacaagcagaacgccctgttccagtacttcagcgacaccttcgaccacctgatcgagatggacaagagagagggcaagtacgacatgggcatcctggacctggcccccggcatcgaggagatctacgaggagagccagcaggtgttcctggcccccggccacccccaggacggccaggtggtgttctacaagatcagcgtggacagaggcctgaagtgggaggacgccttcgccaagagcctggccctgaccggcccctacgacggcttctacctgagctacaaggtgagaggcaacaagcccagctgcctgctggccgagcagaacagaggccagttcttcaccgtgtacaagcccaacatcggcagacagagccagctggaggccctggacagcctgagaagaaagttccacagagtgaccgccgaggaggccaaggagccctgggagagcggctacgccctgagcctgacccactgcagccacagcgcctggaacagacactgcagactggcccaggagggcaaggactgcctgcagggcctgagactgagacaccactacatgctgtgcggcgccctgctgagagtgtggggcagaatcgccgccgtgatggccgacgtgagcagcagcagctacctgcagatcgtgagactgaagaccaaggacagaaagaagcaggtgggcatcaagatccccgagggctgcgtgagaagagtgctgcaggagctgagactgatggacgccgacgtgaagagaagacaggcccccgccctgggctgccccgccccccccgcccccagacccctggccctgccctgcggccccggcgaggtgctggacctgacctacagcccccccgccgaggccttccccccccccccccacttcagcttccccgcccccctgagcctggacgccggccccggcgtggtgcccctgggcacccccgacgcccaggccgaccccgccgccctggcccaccagggctgcgacatcaacttcaaggaggtgctggaggacatgctgagaagcctgcacgccggcccccccagcgagggcgccctgggcgagggcgccggcgccggcggcgccgccggcggcggccccgagagacagagcgtgatccagttcagcccccccttccccggcgcccaggcccccctgtag

SEQ ID NO: 24906 - DNA, 3930 bp, Artificial Sequence
  Description of Artificial Sequence: Synthetic coding sequence
atgagagagcccctgcccggcagcgccagctggggcacccccggcccccccagcgccggcaccatgagccagctgcagctgtggctgcagttcgaggccctgaacaaggacagcagctacttcgaggacttcagcaacatcagcatcttcagcagcagcgtggacagcctgagcgacatcgtggacacccccgacttcctgcccgccgacagcctgaaccaggtgagcaccatctgggacgacaaccccgcccccagcacccacgacaagctgttccagctgagcagacccttcgccggcttcgaggacttcctgcccagccacagcacccccctgctggtgagctaccaggagcagagcgtgcagagccagcccgaggaggaggacgaggccgaggaggaggaggccgaggagctgggccacaccgagacctacgccgactacgtgcccagcaagagcaagatcggcaagcagcaccccgacagagtggtggagaccagcaccctgagcagcgtgcccccccccgacatcacctacaccctggccctgcccagcgacagcggcgccctgagcgccctgcagctggaggccatcacctacgcctgccagcagcacgaggtgctgctgcccagcggccagagagccggcttcctgatcggcgacggcgccggcgtgggcaagggcagaaccgtggccggcgtgatcctggagaaccacctgagaggcagaaagaaggccctgtggttcagcgtgagcaacgacctgaagtacgacgccgagagagacctgagagacatcgaggccaccggcatcgccgtgcacgccctgagcaagatcaagtacggcgacaccaccaccagcgagggcgtgctgttcgccacctacagcgccctgatcggcgagagccaggccggcggccagcacagaaccagactgagacagatcctggactggtgcggcgaggccttcgagggcgtgatcgtgttcgacgagtgccacaaggccaagaacgccggcagcaccaagatgggcaaggccgtgctggacctgcagaacaagctgcccctggccagagtggtgtacgccagcgccaccggcgccagcgagcccagaaacatgatctacatgagcagactgggcatctggggcgagggcacccccttcagaaacttcgaggagttcctgcacgccatcgagaagagaggcgtgggcgccatggagatcgtggccatggacatgaaggtgagcggcatgtacatcgccagacagctgagcttcagcggcgtgaccttcagaatcgaggagatccccctggcccccgccttcgagtgcgtgtacaacagagccgccctgctgtgggccgaggccctgaacgtgttccagcaggccgccgactggatcggcctggagagcagaaagagcctgtggggccagttctggagcgcccaccagagattcttcaagtacctgtgcatcgccgccaaggtgagaagactggtggagctggccagagaggagctggccagagacaagtgcgtggtgatcggcctgcagagcaccggcgaggccagaaccagagaggtgctgggcgagaacgacggccacctgaactgcttcgtgagcgccgccgagggcgtgttcctgagcctgatccagaagcacttccccagcaccaagagaaagagagacagaggcgccggcagcaagagaaagagaagacccagaggcagaggcgccaaggcccccagactggcctgcgagaccgccggcgtgatcagaatcagcgacgacagcagcaccgagagcgaccccggcctggacagcgacttcaacagcagccccgagagcctggtggacgacgacgtggtgatcgtggacgccgtgggcctgcccagcgacgacagaggccccctgtgcctgctgcagagagacccccacggccccggcgtgctggagagagtggagagactgaagcaggacctgctggacaaggtgagaagactgggcagagagctgcccgtgaacaccctggacgagctgatcgaccagctgggcggcccccagagagtggccgagatgaccggcagaaagggcagagtggtgagcagacccgacggcaccgtggccttcgagagcagagccgagcagggcctgagcatcgaccacgtgaacctgagagagaagcagagattcatgagcggcgagaagctggtggccatcatcagcgaggccagcagcagcggcgtgagcctgcaggccgacagaagagtgcagaaccagagaagaagagtgcacatgaccctggagctgccctggagcgccgacagagccatccagcagttcggcagaacccacagaagcaaccaggtgagcgcccccgagtacgtgttcctgatcagcgagctggccggcgagagaagattcgccagcatcgtggccaagagactggagagcctgggcgccctgacccacggcgacagaagagccaccgagagcagagacctgagcaagtacaacttcgagaacaagtacggcaccagagccctgcactgcgtgctgaccaccatcctgagccagaccgagaacaaggtgcccgtgccccagggctaccccggcggcgtgcccaccttcttcagagacatgaagcagggcctgctgagcgtgggcatcggcggcagagagagcagaaacggctgcctggacgtggagaaggactgcagcatcaccaagttcctgaacagaatcctgggcctggaggtgcacaagcagaacgccctgttccagtacttcagcgacaccttcgaccacctgatcgagatggacaagagagagggcaagtacgacatgggcatcctggacctggcccccggcatcgaggagatctacgaggagagccagcaggtgttcctggcccccggccacccccaggacggccaggtggtgttctacaagatcagcgtggacagaggcctgaagtgggaggacgccttcgccaagagcctggccctgaccggcccctacgacggcttctacctgagctacaaggtgagaggcaacaagcccagctgcctgctggccgagcagaacagaggccagttcttcaccgtgtacaagcccaacatcggcagacagagccagctggaggccctggacagcctgagaagaaagttccacagagtgaccgccgaggaggccaaggagccctgggagagcggctacgccctgagcctgacccactgcagccacagcgcctggaacagacactgcagactggcccaggagggcaaggactgcctgcagggcctgagactgagacaccactacatgctgtgcggcgccctgctgagagtgtggggcagaatcgccgccgtgatggccgacgtgagcagcagcagctacctgcagatcgtgagactgaagaccaaggacagaaagaagcaggtgggcatcaagatccccgagggctgcgtgagaagagtgctgcaggagctgagactgatggacgccgacgtgaagagaagacaggcccccgccctgggctgccccgccccccccgcccccagacccctggccctgccctgcggccccggcgaggtgctggacctgacctacagcccccccgccgaggccttccccccccccccccacttcagcttccccgcccccctgagcctggacgccggccccggcgtggtgcccctgggcacccccgacgcccaggccgaccccgccgccctggcccaccagggctgcgacatcaacttcaaggaggtgctggaggacatgctgagaagcctgcacgccggcccccccagcgagggcgccctgggcgagggcgccggcgccggcggcgccgccggcggcggccccgagagacagagcgtgatccagttcagcccccccttccccggcgcccaggcccccctgtag

SEQ ID NO: 24907 - DNA, 453 bp, Artificial Sequence
  Description of Artificial Sequence: Synthetic coding sequence
atgagcggctggatcgccaccagcaagaccagaatgcaggacttctggagcctgctgaccttcagcagcgacctggtggacgtgaaggacagcggcgactaccccctgaccgcccccggcctgagctggaagaagttccagggcagcttctgcgagttcgtgggcaccctggtgtgcagatgccagtacatcctgctgcacgacgacttccccatggacaacctgatcagcctgctgaccggcttcagcgacagccaggtgtgcgccttctgccacaccagcaccctggccgccatgaagctgatgaccagcctggtgagagtggccctgcagctgagcctgcacgaggacatcaaccagagacagtacgaggccgagagaaacaagggccccggccagagagcccccgagagactggagagcctgctggagaagcacaaggagctgcactag

SEQ ID NO: 24908 - DNA, 453 bp, Artificial Sequence; identical to SEQ ID NO: 24907
  Description of Artificial Sequence: Synthetic coding sequence

SEQ ID NO: 24909 - DNA, 891 bp, Artificial Sequence
  Description of Artificial Sequence: Synthetic coding sequence
atgctgagccccaaggacatcctgagaaaggacctgaagctggtgcacggctaccccatgacctgcgccttcgccagcaactgggagaagatcgagcagttccacagcagacccgacgacatcgtgatcgccacctaccccaagagcggcaccacctgggtgagcgagatcatcgacatgatcctgaacgacggcgacatcgagaagtgcaagagaggcttcatcaccgagaaggtgcccatgctggagatgaccctgcccggcctgagaaccagcggcatcgagcagctggagaagaaccccagccccagaatcgtgaagacccacctgcccaccgacctgctgcccaagagcttctgggagaacaactgcaagatgatctacctggccagaaacgccaaggacgtgagcgtgagctactaccacttcgacctgatgaacaacctgcagcccttccccggcacctgggaggagtacctggagaagttcctgaccggcaaggtggcctacggcagctggttcacccacgtgaagaactggtggaagaagaaggaggagcaccccatcctgttcctgtactacgaggacatgaaggagaaccccaaggaggagatcaagaagatcatcagattcctggagaagaacctgaacgacgagatcctggacagaatcatccaccacaccagcttcgaggtgatgaaggacaaccccctggtgaactacacccacctgcccaccaccgtgatggaccacagcaagagccccttcatgagaaagggcaccgccggcgactggaagaactacttcaccgtggcccagaacgagaagttcgacgccatctacgagaccgagatgagcaagaccgccctgcagttcagaaccgagatctag

SEQ ID NO: 24910 - DNA, 468 bp, Artificial Sequence
  Description of Artificial Sequence: Synthetic coding sequence
atgctgagccccaaggacatcctgagaaaggacctgaagctggtgcacggctaccccatgacctgcgccttcgccagcaactgggagaagatcgagcagttccacagcagacccgacgacatcgtgatcgccacctaccccaagagcggcaccacctgggtgagcgagatcatcgacatgatcctgaacgacggcgacatcgagaagtgcaagagaggcttcatcaccgagaaggtgcccatgctggagatgaccctgcccggcctgagaaccagcggcatcgagcagctggagaagaaccccagccccagaatcgtgaagacccacctgcccaccgacctgctgcccaagagcttctgggagaacaactgcaagatgatctacctggccagaaacgccaaggacgtgagcgtgagctactaccacttcgacctgatgaacaacctgcagcccttccccggcacctag

SEQ ID NO: 24911 - DNA, 639 bp, Artificial Sequence
  Description of Artificial Sequence: Synthetic coding sequence
atggaccccgtggtgctgagctacatggacagcctgctgagacagagcgacgtgagcctgctggacccccccagctggctgaacgaccacatcatcggcttcgccttcgagtacttcgccaacagccagttccacgactgcagcgaccacgtgagcttcatcagccccgaggtgacccagttcatcaagtgcaccagcaaccccgccgagatcgccatgttcctggagcccctggacctgcccaacaagagagtggtgttcctggccatcaacgacaacagcaaccaggccgccggcggcacccactggagcctgctggtgtacctgcaggacaagaacagcttcttccactacgacagccacagcagaagcaacagcgtgcacgccaagcaggtggccgagaagctggaggccttcctgggcagaaagggcgacaagctggccttcgtggaggagaaggcccccgcccagcagaacagctacgactgcggcatgtacgtgatctgcaacaccgaggccctgtgccagaacttcttcagacagcagaccgagagcctgctgcagctgctgacccccgcctacatcaccaagaagagaggcgagtggaaggacctgatcaccaccctggccaagaagtag

SEQ ID NO: 24912 - DNA, 639 bp, Artificial Sequence; identical to SEQ ID NO: 24911
  Description of Artificial Sequence: Synthetic coding sequence

SEQ ID NO: 24913 - DNA, 639 bp, Artificial Sequence; identical to SEQ ID NO: 24911
  Description of Artificial Sequence: Synthetic coding sequence

SEQ ID NO: 24914 - DNA, 639 bp, Artificial Sequence; identical to SEQ ID NO: 24911
  Description of Artificial Sequence: Synthetic coding sequence

SEQ ID NO: 24915 - DNA, 1668 bp, Artificial Sequence
  Description of Artificial Sequence: Synthetic coding sequence
atggccgacagaggcggcgtgggcgaggccgccgccgtgggcgccagccccgccagcgtgcccggcctgaaccccaccctgggctggagagagagactgagagccggcctggccggcaccggcgccagcctgtggttcgtggccggcctgggcctgctgtacgccctgagaatccccctgagactgtgcgagaacctggccgccgtgaccgtgttcctgaacagcctgacccccaagttctacgtggccctgaccggcaccagcagcctgatcagcggcctgatcttcatcttcgagtggtggtacttccacaagcacggcaccagcttcatcgagcaggtgagcgtgagccacctgcagcccctgatgggcggcaccgagagcagcatcagcgagcccggcagccccagcagaaacagagagaacgagaccagcagacagaacctgagcgagtgcaaggtgtggagaaaccccctgaacctgttcagaggcgccgagtacagaagatacacctgggtgaccggcaaggagcccctgacctactacgacatgaacctgagcgcccaggaccaccagaccttcttcacctgcgacaccgacttcctgagacccagcgacaccgtgatgcagaaggcctggagagagagaaacccccccgccagaatcaaggccgcctaccaggccctggagctgaacaacgactgcgccaccgcctacgtgctgctggccgaggaggaggccaccaccatcgtggacgccgagagactgttcaagcaggccctgaaggccggcgagaccatctacagacagagccagcagtgccagcaccagagcccccagcacgaggcccagctgagaagagacaccaacgtgctggtgtacatcaagagaagactggccatgtgcgccagaaagctgggcagaatcagagaggccgtgaagatcatgagagacctgatgaaggagttcccccccctgaccatgctgaacatccacgagaacctgctggagagcctgctggagctgcaggcctaccccgacgtgcaggccgtgctggccaagtacgacgacatcagcctgcccaagagcgccgccatctgctacaccgccgccctgctgaagaccagaaccgtgagcgagaagttcagccccgagaccgccagcagaagaggcctgagcaccgccgagatcaacgccgtggaggccatccacagagccgtggagttcaacccccacgtgcccaagtacctgctggagatgaagagcctgatcctgccccccgagcacatcctgaagagaggcgacagcgaggccatcgcctacgccttcttccacctgcagcactggaagagaatcgagggcgccctgaacctgctgcagtgcacctgggagggcaccttcagaatgatcccctaccccctggagaagggccacctgttctacccctaccccagctgcaccgagaccgccgacagagagctgctgcccaccttccaccacgtgagcgtgtaccccaagaaggagctgcccctgttcatccacttcaccgccggcttctgcagcagcaccgccatgatcgccatcctgacccaccagttccccgagatcatgggcatcttcgccaaggccgtgagcatgatcagcagaacctgcgtggactacctgtag

SEQ ID NO: 24916 - DNA, 1728 bp, Artificial Sequence
  Description of Artificial Sequence: Synthetic coding sequence
atggccgacagaggcggcgtgggcgaggccgccgccgtgggcgccagccccgccagcgtgcccggcctgaaccccaccctgggctggagagagagactgagagccggcctggccggcaccggcgccagcctgtggttcgtggccggcctgggcctgctgtacgccctgagaatccccctgagactgtgcgagaacctggccgccgtgaccgtgttcctgaacagcctgacccccaagttctacgtggccctgaccggcaccagcagcctgatcagcggcctgatcttcatcttcgagtggtggtacttccacaagcacggcaccagcttcatcgagcaggtgagcgtgagccacctgcagcccctgatgggcggcaccgagagcagcatcagcgagcccggcagccccagcagaaacagagagaacgagaccagcagacagaacctgagcgagtgcaaggtgtggagaaaccccctgaacctgttcagaggcgccgagtacagaagatacacctgggtgaccggcaaggagcccctgacctactacgacatgaacctgagcgcccaggaccaccagaccttcttcacctgcgacaccgacttcctgagacccagcgacaccgtgatgcagaaggcctggagagagagaaacccccccgccagaatcaaggccgcctaccaggccctggagctgaacaacgactgcgccaccgcctacgtgctgctggccgaggaggaggccaccaccatcgtggacgccgagagactgttcaagcaggccctgaaggccggcgagaccatctacagacagagccagcagtgccagcaccagagcccccagcacgaggcccagctgagaagagacaccaacgtgctggtgtacatcaagagaagactggccatgtgcgccagaaagctgggcagaatcagagaggccgtgaagatcatgagagacctgatgaaggagttcccccccctgaccatgctgaacatccacgagaacctgctggagagcctgctggagctgcaggcctaccccgacgtgcaggccgtgctggccaagtacgacgacatcagcctgcccaagagcgccgccatctgctacaccgccgccctgctgaagaccagaaccgtgagcgagaagttcagccccgagaccgccagcagaagaggcctgagcaccgccgagatcaacgccgtggaggccatccacagagccgtggagttcaacccccacgtgcccaagtacctgctggagatgaagagcctgatcctgccccccgagcacatcctgaagagaggcgacagcgaggccatcgcctacgccttcttccacctgcagcactggaagagaatcgagggcgccctgaacctgctgcagtgcacctgggagggcaccttcagaatgatcccctaccccctggagaagggccacctgttctacccctaccccagctgcaccgagaccgccgacagagagctgctgcccaccttccaccacgtgagcgtgtaccccaagaaggagctgcccctgttcatccacttcaccgccggcttctgcagcagcaccgccatgatcgccatcctgacccaccagttccccgagatcatgggcatcttcgccaaggccgtgctgggcctgtggtgcccccagccctgggccagcagcggcttcgaggagaacacccaggacctgaagagcgaggacctgggcctgagcagcggctag

SEQ ID NO: 24917 - DNA, 1635 bp, Artificial Sequence
  Description of Artificial Sequence: Synthetic coding sequence
atggccgacagaggcggcgtgggcgaggccgccgccgtgggcgccagccccgccagcgtgcccggcctgaaccccaccctgggctggagagagagactgagagccggcctggccggcaccggcgccagcctgtggttcgtggccggcctgggcctgctgtacgccctgagaatccccctgagactgtgcgagaacctggccgccgtgaccgtgttcctgaacagcctgacccccaagttctacgtggccctgaccggcaccagcagcctgatcagcggcctgatcttcatcttcgagtggtggtacttccacaagcacggcaccagcttcatcgagcaggtgagcgtgagccacctgcagcccctgatgggcggcaccgagagcagcatcagcgagcccggcagccccagcagaaacagagagaacgagaccagcagacagaacctgagcgagtgcaaggtgtggagaaaccccctgaacctgttcagaggcgccgagtacagaagatacacctgggtgaccggcaaggagcccctgacctactacgacatgaacctgagcgcccaggaccaccagaccttcttcacctgcgacaccgacttcctgagacccagcgacaccgtgatgcagaaggcctggagagagagaaacccccccgccagaatcaaggccgcctaccaggccctggagctgaacaacgactgcgccaccgcctacgtgctgctggccgaggaggaggccaccaccatcgtggacgccgagagactgttcaagcaggccctgaaggccggcgagaccatctacagacagagccagcagtgccagcaccagagcccccagcacgaggcccagctgagaagagacaccaacgtgctggtgtacatcaagagaagactggccatgtgcgccagaaagctgggcagaatcagagaggccgtgaagatcatgagagacctgatgaaggagttcccccccctgaccatgctgaacatccacgagaacctgctggagagcctgctggagctgcaggcctaccccgacgtgcaggccgtgctggccaagtacgacgacatcagcctgcccaagagcgccgccatctgctacaccgccgccctgctgaagaccagaaccgtgagcgagaagttcagccccgagaccgccagcagaagaggcctgagcaccgccgagatcaacgccgtggaggccatccacagagccgtggagttcaacccccacgtgcccaagtacctgctggagatgaagagcctgatcctgccccccgagcacatcctgaagagaggcgacagcgaggccatcgcctacgccttcttccacctgcagcactggaagagaatcgagggcgccctgaacctgctgcagtgcacctgggagggcaccttccaccacgtgagcgtgtaccccaagaaggagctgcccctgttcatccacttcaccgccggcttctgcagcagcaccgccatgatcgccatcctgacccaccagttccccgagatcatgggcatcttcgccaaggccgtgctgggcctgtggtgcccccagccctgggccagcagcggcttcgaggagaacacccaggacctgaagagcgaggacctgggcctgagcagcggctag

SEQ ID NO: 24918 - DNA, 690 bp, Artificial Sequence
  Description of Artificial Sequence: Synthetic coding sequence
atgagccccttcctgttcagagacgacatgaaggacctgaccgtgttcctgaacagcctgacccccaagttctacgtggccctgaccggcaccagcagcctgatcagcggcctgatcttcatcttcgagtggtggtacttccacaagcacggcaccagcttcatcgagcaggtgagcgtgagccacctgcagcccctgatgggcggcaccgagagcagcatcagcgagcccggcagccccagcagaaacagagagaacgagaccagcagacagaacctgagcgagtgcaaggtgtggagaaaccccctgaacctgttcagaggcgccgagtacagaagatacacctgggtgaccggcaaggagcccctgacctactacgacatgaacctgagcgcccaggaccaccagaccttcttcacctgcgacaccgacttcctgagacccagcgacaccgtgatgcagaaggcctggagagagagaaacccccccgccagaatcaaggccgcctaccaggccctggagctgaacaacgactgcgccaccgcctacgtgctgctggccgaggaggaggccaccaccatcgtggacgccgagagactgttcaagcaggccctgaaggccggcgagaccatctacagacagagccagcagtgccagcaccagagcccccagcacgaggcccagctgtag

SEQ ID NO: 24919 - DNA, 966 bp, Artificial Sequence
  Description of Artificial Sequence: Synthetic coding sequence
atgggcggcaccgagagcagcatcagcgagcccggcagccccagcagaaacagagagaacgagaccagcagacagaacctgagcgagtgcaaggtgtggagaaaccccctgaacctgttcagaggcgccgagtacagaagatacacctgggtgaccggcaaggagcccctgacctactacgacatgaacctgagcgcccaggaccaccagaccttcttcacctgcgacaccgacttcctgagacccagcgacaccgtgatgcagaaggcctggagagagagaaacccccccgccagaatcaaggccgcctaccaggccctggagctgaacaacgactgcgccaccgcctacgtgctgctggccgaggaggaggccaccaccatcgtggacgccgagagactgttcaagcaggccctgaaggccggcgagaccatctacagacagagccagcagtgccagcaccagagcccccagcacgaggcccagctgagaagagacaccaacgtgctggtgtacatcaagagaagactggccatgtgcgccagaaagctgggcagaatcagagaggccgtgaagatcatgagagacctgatgaaggagttcccccccctgaccatgctgaacatccacgagaacctgctggagagcctgctggagctgcaggcctaccccgacgtgcaggccgtgctggccaagtacgacgacatcagcctgcccaagagcgccgccatctgctacaccgccgccctgctgaagaccagaaccgtgagcgagaagttcagccccgagaccgccagcagaagaggcctgagcaccgccgagatcaacgccgtggaggccatccacagagccgtggagttcaacccccacgtgcccaaggtggagatctaccccttcagcccccagctgaacatcaaggccgtggacaacagcgccatcagcaagtaccccgccaacatgtactag

SEQ ID NO: 24920 - DNA, 1617 bp, Artificial Sequence
  Description of Artificial Sequence: Synthetic coding sequence
atggccgacagaggcggcgtgggcgaggccgccgccgtgggcgccagccccgccagcgtgcccggcctgaaccccaccctgggctggagagagagactgagagccggcctggccggcaccggcgccagcctgtggttcgtggccggcctgggcctgctgtacgccctgagaatccccctgagactgtgcgagaacctggccgccggcaccagcagcctgatcagcggcctgatcttcatcttcgagtggtggtacttccacaagcacggcaccagcttcatcgagcaggtgagcgtgagccacctgcagcccctgatgggcggcaccgagagcagcatcagcgagcccggcagccccagcagaaacagagagaacgagaccagcagacagaacctgagcgagtgcaaggtgtggagaaaccccctgaacctgttcagaggcgccgagtacagaagatacacctgggtgaccggcaaggagcccctgacctactacgacatgaacctgagcgcccaggaccaccagaccttcttcacctgcgacaccgacttcctgagacccagcgacaccgtgatgcagaaggcctggagagagagaaacccccccgccagaatcaaggccgcctaccaggccctggagctgaacaacgactgcgccaccgcctacgtgctgctggccgaggaggaggccaccaccatcgtggacgccgagagactgttcaagcaggccctgaaggccggcgagaccatctacagacagagccagcagtgccagcaccagagcccccagcacgaggcccagctgagaagagacaccaacgtgctggtgtacatcaagagaagactggccatgtgcgccagaaagctgggcagaatcagagaggccgtgaagatcatgagagacctgatgaaggagttcccccccctgaccatgctgaacatccacgagaacctgctggagagcctgctggagctgcaggcctaccccgacgtgcaggccgtgctggccaagtacgacgacatcagcctgcccaagagcgccgccatctgctacaccgccgccctgctgaagaccagaaccgtgagcgagaagttcagccccgagaccgccagcagaagaggcctgagcaccgccgagatcaacgccgtggaggccatccacagagccgtggagttcaacccccacgtgcccaagtacctgctggagatgaagagcctgatcctgccccccgagcacatcctgaagagaggcgacagcgaggccatcgcctacgccttcttccacctgcagcactggaagagaatcgagggcgccctgaacctgctgcagtgcacctgggagggcaccttcagaatgatcccctaccccctggagaagggccacctgttctacccctaccccagctgcaccgagaccgccgacagagagctgctgcccaccttccaccacgtgagcgtgtaccccaagaaggagctgcccctgttcatccacttcaccgccggcttctgcagcagcaccgccatgatcgccatcctgacccaccagttccccgagatcatgggcatcttcgccaaggccgtgagcatgatcagcagaacctgcgtggactacctgtag

SEQ ID NO: 24921 - DNA, 1668 bp, Artificial Sequence
  Description of Artificial Sequence: Synthetic coding sequence
atggccgacagaggcggcgtgggcgaggccgccgccgtgggcgccagccccgccagcgtgcccggcctgaaccccaccctgggctggagagagagactgagagccggcctggccggcaccggcgccagcctgtggttcgtggccggcctgggcctgctgtacgccctgagaatccccctgagactgtgcgagaacctggccgccgtgaccgtgttcctgaacagcctgacccccaagttctacgtggccctgaccggcaccagcagcctgatcagcggcctgatcttcatcttcgagtggtggtacttccacaagcacggcaccagcttcatcgagcaggtgagcgtgagccacctgcagcccctgatgggcggcaccgagagcagcatcagcgagcccggcagccccagcagaaacagagagaacgagaccagcagacagaacctgagcgagtgcaaggtgtggagaaaccccctgaacctgttcagaggcgccgagtacagaagatacacctgggtgaccggcaaggagcccctgacctactacgacatgaacctgagcgcccaggaccaccagaccttcttcacctgcgacaccgacttcctgagacccagcgacaccgtgatgcagaaggcctggagagagagaaacccccccgccagaatcaaggccgcctaccaggccctggagctgaacaacgactgcgccaccgcctacgtgctgctggccgaggaggaggccaccaccatcgtggacgccgagagactgttcaagcaggccctgaaggccggcgagaccatctacagacagagccagcagtgccagcaccagagcccccagcacgaggcccagctgagaagagacaccaacgtgctggtgtacatcaagagaagactggccatgtgcgccagaaagctgggcagaatcagagaggccgtgaagatcatgagagacctgatgaaggagttcccccccctgaccatgctgaacatccacgagaacctgctggagagcctgctggagctgcaggcctaccccgacgtgcaggccgtgctggccaagtacgacgacatcagcctgcccaagagcgccgccatctgctacaccgccgccctgctgaagaccagaaccgtgagcgagaagttcagccccgagaccgccagcagaagaggcctgagcaccgccgagatcaacgccgtggaggccatccacagagccgtggagttcaacccccacgtgcccaagtacctgctggagatgaagagcctgatcctgccccccgagcacatcctgaagagaggcgacagcgaggccatcgcctacgccttcttccacctgcagcactggaagagaatcgagggcgccctgaacctgctgcagtgcacctgggagggcaccttcagaatgatcccctaccccctggagaagggccacctgttctacccctaccccagctgcaccgagaccgccgacagagagctgctgcccaccttccaccacgtgagcgtgtaccccaagaaggagctgcccctgttcatccacttcaccgccggcttctgcagcagcaccgccatgatcgccatcctgacccaccagttccccgagatcatgggcatcttcgccaaggccgtggtgggcgtgaagacccagaaggagaacgccgactag

SEQ ID NO: 24922 - DNA, 1179 bp, Artificial Sequence
  Description of Artificial Sequence: Synthetic coding sequence
atgaacctgagcgcccaggaccaccagaccttcttcacctgcgacaccgacttcctgagacccagcgacaccgtgatgcagaaggcctggagagagagaaacccccccgccagaatcaaggccgcctaccaggccctggagctgaacaacgactgcgccaccgcctacgtgctgctggccgaggaggaggccaccaccatcgtggacgccgagagactgttcaagcaggccctgaaggccggcgagaccatctacagacagagccagcagtgccagcaccagagcccccagcacgaggcccagctgagaagagacaccaacgtgctggtgtacatcaagagaagactggccatgtgcgccagaaagctgggcagaatcagagaggccgtgaagatcatgagagacctgatgaaggagttcccccccctgaccatgctgaacatccacgagaacctgctggagagcctgctggagctgcaggcctaccccgacgtgcaggccgtgctggccaagtacgacgacatcagcctgcccaagagcgccgccatctgctacaccgccgccctgctgaagaccagaaccgtgagcgagaagttcagccccgagaccgccagcagaagaggcctgagcaccgccgagatcaacgccgtggaggccatccacagagccgtggagttcaacccccacgtgcccaagtacctgctggagatgaagagcctgatcctgccccccgagcacatcctgaagagaggcgacagcgaggccatcgcctacgccttcttccacctgcagcactggaagagaatcgagggcgccctgaacctgctgcagtgcacctgggagggcaccttcagaatgatcccctaccccctggagaagggccacctgttctacccctaccccagctgcaccgagaccgccgacagagagctgctgcccaccttccaccacgtgagcgtgtaccccaagaaggagctgcccctgttcatccacttcaccgccggcttctgcagcagcaccgccatgatcgccatcctgacccaccagttccccgagatcatgggcatcttcgccaaggccgtgctgggcctgtggtgcccccagccctgggccagcagcggcttcgaggagaacacccaggacctgaagagcgaggacctgggcctgagcagcggctag

SEQ ID NO: 24923 - DNA, 978 bp, Artificial Sequence
  Description of Artificial Sequence: Synthetic coding sequence
atgggcggcaccgagagcagcatcagcgagcccggcagccccagcagaaacagagagaacgagaccagcagacagaacctgagcgagtgcaaggtgtggagaaaccccctgaacctgttcagaggcgccgagtacagaagatacacctgggtgaccggcaaggagcccctgacctactacgacatgaacctgagcgcccaggaccaccagaccttcttcacctgcgacaccgacttcctgagacccagcgacaccgtgatgcagaaggcctggagagagagaaacccccccgccagaatcaaggccgcctaccaggccctggagctgaacaacgactgcgccaccgcctacgtgctgctggccgaggaggaggccaccaccatcgtggacgccgagagactgttcaagcaggccctgaaggccggcgagaccatctacagacagagccagcagtgccagcaccagagcccccagcacgaggcccagctgagaagagacaccaacgtgctggtgtacatcaagagaagactggccatgtgcgccagaaagctgggcagaatcagagaggccgtgaagatcatgagagactacctgctggagatgaagagcctgatcctgccccccgagcacatcctgaagagaggcgacagcgaggccatcgcctacgccttcttccacctgcagcactggaagagaatcgagggcgccctgaacctgctgcagtgcacctgggagggcaccttccaccacgtgagcgtgtaccccaagaaggagctgcccctgttcatccacttcaccgccggcttctgcagcagcaccgccatgatcgccatcctgacccaccagttccccgagatcatgggcatcttcgccaaggccgtgctgggcctgtggtgcccccagccctgggccagcagcggcttcgaggagaacacccaggacctgaagagcgaggacctgggcctgagcagcggctag

SEQ ID NO: 24924 - DNA, 864 bp, Artificial Sequence
  Description of Artificial Sequence: Synthetic coding sequence
tgaatcagcgagcccggcagccccagcagaaacagagagaacgagaccagcagacagaacctgagcgagtgcaaggtgtggagaaaccccctgaacctgttcagaggcgccgagtacagaagatacacctgggtgaccggcaaggagcccctgacctactacgacatgaacctgagcgcccaggaccaccagaccttcttcacctgcgacaccgacttcctgagacccagcgacaccgtgatgcagaaggcctggagagagagaaacccccccgccagaatcaaggccgcctaccaggccctggagctgaacaacgactgcgccaccgcctacgtgctgctggccgaggaggaggccaccaccatcgtggacgccgagagactgttcaagcaggccctgaaggccggcgagaccatctacagacagagccagcagtgccagcaccagagcccccagcacgaggcccagctgagaagagacaccaacgtgctggtgtacatcaagagaagactggccatgtgcgccagaaagctgggcagaatcagagaggccgtgaagatcatgagagactacctgctggagatgaagagcctgatcctgccccccgagcacatcctgaagagaggcgacagcgaggccatcgcctacgccttcttccacctgcagcactggaagagaatcgagggcgccctgaacctgctgcagtgcacctgggagggcaccttccaccacgtgagcgtgtaccccaagaaggagctgcccctgttcatccacttcaccgccggcttctgcagcagcaccgccatgatcgccatcctgacccaccagttccccgagatcatgggcatcttcgccaaggcctag

SEQ ID NO: 24925 - DNA, 1677 bp, Artificial Sequence
  Description of Artificial Sequence: Synthetic coding sequence
atggccgacagaggcggcgtgggcgaggccgccgccgtgggcgccagccccgccagcgtgcccggcctgaaccccaccctgggctggagagagagactgagagccggcctggccggcaccggcgccagcctgtggttcgtggccggcctgggcctgctgtacgccctgagaatccccctgagactgtgcgagaacctggccgccggcaccagcagcctgatcagcggcctgatcttcatcttcgagtggtggtacttccacaagcacggcaccagcttcatcgagcaggtgagcgtgagccacctgcagcccctgatgggcggcaccgagagcagcatcagcgagcccggcagccccagcagaaacagagagaacgagaccagcagacagaacctgagcgagtgcaaggtgtggagaaaccccctgaacctgttcagaggcgccgagtacagaagatacacctgggtgaccggcaaggagcccctgacctactacgacatgaacctgagcgcccaggaccaccagaccttcttcacctgcgacaccgacttcctgagacccagcgacaccgtgatgcagaaggcctggagagagagaaacccccccgccagaatcaaggccgcctaccaggccctggagctgaacaacgactgcgccaccgcctacgtgctgctggccgaggaggaggccaccaccatcgtggacgccgagagactgttcaagcaggccctgaaggccggcgagaccatctacagacagagccagcagtgccagcaccagagcccccagcacgaggcccagctgagaagagacaccaacgtgctggtgtacatcaagagaagactggccatgtgcgccagaaagctgggcagaatcagagaggccgtgaagatcatgagagacctgatgaaggagttcccccccctgaccatgctgaacatccacgagaacctgctggagagcctgctggagctgcaggcctaccccgacgtgcaggccgtgctggccaagtacgacgacatcagcctgcccaagagcgccgccatctgctacaccgccgccctgctgaagaccagaaccgtgagcgagaagttcagccccgagaccgccagcagaagaggcctgagcaccgccgagatcaacgccgtggaggccatccacagagccgtggagttcaacccccacgtgcccaagtacctgctggagatgaagagcctgatcctgccccccgagcacatcctgaagagaggcgacagcgaggccatcgcctacgccttcttccacctgcagcactggaagagaatcgagggcgccctgaacctgctgcagtgcacctgggagggcaccttcagaatgatcccctaccccctggagaagggccacctgttctacccctaccccagctgcaccgagaccgccgacagagagctgctgcccaccttccaccacgtgagcgtgtaccccaagaaggagctgcccctgttcatccacttcaccgccggcttctgcagcagcaccgccatgatcgccatcctgacccaccagttccccgagatcatgggcatcttcgccaaggccgtgctgggcctgtggtgcccccagccctgggccagcagcggcttcgaggagaacacccaggacctgaagagcgaggacctgggcctgagcagcggctag

SEQ ID NO: 24926 - DNA, 1500 bp, Artificial Sequence
  Description of Artificial Sequence: Synthetic coding sequence
atgagccccttcctgttcagagacgacatgaaggacctgaccgtgttcctgaacagcctgacccccaagttctacgtggccctgaccggcaccagcagcctgatcagcggcctgatcttcatcttcgagtggtggtacttccacaagcacggcaccagcttcatcgagcaggtgagcgtgagccacctgcagcccctgatgggcggcaccgagagcagcatcagcgagcccggcagccccagcagaaacagagagaacgagaccagcagacagaacctgagcgagtgcaaggtgtggagaaaccccctgaacctgttcagaggcgccgagtacagaagatacacctgggtgaccggcaaggagcccctgacctactacgacatgaacctgagcgcccaggaccaccagaccttcttcacctgcgacaccgacttcctgagacccagcgacaccgtgatgcagaaggcctggagagagagaaacccccccgccagaatcaaggccgcctaccaggccctggagctgaacaacgactgcgccaccgcctacgtgctgctggccgaggaggaggccaccaccatcgtggacgccgagagactgttcaagcaggccctgaaggccggcgagaccatctacagacagagccagcagtgccagcaccagagcccccagcacgaggcccagctgagaagagacaccaacgtgctggtgtacatcaagagaagactggccatgtgcgccagaaagctgggcagaatcagagaggccgtgaagatcatgagagacctgatgaaggagttcccccccctgaccatgctgaacatccacgagaacctgctggagagcctgctggagctgcaggcctaccccgacgtgcaggccgtgctggccaagtacgacgacatcagcctgcccaagagcgccgccatctgctacaccgccgccctgctgaagaccagaaccgtgagcgagaagttcagccccgagaccgccagcagaagaggcctgagcaccgccgagatcaacgccgtggaggccatccacagagccgtggagttcaacccccacgtgcccaagtacctgctggagatgaagagcctgatcctgccccccgagcacatcctgaagagaggcgacagcgaggccatcgcctacgccttcttccacctgcagcactggaagagaatcgagggcgccctgaacctgctgcagtgcacctgggagggcaccttcagaatgatcccctaccccctggagaagggccacctgttctacccctaccccagctgcaccgagaccgccgacagagagctgctgcccaccttccaccacgtgagcgtgtaccccaagaaggagctgcccctgttcatccacttcaccgccggcttctgcagcagcaccgccatgatcgccatcctgacccaccagttccccgagatcatgggcatcttcgccaaggccgtgagcatgatcagcagaacctgcgtggactacctgtag

SEQ ID NO: 24927 - DNA, 1206 bp, Artificial Sequence
  Description of Artificial Sequence: Synthetic coding sequence
atggccgacagaggcggcgtgggcgaggccgccgccgtgggcgccagccccgccagcgtgcccggcctgaaccccaccctgggctggagagagagactgagagccggcctggccggcaccggcgccagcctgtggttcgtggccggcctgggcctgctgtacgccctgagaatccccctgagactgtgcgagaacctggccgccggcaccagcagcctgatcagcggcctgatcttcatcttcgagtggtggtacttccacaagcacggcaccagcttcatcgagcaggtgagcgtgagccacctgcagcccctgatgggcggcaccgagagcagcatcagcgagcccggcagccccagcagaaacagagagaacgagaccagcagacagaacctgagcgagtgcaaggtgtggagaaaccccctgaacctgttcagaggcgccgagtacagaagatacacctgggtgaccggcaaggagcccctgacctactacgacatgaacctgagcgcccaggaccaccagaccttcttcacctgcgacaccgacttcctgagacccagcgacaccgtgatgcagaaggcctggagagagagaaacccccccgccagaatcaaggccgcctaccaggccctggagctgaacaacgactgcgccaccgcctacgtgctgctggccgaggaggaggccaccaccatcgtggacgccgagagactgttcaagcaggccctgaaggccggcgagaccatctacagacagagccagcagtgccagcaccagagcccccagcacgaggcccagctgagaagagacaccaacgtgctggtgtacatcaagagaagactggccatgtgcgccagaaagctgggcagaatcagagaggccgtgaagatcatgagagacctgatgaaggagttcccccccctgaccatgctgaacatccacgagaacctgctggagagcctgctggagctgcaggcctaccccgacgtgcaggccgtgctggccaagtacgacgacatcagcctgcccaagagcgccgccatctgctacaccgccgccctgctgaagaccagaaccgtgagcgagaagttcagccccgagaccgccagcagaagaggcctgagcaccgccgagatcaacgccgtggaggccatccacagagccgtggagttcaacccccacgtgcccaagctgctggagtag

SEQ ID NO: 24928 - DNA, 1533 bp, Artificial Sequence
  Description of Artificial Sequence: Synthetic coding sequence
atggccgacagaggcggcgtgggcgaggccgccgccgtgggcgccagccccgccagcgtgcccggcctgaaccccaccctgggctggagagagagactgagagccggcctggccggcaccggcgccagcctgtggttcgtggccggcctgggcctgctgtacgccctgagaatccccctgagactgtgcgagaacctggccgccgtgaccgtgttcctgaacagcctgacccccaagttctacgtggccctgaccggcaccagcagcctgatcagcggcctgatcttcatcttcgagtggtggtacttccacaagcacggcaccagcttcatcgagcaggtgagcgtgagccacctgcagcccctgatgggcggcaccgagagcagcatcagcgagcccggcagccccagcagaaacagagagaacgagaccagcagacagaacctgagcgagtgcaaggtgtggagaaaccccctgaacctgttcagaggcgccgagtacagaagctgcgccaccgcctacgtgctgctggccgaggaggaggccaccaccatcgtggacgccgagagactgttcaagcaggccctgaaggccggcgagaccatctacagacagagccagcagtgccagcaccagagcccccagcacgaggcccagctgagaagagacaccaacgtgctggtgtacatcaagagaagactggccatgtgcgccagaaagctgggcagaatcagagaggccgtgaagatcatgagagacctgatgaaggagttcccccccctgaccatgctgaacatccacgagaacctgctggagagcctgctggagctgcaggcctaccccgacgtgcaggccgtgctggccaagtacgacgacatcagcctgcccaagagcgccgccatctgctacaccgccgccctgctgaagaccagaaccgtgagcgagaagttcagccccgagaccgccagcagaagaggcctgagcaccgccgagatcaacgccgtggaggccatccacagagccgtggagttcaacccccacgtgcccaagtacctgctggagatgaagagcctgatcctgccccccgagcacatcctgaagagaggcgacagcgaggccatcgcctacgccttcttccacctgcagcactggaagagaatcgagggcgccctgaacctgctgcagtgcacctgggagggcaccttcagaatgatcccctaccccctggagaagggccacctgttctacccctaccccagctgcaccgagaccgccgacagagagctgctgcccaccttccaccacgtgagcgtgtaccccaagaaggagctgcccctgttcatccacttcaccgccggcttctgcagcagcaccgccatgatcgccatcctgacccaccagttccccgagatcatgggcatcttcgccaaggccgtgctgggcctgtggtgcccccagccctgggccagcagcggcttcgaggagaacacccaggacctgaagagcgaggacctgggcctgagcagcggctag

SEQ ID NO: 24929 - DNA, 444 bp, Artificial Sequence
  Description of Artificial Sequence: Synthetic coding sequence
atgggcagccagggcagcggcggcgtgcccctggtgcaggccccctacaccgtgctgctgctgcccctgggcaccagcagacaggaccccggcgcccagagcttcttcctgtggctgagaagaatgcaggccctggagagagagcaggacgccctgtggcagggcctggagctgctgcagcacggccaggcctggttcgaggaccacctgagagaggcccagagacagcagctgcacctgggcgccctgggcgagaacttcctgaccgacctgcacagcgagcccggcagaccccccctggcccagatccagaaggtgaacatctgcctgcagaacctgatccacgagaagctgagcagacagcagaagggcgtgacccagcccaaggaggagatggcccagagaggctgcaccaagggccccagaggccccaccagagtgtag

SEQ ID NO: 24930 - DNA, 537 bp, Artificial Sequence
  Description of Artificial Sequence: Synthetic coding sequence
atgggcagccagggcagcggcggcgtgcccctggtgcaggccccctacaccgtgctgctgctgcccctgggcaccagcagacaggaccccggcgcccagagcttcttcctgtggctgagaagaatgcaggccctggagagagagcaggacgccctgtggcagggcctggagctgctgcagcacggccaggcctggttcgaggaccacctgagagaggcccagagacagcagctgcacctgggcgccctgggcgagaacttcctgaccgacctgcacagcgagcccggcagaccccccctggcccagatccagaaggtgaacatctgcctgcagaacctgatccacgagaagttcagccccagccccctgaacaaggccagcagctgcaccacccaggacagcaaggagagaagaagagagcagaacctgtggcagcagcaggagctgagcagacagcagaagggcgtgacccagcccaaggaggagatggcccagagaggctgcaccaagggccccagaggccccaccagagtgtag

SEQ ID NO: 24931 - DNA, 444 bp, Artificial Sequence; identical to SEQ ID NO: 24929
  Description of Artificial Sequence: Synthetic coding sequence

SEQ ID NO: 24932 - DNA, 447 bp, Artificial Sequence
  Description of Artificial Sequence: Synthetic coding sequence
atgggcagccagggcagcggcggcgtgcccctggtgcaggccccctacaccgtgctgctgctgcccctgggcaccagcagacaggaccccggcgcccagagcttcttcctgtggctgagaagaatgcaggccctggagagagagcaggacgccctgtggcagggcctggagctgctgcagcacggccaggcctggttcgaggaccacctgagagaggcccagagacagcagctgcacctgggcgccctgggcgagaacttcctgaccgacctgcacagcgagcccggcagaccccccctggcccagatccagaaggtgaacatctgcctgcagaacctgatccacgagaaggagctgagcagacagcagaagggcgtgacccagcccaaggaggagatggcccagagaggctgcaccaagggccccagaggccccaccagagtgtag

SEQ ID NO: 24933 - DNA, 444 bp, Artificial Sequence; identical to SEQ ID NO: 24929
  Description of Artificial Sequence: Synthetic coding sequence

SEQ ID NO: 24934 - DNA, 444 bp, Artificial Sequence; identical to SEQ ID NO: 24929
  Description of Artificial Sequence: Synthetic coding sequence

SEQ ID NO: 24935 - DNA, 444 bp, Artificial Sequence; identical to SEQ ID NO: 24929
  Description of Artificial Sequence: Synthetic coding sequence

SEQ ID NO: 24936 - DNA, 537 bp, Artificial Sequence; identical to SEQ ID NO: 24930
  Description of Artificial Sequence: Synthetic coding sequence

SEQ ID NO: 24937 - DNA, 537 bp, Artificial Sequence; identical to SEQ ID NO: 24930
  Description of Artificial Sequence: Synthetic coding sequence

SEQ ID NO: 24938 - DNA, 537 bp, Artificial Sequence; identical to SEQ ID NO: 24930
  Description of Artificial Sequence: Synthetic coding sequence

SEQ ID NO: 24939 - DNA, 444 bp, Artificial Sequence; identical to SEQ ID NO: 24929
  Description of Artificial Sequence: Synthetic coding sequence

SEQ ID NO: 24940 - DNA, 537 bp, Artificial Sequence; identical to SEQ ID NO: 24930
  Description of Artificial Sequence: Synthetic coding sequence

SEQ ID NO: 24941 - DNA, 447 bp, Artificial Sequence; identical to SEQ ID NO: 24932
  Description of Artificial Sequence: Synthetic coding sequence

SEQ ID NO: 24942 - DNA, 447 bp, Artificial Sequence; identical to SEQ ID NO: 24932
  Description of Artificial Sequence: Synthetic coding sequence

SEQ ID NO: 24943 - DNA, 447 bp, Artificial Sequence; identical to SEQ ID NO: 24932
  Description of Artificial Sequence: Synthetic coding sequence

SEQ ID NO: 24944 - DNA, 447 bp, Artificial Sequence; identical to SEQ ID NO: 24932
  Description of Artificial Sequence: Synthetic coding sequence

SEQ ID NO: 24945 - DNA, 447 bp, Artificial Sequence; identical to SEQ ID NO: 24932
  Description of Artificial Sequence: Synthetic coding sequence

SEQ ID NO: 24946 - DNA, 99 bp, Artificial Sequence
  Description of Artificial Sequence: Synthetic coding sequence
atggccgccgccgccgccggccccgccgccagccagagattcttccagagcttcagcgacgccctgatcgaccaggacccccaggccgccctggagtag

SEQ ID NO: 24947 - DNA, 99 bp, Artificial Sequence; identical to SEQ ID NO: 24946
  Description of Artificial Sequence: Synthetic coding sequence

SEQ ID NO: 24948 - DNA, 4986 bp, Artificial Sequence
  Description of Artificial Sequence: Synthetic coding sequence
atggaggcccccgccgccgagccccccgtgagaggctgcggcccccagcccgcccccgcccccgcccccgcccccgagagaaagaagagccacagagcccccagccccgccagacccaaggacgtggccggctggagcctggccaagggcagaagaggccccggccccggcagcgccgtggcctgcagcgccgccttcagcagcagacccgacaagaagggcagagccgtggcccccggcgccagaggcgccggcgtgagagtggccggcgtgagaaccggcgtgagagccaagggcagacccagaagcggcgccggccccagaccccccccccccccccccagcctgaccgacagcagcagcgaggtgagcgactgcgccagcgaggaggccagactgctgggcctggagctggccctgagcagcgacgccgagagcgccgccggcggccccgccggcgtgagaaccggccagcccgcccagcccgcccccagcgcccagcagccccccagaccccccgccagccccgacgagcccagcgtggccgccagcagcgtgggcagcagcagactgcccctgagcgccagcctggccttcagcgacctgaccgaggagatgctggactgcggccccagcggcctggtgagagagctggaggagctgagaagcgagaacgactacctgaaggacgagatcgaggagctgagagccgagatgctggagatgagagacgtgtacatggaggaggacgtgtaccagctgcaggagctgagacagcagctggaccaggccagcaagacctgcagaatcctgcagtacagactgagaaaggccgagagaagaagcctgagagccgcccagaccggccaggtggacggcgagctgatcagaggcctggagcaggacgtgaaggtgagcaaggacatcagcatgagactgcacaaggagctggaggtggtggagaagaagagagccagactggaggaggagaacgaggagctgagacagagactgatcgagaccgagctggccaagcaggtgctgcagaccgagctggagagacccagagagcacagcctgaagaagagaggcaccagaagcctgggcaaggccgacaagaagaccctggtgcaggaggacagcgccgacctgaagtgccagctgcacttcgccaaggaggagagcgccctgatgtgcaagaagctgaccaagctggccaaggagaacgacagcatgaaggaggagctgctgaagtacagaagcctgtacggcgacctggacagcgccctgagcgccgaggagctggccgacgccccccacagcagagagaccgagctgaaggtgcacctgaagctggtggaggaggaggccaacctgctgagcagaagaatcgtggagctggaggtggagaacagaggcctgagagccgagatggacgacatgaaggaccacggcggcggctgcggcggccccgaggccagactggccttcagcgccctgggcggcggcgagtgcggcgagagcctggccgagctgagaagacacctgcagttcgtggaggaggaggccgagctgctgagaagaagcagcgccgagctggaggaccagaacaagctgctgctgaacgagctggccaagttcagaagcgagcacgagctggacgtggccctgagcgaggacagctgcagcgtgctgagcgagcccagccaggaggagctggccgccgccaagctgcagatcggcgagctgagcggcaaggtgaagaagctgcagtacgagaacagagtgctgctgagcaacctgcagagatgcgacctggccagctgccagagcaccagacccatgctggagaccgacgccgaggccggcgacagcgcccagtgcgtgcccgcccccctgggcgagacccacgagagccacgccgtgagactgtgcagagccagagaggccgaggtgctgcccggcctgagagagcaggccgccctggtgagcaaggccatcgacgtgctggtggccgacgccaacggcttcaccgccggcctgagactgtgcctggacaacgagtgcgccgacttcagactgcacgaggcccccgacaacagcgagggccccagagacaccaagctgatccacgccatcctggtgagactgagcgtgctgcagcaggagctgaacgccttcaccagaaaggccgacgccgtgctgggctgcagcgtgaaggagcagcaggagagcttcagcagcctgccccccctgggcagccagggcctgagcaaggagatcctgctggccaaggacctgggcagcgacttccagccccccgacttcagagacctgcccgagtgggagcccagaatcagagaggccttcagaaccggcgacctggacagcaagcccgaccccagcagaagcttcagaccctacagagccgaggacaacgacagctacgccagcgagatcaaggagctgcagctggtgctggccgaggcccacgacagcctgagaggcctgcaggagcagctgagccaggagagacagctgagaaaggaggaggccgacaacttcaaccagaagatggtgcagctgaaggaggaccagcagagagccctgctgagaagagagttcgagctgcagagcctgagcctgcagagaagactggagcagaagttctggagccaggagaagaacatgctggtgcaggagagccagcagttcaagcacaacttcctgctgctgttcatgaagctgagatggttcctgaagagatggagacagggcaaggtgctgcccagcgagggcgacgacttcctggaggtgaacagcatgaaggagctgtacctgctgatggaggaggaggagatcaacgcccagcacagcgacaacaaggcctgcaccggcgacagctggacccagaacacccccaacgagtacatcaagaccctggccgacatgaaggtgaccctgaaggagctgtgctggctgctgagagacgagagaagaggcctgaccgagctgcagcagcagttcgccaaggccaaggccacctgggagaccgagagagccgagctgaagggccacaccagccagatggagctgaagaccggcaagggcgccggcgagagagccggccccgactggaaggccgccctgcagagagagagagaggagcagcagcacctgctggccgagagctacagcgccgtgatggagctgaccagacagctgcagatcagcgagagaaactggagccaggagaagctgcagctggtggagagactgcagggcgagaagcagcaggtggagcagcaggtgaaggagctgcagaacagactgagccagctgcagaaggccgccgacccctgggtgctgaagcacagcgagctggagaagcaggacaacagctggaaggagaccagaagcgagaagatccacgacaaggaggccgtgagcgaggtggagctgggcggcaacggcctgaagagaaccaagagcgtgagcagcatgagcgagttcgagagcctgctggactgcagcccctacctggccggcggcgacgccagaggcaagaagctgcccaacaaccccgccttcggcttcgtgagcagcgagcccggcgaccccgagaaggacaccaaggagaagcccggcctgagcagcagagactgcaaccacctgggcgccctggcctgccaggacccccccggcagacagatgcagagaagctacaccgcccccgacaagaccggcatcagagtgtactacagcccccccgtggccagaagactgggcgtgcccgtggtgcacgacaaggagggcaagatcatcatcgagcccggcttcctgttcaccaccgccaagcccaaggagagcgccgaggccgacggcctggccgagagcagctacggcagatggctgtgcaacttcagcagacagagactggacggcggcagcgccggcagccccagcgccgccggccccggcttccccgccgccctgcacgacttcgagatgagcggcaacatgagcgacgacatgaaggagatcaccaactgcgtgagacaggccatgagaagcggcagcctggagagaaaggtgaagagcaccagcagccagaccgtgggcctggccagcgtgggcacccagaccatcagaaccgtgagcgtgggcctgcagaccgacccccccagaagcagcctgcacggcaaggcctggagccccagaagcagcagcctggtgagcgtgagaagcaagcagatcagcagcagcctggacaaggtgcacagcagaatcgagagaccctgctgcagccccaagtacggcagccccaagctgcagagaagaagcgtgagcaagctggacagcagcaaggacagaagcctgtggaacctgcaccagggcaagcagaacggcagcgcctgggccagaagcaccaccaccagagacagccccgtgctgagaaacatcaacgacggcctgagcagcctgttcagcgtggtggagcacagcggcagcaccgagagcgtgtggaagctgggcatgagcgagaccagagccaagcccgagccccccaagtacggcatcgtgcaggagttcttcagaaacgtgtgcggcagagcccccagccccaccagcagcgccggcgaggagggcaccaagaagcccgagcccctgagccccgccagctaccaccagcccgagggcgtggccagaatcctgaacaagaaggccgccaagctgggcagcagcgaggaggtgagactgaccatgctgccccaggtgggcaaggacggcgtgctgagagacggcgacggcgccgtggtgctgcccaacgaggacgccgtgtgcgactgcagcacccagagcctgaccagctgcttcgccagaagcagcagaagcgccatcagacacagccccagcaagtgcagactgcaccccagcgagagcagctggggcggcgaggagagagccctgccccccagcgagtag

SEQ ID NO: 24949 - DNA, 3051 bp, Artificial Sequence
  Description of Artificial Sequence: Synthetic coding sequence
atgctggagatgagagacgtgtacatggaggaggacgtgtaccagctgcaggagctgagacagcagctggaccaggccagcaagacctgcagaatcctgcagtacagactgagaaaggccgagagaagaagcctgagagccgcccagaccggccaggtggacggcgagctgatcagaggcctggagcaggacgtgaaggtgagcaaggacatcagcatgagactgcacaaggagctggaggtggtggagaagaagagagccagactggaggaggagaacgaggagctgagacagagactgatcgagaccgagctggccaagcaggtgctgcagaccgagctggagagacccagagagcacagcctgaagaagagaggcaccagaagcctgggcaaggccgacaagaagaccctggtgcaggaggacagcgccgacctgaagtgccagctgcacttcgccaaggaggagagcgccctgatgtgcaagaagctgaccaagctggccaaggagaacgacagcatgaaggaggagctgctgaagtacagaagcctgtacggcgacctggacagcgccctgagcgccgaggagctggccgacgccccccacagcagagagaccgagctgaaggtgcacctgaagctggtggaggaggaggccaacctgctgagcagaagaatcgtggagctggaggtggagaacagaggcctgagagccgagatggacgacatgaaggaccacggcggcggctgcggcggccccgaggccagactggccttcagcgccctgggcggcggcgagtgcggcgagagcctggccgagctgagaagacacctgcagttcgtggaggaggaggccgagctgctgagaagaagcagcgccgagctggaggaccagaacaagctgctgctgaacgagctggccaagttcagaagcgagcacgagctggacgtggccctgagcgaggacagctgcagcgtgctgagcgagcccagccaggaggagctggccgccgccaagctgcagatcggcgagctgagcggcaaggtgaagaagctgcagtacgagaacagagtgctgctgagcaacctgcagagatgcgacctggccagctgccagagcaccagacccatgctggagaccgacgccgaggccggcgacagcgcccagtgcgtgcccgcccccctgggcgagacccacgagagccacgccgtgagactgtgcagagccagagaggccgaggtgctgcccggcctgagagagcaggccgccctggtgagcaaggccatcgacgtgctggtggccgacgccaacggcttcaccgccggcctgagactgtgcctggacaacgagtgcgccgacttcagactgcacgaggcccccgacaacagcgagggccccagagacaccaagctgatccacgccatcctggtgagactgagcgtgctgcagcaggagctgaacgccttcaccagaaaggccgacgccgtgctgggctgcagcgtgaaggagcagcaggagagcttcagcagcctgccccccctgggcagccagggcctgagcaaggagatcctgctggccaaggacctgggcagcgacttccagccccccgacttcagagacctgcccgagtgggagcccagaatcagagaggccttcagaaccggcgacctggacagcaagcccgaccccagcagaagcttcagaccctacagagccgaggacaacgacagctacgccagcgagatcaaggagctgcagctggtgctggccgaggcccacgacagcctgagaggcctgcaggagcagctgagccaggagagacagctgagaaaggaggaggccgacaacttcaaccagaagatggtgcagctgaaggaggaccagcagagagccctgctgagaagagagttcgagctgcagagcctgagcctgcagagaagactggagcagaagttctggagccaggagaagaacatgctggtgcaggagagccagcagttcaagcacaacttcctgctgctgttcatgaagctgagatggttcctgaagagatggagacagggcaaggtgctgcccagcgagggcgacgacttcctggaggtgaacagcatgaaggagctgtacctgctgatggaggaggaggagatcaacgcccagcacagcgacaacaaggcctgcaccggcgacagctggacccagaacacccccaacgagtacatcaagaccctggccgacatgaaggtgaccctgaaggagctgtgctggctgctgagagacgagagaagaggcctgaccgagctgcagcagcagttcgccaaggccaaggccacctgggagaccgagagagccgagctgaagggccacaccagccagatggagctgaagaccggcaagggcgccggcgagagagccggccccgactggaaggccgccctgcagagagagagagaggagcagcagcacctgctggccgagagctacagcgccgtgatggagctgaccagacagctgcagatcagcgagagaaactggagccaggagaagctgcagctggtggagagactgcagggcgagaagcagcaggtggagcagcaggtgaaggagctgcagaacagactgagccagctgcagaaggccgccgacccctgggtgctgaagcacagcgagctggagaagcaggacaacagctggaaggagaccagaagcgagaagatccacgacaaggaggccgtgagcgaggtggagctgggcggcaacggcctgaagagaaccaagagcgtgagcagcatgagcgagttcgagagcctgctggactgcagcccctacctggccggcggcgacgccagaggcaagaagctgcccaacaaccccgccttcggcttcgtgagcagcgagcccggcgaccccgagaaggacaccaaggagaagcccggcctgagcagcagagactgcaaccacctgggcgccctggcctgccaggacccccccggcagccagaagctgcccttcctgctgatcctggcccccccccagcccccccccatcctgtag

SEQ ID NO: 24950 - DNA, 4272 bp, Artificial Sequence
  Description of Artificial Sequence: Synthetic coding sequence
atgctggagatgagagacgtgtacatggaggaggacgtgtaccagctgcaggagctgagacagcagctggaccaggccagcaagacctgcagaatcctgcagtacagactgagaaaggccgagagaagaagcctgagagccgcccagaccggccaggtggacggcgagctgatcagaggcctggagcaggacgtgaaggtgagcaaggacatcagcatgagactgcacaaggagctggaggtggtggagaagaagagagccagactggaggaggagaacgaggagctgagacagagactgatcgagaccgagctggccaagcaggtgctgcagaccgagctggagagacccagagagcacagcctgaagaagagaggcaccagaagcctgggcaaggccgacaagaagaccctggtgcaggaggacagcgccgacctgaagtgccagctgcacttcgccaaggaggagagcgccctgatgtgcaagaagctgaccaagctggccaaggagaacgacagcatgaaggaggagctgctgaagtacagaagcctgtacggcgacctggacagcgccctgagcgccgaggagctggccgacgccccccacagcagagagaccgagctgaaggtgcacctgaagctggtggaggaggaggccaacctgctgagcagaagaatcgtggagctggaggtggagaacagaggcctgagagccgagatggacgacatgaaggaccacggcggcggctgcggcggccccgaggccagactggccttcagcgccctgggcggcggcgagtgcggcgagagcctggccgagctgagaagacacctgcagttcgtggaggaggaggccgagctgctgagaagaagcagcgccgagctggaggaccagaacaagctgctgctgaacgagctggccaagttcagaagcgagcacgagctggacgtggccctgagcgaggacagctgcagcgtgctgagcgagcccagccaggaggagctggccgccgccaagctgcagatcggcgagctgagcggcaaggtgaagaagctgcagtacgagaacagagtgctgctgagcaacctgcagagatgcgacctggccagctgccagagcaccagacccatgctggagaccgacgccgaggccggcgacagcgcccagtgcgtgcccgcccccctgggcgagacccacgagagccacgccgtgagactgtgcagagccagagaggccgaggtgctgcccggcctgagagagcaggccgccctggtgagcaaggccatcgacgtgctggtggccgacgccaacggcttcaccgccggcctgagactgtgcctggacaacgagtgcgccgacttcagactgcacgaggcccccgacaacagcgagggccccagagacaccaagctgatccacgccatcctggtgagactgagcgtgctgcagcaggagctgaacgccttcaccagaaaggccgacgccgtgctgggctgcagcgtgaaggagcagcaggagagcttcagcagcctgccccccctgggcagccagggcctgagcaaggagatcctgctggccaaggacctgggcagcgacttccagccccccgacttcagagacctgcccgagtgggagcccagaatcagagaggccttcagaaccggcgacctggacagcaagcccgaccccagcagaagcttcagaccctacagagccgaggacaacgacagctacgccagcgagatcaaggagctgcagctggtgctggccgaggcccacgacagcctgagaggcctgcaggagcagctgagccaggagagacagctgagaaaggaggaggccgacaacttcaaccagaagatggtgcagctgaaggaggaccagcagagagccctgctgagaagagagttcgagctgcagagcctgagcctgcagagaagactggagcagaagttctggagccaggagaagaacatgctggtgcaggagagccagcagttcaagcacaacttcctgctgctgttcatgaagctgagatggttcctgaagagatggagacagggcaaggtgctgcccagcgagggcgacgacttcctggaggtgaacagcatgaaggagctgtacctgctgatggaggaggaggagatcaacgcccagcacagcgacaacaaggcctgcaccggcgacagctggacccagaacacccccaacgagtacatcaagaccctggccgacatgaaggtgaccctgaaggagctgtgctggctgctgagagacgagagaagaggcctgaccgagctgcagcagcagttcgccaaggccaaggccacctgggagaccgagagagccgagctgaagggccacaccagccagatggagctgaagaccggcaagggcgccggcgagagagccggccccgactggaaggccgccctgcagagagagagagaggagcagcagcacctgctggccgagagctacagcgccgtgatggagctgaccagacagctgcagatcagcgagagaaactggagccaggagaagctgcagctggtggagagactgcagggcgagaagcagcaggtggagcagcaggtgaaggagctgcagaacagactgagccagctgcagaaggccgccgacccctgggtgctgaagcacagcgagctggagaagcaggacaacagctggaaggagaccagaagcgagaagatccacgacaaggaggccgtgagcgaggtggagctgggcggcaacggcctgaagagaaccaagagcgtgagcagcatgagcgagttcgagagcctgctggactgcagcccctacctggccggcggcgacgccagaggcaagaagctgcccaacaaccccgccttcggcttcgtgagcagcgagcccggcgaccccgagaaggacaccaaggagaagcccggcctgagcagcagagactgcaaccacctgggcgccctggcctgccaggacccccccggcagacagatgcagagaagctacaccgcccccgacaagaccggcatcagagtgtactacagcccccccgtggccagaagactgggcgtgcccgtggtgcacgacaaggagggcaagatcatcatcgagcccggcttcctgttcaccaccgccaagcccaaggagagcgccgaggccgacggcctggccgagagcagctacggcagatggctgtgcaacttcagcagacagagactggacggcggcagcgccggcagccccagcgccgccggccccggcttccccgccgccctgcacgacttcgagatgagcggcaacatgagcgacgacatgaaggagatcaccaactgcgtgagacaggccatgagaagcggcagcctggagagaaaggtgaagagcaccagcagccagaccgtgggcctggccagcgtgggcacccagaccatcagaaccgtgagcgtgggcctgcagaccgacccccccagaagcagcctgcacggcaaggcctggagccccagaagcagcagcctggtgagcgtgagaagcaagcagatcagcagcagcctggacaaggtgcacagcagaatcgagagaccctgctgcagccccaagtacggcagccccaagctgcagagaagaagcgtgagcaagctggacagcagcaaggacagaagcctgtggaacctgcaccagggcaagcagaacggcagcgcctgggccagaagcaccaccaccagagacagccccgtgctgagaaacatcaacgacggcctgagcagcctgttcagcgtggtggagcacagcggcagcaccgagagcgtgtggaagctgggcatgagcgagaccagagccaagcccgagccccccaagtacggcatcgtgcaggagttcttcagaaacgtgtgcggcagagcccccagccccaccagcagcgccggcgaggagggcaccaagaagcccgagcccctgagccccgccagctaccaccagcccgagggcgtggccagaatcctgaacaagaaggccgccaagctgggcagcagcgaggaggtgagactgaccatgctgccccaggtgggcaaggacggcgtgctgagagacggcgacggcgccgtggtgctgcccaacgaggacgccgtgtgcgactgcagcacccagagcctgaccagctgcttcgccagaagcagcagaagcgccatcagacacagccccagcaagtgcagactgcaccccagcgagagcagctggggcggcgaggagagagccctgccccccagcgagtag

SEQ ID NO: 24951 - DNA, 3795 bp, Artificial Sequence
  Description of Artificial Sequence: Synthetic coding sequence
atgtgcaagaagctgaccaagctggccaaggagaacgacagcatgaaggaggagctgctgaagtacagaagcctgtacggcgacctggacagcgccctgagcgccgaggagctggccgacgccccccacagcagagagaccgagctgaaggtgcacctgaagctggtggaggaggaggccaacctgctgagcagaagaatcgtggagctggaggtggagaacagaggcctgagagccgagatggacgacatgaaggaccacggcggcggctgcggcggccccgaggccagactggccttcagcgccctgggcggcggcgagtgcggcgagagcctggccgagctgagaagacacctgcagttcgtggaggaggaggccgagctgctgagaagaagcagcgccgagctggaggaccagaacaagctgctgctgaacgagctggccaagttcagaagcgagcacgagctggacgtggccctgagcgaggacagctgcagcgtgctgagcgagcccagccaggaggagctggccgccgccaagctgcagatcggcgagctgagcggcaaggtgaagaagctgcagtacgagaacagagtgctgctgagcaacctgcagagatgcgacctggccagctgccagagcaccagacccatgctggagaccgacgccgaggccggcgacagcgcccagtgcgtgcccgcccccctgggcgagacccacgagagccacgccgtgagactgtgcagagccagagaggccgaggtgctgcccggcctgagagagcaggccgccctggtgagcaaggccatcgacgtgctggtggccgacgccaacggcttcaccgccggcctgagactgtgcctggacaacgagtgcgccgacttcagactgcacgaggcccccgacaacagcgagggccccagagacaccaagctgatccacgccatcctggtgagactgagcgtgctgcagcaggagctgaacgccttcaccagaaaggccgacgccgtgctgggctgcagcgtgaaggagcagcaggagagcttcagcagcctgccccccctgggcagccagggcctgagcaaggagatcctgctggccaaggacctgggcagcgacttccagccccccgacttcagagacctgcccgagtgggagcccagaatcagagaggccttcagaaccggcgacctggacagcaagcccgaccccagcagaagcttcagaccctacagagccgaggacaacgacagctacgccagcgagatcaaggagctgcagctggtgctggccgaggcccacgacagcctgagaggcctgcaggagcagctgagccaggagagacagctgagaaaggaggaggccgacaacttcaaccagaagatggtgcagctgaaggaggaccagcagagagccctgctgagaagagagttcgagctgcagagcctgagcctgcagagaagactggagcagaagttctggagccaggagaagaacatgctggtgcaggagagccagcagttcaagcacaacttcctgctgctgttcatgaagctgagatggttcctgaagagatggagacagggcaaggtgctgcccagcgagggcgacgacttcctggaggtgaacagcatgaaggagctgtacctgctgatggaggaggaggagatcaacgcccagcacagcgacaacaaggcctgcaccggcgacagctggacccagaacacccccaacgagtacatcaagaccctggccgacatgaaggtgaccctgaaggagctgtgctggctgctgagagacgagagaagaggcctgaccgagctgcagcagcagttcgccaaggccaaggccacctgggagaccgagagagccgagctgaagggccacaccagccagatggagctgaagaccggcaagggcgccggcgagagagccggccccgactggaaggccgccctgcagagagagagagaggagcagcagcacctgctggccgagagctacagcgccgtgatggagctgaccagacagctgcagatcagcgagagaaactggagccaggagaagctgcagctggtggagagactgcagggcgagaagcagcaggtggagcagcaggtgaaggagctgcagaacagactgagccagctgcagaaggccgccgacccctgggtgctgaagcacagcgagctggagaagcaggacaacagctggaaggagaccagaagcgagaagatccacgacaaggaggccgtgagcgaggtggagctgggcggcaacggcctgaagagaaccaagagcgtgagcagcatgagcgagttcgagagcctgctggactgcagcccctacctggccggcggcgacgccagaggcaagaagctgcccaacaaccccgccttcggcttcgtgagcagcgagcccggcgaccccgagaaggacaccaaggagaagcccggcctgagcagcagagactgcaaccacctgggcgccctggcctgccaggacccccccggcagacagatgcagagaagctacaccgcccccgacaagaccggcatcagagtgtactacagcccccccgtggccagaagactgggcgtgcccgtggtgcacgacaaggagggcaagatcatcatcgagcccggcttcctgttcaccaccgccaagcccaaggagagcgccgaggccgacggcctggccgagagcagctacggcagatggctgtgcaacttcagcagacagagactggacggcggcagcgccggcagccccagcgccgccggccccggcttccccgccgccctgcacgacttcgagatgagcggcaacatgagcgacgacatgaaggagatcaccaactgcgtgagacaggccatgagaagcggcagcctggagagaaaggtgaagagcaccagcagccagaccgtgggcctggccagcgtgggcacccagaccatcagaaccgtgagcgtgggcctgcagaccgacccccccagaagcagcctgcacggcaaggcctggagccccagaagcagcagcctggtgagcgtgagaagcaagcagatcagcagcagcctggacaaggtgcacagcagaatcgagagaccctgctgcagccccaagtacggcagccccaagctgcagagaagaagcgtgagcaagctggacagcagcaaggacagaagcctgtggaacctgcaccagggcaagcagaacggcagcgcctgggccagaagcaccaccaccagagacagccccgtgctgagaaacatcaacgacggcctgagcagcctgttcagcgtggtggagcacagcggcagcaccgagagcgtgtggaagctgggcatgagcgagaccagagccaagcccgagccccccaagtacggcatcgtgcaggagttcttcagaaacgtgtgcggcagagcccccagccccaccagcagcgccggcgaggagggcaccaagaagcccgagcccctgagccccgccagctaccaccagcccgagggcgtggccagaatcctgaacaagaaggccgccaagctgggcagcagcgaggaggtgagactgaccatgctgccccaggtgggcaaggacggcgtgctgagagacggcgacggcgccgtggtgctgcccaacgaggacgccgtgtgcgactgcagcacccagagcctgaccagctgcttcgccagaagcagcagaagcgccatcagacacagccccagcaagtgcagactgcaccccagcgagagcagctggggcggcgaggagagagccctgccccccagcgagtag

SEQ ID NO: 24952 - DNA, 237 bp, Artificial Sequence
  Description of Artificial Sequence: Synthetic coding sequence
atgggcagcggcctgcccctggtgctgctgctgaccctgctgggcagcagccacggcaccggccccggcatgaccctgcagctgaagctgaaggagagcttcctgaccagcagcagctacgagagcagcttcctggagctgctggagaagctgtgcctgctgctgcacctgcccagcggcaccagcgtgaccctgcaccacgccagaagccagcaccacgtggtgtgcaacacctag

SEQ ID NO: 24953 - DNA, 690 bp, Artificial Sequence
  Description of Artificial Sequence: Synthetic coding sequence
atgcccgccgccggcccccccctgctgctgctgggcacccccggcagcggcaagaccgccctgctgttcgccgccgccctggaggccgccggcgagggccagggccccgtgctgttcctgaccagaagacccctgcagagcatgcccagaggcaccggcaccaccctggaccccatgagactgcagaagatcagattccagtacccccccagcaccagagagctgttcagactgctgtgcagcgcccacgaggcccccggccccgcccccagcctgctgctgctggacggcctggaggagtacctggccgaggaccccgagccccaggaggccgcctacctgatcgccctgctgctggacaccgccgcccacttcagccacagactgggccccggcagagactgcggcctgatggtggccctgcagacccaggaggaggccggcagcggcgacgtgctgcacctggccctgctgcagagatacttccccgcccagtgctggctgcagcccgacgcccccggccccggcgagcacggcctgagagcctgcctggagcccggcggcctgggccccagaaccgagtggtgggtgaccttcagaagcgacggcgagatgatgatcgccccctggcccacccaggccggcgaccccagcagcggcaagggcagcagcagcggcggccagccctag

SEQ ID NO: 24954 - DNA, 2703 bp, Artificial Sequence
  Description of Artificial Sequence: Synthetic coding sequence
atgagcagcaaggagagctgcggcaagaaggagaccagccagagaaaggacaccaccaccagcagccccaacttcggcgagaaggacaagaaggagagaaagacccccgccagcagcaccagcagcagcagcatcagaagcgtgagcagcgagaagagaaagctgaagagcgaccacaccgacgtgctgtactacaacatcaagagaagacagggcctgaagagactgagcgtggagatcgacaccctgagaagaagacccaagatcggcagcagcagccagagacccatcaagctgaaggaggccagctacagcaacgacaaccagatcatcctgcagagccccagcagcaacggcaccaagaaggacatccacaagtgcgtggacttcaagcccaaggacatcaagctgaccaacgccggcagcaagctggaccacggcatcaagagcctgagcagccccaagatcgccagcgacgtgaagcccaaggccgagggccaggccagcgagaacaagtggagccacctgctggtgcagagagagaagatgaaggagctgaagaagggcagaaacagcaagttcagagacaacagcgagaagtgcgtgctggagaagtggaagagaaaccagttcagccaggactacaacagcaacaagatcatcaaggagcccctgggcagcagaagacagaagatcagcttcaagatccccatcaagagcagagacaccctgcagaagctggtggaggagaacgtgttcaacatcgacagcaacaacagcaagaccaagcaggaggagagagagtacctggagagcagccaggtgagcctgaacgtgaccagacagaagaccgagcacctgctgagcgacttcacctacaagagaaccgtgcacgagtggaagagaaagcaccactacgaccaccaggagagcaacgacagccacagcagagagaacctgacccagagcttcgaggccccctgctgcagcgtgagcagcgagagcatccaggacgccgaccaggagatgcagatcgtggaggagctgcacgccgccagagtgggcaagagcgtggacctgcccggcgagctgatgagcatggagatcgacctggaggacgacgtgcacagcagcagcgccaacaacaccagcgacagaaagctgctgatcgtgatcgacaccaacatcctgatgaaccacctgaagttcgtgagaatcctgaagaccaccgaggtgcccggcttcgacaagctggtgctgatcatcccctgggtggtgatgcaggagctggacagaatgaaggagggcaagctgctgaagagagcccagcacaaggccatccccgccgtgcacttcatcaacgacagcctgaagaaccaggacagaaagctgtggggccagagcatccagctggccagccagaagcactacggcctgagcgacgagaacaacgacgacagagtgctgaagtgctgcctgcagcaccaggagctgttcccctgcagcttcgtgatcctgtgcaccgacgacagaaacctgagaaacaagggcctgatcagcggcgtgaagagcctgagcaaggaggagctgagcgccgagctgctgcacctgagcctgaacaccgacgtgtgccaccagccctgcatccccaagcagcagctgaaggccgagaccacccccctgaaggagagctacaaggaggagagcaccaacagcggcctgagcatcctgctggagagcatcgtgagcgacctggagaagagcctgggcaccggcctgagcagcatcctggagaccgagatgaagatcgccttcggcaacctgtggatggagatcctgtacctgaagcccccctggaccctgctgcacctgctgcagtgcttcaagaagcactggctggccgtgttcggcctggtgatggagaagaacctgctgctgaccatcgagagcctgtacaagaacctgagaaaggccaacaaggccgtggacttcaccaccgtgaagttcctgctgcaggacagcagaagcctgctgcacgccttcagcaccagaagcaactacgacggcatcctgccccagaccttcgcccaggtgaacaacctgctgcagaccttcgccgaggtgaagaccaagctgaagcccaacagcagcgagaacaccgtgaccaagaagcaggagggcaccagcctgaagaacagccacaaccaggagatcaccgtgttcagcagcagccacctgccccagcccagcagacaccaggagatctggagcatcctggagagcgtgtggatcaccatctaccagaacagcaccgacgtgttccagagactgggcagcaacagcgccctgaccaccagcaacatcgccagcttcgaggaggccttcatctgcctgcagaagctgatggccgccgtgagagacatcctggagggcatccagagaatcctggcccccaacagcaactaccaggacgtggagaccctgtacaacttcctgatcaagtacgaggtgaacaagaacgtgaagttcaccgcccaggagatctacgactgcgtgagccagaccgagtacagagagaagctgaccatcggctgcagacagctggtggagatggagtacaccatgcagcagtgcaacgccagcgtgtacatggaggccaagaacagaggctggtgcgaggacatgctgaactacagaatctag

SEQ ID NO: 24955 - DNA, 2703 bp, Artificial Sequence; identical to SEQ ID NO: 24954
  Description of Artificial Sequence: Synthetic coding sequence

SEQ ID NO: 24956 - DNA, 483 bp, Artificial Sequence
  Description of Artificial Sequence: Synthetic coding sequence
atgagcagcaaggagagctgcggcaagaaggagaccagccagagaaaggacaccaccaccagcagccccaacttcggcgagaaggacaagaaggagagaaagacccccgccagcagcaccagcagcagcagcatcagaagcgtgagcagcgagaagagaaagctgaagagcgaccacaccgacgtgctgtactacaacatcaagagaagacagggcctgaagagactgagcgtggagatcgacaccctgagaagaagacccaagatcggcagcagcagccagagacccatcaagctgaaggaggccagctacagcaacgacaaccagatcatcctgcagagccccagcagcaacggcaccaagaaggacatccacaagtgcgtggacttcaagcccaaggacatcaagctgaccaacgccggcagcaagctggaccacggcatcaagagcctgagcagccccaagatcgccagcgacgtgtag

SEQ ID NO: 24957 - DNA, 1545 bp, Artificial Sequence
  Description of Artificial Sequence: Synthetic coding sequence
atgatgaacttcctgagaagaagactgagcgacagcagcctgttcagcagcctgagccaggccgtgaagcagaccgccgccagcgccggcctggtggacgcccccggcgccgcccccgccgccgccagaaaggccaaggtgctgctggtggtggacgagccccacgccgactgggccaagtgcttcagaggcaagaaggtgctgggcgactacgacatcaaggtggagcaggccgagttcagcgagctgaacctggtggcccacgccgacggcacctacgccgtggacatgcaggtgctgagaaacggcaccaaggtggtgagaagcttcagacccgacttcgtgctgatcagacagcacgccttcggcatggccgagaacgaggacttcagacacctgatcatcggcatgcagtacgccggcctgcccagcatcaacagcctggagagcatctacaacttctgcgacaagccctgggtgttcgcccagctggtggccatctacaagaccctgggcggcgagaagttccccctgatcgagcagacctactaccccaaccacaaggagatgctgaccctgcccaccttccccgtggtggtgaagatcggccacgcccacagcggcatgggcaaggtgaaggtggagaaccactacgacttccaggacatcgccagcgtggtggccctgacccagacctacgccaccgccgagcccttcatcgacagcaagtacgacatcagagtgcagaagatcggcaacaactacaaggcctacatgagaaccagcatcagcggcaactggaagaccaacaccggcagcgccatgctggagcagatcgccatgagcgacagatacaagctgtgggtggacacctgcagcgagatgttcggcggcctggacatctgcgccgtgaaggccgtgcacggcaaggacggcaaggactacatcttcgaggtgatggactgcagcatgcccctgatcggcgagcaccaggtggaggacagacagctgatcaccgagctggtgatcagcaagatgaaccagctgctgagcagaacccccgccctgagcccccagagacccctgaccacccagcagccccagagcggcaccctgaaggaccccgacagcagcaagacccccccccagagaccccccccccagggcggccccggccagccccagggcatgcagccccccggcaaggtgctgccccccagaagactgccccccggccccagcctgccccccagcagcagcagcagcagcagcagcagcagcagcgccccccagagacccggcggccccaccacccacggcgacgcccccagcagcagcagcagcctggccgaggcccagccccccctggccgcccccccccagaagccccagccccacccccagctgaacaagagccagagcctgaccaacgccttcagcttcagcgagagcagcttcttcagaagcagcgccaacgaggacgaggccaaggccgagaccatcagaagcctgagaaagagcttcgccagcctgttcagcgactag

SEQ ID NO: 24958 - DNA, 729 bp, Artificial Sequence
  Description of Artificial Sequence: Synthetic coding sequence
atggccggcaagctgaagcccctgaacgtggaggcccccgaggccaccgaggaggccgagggccaggccaagagcctgaagaccgaggacctgctggccatggtgatcaagctgcagaaggagggcagcctggagccccagatcgaggacctgatcagcagaatcaacgacctgcagcaggccaagaagaagagcagcgaggagctgagagagacccacagcctgtgggaggccctgcacagagagctggacagcctgaacggcgagaaggtgcacctggaggaggtgctgggcaagaagcaggaggccctgagaatcctgcagatgcactgccaggagaaggagagcgaggcccagagactggacgtgagaggccagctggaggacctgatgggccagcacaaggacctgtgggagttccacatgctggagcagagactggccagagagatcagagccctggagagaagcaaggagcagctgctgagcgagagaagactggtgagagccaagctgagagaggtggagagaagactgcacagcccccccgaggtggagggcgccatggccgtgaacgacggcctgaaggccgagctggagatcttcggcgagcaggtgagaagcgcccccgaggtgggcgccggcgagggcgaggccggccccgagctgcccagagccagagacgaggaggaccccgagccccccgtggccgcccccgacgccctgtag

SEQ ID NO: 24959 - DNA, 267 bp, Artificial Sequence
  Description of Artificial Sequence: Synthetic coding sequence
atggacgacgccgaccccgaggagagaaactacgacaacatgctgaagatgctgagcgacctgaacaaggacctggagaagctgctggaggagatggagaagatcagcgtgcaggccacctggatggcctacgacatggtggtgatgagaaccaaccccaccctggccgagagcatgagaagactggaggacgccttcgtgaactgcaaggaggagatggagaagaactggcaggagctgctgcacgagaccaagcagagactgtag

SEQ ID NO: 24960 - DNA, 942 bp, Artificial Sequence
  Description of Artificial Sequence: Synthetic coding sequence
atgctgctgctggccgacatggacgtggtgaaccagctggtggccggcggccagttcagagtggtgaaggagcccctgggcttcgtgaaggtgctgcagtgggtgttcgccatcttcgccttcgccacctgcggcagctacagcggcgagctgcagctgagcgtggactgcgccaacaagaccgagagcgacctgagcatcgaggtggagttcgagtaccccttcagactgcaccaggtgtacttcgacgcccccacctgcagaggcggcaccaccaaggtgttcctggtgggcgactacagcagcagcgccgagttcttcgtgaccgtggccgtgttcgccttcctgtacagcatgggcgccctggccacctacatcttcctgcagaacaagtacagagagaacaacaagggccccatgctggacttcctggccaccgccgtgttcgccttcatgtggctggtgagcagcagcgcctgggccaagggcctgagcgacgtgaagatggccaccgaccccgagaacatcatcaaggagatgcccgtgtgcagacagaccggcaacacctgcaaggagctgagagaccccgtgaccagcggcctgaacaccagcgtggtgttcggcttcctgaacctggtgctgtgggtgggcaacctgtggttcgtgttcaaggagaccggctgggccgcccccttcctgagagccccccccggcgcccccgagaagcagcccgcccccggcgacgcctacggcgacgccggctacggccagggccccggcggctacggcccccaggacagctacggcccccagggcggctaccagcccgactacggccagcccgccggcagcggcggcagcggctacggcccccagggcgactacggccagcagggctacggcccccagggcgcccccaccagcttcagcaaccagatgtag

SEQ ID NO: 24961 - DNA, 1173 bp, Artificial Sequence
  Description of Artificial Sequence: Synthetic coding sequence
atggccgagcagctggccctggtgatcggcggcaccatcggcggcctgctgctgctgctgctgatcggcgccagctgctgcctgtggagaagattctgcgccaccctgacctacgaggagctgcccggcacccccgccatggccaccaccgccgccagcagcggccagagagacagaccctgccagccccacgccagaacccagctgagcagaccccccgccgtgcccttcgtggtgccccccaccctgcagggcagagactgggtgcccctgcacagcggcgagtgggccgacgccccctgggacccctgccccgccagcgagctgctgccccacaccagcagcggcggcctgggcgacgcctgcatggtgggcgccatcaaccccgagctgtacaagttccccgaggacaagagcgagaccgacttccccgacggctgcctgggcagactgtggttcagcgtggagtacgagcaggaggccgagagactgctggtgggcctgatcaaggcccagcacctgcaggcccccagcgagacctgcagccccctggtgaagctgtacctgctgcccgacgagagaagattcctgcagagcaagaccaagagaaagaccagcaacccccagttcgacgagcacttcatcttccaggtgagcagcaagaccatcacccagagagtgctgaagttcagcgtgtaccacgtggacagacagagaaagcaccagctgctgggccaggtgctgttccccctgaagaacgagaccctggtgggcgactgcagaagagtgatctggagagacctggaggccgagagcctggagccccccagcgagttcggcgacctgcagttctgcctgagctacaacgactacctgagcagactgaccgtggtggtgctgagagccaagggcctgagactgcaggaggacagaggcatcgtgagcgtgttcgtgaaggtgagcctgatgaaccacaacaagttcgtgaagtgcaagaagaccagcgccgtgctgggcagcatcaaccccgtgtacaacgagaccttcagcttcaaggccgacgccaccgagctggacaccgccagcctgagcctgaccgtggtgcagaacatggagggcgacaagcaggccaccaccgtggagctgttcctgttccacctgaccagcggctag

SEQ ID NO: 24962 - DNA, 1833 bp, Artificial Sequence
  Description of Artificial Sequence: Synthetic coding sequence
atggcccaggagatcgacctgagcgccctgaaggagctggagagagaggccatcctgcaggtgctgtacagagaccaggccgtgcagaacaccgaggaggagagaaccagaaagctgaagacccacctgcagcacctgagatggaagggcgccaagaacaccgactgggagcacaaggagaagtgctgcgccagatgccagcaggtgctgggcttcctgctgcacagaggcgccgtgtgcagaggctgcagccacagagtgtgcgcccagtgcagagtgttcctgagaggcacccacgcctggaagtgcaccgtgtgcttcgaggacagaaacgtgaagatcaagaccggcgagtggttctacgaggagagagccaagaagttccccaccggcggcaagcacgagaccgtgggcggccagctgctgcagagctaccagaagctgagcaagatcagcgtggtgccccccacccccccccccgtgagcgagagccagtgcagcagaagccccggcagactgcaggagttcggccagttcagaggcttcaacaagagcgtggagaacctgttcctgagcctggccacccacgtgaagaagctgagcaagagccagaacgacatgaccagcgagaagcacctgctggccaccggccccagacagtgcgtgggccagaccgagagaagaagccagagcgacaccgccgtgaacgtgaccaccagaaaggtgagcgcccccgacatcctgaagcccctgaaccaggaggaccccaagtgcagcaccaaccccatcctgaagcagcagaacctgcccagcagccccgcccccagcaccatcttcagcggcggcttcagacacggcagcctgatcagcatcgacagcacctgcaccgagatgggcaacttcgacaacgccaacgtgaccggcgagatcgagttcgccatccactactgcttcaagacccacagcctggagatctgcatcaaggcctgcaagaacctggcctacggcgaggagaagaagaagaagtgcaacccctacgtgaagacctacctgctgcccgacagaagcagccagggcaagagaaagaccggcgtgcagagaaacaccgtggaccccaccttccaggagaccctgaagtaccaggtggcccccgcccagctggtgaccagacagctgcaggtgagcgtgtggcacctgggcaccctggccagaagagtgttcctgggcgaggtgatcatccccctggccacctgggacttcgaggacagcaccacccagagcttcagatggcaccccctgagagccaaggccgagaagtacgaggacagcgtgccccagagcaacggcgagctgaccgtgagagccaagctggtgctgcccagcagacccagaaagctgcaggaggcccaggagggcaccgaccagcccagcctgcacggccagctgtgcctggtggtgctgggcgccaagaacctgcccgtgagacccgacggcaccctgaacagcttcgtgaagggctgcctgaccctgcccgaccagcagaagctgagactgaagagccccgtgctgagaaagcaggcctgcccccagtggaagcacagcttcgtgttcagcggcgtgacccccgcccagctgagacagagcagcctggagctgaccgtgtgggaccaggccctgttcggcatgaacgacagactgctgggcggcaccagactgggcagcaagggcgacaccgccgtgggcggcgacgcctgcagcctgagcaagctgcagtggcagaaggtgctgagcagccccaacctgtggaccgacatgaccctggtgctgcactag

SEQ ID NO: 24963 - DNA, 1629 bp, Artificial Sequence
  Description of Artificial Sequence: Synthetic coding sequence
atggcccaggagatcgacctgagcgccctgaaggagctggagagagaggccatcctgcaggtgctgtacagagaccaggccgtgcagaacaccgaggaggagagaaccagaaagctgaagacccacctgcagcacctgagatggaagggcgccaagaacaccgactgggagcacaaggagaagtgctgcgccagatgccagcaggtgctgggcttcctgctgcacagaggcgccgtgtgcagaggctgcagccacagagtgtgcgcccagtgcagagtgttcctgagaggcacccacgcctggaagtgcaccgtgtgcttcgaggacagaaacgtgaagatcaagaccggcgagtggttctacgaggagagagccaagaagttccccaccggcggcaagcacgagaccgtgggcggccagctgctgcagagctaccagaagctgagcaagatcagcgtggtgccccccacccccccccccgtgagcgagagccagtgcagcagaagccccggcagaaaggtgagcgcccccgacatcctgaagcccctgaaccaggaggaccccaagtgcagcaccaaccccatcctgaagcagcagaacctgcccagcagccccgcccccagcaccatcttcagcggcggcttcagacacggcagcctgatcagcatcgacagcacctgcaccgagatgggcaacttcgacaacgccaacgtgaccggcgagatcgagttcgccatccactactgcttcaagacccacagcctggagatctgcatcaaggcctgcaagaacctggcctacggcgaggagaagaagaagaagtgcaacccctacgtgaagacctacctgctgcccgacagaagcagccagggcaagagaaagaccggcgtgcagagaaacaccgtggaccccaccttccaggagaccctgaagtaccaggtggcccccgcccagctggtgaccagacagctgcaggtgagcgtgtggcacctgggcaccctggccagaagagtgttcctgggcgaggtgatcatccccctggccacctgggacttcgaggacagcaccacccagagcttcagatggcaccccctgagagccaaggccgagaagtacgaggacagcgtgccccagagcaacggcgagctgaccgtgagagccaagctggtgctgcccagcagacccagaaagctgcaggaggcccaggagggcaccgaccagcccagcctgcacggccagctgtgcctggtggtgctgggcgccaagaacctgcccgtgagacccgacggcaccctgaacagcttcgtgaagggctgcctgaccctgcccgaccagcagaagctgagactgaagagccccgtgctgagaaagcaggcctgcccccagtggaagcacagcttcgtgttcagcggcgtgacccccgcccagctgagacagagcagcctggagctgaccgtgtgggaccaggccctgttcggcatgaacgacagactgctgggcggcaccagactgggcagcaagggcgacaccgccgtgggcggcgacgcctgcagcctgagcaagctgcagtggcagaaggtgctgagcagccccaacctgtggaccgacatgaccctggtgctgcactag

SEQ ID NO: 24964 - DNA, 1011 bp, Artificial Sequence
  Description of Artificial Sequence: Synthetic coding sequence
atgagaaacgagcccagaaacttccagctggagggcagcctgatcagcatcgacagcacctgcaccgagatgggcaacttcgacaacgccaacgtgaccggcgagatcgagttcgccatccactactgcttcaagacccacagcctggagatctgcatcaaggcctgcaagaacctggcctacggcgaggagaagaagaagaagtgcaacccctacgtgaagacctacctgctgcccgacagaagcagccagggcaagagaaagaccggcgtgcagagaaacaccgtggaccccaccttccaggagaccctgaagtaccaggtggcccccgcccagctggtgaccagacagctgcaggtgagcgtgtggcacctgggcaccctggccagaagagtgttcctgggcgaggtgatcatccccctggccacctgggacttcgaggacagcaccacccagagcttcagatggcaccccctgagagccaaggccgagaagtacgaggacagcgtgccccagagcaacggcgagctgaccgtgagagccaagctggtgctgcccagcagacccagaaagctgcaggaggcccaggagggcaccgaccagcccagcctgcacggccagctgtgcctggtggtgctgggcgccaagaacctgcccgtgagacccgacggcaccctgaacagcttcgtgaagggctgcctgaccctgcccgaccagcagaagctgagactgaagagccccgtgctgagaaagcaggcctgcccccagtggaagcacagcttcgtgttcagcggcgtgacccccgcccagctgagacagagcagcctggagctgaccgtgtgggaccaggccctgttcggcatgaacgacagactgctgggcggcaccagactgggcagcaagggcgacaccgccgtgggcggcgacgcctgcagcctgagcaagctgcagtggcagaaggtgctgagcagccccaacctgtggaccgacatgaccctggtgctgcactag

SEQ ID NO: 24965 - DNA, 1704 bp, Artificial Sequence
  Description of Artificial Sequence: Synthetic coding sequence
atggcccaggagatcgacctgagcgccctgaaggagctggagagagaggccatcctgcaggtgctgtacagagaccaggccgtgcagaacaccgaggaggagagaaccagaaagctgaagacccacctgcagcacctgagatggaagggcgccaagaacaccgactgggagcacaaggagaagtgctgcgccagatgccagcaggtgctgggcttcctgctgcacagaggcgccgtgtgcagaggctgcagccacagagtgtgcgcccagtgcagagtgttcctgagaggcacccacgcctggaagtgcaccgtgtgcttcgaggacagaaacgtgaagatcaagaccggcgagtggttctacgaggagagagccaagaagttccccaccggcggcaagcacgagaccgtgggcggccagctgctgcagagctaccagaagctgagcaagatcagcgtggtgccccccacccccccccccgtgagcgagagccagtgcagcagaagccccggcagactgcaggagttcggccagttcagaggcttcaacaagagcgtggagaacctgttcctgagcctggccacccacgtgaagaagctgagcaagagccagaacgacatgaccagcgagaagcacctgctggccaccggccccagacagtgcgtgggccagaccgagagaagaagccagagcgacaccgccgtgaacgtgaccaccagaaaggtgagcgcccccgacatcctgaagcccctgaaccaggaggaccccaagtgcagcaccaaccccatcctgaagcagcagaacctgcccagcagccccgcccccagcaccatcttcagcggcggcttcagacacggcagcctgatcagcatcgacagcacctgcaccgagatgggcaacttcgacaacgccaacgtgaccggcgagatcgagttcgccatccactactgcttcaagacccacagcctggagatctgcatcaaggcctgcaagaacctggcctacggcgaggagaagaagaagaagtgcaacccctacgtgaagacctacctgctgcccgacagaagcagccagggcaagagaaagaccggcgtgcagagaaacaccgtggaccccaccttccaggagaccctgaagtaccaggtggcccccgcccagctggtgaccagacagctgcaggtgagcgtgtggcacctgggcaccctggccagaagagtgttcctgggcgaggtgatcatccccctggccacctgggacttcgaggacagcaccacccagagcttcagatggcaccccctgagagccaaggccgagaagtacgaggacagcgtgccccagagcaacggcgagctgaccgtgagagccaagctggtgctgcccagcagacccagaaagctgcaggaggcccaggagggcaccgaccagcccagcctgcacggccagctgtgcctggtggtgctgggcgccaagaacctgcccgtgagacccgacggcaccctgaacagcttcgtgaagggctgcctgaccctgcccgaccagcagaagctgagactgaagagccccgtgctgagaaagcaggcctgcccccagtggagacacagctgctggagaggctgcatgctgaccatcgaggcccccgtggccgagagccccttccagccccagagcatggacagacacgacagctgccccgccctgacctag

SEQ ID NO: 24966 - DNA, 2193 bp, Artificial Sequence
  Description of Artificial Sequence: Synthetic coding sequence
atgagcaagaacagcgagttcatcaacctgagcttcctgctggaccacgagaaggagatgatcctgggcgtgctgaagagagacgagtacctgaagaaggtggaggacaagagaatcagaaagctgaagaacgagctgctggaggccaagagaagaagcggcaagacccagcaggaggccagcagagtgtgcgtgcactgccacagaaacctgggcctgatcttcgacagaggcgacccctgccaggcctgcagcctgagagtgtgcagagagtgcagagtggccggccccaacggcagctggaagtgcaccgtgtgcgacaagatcgcccagctgagaatcatcaccggcgagtggttcttcgaggagaaggccaagagattcaagcaggtgaacgtgctgggcaccgacgtggtgagacagagcatcctgagaagaagccccggcgccgaggaggtgcagagccaggagcagaccagacaggacgccgagaagagcgacaccagccccgtggccggcaagaaggccagccacgacggccccaagagaaagggcttcctgctgagcaagttcagaagcgccaccagaggcgagatcatcacccccaagaccgacaccggcagaagctacagcctggacctggacggccagcacttcagaagcctgaagagcccccccggcagcgacagaggcagcaccggcagcagcgacctgaacgaccaggagcccggccccagaacccccaagagcagcagaagcaacggcgtgacccccggcacccagagcagccccgcccccagcaccagaaccgtgaccagcgtgatcagcagagagtacggcttcgagaacagcatggacctggccgccatcgagggcaccagccaggagctgaccaagagccacagaagaaacaccagcggcacccccagcatcgccgtgagcggcaccagcctgagcagcgaccagagcagaagcgagctggacctgagcgagagcttcaccgaggacagcgaggacaccgtgagcatcagaagcaagagcgtgcccggcgccctggacaaggacagcctggaggagaccgaggagagcatcgacgccctggtgagcagccagctgagcaccaacacccacagactggccagcggcctgagcaccaccagcctgaacagcatgatgagcgtgtacagcgagaccggcgactacggcaacgtgaaggtgagcggcgagatcctgctgcacatcagctactgctacaagaccggcggcctgtacatcttcgtgaagaactgcagaaacctggccatcggcgacgagaagaagcagagaaccgacgcctacgtgaagagctacctgctgcccgacaagagcagaaacaacaagagaaagaccaagatcagaaccggcaccaaccccgagttcaacgagaccctgaagtacaccatcagccacacccagctggagaccagaaccctgcagctgagcgtgtggcactacgacagattcggcagaaacagcttcctgggcgaggtggagatccccttcgacagctggaacttcgagaaccccaccgacgagtggttcgtgctgcagcccaaggtggagttcgcccccgacatcggcctgcagtacaagggcgagctgaccgtggtgctgagatacatcccccccgaggagaacctgatgctgccccccgagcagctgcagggcaacaagaccttcaagaagggcaagaagaaggagagccccgtgatcagcggcggcatcctggaggtgttcatcaaggaggccaagaacctgaccgccgtgaagagcggcggcaccagcgacagcttcgtgaagggctacctgctgcccgacgacagcaaggccaccaagcacaagaccctggtgatcaagaagagcgtgaacccccagtggaaccacaccttcatgttcagcggcatccacccccaggacatcaagaacgtgtgcctggagctgaccatctgggacaaggaggccttcagcagcaacatcttcctgggcggcgtgagactgaacagcggcagcggcgtgagccacggcaagaacgtggactggatggacagccagggcgaggagcagagactgtggcagaagatggccaacaaccccggcacccccttcgagggcgtgctgatgctgagaagcagcatgggcaagtgcagactgtag

SEQ ID NO: 24967 - DNA, 2193 bp, Artificial Sequence; identical to SEQ ID NO: 24966
  Description of Artificial Sequence: Synthetic coding sequence

SEQ ID NO: 24968 - DNA, 2259 bp, Artificial Sequence
  Description of Artificial Sequence: Synthetic coding sequence
atgagcaagaacagcgagttcatcaacctgagcttcctgctggaccacgagaaggagatgatcctgggcgtgctgaagagagacgagtacctgaagaaggtggaggacaagagaatcagaaagctgaagaacgagctgctggaggccaagagaagaagcggcaagacccagcaggaggccagcagagtgtgcgtgcactgccacagaaacctgggcctgatcttcgacagaggcgacccctgccaggcctgcagcctgagagtgtgcagagagtgcagagtggccggccccaacggcagctggaagtgcaccgtgtgcgacaagatcgcccagctgagaatcatcaccggcgagtggttcttcgaggagaaggccaagagattcaagcaggtgaacgtgctgggcaccgacgtggtgagacagagcatcctgagaagaagccccggcgccgaggaggtgcagagccaggagcagaccagacaggacgccgagaagagcgacaccagccccgtggccggcaagaaggccagccacgacggccccaagagaaagggcttcctgctgagcaagttcagaagcgccaccagaggcgagatcatcacccccaagaccgacaccggcagaagctacagcctggacctggacggccagcacttcagaagcctgaagagcccccccggcagcgacagaggcagcaccggcagcagcgacctgaacgaccaggagcccggccccagaacccccaagagcagcagaagcaacggcgtgacccccggcacccagagcagccccgcccccagcaccagaaccgtgaccagcgtgatcagcagagagtacggcttcgagaacagcatggacctggccgccatcgagggcaccagccaggagctgaccaagagccacagaagaaacaccagcggcacccccagcatcgccgtgagcggcaccagcctgagcagcgaccagagcagaagcgagctggacctgagcgagagcttcaccgaggacagcgaggacaccgtgagcatcagaagcaagagcgtgcccggcgccctggacaaggacagcctggaggagaccgaggagagcatcgacgccctggtgagcagccagctgagcaccaacacccacagactggccagcggcctgagcaccagcagccaggccggcagcgacagaaagtggacctacctgaacgtgcccgacgccgacagcgacaccaccagcctgaacagcatgatgagcgtgtacagcgagaccggcgactacggcaacgtgaaggtgagcggcgagatcctgctgcacatcagctactgctacaagaccggcggcctgtacatcttcgtgaagaactgcagaaacctggccatcggcgacgagaagaagcagagaaccgacgcctacgtgaagagctacctgctgcccgacaagagcagaaacaacaagagaaagaccaagatcagaaccggcaccaaccccgagttcaacgagaccctgaagtacaccatcagccacacccagctggagaccagaaccctgcagctgagcgtgtggcactacgacagattcggcagaaacagcttcctgggcgaggtggagatccccttcgacagctggaacttcgagaaccccaccgacgagtggttcgtgctgcagcccaaggtggagttcgcccccgacatcggcctgcagtacaagggcgagctgaccgtggtgctgagatacatcccccccgaggagaacctgatgctgccccccgagcagctgcagggcaacaagaccttcaagaagggcaagaagaaggagagccccgtgatcagcggcggcatcctggaggtgttcatcaaggaggccaagaacctgaccgccgtgaagagcggcggcaccagcgacagcttcgtgaagggctacctgctgcccgacgacagcaaggccaccaagcacaagaccctggtgatcaagaagagcgtgaacccccagtggaaccacaccttcatgttcagcggcatccacccccaggacatcaagaacgtgtgcctggagctgaccatctgggacaaggaggccttcagcagcaacatcttcctgggcggcgtgagactgaacagcggcagcggcgtgagccacggcaagaacgtggactggatggacagccagggcgaggagcagagactgtggcagaagatggccaacaaccccggcacccccttcgagggcgtgctgatgctgagaagcagcatgggcaagtgcagactgtag

SEQ ID NO: 24969 - DNA, 3762 bp, Artificial Sequence
  Description of Artificial Sequence: Synthetic coding sequence
atgctgagctggagactgcagaccggccccgagaaggccgagctgcaggagctgaacgccagactgtacgactacgtgtgcagagtgagagagctggagagagagaacctgctgctggaggaggagctgagaggcagaagaggcagagagggcctgtgggccgagggccaggccagatgcgccgaggaggccagaagcctgagacagcagctggacgagctgagctgggccaccgccctggccgagggcgagagagacgccctgagaagagagctgagagagctgcagagactggacgccgaggagagagccgccagaggcagactggacgccgagctgggcgcccagcagagagagctgcaggaggccctgggcgccagagccgccctggaggccctgctgggcagactgcaggccgagagaagaggcctggacgccgcccacgagagagacgtgagagagctgagagccagagccgccagcctgaccatgcacttcagagccagagccaccggccccgccgcccccccccccagactgagagaggtgcacgacagctacgccctgctggtggccgagagctggagagagaccgtgcagctgtacgaggacgaggtgagagagctggaggaggccctgagaagaggccaggagagcagactgcaggccgaggaggagaccagactgtgcgcccaggaggccgaggccctgagaagagaggccctgggcctggagcagctgagagccagactggaggacgccctgctgagaatgagagaggagtacggcatccaggccgaggagagacagagagtgatcgactgcctggaggacgagaaggccaccctgaccctggccatggccgactggctgagagactaccaggacctgctgcaggtgaagaccggcctgagcctggaggtggccacctacagagccctgctggagggcgagagcaaccccgagatcgtgatctgggccgagcacgtggagaacatgcccagcgagttcagaaacaagagctaccactacaccgacagcctgctgcagagagagaacgagagaaacctgttcagcagacagaaggcccccctggccagcttcaaccacagcagcgccctgtacagcaacctgagcggccacagaggcagccagaccggcaccagcatcggcggcgacgccagaagaggcttcctgggcagcggctacagcagcagcgccaccacccagcaggagaacagctacggcaaggccgtgagcagccagaccaacgtgagaaccttcagccccacctacggcctgctgagaaacaccgaggcccaggtgaagaccttccccgacagacccaaggccggcgacaccagagaggtgcccgtgtacatcggcgaggacagcaccatcgccagagagagctacagagacagaagagacaaggtggccgccggcgccagcgagagcaccagaagcaacgagagaaccgtgatcctgggcaagaagaccgaggtgaaggccaccagagagcaggagagaaacagacccgagaccatcagaaccaagcccgaggagaagatgttcgacagcaaggagaaggccagcgaggagagaaacctgagatgggaggagctgaccaagctggacaaggaggccagacagagagagagccagcagatgaaggagaaggccaaggagaaggacagccccaaggagaagagcgtgagagagagagaggtgcccatcagcctggaggtgagccaggacagaagagccgaggtgagccccaagggcctgcagacccccgtgaaggacgccggcggcggcaccggcagagaggccgaggccagagagctgagattcagactgggcaccagcgacgccaccggcagcctgcagggcgacagcatgaccgagaccgtggccgagaacatcgtgaccagcatcctgaagcagttcacccagagccccgagaccgaggccagcgccgacagcttccccgacaccaaggtgacctacgtggacagaaaggagctgcccggcgagagaaagaccaagaccgagatcgtggtggagagcaagctgaccgaggacgtggacgtgagcgacgaggccggcctggactacctgctgagcaaggacatcaaggaggtgggcctgaagggcaagagcgccgagcagatgatcggcgacatcatcaacctgggcctgaagggcagagagggcagagccaaggtggtgaacgtggagatcgtggaggagcccgtgagctacgtgagcggcgagaagcccgaggagttcagcgtgcccttcaaggtggaggaggtggaggacgtgagccccggcccctggggcctggtgaaggaggaggagggctacggcgagagcgacgtgaccttcagcgtgaaccagcacagaagaaccaagcagccccaggagaacaccacccacgtggaggaggtgaccgaggccggcgacagcgagggcgagcagagctacttcgtgagcacccccgacgagcaccccggcggccacgacagagacgacggcagcgtgtacggccagatccacatcgaggaggagagcaccatcagatacagctggcaggacgagatcgtgcagggcaccagaagaagaacccagaaggacggcgccgtgggcgagaaggtggtgaagcccctggacgtgcccgcccccagcctggagggcgacctgggcagcacccactggaaggagcaggccagaagcggcgagttccacgccgagcccaccgtgatcgagaaggagatcaagatcccccacgagttccacaccagcatgaagggcatcagcagcaaggagcccagacagcagctggtggaggtgatcggccagctggaggagaccctgcccgagagaatgagagaggagctgagcgccctgaccagagagggccagggcggccccggcagcgtgagcgtggacgtgaagaaggtgcagggcgccggcggcagcagcgtgaccctggtggccgaggtgaacgtgagccagaccgtggacgccgacagactggacctggaggagctgagcaaggacgaggccagcgagatggagaaggccgtggagagcgtggtgagagagagcctgagcagacagagaagccccgcccccggcagccccgacgaggagggcggcgccgaggcccccgccgccggcatcagattcagaagatgggccaccagagagctgtacatccccagcggcgagagcgaggtggccggcggcgccagccacagcagcggccagagaaccccccagggccccgtgagcgccaccgtggaggtgagcagccccaccggcttcgcccagagccaggtgctggaggacgtgagccaggccgccagacacatcaagctgggccccagcgaggtgtggagaaccgagagaatgagctacgagggccccaccgccgaggtggtggagatggacgtgagcaacgtggaggccatcagaagcagaacccaggaggccggcgccctgggcgtgagcgacagaggcagctggagagacgccgacagcagaaacgaccaggccgtgggcgtgagcttcaaggccagcgccggcgagggcgaccaggcccacagagagcagggcaaggagcaggccatgttcgacaagaaggtgcagctgcagagaatggtggaccagagaagcgtgatcagcgacgagaagaaggtggccctgctgtacctggacaacgaggaggaggagaacgacggccactggttctag

SEQ ID NO: 24970 - DNA, 3759 bp, Artificial Sequence
  Description of Artificial Sequence: Synthetic coding sequence
atgctgagctggagactgcagaccggccccgagaaggccgagctgcaggagctgaacgccagactgtacgactacgtgtgcagagtgagagagctggagagagagaacctgctgctggaggaggagctgagaggcagaagaggcagagagggcctgtgggccgagggccaggccagatgcgccgaggaggccagaagcctgagacagcagctggacgagctgagctgggccaccgccctggccgagggcgagagagacgccctgagaagagagctgagagagctgcagagactggacgccgaggagagagccgccagaggcagactggacgccgagctgggcgcccagcagagagagctgcaggaggccctgggcgccagagccgccctggaggccctgctgggcagactgcaggccgagagaagaggcctggacgccgcccacgagagagacgtgagagagctgagagccagagccgccagcctgaccatgcacttcagagccagagccaccggccccgccgcccccccccccagactgagagaggtgcacgacagctacgccctgctggtggccgagagctggagagagaccgtgcagctgtacgaggacgaggtgagagagctggaggaggccctgagaagaggccaggagagcagactgcaggccgaggaggagaccagactgtgcgcccaggaggccgccctgagaagagaggccctgggcctggagcagctgagagccagactggaggacgccctgctgagaatgagagaggagtacggcatccaggccgaggagagacagagagtgatcgactgcctggaggacgagaaggccaccctgaccctggccatggccgactggctgagagactaccaggacctgctgcaggtgaagaccggcctgagcctggaggtggccacctacagagccctgctggagggcgagagcaaccccgagatcgtgatctgggccgagcacgtggagaacatgcccagcgagttcagaaacaagagctaccactacaccgacagcctgctgcagagagagaacgagagaaacctgttcagcagacagaaggcccccctggccagcttcaaccacagcagcgccctgtacagcaacctgagcggccacagaggcagccagaccggcaccagcatcggcggcgacgccagaagaggcttcctgggcagcggctacagcagcagcgccaccacccagcaggagaacagctacggcaaggccgtgagcagccagaccaacgtgagaaccttcagccccacctacggcctgctgagaaacaccgaggcccaggtgaagaccttccccgacagacccaaggccggcgacaccagagaggtgcccgtgtacatcggcgaggacagcaccatcgccagagagagctacagagacagaagagacaaggtggccgccggcgccagcgagagcaccagaagcaacgagagaaccgtgatcctgggcaagaagaccgaggtgaaggccaccagagagcaggagagaaacagacccgagaccatcagaaccaagcccgaggagaagatgttcgacagcaaggagaaggccagcgaggagagaaacctgagatgggaggagctgaccaagctggacaaggaggccagacagagagagagccagcagatgaaggagaaggccaaggagaaggacagccccaaggagaagagcgtgagagagagagaggtgcccatcagcctggaggtgagccaggacagaagagccgaggtgagccccaagggcctgcagacccccgtgaaggacgccggcggcggcaccggcagagaggccgaggccagagagctgagattcagactgggcaccagcgacgccaccggcagcctgcagggcgacagcatgaccgagaccgtggccgagaacatcgtgaccagcatcctgaagcagttcacccagagccccgagaccgaggccagcgccgacagcttccccgacaccaaggtgacctacgtggacagaaaggagctgcccggcgagagaaagaccaagaccgagatcgtggtggagagcaagctgaccgaggacgtggacgtgagcgacgaggccggcctggactacctgctgagcaaggacatcaaggaggtgggcctgaagggcaagagcgccgagcagatgatcggcgacatcatcaacctgggcctgaagggcagagagggcagagccaaggtggtgaacgtggagatcgtggaggagcccgtgagctacgtgagcggcgagaagcccgaggagttcagcgtgcccttcaaggtggaggaggtggaggacgtgagccccggcccctggggcctggtgaaggaggaggagggctacggcgagagcgacgtgaccttcagcgtgaaccagcacagaagaaccaagcagccccaggagaacaccacccacgtggaggaggtgaccgaggccggcgacagcgagggcgagcagagctacttcgtgagcacccccgacgagcaccccggcggccacgacagagacgacggcagcgtgtacggccagatccacatcgaggaggagagcaccatcagatacagctggcaggacgagatcgtgcagggcaccagaagaagaacccagaaggacggcgccgtgggcgagaaggtggtgaagcccctggacgtgcccgcccccagcctggagggcgacctgggcagcacccactggaaggagcaggccagaagcggcgagttccacgccgagcccaccgtgatcgagaaggagatcaagatcccccacgagttccacaccagcatgaagggcatcagcagcaaggagcccagacagcagctggtggaggtgatcggccagctggaggagaccctgcccgagagaatgagagaggagctgagcgccctgaccagagagggccagggcggccccggcagcgtgagcgtggacgtgaagaaggtgcagggcgccggcggcagcagcgtgaccctggtggccgaggtgaacgtgagccagaccgtggacgccgacagactggacctggaggagctgagcaaggacgaggccagcgagatggagaaggccgtggagagcgtggtgagagagagcctgagcagacagagaagccccgcccccggcagccccgacgaggagggcggcgccgaggcccccgccgccggcatcagattcagaagatgggccaccagagagctgtacatccccagcggcgagagcgaggtggccggcggcgccagccacagcagcggccagagaaccccccagggccccgtgagcgccaccgtggaggtgagcagccccaccggcttcgcccagagccaggtgctggaggacgtgagccaggccgccagacacatcaagctgggccccagcgaggtgtggagaaccgagagaatgagctacgagggccccaccgccgaggtggtggagatggacgtgagcaacgtggaggccatcagaagcagaacccaggaggccggcgccctgggcgtgagcgacagaggcagctggagagacgccgacagcagaaacgaccaggccgtgggcgtgagcttcaaggccagcgccggcgagggcgaccaggcccacagagagcagggcaaggagcaggccatgttcgacaagaaggtgcagctgcagagaatggtggaccagagaagcgtgatcagcgacgagaagaaggtggccctgctgtacctggacaacgaggaggaggagaacgacggccactggttctag

SEQ ID NO: 24971 - DNA, 4695 bp, Artificial Sequence
  Description of Artificial Sequence: Synthetic coding sequence
atgctgagctggagactgcagaccggccccgagaaggccgagctgcaggagctgaacgccagactgtacgactacgtgtgcagagtgagagagctggagagagagaacctgctgctggaggaggagctgagaggcagaagaggcagagagggcctgtgggccgagggccaggccagatgcgccgaggaggccagaagcctgagacagcagctggacgagctgagctgggccaccgccctggccgagggcgagagagacgccctgagaagagagctgagagagctgcagagactggacgccgaggagagagccgccagaggcagactggacgccgagctgggcgcccagcagagagagctgcaggaggccctgggcgccagagccgccctggaggccctgctgggcagactgcaggccgagagaagaggcctggacgccgcccacgagagagacgtgagagagctgagagccagagccgccagcctgaccatgcacttcagagccagagccaccggccccgccgcccccccccccagactgagagaggtgcacgacagctacgccctgctggtggccgagagctggagagagaccgtgcagctgtacgaggacgaggtgagagagctggaggaggccctgagaagaggccaggagagcagactgcaggccgaggaggagaccagactgtgcgcccaggaggccgccctgagaagagaggccctgggcctggagcagctgagagccagactggaggacgccctgctgagaatgagagaggagtacggcatccaggccgaggagagacagagagtgatcgactgcctggaggacgagaaggccaccctgaccctggccatggccgactggctgagagactaccaggacctgctgcaggtgaagaccggcctgagcctggaggtggccacctacagagccctgctggagggcgagagcaaccccgagatcgtgatctgggccgagcacgtggagaacatgcccagcgagttcagaaacaagagctaccactacaccgacagcctgctgcagagagagaacgagagaaacctgttcagcagacagaaggcccccctggccagcttcaaccacagcagcgccctgtacagcaacctgagcggccacagaggcagccagaccggcaccagcatcggcggcgacgccagaagaggcttcctgggcagcggctacagcagcagcgccaccacccagcaggagaacagctacggcaaggccgtgagcagccagaccaacgtgagaaccttcagccccacctacggcctgctgagaaacaccgaggcccaggtgaagaccttccccgacagacccaaggccggcgacaccagagaggtgcccgtgtacatcggcgaggacagcaccatcgccagagagagctacagagacagaagagacaaggtggccgccggcgccagcgagagcaccagaagcaacgagagaaccgtgatcctgggcaagaagaccgaggtgaaggccaccagagagcaggagagaaacagacccgagaccatcagaaccaagcccgaggagaagatgttcgacagcaaggagaaggccagcgaggagagaaacctgagatgggaggagctgaccaagctggacaaggaggccagacagagagagagccagcagatgaaggagaaggccaaggagaaggacagccccaaggagaagagcgtgagagagagagaggtgcccatcagcctggaggtgagccaggacagaagagccgaggtgagccccaagggcctgcagacccccgtgaaggacgccggcggcggcaccggcagagaggccgaggccagagagctgagattcagactgggcaccagcgacgccaccggcagcctgcagggcgacagcatgaccgagaccgtggccgagaacatcgtgaccagcatcctgaagcagttcacccagagccccgagaccgaggccagcgccgacagcttccccgacaccaaggtgacctacgtggacagaaaggagctgcccggcgagagaaagaccaagaccgagatcgtggtggagagcaagctgaccgaggacgtggacgtgagcgacgaggccggcctggactacctgctgagcaaggacatcaaggaggtgggcctgaagggcaagagcgccgagcagatgatcggcgacatcatcaacctgggcctgaagggcagagagggcagagccaaggtggtgaacgtggagatcgtggaggagcccgtgagctacgtgagcggcgagaagcccgaggagttcagcgtgcccttcaaggtggaggaggtggaggacgtgagccccggcccctggggcctggtgaaggaggaggagggctacggcgagagcgacgtgaccttcagcgtgaaccagcacagaagaaccaagcagccccaggagaacaccacccacgtggaggaggtgaccgaggccggcgacagcgagggcgagcagagctacttcgtgagcacccccgacgagcaccccggcggccacgacagagacgacggcagcgtgtacggccagatccacatcgaggaggagagcaccatcagatacagctggcaggacgagatcgtgcagggcaccagaagaagaacccagaaggacggcgccgtgggcgagaaggtggtgaagcccctggacgtgcccgcccccagcctggagggcgacctgggcagcacccactggaaggagcaggccagaagcggcgagttccacgccgagcccaccgtgatcgagaaggagatcaagatcccccacgagttccacaccagcatgaagggcatcagcagcaaggagcccagacagcagctggtggaggtgatcggccagctggaggagaccctgcccgagagaatgagagaggagctgagcgccctgaccagagagggccagggcggccccggcagcgtgagcgtggacgtgaagaaggtgcagggcgccggcggcagcagcgtgaccctggtggccgaggtgaacgtgagccagaccgtggacgccgacagactggacctggaggagctgagcaaggacgaggccagcgagatggagaaggccgtggagagcgtggtgagagagagcctgagcagacagagaagccccgcccccggcagccccgacgaggagggcggcgccgaggcccccgccgccggcatcagattcagaagatgggccaccagagagctgtacatccccagcggcgagagcgaggtggccggcggcgccagccacagcagcggccagagaaccccccagggccccgtgagcgccaccgtggaggtgagcagccccaccggcttcgcccagagccaggtgctggaggacgtgagccaggccgccagacacatcaagctgggccccagcgaggtgtggagaaccgagagaatgagctacgagggccccaccgccgaggtggtggaggtgagcgccggcggcgacctgagccaggccgccagccccaccggcgccagcagaagcgtgagacacgtgaccctgggccccggccagagccccctgagcagagaggtgatcttcctgggccccgcccccgcctgccccgaggcctggggcagccccgagcccggccccgccgagagcagcgccgacatggacggcagcggcagacacagcaccttcggctgcagacagttccacgccgagaaggagatcatcttccagggccccatcagcgccgccggcaaggtgggcgactacttcgccaccgaggagagcgtgggcacccagaccagcgtgagacagctgcagctgggccccaaggagggcttcagcggccagatccagttcaccgcccccctgagcgacaaggtggagctgggcgtgatcggcgacagcgtgcacatggagggcctgcccggcagcagcaccagcatcagacacatcagcatcggcccccagagacaccagaccacccagcagatcgtgtaccacggcctggtgccccagctgggcgagagcggcgacagcgagagcaccgtgcacggcgagggcagcgccgacgtgcaccaggccacccacagccacaccagcggcagacagaccgtgatgaccgagaagagcaccttccagagcgtggtgagcgagagcccccaggaggacagcgccgaggacaccagcggcgccgagatgaccagcggcgtgagcagaagcttcagacacatcagactgggccccaccgagaccgagaccagcgagcacatcgccatcagaggccccgtgagcagaaccttcgtgctggccggcagcgccgacagccccgagctgggcaagctggccgacagcagcagaaccctgagacacatcgcccccggccccaaggagaccagcttcaccttccagatggacgtgagcaacgtggaggccatcagaagcagaacccaggaggccggcgccctgggcgtgagcgacagaggcagctggagagacgccgacagcagaaacgaccaggccgtgggcgtgagcttcaaggccagcgccggcgagggcgaccaggcccacagagagcagggcaaggagcaggccatgttcgacaagaaggtgcagctgcagagaatggtggaccagagaagcgtgatcagcgacgagaagaaggtggccctgctgtacctggacaacgaggaggaggagaacgacggccactggttctag

SEQ ID NO: 24972 - DNA, 567 bp, Artificial Sequence
  Description of Artificial Sequence: Synthetic coding sequence
atgaacggcgacgacgccttcgtgagaagacccagagtgggcagccagatccccgagaagatgcagaaggccttcgacgacatcgccaagtacttcagcgagaaggagtgggagaagatgaaggccagcgagaagatcatctacgtgtacatgaagagaaagtacgaggccatgaccaagctgggcttcaaggccaccctgccccccttcatgagaaacaagagagtggccgacttccagggcaacgacttcgacaacgaccccaacagaggcaaccaggtggagcacccccagatgaccttcggcagactgcagggcatcttccccaagatcacccccgagaagcccgccgaggagggcaacgacagcaagggcgtgcccgaggccagcggcccccagaacaacggcaagcagctgagacccagcggcaagctgaacaccagcgagaaggtgaacaagaccagcggccccaagagaggcaagcacgcctggacccacagagtgagagagagaaagcagctggtgatctacgaggagatcagcgacccccaggaggacgacgagtag

SEQ ID NO: 24973 - DNA, 885 bp, Artificial Sequence
  Description of Artificial Sequence: Synthetic coding sequence
atgaaggacagactgcaggagctgaagcagagaaccaaggagatcgagctgagcagagacagccacgtgagcaccaccgagaccgaggagcagggcgtgttcctgcagcaggccgtgatctacgagagagagcccgtggccgagagacacctgcacgagatccagaagctgcaggagagcatcaacaacctggccgacaacgtgcagaagttcggccagcagcagaagagcctggtggccagcatgagaagattcagcctgctgaagagagagagcaccatcaccaaggagatcaagatccaggccgagtacatcaacagaagcctgaacgacctggtgaaggaggtgaagaagagcgaggtggagaacggccccagcagcgtggtgaccagaatcctgaagagccagcacgccgccatgttcagacacttccagcagatcatgttcatctacaacgacaccatcgccgccaagcaggagaagtgcaagaccttcatcctgagacagctggaggtggccggcaaggagatgagcgaggaggacgtgaacgacatgctgcaccagggcaagtgggaggtgttcaacgagagcctgctgaccgagatcaacatcaccaaggcccagctgagcgagatcgagcagagacacaaggagctggtgaacctggagaaccagatcaaggacctgagagacctgttcatccagatcagcctgctggtggaggagcagggcgagagcatcaacaacatcgagatgaccgtgaacagcaccaaggagtacgtgaacaacaccaaggagaagttcggcctggccgtgaagtacaagaagagaaacccctgcagagtgctgtgctgctggtgctgcccctgctgcagcagcaagtag

SEQ ID NO: 24974 - DNA, 393 bp, Artificial Sequence
  Description of Artificial Sequence: Synthetic coding sequence
atggagaccgtggtgaccaccctgcccagagagggcggcgtgggccccagcagaaagatgctgctgctgctgctgctgctgggccccggcagcggcctgagcgccgtggtgagccagcaccccagcagagtgatctgcaagagcggcaccagcgtgaacatcgagtgcagaagcctggacttccaggccaccaccatgttctggtacagacagctgagaaagcagagcctgatgctgatggccaccagcaacgagggcagcgaggtgacctacgagcagggcgtgaagaaggacaagttccccatcaaccaccccaacctgaccttcagcgccctgaccgtgaccagcgcccaccccgaggacagcagcttctacatctgcagcgccagatag

SEQ ID NO: 24975 - DNA, 345 bp, Artificial Sequence
  Description of Artificial Sequence: Synthetic coding sequence
accggcaccagactgctgggctgggtggccctgtgcctgctggccgccggctgcttccacgccaaggtgacccagacccccggctacctggtgaagggcaagggcagaaagaccaagatgtactgcacccccaagaacggccacaccttcgtgtgctggtaccagcagaaccagaacaaggagttcatgttcctgatcagcttccagaacgagcaggtgctgcaggagatggagatgcacaagaagagattcagcagccagtgccccaagaaccccccctgcagcctggccatcctgagcagcgagcccggcgacaccgccctgtacctgtgcgccaccagctag

SEQ ID NO: 24976 - DNA, 339 bp, Artificial Sequence
  Description of Artificial Sequence: Synthetic coding sequence
atgaccatcagattcctgagacaggtggccttctacttcctggaggccggcctgaaggaggccgagatctaccagacccccagacacagagtgatcggcgccggcaagaagatcaccctggagtgcagccagaccatgggccacgacaagatgtactggagcagaagcagaaacggcatcaccccccacccccccttcctgtgggtgaacagcaccgagaagggcgacctgtgcagcgagagcaccgtgagcagaatcagaatcgagagattccccctgaccctggagagcgccagccccagccacaccagccagtacctgtgcgccagcagcgagtag

SEQ ID NO: 24977 - DNA, 525 bp, Artificial Sequence
  Description of Artificial Sequence: Synthetic coding sequence
atggccgacgccgccgccaccgccggcgccggcggcagcggcaccagaagcggcagcaagcagagcaccaaccccgccgacaactaccacctggccagaagaagaaccctgcaggtggtggtgagcagcctgctgaccgaggccggcttcgagagcgccgagaaggccagcgtggagaccctgaccgagatgctgcagagctacatcagcgagatcggcagaagcgccaagagctactgcgagcacaccgccagaacccagcccaccctgagcgacatcgtggtgaccctggtggagatgggcttcaacgtggacaccctgcccgcctacgccaagagaagccagagaatggtgatcaccgccccccccgtgaccaaccagcccgtgacccccaaggccctgaccgccggccagaacagaccccaccccccccacatccccagccacttccccgagttccccgacccccacacctacatcaagacccccgtgagcgacgaggccctgggcctgagagtggtgtag

SEQ ID NO: 24978 - DNA, 1017 bp, Artificial Sequence
  Description of Artificial Sequence: Synthetic coding sequence
atggccgacgccgccgccaccgccggcgccggcggcagcggcaccagaagcggcagcaagcagagcaccaaccccgccgacaactaccacctggccagaagaagaaccctgcaggtggtggtgagcagcctgctgaccgaggccggcttcgagagcgccgagaaggccagcgtggagaccctgaccgagatgctgcagagctacatcagcgagatcggcagaagcgccaagagctactgcgagcacaccgccagaacccagcccaccctgagcgacatcgtggtgaccctggtggagatgggcttcaacgtggacaccctgcccgcctacgccaagagaagccagagaatggtgatcaccgccccccccgtgaccaaccagcccgtgacccccaaggccctgaccgccggccagaacagaccccaccccccccacatccccagccacttccccgagttccccgacccccacacctacatcaagacccccacctacagagagcccgtgagcgactaccaggtgctgagagagaaggccgccagccagagaagagacgtggagagagccctgaccagattcatggccaagaccggcgagacccagagcctgttcaaggacgacgtgagcaccttccccctgatcgccgccagacccttcaccatcccctacctgaccgccctgctgcccagcgagctggagatgcagcagatggaggagaccgacagcagcgagcaggacgagcagaccgacaccgagaacctggccctgcacatcagcatgatcgagagcagaagcgtgacccaggccggcgtgcagtggcaggacctgggcagcctgcagccccccccccccggcttcaagagattcagcagcctgagcctgctgagcagctggaactacagaagaatcctggagcccagaagaagaacccccctgagctgcagcagaacccccccctgcagagtggccggcatgggcagaagaaccagcagcatcaccctgatctgcggcagatag

SEQ ID NO: 24979 - DNA, 936 bp, Artificial Sequence
  Description of Artificial Sequence: Synthetic coding sequence
atggccgacgccgccgccaccgccggcgccggcggcagcggcaccagaagcggcagcaagcagagcaccaaccccgccgacaactaccacctggccagaagaagaaccctgcaggtggtggtgagcagcctgctgaccgaggccggcttcgagagcgccgagaaggccagcgtggagaccctgaccgagatgctgcagagctacatcagcgagatcggcagaagcgccaagagctactgcgagcacaccgccagaacccagcccaccctgagcgacatcgtggtgaccctggtggagatgggcttcaacgtggacaccctgcccgcctacgccaagagaagccagagaatggtgatcaccgccccccccgtgaccaaccagcccgtgacccccaaggccctgaccgccggccagaacagaccccaccccccccacatccccagccacttccccgagttccccgacccccacacctacatcaagacccccacctacagagagcccgtgagcgactaccaggtgctgagagagaaggccgccagccagagaagagacgtggagagagccctgaccagattcatggccaagaccggcgagacccagagcctgttcaaggacgacgtgagcaccttccccctgatcgccgccagacccttcaccatcccctacctgaccgccctgctgcccagcgagctggagatgcagcagatggaggagaccgacagcagcgagcaggacgagcagaccgacaccgagaacctggccctgcacatcagcatggaggacagcggcgccgagaaggagaacaccagcgtgctgcagcagaaccccagcctgagcggcagcagaaacggcgaggagaacatcatcgacaacccctacctgagacccgtgaagaagcccaagatcagaagaaagaagcccgacaccttctag

SEQ ID NO: 24980 - DNA, 1017 bp, Artificial Sequence; identical to SEQ ID NO: 24978
  Description of Artificial Sequence: Synthetic coding sequence

SEQ ID NO: 24981 - DNA, 795 bp, Artificial Sequence
  Description of Artificial Sequence: Synthetic coding sequence
atggagagcggcaagaccgccagccccaagagcatgcccaaggacgcccagatgatggcccagatcctgaaggacatgggcatcaccgagtacgagcccagagtgatcaaccagatgctggagttcgccttcagatacgtgaccaccatcctggacgacgccaagatctacagcagccacgccaagaaggccaccgtggacgccgacgacgtgagactggccatccagtgcagagccgaccagagcttcaccagccccccccccagagacttcctgctggacatcgccagacagagaaaccagacccccctgcccctgatcaagccctacagcggccccagactgccccccgacagatactgcctgaccgcccccaactacagactgaagagcctgcagaagaaggccagcaccagcgccggcagaatcaccgtgcccagactgagcgtgggcagcgtgaccagcagacccagcacccccaccctgggcacccccaccccccagaccatgagcgtgagcaccaaggtgggcacccccatgagcctgaccggccagagattcaccgtgcagatgcccaccagccagagccccgccgtgaaggccagcatccccgccaccagcgccgtgcagaacgtgctgatcaaccccagcctgatcggcagcaagaacatcctgatcaccaccaacatgatgagcagccagaacaccgccaacgagagcagcaacgccctgaagagaaagagagaggacgacgacgacgacgacgacgacgacgacgactacgacaacctgtag

SEQ ID NO: 24982 - DNA, 1374 bp, Artificial Sequence
  Description of Artificial Sequence: Synthetic coding sequence
atggagttcctgctgggcaaccccttcagcacccccgtgggccagtgcctggagaaggccaccgacggcagcctgcagagcgaggactggaccctgaacatggagatctgcgacatcatcaacgagaccgaggagggccccaaggacgccatcagagccctgaagaagagactgaacggcaacagaaactacagagaggtgatgctggccctgaccgcctgggccgacgccttcagaagcagccccgacctgaccggcgtggtgcacatctacgaggagctgaagagaaagggcgtggagttccccatggccgacctggacgccctgagccccatccacaccccccagagaagcgtgcccgaggtggaccccgccgccaccatgcccagaagccagagccagcagagaaccagcgccggcagctacagcagccccccccccgccccctacagcgccccccaggcccccgccctgagcgtgaccggccccatcaccgccaacagcgagcagatcgccagactgagaagcgagctggacgtggtgagaggcaacaccaaggtgatgagcgagatgctgaccgagatggtgcccggccaggaggacagcagcgacctggagctgctgcaggagctgaacagaacctgcagagccatgcagcagagaatcgtggagctgatcagcagagtgagcaacgaggaggtgaccgaggagctgctgcacgtgaacgacgacctgaacaacgtgttcctgagatacgagagattcgagagatacagaagcggcagaagcgtgcagaacgccagcaacggcgtgctgaacgaggtgaccgaggacaacctgatcgacctgggccccggcagccccgccgtggtgagccccatggtgggcaacaccgccccccccagcagcctgagcagccagctggccggcctggacctgggcaccgagagcgtgagcggcaccctgagcagcctgcagcagtgcaaccccagagacggcttcgacatgttcgcccagaccagaggcaacagcctggccgagcagagaaagaccgtgacctacgaggacccccaggccgtgggcggcctggccagcgccctggacaacagaaagcagagcagcgagggcatccccgtggcccagcccagcgtgatggacgacatcgaggtgtggctgagaaccgacctgaagggcgacgacctggaggagggcgtgaccagcgaggagttcgacaagttcctggaggagagagccaaggccgccgagatggtgcccgacctgcccagcccccccatggaggcccccgcccccgccagcaaccccagcggcagaaagaagcccgagagaagcgaggacgccctgttcgccctgtag

SEQ ID NO: 24983 - DNA, 1524 bp, Artificial Sequence
  Description of Artificial Sequence: Synthetic coding sequence
atggagttcctgctgggcaaccccttcagcacccccgtgggccagtgcctggagaaggccaccgacggcagcctgcagagcgaggactggaccctgaacatggagatctgcgacatcatcaacgagaccgaggagggccccaaggacgccatcagagccctgaagaagagactgaacggcaacagaaactacagagaggtgatgctggccctgaccgtgctggagacctgcgtgaagaactgcggccacagattccacatcctggtggccaacagagacttcatcgacagcgtgctggtgaagatcatcagccccaagaacaacccccccaccatcgtgcaggacaaggtgctggccctgatccaggcctgggccgacgccttcagaagcagccccgacctgaccggcgtggtgcacatctacgaggagctgaagagaaagggcgtggagttccccatggccgacctggacgccctgagccccatccacaccccccagagaagcgtgcccgaggtggaccccgccgccaccatgcccagaagccagagccagcagagaaccagcgccggcagctacagcagccccccccccgccccctacagcgccccccaggcccccgccctgagcgtgaccggccccatcaccgccaacagcgagcagatcgccagactgagaagcgagctggacgtggtgagaggcaacaccaaggtgatgagcgagatgctgaccgagatggtgcccggccaggaggacagcagcgacctggagctgctgcaggagctgaacagaacctgcagagccatgcagcagagaatcgtggagctgatcagcagagtgagcaacgaggaggtgaccgaggagctgctgcacgtgaacgacgacctgaacaacgtgttcctgagatacgagagattcgagagatacagaagcggcagaagcgtgcagaacgccagcaacggcgtgctgaacgaggtgaccgaggacaacctgatcgacctgggccccggcagccccgccgtggtgagccccatggtgggcaacaccgccccccccagcagcctgagcagccagctggccggcctggacctgggcaccgagagcgtgagcggcaccctgagcagcctgcagcagtgcaaccccagagacggcttcgacatgttcgcccagaccagaggcaacagcctggccgagcagagaaagaccgtgacctacgaggacccccaggccgtgggcggcctggccagcgccctggacaacagaaagcagagcagcgagggcatccccgtggcccagcccagcgtgatggacgacatcgaggtgtggctgagaaccgacctgaagggcgacgacctggaggagggcgtgaccagcgaggagttcgacaagttcctggaggagagagccaaggccgccgagatggtgcccgacctgcccagcccccccatggaggcccccgcccccgccagcaaccccagcggcagaaagaagcccgagagaagcgaggacgccctgttcgccctgtag

SEQ ID NO: 24984 - DNA, 1389 bp, Artificial Sequence
  Description of Artificial Sequence: Synthetic coding sequence
atggagttcctgctgggcaaccccttcagcacccccgtgggccagtgcctggagaaggccaccgacggcagcctgcagagcgaggactggaccctgaacatggagatctgcgacatcatcaacgagaccgaggagggccccaaggacgccatcagagccctgaagaagagactgaacggcaacagaaactacagagaggtgatgctggccctgaccgtgctggagacctgcgtgaagaactgcggccacagattccacatcctggtggccaacagagacttcatcgacagcgtgctggtgaagatcatcagccccaagaacaacccccccaccatcgtgcaggacaaggtgctggccctgatccagagcgtgcccgaggtggaccccgccgccaccatgcccagaagccagagccagcagagaaccagcgccggcagctacagcagccccccccccgccccctacagcgccccccaggcccccgccctgagcgtgaccggccccatcaccgccaacagcgagcagatcgccagactgagaagcgagctggacgtggtgagaggcaacaccaaggtgatgagcgagatgctgaccgagatggtgcccggccaggaggacagcagcgacctggagctgctgcaggagctgaacagaacctgcagagccatgcagcagagaatcgtggagctgatcagcagagtgagcaacgaggaggtgaccgaggagctgctgcacgtgaacgacgacctgaacaacgtgttcctgagatacgagagattcgagagatacagaagcggcagaagcgtgcagaacgccagcaacggcgtgctgaacgaggtgaccgaggacaacctgatcgacctgggccccggcagccccgccgtggtgagccccatggtgggcaacaccgccccccccagcagcctgagcagccagctggccggcctggacctgggcaccgagagcgtgagcggcaccctgagcagcctgcagcagtgcaaccccagagacggcttcgacatgttcgcccagaccagaggcaacagcctggccgagcagagaaagaccgtgacctacgaggacccccaggccgtgggcggcctggccagcgccctggacaacagaaagcagagcagcgagggcatccccgtggcccagcccagcgtgatggacgacatcgaggtgtggctgagaaccgacctgaagggcgacgacctggaggagggcgtgaccagcgaggagttcgacaagttcctggaggagagagccaaggccgccgagatggtgcccgacctgcccagcccccccatggaggcccccgcccccgccagcaaccccagcggcagaaagaagcccgagagaagcgaggacgccctgttcgccctgtag

SEQ ID NO: 24985 - DNA, 1452 bp, Artificial Sequence
  Description of Artificial Sequence: Synthetic coding sequence
atggagttcctgctgggcaaccccttcagcacccccgtgggccagtgcctggagaaggccaccgacggcagcctgcagagcgaggactggaccctgaacatggagatctgcgacatcatcaacgagaccgaggagggccccaaggacgccatcagagccctgaagaagagactgaacggcaacagaaactacagagaggtgatgctggccctgaccgtgctggagacctgcgtgaagaactgcggccacagattccacatcctggtggccaacagagacttcatcgacagcgtgctggtgaagatcatcagccccaagaacaacccccccaccatcgtgcaggacaaggtgctggccctgatccaggcctgggccgacgccttcagaagcagccccgacctgaccggcgtggtgcacatctacgaggagctgaagagaaagggcgtggagttccccatggccgacctggacgccctgagccccatccacaccccccagagaatcgccagactgagaagcgagctggacgtggtgagaggcaacaccaaggtgatgagcgagatgctgaccgagatggtgcccggccaggaggacagcagcgacctggagctgctgcaggagctgaacagaacctgcagagccatgcagcagagaatcgtggagctgatcagcagagtgagcaacgaggaggtgaccgaggagctgctgcacgtgaacgacgacctgaacaacgtgttcctgagatacgagagattcgagagatacagaagcggcagaagcgtgcagaacgccagcaacggcgtgctgaacgaggtgaccgaggacaacctgatcgacctgggccccggcagccccgccgtggtgagccccatggtgggcaacaccgccccccccagcagcctgagcagccagctggccggcctggacctgggcaccgagagcgtgagcggcaccctgagcagcctgcagcagtgcaaccccagagacggcttcgacatgttcgcccagaccagaggcaacagcctggccgagcagagaaagaccgtgacctacgaggacccccaggccgtgggcggcctggccagcgccctggacaacagaaagcagagcagcgagggcaccttcctgagcagcgcccagaagagaggcagaggcggcgagagcgacctggagcccatcgacagctggctgatcacccagggcatgatccccgtggcccagcccagcgtgatggacgacatcgaggtgtggctgagaaccgacctgaagggcgacgacctggaggagggcgtgaccagcgaggagttcgacaagttcctggaggagagagccaaggccgccgagatggtgcccgacctgcccagcccccccatggaggcccccgcccccgccagcaaccccagcggcagaaagaagcccgagagaagcgaggacgccctgttcgccctgtag

SEQ ID NO: 24986 - DNA, 834 bp, Artificial Sequence
  Description of Artificial Sequence: Synthetic coding sequence
atggagttcctgctgggcaaccccttcagcacccccgtgggccagtgcctggagaaggccaccgacggcagcctgcagagcgaggactggaccctgaacatggagatctgcgacatcatcaacgagaccgaggagggccccaaggacgccatcagagccctgaagaagagactgaacggcaacagaaactacagagaggtgatgctggccctgaccgcctgggccgacgccttcagaagcagccccgacctgaccggcgtggtgcacatctacgaggagctgaagagaaagggcgtggagttccccatggccgacctggacgccctgagccccatccacaccccccagagaagcgtgcccgaggtggaccccgccgccaccatgcccagaagccagagccagcagagaaccagcgccggcagctacagcagccccccccccgccccctacagcgccccccaggcccccgccctgagcgtgaccggccccatcaccgccaacagcgagcagatcgccagactgagaagcgagctggacgtggtgagaggcaacaccaaggtgatgagcgagatgctgaccgagatggtgcccggccaggaggacagcagcgacctggagctgctgcaggagctgaacagaacctgcagagccatgcagcagagaatcgtggagctgatcagcagagtgagcaacgaggaggtgaccgaggagctgctgcacgtgaacgacgacctgaacaacgtgttcctgagatacgagagatgggagcccgacttcttcttcttcttcttcctggagaagatcgtggccatcaccgagggcttcctgagctag

SEQ ID NO: 24987 - DNA, 1170 bp, Artificial Sequence
  Description of Artificial Sequence: Synthetic coding sequence
atggagttcctgctgggcaaccccttcagcacccccgtgggccagtgcctggagaaggccaccgacggcagcctgcagagcgaggactggaccctgaacatggagatctgcgacatcatcaacgagaccgaggagggccccaaggacgccatcagagccctgaagaagagactgaacggcaacagaaactacagagaggtgatgctggccctgaccgtgctggagacctgcgtgaagaactgcggccacagattccacatcctggtggccaacagagacttcatcgacagcgtgctggtgaagatcatcagccccaagaacaacccccccaccatcgtgcaggacaaggtgctggccctgatccagatcgccagactgagaagcgagctggacgtggtgagaggcaacaccaaggtgatgagcgagatgctgaccgagatggtgcccggccaggaggacagcagcgacctggagctgctgcaggagctgaacagaacctgcagagccatgcagcagagaatcgtggagctgatcagcagagtgagcaacgaggaggtgaccgaggagctgctgcacgtgaacgacgacctgaacaacgtgttcctgagatacgagagattcgagagatacagaagcggcagaagcgtgcagaacgccagcaacggcgtgctgaacgaggtgaccgaggacaacctgatcgacctgggccccggcagccccgccgtggtgagccccatggtgggcaacaccgccccccccagcagcctgagcagccagctggccggcctggacctgggcaccgagagcgtgagcggcaccctgagcagcctgcagcagtgcaaccccagagacggcttcgacatgttcgcccagaccagaggcaacagcctggccgagcagagaaagaccgtgacctacgaggacccccaggccgtgggcggcctggccagcgccctggacaacagaaagcagagcagcgagggcaagggcgacgacctggaggagggcgtgaccagcgaggagttcgacaagttcctggaggagagagccaaggccgccgagatggtgcccgacctgcccagcccccccatggaggcccccgcccccgccagcaaccccagcggcagaaagaagcccgagagaagcgaggacgccctgttcgccctgtag

SEQ ID NO: 24988 - DNA, 1167 bp, Artificial Sequence
  Description of Artificial Sequence: Synthetic coding sequence
atggagttcctgctgggcaaccccttcagcacccccgtgggccagtgcctggagaaggccaccgacggcagcctgcagagcgaggactggaccctgaacatggagatctgcgacatcatcaacgagaccgaggagggccccaaggacgccatcagagccctgaagaagagactgaacggcaacagaaactacagagaggtgatgctggccctgaccatcgccagactgagaagcgagctggacgtggtgagaggcaacaccaaggtgatgagcgagatgctgaccgagatggtgcccggccaggaggacagcagcgacctggagctgctgcaggagctgaacagaacctgcagagccatgcagcagagaatcgtggagctgatcagcagagtgagcaacgaggaggtgaccgaggagctgctgcacgtgaacgacgacctgaacaacgtgttcctgagatacgagagattcgagagatacagaagcggcagaagcgtgcagaacgccagcaacggcgtgctgaacgaggtgaccgaggacaacctgatcgacctgggccccggcagccccgccgtggtgagccccatggtgggcaacaccgccccccccagcagcctgagcagccagctggccggcctggacctgggcaccgagagcgtgagcggcaccctgagcagcctgcagcagtgcaaccccagagacggcttcgacatgttcgcccagaccagaggcaacagcctggccgagcagagaaagaccgtgacctacgaggacccccaggccgtgggcggcctggccagcgccctggacaacagaaagcagagcagcgagggcaccttcctgagcagcgcccagaagagaggcagaggcggcgagagcgacctggagcccatcgacagctggctgatcacccagggcatgatccccgtggcccagcccagcgtgatggacgacatcgaggtgtggctgagaaccgacctgaagggcgacgacctggaggagggcgtgaccagcgaggagttcgacaagttcctggaggagagagccaaggccgccgagatggtgcccgacctgcccagcccccccatggaggcccccgcccccgccagcaaccccagcggcagaaagaagcccgagagaagcgaggacgccctgttcgccctgtag

SEQ ID NO: 24989 - DNA, 1374 bp, Artificial Sequence; identical to SEQ ID NO: 24982
  Description of Artificial Sequence: Synthetic coding sequence

SEQ ID NO: 24990 - DNA, 2571 bp, Artificial Sequence
  Description of Artificial Sequence: Synthetic coding sequence
tgatgcaccaacgaggccctggtggacgagatcatgatgaccctgaagcaggccttcaccgtggccgccgtgcagcagaccgccaaggcccccgcccagctgtgcgagggctgccccctgcagagcctgcacaagctgtgcgagagaatcgagggcatgaacagcagcaagaccaagctggagctgcagaagcacctgaccaccctgaccaaccaggagcaggccaccatcttcgaggaggtgcagaagctgagacccagaaacgagcagagagagaacgagctgatcatcagcttcctgagatgcctgtacgaggagaagcagaaggagcacatccacatcggcgagatgaagcagaccagccagatggccgccgagaacatcggcagcgagctgccccccagcgccaccagattcagactggacatgctgaagaacaaggccaagagaagcctgaccgagagcctggagagcatcctgagcagaggcaacaaggccagaggcctgcaggagcacagcatcagcgtggacctggacagcagcctgagcagcaccctgagcaacaccagcaaggagcccagcgtgtgcgagaaggaggccctgcccatcagcgagagcagcttcaagctgctgggcagcagcgaggacctgagcagcgacagcgagagccacctgcccgaggagcccgcccccctgagcccccagcaggccttcagaagaagagccaacaccctgagccacttccccatcgagtgccaggagcccccccagcccgccagaggcagccccggcgtgagccagagaaagctgatgagataccacagcgtgagcaccgagaccccccacgagagaaacatcagctacagaaacgccctgagaaagaagctgcacagcagcagcagcgtgcccaacttcctgaagttcctggcccccgtggacgagaacaacaccagcgacttcatgaacaccaagagagacttcgagagcaaggccaaccacctgggcgacagcggcggcacccccgtgaagaccagaagacacagctggagacagcagatcttcctgagagtggccaccccccagaaggcctgcgacagcagcagcagatacgaggactacagcgagctgggcgagctgccccccagaagccccctggagcccgtgtgcgaggacggccccttcggccccccccccgaggagaagaagagaaccagcagagagctgagagagctgtggcagaaggccatcctgcagcagatcctgctgctgagaatggagaaggagaaccagaagctgcaggccagcgagaacgacctgctgaacaagagactgaagctggactacgaggagatcaccccctgcctgaaggaggtgaccaccgtgtgggagaagatgctgagcacccccggcagaagcaagatcaagttcgacatggagaagatgcacagcgccgtgggccagggcgtgcccagacaccacagaggcgagatctggaagttcctggccgagcagttccacctgaagcaccagttccccagcaagcagcagcccaaggacgtgccctacaaggagctgctgaagcagctgaccagccagcagcacgccatcctgatcgacctgggcagaaccttccccacccacccctacttcagcgcccagctgggcgccggccagctgagcctgtacaacatcctgaaggcctacagcctgctggaccaggaggtgggctactgccagggcctgagcttcgtggccggcatcctgctgctgcacatgagcgaggaggaggccttcaagatgctgaagttcctgatgttcgacatgggcctgagaaagcagtacagacccgacatgatcatcctgcagatccagatgtaccagctgagcagactgctgcacgactaccacagagacctgtacaaccacctggaggagcacgagatcggccccagcctgtacgccgccccctggttcctgaccatgttcgccagccagttccccctgggcttcgtggccagagtgttcgacatgatcttcctgcagggcaccgaggtgatcttcaaggtggccctgagcctgctgggcagccacaagcccctgatcctgcagcacgagaacctggagaccatcgtggacttcatcaagagcaccctgcccaacctgggcctggtgcagatggagaagaccatcaaccaggtgttcgagatggacatcgccaagcagctgcaggcctacgaggtggagtaccacgtgctgcaggaggagctgatcgacagcagccccctgagcgacaaccagagaatggacaagctggagaagaccaacagcagcctgagaaagcagaacctggacctgctggagcagctgcaggtggccaacggcagaatccagagcctggaggccaccatcgagaagctgctgagcagcgagagcaagctgaagcaggccatgctgaccctggagctggagagaagcgccctgctgcagaccgtggaggagctgagaagaagaagcgccgagcccagcgacagagagcccgagtgcacccagcccgagcccaccggcgactag

SEQ ID NO: 24991 - DNA, 2682 bp, Artificial Sequence
  Description of Artificial Sequence: Synthetic coding sequence
atgttccccctgaaggacgccgagatgggcgccttcaccttcttcgccagcgccctgccccacgacgtgtgcggcagcaacggcctgcccctgacccccaacagcatcaagatcctgggcagattccagatcctgaagaccatcacccaccccagactgtgccagtacgtggacatcagcagaggcaagcacgagagactggtggtggtggccgagcactgcgagagaagcctggaggacctgctgagagagagaaagcccgtgagctgcagcaccgtgctgtgcatcgccttcgaggtgctgcagggcctgcagtacatgaacaagcacggcatcgtgcacagagccctgagcccccacaacatcctgctggacagaaagggccacatcaagctggccaagttcggcctgtaccacatgaccgcccacggcgacgacgtggacttccccatcggctaccccagctacctggcccccgaggtgatcgcccagggcatcttcaagaccaccgaccacatgcccagcaagaagcccctgcccagcggccccaagagcgacgtgtggagcctgggcatcatcctgttcgagctgtgcgtgggcagaaagctgttccagagcctggacatcagcgagagactgaagttcctgctgaccctggactgcgtggacgacaccctgatcgtgctggccgaggagcacggctgcctggacatcatcaaggagctgcccgagaccgtgatcgacctgctgaacaagtgcctgaccttccaccccagcaagagacccacccccgaccagctgatgaaggacaaggtgttcagcgaggtgagccccctgtacacccccttcaccaagcccgccagcctgttcagcagcagcctgagatgcgccgacctgaccctgcccgaggacatcagccagctgtgcaaggacatcaacaacgactacctggccgagagaagcatcgaggaggtgtactacctgtggtgcctggccggcggcgacctggagaaggagctggtgaacaaggagatcatcagaagcaagccccccatctgcaccctgcccaacttcctgttcgaggacggcgagagcttcggccagggcagagacagaagcagcctgctggacgacaccaccgtgaccctgagcctgtgccagctgagaaacagactgaaggacgtgggcggcgaggccttctaccccctgctggaggacgaccagagcaacctgccccacagcaacagcaacaacgagctgagcgccgccgccaccctgcccctgatcatcagagagaaggacaccgagtaccagctgaacagaatcatcctgttcgacagactgctgaaggcctacccctacaagaagaaccagatctggaaggaggccagagtggacatcccccccctgatgagaggcctgacctgggccgccctgctgggcgtggagggcgccatccacgccaagtacgacgccatcgacaaggacacccccatccccaccgacagacagatcgaggtggacatccccagatgccaccagtacgacgagctgctgagcagccccgagggccacgccaagttcagaagagtgctgaaggcctgggtggtgagccaccccgacctggtgtactggcagggcctggacagcctgtgcgcccccttcctgtacctgaacttcaacaacgaggccctggcctacgcctgcatgagcgccttcatccccaagtacctgtacaacttcttcctgaaggacaacagccacgtgatccaggagtacctgaccgtgttcagccagatgatcgccttccacgaccccgagctgagcaaccacctgaacgagatcggcttcatccccgacctgtacgccatcccctggttcctgaccatgttcacccacgtgttccccctgcacaagatcttccacctgtgggacaccctgctgctgggcaacagcagcttccccttctgcatcggcgtggccatcctgcagcagctgagagacagactgctggccaacggcttcaacgagtgcatcctgctgttcagcgacctgcccgagatcgacatcgagagatgcgtgagagagagcatcaacctgttctgctggacccccaagagcgccacctacagacagcacgcccagccccccaagcccagcagcgacagcagcggcggcagaagcagcgccccctacttcagcgccgagtgccccgacccccccaagaccgacctgagcagagagagcatccccctgaacgacctgaagagcgaggtgagccccagaatcagcgccgaggacctgatcgacctgtgcgagctgaccgtgaccggccacttcaagacccccagcaagaagaccaagagcagcaagcccaagctgctggtggtggacatcagaaacagcgaggacttcatcagaggccacatcagcggcagcatcaacatccccttcagcgccgccttcaccgccgagggcgagctgacccagggcccctacaccgccatgctgcagaacttcaagggcaaggtgatcgtgatcgtgggccacgtggccaagcacaccgccgagttcgccgcccacctggtgaagatgaagtaccccagaatctgcatcctggacggcggcatcaacaagatcaagcccaccggcctgctgaccatccccagcccccagatctag

SEQ ID NO: 24992 - DNA, 2493 bp, Artificial Sequence
  Description of Artificial Sequence: Synthetic coding sequence
atgttccccctgaaggacgccgagatgggcgccttcaccttcttcgccagcgccctgccccacgacgtgtgcggcagcaacggcctgcccctgacccccaacagcatcaagatcctgggcagattccagatcctgaagaccatcacccaccccagactgtgccagtacgtggacatcagcagaggcaagcacgagagactggtggtggtggccgagcactgcgagagaagcctggaggacctgctgagagagagaaagcccgtgagataccccagctacctggcccccgaggtgatcgcccagggcatcttcaagaccaccgaccacatgcccagcaagaagcccctgcccagcggccccaagagcgacgtgtggagcctgggcatcatcctgttcgagctgtgcgtgggcagaaagctgttccagagcctggacatcagcgagagactgaagttcctgctgaccctggactgcgtggacgacaccctgatcgtgctggccgaggagcacggctgcctggacatcatcaaggagctgcccgagaccgtgatcgacctgctgaacaagtgcctgaccttccaccccagcaagagacccacccccgaccagctgatgaaggacaaggtgttcagcgaggtgagccccctgtacacccccttcaccaagcccgccagcctgttcagcagcagcctgagatgcgccgacctgaccctgcccgaggacatcagccagctgtgcaaggacatcaacaacgactacctggccgagagaagcatcgaggaggtgtactacctgtggtgcctggccggcggcgacctggagaaggagctggtgaacaaggagatcatcagaagcaagccccccatctgcaccctgcccaacttcctgttcgaggacggcgagagcttcggccagggcagagacagaagcagcctgctggacgacaccaccgtgaccctgagcctgtgccagctgagaaacagactgaaggacgtgggcggcgaggccttctaccccctgctggaggacgaccagagcaacctgccccacagcaacagcaacaacgagctgagcgccgccgccaccctgcccctgatcatcagagagaaggacaccgagtaccagctgaacagaatcatcctgttcgacagactgctgaaggcctacccctacaagaagaaccagatctggaaggaggccagagtggacatcccccccctgatgagaggcctgacctgggccgccctgctgggcgtggagggcgccatccacgccaagtacgacgccatcgacaaggacacccccatccccaccgacagacagatcgaggtggacatccccagatgccaccagtacgacgagctgctgagcagccccgagggccacgccaagttcagaagagtgctgaaggcctgggtggtgagccaccccgacctggtgtactggcagggcctggacagcctgtgcgcccccttcctgtacctgaacttcaacaacgaggccctggcctacgcctgcatgagcgccttcatccccaagtacctgtacaacttcttcctgaaggacaacagccacgtgatccaggagtacctgaccgtgttcagccagatgatcgccttccacgaccccgagctgagcaaccacctgaacgagatcggcttcatccccgacctgtacgccatcccctggttcctgaccatgttcacccacgtgttccccctgcacaagatcttccacctgtgggacaccctgctgctgggcaacagcagcttccccttctgcatcggcgtggccatcctgcagcagctgagagacagactgctggccaacggcttcaacgagtgcatcctgctgttcagcgacctgcccgagatcgacatcgagagatgcgtgagagagagcatcaacctgttctgctggacccccaagagcgccacctacagacagcacgcccagccccccaagcccagcagcgacagcagcggcggcagaagcagcgccccctacttcagcgccgagtgccccgacccccccaagaccgacctgagcagagagagcatccccctgaacgacctgaagagcgaggtgagccccagaatcagcgccgaggacctgatcgacctgtgcgagctgaccgtgaccggccacttcaagacccccagcaagaagaccaagagcagcaagcccaagctgctggtggtggacatcagaaacagcgaggacttcatcagaggccacatcagcggcagcatcaacatccccttcagcgccgccttcaccgccgagggcgagctgacccagggcccctacaccgccatgctgcagaacttcaagggcaaggtgatcgtgatcgtgggccacgtggccaagcacaccgccgagttcgccgcccacctggtgaagatgaagtaccccagaatctgcatcctggacggcggcatcaacaagatcaagcccaccggcctgctgaccatccccagcccccagatctag

SEQ ID NO: 24993 - DNA, 2565 bp, Artificial Sequence
  Description of Artificial Sequence: Synthetic coding sequence
atgttccccctgaaggacgccgagatgggcgccttcaccttcttcgccagcgccctgccccacgacgtgtgcggcagcaacggcctgcccctgacccccaacagcatcaagatcctgggcagattccagatcctgaagaccatcacccaccccagactgtgccagtacgtggacatcagcagaggcaagcacgagagactggtggtggtggccgagcactgcgagagaagcctggaggacctgctgagagagagaaagcccgtgagctgcagcaccgtgctgtgcatcgccttcgaggtgctgcagggcctgcagtacatgaacaagcacggcatcgtgcacagagccctgagcccccacaacatcctgctggacagaaagggccacatcaagctggccaagttcggcctgtaccacatgaccgcccacggcgacgacgtggacttccccatcggctaccccagctacctggcccccgagggcagaaagctgttccagagcctggacatcagcgagagactgaagttcctgctgaccctggactgcgtggacgacaccctgatcgtgctggccgaggagcacggctgcctggacatcatcaaggagctgcccgagaccgtgatcgacctgctgaacaagtgcctgaccttccaccccagcaagagacccacccccgaccagctgatgaaggacaaggtgttcagcgaggtgagccccctgtacacccccttcaccaagcccgccagcctgttcagcagcagcctgagatgcgccgacctgaccctgcccgaggacatcagccagctgtgcaaggacatcaacaacgactacctggccgagagaagcatcgaggaggtgtactacctgtggtgcctggccggcggcgacctggagaaggagctggtgaacaaggagatcatcagaagcaagccccccatctgcaccctgcccaacttcctgttcgaggacggcgagagcttcggccagggcagagacagaagcagcctgctggacgacaccaccgtgaccctgagcctgtgccagctgagaaacagactgaaggacgtgggcggcgaggccttctaccccctgctggaggacgaccagagcaacctgccccacagcaacagcaacaacgagctgagcgccgccgccaccctgcccctgatcatcagagagaaggacaccgagtaccagctgaacagaatcatcctgttcgacagactgctgaaggcctacccctacaagaagaaccagatctggaaggaggccagagtggacatcccccccctgatgagaggcctgacctgggccgccctgctgggcgtggagggcgccatccacgccaagtacgacgccatcgacaaggacacccccatccccaccgacagacagatcgaggtggacatccccagatgccaccagtacgacgagctgctgagcagccccgagggccacgccaagttcagaagagtgctgaaggcctgggtggtgagccaccccgacctggtgtactggcagggcctggacagcctgtgcgcccccttcctgtacctgaacttcaacaacgaggccctggcctacgcctgcatgagcgccttcatccccaagtacctgtacaacttcttcctgaaggacaacagccacgtgatccaggagtacctgaccgtgttcagccagatgatcgccttccacgaccccgagctgagcaaccacctgaacgagatcggcttcatccccgacctgtacgccatcccctggttcctgaccatgttcacccacgtgttccccctgcacaagatcttccacctgtgggacaccctgctgctgggcaacagcagcttccccttctgcatcggcgtggccatcctgcagcagctgagagacagactgctggccaacggcttcaacgagtgcatcctgctgttcagcgacctgcccgagatcgacatcgagagatgcgtgagagagagcatcaacctgttctgctggacccccaagagcgccacctacagacagcacgcccagccccccaagcccagcagcgacagcagcggcggcagaagcagcgccccctacttcagcgccgagtgccccgacccccccaagaccgacctgagcagagagagcatccccctgaacgacctgaagagcgaggtgagccccagaatcagcgccgaggacctgatcgacctgtgcgagctgaccgtgaccggccacttcaagacccccagcaagaagaccaagagcagcaagcccaagctgctggtggtggacatcagaaacagcgaggacttcatcagaggccacatcagcggcagcatcaacatccccttcagcgccgccttcaccgccgagggcgagctgacccagggcccctacaccgccatgctgcagaacttcaagggcaaggtgatcgtgatcgtgggccacgtggccaagcacaccgccgagttcgccgcccacctggtgaagatgaagtaccccagaatctgcatcctggacggcggcatcaacaagatcaagcccaccggcctgctgaccatccccagcccccagatctag

SEQ ID NO: 24994 - DNA, 2682 bp, Artificial Sequence; identical to SEQ ID NO: 24991
  Description of Artificial Sequence: Synthetic coding sequence

SEQ ID NO: 24995 - DNA, 2682 bp, Artificial Sequence; identical to SEQ ID NO: 24991
  Description of Artificial Sequence: Synthetic coding sequence

SEQ ID NO: 24996 - DNA, 207 bp, Artificial Sequence
  Description of Artificial Sequence: Synthetic coding sequence
atgttccccctgaaggacgccgagatgggcgccttcaccttcttcgccagcgccctgccccacgacgtgtgcggcagcaacggcctgcccctgacccccaacagcatcaagatcctgggcagattccagatcctgaagaccatcacccaccccagactgtgccagtacgtggacatcagcagaggcaagcacgagagactggtgtag

SEQ ID NO: 24997 - DNA, 480 bp, Artificial Sequence
  Description of Artificial Sequence: Synthetic coding sequence
atgttccccctgaaggacgccgagatgggcgccttcaccttcttcgccagcgccctgccccacgacgtgtgcggcagcaacggcctgcccctgacccccaacagcatcaagatcctgggcagattccagatcctgaagaccatcacccaccccagactgtgccagtacgtggacatcagcagaggcaagcacgagagactggtggtggtggccgagcactgcgagagaagcctggaggacctgctgagagagagaaagcccgtgagctgcagcaccgtgctgtgcatcgccttcgaggtgctgcagggcctgcagtacatgaacaagcacggcatcgtgcacagagccctgagcccccacaacatcctgctggacagaaagggccacatcaagctggccaagttcggcctgtaccacatgaccgcccacggcgacgacgtggacttccccatcggctaccccagctacctggccccctag

SEQ ID NO: 24998 - DNA, 318 bp, Artificial Sequence
  Description of Artificial Sequence: Synthetic coding sequence
atgttccccctgaaggacgccgagatgggcgccttcaccttcttcgccagcgccctgccccacgacgtgtgcggcagcaacggcctgcccctgacccccaacagcatcaagatcctgggcagattccagatcctgaagaccatcacccaccccagactgtgccagtacgtggacatcagcagaggcaagcacgagagactggtggtggtggccgagcactgcgagagaagcctggaggacctgctgagagagagaaagcccgtgagctgcagcaccgtgctgtgcatcgccttcgaggtgctgcagggcctgcagtag

SEQ ID NO: 24999 - DNA, 753 bp, Artificial Sequence
  Description of Artificial Sequence: Synthetic coding sequence
atggagatggacggcgacccctacaacctgcccgcccagggccagggcaacatcatcatcaccaagtacgagcagggccacagagccggcgccgccgtggacctgggccacgagcaggtggacgtgagaaagtacaccaacaacctgggcatcgtgcacgagatggagctgccccacgtgagcgccctggaggtgaagcagagaagaaaggagagcaagagaaccaacaagtggcagaagatgctggccgactggaccaagtacagaagcaccaagaagctgagccagagagtgtacaaggtgatccccctggccgtgagaggcagagcctggagcctgctgctggacatcgacagaatcaagagccagaaccccggcaagtacaaggtgatgaaggagaagggcaagagaagcagcagaatcatccactgcatccagctggacgtgagccacaccctgcagaagcacatgatgttcatccagagattcggcgtgaagcagcaggagctgtgcgacatcctggtggcctacagcgcctacaaccccgaggtgggctaccacagagacctgagcagaatcaccgccatcctgctgctgtgcctgcccgaggaggacgccttctgggccctgacccagctgctggccggcgagagacacagcctgtggtacagcaccgcccagatcctgcccggcagcagaggcagctacagaaccagaagcagatgctgcaccagccccagccagagaagctag

SEQ ID NO: 25000 - DNA, 453 bp, Artificial Sequence
  Description of Artificial Sequence: Synthetic coding sequence
atgggccacctggacaaggagggcctgtgcacccagggcagcagcttcagctggctgctgagagtgctgaacgacggcatcagcctgggcctgaccccctgcctgtgggacatgtacctgctggagggcgagcagatgctgatgctgatcaccagcatcgccttcaaggtgcagagaagcctgtacgaggagaccaacaaggagacctggggccccgccacccccagagccctgaagggcaccggcagagccagacccatctgcgagagcctgcacagcagcctgcaggccctgaccgccagcgagagcagcagaggccccagcctgctgcagaccccccccagagtgcccggccagcaggccctgagcagaggcgacaagggcatcagcgtgagcctgagcctgcccagcctgcccagcagaagaggcagatgcggcagaatcatcggctag

SEQ ID NO: 25001 - DNA, 2286 bp, Artificial Sequence
  Description of Artificial Sequence: Synthetic coding sequence
atgagacaggacaagctgaccggcagcctgagaagaggcggcagatgcctgaagagacagggcggcggcgtgggcaccatcctgagcaacgtgctgaagaagagaagctgcatcagcagaaccgcccccagactgctgtgcaccctggagcccggcgtggacaccaagctgaagttcaccctggagcccagcctgggccagaacggcttccagcagtggtacgacgccctgaaggccgtggccagactgagcaccggcatccccaaggagtggagaagaaaggtgtggctgaccctggccgaccactacctgcacagcatcgccatcgactgggacaagaccatgagattcaccttcaacgagagaagcaaccccgacgacgacagcatgggcatccagatcgtgaaggacctgcacagaaccggctgcagcagctactgcggccaggaggccgagcaggacagagtggtgctgaagagagtgctgctggcctacgccagatggaacaagaccgtgggctactgccagggcttcaacatcctggccgccctgatcctggaggtgatggagggcaacgagggcgacgccctgaagatcatgatctacctgatcgacaaggtgctgcccgagagctacttcgtgaacaacctgagagccctgagcgtggacatggccgtgttcagagacctgctgagaatgaagctgcccgagctgagccagcacctggacaccctgcagagaaccgccaacaaggagagcggcggcggctacgagccccccctgaccaacgtgttcaccatgcagtggttcctgaccctgttcgccacctgcctgcccaaccagaccgtgctgaagatctgggacagcgtgttcttcgagggcagcgagatcatcctgagagtgagcctggccatctgggccaagctgggcgagcagatcgagtgctgcgagaccgccgacgagttctacagcaccatgggcagactgacccaggagatgctggagaacgacctgctgcagagccacgagctgatgcagaccgtgtacagcatggcccccttccccttcccccagctggccgagctgagagagaagtacacctacaacatcacccccttccccgccaccgtgaagcccaccagcgtgagcggcagacacagcaaggccagagacagcgacgaggagaacgaccccgacgacgaggacgccgtggtgaacgccgtgggctgcctgggccccttcagcggcttcctggcccccgagctgcagaagtaccagaagcagatcaaggagcccaacgaggagcagagcctgagaagcaacaacatcgccgagctgagccccggcgccatcaacagctgcagaagcgagtaccacgccgccttcaacagcatgatgatggagagaatgaccaccgacatcaacgccctgaagagacagtacagcagaatcaagaagaagcagcagcagcaggtgcaccaggtgtacatcagagccgacaagggccccgtgaccagcatcctgcccagccaggtgaacagcagccccgtgatcaaccacctgctgctgggcaagaagatgaagatgaccaacagagccgccaagaacgccgtgatccacatccccggccacaccggcggcaagatcagccccgtgccctacgaggacctgaagaccaagctgaacagcccctggagaacccacatcagagtgcacaagaagaacatgcccagaaccaagagccaccccggctgcggcgacaccgtgggcctgatcgacgagcagaacgaggccagcaagaccaacggcctgggcgccgccgaggccttccccagcggctgcaccgccaccgccggcagagagggcagcagccccgagggcagcaccagaagaaccatcgagggccagagccccgagcccgtgttcggcgacgccgacgtggacgtgagcgccgtgcaggccaagctgggcgccctggagctgaaccagagagacgccgccgccgagaccgagctgagagtgcaccccccctgccagagacactgccccgagccccccagcgcccccgaggagaacaaggccaccagcaaggccccccagggcagcaacagcaagacccccatcttcagccccttccccagcgtgaagcccctgagaaagagcgccaccgccagaaacctgggcctgtacggccccaccgagagaacccccaccgtgcacttcccccagatgagcagaagcttcagcaagcccggcggcggcaacagcggcaccaagaagagatag

SEQ ID NO: 25002 - DNA, 2454 bp, Artificial Sequence
  Description of Artificial Sequence: Synthetic coding sequence
atgtaccacagcctgagcgagaccagacaccccctgcagcccgaggagcaggaggtgggcatcgaccccctgagcagctacagcaacaagagcggcggcgacagcaacaagaacggcagaagaaccagcagcaccctggacagcgagggcaccttcaacagctacagaaaggagtgggaggagctgttcgtgaacaacaactacctggccaccatcagacagaagggcatcaacggccagctgagaagcagcagattcagaagcatctgctggaagctgttcctgtgcgtgctgccccaggacaagagccagtggatcagcagaatcgaggagctgagagcctggtacagcaacatcaaggagatccacatcaccaaccccagaaaggtggtgggccagcaggacctgatgatcaacaaccccctgagccaggacgagggcagcctgtggaacaagttcttccaggacaaggagctgagaagcatgatcgagcaggacgtgaagagaaccttccccgagatgcagttcttccagcaggagaacgtgagaaagatcctgaccgacgtgctgttctgctacgccagagagaacgagcagctgctgtacaagcagggcatgcacgagctgctggcccccatcgtgttcgtgctgcactgcgaccaccaggccttcctgcacgccagcgagagcgcccagcccagcgaggagatgaagaccgtgctgaaccccgagtacctggagcacgacgcctacgccgtgttcagccagctgatggagaccgccgagccctggttcagcaccttcgagcacgacggccagaagggcaaggagaccctgatgacccccatccccttcgccagaccccaggacctgggccccaccatcgccatcgtgaccaaggtgaaccagatccaggaccacctgctgaagaagcacgacatcgagctgtacatgcacctgaacagactggagatcgccccccagatctacggcctgagatgggtgagactgctgttcggcagagagttccccctgcaggacctgctggtggtgtgggacgccctgttcgccgacggcctgagcctgggcctggtggactacatcttcgtggccatgctgctgtacatcagagacgccctgatcagcagcaactaccagacctgcctgggcctgctgatgcactaccccttcatcggcgacgtgcacagcctgatcctgaaggccctgttcctgagagaccccaagagaaaccccagacccgtgacctaccagttccaccccaacctggactactacaaggccagaggcgccgacctgatgaacaagagcagaaccaacgccaagggcgcccccctgaacatcaacaaggtgagcaacagcctgatcaacttcggcagaaagctgatcagccccgccatggcccccggcagcgccggcggccccgtgcccggcggcaacagcagcagcagcagcagcgtggtgatccccaccagaaccagcgccgaggcccccagccaccacctgcagcagcagcagcagcagcagagactgatgaagagcgagagcatgcccgtgcagctgaacaagggcgacgtggtgaccggcagcgacgcccaggtgagcgtgcccgtgcagaccctgaccgacctgcagggcctgagcagcaagaacatcagcagcagccccagcgtggagagcctgcccggcggcagagagttcaccggcagcccccccagcagcgccaccaagaaggacagcttcttcagcaacatcagcagaagcagaagccacagcaagaccatgggcagaaaggagagcgaggaggagctggaggcccagatcagcttcctgcagggccagctgaacgacctggacgccatgtgcaagtactgcgccaaggtgatggacacccacctggtgaacatccaggacgtgatcctgcaggagaacctggagaaggaggaccagatcctggtgagcctggccggcctgaagcagatcaaggacatcctgaagggcagcctgagattcaaccagagccagctggaggccgaggagaacgagcagatcaccatcgccgacaaccactactgcagcagcggccagggccagggcagaggccagggccagagcgtgcagatgagcggcgccatcaagcaggccagcagcgagacccccggctgcaccgacagaggcaacagcgacgacttcatcctgatcagcaaggacgacgacggcagcagcgccagaggcagcttcagcggccaggcccagcccctgagaaccctgagaagcaccagcggcaagagccaggcccccgtgtgcagccccctggtgttcagcgaccccctgatgggccccgccagcgccagcagcagcaaccccagcagcagccccgacgacgacagcagcaaggacagcggcttcaccatcgtgagccccctggacatctag

SEQ ID NO: 25003 - DNA, 624 bp, Artificial Sequence
  Description of Artificial Sequence: Synthetic coding sequence
atgctggccctgagatgcggcagcagatggctgggcctgctgagcgtgcccagaagcgtgcccctgagactgcccgccgccagagcctgcagcaagggcagcggcgaccccagcagcagcagcagcagcggcaaccccctggtgtacctggacgtggacgccaacggcaagcccctgggcagagtggtgctggagctgaaggccgacgtggtgcccaagaccgccgagaacttcagagccctgtgcaccggcgagaagggcttcggctacaagggcagcaccttccacagagtgatccccagcttcatgtgccaggccggcgacttcaccaaccacaacggcaccggcggcaagagcatctacggcagcagattccccgacgagaacttcaccctgaagcacgtgggccccggcgtgctgagcatggccaacgccggccccaacaccaacggcagccagttcttcatctgcaccatcaagaccgactggctggacggcaagcacgtggtgttcggccacgtgaaggagggcatggacgtggtgaagaagatcgagagcttcggcagcaagagcggcagaaccagcaagaagatcgtgatcaccgactgcggccagctgagctag

SEQ ID NO: 25004 - DNA, 444 bp, Artificial Sequence
  Description of Artificial Sequence: Synthetic coding sequence
atgggcttcatcttcagcaagagcatgaacgagagcatgaagaaccagaaggagttcatgctgatgaacgccagactgcagctggagagacagctgatcatgcagagcgagatgagagagagacagatggccatgcagatcgcctggagcagagagttcctgaagtacttcggcaccttcttcggcctggccgccatcagcctgaccgccggcgccatcaagaagaagaagcccgccttcctggtgcccatcgtgcccctgagcttcatcctgacctaccagtacgacctgggctacggcaccctgctggagagaatgaagggcgaggccgaggacatcctggagaccgagaagagcaagctgcagctgcccagaggcatgatcaccttcgagagcatcgagaaggccagaaaggagcagagcagattcttcatcgacaagtag

SEQ ID NO: 25005 - DNA, 1203 bp, Artificial Sequence
  Description of Artificial Sequence: Synthetic coding sequence
atgagcagcctgcacaagagcagaatcgccgacttccaggacgtgctgaaggagcccagcatcgccctggagaagctgagagagctgagcttcagcggcatcccctgcgagggcggcctgagatgcctgtgctggaagatcctgctgaactacctgcccctggagagagccagctggaccagcatcctggccaagcagagagagctgtacgcccagttcctgagagagatgatcatccagcccggcatcgccaaggccaacatgggcgtgagcagagaggacgtgaccttcgaggaccaccccctgaaccccaaccccgacagcagatggaacacctacttcaaggacaacgaggtgctgctgcagatcgacaaggacgtgagaagactgtgccccgacatcagcttcttccagagagccaccgactacccctgcctgctgatcctggacccccagaacgagttcgagaccctgagaaagagagtggagcagaccaccctgaagagccagaccgtggccagaaacagaagcggcgtgaccaacatgagcagcccccacaagaacagcgtgcccagcagcctgaacgagtacgaggtgctgcccaacggctgcgaggcccactgggaggtggtggagagaatcctgttcatctacgccaagctgaaccccggcatcgcctacgtgcagggcatgaacgagatcgtgggccccctgtactacaccttcgccaccgaccccaacagcgagtggaaggagcacgccgaggccgacaccttcttctgcttcaccaacctgatggccgagatcagagacaacttcatcaagagcctggacgacagccagtgcggcatcacctacaagatggagaaggtgtacagcaccctgaaggacaaggacgtggagctgtacctgaagctgcaggagcagaacatcaagccccagttcttcgccttcagatggctgaccctgctgctgagccaggagttcctgctgcccgacgtgatcagaatctgggacagcctgttcgccgacgacaacagattcgacttcctgctgctggtgtgctgcgccatgctgatgctgatcagagagcagctgctggagggcgacttcaccgtgaacatgagactgctgcaggactaccccatcaccgacgtgtgccagatcctgcagaaggccaaggagctgcaggacagcaagtag

SEQ ID NO: 25006 - DNA, 660 bp, Artificial Sequence
  Description of Artificial Sequence: Synthetic coding sequence
atgagcagcccccacaagaacagcgtgcccagcagcctgaacgagtacgaggtgctgcccaacggctgcgaggcccactgggaggtggtggagagaatcctgttcatctacgccaagctgaaccccggcatcgcctacgtgcagggcatgaacgagatcgtgggccccctgtactacaccttcgccaccgaccccaacagcgagtggaaggagcacgccgaggccgacaccttcttctgcttcaccaacctgatggccgagatcagagacaacttcatcaagagcctggacgacagccagtgcggcatcacctacaagatggagaaggtgtacagcaccctgaaggacaaggacgtggagctgtacctgaagctgcaggagcagaacatcaagccccagttcttcgccttcagatggctgaccctgctgctgagccaggagttcctgctgcccgacgtgatcagaatctgggacagcctgttcgccgacgacaacagattcgacttcctgctgctggtgtgctgcgccatgctgatgctgatcagagagcagctgctggagggcgacttcaccgtgaacatgagactgctgcaggactaccccatcaccgacgtgtgccagatcctgcagaaggccaaggagctgcaggacagcaagtag

SEQ ID NO: 25007 - DNA, 2082 bp, Artificial Sequence
  Description of Artificial Sequence: Synthetic coding sequence
atgaccgacggcaagctgagcaccagcaccaacggcgtggccttcatgggcatcctggacggcagacccggcaaccccctgcagaacctgcagcacgtgaacctgaaggcccccagactgctgagcgcccccgagtacggccccaagctgaagctgagagccctggaggacagacacagcctgcagagcgtggacagcggcatccccaccctggagatcggcaaccccgagcccgtgccctgcagcgccgtgcacgtgagaagaaagcagagcgacagcgacctgatccccgagagagccttccagagcgcctgcgccctgcccagctgcgccccccccgcccccagcagcaccgagagagagcagagcgtgagaaagagcagcaccttccccagaaccggctacgacagcgtgaagctgtacagccccaccagcaaggccctgaccagaagcgacgacgtgagcgtgtgcagcgtgagcagcctgggcaccgagctgagcaccaccctgagcgtgagcaacgaggacatcctggacctggtggtgaccagcagcagcagcgccatcgtgaccctggagaacgacgacgacccccagttcaccaacgtgaccctgagcagcatcaaggagaccagaggcctgcaccagcaggactgcgtgcacgaggccgaggagggcagcaagctgaagatcctgggccccttcagcaacttcttcgccagaaacctgctggccagaaagcagagcgccagactggacaagcacaacgacctgggctggaagctgttcggcaaggcccccctgagagagaacgcccagaaggacagcaagagaatccagaaggagtacgaggacaaggccggcagacccagcaagccccccagccccaagcagaacgtgagaaagaacctggacttcgagcccctgagcaccaccgccctgatcctggaggacagacccgccaacctgcccgccaagcccgccgaggaggcccagaagcacagacagcagtacgaggagatggtggtgcaggccaagaagagagagctgaaggaggcccagagaagaaagaagcagctggaggagagatgcagagtggaggagagcatcggcaacgccgtgctgacctggaacaacgagatcctgcccaactgggagaccatgtggtgcagcagaaaggtgagagacctgtggtggcagggcatcccccccagcgtgagaggcaaggtgtggagcctggccatcggcaacgagctgaacatcacccacgagctgttcgacatctgcctggccagagccaaggagagatggagaagcctgagcaccggcggcagcgaggtggagaacgaggacgccggcttcagcgccgccgacagagaggccagcctggagctgatcaagctggacatcagcagaaccttccccaacctgtgcatcttccagcagggcggcccctaccacgacatgctgcacagcatcctgggcgcctacacctgctacagacccgacgtgggctacgtgcagggcatgagcttcatcgccgccgtgctgatcctgaacctggacaccgccgacgccttcatcgccttcagcaacctgctgaacaagccctgccagatggccttcttcagagtggaccacggcctgatgctgacctacttcgccgccttcgaggtgttcttcgaggagaacctgcccaagctgttcgcccacttcaagaagaacaacctgacccccgacatctacctgatcgactggatcttcaccctgtacagcaagagcctgcccctggacctggcctgcagaatctgggacgtgttctgcagagacggcgaggagttcctgttcagaaccgccctgggcatcctgaagctgttcgaggacatcctgaccaagatggacttcatccacatggcccagttcctgaccagactgcccgaggacctgcccgccgaggagctgttcgccagcatcgccaccatccagatgcagagcagaaacaagaagtgggcccaggtgctgaccgccctgcagaaggacagcagagagatggagaagggcagccccagcctgagacactag

SEQ ID NO: 25008 - DNA, 171 bp, Artificial Sequence
  Description of Artificial Sequence: Synthetic coding sequence
atgaccgacggcaagctgagcaccagcaccaacggcgtggccttcatgggcatcctggacggcagacccggcaaccccctgcagaacctgcagcacgtgaacctgaaggcccccagactgctgagcgcccccgagtacggccccaagctgaagctgagagccctggagtag

SEQ ID NO: 25009 - DNA, 384 bp, Artificial Sequence
  Description of Artificial Sequence: Synthetic coding sequence
atgaccgacggcaagctgagcaccagcaccaacggcgtggccttcatgggcatcctggacggcagacccggcaaccccctgcagaacctgcagcacgtgaacctgaaggcccccagactgctgagcgcccccgagtacggccccaagctgaagctgagagccctggaggacagacacagcctgcagagcgtggacagcggcatccccaccctggagatcggcaaccccgagcccgtgccctgcagcgccgtgcacgtgagaagaaagcagagcgacagcgacctgatccccgagagagccttccagagcgcctgcgccctgcccagctgcgccccccccgcccccagcagcaccgagagagagcagagcgtgagaaagagctag

SEQ ID NO: 25010 - DNA, 1023 bp, Artificial Sequence
  Description of Artificial Sequence: Synthetic coding sequence
atgtggtgcagcagaaaggtgagagacctgtggtggcagggcatcccccccagcgtgagaggcaaggtgtggagcctggccatcggcaacgagctgaacatcacccacgagctgttcgacatctgcctggccagagccaaggagagatggagaagcctgagcaccggcggcagcgaggtggagaacgaggacgccggcttcagcgccgccgacagagaggccagcctggagctgatcaagctggacatcagcagaaccttccccaacctgtgcatcttccagcaggtgctgatcttcgtggacttcagagtgggcctgcagaagagcttccagaagagaaaggagagagagagcaccaagctgcagcagctgtggagctggtgcctgggcggcccctaccacgacatgctgcacagcatcctgggcgcctacacctgctacagacccgacgtgggctacgtgcagggcatgagcttcatcgccgccgtgctgatcctgaacctggacaccgccgacgccttcatcgccttcagcaacctgctgaacaagccctgccagatggccttcttcagagtggaccacggcctgatgctgacctacttcgccgccttcgaggtgttcttcgaggagaacctgcccaagctgttcgcccacttcaagaagaacaacctgacccccgacatctacctgatcgactggatcttcaccctgtacagcaagagcctgcccctggacctggcctgcagaatctgggacgtgttctgcagagacggcgaggagttcctgttcagaaccgccctgggcatcctgaagctgttcgaggacatcctgaccaagatggacttcatccacatggcccagttcctgaccagactgcccgaggacctgcccgccgaggagctgttcgccagcatcgccaccatccagatgcagagcagaaacaagaagtgggcccaggtgctgaccgccctgcagaaggacagcagagagatggagaagggcagccccagcctgagacactag

SEQ ID NO: 25011 - DNA, 2082 bp, Artificial Sequence; identical to SEQ ID NO: 25007
  Description of Artificial Sequence: Synthetic coding sequence

SEQ ID NO: 25012 - DNA, 1242 bp, Artificial Sequence
  Description of Artificial Sequence: Synthetic coding sequence
atggagtacgaggacaaggccggcagacccagcaagccccccagccccaagcagaacgtgagaaagaacctggacttcgagcccctgagcaccaccgccctgatcctggaggacagacccgccaacctgcccgccaagcccgccgaggaggcccagaagcacagacagcagtacgaggagatggtggtgcaggccaagaagagagagctgaaggaggcccagagaagaaagaagcagctggaggagagatgcagagtggaggagagcatcggcaacgccgtgctgacctggaacaacgagatcctgcccaactgggagaccatgtggtgcagcagaaaggtgagagacctgtggtggcagggcatcccccccagcgtgagaggcaaggtgtggagcctggccatcggcaacgagctgaacatcacccacgagctgttcgacatctgcctggccagagccaaggagagatggagaagcctgagcaccggcggcagcgaggtggagaacgaggacgccggcttcagcgccgccgacagagaggccagcctggagctgatcaagctggacatcagcagaaccttccccaacctgtgcatcttccagcagggcggcccctaccacgacatgctgcacagcatcctgggcgcctacacctgctacagacccgacgtgggctacgtgcagggcatgagcttcatcgccgccgtgctgatcctgaacctggacaccgccgacgccttcatcgccttcagcaacctgctgaacaagccctgccagatggccttcttcagagtggaccacggcctgatgctgacctacttcgccgccttcgaggtgttcttcgaggagaacctgcccaagctgttcgcccacttcaagaagaacaacctgacccccgacatctacctgatcgactggatcttcaccctgtacagcaagagcctgcccctggacctggcctgcagaatctgggacgtgttctgcagagacggcgaggagttcctgttcagaaccgccctgggcatcctgaagctgttcgaggacatcctgaccaagatggacttcatccacatggcccagttcctgaccagactgcccgaggacctgcccgccgaggagctgttcgccagcatcgccaccatccagatgcagagcagaaacaagaagtgggcccaggtgctgaccgccctgcagaaggacagcagagagatggagaagggcagccccagcctgagacactag

SEQ ID NO: 25013 - DNA, 2304 bp, Artificial Sequence
  Description of Artificial Sequence: Synthetic coding sequence
atgagcctgggcagactgctgagaagagccagcagcaaggccagcgacctgctgaccctgacccccggcggcagcggcagcggcagccccagcgtgctggacggcgagatcatctacagcaagaacaacgtgtgcgtgcacccccccgagggcctgcagggcctgggcgagcaccaccccggctacctgtgcctgtacatggagaaggacgagatgctgggcgccaccctgatcctggcctgggtgcccaacagcagaatccagagacaggacgaggaggccctgagatacatcacccccgagagcagccccgtgagaaaggcccccagacccagaggcagaagaaccagaagcagcggcgccagccaccagcccagccccaccgagctgagacccaccctgacccccaaggacgaggacatcctggtggtggcccagagcgtgcccgacagaatgctggccagccccgcccccgaggacgaggagaagctggcccagggcctgggcgtggacggcgcccagcccgccagccagcccgcctgcagccccagcggcatcctgagcaccgtgagcccccaggacgtgaccgaggagggcagagagcccagacccgaggccggcgaggaggacggcagcctggagctgagcgccgagggcgtgagcagagacagcagcttcgacagcgacagcgacaccttcagcagccccttctgcctgagccccatcagcgccgccctggccgagagcagaggcagcgtgttcctggagagcgacagcagcccccccagcagcagcgacgccggcctgagattccccgacagcaacggcctgctgcagacccccagatgggacgagccccagagagtgtgcgccctggagcagatctgcggcgtgttcagagtggacctgggccacatgagaagcctgagactgttcttcagcgacgaggcctgcaccagcggccagctggtggtggccagcagagagagccagtacaaggtgttccacttccaccacggcggcctggacaagctgagcgacgtgttccagcagtggaagtactgcaccgagatgcagctgaaggaccagcaggtggcccccgacaagacctgcatgcagttcagcatcagaagacccaagctgcccagcagcgagacccaccccgaggagagcatgtacaagagactgggcgtgagcgcctggctgaaccacctgaacgagctgggccaggtggaggaggagtacaagctgagaaaggccatcttcttcggcggcatcgacgtgagcatcagaggcgaggtgtggcccttcctgctgagatactacagccacgagagcaccagcgaggagagagaggccctgagactgcagaagagaaaggagtacagcgagatccagcagaagagactgagcatgacccccgaggagcacagagccttctggagaaacgtgcagttcaccgtggacaaggacgtggtgagaaccgacagaaacaaccagttcttcagaggcgaggacaaccccaacgtggagagcatgagaagaatcctgctgaactacgccgtgtacaaccccgccgtgggctacagccagggcatgagcgacctggtggcccccatcctggccgaggtgctggacgagagcgacaccttctggtgcttcgtgggcctgatgcagaacaccatcttcgtgagcagccccagagacgaggacatggagaagcagctgctgtacctgagagagctgctgagactgacccacgtgagattctaccagcacctggtgagcctgggcgaggacggcctgcagatgctgttctgccacagatggctgctgctgtgcttcaagagagagttccccgaggccgaggccctgagaatctgggaggcctgctgggcccactaccagaccgactacttccacctgttcatctgcgtggccatcgtggccatctacggcgacgacgtgatcgagcagcagctggccaccgaccagatgctgctgcacttcggcaacctggccatgcacatgaacggcgagctggtgctgagaaaggccagaagcctgctgtaccagttcagactgctgcccagaatcccctgcagcctgcacgacctgtgcaagctgtgcggcagcggcatgtgggacagcggcagcatgcccgccgtggagtgcaccggccaccaccccggcagcgagagctgcccctacggcggcaccgtggagatgcccagccccaagagcctgagagagggcaagaagggccccaagaccccccaggacggcttcggcttcagaagatag

SEQ ID NO: 25014 - DNA, 1218 bp, Artificial Sequence
  Description of Artificial Sequence: Synthetic coding sequence
atgaaggtggcccccgacaagacctgcatgcagttcagcatcagaagacccaagctgcccagcagcgagacccaccccgaggagagcatgtacaagagactgggcgtgagcgcctggctgaaccacctgaacgagctgggccaggtggaggaggagtacaagctgagaaaggccatcttcttcggcggcatcgacgtgagcatcagaggcgaggtgtggcccttcctgctgagatactacagccacgagagcaccagcgaggagagagaggccctgagactgcagaagagaaaggagtacagcgagatccagcagaagagactgagcatgacccccgaggagcacagagccttctggagaaacgtgcagttcaccgtggacaaggacgtggtgagaaccgacagaaacaaccagttcttcagaggcgaggacaaccccaacgtggagagcatgagaagaatcctgctgaactacgccgtgtacaaccccgccgtgggctacagccagggcatgagcgacctggtggcccccatcctggccgaggtgctggacgagagcgacaccttctggtgcttcgtgggcctgatgcagaacaccatcttcgtgagcagccccagagacgaggacatggagaagcagctgctgtacctgagagagctgctgagactgacccacgtgagattctaccagcacctggtgagcctgggcgaggacggcctgcagatgctgttctgccacagatggctgctgctgtgcttcaagagagagttccccgaggccgaggccctgagaatctgggaggcctgctgggcccactaccagaccgactacttccacctgttcatctgcgtggccatcgtggccatctacggcgacgacgtgatcgagcagcagctggccaccgaccagatgctgctgcacttcggcaacctggccatgcacatgaacggcgagctggtgctgagaaaggccagaagcctgctgtaccagttcagactgctgcccagaatcccctgcagcctgcacgacctgtgcaagctgtgcggcagcggcatgtgggacagcggcagcatgcccgccgtggagtgcaccggccaccaccccggcagcgagagctgcccctacggcggcaccgtggagatgcccagccccaagagcctgagagagggcaagaagggccccaagaccccccaggacggcttcggcttcagaagatag

SEQ ID NO: 25015 - DNA, 2154 bp, Artificial Sequence
  Description of Artificial Sequence: Synthetic coding sequence
atgggcgacctgcccccctaccccgagagacccgcccagcagccccccggcagaagaaccagccaggccagccagagaagacacagcagagaccaggcccaggccctggccgccgaccccgaggagagacagcagatcccccccgacgcccagagaaacgcccccggctggagccagagaggcagcctgagccagcaggagaacctgctgatgccccaggtgttccaggccgaggaggccagactgggcggcatggagtaccccagcgtgaacaccggcttccccagcgagttccagccccagccctacagcgacgagagcagaatgcaggtggccgagctgaccaccagcctgatgctgcagagactgcagcagggccagagcagcctgttccagcagctggaccccaccttccaggagccccccgtgaaccccctgggccagttcaacctgtaccagaccgaccagttcagcgagggcgcccagcacggcccctacatcagagacgaccccgccctgcagttcctgcccagcgagctgggcttcccccactacagcgcccaggtgcccgagcccgagcccctggagctggccgtgcagaacgccaaggcctacctgctgcagaccagcatcaactgcgacctgagcctgtacgagcacctggtgaacctgctgaccaagatcctgaaccagagacccgaggaccccctgagcgtgctggagagcctgaacagaaccacccagtgggagtggttccaccccaagctggacaccctgagagacgaccccgagatgcagcccacctacaagatggccgagaagcagaaggccctgttcaccagaagcggcggcggcaccgagggcgagcaggagatggaggaggaggtgggcgagacccccgtgcccaacatcatggagaccgccttctacttcgagcaggccggcgtgggcctgagcagcgacgagagcttcagaatcttcctggccatgaagcagctggtggagcagcagcccatccacacctgcagattctggggcaagatcctgggcatcaagagaagctacctggtggccgaggtggagttcagagagggcgaggaggaggccgaggaggaggaggtggaggagatgaccgagggcggcgaggtgatggaggcccacggcgaggaggagggcgaggaggacgaggagaaggccgtggacatcgtgcccaagagcgtgtggaagcccccccccgtgatccccaaggaggagagcagaagcggcgccaacaagtacctgtacttcgtgtgcaacgagcccggcctgccctggaccagactgccccacgtgacccccgcccagatcgtgaacgccagaaagatcaagaagttcttcaccggctacctggacacccccgtggtgagctacccccccttccccggcaacgaggccaactacctgagagcccagatcgccagaatcagcgccgccacccaggtgagccccctgggcttctaccagttcagcgaggaggagggcgacgaggaggaggagggcggcgccggcagagacagctacgaggagaaccccgacttcgagggcatccccgtgctggagctggtggacagcatggccaactgggtgcaccacacccagcacatcctgccccagggcagatgcacctgggtgaaccccctgcagaagaccgaggaggaggaggacctgggcgaggaggaggagaaggccgacgagggccccgaggaggtggagcaggaggtgggcccccccctgctgacccccctgagcgaggacgccgagatcatgcacctggccccctggaccaccagactgagctgcagcctgtgcccccagtacagcgtggccgtggtgagaagcaacctgtggcccggcgcctacgcctacgccagcggcaagaagttcgagaacatctacatcggctggggccacaagtacagccccgagagcttcaaccccgccctgcccgcccccatccagcaggagtaccccagcggccccgagatcatggagatgagcgaccccaccgtggaggaggagcaggccctgaaggccgcccaggagcaggccctgggcgccaccgaggaggaggaggagggcgaggaggaggaggagggcgaggagaccgacgactag

SEQ ID NO: 25016 - DNA, 1848 bp, Artificial Sequence
  Description of Artificial Sequence: Synthetic coding sequence
atggagggcgccggctacagagacaacgacgtgctgctgcactgggcccccgtggaggaggccggcgacagcacccagatcctgttcagcaagaaggacagcagcggcggcgacagctgcgccagcgaggaggagcccaccttcgaccccgactacgagcccgactgggccgtgatcagcaccgtgagaccccagctgtgccacagcgagcccaccagaggcgccgagcccagctgcccccagggcagctgggccttcagcgtgagcctgggcgagctgaagagcatcagaagaagcaagcccggcctgagctgggcctacctggtgctggtgacccaggccggcggcagcctgcccgccctgcacttccacagaggcggcaccagagccctgctgagagtgctgagcagatacctgctgctggccagcagcccccaggacagcagactgtacctggtgttcccccacgacagcagcgccctgagcaacagcttccaccacctgcagctgttcgaccaggacagcagcaacgtggtgagcagattcctgcaggacccctacagcaccaccttcagcagcttcagcagagtgaccaacttcttcagaggcgccctgcagccccagcccgagggcgccgccagcgacctgccccccccccccgacgacgagcccgagcccggcttcgaggtgatcagctgcgtggagctgggccccagacccaccgtggagagaggcccccccgtgaccgaggaggagtgggccagacacgtgggccccgagggcagactgcagcaggtgcccgagctgaagaacagaatcttcagcggcggcctgagccccagcctgagaagagaggcctggaagttcctgctgggctacctgagctgggagggcaccgccgaggagcacaaggcccacatcagaaagaagaccgacgagtacttcagaatgaagctgcagtggaagagcgtgagccccgagcaggagagaagaaacagcctgctgcacggctacagaagcctgatcgagagagacgtgagcagaaccgacagaaccaacaagttctacgagggccccgagaaccccggcctgggcctgctgaacgacatcctgctgacctactgcatgtaccacttcgacctgggctacgtgcagggcatgagcgacctgctgagccccatcctgtacgtgatccagaacgaggtggacgccttctggtgcttctgcggcttcatggagctggtgcagggcaacttcgaggagagccaggagaccatgaagagacagctgggcagactgctgctgctgctgagagtgctggaccccctgctgtgcgacttcctggacagccaggacagcggcagcctgtgcttctgcttcagatggctgctgatctggttcaagagagagttccccttccccgacgtgctgagactgtgggaggtgctgtggaccggcctgcccggccccaacctgcacctgctggtggcctgcgccatcctggacatggagagagacaccctgatgctgagcggcttcggcagcaacgagatcctgaagcacatcaacgagctgaccatgaagctgagcgtggaggacgtgctgaccagagccgaggccctgcacagacagctgaccgcctgccccgagctgccccacaacgtgcaggagatcctgggcctggccccccccgccgagccccacagccccagccccaccgccagccccctgcccctgagccccaccagagccccccccacccccccccccagcaccgacaccgccccccagcccgacagcagcctggagatcctgcccgaggaggaggacgagggcgccgacagctag

SEQ ID NO: 25017 - DNA, 1581 bp, Artificial Sequence
  Description of Artificial Sequence: Synthetic coding sequence
atgctgcaggaggagagcgacctgagcctgatcatcgcccagatcgtgcagaagctgaagggcagcaacctgtacagccagctggagagacaggcctgggccagcctgcagagacccgagatcaagctggagagcctgaaggaggacatcaaggagttcttcaagatcagcggctgggagaagaagctgcagaacgccgtgtacagcgagctgagcgtgttccccctgcccagccaccccgccgccccccccgagcacctgaaggagcccctggtgtacatgagaaaggcccagggcagctgggagaagagaatcctgaagagcctgaacagcatgtgcaccgagctgagcatccccctggccagaaagagacccgtgggcgagcagaaggagctgctgaacaagtggaacgagatgggcaccgacgagcccgacctgagcctgttcagacccgtgtacgcccccaaggacttcctggaggtgctgatcaacctgagaaaccccaactacgagaacggcgacagcctgagcttcagaacccacctgggcctgatccaggtgcccctgaaggtgaaggacatccccgagctgaaggagtgcttcgtggagctgggcctgaacatcggccagctgggcatcgacgacagcacccaggtgccccccgagctgttcgagaacgagcacgtgagaatcggccagaaggtgctggccgagcaggacagcgccgccgcccagcagtacatcagacagggcagccccaccgccctgagagccgagctgtgggccctgatcctgaacatcagcagccagcccgaggacgtgctgtactacgagcagctgaagaccaacgtgatccagcacgacctgctggtggacagcctgatctacaaggacgtgaagctgaccgccagcaacgacgactactacttcgtgttcgaggactacctgtaccaggtgctgctgtgcttcagcagagacaccagcgtgctgagccacttcgccttcaacagcgccagcccccccaagagctacatcagaggcaagctgggcctggaggagtacgccgtgttctacccccccaacggcgtgatccccttccacggcttcagcatgtacgtggcccccctgtgcttcctgtaccacgagcccagcaagctgtaccagatcttcagagagatgtacgtgagattcttcttcagactgcacagcatcagcagccaccccagcggcatcgtgagcctgtgcctgctgttcgagaccctgctgcagacctacctgccccagctgttctaccacctgagagagatcggcgcccagcccctgagaatcagcttcaagtggatggtgagagccttcagcggctacctggccaccgaccagctgctgctgctgtgggacagaatcctgggctacaacagcctggagatcctggccgtgctggccgccgccgtgttcgccttcagagccgtgaacctgatggaggtgaccagcctggccgccgccgaggccgtgctggccgacctgagcaccctgaaggtgatgcccctgctgcagatcttcctgttcgccaccgtgacctag

SEQ ID NO: 25018 - DNA, 1386 bp, Artificial Sequence
  Description of Artificial Sequence: Synthetic coding sequence
atgctgcaggaggagagcgacctgagcctgatcatcgcccagatcgtgcagaagctgaagggcagcaacctgtacagccagctggagagacaggcctggggcagctgggagaagagaatcctgaagagcctgaacagcatgtgcaccgagctgagcatccccctggccagaaagagacccgtgggcgagcagaaggagctgctgaacaagtggaacgagatgggcaccgacgagcccgacctgagcctgttcagacccgtgtacgcccccaaggacttcctggaggtgctgatcaacctgagaaaccccaactacgagaacggcgacagcctgagcttcagaacccacctgggcctgatccaggtgcccctgaaggtgaaggacatccccgagctgaaggagtgcttcgtggagctgggcctgaacatcggccagctgggcatcgacgacagcacccaggtgccccccgagctgttcgagaacgagcacgtgagaatcggccagaaggtgctggccgagcaggacagcgccgccgcccagcagtacatcagacagggcagccccaccgccctgagagccgagctgtgggccctgatcctgaacatcagcagccagcccgaggacgtgctgtactacgagcagctgaagaccaacgtgatccagcacgacctgctggtggacagcctgatctacaaggacgtgaagctgaccgccagcaacgacgactactacttcgtgttcgaggactacctgtaccaggtgctgctgtgcttcagcagagacaccagcgtgctgagccacttcgccttcaacagcgccagcccccccaagagctacatcagaggcaagctgggcctggaggagtacgccgtgttctacccccccaacggcgtgatccccttccacggcttcagcatgtacgtggcccccctgtgcttcctgtaccacgagcccagcaagctgtaccagatcttcagagagatgtacgtgagattcttcttcagactgcacagcatcagcagccaccccagcggcatcgtgagcctgtgcctgctgttcgagaccctgctgcagacctacctgccccagctgttctaccacctgagagagatcggcgcccagcccctgagaatcagcttcaagtggatggtgagagccttcagcggctacctggccaccgaccagctgctgctgctgtgggacagaatcctgggctacaacagcctggagatcctggccgtgctggccgccgccgtgttcgccttcagagccgtgaacctgatggaggtgaccagcctggccgccgccgaggccgtgctggccgacctgagcaccctgaaggtgatgcccctgctgcagatcttcctgttcgccaccgtgacctag

SEQ ID NO: 25019 - DNA, 1011 bp, Artificial Sequence
  Description of Artificial Sequence: Synthetic coding sequence
atgaccaccctgagccccgagaacagcctgagcgccagacagagcgccagcttcatcctggtgaagagaaagccccccatcgacaagaccgagtgggacagcttcttcgacgagagcggccacctggccaagagcagagacttcatctgcgtgaacatcctggagagaggcctgcaccccttcgtgagaaccgaggcctggaagttcctgaccggctacttcagctggcagagcagccaggacgagagactgaccgtggacagcatgagaagaaagaactacaaggccctgtgccagatgtacgagaagatccagcccctgctggagaacctgcacagaaacttcaccgagaccagaaacaacatcgccagagacatccagaagatctacgacaaggaccccctgggcaacgtgctgatcgacaagaagagactggagaagatcctgctgctgagctacgtgtgcaacacccaggccgagtaccagcagggcttccacgagatgatgatgctgttccagctgatggtggagcacgaccacgagaccttctggctgttccagttcttcctgcagaagaccgagcacagctgcgtgatcaacatcggcgtggccaagaacctggacatgctgagcaccctgatcaccttcctggaccccgtgttcgccgagcacctgaagggcaagggcgccggcgccgtgcagagcctgttcccctggttctgcttctgcttccagagagccttcaagagcttcgacgacgtgtggagactgtgggaggtgctgctgaccggcaagccctgcagaaacttccaggtgctggtggcctacagcatgctgcagatggtgagagagcaggtgctgcaggagagcatgggcggcgacgacatcctgctggcctgcaacaacctgatcgacctggacgccgacgagctgatcagcgccgcctgcgtggtgtacgccgagctgatccagaaggacgtgccccagaccctgaaggacttcttcctgtag

SEQ ID NO: 25020 - DNA, 903 bp, Artificial Sequence
  Description of Artificial Sequence: Synthetic coding sequence
atgaccaccctgagccccgagaacagcctgagcgccagacagagcgccagcttcatcctgggcctgcaccccttcgtgagaaccgaggcctggaagttcctgaccggctacttcagctggcagagcagccaggacgagagactgaccgtggacagcatgagaagaaagaactacaaggccctgtgccagatgtacgagaagatccagcccctgctggagaacctgcacagaaacttcaccgagaccagaaacaacatcgccagagacatccagaagatctacgacaaggaccccctgggcaacgtgctgatcgacaagaagagactggagaagatcctgctgctgagctacgtgtgcaacacccaggccgagtaccagcagggcttccacgagatgatgatgctgttccagctgatggtggagcacgaccacgagaccttctggctgttccagttcttcctgcagaagaccgagcacagctgcgtgatcaacatcggcgtggccaagaacctggacatgctgagcaccctgatcaccttcctggaccccgtgttcgccgagcacctgaagggcaagggcgccggcgccgtgcagagcctgttcccctggttctgcttctgcttccagagagccttcaagagcttcgacgacgtgtggagactgtgggaggtgctgctgaccggcaagccctgcagaaacttccaggtgctggtggcctacagcatgctgcagatggtgagagagcaggtgctgcaggagagcatgggcggcgacgacatcctgctggcctgcaacaacctgatcgacctggacgccgacgagctgatcagcgccgcctgcgtggtgtacgccgagctgatccagaaggacgtgccccagaccctgaaggacttcttcctgtag

SEQ ID NO: 25021 - DNA, 1554 bp, Artificial Sequence
  Description of Artificial Sequence: Synthetic coding sequence
atggccagcgacggcgccagaaagcagttctggaagagaagcaacagcaagctgcccggcagcatccagcacgtgtacggcgcccagcacccccccttcgaccccctgctgcacggcaccctgctgagaagcaccgccaagatgcccaccacccccgtgaaggccaagagagtgagcaccttccaggagttcgagagcaacaccagcgacgcctgggacgccggcgaggacgacgacgagctgctggccatggccgccgagagcctgaacagcgaggtggtgatggagaccgccaacagagtgctgagaaaccacagccagagacagggcagacccaccctgcaggagggccccggcctgcagcagaagcccagacccgaggccgagccccccagcccccccagcggcgacctgagactggtgaagagcgtgagcgagagccacaccagctgccccgccgagagcgccagcgacgccgcccccctgcagagaagccagagcctgccccacagcgccaccgtgaccctgggcggcaccagcgaccccagcaccctgagcagcagcgccctgagcgagagagaggccagcagactggacaagttcaagcagctgctggccggccccaacaccgacctggaggagctgagaagactgagctggagcggcatccccaagcccgtgagacccatgacctggaagctgctgagcggctacctgcccgccaacgtggacagaagacccgccaccctgcagagaaagcagaaggagtacttcgccttcatcgagcactactacgacagcagaaacgacgaggtgcaccaggacacctacagacagatccacatcgacatccccagaatgagccccgaggccctgatcctgcagcccaaggtgaccgagatcttcgagagaatcctgttcatctgggccatcagacaccccgccagcggctacgtgcagggcatcaacgacctggtgacccccttcttcgtggtgttcatctgcgagtacatcgaggccgaggaggtggacaccgtggacgtgagcggcgtgcccgccgaggtgctgtgcaacatcgaggccgacacctactggtgcatgagcaagctgctggacggcatccaggacaactacaccttcgcccagcccggcatccagatgaaggtgaagatgctggaggagctggtgagcagaatcgacgagcaggtgcacagacacctggaccagcacgaggtgagatacctgcagttcgccttcagatggatgaacaacctgctgatgagagaggtgcccctgagatgcaccatcagactgtgggacacctaccagagcgagcccgacggcttcagccacttccacctgtacgtgtgcgccgccttcctggtgagatggagaaaggagatcctggaggagaaggacttccaggagctgctgctgttcctgcagaacctgcccaccgcccactgggacgacgaggacatcagcctgctgctggccgaggcctacagactgaagttcgccttcgccgacgcccccaaccactacaagaagtag

SEQ ID NO: 25022 - DNA, 1320 bp, Artificial Sequence
  Description of Artificial Sequence: Synthetic coding sequence
atggccagcgacggcgccagaaagcagttctggaagagaagcaacagcaagctgcccggcagcctgctgagaagcaccgccaagatgcccaccacccccgtgaaggccaagagagtgagcaccttccaggagttcgagagcaacaccagcgacgcctgggacgccggcgaggacgacgacgagctgctggccatggccgccgagagcctgaacagcgaggtggtgatggagaccgccaacagagtgctgagaaaccacagccagagacagggcagacccaccctgcaggagggccccggcctgcagcagaagcccagacccgaggccgagccccccagcccccccagcggcgacctgagactggtgaagagcgtgagcgagagccacaccagctgccccgccgaggagctgagaagactgagctggagcggcatccccaagcccgtgagacccatgacctggaagctgctgagcggctacctgcccgccaacgtggacagaagacccgccaccctgcagagaaagcagaaggagtacttcgccttcatcgagcactactacgacagcagaaacgacgaggtgcaccaggacacctacagacagatccacatcgacatccccagaatgagccccgaggccctgatcctgcagcccaaggtgaccgagatcttcgagagaatcctgttcatctgggccatcagacaccccgccagcggctacgtgcagggcatcaacgacctggtgacccccttcttcgtggtgttcatctgcgagtacatcgaggccgaggaggtggacaccgtggacgtgagcggcgtgcccgccgaggtgctgtgcaacatcgaggccgacacctactggtgcatgagcaagctgctggacggcatccaggacaactacaccttcgcccagcccggcatccagatgaaggtgaagatgctggaggagctggtgagcagaatcgacgagcaggtgcacagacacctggaccagcacgaggtgagatacctgcagttcgccttcagatggatgaacaacctgctgatgagagaggtgcccctgagatgcaccatcagactgtgggacacctaccagagcgagcccgacggcttcagccacttccacctgtacgtgtgcgccgccttcctggtgagatggagaaaggagatcctggaggagaaggacttccaggagctgctgctgttcctgcagaacctgcccaccgcccactgggacgacgaggacatcagcctgctgctggccgaggcctacagactgaagttcgccttcgccgacgcccccaaccactacaagaagtag

SEQ ID NO: 25023 - DNA, 975 bp, Artificial Sequence
  Description of Artificial Sequence: Synthetic coding sequence
atgcccaccacccccgtgaaggccaagagagtgagcaccttccaggagttcgagagcaacaccagcgacgcctgggacgccggcgaggacgacgacgagctgctggccatggccgccgagagcctgaacagcgaggtggtgatggagaccgccaacagagtgctgagaaaccacagccagagacagggcagacccaccctgcaggagggccccggcctgcagcagaagcccagacccgaggccgagccccccagcccccccagcggcgacctgagactggtgaagagcgtgagcgagagccacaccagctgccccgccgagagcgccagcgacgccgcccccctgcagagaagccagagcctgccccacagcgccaccgtgaccctgggcggcaccagcgaccccagcaccctgagcagcagcgccctgagcgagagagaggccagcagactggacaagttcaagcagctgctggccggccccaacaccgacctggaggagctgagaagactgagctggagcggcatccccaagcccgtgagacccatgacctggaagctgctgagcggctacctgcccgccaacgtggacagaagacccgccaccctgcagagaaagcagaaggagtacttcgccttcatcgagcactactacgacagcagaaacgacgaggtgcaccaggacacctacagacagatccacatcgacatccccagaatgagccccgaggccctgatcctgcagcccaaggtgaccgagatcttcgagagaatcctgttcatctgggccatcagacaccccgccagcggctacgtgcagggcatcaacgacctggtgacccccttcttcgtggtgttcatctgcgagtacatcgccttccccggctgcggcagaccccagatccccatcctggccgtgatctggagagacgagccctaccccagaaccgacgagcagatcatcctgagaagatag

SEQ ID NO: 25024 - DNA, 1413 bp, Artificial Sequence
  Description of Artificial Sequence: Synthetic coding sequence
atgcccaccacccccgtgaaggccaagagagtgagcaccttccaggagttcgagagcaacaccagcgacgcctgggacgccggcgaggacgacgacgagctgctggccatggccgccgagagcctgaacagcgaggtggtgatggagaccgccaacagagtgctgagaaaccacagccagagacagggcagacccaccctgcaggagggccccggcctgcagcagaagcccagacccgaggccgagccccccagcccccccagcggcgacctgagactggtgaagagcgtgagcgagagccacaccagctgccccgccgagagcgccagcgacgccgcccccctgcagagaagccagagcctgccccacagcgccaccgtgaccctgggcggcaccagcgaccccagcaccctgagcagcagcgccctgagcgagagagaggccagcagactggacaagttcaagcagctgctggccggccccaacaccgacctggaggagctgagaagactgagctggagcggcatccccaagcccgtgagacccatgacctggaagctgctgagcggctacctgcccgccaacgtggacagaagacccgccaccctgcagagaaagcagaaggagtacttcgccttcatcgagcactactacgacagcagaaacgacgaggtgcaccaggacacctacagacagatccacatcgacatccccagaatgagccccgaggccctgatcctgcagcccaaggtgaccgagatcttcgagagaatcctgttcatctgggccatcagacaccccgccagcggctacgtgcagggcatcaacgacctggtgacccccttcttcgtggtgttcatctgcgagtacatcgaggccgaggaggtggacaccgtggacgtgagcggcgtgcccgccgaggtgctgtgcaacatcgaggccgacacctactggtgcatgagcaagctgctggacggcatccaggacaactacaccttcgcccagcccggcatccagatgaaggtgaagatgctggaggagctggtgagcagaatcgacgagcaggtgcacagacacctggaccagcacgaggtgagatacctgcagttcgccttcagatggatgaacaacctgctgatgagagaggtgcccctgagatgcaccatcagactgtgggacacctaccagagcgagcccgacggcttcagccacttccacctgtacgtgtgcgccgccttcctggtgagatggagaaaggagatcctggaggagaaggacttccaggagctgctgctgttcctgcagaacctgcccaccgcccactgggacgacgaggacatcagcctgctgctggccgaggcctacagactgaagttcgccttcgccgacgcccccaaccactacaagaagtag

SEQ ID NO: 25025 - DNA, 1377 bp, Artificial Sequence
  Description of Artificial Sequence: Synthetic coding sequence
atggccagcgacggcgccagaaagcagttctggaagagaagcaacagcaagctgcccggcagcatccagcacgtgtacggcgcccagcacccccccttcgaccccctgctgcacggcaccctgctgagaagcaccgccaagatgcccaccacccccgtgaaggccaagagagtgagcaccttccaggagttcgagagcaacaccagcgacgcctgggacgccggcgaggacgacgacgagctgctggccatggccgccgagagcctgaacagcgaggtggtgatggagaccgccaacagagtgctgagaaaccacagccagagacagggcagacccaccctgcaggagggccccggcctgcagcagaagcccagacccgaggccgagccccccagcccccccagcggcgacctgagactggtgaagagcgtgagcgagagccacaccagctgccccgccgaggagctgagaagactgagctggagcggcatccccaagcccgtgagacccatgacctggaagctgctgagcggctacctgcccgccaacgtggacagaagacccgccaccctgcagagaaagcagaaggagtacttcgccttcatcgagcactactacgacagcagaaacgacgaggtgcaccaggacacctacagacagatccacatcgacatccccagaatgagccccgaggccctgatcctgcagcccaaggtgaccgagatcttcgagagaatcctgttcatctgggccatcagacaccccgccagcggctacgtgcagggcatcaacgacctggtgacccccttcttcgtggtgttcatctgcgagtacatcgaggccgaggaggtggacaccgtggacgtgagcggcgtgcccgccgaggtgctgtgcaacatcgaggccgacacctactggtgcatgagcaagctgctggacggcatccaggacaactacaccttcgcccagcccggcatccagatgaaggtgaagatgctggaggagctggtgagcagaatcgacgagcaggtgcacagacacctggaccagcacgaggtgagatacctgcagttcgccttcagatggatgaacaacctgctgatgagagaggtgcccctgagatgcaccatcagactgtgggacacctaccagagcgagcccgacggcttcagccacttccacctgtacgtgtgcgccgccttcctggtgagatggagaaaggagatcctggaggagaaggacttccaggagctgctgctgttcctgcagaacctgcccaccgcccactgggacgacgaggacatcagcctgctgctggccgaggcctacagactgaagttcgccttcgccgacgcccccaaccactacaagaagtag

SEQ ID NO: 25026 - DNA, 1518 bp, Artificial Sequence
  Description of Artificial Sequence: Synthetic coding sequence
atggccgccgagaacagcaagcagttctggaagagaagcgccaagctgcccggcagcatccagcccgtgtacggcgcccagcacccccccctggaccccagactgaccaagaacttcatcaaggagagaagcaaggtgaacaccgtgcccctgaagaacaagaaggccagcagcttccacgagttcgccagaaacaccagcgacgcctgggacatcggcgacgacgaggaggaggacttcagcagccccagcttccagaccctgaacagcaaggtggccctggccaccgccgcccaggtgctggagaaccacagcaagctgagagtgaagcccgagagaagccagagcaccaccagcgacgtgcccgccaactacaaggtgatcaagagcagcagcgacgcccagctgagcagaaacagcagcgacacctgcctgagaaaccccctgcacaagcagcagagcctgcccctgagacccatcatccccctggtggccagaatcagcgaccagaacgccagcggcgccccccccatgaccgtgagagagaagaccagactggagaagttcagacagctgctgagcagccagaacaccgacctggacgagctgagaaagtgcagctggcccggcgtgcccagagaggtgagacccatcacctggagactgctgagcggctacctgcccgccaacaccgagagaagaaagctgaccctgcagagaaagagagaggagtacttcggcttcatcgagcagtactacgacagcagaaacgaggagcaccaccaggacacctacagacagatccacatcgacatccccagaaccaaccccctgatccccctgttccagcagcccctggtgcaggagatcttcgagagaatcctgttcatctgggccatcagacaccccgccagcggctacgtgcagggcatcaacgacctggtgacccccttcttcgtggtgttcctgagcgagtacgtggaggaggacgtggagaacttcgacgtgaccaacctgagccaggacatgctgagaagcatcgaggccgacagcttctggtgcatgagcaagctgctggacggcatccaggacaactacaccttcgcccagcccggcatccagaagaaggtgaaggccctggaggagctggtgagcagaatcgacgagcaggtgcacaaccacttcagaagatacgaggtggagtacctgcagttcgccttcagatggatgaacaacctgctgatgagagagctgcccctgagatgcaccatcagactgtgggacacctaccagagcgagcccgagggcttcagccacttccacctgtacgtgtgcgccgccttcctgatcaagtggagaaaggagatcctggacgaggaggacttccagggcctgctgatgctgctgcagaacctgcccaccatccactggggcaacgaggagatcggcctgctgctggccgaggcctacagactgaagtacatgttcgccgacgcccccaaccactacagaagatag

SEQ ID NO: 25027 - DNA, 2055 bp, Artificial Sequence
  Description of Artificial Sequence: Synthetic coding sequence
atggccgagggcgaggacgtgccccccctgcccaccagcagcggcgacggctgggagaaggacctggaggaggccctggaggccggcggctgcgacctggagaccctgagaaacatcatccagggcagacccctgcccgccgacctgagagccaaggtgtggaagatcgccctgaacgtggccggcaagggcgacagcctggccagctgggacggcatcctggacctgcccgagcagaacaccatccacaaggactgcctgcagttcatcgaccagctgagcgtgcccgaggagaaggccgccgagctgctgctggacatcgagagcgtgatcaccttctactgcaagagcagaaacatcaagtacagcaccagcctgagctggatccacctgctgaagcccctggtgcacctgcagctgcccagaagcgacctgtacaactgcttctacgccatcatgaacaagtacatccccagagactgcagccagaagggcagacccttccacctgttcagactgctgatccagtaccacgagcccgagctgtgcagctacctggacaccaagaagatcacccccgacagctacgccctgaactggctgggcagcctgttcgcctgctactgcagcaccgaggtgacccaggccatctgggacggctacctgcagcaggccgaccccttcttcatctacttcctgatgctgatcatcctggtgaacgccaaggaggtgatcctgacccaggagagcgacagcaaggaggaggtgatcaagttcctggagaacacccccagcagcctgaacatcgaggacatcgaggacctgttcagcctggcccagtactactgcagcaagacccccgccagcttcagaaaggacaaccaccacctgttcggcagcaccctgctgggcatcaaggacgacgacgccgacctgagccaggccctgtgcctggccatcagcgtgagcgagatcctgcaggccaaccagctgcagggcgagggcgtgagattcttcgtggtggactgcagacccgccgagcagtacaacgccggccacctgagcaccgccttccacctggacagcgacctgatgctgcagaaccccagcgagttcgcccagagcgtgaagagcctgctggaggcccagaagcagagcatcgagagcggcagcatcgccggcggcgagcacctgtgcttcatgggcagcggcagagaggaggaggacatgtacatgaacatggtgctggcccacttcctgcagaagaacaaggagtacgtgagcatcgccagcggcggcttcatggccctgcagcagcacctggccgacatcaacgtggacggccccgagaacggctacggccactggatcgccagcaccagcggcagcagaagcagcatcaacagcgtggacggcgagagccccaacggcagcagcgacagaggcatgaagagcctggtgaacaagatgaccgtggccctgaagaccaagagcgtgaacgtgagagagaaggtgatcagcttcatcgagaacaccagcacccccgtggacagacacgtgagcagcagcgacagagtgggcaagccctacagaggcgtgaagcccgtgttcagcatcggcgacgaggaggagtacgacaccgacgagatcgacagcagcagcatgagcgacgacgacagaaaggaggtggtgaacatccagacctggatcaacaagcccgacgtgaagcaccacttcccctgcaaggaggtgaaggagagcggccacatgttccccagccacctgctggtgaccgccacccacatgtactgcctgagagagatcgtgagcagaaagggcctggcctacatccagagcagacaggccctgaacagcgtggtgaagatcaccagcaagaagaagcaccccgagctgatcaccttcaagtacggcaacagcagcgccagcggcatcgagatcctggccatcgagagatacctgatccccaacgccggcgacgccaccaaggccatcaagcagcagatcatgaaggtgctggacgccctggagagctag

SEQ ID NO: 25028 - DNA, 2100 bp, Artificial Sequence
  Description of Artificial Sequence: Synthetic coding sequence
atggccgagggcgaggacgtgccccccctgcccaccagcagcggcgacggctgggagaaggacctggaggaggccctggaggccggcggctgcgacctggagaccctgagaaacatcatccagggcagacccctgcccgccgacctgagagccaaggtgtggaagatcgccctgaacgtggccggcaagggcgacagcctggccagctgggacggcatcctggacctgcccgagcagaacaccatccacaaggactgcctgcagttcatcgaccagctgagcgtgcccgaggagaaggccgccgagctgctgctggacatcgagagcgtgatcaccttctactgcaagagcagaaacatcaagtacagcaccagcctgagctggatccacctgctgaagcccctggtgcacctgcagctgcccagaagcgacctgtacaactgcttctacgccatcatgaacaagtacatccccagagactgcagccagaagggcagacccttccacctgttcagactgctgatccagtaccacgagcccgagctgtgcagctacctggacaccaagaagatcacccccgacagctacgccctgaactggctgggcagcctgttcgcctgctactgcagcaccgaggtgacccaggccatctgggacggctacctgcagcaggccgaccccttcttcatctacttcctgatgctgatcatcctggtgaacgccaaggaggtgatcctgacccaggagagcgacagcaaggaggaggtgatcaagttcctggagaacacccccagcagcctgaacatcgaggacatcgaggacctgttcagcctggcccagtactactgcagcaagacccccgccagcttcagaaaggacaaccaccacctgttcggcagcaccctgctgggcatcaaggacgacgacgccgacctgagccaggccctgtgcctggccatcagcgtgagcgagatcctgcaggccaaccagctgcagggcgagggcgtgagattcttcgtggtggactgcagacccgccgagcagtacaacgccggccacctgagcaccgccttccacctggacagcgacctgatgctgcagaaccccagcgagttcgcccagagcgtgaagagcctgctggaggcccagaagcagagcatcgagagcggcagcatcgccggcggcgagcacctgtgcttcatgggcagcggcagagaggaggaggacatgtacatgaacatggtgctggcccacttcctgcagaagaacaaggagtacgtgagcatcgccagcggcggcttcatggccctgcagcagcacctggccgacatcaacgtggacggccccgagaacggctacggccactggatcgccagcaccagcggcagcagaagcagcatcaacagcgtggacggcgagagccccaacggcagcagcgacagaggcatgaagagcctggtgaacaagatgaccgtggccctgaagaccaagagcgtgaacgtgagagagaaggtgatcagcttcatcgagaacaccagcacccccgtggacagaatgagcttcaacctgccctggcccgacagaagctgcaccgagagacacgtgagcagcagcgacagagtgggcaagccctacagaggcgtgaagcccgtgttcagcatcggcgacgaggaggagtacgacaccgacgagatcgacagcagcagcatgagcgacgacgacagaaaggaggtggtgaacatccagacctggatcaacaagcccgacgtgaagcaccacttcccctgcaaggaggtgaaggagagcggccacatgttccccagccacctgctggtgaccgccacccacatgtactgcctgagagagatcgtgagcagaaagggcctggcctacatccagagcagacaggccctgaacagcgtggtgaagatcaccagcaagaagaagcaccccgagctgatcaccttcaagtacggcaacagcagcgccagcggcatcgagatcctggccatcgagagatacctgatccccaacgccggcgacgccaccaaggccatcaagcagcagatcatgaaggtgctggacgccctggagagctag

SEQ ID NO: 25029 - DNA, 1689 bp, Artificial Sequence
  Description of Artificial Sequence: Synthetic coding sequence
atgggctggtacttcagactggccagaaccgagcactacagccagagactgcccgccgtgtactgggactgcagccagaagggcagacccttccacctgttcagactgctgatccagtaccacgagcccgagctgtgcagctacctggacaccaagaagatcacccccgacagctacgccctgaactggctgggcagcctgttcgcctgctactgcagcaccgaggtgacccaggccatctgggacggctacctgcagcaggccgaccccttcttcatctacttcctgatgctgatcatcctggtgaacgccaaggaggtgatcctgacccaggagagcgacagcaaggaggaggtgatcaagttcctggagaacacccccagcagcctgaacatcgaggacatcgaggacctgttcagcctggcccagtactactgcagcaagacccccgccagcttcagaaaggacaaccaccacctgttcggcagcaccctgctgggcatcaaggacgacgacgccgacctgagccaggccctgtgcctggccatcagcgtgagcgagatcctgcaggccaaccagctgcagggcgagggcgtgagattcttcgtggtggactgcagacccgccgagcagtacaacgccggccacctgagcaccgccttccacctggacagcgacctgatgctgcagaaccccagcgagttcgcccagagcgtgaagagcctgctggaggcccagaagcagagcatcgagagcggcagcatcgccggcggcgagcacctgtgcttcatgggcagcggcagagaggaggaggacatgtacatgaacatggtgctggcccacttcctgcagaagaacaaggagtacgtgagcatcgccagcggcggcttcatggccctgcagcagcacctggccgacatcaacgtggacggccccgagaacggctacggccactggatcgccagcaccagcggcagcagaagcagcatcaacagcgtggacggcgagagccccaacggcagcagcgacagaggcatgaagagcctggtgaacaagatgaccgtggccctgaagaccaagagcgtgaacgtgagagagaaggtgatcagcttcatcgagaacaccagcacccccgtggacagaatgagcttcaacctgccctggcccgacagaagctgcaccgagagacacgtgagcagcagcgacagagtgggcaagccctacagaggcgtgaagcccgtgttcagcatcggcgacgaggaggagtacgacaccgacgagatcgacagcagcagcatgagcgacgacgacagaaaggaggtggtgaacatccagacctggatcaacaagcccgacgtgaagcaccacttcccctgcaaggaggtgaaggagagcggccacatgttccccagccacctgctggtgaccgccacccacatgtactgcctgagagagatcgtgagcagaaagggcctggcctacatccagagcagacaggccctgaacagcgtggtgaagatcaccagcaagaagaagcaccccgagctgatcaccttcaagtacggcaacagcagcgccagcggcatcgagatcctggccatcgagagatacctgatccccaacgccggcgacgccaccaaggccatcaagcagcagatcatgaaggtgctggacgccctggagagctag

SEQ ID NO: 25030 - DNA, 753 bp, Artificial Sequence; identical to SEQ ID NO: 24999
  Description of Artificial Sequence: Synthetic coding sequence

SEQ ID NO: 25031 - DNA, 633 bp, Artificial Sequence
  Description of Artificial Sequence: Synthetic coding sequence
atggagatggacgaggaccccgacaacctgcccgcccagggccagggcaacatcatcatcaccaagtacgagcagggccacagagccggcgccgccgtggacctgggccacgagcaggtggacgtgagaaagtacaccaacaacctgggcatcgtgcacgagatggagctgcccagagtgagcgccctggaggtgaagcagagaagaaaggagagcaagagaaccaacaagtggcagaagatgctggccgactggaccaagtacagaagcaccaagaagctgagccagagagtgtgcaaggtgatccccctggccgtgagaggcagagccctgagcctgctgctggacatcgacaagatcaagagccagaaccccggcaagtacaaggtgatgaaggagaagggcaagagaagcagcagaatcatccactgcatccagctggacgtgagccacaccctgcagaagcacatgatgttcatccagagattcggcgtgaagcagcaggagctgtgcgacatcctggtggcctacagcgcctacaaccccgtgagcatccccggccagagatacagctggtacctgtgcccctacagccaggcctgggtgagcctgggcggcgtggccaccagctag

SEQ ID NO: 25032 - DNA, 633 bp, Artificial Sequence; identical to SEQ ID NO: 25031
  Description of Artificial Sequence: Synthetic coding sequence

SEQ ID NO: 25033 - DNA, 453 bp, Artificial Sequence; identical to SEQ ID NO: 25000
  Description of Artificial Sequence: Synthetic coding sequence

SEQ ID NO: 25034 - DNA, 246 bp, Artificial Sequence
  Description of Artificial Sequence: Synthetic coding sequence
atgggccacctggacaaggagggcctgtgcacccagggcagcagcttcagctggctgctgagagtgctgaacgacggcatcagcctgggcctgaccccctgcctgtgggacatgtacctgctggagggcgagcagatgctgatgctgatcaccagcatcgccttcaaggtgcagagaagacccagcagagccctggaggagcccgaccccttcgtgagagccagcacccccccctgcaagagatag

SEQ ID NO: 25035 - DNA, 2892 bp, Artificial Sequence
  Description of Artificial Sequence: Synthetic coding sequence
atgcccggcgccggcgccagagccgaggagggcggcggcggcggcgagggcgccgcccagggcgccgccgccgagcccggcgccggccccgccagagagcccgccagactgtgcggctacctgcagaagctgagcggcaagggccccctgagaggctacagaagcagatggttcgtgttcgacgccagaagatgctacctgtactacttcaagagcccccaggacgccctgcccctgggccacctggacatcgccgacgcctgcttcagctaccagggccccgacgaggccgccgagcccggcaccgagccccccgcccacttccaggtgcacagcgccggcgccgtgaccgtgctgaaggcccccaacagacagctgatgacctactggctgcaggagctgcagcagaagagatgggagtactgcaacagcctggacatggtgaagtgggacagcagaaccagccccacccccggcgacttccccaagggcctggtggccagagacaacaccgacctgatctacccccaccccaacgccagcgccgagaaggccagaaacgtgctggccgtggagaccgtgcccggcgagctggtgggcgagcaggccgccaaccagcccgcccccggccaccccaacagcatcaacttctacagcctgaagcagtggggcaacgagctgaagaacagcatgagcagcttcagacccggcagaggccacaacgacagcagaagaaccgtgttctacaccaacgaggagtgggagctgctggaccccacccccaaggacctggaggagagcatcgtgcaggaggagaagaagaagctgacccccgagggcaacaagggcgtgaccggcagcggcttccccttcgacttcggcagaaacccctacaagggcaagagacccctgaaggacatcatcggcagctacaagaacagacacagcagcggcgaccccagcagcgagggcaccagcggcagcggcagcgtgagcatcagaaagcccgccagcgagatgcagctgcaggtgcagagccagcaggaggagctggagcagctgaagaaggacctgagcagccagaaggagctggtgagactgctgcagcagaccgtgagaagcagccagtacgacaagtacttcaccagcagcagactgtgcgagggcgtgcccaaggacaccctggagctgctgcaccagaaggacgaccagatcctgggcctgaccagccagctggagagattcagcctggagaaggagagcctgcagcaggaggtgagaaccctgaagagcaaggtgggcgagctgaacgagcagctgggcatgctgatggagaccatccaggccaaggacgaggtgatcatcaagctgagcgagggcgagggcaacggccccccccccaccgtggcccccagcagccccagcgtggtgcccgtggccagagaccagctggagctggacagactgaaggacaacctgcagggctacaagacccagaacaagttcctgaacaaggagatcctggagctgagcgccctgagaagaaacgccgagagaagagagagagacctgatggccaagtacagcagcctggaggccaagctgtgccagatcgagagcaagtacctgatcctgctgcaggagatgaagacccccgtgtgcagcgaggaccagggccccaccagagaggtgatcgcccagctgctggaggacgccctgcaggtggagagccaggagcagcccgagcaggccttcgtgaagccccacctggtgagcgagtacgacatctacggcttcagaaccgtgcccgaggacgacgaggaggagaagctggtggccaaggtgagagccctggacctgaagaccctgtacctgaccgagaaccaggaggtgagcaccggcgtgaagtgggagaactacttcgccagcaccgtgaacagagagatgatgtgcagccccgagctgaagaacctgatcagagccggcatcccccacgagcacagaagcaaggtgtggaagtggtgcgtggacagacacaccagaaagttcaaggacaacaccgagcccggccacttccagaccctgctgcagaaggccctggagaagcagaaccccgccagcaagcagatcgagctggacctgctgagaaccctgcccaacaacaagcactacagctgccccaccagcgagggcatccagaagctgagaaacgtgctgctggccttcagctggagaaaccccgacatcggctactgccagggcctgaacagactggtggccgtggccctgctgtacctggagcaggaggacgccttctggtgcctggtgaccatcgtggaggtgttcatgcccagagactactacaccaagaccctgctgggcagccaggtggaccagagagtgttcagagacctgatgagcgagaagctgcccagactgcacggccacttcgagcagtacaaggtggactacaccctgatcaccttcaactggttcctggtggtgttcgtggacagcgtggtgagcgacatcctgttcaagatctgggacagcttcctgtacgagggccccaaggtgatcttcagattcgccctggccctgttcaagtacaaggaggaggagatcctgaagctgcaggacagcatgagcatcttcaagtacctgagatacttcaccagaaccatcctggacgccagaaagctgatcagcatcagcttcggcgacctgaaccccttccccctgagacagatcagaaacagaagagcctaccacctggagaaggtgagactggagctgaccgagctggaggccatcagagaggacttcctgagagagagagacaccagccccgacaagggcgagctggtgagcgacgaggaggaggacacctag

SEQ ID NO: 25036 - DNA, 2745 bp, Artificial Sequence
  Description of Artificial Sequence: Synthetic coding sequence
atgcccggcgccggcgccagagccgaggagggcggcggcggcggcgagggcgccgcccagggcgccgccgccgagcccggcgccggccccgccagagagcccgccagactgtgcggctacctgcagaagctgagcggcaagggccccctgagaggctacagaagcagatggttcgtgttcgacgccagaagatgctacctgtactacttcaagagcccccaggacgccctgcccctgggccacctggacatcgccgacgcctgcttcagctaccagggccccgacgaggccgccgagcccggcaccgagccccccgcccacttccaggtgcacagcgccggcgccgtgaccgtgctgaaggcccccaacagacagctgatgacctactggctgcaggagctgcagcagaagagatgggagtactgcaacagcctggacatggtgaagtgggacagcagaaccagccccacccccggcgacttccccaagggcctggtggccagagacaacaccgacctgatctacccccaccccaacgccagcgccgagaaggccagaaacgtgctggccgtggagaccgtgcccggcgagctggtgggcgagcaggccgccaaccagcccgcccccggccaccccaacagcatcaacttctacagcctgaagcagtggggcaacgagctgaagaacagcatgagcagcttcagacccggcagaggccacaacgacagcagaagaaccgtgttctacaccaacgaggagtgggagctgctggaccccacccccaaggacctggaggagagcatcgtgcaggaggagaagaagaagctgacccccgagggcaacaagggcgtgaccggcagcggcttccccttcgacttcggcagaaacccctacaagggcaagagacccctgaaggacatcatcggcagctacaagaacagacacagcagcggcgaccccagcagcgagggcaccagcggcagcggcagcgtgagcatcagaaagcccgccagcgagatgcagctgcaggtgcagagccagcaggaggagctggagcagctgaagaaggacctgagcagccagaaggagctggtgagactgctgcagcagaccgtgagaagcagccagtacgacaagtacttcaccagcagcagactgtgcgagggcgtgcccaaggacaccctggagctgctgcaccagaaggacgaccagatcctgggcctgaccagccagctggagagattcagcctggagaaggagagcctgcagcaggaggtgagaaccctgaagagcaaggtgggcgagctgaacgagcagctgggcatgctgatggagaccatccaggccaaggacgaggtgatcatcaagctgagcgagggcgagggcaacggccccccccccaccgtggcccccagcagccccagcgtggtgcccgtggccagagaccagctggagctggacagactgaaggacaacctgcagggctacaagacccagaacaagttcctgaacaaggagatcctggagctgagcgccctgagaagaaacgccgagagaagagagagagacctgatggccaagtacagcagcctggaggccaagctgtgccagatcgagagcaagtacctgatcctgctgcaggagatgaagacccccgtgtgcagcgaggaccagggccccaccagagaggtgatcgcccagctgctggaggacgccctgcaggtggagagccaggagcagcccgagcaggccttcgtgaagccccacctggtgagcgagtacgacatctacggcttcagaaccgtgcccgaggacgacgaggaggagaagctggtggccaaggtgagagccctggacctgaagaccctgtacctgaccgagaaccaggaggtgagcaccggcgtgaagtgggagaactacttcgccagcaccgtgaacagagagatgatgtgcagccccgagctgaagaacctgatcagagccggcatcccccacgagcacagaagcaaggtgtggaagtggtgcgtggacagacacaccagaaagttcaaggacaacaccgagcccggccacttccagaccctgctgcagaaggccctggagaagcagaaccccgccagcaagcagatcgagctggacctgctgagaaccctgcccaacaacaagcactacagctgccccaccagcgagggcatccagaagctgagaaacgtgctgctggccttcagctggagaaaccccgacatcggctactgccagggcctgaacagactggtggccgtggccctgctgtacctggagcaggaggacgccttctggtgcctggtgaccatcgtggaggtgttcatgcccagagactactacaccaagaccctgctgggcagccaggtggaccagagagtgttcagagacctgatgagcgagaagctgcccagactgcacggccacttcgagcagtacaaggtggactacaccctgatcaccttcaactggttcctggtggtgttcgtggacagcgtggtgagcgacatcctgttcaagatctgggacagcttcctgtacgagggccccaaggtgatcttcagattcgccctggccctgttcaagtacaaggaggaggagatcctgaagctgcaggacagcatgagcatcttcaagtacctgagatacttcaccagaaccatcctggacgccagaagcggcaccgacgcccccaccacctggagaaagagcggctggagctag

SEQ ID NO: 25037 - DNA, 768 bp, Artificial Sequence
  Description of Artificial Sequence: Synthetic coding sequence
atggtgctggagctgaacgccagcgacgacagaggcatcgacatcatcagaggccccatcctgagcttcgccagcaccagaaccatcttcaagaagggcttcaagctggtgatcctggacgaggccgacgccatgacccaggacgcccagaacgccctgagaagagtgatcgagaagttcaccgagaacaccagattctgcctgatctgcaactacctgagcaagatcatccccgccctgcagagcagatgcaccagattcagattcggccccctgacccccgagctgatggtgcccagactggagcacgtggtggaggaggagaaggtggacatcagcgaggacggcatgaaggccctggtgaccctgagcagcggcgacatgagaagagccctgaacatcctgcagagcaccaacatggccttcggcaaggtgaccgaggagaccgtgtacacctgcaccggccaccccctgaagagcgacatcgccaacatcctggactggatgctgaaccaggacttcaccaccgcctacagaaacatcaccgagctgaagaccctgaagggcctggccctgcacgacatcctgaccgagatccacctgttcgtgcacagagtggacttccccagcagcgtgagaatccacctgctgaccaagatggccgacatcgagtacagactgagcgtgggcaccaacgagaagatccagctgagcagcctgatcgccgccttccaggtgaccagagacctgatcgtggccgaggcctag

SEQ ID NO: 25038 - DNA, 1734 bp, Artificial Sequence
  Description of Artificial Sequence: Synthetic coding sequence
atgagacaggacaagctgaccggcagcctgagaagaggcggcagatgcctgaagagacagggcggcggcgtgggcaccatcctgagcaacgtgctgaagaagagaagctgcatcagcagaaccgcccccagactgctgtgcaccctggagcccggcgtggacaccaagctgaagttcaccctggagcccagcctgggccagaacggcttccagcagtggtacgacgccctgaaggccgtggccagactgagcaccggcatccccaaggagtggagaagaaaggacctgcacagaaccggctgcagcagctactgcggccaggaggccgagcaggacagagtggtgctgaagagagtgctgctggcctacgccagatggaacaagaccgtgggctactgccagggcttcaacatcctggccgccctgatcctggaggtgatggagggcaacgagggcgacgccctgaagatcatgatctacctgatcgacaaggtgctgcccgagagctacttcgtgaacaacctgagagccctgagcgtggacatggccgtgttcagagacctgctgagaatgaagctgcccgagctgagccagcacctggacaccctgcagagaaccgccaacaaggagagcggcggcggctacgagccccccctgaccaacgtgttcaccatgcagtggttcctgaccctgttcgccacctgcctgcccaaccagaccgtgctgaagatctgggacagcgtgttcttcgagggcagcgagatcatcctgagagtgagcctggccatctgggccaagctgggcgagcagatcgagtgctgcgagaccgccgacgagttctacagcaccatgggcagactgacccaggagatgctggagaacgacctgctgcagagccacgagctgatgcagaccgtgtacagcatggcccccttccccttcccccagctggccgagctgagagagaagtacacctacaacatcacccccttccccgccaccgtgaagcccaccagcgtgagcggcagacacagcaaggccagagacagcgacgaggagaacgaccccgacgacgaggacgccgtggtgaacgccgtgggctgcctgggccccttcagcggcttcctggcccccgagctgcagaagtaccagaagcagatcaaggagcccaacgaggagcagagcctgagaagcaacaacatcgccgagctgagccccggcgccatcaacagctgcagaagcgagtaccacgccgccttcaacagcatgatgatggagagaatgaccaccgacatcaacgccctgaagagacagtacagcagaatcaagaagaagcagcagcagcaggtgcaccaggtgtacatcagagccgacaagggccccgtgaccagcatcctgcccagccaggtgaacagcagccccgtgatcaaccacctgctgctgggcaagaagatgaagatgaccaacagagccgccaagaacgccgtgatccacatccccggccacaccggcggcaagatcagccccgtgccctacgaggacctgaagaccaagctgaacagcccctggagaacccacatcagagtgcacaagaagaacatgcccagaaccaagagccaccccggctgcggcgacaccgtgggcctgatcgacgagcagaacgaggccagcaagaccaacggcctgggcgccgccgaggccttccccagcggctgcaccgccggccagggctag

SEQ ID NO: 25039 - DNA, 1914 bp, Artificial Sequence
  Description of Artificial Sequence: Synthetic coding sequence
atgagacaggacaagctgaccggcagcctgagaagaggcggcagatgcctgaagagacagggcggcggcgtgggcaccatcctgagcaacgtgctgaagaagagaagctgcatcagcagaaccgcccccagactgctgtgcaccctggagcccggcgtggacaccaagctgaagttcaccctggagcccagcctgggccagaacggcttccagcagtggtacgacgccctgaaggccgtggccagactgagcaccggcatccccaaggagtggagaagaaaggtgtggctgaccctggccgaccactacctgcacagcatcgccatcgactgggacaagaccatgagattcaccttcaacgagagaagcaaccccgacgacgacagcatgggcatccagatcgtgaaggacctgcacagaaccggctgcagcagctactgcggccaggaggccgagcaggacagagtggtgctgaagagagtgctgctggcctacgccagatggaacaagaccgtgggctactgccagggcttcaacatcctggccgccctgatcctggaggtgatggagggcaacgagggcgacgccctgaagatcatgatctacctgatcgacaaggtgctgcccgagagctacttcgtgaacaacctgagagccctgagcgtggacatggccgtgttcagagacctgctgagaatgaagctgcccgagctgagccagcacctggacaccctgcagagaaccgccaacaaggagagcggcggcggctacgagccccccctgaccaacgtgttcaccatgcagtggttcctgaccctgttcgccacctgcctgcccaaccagaccgtgctgaagatctgggacagcgtgttcttcgagggcagcgagatcatcctgagagtgagcctggccatctgggccaagctgggcgagcagatcgagtgctgcgagaccgccgacgagttctacagcaccatgggcagactgacccaggagatgctggagaacgacctgctgcagagccacgagctgatgcagaccgtgtacagcatggcccccttccccttcccccagctggccgagctgagagagaagtacacctacaacatcacccccttccccgccaccgtgaagcccaccagcgtgagcggcagacacagcaaggccagagacagcgacgaggagaacgaccccgacgacgaggacgccgtggtgaacgccgtgggctgcctgggccccttcagcggcttcctggcccccgagctgcagaagtaccagaagcagatcaaggagcccaacgaggagcagagcctgagaagcaacaacatcgccgagctgagccccggcgccatcaacagctgcagaagcgagtaccacgccgccttcaacagcatgatgatggagagaatgaccaccgacatcaacgccctgaagagacagtacagcagaatcaagaagaagcagcagcagcaggtgcaccaggtgtacatcagagccgacaagggccccgtgaccagcatcctgcccagccaggtgaacagcagccccgtgatcaaccacctgctgctgggcaagaagatgaagatgaccaacagagccgccaagaacgccgtgatccacatccccggccacaccggcggcaagatcagccccgtgccctacgaggacctgaagaccaagctgaacagcccctggagaacccacatcagagtgcacaagaagaacatgcccagaaccaagagccaccccggctgcggcgacaccgtgggcctgatcgacgagcagaacgaggccagcaagaccaacggcctgggcgccgccgaggccttccccagcggctgcaccgccaccgccggcagagagggcagcagccccgagggcagcagcagctacaagagcctgcagatgatctag

SEQ ID NO: 25040 - DNA, 2388 bp, Artificial Sequence
  Description of Artificial Sequence: Synthetic coding sequence
atgtaccacagcctgagcgagaccagacaccccctgcagcccgaggagcaggaggtgggcatcgaccccctgagcagctacagcaacaagagcggcggcgacagcaacaagaacggcagaagaaccagcagcaccctggacagcgagggcaccttcaacagctacagaaaggagtgggaggagctgttcgtgaacaacaactacctggccaccatcagacagaagggcatcaacggccagctgagaagcagcagattcagaagcatctgctggaagctgttcctgtgcgtgctgccccaggacaagagccagtggatcagcagaatcgaggagctgagagcctggtacagcaacatcaaggagatccacatcaccaaccccagaaaggtggtgggccagcaggacctgatgatcaacaaccccctgagccaggacgagggcagcctgtggaacaagttcttccaggacaaggagctgagaagcatgatcgagcaggacgtgaagagaaccttccccgagatgcagttcttccagcaggagaacgtgagaaagatcctgaccgacgtgctgttctgctacgccagagagaacgagcagctgctgtacaagcagggcatgcacgagctgctggcccccatcgtgttcgtgctgcactgcgaccaccaggccttcctgcacgccagcgagagcgcccagcccagcgaggagatgaagaccgtgctgaaccccgagtacctggagcacgacgcctacgccgtgttcagccagctgatggagaccgccgagccctggttcagcaccttcgagcacgacggccagaagggcaaggagaccctgatgacccccatccccttcgccagaccccaggacctgggccccaccatcgccatcgtgaccaaggtgaaccagatccaggaccacctgctgaagaagcacgacatcgagctgtacatgcacctgaacagactggagatcgccccccagatctacggcctgagatgggtgagactgctgttcggcagagagttccccctgcaggacctgctggtggtgtgggacgccctgttcgccgacggcctgagcctgggcctggtggactacatcttcgtggccatgctgctgtacatcagagacgccctgatcagcagcaactaccagacctgcctgggcctgctgatgcactaccccttcatcggcgacgtgcacagcctgatcctgaaggccctgttcctgagagaccccaagagaaaccccagacccgtgacctaccagttccaccccaacctggactactacaaggccagaggcgccgacctgatgaacaagagcagaaccaacgccaagggcgcccccctgaacatcaacaaggtgagcaacagcctgatcaacttcggcagaaagctgatcagccccgccatggcccccggcagcgccggcggccccgtgcccggcggcaacagcagcagcagcagcagcgtggtgatccccaccagaaccagcgccgaggcccccagccaccacctgcagcagcagcagcagcagcagagactgatgaagagcgagagcatgcccgtgcagctgaacaagggcctgagcagcaagaacatcagcagcagccccagcgtggagagcctgcccggcggcagagagttcaccggcagcccccccagcagcgccaccaagaaggacagcttcttcagcaacatcagcagaagcagaagccacagcaagaccatgggcagaaaggagagcgaggaggagctggaggcccagatcagcttcctgcagggccagctgaacgacctggacgccatgtgcaagtactgcgccaaggtgatggacacccacctggtgaacatccaggacgtgatcctgcaggagaacctggagaaggaggaccagatcctggtgagcctggccggcctgaagcagatcaaggacatcctgaagggcagcctgagattcaaccagagccagctggaggccgaggagaacgagcagatcaccatcgccgacaaccactactgcagcagcggccagggccagggcagaggccagggccagagcgtgcagatgagcggcgccatcaagcaggccagcagcgagacccccggctgcaccgacagaggcaacagcgacgacttcatcctgatcagcaaggacgacgacggcagcagcgccagaggcagcttcagcggccaggcccagcccctgagaaccctgagaagcaccagcggcaagagccaggcccccgtgtgcagccccctggtgttcagcgaccccctgatgggccccgccagcgccagcagcagcaaccccagcagcagccccgacgacgacagcagcaaggacagcggcttcaccatcgtgagccccctggacatctag

SEQ ID NO: 25041 - DNA, 552 bp, Artificial Sequence
  Description of Artificial Sequence: Synthetic coding sequence
atgtaccacagcctgagcgagaccagacaccccctgcagcccgaggagcaggaggtgggcatcgaccccctgagcagctacagcaacaagagcggcggcgacagcaacaagaacggcagaagaaccagcagcaccctggacagcgagggcaccttcaacagctacagaaaggagtgggaggagctgttcgtgaacaacaactacctggccaccatcagacagaagggcatcaacggccagctgagaagcagcagattcagaagcatctgctggaagctgttcctgtgcgtgctgccccaggacaagagccagtggatcagcagaatcgaggagctgagagcctggtacagcaacatcaaggagatccacatcaccaaccccagaaaggtggtgggccagcaggacctgatgatcaacaaccccctgagccaggacgagggcagcctgtggaacaagttcttccaggacaaggagctgagaagcatgatcgagcaggacgtgaagagaaccttccccgagatgcagttcttccagcaggagaacgtgagatag

SEQ ID NO: 25042 - DNA, 2388 bp, Artificial Sequence; identical to SEQ ID NO: 25040
  Description of Artificial Sequence: Synthetic coding sequence

SEQ ID NO: 25043 - DNA, 267 bp, Artificial Sequence
  Description of Artificial Sequence: Synthetic coding sequence
atgtaccacagcctgagcgagaccagacaccccctgcagcccgaggagcaggaggtgggcatcgaccccctgagcagctacagcaacaagagcggcggcgacagcaacaagaacggcagaagaaccagcagcaccctggacagcgagggcaccttcaacagctacagaaaggagtgggaggagctgttcgtgaacaacaactacctggccaccatcagacagaagggcatcaacggccagctgagaagcagcagattcagaagctag

SEQ ID NO: 25044 - DNA, 3423 bp, Artificial Sequence
  Description of Artificial Sequence: Synthetic coding sequence
atgtggctgaagcccgaggaggtgctgctgaagaacgccctgaagctgtgggtgacccagaagagcagctgctacttcatcctgcagagaagaagaggccacggcgagggcggcggcagactgaccggcagactggtgggcgccctggacgccgtgctggacagcaacgccagagtggcccccttcagaatcctgctgcaggtgcccggcagccaggtgtacagccccatcgcctgcggcgccaccctggaggagatcaaccagcactgggactggctggagcagaacctgctgcacaccctgagcgtgttcgacaacaaggacgacatcgccagcttcgtgaagggcaaggtgaaggccctgatcgccgaggagaccagcagcagactggccgagcaggaggaggagcccgagaagttcagagaggccctggtgaagttcgaggccagattcaacttccccgaggccgagaagctggtgacctactacagctgctgctgctggaagggcagagtgcccagacagggctggctgtacctgagcatcaaccacctgtgcttctacagcttcttcctgggcaaggagctgaagctggtggtgccctgggtggacatccagaagctggagagaaccagcaacgtgttcctgaccgacaccatcagaatcaccacccagaacaaggagagagacttcagcatgttcctgaacctggacgaggtgttcaaggtgatggagcagctggccgacgtgaccctgagaagactgctggacaacgaggtgttcgacctggaccccgacctgcaggagcccagccagatcaccaagagagacctggaggccagagcccagaacgagttcttcagagccttcttcagactgcccagaaaggagaagctgcacgccgtggtggactgcagcctgtggacccccttcagcagatgccacaccaccggcagaatgttcgccagcgacagctacatctgcttcgccagcagagaggacggctgctgcaagatcatcctgcccctgagagaggtggtgagcatcgagaagatggaggacaccagcctgctgccccaccccatcatcgtgagcatcagaagcaaggtggccttccagttcatcgagctgagagacagagacagcctggtggaggccctgctggccagactgaagcaggtgcacgccaaccaccccgtgcactacgacaccagcgccgacgacgacatggccagcctggtgttccacagcaccagcatgtgcagcgaccacagattcggcgacctggagatgatgagcagccagaacagcgaggagagcgagaaggagaagagccccctgatgcaccccgacgccctggtgaccgccttccagcagagcggcagccagagccccgacagcagaatgagcagagagcagatcaagatcagcctgtggaacgaccacttcgtggagtacggcagaaccgtgtgcatgttcagaaccgagaagatcagaaagctggtggccatgggcatccccgagagcctgagaggcagactgtggctgctgttcagcgacgccgtgaccgacctggccagccaccccggctactacggcaacctggtggaggagagcctgggcaagtgctgcctggtgaccgaggagatcgagagagacctgcacagaagcctgcccgagcaccccgccttccagaacgagaccggcatcgccgccctgagaagagtgctgaccgcctacgcccacagaaaccccaagatcggctactgccagagcatgaacatcctgaccagcgtgctgctgctgtacaccaaggaggaggaggccttctggctgctggtggccgtgtgcgagagaatgctgcccgactacttcaaccacagagtgatcggcgcccaggtggaccagagcgtgttcgaggagctgatcaagggccacctgcccgagctggccgagcacatgaacgacctgagcgccctggccagcgtgagcctgagctggttcctgaccctgttcctgagcatcatgcccctggagagcgccgtgaacgtggtggactgcttcttctacgacggcatcaaggccatcttccagctgggcctggccgtgctggaggccaacgccgaggacctgtgcagcagcaaggacgacggccaggccctgatgatcctgagcagattcctggaccacatcaagaacgaggacagccccggcccccccgtgggcagccaccacgccttcttcagcgacgaccaggagccctaccccgtgaccgacatcagcgacctgatcagagacagctacgagaagttcggcgaccagagcgtggagcagatcgagcacctgagatacaagcacagaatcagagtgctgcagggccacgaggacaccaccaagcagaacgtgctgagagtggtgatccccgaggtgagcatcctgcccgaggacctggaggagctgtacgacctgttcaagagagagcacatgatgagctgctactgggagcagcccagacccatggccagcagacacgaccccagcagaccctacgccgagcagtacagaatcgacgccagacagttcgcccacctgttccagctggtgagcccctggacctgcggcgcccacaccgagatcctggccgagagaaccttcagactgctggacgacaacatggaccagctgatcgagttcaaggccttcgtgagctgcctggacatcatgtacaacggcgagatgaacgagaagatcaagctgctgtacagactgcacatcccccccgccctgaccgagaacgacagagacagccagagccccctgagaaaccccctgctgagcaccagcagacccctggtgttcggcaagcccaacggcgacgccgtggactaccagaagcagctgaagcagatgatcaaggacctggccaaggagaaggacaagaccgagaaggagctgcccaagatgagccagagagagttcatccagttctgcaagaccctgtacagcatgttccacgaggaccccgaggagaacgacctgtaccaggccatcgccaccgtgaccaccctgctgctgcagatcggcgaggtgggccagagaggcagcagcagcggcagctgcagccaggagtgcggcgaggagctgagagccagcgcccccagccccgaggacagcgtgttcgccgacaccggcaagaccccccaggacagccaggccttccccgaggccgccgagagagactggaccgtgagcctggagcacatcctggccagcctgctgaccgagcagagcctggtgaacttcttcgagaagcccctggacatgaagagcaagctggagaacgccaagatcaaccagtacaacctgaagaccttcgagatgagccaccagagccagagcgagctgaagctgagcaacctgtag

SEQ ID NO: 25045 - DNA, 3468 bp, Artificial Sequence
  Description of Artificial Sequence: Synthetic coding sequence
atgtggctgaagcccgaggaggtgctgctgaagaacgccctgaagctgtgggtgacccagaagagcagctgctacttcatcctgcagagaagaagaggccacggcgagggcggcggcagactgaccggcagactggtgggcgccctggacgccgtgctggacagcaacgccagagtggcccccttcagaatcctgctgcaggtgcccggcagccaggtgtacagccccatcgcctgcggcgagctgctgaacggcagcgacgtgtactgggccatcgccaccggcgccaccctggaggagatcaaccagcactgggactggctggagcagaacctgctgcacaccctgagcgtgttcgacaacaaggacgacatcgccagcttcgtgaagggcaaggtgaaggccctgatcgccgaggagaccagcagcagactggccgagcaggaggaggagcccgagaagttcagagaggccctggtgaagttcgaggccagattcaacttccccgaggccgagaagctggtgacctactacagctgctgctgctggaagggcagagtgcccagacagggctggctgtacctgagcatcaaccacctgtgcttctacagcttcttcctgggcaaggagctgaagctggtggtgccctgggtggacatccagaagctggagagaaccagcaacgtgttcctgaccgacaccatcagaatcaccacccagaacaaggagagagacttcagcatgttcctgaacctggacgaggtgttcaaggtgatggagcagctggccgacgtgaccctgagaagactgctggacaacgaggtgttcgacctggaccccgacctgcaggagcccagccagatcaccaagagagacctggaggccagagcccagaacgagttcttcagagccttcttcagactgcccagaaaggagaagctgcacgccgtggtggactgcagcctgtggacccccttcagcagatgccacaccaccggcagaatgttcgccagcgacagctacatctgcttcgccagcagagaggacggctgctgcaagatcatcctgcccctgagagaggtggtgagcatcgagaagatggaggacaccagcctgctgccccaccccatcatcgtgagcatcagaagcaaggtggccttccagttcatcgagctgagagacagagacagcctggtggaggccctgctggccagactgaagcaggtgcacgccaaccaccccgtgcactacgacaccagcgccgacgacgacatggccagcctggtgttccacagcaccagcatgtgcagcgaccacagattcggcgacctggagatgatgagcagccagaacagcgaggagagcgagaaggagaagagccccctgatgcaccccgacgccctggtgaccgccttccagcagagcggcagccagagccccgacagcagaatgagcagagagcagatcaagatcagcctgtggaacgaccacttcgtggagtacggcagaaccgtgtgcatgttcagaaccgagaagatcagaaagctggtggccatgggcatccccgagagcctgagaggcagactgtggctgctgttcagcgacgccgtgaccgacctggccagccaccccggctactacggcaacctggtggaggagagcctgggcaagtgctgcctggtgaccgaggagatcgagagagacctgcacagaagcctgcccgagcaccccgccttccagaacgagaccggcatcgccgccctgagaagagtgctgaccgcctacgcccacagaaaccccaagatcggctactgccagagcatgaacatcctgaccagcgtgctgctgctgtacaccaaggaggaggaggccttctggctgctggtggccgtgtgcgagagaatgctgcccgactacttcaaccacagagtgatcggcgcccaggtggaccagagcgtgttcgaggagctgatcaagggccacctgcccgagctggccgagcacatgaacgacctgagcgccctggccagcgtgagcctgagctggttcctgaccctgttcctgagcatcatgcccctggagagcgccgtgaacgtggtggactgcttcttctacgacggcatcaaggccatcttccagctgggcctggccgtgctggaggccaacgccgaggacctgtgcagcagcaaggacgacggccaggccctgatgatcctgagcagattcctggaccacatcaagaacgaggacagccccggcccccccgtgggcagccaccacgccttcttcagcgacgaccaggagccctaccccgtgaccgacatcagcgacctgatcagagacagctacgagaagttcggcgaccagagcgtggagcagatcgagcacctgagatacaagcacagaatcagagtgctgcagggccacgaggacaccaccaagcagaacgtgctgagagtggtgatccccgaggtgagcatcctgcccgaggacctggaggagctgtacgacctgttcaagagagagcacatgatgagctgctactgggagcagcccagacccatggccagcagacacgaccccagcagaccctacgccgagcagtacagaatcgacgccagacagttcgcccacctgttccagctggtgagcccctggacctgcggcgcccacaccgagatcctggccgagagaaccttcagactgctggacgacaacatggaccagctgatcgagttcaaggccttcgtgagctgcctggacatcatgtacaacggcgagatgaacgagaagatcaagctgctgtacagactgcacatcccccccgccctgaccgagaacgacagagacagccagagccccctgagaaaccccctgctgagcaccagcagacccctggtgttcggcaagcccaacggcgacgccgtggactaccagaagcagctgaagcagatgatcaaggacctggccaaggagaaggacaagaccgagaaggagctgcccaagatgagccagagagagttcatccagttctgcaagaccctgtacagcatgttccacgaggaccccgaggagaacgacctgtaccaggccatcgccaccgtgaccaccctgctgctgcagatcggcgaggtgggccagagaggcagcagcagcggcagctgcagccaggagtgcggcgaggagctgagagccagcgcccccagccccgaggacagcgtgttcgccgacaccggcaagaccccccaggacagccaggccttccccgaggccgccgagagagactggaccgtgagcctggagcacatcctggccagcctgctgaccgagcagagcctggtgaacttcttcgagaagcccctggacatgaagagcaagctggagaacgccaagatcaaccagtacaacctgaagaccttcgagatgagccaccagagccagagcgagctgaagctgagcaacctgtag

SEQ ID NO: 25046 - DNA, 1899 bp, Artificial Sequence
  Description of Artificial Sequence: Synthetic coding sequence
atgtggctgaagcccgaggaggtgctgctgaagaacgccctgaagctgtggctgatggagagaagcaacgactacttcgtgctgcagagaagaagaggctacggcgaggagggcggcggcggcctgaccggcctgctggtgggcaccctggacagcgtgctggacagcaccgccaaggtggcccccttcagaatcctgcaccagacccccgacagccaggtgtacctgagcatcgcctgcggcgccaacagagaggagatcaccaagcactgggactggctggagcagaacatcatgaagaccctgagcgtgttcgacagcaacgaggacatcaccaacttcgtgcagggcaagatcagaggcctgatcgccgaggagggcaagcactgcttcgccaaggaggacgaccccgagaagttcagagaggccctgctgaagttcgagaagtgcttcggcctgcccgagaaggagaagctggtgacctactacagctgcagctactggaagggcagagtgccctgccagggctggctgtacctgagcaccaacttcctgagcttctacagcttcctgctgggcagcgagatcaagctgatcatcagctgggacgaggtgagcaagctggagaagaccagcaacgtgatcctgaccgagagcatccacgtgtgcagccagggcgagaaccactacttcagcatgttcctgcacatcaaccagacctacctgctgatggagcagctggccaactacgccatcagaagactgttcgacaaggagaccttcgacaacgaccccgtgctgtacaaccccctgcagatcaccaagagaggcctggagaacagagcccacagcgagcagttcaacgccttcttcagactgcccaagggcgagagcctgaaggaggtgcacgagtgcttcctgtgggtgcccttcagccacttcaacacccacggcaagatgtgcatcagcgagaactacatctgcttcgccagccaggacggcaaccagtgcagcgtgatcatccccctgagagaggtgctggccatcgacaagaccaacgacagcagcaagagcgtgatcatcagcatcaagggcaagaccgccttcagattccacgaggtgaaggacttcgagcagctggtggccaagctgagactgagatgcggcgccgccagcacccagtaccacgacatcagcaccgagctggccatcagcagcgagagcaccgagcccagcgacaacttcgaggtgcagagcctgaccagccagagagagtgcagcaagaccgtgaacaccgaggccctgatgaccgtgttccacccccagaacctggagaccctgaacagcaagatgctgaaggagaagatgaaggagcagagctggaagatcctgttcgccgagtgcggcagaggcgtgagcatgttcagaaccaagaagaccagagacctggtggtgagaggcatccccgagaccctgagaggcgagctgtggatgctgttcagcggcgccgtgaacgacatggccaccaaccccgactactacaccgaggtggtggagcagagcctgggcacctgcaacctggccaccgaggagatcgagagagacctgagaagaagcctgcccgagcaccccgccttccagagcgacaccggcatcagcgccctgagaagagtgctgaccgcctacgcctacagaaaccccaagatcggctactgccaggccatgaacatcctgaccagcgtgctgctgctgtacgccaaggaggaggaggccttctggctgctggtggccgtgtgcgagagaatgctgcccgactacttcaacagaagaatcatcggcagcgacgacttcatgcccctggtgagaatccagggccagtgcgtgatcggcgagaagtag

SEQ ID NO: 25047 - DNA, 3363 bp, Artificial Sequence
  Description of Artificial Sequence: Synthetic coding sequence
atgtggctgaagcccgaggaggtgctgctgaagaacgccctgaagctgtggctgatggagagaagcaacgactacttcgtgctgcagagaagaagaggctacggcgaggagggcggcggcggcctgaccggcctgctggtgggcaccctggacagcgtgctggacagcaccgccaaggtggcccccttcagaatcctgcaccagacccccgacagccaggtgtacctgagcatcgcctgcggcgccaacagagaggagatcaccaagcactgggactggctggagcagaacatcatgaagaccctgagcgtgttcgacagcaacgaggacatcaccaacttcgtgcagggcaagatcagaggcctgatcgccgaggagggcaagcactgcttcgccaaggaggacgaccccgagaagttcagagaggccctgctgaagttcgagaagtgcttcggcctgcccgagaaggagaagctggtgacctactacagctgcagctactggaagggcagagtgccctgccagggctggctgtacctgagcaccaacttcctgagcttctacagcttcctgctgggcagcgagatcaagctgatcatcagctgggacgaggtgagcaagctggagaagaccagcaacgtgatcctgaccgagagcatccacgtgtgcagccagggcgagaaccactacttcagcatgttcctgcacatcaaccagacctacctgctgatggagcagctggccaactacgccatcagaagactgttcgacaaggagaccttcgacaacgaccccgtgctgtacaaccccctgcagatcaccaagagaggcctggagaacagagcccacagcgagcagttcaacgccttcttcagactgcccaagggcgagagcctgaaggaggtgcacgagtgcttcctgtgggtgcccttcagccacttcaacacccacggcaagatgtgcatcagcgagaactacatctgcttcgccagccaggacggcaaccagtgcagcgtgatcatccccctgagagaggtgctggccatcgacaagaccaacgacagcagcaagagcgtgatcatcagcatcaagggcaagaccgccttcagattccacgaggtgaaggacttcgagcagctggtggccaagctgagactgagatgcggcgccgccagcacccagtaccacgacatcagcaccgagctggccatcagcagcgagagcaccgagcccagcgacaacttcgaggtgcagagcctgaccagccagagagagtgcagcaagaccgtgaacaccgaggccctgatgaccgtgttccacccccagaacctggagaccctgaacagcaagatgctgaaggagaagatgaaggagcagagctggaagatcctgttcgccgagtgcggcagaggcgtgagcatgttcagaaccaagaagaccagagacctggtggtgagaggcatccccgagaccctgagaggcgagctgtggatgctgttcagcggcgccgtgaacgacatggccaccaaccccgactactacaccgaggtggtggagcagagcctgggcacctgcaacctggccaccgaggagatcgagagagacctgagaagaagcctgcccgagcaccccgccttccagagcgacaccggcatcagcgccctgagaagagtgctgaccgcctacgcctacagaaaccccaagatcggctactgccaggccatgaacatcctgaccagcgtgctgctgctgtacgccaaggaggaggaggccttctggctgctggtggccgtgtgcgagagaatgctgcccgactacttcaacagaagaatcatcggcgccctggtggaccaggccgtgttcgaggagctgatcagagaccacctgccccagctgaccgagcacatgaccgacatgaccttcttcagcagcgtgagcctgagctggttcctgaccctgttcatcagcgtgctgcccatcgagagcgccgtgaacgtggtggactgcttcttctacgacggcatcaaggccatcctgcagctgggcctggccatcctggactacaacctggacaagctgctgacctgcaaggacgacgccgaggccgtgaccgccctgaacagattcttcgacaacgtgaccaacaaggacagccccctgcccagcaacgtgcagcagggcagcaacgtgagcgacgagaagaccagccacaccagagtggacatcaccgacctgatcagagagagcaacgagaagtacggcaacatcagatacgaggacatccacagcatgagatgcagaaacagactgtacgtgatccagaccctggaggagaccaccaagcagaacgtgctgagagtggtgagccaggacgtgaagctgagcctgcaggagctggacgagctgtacgtgatcttcaagaaggagctgttcctgagctgctactggtgcctgggctgccccgtgctgaagcaccacgaccccagcctgccctacctggagcagtaccagatcgactgccagcagttcagagccctgtaccacctgctgagcccctgggcccacagcgccaacaaggacagcctggccctgtggaccttcagactgctggacgagaacagcgactgcctgatcaacttcaaggagttcagcagcgccatcgacatcatgtacaacggcagcttcaccgagaagctgaagctgctgttcaagctgcacatcccccccgcctacaccgaggtgaagagcaaggacgccagcaagggcgacgagctgagcaaggaggagctgctgtacttcagccagctgcacgtgagcaagcccgccaacgagaaggaggccgagagcgccaagcacagccccgagaagggcaagggcaagatcgacatccaggcctacctgagccagtggcaggacgagctgttcaagaaggaggagaacatcaaggacctgcccagaatgaaccagagccagttcatccagttcagcaagaccctgtacaacctgttccacgaggaccccgaggaggagagcctgtaccaggccatcgccgtggtgaccagcctgctgctgagaatggaggaggtgggcagaaagctgcacagccccaccagcagcgccaagggcttcagcggcaccgtgtgcggcagcggcggccccagcgaggagaagaccggcagccacctggagaaggacccctgcagcttcagagaggagccccagtggagcttcgccttcgagcagatcctggccagcctgctgaacgagcccgccctggtgagattcttcgagaagcccatcgacgtgaaggccaagctggagaacgccagaatcagccagctgagaagcagaaccaagatgtag

SEQ ID NO: 25048 - DNA, 654 bp, Artificial Sequence
  Description of Artificial Sequence: Synthetic coding sequence
ttcaacagattcttcgacaacgtgaccaacaaggacagccccctgcccagcaacgtgcagcagggcagcaacgtgagcgacgagaagaccagccacaccagagtggacatcaccgacctgatcagagagagcaacgagctgagagtggtgagccaggacgtgaagctgagcctgcaggagctggacgagctgtacgtgatcttcaagaaggagctgttcctgagctgctactggtgcctgggctgccccgtgctgaagcaccacgaccccagcctgccctacctggagcagtaccagatcgactgccagcagttcagagccctgtaccacctgctgagcccctgggcccacagcgccaacaaggacagcctggccctgtggaccttcagactgctggacgagaacagcgactgcctgatcaacttcaaggagttcagcagcgccatcgacatcatgtacaacggcagcttcaccgagaagctgaagctgctgttcaagctgcacatcccccccgcctacaccgaggtgaagagcaaggacgccagcaagggcgacgagctgagcaaggaggagctgctgtacttcagccagctgcacgtgagcaagcccgccaacgagaaggaggccgagagcgccaagcacagccccgagtag

SEQ ID NO: 25049 - DNA, 3801 bp, Artificial Sequence
  Description of Artificial Sequence: Synthetic coding sequence
atgtgggtgaaccccgaggaggtgctgctggccaacgccctgtggatcaccgagagagccaacccctacttcatcctgcagagaagaaagggccacgccggcgacggcggcggcggcggcggcctggccggcctgctggtgggcaccctggacgtggtgctggacagcagcgccagagtggccccctacagaatcctgtaccagacccccgacagcctggtgtactggaccatcgcctgcggcggcagcagaaaggagatcaccgagcactgggagtggctggagcagaacctgctgcagaccctgagcatcttcgagaacgagaacgacatcaccaccttcgtgagaggcaagatccagggcatcatcgccgagtacaacaagatcaacgacgtgaaggaggacgacgacaccgagaagttcaaggaggccatcgtgaagttccacagactgttcggcatgcccgaggaggagaagctggtgaactactacagctgcagctactggaagggcaaggtgcccagacagggctggatgtacctgagcatcaaccacctgtgcttctacagcttcctgatgggcagagaggccaagctggtgatcagatgggtggacatcacccagctggagaagaacgccaccctgctgctgcccgacgtgatcaaggtgagcaccagaagcagcgagcacttcttcagcgtgttcctgaacatcaacgagaccttcaagctgatggagcagctggccaacatcgccatgagacagctgctggacaacgagggcttcgagcaggacagaagcctgcccaagctgaagagaaagagccccaagaaggtgagcgccctgaagagagacctggacgccagagccaagagcgagagatacagagccctgttcagactgcccaaggacgagaagctggacggccacaccgactgcaccctgtggacccccttcaacaagatgcacatcctgggccagatgttcgtgagcaccaactacatctgcttcaccagcaaggaggagaacctgtgcagcctgatcatccccctgagagaggtgaccatcgtggagaaggccgacagcagcagcgtgctgcccagccccctgagcatcagcaccagaaacagaatgaccttcctgttcgccaacctgaaggacagagacttcctggtgcagagaatcagcgacttcctgcagcagaccaccagcaagatctacagcgacaaggagttcgccggcagctacaacagcagcgacgacgaggtgtacagcagacccagcagcctggtgagcagcagcccccagagaagcaccagcagcgacgccgacggcgagagacagttcaacctgaacggcaacagcgtgcccaccgccacccagaccctgatgaccatgtacagaagaagaagccccgaggagttcaaccccaagctggccaaggagttcctgaaggagcaggcctggaagatccacttcgccgagtacggccagggcatctgcatgtacagaaccgagaagaccagagagctggtgctgaagggcatccccgagagcatgagaggcgagctgtggctgctgctgagcggcgccatcaacgagaaggccacccaccccggctactacgaggacctggtggagaagagcatgggcaagtacaacctggccaccgaggagatcgagagagacctgcacagaagcctgcccgagcaccccgccttccagaacgagatgggcatcgccgccctgagaagagtgctgaccgcctacgccttcagaaaccccaacatcggctactgccaggccatgaacatcgtgaccagcgtgctgctgctgtacgccaaggaggaggaggccttctggctgctggtggccctgtgcgagagaatgctgcccgactactacaacaccagagtggtgggcgccctggtggaccagggcgtgttcgaggagctggccagagactacgtgccccagctgtacgactgcatgcaggacctgggcgtgatcagcaccatcagcctgagctggttcctgaccctgttcctgagcgtgatgcccttcgagagcgccgtggtggtggtggactgcttcttctacgagggcatcaaggtgatcttccagctggccctggccgtgctggacgccaacgtggacaagctgctgaactgcaaggacgacggcgaggccatgaccgtgctgggcagatacctggacagcgtgaccaacaaggacagcaccctgccccccatcccccacctgcacagcctgctgagcgacgacgtggagccctaccccgaggtggacatcttcagactgatcagaaccagctacgagaagttcggcaccatcagagccgacctgatcgagcagatgagattcaagcagagactgaaggtgatccagaccctggaggacaccaccaagagaaacgtggtgagaaccatcgtgaccgagaccagcttcaccatcgacgagctggaggagctgtacgccctgttcaaggccgagcacctgaccagctgctactggggcggcagcagcaacgccctggacagacacgaccccagcctgccctacctggagcagtacagaatcgacttcgagcagttcaagggcatgttcgccctgctgttcccctgggcctgcggcacccacagcgacgtgctggccagcagactgttccagctgctggacgagaacggcgacagcctgatcaacttcagagagttcgtgagcggcctgagcgccgcctgccacggcgacctgaccgagaagctgaagctgctgtacaagatgcacgtgctgcccgagcccagcagcgaccaggacgagcccgacagcgccttcgaggccacccagtacttcttcgaggacatcacccccgagtgcacccacgtggtgggcctggacagcagaagcaagcagggcgccgacgacggcttcgtgaccgtgagcctgaagcccgacaagggcaagagagccaacagccaggagaacagaaactacctgagactgtggacccccgagaacaagagcaagagcaagaacgccaaggacctgcccaagctgaaccagggccagttcatcgagctgtgcaagaccatgtacaacatgttcagcgaggaccccaacgagcaggagctgtaccacgccaccgccgccgtgaccagcctgctgctggagatcggcgaggtgggcaagctgttcgtggcccagcccgccaaggagggcggcagcggcggcagcggccccagctgccaccagggcatccccggcgtgctgttccccaagaagggccccggccagccctacgtggtggagagcgtggagcccctgcccgccagcctggcccccgacagcgaggagcacagcctgggcggccagatggaggacatcaagctggaggacagcagccccagagacaacggcgcctgcagcagcatgctgatcagcgacgacgacaccaaggacgacagcagcatgagcagctacagcgtgctgagcgccggcagccacgaggaggacaagctgcactgcgaggacatcggcgaggacaccgtgctggtgagaagcggccagggcaccgccgccctgcccagaagcaccagcctggacagagactgggccatcaccttcgagcagttcctggccagcctgctgaccgagcccgccctggtgaagtacttcgacaagcccgtgtgcatgatggccagaatcaccagcgccaagaacatcagaatgatgggcaagcccctgaccagcgccagcgactacgagatcagcgccatgagcggctag

SEQ ID NO: 25050 - DNA, 1848 bp, Artificial Sequence
  Description of Artificial Sequence: Synthetic coding sequence
atggagagcatgttcgaggacgacatcagcatcctgacccaggaggccctgggccccagcgaggtgtggctggacagccccggcgaccccagcctgggcggcgacatgtgcagcgccagccacttcgccctgatcaccgcctacggcgacatcaaggagagactgggcggcctggagagagagaacgccaccctgagaagaagactgaaggtgtacgagatcaagtaccccctgatcagcgacttcggcgaggagcacggcttcagcctgtacgagatcaaggacggcagcctgctggaggtggagaaggtgagcctgcagcagagactgaaccagttccagcacgagctgcagaagaacaaggagcaggaggagcagctgggcgagatgatccaggcctacgagaagctgtgcgtggagaagagcgacctggagaccgagctgagagagatgagagccctggtggagacccacctgagacagatctgcggcctggagcagcagctgagacagcagcagggcctgcaggacgccgccttcagcaacctgagccccccccccgcccccgcccccccctgcaccgacctggacctgcactacctggccctgagaggcggcagcggcctgagccacgccggctggcccggcagcacccccagcgtgagcgacctggagagaagaagactggaggaggccctggaggccgcccagggcgaggccagaggcgcccagctgagagaggagcagctgcaggccgagtgcgagagactgcagggcgagctgaagcagctgcaggagaccagagcccaggacctggccagcaaccagagcgagagagacatggcctgggtgaagagagtgggcgacgaccaggtgaacctggccctggcctacaccgagctgaccgaggagctgggcagactgagagagctgagcagcctgcagggcagaatcctgagaaccctgctgcaggagcaggccagaagcggcggccagagacacagccccctgagccagagacacagccccgccccccagtgccccagccccagcccccccgccagagccgcccccccctgccccccctgccagagccccgtgccccagagaagaagccccgtgcccccctgccccagcccccagcagagaagaagccccgccagccccagctgccccagccccgtgccccagagaagaagccccgtgccccccagctgccagagccccagcccccagagaagaagccccgtgccccccagctgccccgccccccagcccagacccccccccccccccccccccggcgagagaaccctggccgagagagcctacgccaagccccccagccaccacgtgaaggccggcttccagggcagaagaagctacagcgagctggccgagggcgccgcctacgccggcgccagccccccctggctgcaggccgaggccgccaccctgcccaagcccagagcctacggcagcgagctgtacggccccggcagacccctgagccccagaagagccttcgagggcatcagactgagattcgagaagcagcccagcgaggaggacgagtgggccgtgcccaccagcccccccagccccgaggtgggcaccatcagatgcgccagcttctgcgccggcttccccatccccgagagccccgccgccaccgcctacgcccacgccgagcacgcccagagctggcccagcatcaacctgctgatggagaccgtgggcagcgacatcagaagctgccccctgtgccagctgggcttccccgtgggctaccccgacgacgccctgatcaagcacatcgacagccacctggagaacagcaagatctag

SEQ ID NO: 25051 - DNA, 672 bp, Artificial Sequence
  Description of Artificial Sequence: Synthetic coding sequence
atggagagcatgttcgaggacgacatcagcatcctgacccaggaggccctgggccccagcgaggtgtggctggacagccccggcgaccccagcctgggcggcgacatgtgcagcgccagccacttcgccctgatcaccgcctacggcgacatcaaggagagactgggcggcctggagagagagaacgccaccctgagaagaagactgaaggtgtacgagatcaagtaccccctgatcagcgacttcggcgaggagcacggcttcagcctgtacgagatcaaggacggcagcctgctggaggtggagaaggtgagcctgcagcagagactgaaccagttccagcacgagctgcagaagaacaaggagcaggaggagcagctgggcgagatgatccaggcctacgagaagctgtgcgtggagaagagcgacctggagaccgagctgagagagatgagagccctggtggagacccacctgagacagatctgcggcctggagcagcagctgagacagcagcagggcctgcaggacgccgccttcagcaacctgagcccccccagaagagccagagccgtgctggccgtgcaccagctggccgacggcgacggcggcctgagacacccccagctgccccccctgcccgccggcttcccctgcagagtgcccggctag

SEQ ID NO: 25052 - DNA, 1062 bp, Artificial Sequence
  Description of Artificial Sequence: Synthetic coding sequence
atgctggagggccagctggaggccagagagcccaaggagggcacccaccccgaggacccctgccccggcgccggcgccgccatggagaagacccccgccgccgccgaggtgcccagagaggacagcaacgccggcgagatgcccagcctgcagcagcagatcaccagcctgcaccaggagctgggcagacagcagagcctgtgggccgacatccacagaaagctgcagagccacatggacgccctgagaaagcagaacagagagctgagagaggagctgagaggcctgcagagacagcagtgggaggccggcaagaagcccgccgccagcccccacgccggcagagagagccacaccctggccctggagcccgccttcggcaagatcagccccctgagcgccgacgaggagaccacccccaagtacgccggcagaaagagccagagcgccaccctgctgggccagagatggagcagcaaccacctggccccccccaagcccatgagcctgaagaccgagagaatcaacagcggcaagacccccccccaggaggacagagagaagagcccccccggcagaagacaggacagaagccccgcccccaccggcagacccacccccggcgccgagagaagagaggtgagcgaggacggcaagatcatgcaccccagcagcagaagcctgcagaacagcggcggcagaaagagccccgtgcaggccagccaggccgccaccctgcaggagcagaccgccgccgccggcgtggccgacagaagcagcagcgtgctgggcagcagcgagggcggcttcctgagcagagtgcaggccgaggagttcgccagcagcagccccgacagcgccgagagacagaacctgcccgtgaacccccccagcagcctggagatcgcccaggccatggacaccaagatgaagaaggaggaggtgcaggaggagaagagacaccccaacggcaaggccgacgactgcagaagaagcggcttccccagcgagttccccggcgccctgcacgccgcccccagcagacaggacatgggcccctag

SEQ ID NO: 25053 - DNA, 1125 bp, Artificial Sequence
  Description of Artificial Sequence: Synthetic coding sequence
atgaaggtggacatggccaacttcgccatcagcagcatcagaccccacctgatgcagcagagcgtggagtacgagagaaagaagttccaggagatcctggagagacagcccaacagcctggacttcgtgacccagtggctggaggaggccagcgaggacctgatgacccagaagtacaagcacgccctgcccgtgggcggcatggccgccggcagcggcgacatgcccagactgagccccgtggccgtgcagaactacgcctacctgaagctgctgaagtgggaccacctgcagagacccttccccgagaccgtgctgatggaccagagcagattccacgagctgcagctgcagctggagcagctgaccatcctgggcgccgtgctgctggtgaccttcagcatggccgcccccggcatcagcagccaggccgacttcgccgagaagctgaagatgatcgtgaagatcctgctgaccgacatgcacctgcccagcttccacctgaaggacgtgctgaccaccatcggcgagaaggtgtgcctggaggtgagcagctgcctgagcctgtgcggcagcagccccttcaccaccgacaaggagaccgtgctgaagggccagatccaggccgtggccagccccgacgaccccatcagaagaatcatggagagcagaatcctgaccttcctggagacctacctggccagcggccaccagaagcccctgcccaccgtgcccggcggcctgagccccgtgcagagagagctggaggaggtggccatcaagttcgccagactggtgaactacaacaagatggtgttctgcccctactacgacgccatcctgagaaagagatggatcagcttcggcaacttcttcggcagcagcaacaccgacatgagcccctggaactgcagaaccgactaccccatgagcctgcacatcagattccccaagaaccacgtgatcgaggcccccatgaccatccagctgtgcttccaggagccctgcaacaaggccctgagcctgctgaacatccccctggaggccaagggcatcctggacagaagcttcctgcagagaagactgaagccctacagaatcagattctgctgcagagccctgtag

SEQ ID NO: 25054 - DNA, 1530 bp, Artificial Sequence
  Description of Artificial Sequence: Synthetic coding sequence
atgagcgagaacctggacaagagcaacgtgaacgaggccggcaagagcaagagcaacgacagcgaggagggcctggaggacgccgtggagggcgccgacgaggccctgcagaaggccatcaagagcgacagcagcagcccccagagagtgcagagaccccacagcagcccccccagattcgtgaccgtggaggagctgctggagaccgccagaggcgtgaccaacatggccctggcccacgagatcgtggtgaacggcgacttccagatcaagcccgtggagctgcccgagaacagcctgaagaagagagtgaaggagatcgtgcacaaggccttctgggactgcctgagcgtgcagctgagcgaggacccccccgcctacgaccacgccatcaagctggtgggcgagatcaaggagaccctgctgagcttcctgctgcccggccacaccagactgagaaaccagatcaccgaggtgctggacctggacctgatcaagcaggaggccgagaacggcgccctggacatcagcaagctggccgagttcatcatcggcatgatgggcaccctgtgcgcccccgccagagacgaggaggtgaagaagctgaaggacatcaaggagatcgtgcccctgttcagagagatcttcagcgtgctggacctgatgaaggtggacatggccaacttcgccatcagcagcatcagaccccacctgatgcagcagagcgtggagtacgagagaaagaagttccaggagatcctggagagacagcccaacagcctggacttcgtgacccagtggctggaggaggccagcgaggacctgatgacccagaagtacaagcacgccctgcccgtgggcggcatggccgccggcagcggcgacatgcccagactgagccccgtggccgtgcagaactacgcctacctgaagctgctgaagtgggaccacctgcagagacccttccccgagaccgtgctgatggaccagagcagattccacgagctgcagctgcagctggagcagctgaccatcctgggcgccgtgctgctggtgaccttcagcatggccgcccccggcatcagcagccaggccgacttcgccgagaagctgaagatgatcgtgaagatcctgctgaccgacatgcacctgcccagcttccacctgaaggacgtgctgaccaccatcggcgagaaggtgtgcctggaggtgagcagctgcctgagcctgtgcggcagcagccccttcaccaccgacaaggagaccgtgctgaagggccagatccaggccgtggccagccccgacgaccccatcagaagaatcatggagagcagaatcctgaccttcctggagacctacctggccagcggccaccagaagcccctgcccaccgtgcccggcggcctgagccccgtgcagagagagctggaggaggtggccatcaagttcgccagactggtgaactacaacaagatggtgttctgcccctactacgacgccatcctgagcaagatcctggtgagaagctag

SEQ ID NO: 25055 - DNA, 1530 bp, Artificial Sequence; identical to SEQ ID NO: 25054
  Description of Artificial Sequence: Synthetic coding sequence

SEQ ID NO: 25056 - DNA, 165 bp, Artificial Sequence
  Description of Artificial Sequence: Synthetic coding sequence
atgagcgagaacctggacaagagcaacgtgaacgaggccggcaagagcaagagcaacgacagcgaggagggcctggaggacgccgtggagggcgccgacgaggccctgcagaaggccatcaagagcgacagcagcagcccccagagagtgcagagaccccactag

SEQ ID NO: 25057 - DNA, 435 bp, Artificial Sequence
  Description of Artificial Sequence: Synthetic coding sequence
atgagcgagaacctggacaagagcaacgtgaacgaggccggcaagagcaagagcaacgacagcgaggagggcctggaggacgccgtggagggcgccgacgaggccctgcagaaggccatcaagagcgacagcagcagcccccagagagtgcagagaccccacagcagcccccccagattcgtgaccgtggaggagctgctggagaccgccagaggcgtgaccaacatggccctggcccacgagatcgtggtgaacggcgacttccagatcaagcccgtggagctgcccgagaacagcctgaagaagagagtgaaggagatcgtgcacaaggccttctgggactgcctgagcgtgcagctgagcgaggacccccccgcctacgaccacgccatcaagctggtgggcgagatcaaggagaccctgctgagcttctag

SEQ ID NO: 25058 - DNA, 1530 bp, Artificial Sequence; identical to SEQ ID NO: 25054
  Description of Artificial Sequence: Synthetic coding sequence

SEQ ID NO: 25059 - DNA, 1560 bp, Artificial Sequence
  Description of Artificial Sequence: Synthetic coding sequence
atgcccttcaacggcgagaagcagtgcgtgggcgaggaccagcccagcgacagcgacagcagcagattcagcgagagcatggccagcctgagcgactacgagtgcagcagacagagcttcgccagcgacagcagcagcaagagcagcagccccgccagcaccagcccccccagagtggtgaccttcgacgaggtgatggccaccgccagaaacctgagcaacctgaccctggcccacgagatcgccgtgaacgagaacttccagctgaagcaggaggccctgcccgagaagagcctggccggcagagtgaagcacatcgtgcaccaggccttctgggacgtgctggacagcgagctgaacgccgacccccccgagttcgagcacgccatcaagctgttcgaggagatcagagagatcctgctgagcttcctgacccccggcggcaacagactgagaaaccagatctgcgaggtgctggacaccgacctgatcagacagcaggccgagcacagcgccgtggacatccagggcctggccaactacgtgatcagcaccatgggcaagctgtgcgcccccgtgagagacaacgacatcagagagctgaaggccaccggcaacatcgtggaggtgctgagacagatcttccacgtgctggacctgatgcagatggacatggccaacttcaccatcatgagcctgagaccccacctgcagagacagctggtggagtacgagagaaccaagttccaggagatcctggaggagacccccagcgccctggaccagaccaccgagtggatcaaggagagcgtgaacgaggagctgttcagcctgagcgagagcgccctgacccccggcgccgagaacaccagcaagcccagcctgagccccaccctggtgctgaacaacagctacctgaagctgctgcagtgggactaccagaagaaggagctgcccgagaccctgatgaccgacggcgccagactgcaggagctgaccgagaagctgaaccagctgaagatcatcgcctgcctgagcctgatcaccaacaacatggtgggcgccatcaccggcggcctgcccgagctggccagcagactgaccagaatcagcgccgtgctgctggagggcatgaacaaggagaccttcaacctgaaggaggtgctgaacagcatcggcatccagacctgcgtggaggtgaacaagaccctgatggagagaggcctgcccaccctgaacgccgagatccaggccaacctgatcggccagttcagcagcatcgaggaggaggacaaccccatctggagcctgatcgacaagagaatcaagctgtacatgagaagactgctgtgcctgcccagcccccagaagtgcatgccccccatgcccggcggcctggccgtgatccagcaggagctggaggccctgggcagccagtacgccaacatcgtgaacctgaacaagcaggtgtacggccccttctacgccaacatcctgagaaagctgctgttcaacgaggaggccatgggcaaggtggacgccagcccccccaccaactag

SEQ ID NO: 25060 - DNA, 294 bp, Artificial Sequence
  Description of Artificial Sequence: Synthetic coding sequence
atgcccttcaacggcgagaagcagtgcgtgggcgaggaccagcccagcgacagcgacagcagcagattcagcgagagcatggccagcctgagcgactacgagtgcagcagacagagcttcgccagcgacagcagcagcaagagcagcagccccgccagcaccagcccccccagagtggtgaccttcgacgaggtgatggccaccgccagaaacctgagcaacctgaccctggcccacgagatcgccgtgaacgagaacttccagctgaagcaggaggccctgcccgagaagtag

SEQ ID NO: 25061 - DNA, 57 bp, Artificial Sequence
  Description of Artificial Sequence: Synthetic coding sequence
atgcccttcaacggcgagaagcagtgcgtgggcgaggaccagcccagcgacagctag

SEQ ID NO: 25062 - DNA, 399 bp, Artificial Sequence
  Description of Artificial Sequence: Synthetic coding sequence
atgcccttcaacggcgagaagcagtgcgtgggcgaggaccagcccagcgacagcgacagcagcagattcagcgagagcatggccagcctgagcgactacgagtgcagcagacagagcttcgccagcgacagcagcagcaagagcagcagccccgccagcaccagcccccccagagtggtgaccttcgacgaggtgatggccaccgccagaaacctgagcaacctgaccctggcccacgagatcgccgtgaacgagaacttccagctgaagcaggaggccctgcccgagaagagcctggccggcagagtgaagcacatcgtgcaccaggccttctgggacgtgctggacagcgagctgaacgccgacccccccgagttcgagcacgccatcaagctgtag

SEQ ID NO: 25063 - DNA, 705 bp, Artificial Sequence
  Description of Artificial Sequence: Synthetic coding sequence
atgcccttcaacggcgagaagcagtgcgtgggcgaggaccagcccagcgacagcgacagcagcagattcagcgagagcatggccagcctgagcgactacgagtgcagcagacagagcttcgccagcgacagcagcagcaagagcagcagccccgccagcaccagcccccccagagtggtgaccttcgacgaggtgatggccaccgccagaaacctgagcaacctgaccctggcccacgagatcgccgtgaacgagaacttccagctgaagcaggaggccctgcccgagaagagcctggccggcagagtgaagcacatcgtgcaccaggccttctgggacgtgctggacagcgagctgaacgccgacccccccgagttcgagcacgccatcaagctgttcgaggagatcagagagatcctgctgagcttcctgacccccggcggcaacagactgagaaaccagatctgcgaggtgctggacaccgacctgatcagacagcaggccgagcacagcgccgtggacatccagggcctggccaactacgtgatcagcaccatgggcaagctgtgcgcccccgtgagagacaacgacatcagagagctgaaggccaccggcaacatcgtggaggtgctgagacagatcttccacgtgctggacctgatgcagatggacatggccaacttcaccatcatgagcctgagatag

SEQ ID NO: 25064 - DNA, 57 bp, Artificial Sequence; identical to SEQ ID NO: 25061
  Description of Artificial Sequence: Synthetic coding sequence

SEQ ID NO: 25065 - DNA, 540 bp, Artificial Sequence
  Description of Artificial Sequence: Synthetic coding sequence
atgatgatgagcgacaacgccaagggcagagccgcccacagctggaagaagagaggcagcatcagcagcctgagcaaccacgagttctggagaaaggagatccacggcagaatcaaggacagcatgagcaccgtgagctacatggaggagcccagccagagagacgacatcagcagactgaccgtgcagatggagaacacctaccagctgggcccccccaagcacttccccgtggtgaccgtgaaccacatcctgaaggacgtggtgaccagctacctgcaggtggaggagtacgagcccgagctgtgcagacagatgaccaagaccatcagcgaggtgatcaaggcccaggtgaaggacctgatgatccccagatacaagctgatcgtgatcgtgcacatcggccagctgaacagacagagcatcctgatcggcagcagatgcctgtgggaccccaagagcgacaccttcagcagctacgtgttcagaaacagcagcctgttcgccctggccaacgtgtacgccgtgtacctggagtag

SEQ ID NO: 25066 - DNA, 429 bp, Artificial Sequence
  Description of Artificial Sequence: Synthetic coding sequence
atggccaccagcatcggcgtgagcttcagcgtgggcgacggcgtgcccgaggccgagaagaacgccggcgagcccgagaacacctacatcctgagacccgtgttccagcagagattcagacccagcgtggtgaaggactgcatccacgccgtgctgaaggaggagctggccaacgccgagtacagccccgaggagatgccccagctgaccaagcacctgagcgagaacatcaaggacaagctgaaggagatgggcttcgacagatacaagatggtggtgcaggtggtgatcggcgagcagagaggcgagggcgtgttcatggccagcagatgcttctgggacgccgacaccgacaactacacccacgacgtgttcatgaacgacagcctgttctgcgtggtggccgccttcggctgcttctactactag

SEQ ID NO: 25067 - DNA, 255 bp, Artificial Sequence
  Description of Artificial Sequence: Synthetic coding sequence
atggccaccagcatcggcgtgagcttcagcgtgggcgacggcgtgcccgaggccgagaagaacgccggcgagcccgagaacacctacatcctgagacccgtgttccagcagagattcagacccagcgtggtgaaggactgcatccacgccgtgctgaaggaggagctggccaacgccgagtacagccccgaggagatgccccagctgaccaagcacctgagcgagaacatcaaggacaagaagaagaagaagtag

SEQ ID NO: 25068 - DNA, 1053 bp, Artificial Sequence
  Description of Artificial Sequence: Synthetic coding sequence
atgagcgccgcctgctgggaggagccctggggcctgcccggcggcttcgccaagagagtgctggtgaccggcggcgccggcttcatcgccagccacatgatcgtgagcctggtggaggactaccccaactacatgatcatcaacctggacaagctggactactgcgccagcctgaagaacctggagaccatcagcaacaagcagaactacaagttcatccagggcgacatctgcgacagccacttcgtgaagctgctgttcgagaccgagaagatcgacatcgtgctgcacttcgccgcccagacccacgtggacctgagcttcgtgagagccttcgagttcacctacgtgaacgtgtacggcacccacgtgctggtgagcgccgcccacgaggccagagtggagaagttcatctacgtgagcaccgacgaggtgtacggcggcagcctggacaaggagttcgacgagagcagccccaagcagcccaccaacccctacgccagcagcaaggccgccgccgagtgcttcgtgcagagctactgggagcagtacaagttccccgtggtgatcaccagaagcagcaacgtgtacggcccccaccagtaccccgagaaggtgatccccaagttcatcagcctgctgcagcacaacagaaagtgctgcatccacggcagcggcctgcagaccagaaacttcctgtacgccaccgacgtggtggaggccttcctgaccgtgctgaagaagggcaagcccggcgagatctacaacatcggcaccaacttcgagatgagcgtggtgcagctggccaaggagctgatccagctgatcaaggagaccaacagcgagagcgagatggagaactgggtggactacgtgaacgacagacccaccaacgacatgagataccccatgaagagcgagaagatccacggcctgggctggagacccaaggtgccctggaaggagggcatcaagaagaccatcgagtggtacagagagaacttccacaactggaagaacgtggagaaggccctggagcccttccccgtgtag

SEQ ID NO: 25069 - DNA, 4236 bp, Artificial Sequence
  Description of Artificial Sequence: Synthetic coding sequence
atggccagcatcagcgagcccgtgaccttcagagagttctgccccctgtactacctgctgaacgccatccccaccaagatccagaagggcttcagaagcatcgtggtgtacctgaccgccctggacaccaacggcgactacatcgccgtgggcagcagcatcggcatgctgtacctgtactgcagacacctgaaccagatgagaaagtacaacttcgagggcaagaccgagagcatcaccgtggtgaagctgctgagctgcttcgacgacctggtggccgccggcaccgccagcggcagagtggccgtgttccagctggtgagcagcctgcccggcagaaacaagcagctgagaagattcgacgtgaccggcatccacaagaacagcatcaccgccctggcctggagccccaacggcatgaagctgttcagcggcgacgacaagggcaagatcgtgtacagcagcctggacctggaccagggcctgtgcaacagccagctggtgctggaggagcccagcagcatcgtgcagctggactacagccagaaggtgctgctggtgagcaccctgcagagaagcctgctgttctacaccgaggagaagagcgtgagacagatcggcacccagcccagaaagagcaccggcaagttcggcgcctgcttcatccccggcctgtgcaagcagagcgacctgaccctgtacgccagcagacccggcctgagactgtggaaggccgacgtgcacggcaccgtgcaggccaccttcatcctgaaggacgccttcgccggcggcgtgaagcccttcgagctgcaccccagactggagagccccaacagcggcagctgcagcctgcccgagagacacctgggcctggtgagctgcttcttccaggagggctgggtgctgagctggaacgagtacagcatctacctgctggacaccgtgaaccaggccaccgtggccggcctggagggcagcggcgacatcgtgagcgtgagctgcaccgagaacgagatcttcttcctgaagggcgacagaaacatcatcagaatcagcagcagacccgagggcctgaccagcaccgtgagagacggcctggagatgagcggctgcagcgagagagtgcacgtgcagcaggccgagaagctgcccggcgccaccgtgagcgagaccagactgagaggcagcagcatggccagcagcgtggccagcgagcccagaagcagaagcagcagcctgaacagcaccgacagcggcagcggcctgctgccccccggcctgcaggccacccccgagctgggcaagggcagccagcccctgagccagagattcaacgccatcagcagcgaggacttcgaccaggagctggtggtgaagcccatcaaggtgaagagaaagaagaagaagaagaagaccgagggcggcagcagaagcacctgccacagcagcctggagagcaccccctgcagcgagttccccggcgacagcccccagagcctgaacaccgacctgctgagcatgaccagcagcgtgctgggcagcagcgtggaccagctgagcgccgagagccccgaccaggagagcagcttcaacggcgaggtgaacggcgtgccccaggagaacaccgaccccgagaccttcaacgtgctggaggtgagcggcagcatgcccgacagcctggccgaggaggacgacatcagaaccgagatgccccactgccaccacgcccacggcagagagctgctgaacggcgccagagaggacgtgggcggcagcgacgtgaccggcctgggcgacgagccctgccccgccgacgacggccccaacagcacccagctgcccttccaggagcaggacagcagccccggcgcccacgacggcgaggacatccagcccatcggcccccagagcaccttctgcgaggtgcccctgctgaacagcctgaccgtgcccagcagcctgagctgggcccccagcgccgagcagtggctgcccggcaccagagccgacgagggcagccccgtggagcccagccaggagcaggacatcctgaccagcatggaggccagcggccacctgagcaccaacctgtggcacgccgtgaccgacgacgacaccggccagaaggagatccccatcagcgagagagtgctgggcagcgtgggcggccagctgacccccgtgagcgccctggccgccagcacccacaagccctggctggagcagccccccagagaccagaccctgaccagcagcgacgaggaggacatctacgcccacggcctgcccagcagcagcagcgagaccagcgtgaccgagctgggccccagctgcagccagcaggacctgagcagactgggcgccgaggacgccggcctgctgaagcccgaccagttcgccgagagctggatgggctacagcggccccggctacggcatcctgagcctggtggtgagcgagaagtacatctggtgcctggactacaagggcggcctgttctgcagcgccctgcccggcgccggcctgagatggcagaagttcgaggacgccgtgcagcaggtggccgtgagccccagcggcgccctgctgtggaagatcgagcagaagagcaacagagccttcgcctgcggcaaggtgaccatcaagggcaagagacactggtacgaggccctgccccaggccgtgttcgtggccctgagcgacgacaccgcctggatcatcagaaccagcggcgacctgtacctgcagaccggcctgagcgtggacagaccctgcgccagagccgtgaaggtggactgcccctaccccctgagccagatcaccgccagaaacaacgtggtgtgggccctgaccgagcagagagccctgctgtacagagagggcgtgagcagcttctgccccgagggcgagcagtggaagtgcgacatcgtgagcgagagacaggccctggagcccgtgtgcatcaccctgggcgaccagcagaccctgtgggccctggacatccacggcaacctgtggttcagaaccggcatcatcagcaagaagccccagggcgacgacgaccactggtggcaggtgagcatcaccgactacgtggtgttcgaccagtgcagcctgttccagaccatcatccacgccacccacagcgtggccaccgccgcccaggcccccgtggagaaggtggccgacaagctgagaatggccttctggagccagcagctgcagtgccagcccagcctgctgggcgtgaacaacagcggcgtgtggatcagcagcggcaagaacgagttccacgtggccaagggcagcctgatcggcacctactggaaccacgtggtgcccagaggcaccgccagcgccaccaagtgggccttcgtgctggccagcgccgcccccaccaaggagggcagcttcctgtggctgtgccagagcagcaaggacctgtgcagcgtgagcgcccagagcgcccagagcagacccagcaccgtgcagctgccccccgaggccgagatgagagcctacgccgcctgccaggacgccctgtgggccctggacagcctgggccaggtgttcatcagaaccctgagcaagagctgccccaccggcatgcactggaccagactggacctgagccagctgggcgccgtgaagctgaccagcctggcctgcggcaaccagcacatctgggcctgcgacagcagaggcggcgtgtacttcagagtgggcacccagcccctgaaccccagcctgatgctgcccgcctggatcatgatcgagccccccgtgcagcccgccggcgtgagcctggtgagcgtgcacagcagccccaacgaccagatgctgtgggtgctggacagcagatggaacgtgcacgtgagaaccggcatcaccgaggagatgcccgtgggcaccgcctgggagcacgtgcccggcctgcaggcctgccagctggccctgagcaccagaaccgtgtgggccagatgccccaacggcgacctggccagaagatacggcgtgaccgacaagaaccccgccggcgactactggaagaagatccccggcagcgtgagctgcttcaccgtgaccgccagcgacgagctgtgggccgtgggcccccccggctacctgctgcagagactgaccaagaccttcagccacagccacggcacccagaagagcagccaggccgccatgccccaccccgaggacctggaggacgagtgggaggtgatctag

SEQ ID NO: 25070 - DNA, 2202 bp, Artificial Sequence
  Description of Artificial Sequence: Synthetic coding sequence
atggccagcatcagcgagcccgtgaccttcagagagttctgccccctgtactacctgctgaacgccatccccaccaagatccagaagggcttcagaagcatcgtggtgtacctgaccgccctggacaccaacggcgactacatcgccgtgggcagcagcatcggcatgctgtacctgtactgcagacacctgaaccagatgagaaagtacaacttcgagggcaagaccgagagcatcaccgtggtgaagctgctgagctgcttcgacgacctggtggccgccggcaccgccagcggcagagtggccgtgttccagctggtgagcagcctgcccggcagaaacaagcagctgagaagattcgacgtgaccggcatccacaagaacagcatcaccgccctggcctggagccccaacggcatgaagctgttcagcggcgacgacaagggcaagatcgtgtacagcagcctggacctggaccagggcctgtgcaacagccagctggtgctggaggagcccagcagcatcgtgcagctggactacagccagaaggtgctgctggtgagcaccctgcagagaagcctgctgttctacaccgaggagaagagcgtgagacagatcggcacccagcccagaaagagcaccggcaagttcggcgcctgcttcatccccggcctgtgcaagcagagcgacctgaccctgtacgccagcagacccggcctgagactgtggaaggccgacgtgcacggcaccgtgcaggccaccttcatcctgaaggacgccttcgccggcggcgtgaagcccttcgagctgcaccccagactggagagccccaacagcggcagctgcagcctgcccgagagacacctgggcctggtgagctgcttcttccaggagggctgggtgctgagctggaacgagtacagcatctacctgctggacaccgtgaaccaggccaccgtggccggcctggagggcagcggcgacatcgtgagcgtgagctgcaccgagaacgagatcttcttcctgaagggcgacagaaacatcatcagaatcagcagcagacccgagggcctgaccagcaccgtgagagacggcctggagatgagcggctgcagcgagagagtgcacgtgcagcaggccgagaagctgcccggcgccaccgtgagcgagaccagactgagaggcagcagcatggccagcagcgtggccagcgagcccagaagcagaagcagcagcctgaacagcaccgacagcggcagcggcctgctgccccccggcctgcaggccacccccgagctgggcaagggcagccagcccctgagccagagattcaacgccatcagcagcgaggacttcgaccaggagctggtggtgaagcccatcaaggtgaagagaaagaagaagaagaagaagaccgagggcggcagcagaagcacctgccacagcagcctggagagcaccccctgcagcgagttccccggcgacagcccccagagcctgaacaccgacctgctgagcatgaccagcagcgtgctgggcagcagcgtggaccagctgagcgccgagagccccgaccaggagagcagcttcaacggcgaggtgaacggcgtgccccaggagaacaccgaccccgagaccttcaacgtgctggaggtgagcggcagcatgcccgacagcctggccgaggaggacgacatcagaaccgagatgccccactgccaccacgcccacggcagagagctgctgaacggcgccagagaggacgtgggcggcagcgacgtgaccggcctgggcgacgagccctgccccgccgacgacggccccaacagcaccccccagcacaccacccacctgaccagccaccacagcaccccccaccacaccaccccccactgcaccatcccccaccacatcagcccccaccacagcaccccccaccacaccacccaccacaccccccacagaaccgccccccacagaaccgccccctacctggccaccagccaccacaccaccccccaccacaccagcctgcccacccacggcgccggctgccccccccccggcgagcacaccagcgccgagaccgtgaagcccgacggctgcaagtggaacctggacgtgtgcacctgcgtgcccggcagagacggcaccggcggctgcatgggcagaggcggcgccgagcagggcagcctgacctag

SEQ ID NO: 25071 - DNA, 3804 bp, Artificial Sequence
  Description of Artificial Sequence: Synthetic coding sequence
atggccagcatcagcgagcccgtgaccttcagagagttctgccccctgtactacctgctgaacgccatccccaccaagatccagaagggcttcagaagcatcgtggtgtacctgaccgccctggacaccaacggcgactacatcgccgtgggcagcagcatcggcatgctgtacctgtactgcagacacctgaaccagatgagaaagtacaacttcgagggcaagaccgagagcatcaccgtggtgaagctgctgagctgcttcgacgacctggtggccgccggcaccgccagcggcagagtggccgtgttccagctggtgagcagcctgcccggcagaaacaagcagctgagaagattcgacgtgaccggcatccacaagaacagcatcaccgccctggcctggagccccaacggcatgaagctgttcagcggcgacgacaagggcaagatcgtgtacagcagcctggacctggaccagggcctgtgcaacagccagctggtgctggaggagcccagcagcatcgtgcagctggactacagccagaaggtgctgctggtgagcaccctgcagagaagcctgctgttctacaccgaggagaagagcgtgagacagatcggcacccagcccagaaagagcaccggcaagttcggcgcctgcttcatccccggcctgtgcaagcagagcgacctgaccctgtacgccagcagacccggcctgagactgtggaaggccgacgtgcacggcaccgtgcaggccaccttcatcctgaaggacgccttcgccggcggcgtgaagcccttcgagctgcaccccagactggagagccccaacagcggcagctgcagcctgcccgagagacacctgggcctggtgagctgcttcttccaggagggctgggtgctgagctggaacgagtacagcatctacctgctggacaccgtgaaccaggccaccgtggccggcctggagggcagcggcgacatcgtgagcgtgagctgcaccgagaacgagatcttcttcctgaagggcgacagaaacatcatcagaatcagcagcagacccgagggcctgaccagcaccgtgagagacggcctggagatgagcggctgcagcgagagagtgcacgtgcagcaggccgagaagctgcccggcgccaccgtgagcgagaccagactgagaggcagcagcatggccagcagcgtggccagcgagcccagaagcagaagcagcagcctgaacagcaccgacagcggcagcggcctgctgccccccggcctgcaggccacccccgagctgggcaagggcagccagcccctgagccagagattcaacgccatcagcagcgaggacttcgaccaggagctggtggtgaagcccatcaaggtgaagagaaagaagaagaagaagaagaccgagggcggcagcagaagcacctgccacagcagcctggagagcaccccctgcagcgagttccccggcgacagcccccagagcctgaacaccgacctgctgagcatgaccagcagcgtgctgggcagcagcgtggaccagctgagcgccgagagccccgaccaggagagcagcttcaacggcgaggtgaacggcgtgccccaggagaacaccgaccccgagaccttcaacgtgctggaggtgagcggcagcatgcccgacagcctggccgaggaggacgacatcagaaccgagatgccccactgccaccacgcccacggcagagagctgctgaacggcgccagagaggacgtgggcggcagcgacgtgaccggcctgggcgacgagccctgccccgccgacgacggccccaacagcacccagctgcccttccaggagcaggacagcagccccggcgcccacgacggcgaggacatccagcccatcggcccccagagcaccttctgcgaggtgcccctgctgaacagcctgaccgtgcccagcagcctgagctgggcccccagcgccgagcagtggctgcccggcaccagagccgacgagggcagccccgtggagcccagccaggagcaggacatcctgaccagcatggaggccagcggccacctgagcaccaacctgtggcacgccgtgaccgacgacgacaccggccagaaggagatccccatcagcgagagagtgctgggcagcgtgggcggccagctgacccccgtgagcgccctggccgccagcacccacaagccctggctggagcagccccccagagaccagaccctgaccagcagcgacgaggaggacatctacgcccacggcctgcccagcagcagcagcgagaccagcgtgaccgagctgggccccagctgcagccagcaggacctgagcagactgggcgccgaggacgccggcctgctgaagcccgaccagttcgccgagagctggatgggctacagcggccccggctacggcatcctgagcctggtggtgagcgagaagtacatctggtgcctggactacaagggcggcctgttctgcagcgccctgcccggcgccggcctgagatggcagaagttcgaggacgccgtgcagcaggtggccgtgagccccagcggcgccctgctgtggaagatcgagcagaagagcaacagagccttcgcctgcggcaaggtgaccatcaagggcaagagacactggtacgaggccctgccccaggccgtgttcgtggccctgagcgacgacaccgcctggatcatcagaaccagcggcgacctgtacctgcagaccggcctgagcgtggacagaccctgcgccagagccgtgaaggtggactgcccctaccccctgagccagatcaccgccagaaacaacgtggtgtgggccctgaccgagcagagagccctgctgtacagagagggcgtgagcagcttctgccccgagggcgagcagtggaagtgcgacatcgtgagcgagagacaggccctggagcccgtgtgcatcaccctgggcgaccagcagaccctgtgggccctggacatccacggcaacctgtggttcagaaccggcatcatcagcaagaagccccagggcgacgacgaccactggtggcaggtgagcatcaccgactacgtggtgttcgaccagtgcagcctgttccagaccatcatccacgccacccacagcgtggccaccgccgcccaggcccccgtggagaaggtggccgacaagctgagaatggccttctggagccagcagctgcagtgccagcccagcctgctgggcgtgaacaacagcggcgtgtggatcagcagcggcaagaacgagttccacgtggccaagggcagcctgatcggcacctactggaaccacgtggtgcccagaggcaccgccagcgccaccaagtgggccttcgtgctggccagcgccgcccccaccaaggagggcagcttcctgtggctgtgccagagcagcaaggacctgtgcagcgtgagcgcccagagcgcccagagcagacccagcaccgtgcagctgccccccgaggccgagatgagagcctacgccgcctgccaggacgccctgtgggccctggacagcctgggccaggtgttcatcagaaccctgagcaagagctgccccaccggcatgcactggaccagactggacctgagccagctgggcgccgtgaagctgaccagcctggcctgcggcaaccagcacatctgggcctgcgacagcagaggcggcgtgtacttcagagtgggcacccagcccctgaaccccagcctgatgctgcccgcctggatcatgatcgagccccccgtgcaggtgagcagaagctag

SEQ ID NO: 25072 - DNA, 453 bp, Artificial Sequence
  Description of Artificial Sequence: Synthetic coding sequence
atggacagcagaaagctgagccccagaggcaagaagctggagagccacctgagccaggagcacagaagaccccccctgggcctgatcgccgcctggggccagcccagcatccagagcagcgtgcagcagggcctgcagacccaggactgggtgtgcgagccccccgagagaagaagacccggcagaagatggagcgtgagcatcgacgagagaagaagactggccaccctgggcggcagagagagacccggcgccgccggcacccagctgcactgcagagacgtggtgcagatggtggcccagctggtgagcgaggacgtggacaaggacgtgctgctgccccaccccctgagaagcaccgagagcaccaacgccttccaggccttcctggccagaagcgcccccttctggcacaacgccaccttcgaggccagcagaagcccccccagctag

SEQ ID NO: 25073 - DNA, 621 bp, Artificial Sequence
  Description of Artificial Sequence: Synthetic coding sequence
atggacagccagcaggaggacctgagattccccggcatgtgggtgagcctgtacttcggcatcctgggcctgtgcagcgtgatcaccggcggctgcatcatcttcctgcactggagaaagaacctgagaagagaggagcacgcccagcagtgggtggaggtgatgagagccgccaccttcacctacagccccctgctgtactggatcaacaagagaagaagatacggcatgaacgccgccatcaacaccggccccgcccccgccgtgaccaagaccgagaccgaggtgcagaaccccgacgtgctgtgggacctggacatccccgagggcagaagccacgccgaccaggacagcaaccccaaggccgaggcccccgcccccctgcagcccgccctgcagctggccccccagcagccccaggccagaagccccttccccctgcccatcttccaggaggtgcccttcgccccccccctgtgcaacctgccccccctgctgaaccacagcgtgagctaccccctggccacctgccccgagagaaacgtgctgttccacagcctgctgaacctggcccaggaggaccacagcttcaacgccaagcccttccccagcgagctgtag

SEQ ID NO: 25074 - DNA, 1176 bp, Artificial Sequence
  Description of Artificial Sequence: Synthetic coding sequence
atggccggcagaagcctgtgcctgaccagaagcagcgtgcccggcacccccttccccccccccgtgcagcagcccagcacccccggccccgacctgctggccctggaggaggagtacaagagactgaacgccgagctgcaggccaagaccgccgacgtggtgcagcaggccaaggagatcatcagagacagacaggaggtgagaagcagacccgtgagcacccagatgaagagctgcgacgacgaggacgactacagcctgagaggcctgctgcccagcgagggcatcgtgcacctgcacagcgagaccaagcccaagaccaagaacatcgaccccgtgaacaaggtgcagaacaagctgcacagcgccaacaagggcagaaagaccaacagcagcgtgaagctgaagtacagcgacgtgcagaccgccgacgacgtggccatccccgaggacttcagcgacttcagcctggccaagaccatcagcaagatcgagggccagctggaggaggagggcctgcccgagtacatcgacgacatcttcagcggcgtgagcaacgacatcggcaccgaggcccagatcagattcctgaaggccaagctgcacgtgatgcaggaggagctggacaacgtggtgtgcgagtgcaacaagaaggaggacgagatccagaacctgaagagccaggtgaagaacttcgaggaggacttcatgagacagcagagaaccatcaacatgcagcagagccaggtggagaagtacaagaccctgttcgaggaggccaacaagaagtacgacggcctgcagcagcagctgagcagcgtggagagagagctggagaacaagagaagactgcagaagcaggccgccagcagccagagcgccaccgaggtgagactgaacagagccctggaggaggccgagaagtacaagctggagctgagcaagctgagacagaacaacaaggacatcgccaacgaggagcacaagaagatcgaggtgctgaagagcgagaacaagaagctggagaagcagaagggcgagctgatgatcggcttcaagaagcagctgaagctgatcgacgtgctgaagagacagaagatgcacatcgaggccgccaagatgctgagcttcaccgaggaggagttcatgaaggccctggagtggggcaacagctag

SEQ ID NO: 25075 - DNA, 951 bp, Artificial Sequence
  Description of Artificial Sequence: Synthetic coding sequence
atgaagagctgcgacgacgaggacgactacagcctgagaggcctgctgcccagcgagggcatcgtgcacctgcacagcgagaccaagcccaagaccaagaacatcgaccccgtgaacaaggtgcagaacaagctgcacagcgccaacaagggcagaaagaccaacagcagcgtgaagctgaagtacagcgacgtgcagaccgccgacgacgtggccatccccgaggacttcagcgacttcagcctggccaagaccatcagcaagatcgagggccagctggaggaggagggcctgcccgagtacatcgacgacatcttcagcggcgtgagcaacgacatcggcaccgaggcccagatcagattcctgaaggccaagctgcacgtgatgcaggaggagctggacaacgtggtgtgcgagtgcaacaagaaggaggacgagatccagaacctgaagagccaggtgaagaacttcgaggaggacttcatgagacagcagagaaccatcaacatgcagcagagccaggtggagaagtacaagaccctgttcgaggaggccaacaagaagtacgacggcctgcagcagcagctgagcagcgtggagagagagctggagaacaagagaagactgcagaagcaggccgccagcagccagagcgccaccgaggtgagactgaacagagccctggaggaggccgagaagtacaagctggagctgagcaagctgagacagaacaacaaggacatcgccaacgaggagcacaagaagatcgaggtgctgaagagcgagaacaagaagctggagaagcagaagggcgagctgatgatcggcttcaagaagcagctgaagctgatcgacgtgctgaagagacagaagatgcacatcgaggccgccaagatgctgagcttcaccgaggaggagttcatgaaggccctggagtggggcaacagctag

SEQ ID NO: 25076 - DNA, 828 bp, Artificial Sequence
  Description of Artificial Sequence: Synthetic coding sequence
atgagccagaagagacagaccaagttccagaacggcaagagcaagaccagcgagaacagcagcgccaagagagagaagggcatggtggtgaacagcaaggagatcagcgacgccgtgggccagagcaagttcgtgctggagaacctgagacactacaccgtgcaccccaacctggcccagtactacaagcccctgaaggccaccgccctgcagaagttcctggcccagaacagaaagaacaccagcttcatgctgaaggtgacccagtacgaccaggacaagaccctgctgatcatgaccaacaacccccccccctgcagcatcacccagcaggacaaggagagcgccagcaagtacttcagcaaggagctgctgctgaaggtgatggagagccaccaccagcacaagcccaccgagaacctgtggctgcccagaatgccccagaagaagaagctgagaagcaagctgaagcccatcttccccctgatcctgagcgacgaccccaccagcaagagagagcagtggttcagattcagcaccgacaacgacttcaagagcgagggcaagtacagcaaggtgtacgccctgagaacccagaagaagatgtacccccagctgaccttcgcccccgtgcacgagagagacatgagaaaggacgccagcaagaagagcgccagcgagagacccatcagcaaggtgatcagagagcccctgaccctggccagcctgctggaggacatgcccaccagaaccgcccccggcgagagcgccttcagaaacggcagagccccccagtggatcatcaagaaggccaccgtgatcggctag

SEQ ID NO: 25077 - DNA, 927 bp, Artificial Sequence
  Description of Artificial Sequence: Synthetic coding sequence
atgagacccgagggcagcctgacctacagagtgcccgagagactgagacagggcttctgcggcgtgggcagagccgcccaggccctggtgtgcgccagcgccaaggagggcaccgccttcagaatggaggccgtgcaggagggcgccgccggcgtggagagcgagcaggccgccctgggcgaggaggccgtgctgctgctggacgacatcatggccgaggtggaggtggtggccgaggaggagggcctggtggagagaagagaggaggcccagagagcccagcaggccgtgcccggccccggccccatgacccccgagagcgccctggaggagctgctggccgtgcaggtggagctggagcccgtgaacgcccaggccagaaaggccttcagcagacagagagagaagatggagagaagaagaaagccccacctggacagaagaggcgccgtgatccagagcgtgcccggcttctgggccaacgtgatcgccaaccacccccagatgagcgccctgatcaccgacgaggacgaggacatgctgagctacatggtgagcctggaggtggaggaggagaagcaccccgtgcacctgtgcaagatcatgctgttcttcagaagcaacccctacttccagaacaaggtgatcaccaaggagtacctggtgaacatcaccgagtacagagccagccacagcacccccatcgagtggtaccccgactacgaggtggaggcctacagaagaagacaccacaacagcagcctgaacttcttcaactggttcagcgaccacaacttcgccggcagcaacaagatcgccgagatcctgtgcaaggacctgtggagaaaccccctgcagtactacaagagaatgaagccccccgaggagggcaccgagaccagcggcgacagccagctgctgagctag

SEQ ID NO: 25078 - DNA, 441 bp, Artificial Sequence
  Description of Artificial Sequence: Synthetic coding sequence
atgagacccgagggcagcctgacctacagagtgcccgagagactgagacagggcttctgcggcgtgggcagagccgcccaggccctggtggagctggagcccgtgaacgcccaggccagaaaggccttcagcagacagagagagaagatggagagaagaagaaagccccacctggacagaagaggcgccgtgatccagagcgtgcccggcttctgggccaacgtgatcgccaaccacccccagatgagcgccctgatcaccgacgaggacgaggacatgctgagctacatggtgagcctggaggtggaggaggagaagcaccccgtgcacctgtgcaagatcatgctgttcttcagaagcaacccctacttccagaacaaggtgatcaccaaggagtacctggtgaacatcaccgagtacagagccagccacagcacctag

SEQ ID NO: 25079 - DNA, 885 bp, Artificial Sequence
  Description of Artificial Sequence: Synthetic coding sequence
atgagacccgagggcagcctgacctacagagtgcccgagagactgagacagggcttctgcggcgtgggcagagccgcccaggccctggtgtgcgccagcgccaaggagggcaccgccttcagaatggaggccgtgcaggagggcgccgccggcgtggagagcgagcaggccgccctgggcgaggaggccgtgctgctgctggacgacatcatggccgaggtggaggtggtggccgaggaggagggcctggtggagagaagagaggaggcccagagagcccagcaggccgtgcccggccccggccccatgacccccgagagcgccctggaggagctgctggccgtgcaggtggagctggagcccgtgaacgcccaggccagaaaggccttcagcagacagagagagaagatggagagaagaagaaagccccacctggacagaagaggcgccgtgatccagagcgtgcccggcttctgggccaacgtgatcgccaaccacccccagatgagcgccctgatcaccgacgaggacgaggacatgctgagctacatggtgagcctggaggtggaggaggagaagcaccccgtgcacctgtgcaagatcatgctgttcttcagaagcaacccctacttccagaacaaggtgatcaccaaggagtacctggtgaacatcaccgagtacagagccagccacagcacccccatcgagtggtaccccgactacgaggtggaggcctacagaagaagacaccacaacagcagcctgaacttcttcaactggttcagcgaccacaacttcgccggcagcaacaagatcgccgagagccccgacagaagctacgtgagaacctgcggcgccatcccctgcaacaccaccagaggctag

SEQ ID NO: 25080 - DNA, 927 bp, Artificial Sequence
  Description of Artificial Sequence: Synthetic coding sequence
atgagacccgagggcagcctgacctacagagtgcccgagagactgagacagggcagctgcggcgtgggcagagccgcccaggccctggtgtgcgccagcgccaaggagggcaccgccttcagaatggaggccgtgcaggagggcgccgccggcgtggagagcgagcaggccgccctgggcgaggaggccgtgctgctgctggacgacatcatggccgaggtggaggtggtggccgaggaggagggcctggtggagagaagagaggaggcccagagagcccagcaggccgtgcccggccccggccccatgacccccgagagcgccctggaggagctgctggccgtgcaggtggagctggagcccgtgaacgcccaggccagaaaggccttcagcagacagagagagaagatggagagaagaagaaagccccacctggacagaagaggcgccgtgatccagagcgtgcccggcttctgggccaacgtgatcgccaaccacccccagatgagcgccctgatcaccgacgaggacgaggacatgctgagctacatggtgagcctggaggtggaggaggagaagcacagagtgcacctgtgcaagatcatgctgttcttcagaagcaacccctacttccagaacaaggtgatcaccaaggagtacctggtgaacatcaccgagtacagagccagccacagcacccccatcgagtggtaccccgactacgaggtggaggcctacagaagaagacaccacaacagcagcctgaacttcttcaactggttcagcgaccacaacttcgccggcagcaacaagatcgccgagatcctgtgcaaggacctgtggagaaaccccctgcagtactacaagagaatgaagccccccgaggagggcaccgagaccagcggcgacagccagctgctgagctag

SEQ ID NO: 25081 - DNA, 795 bp, Artificial Sequence
  Description of Artificial Sequence: Synthetic coding sequence
atgagacccgagggcagcctgacctacagagtgcccgagagactgagacagggcttctgcggcgtgggcagagccgcccaggccctggtgtgcgccagcgccaaggagggcaccgccttcagaatggaggccgtgcaggagggcgccgccggcgtggagagcgagcaggccgccctgggcgaggaggccgtgctgctgctggacgacatcatggccgaggtggaggtggtggccgaggtggaggtggtggccgaggaggagggcctggtggagagaagagaggaggcccagagagcccagcaggccgtgcccggccccggccccatgacccccgagagcgccctggaggagctgctggccgtgcaggtggagctggagcccgtgaacgcccaggccagaaaggccttcagcagacagagagagaagatggagagaagaagaaagccccacctggacagaagaggcgccgtgatccagagcgtgcccggcttctgggccaacgtgatcgccaaccacccccagatgagcgccctgatcaccgacgaggacgaggacatgctgagctacatggtgagcctggaggtggaggaggagaagcaccccgtgcacctgtgcaagatcatgctgttcttcagaagcaacccctacttccagaacaaggtgatcaccaaggagtacctggtgaacatcaccggcgacagatggctgcccggctgggtggtggagggcagatggtgggtggaccactgccagagagaccccgcccccttcccccagaagctgctgagcctgtag

SEQ ID NO: 25082 - DNA, 516 bp, Artificial Sequence
  Description of Artificial Sequence: Synthetic coding sequence
atgagacccgagggcagcctgacctacagagtgcccgagagactgagacagggcttctgcggcgtgggcagagccgcccaggccctggtggagctggagcccgtgaacgcccaggccagaaaggccttcagcagacagagagagaagatggagagaagaagaaagccccacctggacagaagaggcgccgtgatccagagcgtgcccggcttctgggccaacgtgatcgccaaccacccccagatgagcgccctgatcaccgacgaggacgaggacatgctgagctacatggtgagcctggaggtggaggaggagaagcaccccgtgcacctgtgcaagatcatgctgttcttcagaagcaacccctacttccagaacaaggtgatcaccaaggagtacctggtgaacatcaccggcgacagatggctgcccggctgggtggtggagggcagatggtgggtggaccactgccagagagaccccgcccccttcccccagaagctgctgagcctgtag

SEQ ID NO: 25083 - DNA, 927 bp, Artificial Sequence; identical to SEQ ID NO: 25077
  Description of Artificial Sequence: Synthetic coding sequence

SEQ ID NO: 25084 - DNA, 927 bp, Artificial Sequence; identical to SEQ ID NO: 25077
  Description of Artificial Sequence: Synthetic coding sequence

SEQ ID NO: 25085 - DNA, 903 bp, Artificial Sequence
  Description of Artificial Sequence: Synthetic coding sequence
atgagacccgagggcagcctgacctacagagtgcccgagagactgagacagggcttctgcggcgtgggcagagccgcccaggccctggtgtgcgccagcgccaaggagggcaccgccttcagaatggaggccgtgcaggagggcgccgccggcgtggagagcgagcaggccgccctgggcgaggaggccgtgctgctgctggacgacatcatggccgaggtggaggtggtggccgaggtggaggtggtggccgaggaggagggcctggtggagagaagagaggaggcccagagagcccagcaggccgtgcccggccccggccccatgacccccgagagcgccctggaggagctgctggccgtgcaggtggagctggagcccgtgaacgcccaggccagaaaggccttcagcagacagagagagaagatggagagaagaagaaagccccacctggacagaagaggcgccgtgatccagagcgtgcccggcttctgggccaacgtgatcgccaaccacccccagatgagcgccctgatcaccgacgaggacgaggacatgctgagctacatggtgagcctggaggtggaggaggagaagcaccccgtgcacctgtgcaagatcatgctgttcttcagaagcaacccctacttccagaacaaggtgatcaccaaggagtacctggtgaacatcaccgagtacagagccagccacagcacccccatcgagtggtaccccgactacgaggtggaggcctacagaagaagacaccacaacagcagcctgaacttcttcaactggttcagcgaccacaacttcgccggcagcaacaagatcgccgagagccccgacagaagctacgtgagaacctgcggcgccatcccctgcaacaccaccagaggctag

SEQ ID NO: 25086 - DNA, 945 bp, Artificial Sequence
  Description of Artificial Sequence: Synthetic coding sequence
atgagacccgagggcagcctgacctacagagtgcccgagagactgagacagggcttctgcggcgtgggcagagccgcccaggccctggtgtgcgccagcgccaaggagggcaccgccttcagaatggaggccgtgcaggagggcgccgccggcgtggagagcgagcaggccgccctgggcgaggaggccgtgctgctgctggacgacatcatggccgaggtggaggtggtggccgaggtggaggtggtggccgaggaggagggcctggtggagagaagagaggaggcccagagagcccagcaggccgtgcccggccccggccccatgacccccgagagcgccctggaggagctgctggccgtgcaggtggagctggagcccgtgaacgcccaggccagaaaggccttcagcagacagagagagaagatggagagaagaagaaagccccacctggacagaagaggcgccgtgatccagagcgtgcccggcttctgggccaacgtgatcgccaaccacccccagatgagcgccctgatcaccgacgaggacgaggacatgctgagctacatggtgagcctggaggtggaggaggagaagcaccccgtgcacctgtgcaagatcatgctgttcttcagaagcaacccctacttccagaacaaggtgatcaccaaggagtacctggtgaacatcaccgagtacagagccagccacagcacccccatcgagtggtaccccgactacgaggtggaggcctacagaagaagacaccacaacagcagcctgaacttcttcaactggttcagcgaccacaacttcgccggcagcaacaagatcgccgagatcctgtgcaaggacctgtggagaaaccccctgcagtactacaagagaatgaagccccccgaggagggcaccgagaccagcggcgacagccagctgctgagctag

SEQ ID NO: 25087 - DNA, 927 bp, Artificial Sequence
  Description of Artificial Sequence: Synthetic coding sequence
atgagacccgagggcagcctgacctactgggtgcccgagagactgagacagggcttctgcggcgtgggcagagccgcccaggccctggtgtgcgccagcgccaaggagggcaccgccttcagaatggaggccgtgcaggagggcgccgccggcgtggagagcgagcaggccgccctgggcgaggaggccgtgctgctgctggacgacatcatggccgaggtggaggtggtggccgaggaggagggcctggtggagagaagagaggaggcccagagagcccagcaggccgtgcccggccccggccccatgacccccgagagcgccctggaggagctgctggccgtgcaggtggagctggagcccgtgaacgcccaggccagaaaggccttcagcagacagagagagaagatggagagaagaagaaagccccacctggacagaagaggcgccgtgatccagagcgtgcccggcttctgggccaacgtgatcgccaaccacccccagatgagcgccctgatcaccgacgaggacgaggacatgctgagctacatggtgagcctggaggtggaggaggagaagcaccccgtgcacctgtgcaagatcatgctgttcttcagaagcaacccctacttccagaacaaggtgatcaccaaggagtacctggtgaacatcaccgagtacagagccagccacagcacccccatcgagtggtacctggactacgaggtggaggcctacagaagaagacaccacaacagcagcctgaacttcttcaactggttcagcgaccacaacttcgccggcagcaacaagatcgccgagatcctgtgcaaggacctgtggagaaaccccctgcagtactacaagagaatgaagccccccgaggagggcaccgagaccagcggcgacagccagctgctgagctag

SEQ ID NO: 25088 - DNA, 942 bp, Artificial Sequence
  Description of Artificial Sequence: Synthetic coding sequence
atgagacccgagggcagcctgacctactgggtgcccgagagactgagacagggcttctgcggcgtgggcagagccgcccaggccctggtgtgcgccagcgccaaggagggcaccgccttcagaatggaggccgtgcaggagggcgccgccggcgtggagagcgagcaggccgccctgggcgaggaggccgtgctgctgctggacgacatcatggccgaggtggaggtggtggccgaggtggaggtggtggccgaggaggagggcctggtggagagaagagaggaggcccagagagcccagcaggccgtgcccggccccggccccatgacccccgagagcgccctggaggagctgctggccgtgcaggtggagctggagcccgtgaacgcccaggccagaaaggccttcagcagacagagagagaagatggagagaagcaagccccacctggacagaagaggcgccgtgatccagagcgtgcccggcttctgggccaacgtgatcgccaaccacccccagatgagcgccctgatcaccgacgaggacgaggacatgctgagctacatggtgagcctggaggtggaggaggagaagcaccccgtgcacctgtgcaagatcatgctgttcttcagaagcaacccctacttccagaacaaggtgatcaccaaggagtacctggtgaacatcaccgagtacagagccagccacagcacccccatcgagtggtaccccgactacgaggtggaggcctacagaagaagacaccacaacagcagcctgaacttcttcaactggttcagcgaccacaacttcgccggcagcaacaagatcgccgagatcctgtgcaaggacctgtggagaaaccccctgcagtactacaagagaatgaagccccccgaggagggcaccgagaccagcggcgacagccagctgctgagctag

SEQ ID NO: 25089 - DNA, 885 bp, Artificial Sequence
  Description of Artificial Sequence: Synthetic coding sequence
atgagacccgagggcagcctgacctactgggtgcccgagagactgagacagggcttctgcggcgtgggcagagccgcccaggccctggtgtgcgccagcgccaaggagggcaccgccttcagaatggaggccgtgcaggagggcgccgccggcgtggagagcgagcaggccgccctgggcgaggaggccgtgctgctgctggacgacatcatggccgaggtggaggtggtggccgaggaggagggcctggtggagagaagagaggaggcccagagagcccagcaggccgtgcccggccccggccccatgacccccgagagcgccctggaggagctgctggccgtgcaggtggagctggagcccgtgaacgcccaggccagaaaggccttcagcagacagagagagaagatggagagaagaagaaagccccacctggacagaagaggcgccgtgatccagagcgtgcccggcttctgggccaacgtgatcgccaaccacccccagatgagcgccctgatcaccgacgaggacgaggacatgctgagctacatggtgagcctggaggtggaggaggagaagcaccccgtgcacctgtgcaagatcatgctgttcttcagaagcaacccctacttccagaacaaggtgatcaccaaggagtacctggtgaacatcaccgagtacagagccagccacagcacccccatcgagtggtacctggactacgaggtggaggcctacagaagaagacaccacaacagcagcctgaacttcttcaactggttcagcgaccacaacttcgccggcagcaacaagatcgccgagagccccgacagaagctacgtgagaacctgcggcgccatcccctgcaacaccaccagaggctag

SEQ ID NO: 25090 - DNA, 927 bp, Artificial Sequence
  Description of Artificial Sequence: Synthetic coding sequence
atgagacccgagggcagcctgacctactgggtgcccgagagactgagacagggcttctgcggcgtgggcagagccgcccaggccctggtgtgcgccagcgccaaggagggcaccgccttcagaatggaggccgtgcaggagggcgccgccggcgtggagagcgagcaggccgccctgggcgaggaggccgtgctgctgctggacgacatcatggccgaggtggaggtggtggccgaggaggagggcctggtggagagaagagaggaggcccagagagcccagcaggccgtgcccggccccggccccatgacccccgagagcgccctggaggagctgctggccgtgcaggtggagctggagcccgtgaacgcccaggccagaaaggccttcagcagacagagagagaagatggagagaagaagaaagccccacctggacagaagaggcgccgtgatccagagcgtgcccggcttctgggccaacgtgatcgccaaccacccccagatgagcgccctgatcaccgacgaggacgaggacatgctgagctacatggtgagcctggaggtggaggaggagaagcaccccgtgcacctgtgcaagatcatgctgttcttcagaagcaacccctacttccagaacaaggtgatcaccaaggagtacctggtgaacatcaccgagtacagagccagccacagcacccccatcgagtggtaccccgactacgaggtggaggcctacagaagaagacaccacaacagcagcctgaacttcttcaactggttcagcgaccacaacttcgccggcagcaacaagatcgccgagatcctgtgcaaggacctgtggagaaaccccctgcagtactacaagagaatgaagccccccgaggagggcaccgagaccagcggcgacagccagctgctgagctag

SEQ ID NO: 25091 - DNA, 621 bp, Artificial Sequence
  Description of Artificial Sequence: Synthetic coding sequence
atgacccccgagagcgccctggaggagctgctggccgtgcaggtggagctggagcccgtgaacgcccaggccagaaaggccttcagcagacagagagagaagatggagagaagaagaaagccccacctggacagaagaggcgccgtgatccagagcgtgcccggcttctgggccaacgtgatcgccaaccacccccagatgagcgccctgatcaccgacgaggacgaggacatgctgagctacatggtgagcctggaggtggaggaggagaagcaccccgtgcacctgtgcaagatcatgctgttcttcagaagcaacccctacttccagaacaaggtgatcaccaaggagtacctggtgaacatcaccgagtacagagccagccacagcacccccatcgagtggtacctggactacgaggtggaggcctacagaagaagacaccacaacagcagcctgaacttcttcaactggttcagcgaccacaacttcgccggcagcaacaagatcgccgagatcctgtgcaaggacctgtggagaaaccccctgcagtactacaagagaatgaagccccccgaggagggcaccgagaccagcggcgagcccctggtgggcacctag

SEQ ID NO: 25092 - DNA, 828 bp, Artificial Sequence; identical to SEQ ID NO: 25076
  Description of Artificial Sequence: Synthetic coding sequence

SEQ ID NO: 25093 - DNA, 177 bp, Artificial Sequence
  Description of Artificial Sequence: Synthetic coding sequence
atgagccagaagagacagaccaagttccagaacggcaagagcaagaccagcgagaacagcagcgccaagagagagaagggcatggtggtgaacagcaaggagatcagcgacgccgtgggccagagcaagttcgtgctggagaacctgagacactacaccgtgcaccccaacctgtag

SEQ ID NO: 25094 - DNA, 231 bp, Artificial Sequence
  Description of Artificial Sequence: Synthetic coding sequence
atgagccagaagagacagaccaagttccagaacggcaagagcaagaccagcgagaacagcagcgccaagagagagaagggcatggtggtgaacagcaaggagatcagcgacgccgtgggccagagcaagttcgtgctggagaacctgagacactacaccgtgcaccccaacctggcccagtactacaagcccctgaaggccaccgccctgcagaagttcctggcccagtag

SEQ ID NO: 25095 - DNA, 828 bp, Artificial Sequence; identical to SEQ ID NO: 25076
  Description of Artificial Sequence: Synthetic coding sequence

SEQ ID NO: 25096 - DNA, 1230 bp, Artificial Sequence
  Description of Artificial Sequence: Synthetic coding sequence
atggccctgagacccgaggaccccagcagcggcttcagacacagcaacgtggtggccttcatcaacgagaagatggccagacacaccaagggccccgagttctacctggagaacatcagcctgagctgggagaaggtggaggacaagctgagagccatcctggaggacagcgaggtgcccagcgaggtgaaggaggcctgcacctggggcagcctggccctgggcgtgagattcgcccacagacaggcccagctgcagagacacagagtgagatggctgcacggcttcgccaagctgcacaagagcgccgcccaggccctggccagcgacctgaagaagctgagagagcagcaggagaccgagagaaaggaggccgccagcagactgagaatggcccagaccagcctggtggaggtgcagaaggagagagacaaggagctggtgagcccccacgagtgggagcagggcgccggctggcccggcctggccaccgccggcggcgtgtgcaccgagggcgccgccgaggaggaggaggaggccgccgtggccgccgccggcgccgccggcggcaagggcgccgaggaggagcagagagacgtggaggtggtggccgcccccgtggaggccatggccccccccgtggaggccggcgccgcccccatggagacccagttcccccacgtggaggccagagccgccagcatggagaccaccgagaagctggagagaatcctgctgcagctgctgggcgacgccgaccaggagaagtacacctactggggccagaaggagggcgacctgagaagcgtggagaccgccaccagctacttcagcggcaccaccaacccctggagcagagccagcagcgagcccctgcccgtgcagctgcccgccagctacagctacagctacagcagccccttcagcagcttcagcgacatccccaccatcagccccccccaggccaccgtgaccgcccccgtgcccccccagctgcccagcgactgggaggccttcgacaccagcctgtggagcgacggcggcccccacagaatcgaccaccaggagcaccccagagacagaagatacagcgagccccaccagcagagaccccccgtgtacagaagacccggcgactgggactgcccctggtgcaacgccgtgaacttcagcagaagagacacctgcttcgactgcggcaagggcatctggctgcagaagccccactag

SEQ ID NO: 25097 - DNA, 2637 bp, Artificial Sequence
  Description of Artificial Sequence: Synthetic coding sequence
atgtacgagggcaagcacatccacttcagcgaggtggacaacaagcccctgtgcagctacagccccaagctgtgcaagcagagaagactgaacggctacgccttctgcatcagacacgtgctggaggacaagaccgcccccttcaagcagtgcgagtacgtggccaagtacaacagccagagatgcaccaaccccatccccaagagcgaggacagaagatactgcaacagccacctgcaggtgctgggcttcatccccaagaaggagagaaagaagaagaacgaccccatcgacgaggtgaaggtgagacaccagatggacaccatggccttcagcctgaccgtgcccaccctggccctgaagatgcccaacggcctggacggcatgagcctgagcccccccggcgccagagtgcccctgcactacctggagaccgagctggaggaccccttcgccttcaacgaggaggacgacgacctgaagaagggcgccaccgtgagaaagaagctgcagagcaagctggcccagaacagacagagacagagagagaccgagatcctgaaggtgagacaggagcacttcagccccccccccgcccccagccagcagcagcccccccagcagcacagccacctgagccccctgagcaccagcctgaagccccccgcccccccccagggcagcgtgtgcaagagcccccagccccagaacaccagcctgcccatgcagggcgtggcccccaccacccacaccatcgcccaggccagacagctgagccacaagagacccctgcccctgctgcccagcagcagagcccccaccgtggacccccccagaaccgacagaatcctgatgaaggccaccgccttcagcccccacttcagctgcatcagcagactgcagagactggtgaagctgtgcacccagaagcaccagctggacaccgacctgttcccccacctgggcctggactggagcgaggagagcggcgaggagcccgaggacagcgagcaggccagcccctaccaggtggcctggagcatcagagagaccctgagataccagagacacgccagcgacgacgacgacgccgagagcagaagcagcagagtgacccagctgtgcacctacttccagcagaagtacaagcacctgtgcagactggagagagccgagagcagacagaagaagtgcagacacaccttcagaaaggccctgctgcaggccgccagcaaggagcccgagtgcaccggccagctgatccaggagctgagaagagccgcctgcagcagaaccagcatcagcagaaccaagctgagagaggtggagcccgccgcctgcagcggcaccgtgaagggcgagcagtgcgccaacaaggccctgcccttcaccagacactgcttccagcacatcctgctgaaccacagccagcagctgttcagcagctgcaccgccaagttcgccgacggccagcagtgcagcgtgcccgtgttcgacatcacccaccagacccccctgtgcgaggagcacgccaagaagatggacaacttcctgagaggcgacaacagcagaaaggtgcagcaccagcagcagagaaagcccagaaagaagaccaagccccccgccctgaccaagaagcacaagaagaagagaagaagaggccccagaagaccccagaagcccatcccccccgccgtgccccagggcaacctgagcatgcccgccagcgtgagcctgcccgtggaggccagccacatcagaagccccagcacccccgagctgagcgccgacgagctgcccgacgacatcgccaacgagatcaccgacatcccccacgacctggagctgaaccaggaggacttcagcgacgtgctgcccagactgcccgacgacctgcaggacttcgacttcttcgagggcaagaacggcgacctgctgcccaccaccgaggaggccgaggagctggagagagccctgcaggccgtgaccagcctggagtgcctgagcaccatcggcgtgctggcccagagcgacggcgtgcccgtgcaggagctgagcgacagaggcatcggcgtgttcagcaccggcaccggcgccagcggcatccagagcctgagcagagaggtgaacaccgacctgggcgagctgctgaacggcagaatcgtgcacgacaacttcagcagcctggagctggacgagaacctgctgagaagcgccaccctgagcaacccccccacccccctggccggccagatccagggccagttcagcgcccccgccaacgtgggcctgaccagcgccaccctgatcagccagagcgccctgggcgagagagccttccccggccagttccacggcctgcacgacggcagccacgccagccagagaccccaccccgcccagctgctgagcaaggccgacgacctgatcaccagcagacagcagtacagcagcgaccacagccacagcagcccccacggcagccactacgacagcgagcacgtgcccagcccctacagcgaccacatcaccagcccccacaccaccagctacagcggcgacaacatggccgcccccgtgtgcttcagaggctaccacagacccgccagcgtggcctggggcctgctgctgaactag

SEQ ID NO: 25098 - DNA, 4983 bp, Artificial Sequence
  Description of Artificial Sequence: Synthetic coding sequence
atggacagcggccccgtgtaccacggcgacagcagacagctgagcgccagcggcgtgcccgtgaacggcgccagagagcccgccggccccagcctgctgggcaccggcggcccctggagagtggaccagaagcccgactgggaggccgcccccggccccgcccacaccgccagactggaggacgcccacgacctggtggccttcagcgccgtggccgaggccgtgagcagctacggcgccctgagcaccagactgtacgagaccttcaacagagagatgagcagagaggccggcaacaacagcagaggccccagacccggccccgagggctgcagcgccggcagcgaggacctggacaccctgcagaccgccctggccctggccagacacggcatgaagccccccaactgcaactgcgacggccccgagtgccccgactacctggagtggctggagggcaagatcaagagcgtggtgatggagggcggcgaggagagacccagactgcccggccccctgccccccggcgaggccggcctgcccgcccccagcaccagacccctgctgagcagcgaggtgccccagatcagcccccaggagggcctgcccctgagccagagcgccctgagcatcgccaaggagaagaacatcagcctgcagaccgccatcgccatcgaggccctgacccagctgagcagcgccctgccccagcccagccacagcaccccccaggccagctgccccctgcccgaggccctgagcccccccgcccccttcagaagcccccagagctacctgagagcccccagctggcccgtggtgccccccgaggagcacagcagcttcgcccccgacagcagcgccttcccccccgccacccccagaaccgagttccccgaggcctggggcaccgacaccccccccgccacccccagaagcagctggcccatgcccagacccagccccgaccccatggccgagctggagcagctgctgggcagcgccagcgactacatccagagcgtgttcaagagacccgaggccctgcccaccaagcccaaggtgaaggtggaggcccccagcagcagccccgcccccgcccccagccccgtgctgcagagagaggcccccacccccagcagcgagcccgacacccaccagaaggcccagaccgccctgcagcagcacctgcaccacaagagaagcctgttcctggagcaggtgcacgacaccagcttccccgcccccagcgagcccagcgcccccggctggtggcccccccccagcagccccgtgcccagactgcccgacagaccccccaaggagaagaagaagaagctgcccacccccgccggcggccccgtgggcaccgagaaggccgcccccggcatcaagcccagcgtgagaaagcccatccagatcaagaagagcagacccagagaggcccagcccctgttcccccccgtgagacagatcgtgctggagggcctgagaagccccgccagccaggaggtgcaggcccacccccccgcccccctgcccgccagccagggcagcgccgtgcccctgccccccgagcccagcctggccctgttcgcccccagccccagcagagacagcctgctgccccccacccaggagatgagaagccccagccccatgaccgccctgcagcccggcagcaccggccccctgccccccgccgacgacaagctggaggagctgatcagacagttcgaggccgagttcggcgacagcttcggcctgcccggcccccccagcgtgcccatccaggaccccgagaaccagcagacctgcctgcccgcccccgagagccccttcgccaccagaagccccaagcagatcaagatcgagagcagcggcgccgtgaccgtgctgagcaccacctgcttccacagcgaggagggcggccaggaggccacccccaccaaggccgagaaccccctgacccccaccctgagcggcttcctggagagccccctgaagtacctggacacccccaccaagagcctgctggacacccccgccaagagagcccaggccgagttccccacctgcgactgcgtggagcagatcgtggagaaggacgagggcccctactacacccacctgggcagcggccccaccgtggccagcatcagagagctgatggaggagagatacggcgagaagggcaaggccatcagaatcgagaaggtgatctacaccggcaaggagggcaagagcagcagaggctgccccatcgccaagtgggtgatcagaagacacaccctggaggagaagctgctgtgcctggtgagacacagagccggccaccactgccagaacgccgtgatcgtgatcctgatcctggcctgggagggcatccccagaagcctgggcgacaccctgtaccaggagctgaccgacaccctgagaaagtacggcaaccccaccagcagaagatgcggcctgaacgacgacagaacctgcgcctgccagggcaaggaccccaacacctgcggcgccagcttcagcttcggctgcagctggagcatgtacttcaacggctgcaagtacgccagaagcaagacccccagaaagttcagactggccggcgacaaccccaaggaggaggaggtgctgagaaagagcttccaggacctggccaccgaggtggcccccctgtacaagagactggccccccaggcctaccagaaccaggtgaccaacgaggagatcgccatcgactgcagactgggcctgaaggagggcagacccttcgccggcgtgaccgcctgcatggacttctgcgcccacgcccacaaggaccagcacaacctgtacaacggctgcaccgtggtgtgcaccctgaccaaggaggacaacagatgcgtgggcaagatccccgaggacgagcagctgcacgtgctgcccctgtacaagatggccaacaccgacgagttcggcagcgaggagaaccagaacgccaaggtgggcagcggcgccatccaggtgctgaccgccttccccagagaggtgagaagactgcccgagcccgccaagagctgcagacagagacagctggaggccagaaaggccgccgccgagaagaagaagatccagaaggagaagctgagcacccccgagaagatcaagcaggaggccctggagctggccggcatcaccagcgaccccggcctgagcctgaagggcggcctgagccagcagggcctgaagcccagcctgaaggtggagccccagaaccacttcagcagcttcaagtacagcggcaacgccgtggtggagagctacagcgtgctgggcaactgcagacccagcgacccctacagcatgaacagcgtgtacagctaccacagctactacgcccagcccagcctgaccagcgtgaacggcttccacagcaagtacgccctgcccagcttcagctactacggcttccccagcagcaaccccgtgttccccagccagttcctgggccccggcgcctggggccacagcggcagcagcggcagcttcgagaagaagcccgacctgcacgccctgcacaacagcctgagccccgcctacggcggcgccgagttcgccgagctgcccagccaggccgtgcccaccgacgcccaccaccccaccccccaccaccagcagcccgcctaccccggccccaaggagtacctgctgcccaaggcccccctgctgcacagcgtgagcagagaccccagccccttcgcccagagcagcaactgctacaacagaagcatcaagcaggagcccgtggaccccctgacccaggccgagcccgtgcccagagacgccggcaagatgggcaagacccccctgagcgaggtgagccagaacggcggccccagccacctgtggggccagtacagcggcggccccagcatgagccccaagagaaccaacggcgtgggcggcagctggggcgtgttcagcagcggcgagagccccgccatcgtgcccgacaagctgagcagcttcggcgccagctgcctggcccccagccacttcaccgacggccagtggggcctgttccccggcgagggccagcaggccgccagccacagcggcggcagactgagaggcaagccctggagcccctgcaagttcggcaacagcaccagcgccctggccggccccagcctgaccgagaagccctgggccctgggcgccggcgacttcaacagcgccctgaagggcagccccggcttccaggacaagctgtggaaccccatgaagggcgaggagggcagaatccccgccgccggcgccagccagctggacagagcctggcagagcttcggcctgcccctgggcagcagcgagaagctgttcggcgccctgaagagcgaggagaagctgtgggaccccttcagcctggaggagggccccgccgaggagccccccagcaagggcgccgtgaaggaggagaagggcggcggcggcgccgaggaggaggaggaggagctgtggagcgacagcgagcacaacttcctggacgagaacatcggcggcgtggccgtggcccccgcccacggcagcatcctgatcgagtgcgccagaagagagctgcacgccaccacccccctgaagaagcccaacagatgccaccccaccagaatcagcctggtgttctaccagcacaagaacctgaaccagcccaaccacggcctggccctgtgggaggccaagatgaagcagctggccgagagagccagagccagacaggaggaggccgccagactgggcctgggccagcaggaggccaagctgtacggcaagaagagaaagtggggcggcaccgtggtggccgagccccagcagaaggagaagaagggcgtggtgcccaccagacaggccctggccgtgcccaccgacagcgccgtgaccgtgagcagctacgcctacaccaaggtgaccggcccctacagcagatggatctag

SEQ ID NO: 25099 - DNA, 759 bp, Artificial Sequence
  Description of Artificial Sequence: Synthetic coding sequence
atgacccacgacaagagctggagaagatgcagcatcagcggcagcaccaagtgcagatgcggcagcagaatcgccggccccaacgccctgggcagcggcggcagcagaagcagcagcagcagcagcagaagcatcctgagcagcagcatcctgagcagcagcatccccagcagcagcagcagcagcagcagccccagcagcagccccagcagcagcagccccagcagcagccacagcagcagcagccccagcagcagcagcagcaccagcagccccagcagcagcagcagcagcagcagcagcagccccagcagcagcaacagcagcagcagcagcagcagcagcagccccagcagcagcagcagcagcagcagcagcagccccagcagcagcagcagcagccccagcagcagcagcagcagcagcagcagcagccccagcagcagcagcagcagccccagcagcagcagcagcagcagcagcagcagcagcagcagccccagcagcagcagccccagcagcagcggcagcagccccagcagcagcaacagcagccccagcagcagcagcagcagccccagcagcagcagcagcagccccagccccagaagcagcagccccagcagcagcagcagcagcaccagcagccccagcagcagcagccccagcagcagcagccccagcagcagctgccccagcgccgccctgggcagaagaccccagagcccccagagcagccactgcgcccccttcccctag

SEQ ID NO: 25100 - DNA, 759 bp, Artificial Sequence; identical to SEQ ID NO: 25099
  Description of Artificial Sequence: Synthetic coding sequence

SEQ ID NO: 25101 - DNA, 759 bp, Artificial Sequence; identical to SEQ ID NO: 25099
  Description of Artificial Sequence: Synthetic coding sequence

SEQ ID NO: 25102 - DNA, 156 bp, Artificial Sequence
  Description of Artificial Sequence: Synthetic coding sequence
atgacccacgacaagagctggagaagatgcagcatcagcggcagcaccaagtgcagatgcggcagcagaatcgccggccccaacgccctgggcagcggcggcagcagaagcagcagcagcagcagcagaagcatcctgagcagcagcatcctgtag

SEQ ID NO: 25103 - DNA, 66 bp, Artificial Sequence
  Description of Artificial Sequence: Synthetic coding sequence
atgacccacgacaagagctggagaagatgcagcatcagcggcagcaccaagtgcagatgcggctag

SEQ ID NO: 25104 - DNA, 228 bp, Artificial Sequence
  Description of Artificial Sequence: Synthetic coding sequence
atgacccacgacaagagctggagaagatgcagcatcagcggcagcaccaagtgcagatgcggcagcagaatcgccggccccaacgccctgggcagcggcggcagcagaagcagcagcagcagcagcagaagcatcctgagcagcagcatcctgagcagcagcatccccagcagcagcagcagcagcagcagccccagcagcagccccagcagcagcagccccagctag

SEQ ID NO: 25105 - DNA, 132 bp, Artificial Sequence
  Description of Artificial Sequence: Synthetic coding sequence
atgacccacgacaagagctggagaagatgcagcatcagcggcagcaccaagtgcagatgcggcagcagaatcgccggccccaacgccctgggcagcggcggcagcagaagcagcagcagcagcagcagatag

SEQ ID NO: 25106 - DNA, 117 bp, Artificial Sequence
  Description of Artificial Sequence: Synthetic coding sequence
atgacccacgacaagagctggagaagatgcagcatcagcggcagcaccaagtgcagatgcggcagcagaatcgccggccccaacgccctgggcagcggcggcagcagaagcagctag

SEQ ID NO: 25107 - DNA, 39 bp, Artificial Sequence
  Description of Artificial Sequence: Synthetic coding sequence
atgacccacgacaagagctggagaagatgcagcatctag

SEQ ID NO: 25108 - DNA, 63 bp, Artificial Sequence
  Description of Artificial Sequence: Synthetic coding sequence
atgacccacgacaagagctggagaagatgcagcatcagcggcagcaccaagtgcagatgctag

SEQ ID NO: 25109 - DNA, 453 bp, Artificial Sequence
  Description of Artificial Sequence: Synthetic coding sequence
atgacccacgacaagagctggagaagatgcagcatcagcggcagcaccaagtgcagatgcggcagcagaatcgccggccccaacgccctgggcagcggcggcagcagaagcagcagcagcagcagcagaagcatcctgagcagcagcatcctgagcagcagcatccccagcagcagcagcagcagcagcagccccagcagcagccccagcagcagcagccccagcagcagccacagcagcagcagccccagcagcagcagcagcaccagcagccccagcagcagcagcagcagcagcagcagcagccccagcagcagcaacagcagcagcagcagcagcagcagcagccccagcagcagcagcagcagcagcagcagcagccccagcagcagcagcagcagccccagcagcagcagcagcagcagcagcagcagccccagcagcagcagctag

SEQ ID NO: 25110 - DNA, 747 bp, Artificial Sequence
  Description of Artificial Sequence: Synthetic coding sequence
atgctgagaaacaacaagaccatcatcatcaagtacttcctgaacctgatcaacggcgccttcctggtgctgggcctgctgttcatgggcttcggcgcctggctgctgctggacagaaacaacttcctgaccgccttcgacgagaacaaccacttcatcgtgcccatcagccagatcctgatcggcatgggcagcagcaccgtgctgttctgcctgctgggctacatcggcatccacaacgagatcagatggctgctgatcgtgtacgccgtgctgatcacctggaccttcgccgtgcaggtggtgctgagcgccttcatcatcaccaagaaggaggaggtgcagcagctgtggcacgacaagatcgacttcgtgatcagcgagtacggcagcaaggacaagcccgaggacatcaccaagtggaccatcctgaacgccctgcagaagaccctgcagtgctgcggccagcacaactacaccgactggatcaagaacaagaacaaggagaacagcggccaggtgccctgcagctgcaccaagagcaccctgagaaagtggttctgcgacgagcccctgaacgccacctacctggagggctgcgagaacaagatcagcgcctggtacaacgtgaacgtgctgaccctgatcggcatcaacttcggcctgctgaccagcgaggtgttccaggtgagcctgaccgtgtgcttcttcaagaacatcaagaacatcatccacgccgagatgtag

SEQ ID NO: 25111 - DNA, 267 bp, Artificial Sequence
  Description of Artificial Sequence: Synthetic coding sequence
atgctgagaaacaacaagaccatcatcatcaagtacttcctgaacctgatcaacggcgccttcctggtgctgggcctgctgttcatgggcttcggcgcctggctgctgctggacagaaacaacttcctgaccgccttcgacgagaacaaccacttcatcgtgcccatcagccagatcctgatcggcatgggcagcagcaccgtgctgttctgcctgctgggctacatcggcatccacaacgagatcagatggctgctgatcgtgtag

SEQ ID NO: 25112 - DNA, 7128 bp, Artificial Sequence
  Description of Artificial Sequence: Synthetic coding sequence
atgcacatcctgttccagaagggcatgctgaagagagtgaagaagctgctggacctgctggtgaagttcgacatcaacttcaacctgaagaacaaggagggcaaggacgccagacacagaatcaagaagaacgacagcctgctgctggcctggaacaaggccctgatggagaacagaagaagaagcagacaggacagcgccgcccacctgggcaagctgagcaagagcaccgcccccggccacaccagccagctgaagagccagggcagcttcaagagcgtgccctgcggcgccaccgccagaaccctgcccgagggcagcgccgtgcccgacagctgggagaccctgcccggcacccaggtgaccagaaaggagcccggcgccctgagaccctgcagcctgagagactgcctgatgcaggacatcaccgtgctgatccagcaggtggaggtggaccccagcttccccgaggactgcctgcagagcagcgagcccctggaggccggcgccggcaaggagggcaagaaggacgacaagcccaccctgggcgccggcgcccccgactgcagcgaggtgggcgagggccacgcccaggtgggcctgggcgccctgcagctggtgcccgacgacaacagaggcaaggagggcaacgacgaccaggacgactggagcacccaggagatcgaggcctgcctgcaggacttcgacaacatgacctgggagatcgagtgcaccagcgagatgctgaagaagctgagcagcaaggtgatgaccaaggtgatcaagaagaagatcatcctggccatccagcagctgggcaacggcgagtggacccagggcctgcagaagagactgaagcacctgaagggcagcatccagctgttcgaggccaagctggacaagggcgccagaatgctgtgggagctggccatcgacttcagccccagatgcagcgagaaccccgagaagatcatcgccaccgagcagaacacctgcgccatggagaagagcggcagaatctacaccgagatcatcagaatctgggacatcgtgctggaccactgcaagctggccgacagcatcaaggccatctgcaacgcctacaacagaggcctgagctgcgtgctgagaaagaagctgaagggcatcaacaagggccaggtgagcgccaacatgaagatccagaagagaatccccagatgctacgtggaggacaccgaggccgagaagggcagagagcacgtgaaccccgagtacttcccccccgccagcgccgtggagaccgagtacaacatcatgaagttccacagcttcagcaccaacatggccttcaacatcctgaacgacaccaccgccaccgtggagtaccccttcagagtgggcgagctggagtacgccgtgatcgacctgaaccccagacccctggagcccatcatcctgatcggcagaagcggcaccggcaagaccacctgctgcctgtacagactgtggaagaagttccacgtgtactgggagaaggccgagcaggccggcagccccctgctggccaagcaggtgtggctgaagagaagactggaggtggagcccggcaaggagagccccggcggcgaggaggaggaggaggaggaggacgaggaggaggaggacagcatcgaggtggagaccgtggagagcatcgacgagcaggagtacgaggcctgcgccggcggcgccggcgtggagcccgccggcgacggccaggccgccgaggtgtgcgcccccgagcacccccaccagctggagcacctgcaccagatcttcgtgaccaagaaccacgtgctgtgccaggaggtgcagagaaacttcatcgagctgagcaagagcaccaaggccaccagccactacaagcccctggaccccaacatccacaagctgcaggacctgagagacgagaacttccccctgttcgtgaccagcaagcagctgctgctgctgctggacgccagcctgcccaagcccttcttcctgagaaacgaggacggcagcctgaagagaaccatcatcggctggagcgcccaggaggagagcaccatccccagctggcaggaggacgaggaggaggccgaggtggacggcgactacagcgaggaggacaaggccgtggagatgagaaccggcgacagcgaccccagagtgtacgtgaccttcgaggtgttcaagaacgagatctggcccaagatgaccaagggcagaaccgcctacaaccccgccctgatctggaaggagatcaagagcttcctgaagggcagcttcgaggccctgagctgcccccacggcagactgaccgaggaggtgtacaagaagctgggcagaaagagatgccccaacttcaaggaggacagaagcgagatctacagcctgttcagcctgtaccagcagatcagaagccagaagggctacttcgacgaggaggacgtgctgtacaacatcagcagaagactgagcaagctgagagtgctgccctggagcatccacgagctgtacggcgacgagatccaggacttcacccaggccgagctggccctgctgatgaagtgcatcaacgaccccaacagcatgttcctgaccggcgacaccgcccagagcatcatgaagggcgtggccttcagattcagcgacctgagaagcctgttccactacgccagcagaaacaccatcgacaagcagtgcgccgtgagaaagcccaagaagatccaccagctgtaccagaactacagaagccacagcggcatcctgaacctggccagcggcgtggtggacctgctgcagttctacttccccgagagcttcgacagactgcccagagacagcggcctgttcgacggccccaagcccaccgtgctggagagctgcagcgtgagcgacctggccatcctgctgagaggcaacaagagaaagacccagcccatcgagttcggcgcccaccaggtgatcctggtggccaacgagaccgccaaggagaagatccccgaggagctgggcctggccctggtgctgaccatctacgaggccaagggcctggagttcgacgacgtgctgctgtacaacttcttcaccgacagcgaggcctacaaggagtggaagatcatcagcagcttcacccccaccagcaccgacagcagagaggagaacagacccctggtggaggtgcccctggacaagcccggcagcagccagggcagaagcctgatggtgaaccccgagatgtacaagctgctgaacggcgagctgaagcagctgtacaccgccatcaccagagccagagtgaacctgtggatcttcgacgagaacagagagaagagagcccccgccttcaagtacttcatcagaagagacttcgtgcaggtggtgaagaccgacgagaacaaggacttcgacgacagcatgttcgtgaagaccagcacccccgccgagtggatcgcccagggcgactactacgccaagcaccagtgctggaaggtggccgccaagtgctaccagaagggcggcgccttcgagaaggagaagctggccctggcccacgacaccgccctgagcatgaagagcaagaaggtgagccccaaggagaagcagctggagtacctggagctggccaagacctacctggagtgcaaggagcccaccctgagcctgaagtgcctgagctacgccaaggagttccagctgagcgcccagctgtgcgagagactgggcaagatcagagacgccgcctacttctacaagagaagccagtgctacaaggacgccttcagatgcttcgagcagatccaggagttcgacctggccctgaagatgtactgccaggaggagctgttcgaggaggccgccatcgccgtggagaagtacgaggagatgctgaagaccaagaccctgcccatcagcaagctgagctacagcgccagccagttctacctggaggccgccgccaagtacctgagcgccaacaagatgaaggagatgatggccgtgctgagcaagctggacatcgaggaccagctggtgttcctgaagagcagaaagagactggccgaggccgccgacctgctgaacagagagggcagaagagaggaggccgccctgctgatgaagcagcacggctgcctgctggaggccgccagactgaccgccgacaaggacttccaggccagctgcctgctgggcgccgccagactgaacgtggccagagacagcgacatcgagcacaccaaggacatcctgagagaggccctggacatctgctaccagaccggccagctgagcggcatcgccgaggcccacttcctgcagggcgtgatcctgagagacttccagaagctgagagacgccttcttcaagttcgacaccctgaaccacagcgccggcgtggtggaggccctgtacgaggccgccagccagtgcgaggccgagcccgagaagatcctgggcctggcccccggcggcctggagatcctgctgagcctggtgagagccctgaagagagtgaccaacaacgccgagaaggagatggtgaagagctgcttcgagttcttcggcatcagccaggtggacgccaagtactgccagatcgcccagaacgaccccggccccatcctgagaatcatcttcgacctggacctgaacctgagagagaagaagaccaaggaccacttcctgatcatgaccgaccaggtgaagctggccctgaacaagcacctgctgggcagactgtgccagatcaccagaagcctgctgggcaagacctacagaggcgtgtgcatgagattcatcgtgggcctgaagtgcgaggacgagaactgcgagcacttccacagacccctgagaagatgcgaggccaagtgcctggtgcagagcaagatgaacctggtggccatcaacggcctgctgctggaggccaagaaggtgttccccaagatcctggccgaggagctgaaggagatcgactacatcctgagcaccgacatgtacggcctgtgcaagagcatcctggacgtgctgttccccaagcacttccaccagagagtgctgagcgagaaccccatggcctgcaaggagatcctgaagcccaactacaagagcttcagattctacagattcgccctgaaggagtacatccacttcctgttcgagaacgagagcgccagaaacagaagagagagcaccgacctgtggctgagcgccatgcaggccttcctgctgagcagcaactaccccgaggagttcgagaagctgctgcaccaggaggaggacaactacaacagagagctgaaggccctggagagcgagaaggacgagagaggcagaggcagaggcagcagaatcaagggcatcgagggcaagttcggcatgctggcccccaacagagacgacgagaacatggacaagacccacctgtgcttcatcagactgctggagaactgcatcgaccagttctacgtgtacagaaaccccgaggactacaagagactgttcttcagattcatgaacgtgctgatcaagagatgcaaggagcccctgatccccagcatcggcaacaccgtggccctgctggagttccagttcatccactgcggcgtggtgctggccagactgtggaagaacgtgatcctgtgcctgcccaagagctacatcgccctgctgcactactgggagttcctgttcagcaagaaggacaaggagctgggcgacgtgttcagcatcatccaggagtacaagcccaaggacgtgaccagagccatccaggacttcagattccacctgagctacctggccaaggtgctgtgcggctacgagaacgtgaacttcaacgtgctgctggacgccttcagcgagatcgactacgtggtgagcggcgaggccgagagaaccctggtgctgtgcctggtgatgctggtgaacgccgaggagatcctgcagccctactgcaagcccctgctgtacagacacttcagagagatcgagagcagactgcagctgatgagcatggactgccccggccaggtgcccgagagactgctgaaggtggtgaagagagtgctggtggccgtgaacgtgaagagcgtggccgaggccctgcaggacctgctgttcgagagagacgaggagtacctgatggactgcgactggagatgggaccccgtgcacaccaagggcagcatcgtgagaggcctgtactacgaggaggtgagactgaacagactgctgtgcctggaccccgtggactacttcgccgagcccgagtgcgagttcggccaggacgagatggacgagctggccctggaggacagagaccacgtgctggccaccatcctgagccagaagcagagaaaggccagcatccagagaaagctgagaagagcctgcctggtggtgagcctgtgcatcagctggagaagaagagtgggcacccagatggagagagtgagagaggaggccagagagcccagagccggcaacttcaagaaggccgacgtggacagaacccagtgcgacctgtgcggcgtgaagttcaccagaggccccgagaactacttcagccccagcaaggccttcgagggcgccgccagcgaggtggccgtgctgagcagagccgagctggagagagaggagtgccaggagagaaacagcgagagctacgagcagcacatccacctggagcaccaccagagacagcaggtggcctaccagaagtacagcgagttcttccacgagaaggtggaccccgccatcgacgagggcaagctggtggtgcaggacatcgagcagagcgtgtggatccacagccacgtgggcagcaaggagcacagccacatgctgcagaaggtgcaggagcacatcaagagagtgagcgacatggtggaggacctgtacagaagaaaggcctgggccggcgccgaggaggccatgaccagactggtgaacatcctgatcctgagcgtgagagacgccagagactggctgatgaagaccgagaccagactgaagaaggagggcatcgtgcaggaggacgactacgagaacgaggtggaggacttcggcgagctgagacccagaagaagaagcagaaagtgcggcaagcagagaaagtactag

SEQ ID NO: 25113 - DNA, 7128 bp, Artificial Sequence; identical to SEQ ID NO: 25112
  Description of Artificial Sequence: Synthetic coding sequence

SEQ ID NO: 25114 - DNA, 8778 bp, Artificial Sequence
  Description of Artificial Sequence: Synthetic coding sequence
atgtgggaccccagagccgccagagtgccccccagagacctggccgtgctgctgtgcaacaagagcaacgccttcttcagcctgggcaagtggaacgaggccttcgtggccgccaaggagtgcctgcagtgggaccccacctacgtgaagggctactacagagccggctacagcctgctgagactgcaccagccctacgaggccgccagaatgttcttcgagggcctgagactggtgcagagaagccaggaccaggcccccgtggccgacttcctggtgggcgtgttcaccaccatgagcagcgacagcatcgtgctgcagagcttcctgccctgcttcgaccacatcttcaccaccggcttccccaccgaggtgtggcagagcgtgatcgagaagctggccaagaagggcctgtggcacagcttcctgctgctgagcgccaagaaggacagactgcccagaaacatccacgtgcccgagctgagcctgaagagcctgttcgagaagtacgtgttcatcggcctgtacgagaagatggagcaggtgcccaagctggtgcagtggctgatcagcatcggcgccagcgtggagaccatcggcccctaccccctgcacgccctgatgagactgtgcatccaggccagagagaaccacctgttcagatggctgatggaccacaagcccgagtggaagggcagaatcaaccagaaggacggcgacggctgcaccgtgctgcacgtggtggccgcccacagccccggctacctggtgaagagacagaccgaggacgtgcagatgctgctgagattcggcgccgaccccaccctgctggacagacagagcagaagcgtggtggacgtgctgaagagaaacaagaacttcaaggccatcgagaagatcaacagccacctggagaagctggccacctgcagcaaggacctgagcggcttcagcaacggcgacggccccaccagcgagaacgacatcttcagaaaggtgctggagcagctggtgaagtacatgaacagcggcaacagactgctgcacaagaacttcctgaagcaggaggtggtgcagagattcctgagactgctgagcaccctgcaggagatcccccccgacctggtgtgcgacatcaaccaggactgcgccaccaccgtgttcaagttcctgctggagaagcagagatggcccgaggtgctgctgctgctgaccagaaaggtgagcggcgagccccccctgggcgactgcctgatcaaggactgcaacttcagcgacctggacatctgcaccatcatcccccacctgagcacctgggaccagagaaagaagcagctgctgggctgcctgatcgacagcggcgccctgcccgacggcctgcaggagagccaggagagacccgtggtgacctgcctgaagcacgaggacttcgagctggccttcctgctgctgaccaagggcgccgaccccagagccatcagcctgaccgagggcgacacccccctgcacgccgccctgcacatcttcctggagatcaaggccgacatcggcttcagcttcctgagccacctgctggacctgttctggagcaaccccaccgagttcgactacctgaaccccaacgtgcaggacagcaacggcaacaccctgatgcacatcctgttccagaagggcatgctgaagagagtgaagaagctgctggacctgctggtgaagttcgacatcaacttcaacctgaagaacaaggagggcaaggacgccagacacagaatcaagaagaacgacagcctgctgctggcctggaacaaggccctgatggagaacagaagaagaagcagacaggacagcgccgcccacctgggcaagctgagcaagagcaccgcccccggccacaccagccagctgaagagccagggcagcttcaagagcgtgccctgcggcgccaccgccagaaccctgcccgagggcagcgccgtgcccgacagctgggagaccctgcccggcacccaggtgaccagaaaggagcccggcgccctgagaccctgcagcctgagagactgcctgatgcaggacatcaccgtgctgatccagcaggtggaggtggaccccagcttccccgaggactgcctgcagagcagcgagcccctggaggccggcgccggcaaggagggcaagaaggacgacaagcccaccctgggcgccggcgcccccgactgcagcgaggtgggcgagggccacgcccaggtgggcctgggcgccctgcagctggtgcccgacgacaacagaggcaaggagggcaacgacgaccaggacgactggagcacccaggagatcgaggcctgcctgcaggacttcgacaacatgacctgggagatcgagtgcaccagcgagatgctgaagaagctgagcagcaaggtgatgaccaaggtgatcaagaagaagatcatcctggccatccagcagctgggcaacggcgagtggacccagggcctgcagaagagactgaagcacctgaagggcagcatccagctgttcgaggccaagctggacaagggcgccagaatgctgtgggagctggccatcgacttcagccccagatgcagcgagaaccccgagaagatcatcgccaccgagcagaacacctgcgccatggagaagagcggcagaatctacaccgagatcatcagaatctgggacatcgtgctggaccactgcaagctggccgacagcatcaaggccatctgcaacgcctacaacagaggcctgagctgcgtgctgagaaagaagctgaagggcatcaacaagggccaggtgagcgccaacatgaagatccagaagagaatccccagatgctacgtggaggacaccgaggccgagaagggcagagagcacgtgaaccccgagtacttcccccccgccagcgccgtggagaccgagtacaacatcatgaagttccacagcttcagcaccaacatggccttcaacatcctgaacgacaccaccgccaccgtggagtaccccttcagagtgggcgagctggagtacgccgtgatcgacctgaaccccagacccctggagcccatcatcctgatcggcagaagcggcaccggcaagaccacctgctgcctgtacagactgtggaagaagttccacgtgtactgggagaaggccgagcaggccggcagccccctgctggccaagcaggtgtggctgaagagaagactggaggtggagcccggcaaggagagccccggcggcgaggaggaggaggaggaggaggacgaggaggaggaggacagcatcgaggtggagaccgtggagagcatcgacgagcaggagtacgaggcctgcgccggcggcgccggcgtggagcccgccggcgacggccaggccgccgaggtgtgcgcccccgagcacccccaccagctggagcacctgcaccagatcttcgtgaccaagaaccacgtgctgtgccaggaggtgcagagaaacttcatcgagctgagcaagagcaccaaggccaccagccactacaagcccctggaccccaacatccacaagctgcaggacctgagagacgagaacttccccctgttcgtgaccagcaagcagctgctgctgctgctggacgccagcctgcccaagcccttcttcctgagaaacgaggacggcagcctgaagagaaccatcatcggctggagcgcccaggaggagagcaccatccccagctggcaggaggacgaggaggaggccgaggtggacggcgactacagcgaggaggacaaggccgtggagatgagaaccggcgacagcgaccccagagtgtacgtgaccttcgaggtgttcaagaacgagatctggcccaagatgaccaagggcagaaccgcctacaaccccgccctgatctggaaggagatcaagagcttcctgaagggcagcttcgaggccctgagctgcccccacggcagactgaccgaggaggtgtacaagaagctgggcagaaagagatgccccaacttcaaggaggacagaagcgagatctacagcctgttcagcctgtaccagcagatcagaagccagaagggctacttcgacgaggaggacgtgctgtacaacatcagcagaagactgagcaagctgagagtgctgccctggagcatccacgagctgtacggcgacgagatccaggacttcacccaggccgagctggccctgctgatgaagtgcatcaacgaccccaacagcatgttcctgaccggcgacaccgcccagagcatcatgaagggcgtggccttcagattcagcgacctgagaagcctgttccactacgccagcagaaacaccatcgacaagcagtgcgccgtgagaaagcccaagaagatccaccagctgtaccagaactacagaagccacagcggcatcctgaacctggccagcggcgtggtggacctgctgcagttctacttccccgagagcttcgacagactgcccagagacagcggcctgttcgacggccccaagcccaccgtgctggagagctgcagcgtgagcgacctggccatcctgctgagaggcaacaagagaaagacccagcccatcgagttcggcgcccaccaggtgatcctggtggccaacgagaccgccaaggagaagatccccgaggagctgggcctggccctggtgctgaccatctacgaggccaagggcctggagttcgacgacgtgctgctgtacaacttcttcaccgacagcgaggcctacaaggagtggaagatcatcagcagcttcacccccaccagcaccgacagcagagaggagaacagacccctggtggaggtgcccctggacaagcccggcagcagccagggcagaagcctgatggtgaaccccgagatgtacaagctgctgaacggcgagctgaagcagctgtacaccgccatcaccagagccagagtgaacctgtggatcttcgacgagaacagagagaagagagcccccgccttcaagtacttcatcagaagagacttcgtgcaggtggtgaagaccgacgagaacaaggacttcgacgacagcatgttcgtgaagaccagcacccccgccgagtggatcgcccagggcgactactacgccaagcaccagtgctggaaggtggccgccaagtgctaccagaagggcggcgccttcgagaaggagaagctggccctggcccacgacaccgccctgagcatgaagagcaagaaggtgagccccaaggagaagcagctggagtacctggagctggccaagacctacctggagtgcaaggagcccaccctgagcctgaagtgcctgagctacgccaaggagttccagctgagcgcccagctgtgcgagagactgggcaagatcagagacgccgcctacttctacaagagaagccagtgctacaaggacgccttcagatgcttcgagcagatccaggagttcgacctggccctgaagatgtactgccaggaggagctgttcgaggaggccgccatcgccgtggagaagtacgaggagatgctgaagaccaagaccctgcccatcagcaagctgagctacagcgccagccagttctacctggaggccgccgccaagtacctgagcgccaacaagatgaaggagatgatggccgtgctgagcaagctggacatcgaggaccagctggtgttcctgaagagcagaaagagactggccgaggccgccgacctgctgaacagagagggcagaagagaggaggccgccctgctgatgaagcagcacggctgcctgctggaggccgccagactgaccgccgacaaggacttccaggccagctgcctgctgggcgccgccagactgaacgtggccagagacagcgacatcgagcacaccaaggacatcctgagagaggccctggacatctgctaccagaccggccagctgagcggcatcgccgaggcccacttcctgcagggcgtgatcctgagagacttccagaagctgagagacgccttcttcaagttcgacaccctgaaccacagcgccggcgtggtggaggccctgtacgaggccgccagccagtgcgaggccgagcccgagaagatcctgggcctggcccccggcggcctggagatcctgctgagcctggtgagagccctgaagagagtgaccaacaacgccgagaaggagatggtgaagagctgcttcgagttcttcggcatcagccaggtggacgccaagtactgccagatcgcccagaacgaccccggccccatcctgagaatcatcttcgacctggacctgaacctgagagagaagaagaccaaggaccacttcctgatcatgaccgaccaggtgaagctggccctgaacaagcacctgctgggcagactgtgccagatcaccagaagcctgctgggcaagacctacagaggcgtgtgcatgagattcatcgtgggcctgaagtgcgaggacgagaactgcgagcacttccacagacccctgagaagatgcgaggccaagtgcctggtgcagagcaagatgaacctggtggccatcaacggcctgctgctggaggccaagaaggtgttccccaagatcctggccgaggagctgaaggagatcgactacatcctgagcaccgacatgtacggcctgtgcaagagcatcctggacgtgctgttccccaagcacttccaccagagagtgctgagcgagaaccccatggcctgcaaggagatcctgaagcccaactacaagagcttcagattctacagattcgccctgaaggagtacatccacttcctgttcgagaacgagagcgccagaaacagaagagagagcaccgacctgtggctgagcgccatgcaggccttcctgctgagcagcaactaccccgaggagttcgagaagctgctgcaccaggaggaggacaactacaacagagagctgaaggccctggagagcgagaaggacgagagaggcagaggcagaggcagcagaatcaagggcatcgagggcaagttcggcatgctggcccccaacagagacgacgagaacatggacaagacccacctgtgcttcatcagactgctggagaactgcatcgaccagttctacgtgtacagaaaccccgaggactacaagagactgttcttcagattcatgaacgtgctgatcaagagatgcaaggagcccctgatccccagcatcggcaacaccgtggccctgctggagttccagttcatccactgcggcgtggtgctggccagactgtggaagaacgtgatcctgtgcctgcccaagagctacatcgccctgctgcactactgggagttcctgttcagcaagaaggacaaggagctgggcgacgtgttcagcatcatccaggagtacaagcccaaggacgtgaccagagccatccaggacttcagattccacctgagctacctggccaaggtgctgtgcggctacgagaacgtgaacttcaacgtgctgctggacgccttcagcgagatcgactacgtggtgagcggcgaggccgagagaaccctggtgctgtgcctggtgatgctggtgaacgccgaggagatcctgcagccctactgcaagcccctgctgtacagacacttcagagagatcgagagcagactgcagctgatgagcatggactgccccggccaggtgcccgagagactgctgaaggtggtgaagagagtgctggtggccgtgaacgtgaagagcgtggccgaggccctgcaggacctgctgttcgagagagacgaggagtacctgatggactgcgactggagatgggaccccgtgcacaccaagggcagcatcgtgagaggcctgtactacgaggaggtgagactgaacagactgctgtgcctggaccccgtggactacttcgccgagcccgagtgcgagttcggccaggacgagatggacgagctggccctggaggacagagaccacgtgctggccaccatcctgagccagaagcagagaaaggccagcatccagagaaagctgagaagagcctgcctggtggtgagcctgtgcatcagctggagaagaagagtgggcacccagatggagagagtgagagaggaggccagagagcccagagccggcaacttcaagaaggccgacgtggacagaacccagtgcgacctgtgcggcgtgaagttcaccagaggccccgagaactacttcagccccagcaaggccttcgagggcgccgccagcgaggtggccgtgctgagcagagccgagctggagagagaggagtgccaggagagaaacagcgagagctacgagcagcacatccacctggagcaccaccagagacagcaggtggcctaccagaagtacagcgagttcttccacgagaaggtggaccccgccatcgacgagggcaagctggtggtgcaggacatcgagcagagcgtgtggatccacagccacgtgggcagcaaggagcacagccacatgctgcagaaggtgcaggagcacatcaagagagtgagcgacatggtggaggacctgtacagaagaaaggcctgggccggcgccgaggaggccatgaccagactggtgaacatcctgatcctgagcgtgagagacgccagagactggctgatgaagaccgagaccagactgaagaaggagggcatcgtgcaggaggacgactacgagaacgaggtggaggacttcggcgagctgagacccagaagaagaagcagaaagtgcggcaagcagagaaagtactag

SEQ ID NO: 25115 - DNA, 2583 bp, Artificial Sequence
  Description of Artificial Sequence: Synthetic coding sequence
atggcccccgccggctgctgctgctgctgctgcttctggggcggcgccgtggccgccgccggcgccgccagaagagtgctgctgctgctgctgctgggcgtgctgagcgccggcctgagacccggcgccctggccaccgagcactacagccccctgagcctgctgaagcaggagctgcagcacagacagcagcaggaggcccccgccggcggcggcggctgcagcccccagagcggcgactggggcgaccagtacagcgccgagtgcggcgagagcagcttcctgaacttccacgacagcgactgcgagcccaagggcagcagcccctgcgacagcctgctgagcctgaacaccgagaagatcctgagccaggccaagagcatcgccgagcagaagagattccccttcgccaccgacaacgacagcaccaacgaggagctggccatcgcctacgtgctgatcggcagcggcctgtacgacgaggccatcagacacttcagcaccatgctgcaggaggagcccgacctggtgagcgccatctacggcagaggcatcgcctacggcaagaagggcctgcacgacatcaagaacgccgagctggccctgttcgagctgagcagagtgatcaccctggagcccgacagacccgaggtgttcgagcagagagccgagatcctgagccccctgggcagaatcaacgaggccgtgaacgacctgaccaaggccatccagctgcagcccagcgccagactgtacagacacagaggcaccctgtacttcatcagcgaggactacgccaccgcccacgaggacttccagcagagcctggagctgaacaagaaccagcccatcgccatgctgtacaagggcctgaccttcttccacagaggcctgctgaaggaggccatcgagagcttcaaggaggccctgaagcagaaggtggacttcatcgacgcctacaagagcctgggccaggcctacagagagctgggcaacttcgaggccgccaccgagagcttccagaaggccctgctgctgaaccagaaccacgtgcagaccctgcagctgagaggcatgatgctgtaccaccacggcagcctgcaggaggccctgaagaacttcaagagatgcctgcagctggagccctacaacgaggtgtgccagtacatgaagggcctgagccacgtggccatgggccagttctacgagggcatcaaggcccagaccaaggtgatgctgaacgaccccctgcccggccagaaggccagccccgagtacctgaaggtgaagtacctgagagagtacagcagatacctgcacgcccacctggacacccccctgaccgagtacaacatcgacgtggacctgcccggcagcttcaaggaccactgggccaagaacctgcccttcctgatcgaggactacgaggagcagcccggcctgcagccccacatcaaggacgtgctgcaccagaacttcgagagctacaagcccgaggtgcaggagctgatctgcgtggccgacagactgggcagcctgatgcagtacgagacccccggcttcctgcccaacaagagaatccacagagccatgggcctggccgccctggaggtgatgcaggccgtgcagagaacctggaccaacagcaaggtgagaatgaacggcaagaccagactgatgcagtggagagacatgttcgacatcgccgtgaagtggagaagaatcgccgaccccgaccagcccgtgctgtggctggaccagatgcccgccagaagcctgagcagaggcttcaacaaccacatcaacctgatcagaggccaggtgatcaacatgagatacctggagtacttcgagaagatcctgcacttcatcaaggacagaatcctggtgtaccacggcgccaacaaccccaagggcctgctggaggtgagagaggccctggagaaggtgcacaaggtggaggacctgctgcccatcatgaagcagttcaacaccaagaccaaggacggcttcaccgtgaacaccaaggtgcccagcctgaaggaccagggcaaggagtacgacggcttcaccatcaccatcaccggcgacaaggtgggcaacatcctgttcagcgtggagacccagaccaccgaggagagaacccagctgtaccacgccgagatcgacgccctgtacaaggacctgaccgccaagggcaaggtgctgatcctgagcagcgagttcggcgaggccgacgccgtgtgcaacctgatcctgagcctggtgtactacttctacaacctgatgcccctgagcagaggcagcagcgtgatcgcctacagcgtgatcgtgggcgccctgatggccagcggcaaggaggtggccggcaagatccccaagggcaagctggtggacttcgaggccatgaccgcccccggcagcgaggccttcagcaaggtggccaagagctggatgaacctgaagagcatcagccccagctacaagaccctgcccagcgtgagcgagaccttccccaccctgagaagcatgatcgaggtgctgaacaccgacagcagccccagatgcctgaagaagctgtag

SEQ ID NO: 25116 - DNA, 2421 bp, Artificial Sequence
  Description of Artificial Sequence: Synthetic coding sequence
atggcccccgccggctgctgctgctgctgctgcttctggggcggcgccgtggccgccgccggcgccgccagaagagtgctgctgctgctgctgctgggcgtgctgagcgccggcctgagacccggcgccctggccaccgagcactacagccccctgagcctgctgaagcaggagctgcagcacagacagcagcaggaggcccccgccggcggcggcggctgcagcccccagagcggcgactggggcgaccagtacagcgccgagtgcggcgagagcagcttcctgaacttccacgacagcgactgcgagcccaagggcagcagcccctgcgacagcctgctgagcctgaacaccgagaagatcctgagccaggccaagagcatcgccgagcagaagagattccccttcgccaccgacaacgacagcaccaacgaggagctggccatcgcctacgtgctgatcggcagcggcctgtacgacgaggccatcagacacttcagcaccatgctgcagatcctgagccccctgggcagaatcaacgaggccgtgaacgacctgaccaaggccatccagctgcagcccagcgccagactgtacagacacagaggcaccctgtacttcatcagcgaggactacgccaccgcccacgaggacttccagcagagcctggagctgaacaagaaccagcccatcgccatgctgtacaagggcctgaccttcttccacagaggcctgctgaaggaggccatcgagagcttcaaggaggccctgaagcagaaggtggacttcatcgacgcctacaagagcctgggccaggcctacagagagctgggcaacttcgaggccgccaccgagagcttccagaaggccctgctgctgaaccagaaccacgtgcagaccctgcagctgagaggcatgatgctgtaccaccacggcagcctgcaggaggccctgaagaacttcaagagatgcctgcagctggagccctacaacgaggtgtgccagtacatgaagggcctgagccacgtggccatgggccagttctacgagggcatcaaggcccagaccaaggtgatgctgaacgaccccctgcccggccagaaggccagccccgagtacctgaaggtgaagtacctgagagagtacagcagatacctgcacgcccacctggacacccccctgaccgagtacaacatcgacgtggacctgcccggcagcttcaaggaccactgggccaagaacctgcccttcctgatcgaggactacgaggagcagcccggcctgcagccccacatcaaggacgtgctgcaccagaacttcgagagctacaagcccgaggtgcaggagctgatctgcgtggccgacagactgggcagcctgatgcagtacgagacccccggcttcctgcccaacaagagaatccacagagccatgggcctggccgccctggaggtgatgcaggccgtgcagagaacctggaccaacagcaaggtgagaatgaacggcaagaccagactgatgcagtggagagacatgttcgacatcgccgtgaagtggagaagaatcgccgaccccgaccagcccgtgctgtggctggaccagatgcccgccagaagcctgagcagaggcttcaacaaccacatcaacctgatcagaggccaggtgatcaacatgagatacctggagtacttcgagaagatcctgcacttcatcaaggacagaatcctggtgtaccacggcgccaacaaccccaagggcctgctggaggtgagagaggccctggagaaggtgcacaaggtggaggacctgctgcccatcatgaagttcaacaccaagaccaaggacggcttcaccgtgaacaccaaggtgcccagcctgaaggaccagggcaaggagtacgacggcttcaccatcaccatcaccggcgacaaggtgggcaacatcctgttcagcgtggagacccagaccaccgaggagagaacccagctgtaccacgccgagatcgacgccctgtacaaggacctgaccgccaagggcaaggtgctgatcctgagcagcgagttcggcgaggccgacgccgtgtgcaacctgatcctgagcctggtgtactacttctacaacctgatgcccctgagcagaggcagcagcgtgatcgcctacagcgtgatcgtgggcgccctgatggccagcggcaaggaggtggccggcaagatccccaagggcaagctggtggacttcgaggccatgaccgcccccggcagcgaggccttcagcaaggtggccaagagctggatgaacctgaagagcatcagccccagctacaagaccctgcccagcgtgagcgagaccttccccaccctgagaagcatgatcgaggtgctgaacaccgacagcagccccagatgcctgaagaagctgtag

SEQ ID NO: 25117 - DNA, 2424 bp, Artificial Sequence
  Description of Artificial Sequence: Synthetic coding sequence
atggcccccgccggctgctgctgctgctgctgcttctggggcggcgccgtggccgccgccggcgccgccagaagagtgctgctgctgctgctgctgggcgtgctgagcgccggcctgagacccggcgccctggccaccgagcactacagccccctgagcctgctgaagcaggagctgcagcacagacagcagcaggaggcccccgccggcggcggcggctgcagcccccagagcggcgactggggcgaccagtacagcgccgagtgcggcgagagcagcttcctgaacttccacgacagcgactgcgagcccaagggcagcagcccctgcgacagcctgctgagcctgaacaccgagaagatcctgagccaggccaagagcatcgccgagcagaagagattccccttcgccaccgacaacgacagcaccaacgaggagctggccatcgcctacgtgctgatcggcagcggcctgtacgacgaggccatcagacacttcagcaccatgctgcagatcctgagccccctgggcagaatcaacgaggccgtgaacgacctgaccaaggccatccagctgcagcccagcgccagactgtacagacacagaggcaccctgtacttcatcagcgaggactacgccaccgcccacgaggacttccagcagagcctggagctgaacaagaaccagcccatcgccatgctgtacaagggcctgaccttcttccacagaggcctgctgaaggaggccatcgagagcttcaaggaggccctgaagcagaaggtggacttcatcgacgcctacaagagcctgggccaggcctacagagagctgggcaacttcgaggccgccaccgagagcttccagaaggccctgctgctgaaccagaaccacgtgcagaccctgcagctgagaggcatgatgctgtaccaccacggcagcctgcaggaggccctgaagaacttcaagagatgcctgcagctggagccctacaacgaggtgtgccagtacatgaagggcctgagccacgtggccatgggccagttctacgagggcatcaaggcccagaccaaggtgatgctgaacgaccccctgcccggccagaaggccagccccgagtacctgaaggtgaagtacctgagagagtacagcagatacctgcacgcccacctggacacccccctgaccgagtacaacatcgacgtggacctgcccggcagcttcaaggaccactgggccaagaacctgcccttcctgatcgaggactacgaggagcagcccggcctgcagccccacatcaaggacgtgctgcaccagaacttcgagagctacaagcccgaggtgcaggagctgatctgcgtggccgacagactgggcagcctgatgcagtacgagacccccggcttcctgcccaacaagagaatccacagagccatgggcctggccgccctggaggtgatgcaggccgtgcagagaacctggaccaacagcaaggtgagaatgaacggcaagaccagactgatgcagtggagagacatgttcgacatcgccgtgaagtggagaagaatcgccgaccccgaccagcccgtgctgtggctggaccagatgcccgccagaagcctgagcagaggcttcaacaaccacatcaacctgatcagaggccaggtgatcaacatgagatacctggagtacttcgagaagatcctgcacttcatcaaggacagaatcctggtgtaccacggcgccaacaaccccaagggcctgctggaggtgagagaggccctggagaaggtgcacaaggtggaggacctgctgcccatcatgaagcagttcaacaccaagaccaaggacggcttcaccgtgaacaccaaggtgcccagcctgaaggaccagggcaaggagtacgacggcttcaccatcaccatcaccggcgacaaggtgggcaacatcctgttcagcgtggagacccagaccaccgaggagagaacccagctgtaccacgccgagatcgacgccctgtacaaggacctgaccgccaagggcaaggtgctgatcctgagcagcgagttcggcgaggccgacgccgtgtgcaacctgatcctgagcctggtgtactacttctacaacctgatgcccctgagcagaggcagcagcgtgatcgcctacagcgtgatcgtgggcgccctgatggccagcggcaaggaggtggccggcaagatccccaagggcaagctggtggacttcgaggccatgaccgcccccggcagcgaggccttcagcaaggtggccaagagctggatgaacctgaagagcatcagccccagctacaagaccctgcccagcgtgagcgagaccttccccaccctgagaagcatgatcgaggtgctgaacaccgacagcagccccagatgcctgaagaagctgtag

SEQ ID NO: 25118 - DNA, 2313 bp, Artificial Sequence
  Description of Artificial Sequence: Synthetic coding sequence
atggacagagacctgctgagacagagcctgaactgccacggcagcagcctgctgagcctgctgagaagcgagcagcaggacaacccccacttcagaagcctgctgggcagcgccgccgagcccgccagaggcccccccccccagcaccccctgcagggcagaaaggagaagagagtggacaacatcgagatccagaagttcatcagcaagaaggccgacctgctgttcgccctgagctggaagagcgacgcccccgccaccagcgagatcaacgaggacagcgaggaccactacgccatcatgccccccctggagcagttcatggagatccccagcatggacagaagagagctgttcttcagagacatcgagagaggcgacatcgtgatcggcagaatcagcagcatcagagagttcggcttcttcatggtgctgatctgcctgggcagcggcatcatgagagacatcgcccacctggagatcaccgccctgtgccccctgagagacgtgcccagccacagcaaccacggcgaccccctgagctactaccagaccggcgacatcatcagagccggcatcaaggacatcgacagataccacgagaagctggccgtgagcctgtacagcagcagcctgcccccccacctgagcggcatcaagctgggcgtgatcagcagcgaggagctgcccctgtactacagaagaagcgtggagctgaacagcaacagcctggagagctacgagaacgtgatgcagagcagcctgggcttcgtgaaccccggcgtggtggagttcctgctggagaagctgggcatcgacgagagcaacccccccagcctgatgagaggcctgcagagcaagaacttcagcgaggacgacttcgccagcgccctgagaaagaagcagagcgccagctgggccctgaagtgcgtgaagatcggcgtggactacttcaaggtgggcagacacgtggacgccatgaacgagtacaacaaggccctggagatcgacaagcagaacgtggaggccctggtggccagaggcgccctgtacgccaccaagggcagcctgaacaaggccatcgaggacttcgagctggccctggagaactgccccacccacagaaacgccagaaagtacctgtgccagaccctggtggagagaggcggccagctggaggaggaggagaagttcctgaacgccgagagctactacaagaaggccctggccctggacgagaccttcaaggacgccgaggacgccctgcagaagctgcacaagtacatgcagaagagcctggagctgagagagaagcaggccgagaaggaggagaagcagaagaccaagaagatcgagaccagcgccgagaagctgagaaagctgctgaaggaggagaagagactgaagaagaagagaagaaagagcaccagcagcagcagcgtgagcagcgccgacgagagcgtgagcagcagcagcagcagcagcagcagcggccacaagagacacaagaagcacaagagaaacagaagcgagagcagcagaagcagcagaagacacagcagcagagccagcagcaaccagatcgaccagaacagaaaggacgagtgctaccccgtgcccgccaacaccagcgccagcttcctgaaccacaagcaggaggtggagaagctgctgggcaagcaggacagactgcagtacgagaagacccagatcaaggagaaggacagatgccccctgagcagcagcagcctggagatccccgacgacttcggcggcagaagcgaggaccccagagacttctacaacagctacaagacccaggccggcagcagcaagaccgagaagccctacaagagcgagagacacttcagcagcagaagaaacagcagcgacagcttctgcagaaacagcgaggacaagatctacggctacagaagattcgagaaggacatcgagggcagaaaggagcactacagaagatgggagcccggcagcgtgagacacagcaccagccccgccagcagcgagtacagctggaagagcgtggagaagtacaagaagtacgcccacagcggcagcagagacttcagcagacacgagcagagatacagactgaacaccaaccagggcgagtacgagagagaggacaactacggcgaggacatcaagaccgaggtgcccgaggaggacgccctgagcagcaaggagcacagcgagagcagcgtgaagaagaacctgccccagaacctgctgaacatcttcaaccagatcgccgagttcgagaaggagaagggcaacaagagcaagaactag

SEQ ID NO: 25119 - DNA, 1962 bp, Artificial Sequence
  Description of Artificial Sequence: Synthetic coding sequence
atggacagagacctgctgagacagagcctgaactgccacggcagcagcctgctgagcctgctgagaagcgagcagcaggacaacccccacttcagaagcctgctgggcagcgccgccgagcccgccagaggcccccccccccagcaccccctgcagggcagaaaggagaagagagtggacaacatcgagatccagaagttcatcagcaagaaggccgacctgctgttcgccctgagctggaagagcgacgcccccgccaccagcgagatcaacgaggacagcgaggaccactacgccatcatgccccccctggagcagttcatggagatccccagcatggacagaagagagctgttcttcagagacatcgagagaggcgacatcgtgatcggcagaatcagcagcatcagagagttcggcttcttcatggtgctgatctgcctgggcagcggcatcatgagagacatcgcccacctggagatcaccgccctgtgccccctgagagacgtgcccagccacagcaaccacggcgaccccctgagctactaccagaccggcgacatcatcagagccggcatcaaggacatcgacagataccacgagaagctggccgtgagcctgtacagcagcagcctgcccccccacctgagcggcatcaagctgggcgtgatcagcagcgaggagctgcccctgtactacagaagaagcgtggagctgaacagcaacagcctggagagctacgagaacgtgatgcagagcagcctgggcttcgtgaaccccggcgtggtggagttcctgctggagaagctgggcatcgacgagagcaacccccccagcctgatgagaggcctgcagagcaagaacttcagcgaggacgacttcgccagcgccctgagaaagaagcagagcgccagctgggccctgaagtgcgtgaagatcggcgtggactacttcaaggtgggcagacacgtggacgccatgaacgagtacaacaaggccctggagatcgacaagcagaacgtggaggccctggtggccagaggcgccctgtacgccaccaagggcagcctgaacaaggccatcgaggacttcgagctggccctggagaactgccccacccacagaaacgccagaaagtacctgtgccagaccctggtggagagaggcggccagctggaggaggaggagaagttcctgaacgccgagagctactacaagaaggccctggccctggacgagaccttcaaggacgccgaggacgccctgcagaagctgcacaagtacatgcagaagagcctggagctgagagagaagcaggccgagaaggaggagaagcagaagaccaagaagatcgagaccagcgccgagaagctgagaaagctgctgaaggaggagaagagactgaagaagaagagaagaaagagcaccagcagcagcagcgtgagcagcgccgacgagagcgtgagcagcagcagcagcagcagcagcagcggccacaagagacacaagaagcacaagagaaacagaagcgagagcagcagaagcagcagaagacacagcagcagagccagcagcaaccagatcgaccagaacagaaaggacgagtgctaccccgtgcccgccaacaccagcgccagcttcctgaaccacaagcaggaggtggagaagctgctgggcaagcaggacagactgcagtacgagaagacccagatcaaggagaaggacagatgccccctgagcagcagcagcctggagatccccgacgacttcggcgtgtacagctacctgttcaagaagctgaccatcaagcagccccaggccggccccagcggcgacatccccgaggagggcatcgtgatcatcgacgacagcagcatccacgtgaccgaccccgaggacctgcaggtgggccaggacatggaggtggaggacagcggcatcgacgaccccgaccacggctag

SEQ ID NO: 25120 - DNA, 1320 bp, Artificial Sequence
  Description of Artificial Sequence: Synthetic coding sequence
atggacagagacctgctgagacagagcctgaactgccacggcagcagcctgctgagcctgctgagaagcgagcagcaggacaacccccacttcagaagcctgctgggcagcgccgccgagcccgccagaggcccccccccccagcaccccctgcagggcagaaaggagaagagagtggacaacatcgagatccagaagttcatcagcaagaaggccgacctgctgttcgccctgagctggaagagcgacgcccccgccaccagcgagatcaacgaggacagcgaggaccactacgccatcatgccccccctggagcagttcatggagatccccagcatggacagaagagagctgttcttcagagacatcgagagaggcgacatcgtgatcggcagaatcagcagcatcagagagttcggcttcttcatggtgctgatctgcctgggcagcggcatcatgagagacatcgcccacctggagatcaccgccctgtgccccctgagagacgtgcccagccacagcaaccacggcgaccccctgagctactaccagaccggcgacatcatcagagccggcatcaaggacatcgacagataccacgagaagctggccgtgagcctgtacagcagcagcctgcccccccacctgagcggcatcaagctgggcgtgatcagcagcgaggagctgcccctgtactacagaagaagcgtggagctgaacagcaacagcctggagagctacgagaacgtgatgcagagcagcctgggcttcgtgaaccccggcgtggtggagttcctgctggagaagctgggcatcgacgagagcaacccccccagcctgatgagaggcctgcagagcaagaacttcagcgaggacgacttcgccagcgccctgagaaagaagcagagcgccagctgggccctgaagtgcgtgaagatcggcgtggactacttcaaggtgggcagacacgtggacgccatgaacgagtacaacaaggccctggagatcgacaagcagaacgtggaggccctggtggccagaggcgccctgtacgccaccaagggcagcctgaacaaggccatcgaggacttcgagctggccctggagaactgccccacccacagaaacgccagaaagtacctgtgccagaccctggtggagagaggcggccagctggaggaggaggagaagttcctgaacgccgagagctactacaagaaggccctggccctggacgagaccttcaaggacgccgaggacgccctgcagaagctgcacaagtacatgcaggtgatcccctacttcctgctggagatctag

SEQ ID NO: 25121 - DNA, 1125 bp, Artificial Sequence
  Description of Artificial Sequence: Synthetic coding sequence
atggcctggctggacagcagaaacaccagcctgcccagcctgggcttctgcctgctgctgctgcccctgcaccccgcccccctgctgcccaccacccccacccccgccctgtgccccggcctggtgcacagccagggccaccccagcgcctgcccccacttcccccacagctacagcagaggccagcagtgcctggagcaggccgactgggagaccgccgtgctgctgttcagcagagccctgcacctggacccccagctgggccagtgcctgttcgagcagtgcgccttcctggacgccctgaacgtgttcagccacgccgccgagctgcagcccgagaagccctgcttcagatacagatgcatggcctgcctgctggccctgaagcagcaccaggcctgcctgaccctgatcaccaacgagctgaagcaggacaccaccaacgccgacgtgtacatcttcagagccagactgtacaacttcctgcagaagccccacctgtgctacagagacctgcacagcgccctgctgctgaaccccaagcacccccaggccagaatgctgctgcagaagatggtggcccaggcccagcaggccagacaggacgccggcatcctggccgtgcagggcaagctggccagaaccgccgccgaccagccctgccacagagagcagcccagcggcccccagagcctgcccctgcccggccaccacgtgcccaccgcccccggcgtgagatggggcagcggcggcctgcccgagggcgccggccacggcgacagaggccccggcggccacggcgccgccggcaccgcccccgccgtggccgacctgcagagactgtgcagagccctgctgcaggccggcagactgcccggcggcagagccgccgccgagcagggcccccccggcagagccgccggcgagagaaccctgcaccagcccagaagacagttccagaaggccgagaaccacttcagcaccgccatcagacacaacccccagaaggcccagtactacctgtacagagccaagagcagacagctgctgcagaacatcttcggcgccagacaggacgtggccaccgtgctgctgctgaaccccaagcagcccaaggacgcctag

SEQ ID NO: 25122 - DNA, 1230 bp, Artificial Sequence
  Description of Artificial Sequence: Synthetic coding sequence
atgcacggcctgagccccggcccccaggccgccagcggcctgccccacgcccaccaccagagagccgaggccggccaccaccagagaagatgcctgcacctgcccggccagaccctgcagctgagccccgaggccccccccctgctgcccggccccgcccagagactggccgtggagagccaggcccccgccggccaggacgccgcccccgaggacggcggccccggccccgccggcgcccccagatgcggcgaccccggctgcgccggccaggccgccgccagaaccgccgccgaccagccctgccacagagagcagcccagcggcccccagagcctgcccctgcccggccaccacgtgcccaccgcccccggcgtgagatggggcagcggcggcctgcccgagggcgccggccacggcgacagaggccccggcggccacggcgccgccggcaccgcccccgccgtggccgacctgcagagactgtgcagagccctgctgcaggccggcagactgcccggcggcagagccgccgccgagcagggcccccccggcagagccgccggcgagagaaccctgcaccagcccagaagacagttccagaaggccgagaaccacttcagcaccgccatcagacacaacccccagaaggcccagtactacctgtacagagccaagagcagacagctgctgcagaacatcttcggcgccagacaggacgtggccaccgtgctgctgctgaaccccaagcagcccaagctgagcctgctgatgaccaacctgttccccggcatgagcgtggaggaggtgctgagcacccagatcgcccacctggccagactgcagctggagcagatggtggagggcagcctgcaggccggcagcccccagggcatcgtgggcatgctgaagagacacgagctggagagacagaaggccctggccctgcagcacagctggaagcagggcgagcccctgatcgccaccagcgaggagctgaaggccacccccgagatcccccaggtgaagcccggcagcagcgagggcgaggccgaggcccccgaggaggaggaggagaaggagaaggagaagaaggaggtgagcggcgtgcaggccagagccagaagcccctggggcctgggccacagcgtgccccagcccagagccgagggctgcagacccgtggagagcggcttccaggcctggctgtgcacccccagcgccgtgtag

SEQ ID NO: 25123 - DNA, 2622 bp, Artificial Sequence
  Description of Artificial Sequence: Synthetic coding sequence
atgaccgacagcgacgaggacgccctgaaggtggaccagggccccagcagagacatccccaagccctgggtgatccccgcccccaagggcatcctgcagcacatcttcggcaccagccacgtgttccagagcatctgcgacgtgaagcccaaggtgaccggcctgaccgtgcccctgaaggtgagagagtactacagcagaggccagcagtgcctggagcaggccgactgggagaccgccgtgctgctgttcagcagagccctgcacctggacccccagctggtggacttctacgccctgagagccgaggcctacctgcagctgtgcgacttcagcagcgccgcccagaacctgagaagagcctacagcctgcagcaggacaactgcaagcacctggagagactgaccttcgtgctgtacctgcagggccagtgcctgttcgagcagtgcgccttcctggacgccctgaacgtgttcagccacgccgccgagctgcagcccgagaagccctgcttcagatacagatgcatggcctgcctgctggccctgaagcagcaccaggcctgcctgaccctgatcaccaacgagctgaagcaggacaccaccaacgccgacgtgtacatcttcagagccagactgtacaacttcctgcagaagccccacctgtgctacagagacctgcacagcgccctgctgctgaaccccaagcacccccaggccagaatgctgctgcagaagatggtggcccaggcccagcaggccagacaggacgccggcatcctggccgtgcagggcaagctgcagcacgccctgcagagaatcaacagagccatcgagaacaaccccctggaccccagcctgttcctgttcagaggcaccatgtacagaagactgcaggagttcgacggcgccgtggaggacttcctgaaggtgctggacatggtgaccgaggaccaggaggacatggtgagacaggcccagagacagctgctgctgacctacaacgacttcgccgtgcactgctacagacagggcgcctaccaggagggcgtgctgctgctgaacaaggccctgagagacgagcagcaggagaagggcctgtacatcaacagaggcgactgcttcttccagctgggcaacctggccttcgccgaggccgactaccagcaggccctggccctgagcccccaggacgagggcgccaacaccagaatgggcctgctgcaggagaagatgggcttctgcgagcagagaagaaagcagttccagaaggccgagaaccacttcagcaccgccatcagacacaacccccagaaggcccagtactacctgtacagagccaagagcagacagctgctgcagaacatcttcggcgccagacaggacgtggccaccgtgctgctgctgaaccccaagcagcccaagctgagcctgctgatgaccaacctgttccccggcatgagcgtggaggaggtgctgagcacccagatcgcccacctggccagactgcagctggagcagatggtggagggcagcctgcaggccggcagcccccagggcatcgtgggcatgctgaagagacacgagctggagagacagaaggccctggccctgcagcacagctggaagcagggcgagcccctgatcgccaccagcgaggagctgaaggccacccccgagatcccccaggtgaagcccggcagcagcgagggcgaggccgaggcccccgaggaggaggaggagaaggagaaggagaagaaggaggagaagaagagcgagctgatccccagcaaggtggccagcctgagcgacagctacctggaccagaccagcagcgccagcagcatgagcttcagaaccaccggcaccagcgagaccgagatgagcgccatctgccaggagtacagaagcaccagcgccaccgccgtgaccttcagcgacagcagcctgctgaagacccagagcagcgacagcggcaacaacagagaggccctgagccacggccccagaaagatcaaggccacccagggccagagacagagcctgagcaagaccgagcccacccagagccagagaagaaacagcagcaagaccaaggccaccatccacaagagaaacagcagcaagaccaaggccacccagagccagagaagaaacagcagcaagaccagagccacccagggccagggccagagcagcagcaagaccgaggccacccagggccagagacagagcagcagcgagatcgaggccacccagggccccagacaggagcccagcaagaccaagaccaccagaagccccagacagagacccagaaaggtgaaggccgccagaggcagaagctggagacccagcaaggtggacgccacccagggcagaagcagaggcctgctgagaagcagcaccaagaccgaggccttctacgacagcaactggagcctgagcaagaccgagtacgcccagggccagggccagagaagcagcaaggccgagggcgcccagggcaagagccagggcatgagcagcaccagcagcaaggccgagagcacctggggccccagccccagcctgagcaagaccgaggtggaccaggacctgacctactacgaggccgtgtag

SEQ ID NO: 25124 - DNA, 726 bp, Artificial Sequence
  Description of Artificial Sequence: Synthetic coding sequence
atggcctgcctgctggccctgaagcagcaccaggcctgcctgaccctgatcaccaacgagctgaagcaggacaccaccaacgccgacgtgtacatcttcagagccagactgtacaacttcctgcagaagccccacctgtgctacagagacctgcacagcgccctgctgctgaaccccaagcacccccaggccagaatgctgctgcagaagatggtggcccaggcccagcaggccagacaggacgccggcatcctggccgtgcagggcaagctgcagcacgccctgcagagaatcaacagagccatcgagaacaaccccctggaccccagcctgttcctgttcagaggcaccatgtacagaagactgcaggagttcgacggcgccgtggaggacttcctgaaggtgctggacatggtgaccgaggaccaggaggacatggtgagacaggcccagagacagctgctgctgacctacaacgacttcgccgtgcactgctacagacagggcgcctaccaggagggcgtgctgctgctgaacaaggccctgagagacgagcagcaggagaagggcctgtacatcaacagaggcggcgcccagagacccggccactggggcggcggcgtgagaggcagcctggccatcagcaaggcccccaccggccacctgagacccctgggcggcagaagaaagggcgagagaaaggaggccagagaggaggagatgtag

SEQ ID NO: 25125 - DNA, 3426 bp, Artificial Sequence
  Description of Artificial Sequence: Synthetic coding sequence
atggccgccgccgtgggcgtgagaggcagatacgagctgcccccctgcagcggccccggctggctgctgagcctgagcgccctgctgagcgtggccgccagaggcgccttcgccaccacccactgggtggtgaccgaggacggcaagatccagcagcaggtggacagccccatgaacctgaagcacccccacgacctggtgatcctgatgagacaggaggccaccgtgaactacctgaaggagctggagaagcagctggtggcccagaagatccacatcgaggagaacgaggacagagacaccggcctggagcagagacacaacaaggaggaccccgactgcatcaaggccaaggtgcccctgggcgacctggacctgtacgacggcacctacatcaccctggagagcaaggacatcagccccgaggactacatcgacaccgagagccccgtgccccccgaccccgagcagcccgactgcaccaagatcctggagctgccctacagcatccacgccttccagcacctgagaggcgtgcaggagagagtgaacctgagcgcccccctgctgcccaaggaggaccccatcttcacctacctgagcaagagactgggcagaagcatcgacgacatcggccacctgatccacgagggcctgcagaagaacaccagcagctgggtgctgtacaacatggccagcttctactggagaatcaagaacgagccctaccaggtggtggagtgcgccatgagagccctgcacttcagcagcagacacaacaaggacatcgccctggtgaacctggccaacgtgctgcacagagcccacttcagcgccgacgccgccgtggtggtgcacgccgccctggacgacagcgacttcttcaccagctactacaccctgggcaacatctacgccatgctgggcgagtacaaccacagcgtgctgtgctacgaccacgccctgcaggccagacccggcttcgagcaggccatcaagagaaagcacgccgtgctgtgccagcagaagctggagcagaagctggaggcccagcacagaagcctgcagagaaccctgaacgagctgaaggagtaccagaagcagcacgaccactacctgagacagcaggagatcctggagaagcacaagctgatccaggaggagcagatcctgagaaacatcatccacgagacccagatggccaaggaggcccagctgggcaaccaccagatctgcagactggtgaaccagcagcacagcctgcactgccagtgggaccagcccgtgagataccacagaggcgacatcttcgagaacgtggactacgtgcagttcggcgaggacagcagcaccagcagcatgatgagcgtgaacttcgacgtgcagagcaaccagagcgacatcaacgacagcgtgaagagcagccccgtggcccacagcatcctgtggatctggggcagagacagcgacgcctacagagacaagcagcacatcctgtggcccaagagagccgactgcaccgagagctaccccagagtgcccgtgggcggcgagctgcccacctacttcctgccccccgagaacaagggcctgagaatccacgagctgagcagcgacgactacagcaccgaggaggaggcccagacccccgactgcagcatcaccgacttcagaaagagccacaccctgagctacctggtgaaggagctggaggtgagaatggacctgaaggccaagatgcccgacgaccacgccagaaagatcctgctgagcagaatcaacaactacaccatccccgaggaggagatcggcagcttcctgttccacgccatcaacaagcccaacgcccccatctggctgatcctgaacgaggccggcctgtactggagagccgtgggcaacagcaccttcgccatcgcctgcctgcagagagccctgaacctggcccccctgcagtaccaggacgtgcccctggtgaacctggccaacctgctgatccactacggcctgcacctggacgccaccaagctgctgctgcaggccctggccatcaacagcagcgagcccctgaccttcctgagcctgggcaacgcctacctggccctgaagaacatcagcggcgccctggaggccttcagacaggccctgaagctgaccaccaagtgccccgagtgcgagaacagcctgaagctgatcagatgcatgcagttctaccccttcctgtacaacatcaccagcagcgtgtgcagcggcaccgtggtggaggagagcaacggcagcgacgagatggagaacagcgacgagaccaagatgagcgaggagatcctggccctggtggacgagttccagcaggcctggcccctggagggcttcggcggcgccctggagatgaagggcagaagactggacctgcagggcatcagagtgctgaagaagggcccccaggacggcgtggccagaagcagctgctacggcgactgcagaagcgaggacgacgaggccaccgagtggatcaccttccaggtgaagagagtgaagaagcccaagggcgaccacaagaagacccccggcaagaaggtggagaccggccagatcgagaacggccacagataccaggccaacctggagatcaccggccccaaggtggccagccccggcccccagggcaagaagagagactaccagagactgggctggcccagccccgacgagtgcctgaagctgagatgggtggagctgaccgccatcgtgagcacctggctggccgtgagcagcaagaacatcgacatcaccgagcacatcgacttcgccacccccatccagcagcccgccatggagcccctgtgcaacggcaacctgcccaccagcatgcacaccctggaccacctgcacggcgtgagcaacagagccagcctgcactacaccggcgagagccagctgaccgaggtgctgcagaacctgggcaaggaccagtacccccagcagagcctggagcagatcggcaccagaatcgccaaggtgctggagaagaaccagaccagctgggtgctgagcagcatggccgccctgtactggagagtgaagggccagggcaagaaggccatcgactgcctgagacaggccctgcactacgccccccaccagatgaaggacgtgcccctgatcagcctggccaacatcctgcacaacgccaagctgtggaacgacgccgtgatcgtggccaccatggccgtggagatcgccccccacttcgccgtgaaccacttcaccctgggcaacgtgtacgtggccatggaggagttcgagaaggccctggtgtggtacgagagcaccctgaagctgcagcccgagttcgtgcccgccaagaacagaatccagaccatccagtgccacctgatgctgaagaagggcagaagaagcccctag

SEQ ID NO: 25126 - DNA, 2871 bp, Artificial Sequence
  Description of Artificial Sequence: Synthetic coding sequence
atggccgccgccgtgggcgtgagaggcagatacgagctgcccccctgcagcggccccggctggctgctgagcctgagcgccctgctgagcgtggccgccagaggcgccttcgccaccacccactgggtggtgaccgaggacggcaagatccagcagcaggtggacagccccatgaacctgaagcacccccacgacctggtgatcctgatgagacaggaggccaccgtgaactacctgaaggagctggagaagcagctggtggcccagaagatccacatcgaggagaacgaggacagagacaccggcctggagcagagacacaacaaggaggaccccgactgcatcaaggccaaggtgcccctgggcgacctggacctgtacgacggcacctacatcaccctggagagcaaggacatcagccccgaggactacatcgacaccgagagccccgtgccccccgaccccgagcagcccgactgcaccaagatcctggagctgccctacagcatccacgccttccagcacctgagaggcgtgcaggagagagtgaacctgagcgcccccctgctgcccaaggaggaccccatcttcacctacctgagcaagagactgggcagaagcatcgacgacatcggccacctgatccacgagggcctgcagaagaacaccagcagctgggtgctgtacaacatggccagcttctactggagaatcaagaacgagccctaccaggtggtggagtgcgccatgagagccctgcacttcagcagcagacacaacaaggacatcgccctggtgaacctggccaacgtgctgcacagagcccacttcagcgccgacgccgccgtggtggtgcacgccgccctggacgacagcgacttcttcaccagctactacaccctgggcaacatctacgccatgctgggcgagtacaaccacagcgtgctgtgctacgaccacgccctgcaggccagacccggcttcgagcaggccatcaagagaaagcacgccgtgctgtgccagcagaagctggagcagaagctggaggcccagcacagaagcctgcagagaaccctgaacgagctgaaggagtaccagaagcagcacgaccactacctgagacagcaggagatcctggagaagcacaagctgatccaggaggagcagatcctgagaaacatcatccacgagacccagatggccaaggaggcccagctgggcaaccaccagatctgcagactggtgaaccagcagcacagcctgcactgccagtgggaccagcccgtgagataccacagaggcgacatcttcgagaacgtggactacgtgcagttcggcgaggacagcagcaccagcagcatgatgagcgtgaacttcgacgtgcagagcaaccagagcgacatcaacgacagcgtgaagagcagccccgtggcccacagcatcctgtggatctggggcagagacagcgacgcctacagagacaagcagcacatcctgtggcccaagagagccgactgcaccgagagctaccccagagtgcccgtgggcggcgagctgcccacctacttcctgccccccgagaacaagggcctgagaatccacgagctgagcagcgacgactacagcaccgaggaggaggcccagacccccgactgcagcatcaccgacttcagaaagagccacaccctgagctacctggtgaaggagctggaggtgagaatggacctgaaggccaagatgcccgacgaccacgccagaaagatcctgctgagcagaatcaacaactacaccatccccgaggaggagatcggcagcttcctgttccacgccatcaacaagcccaacgcccccatctggctgatcctgaacgaggccggcctgtactggagagccgtgggcaacagcaccttcgccatcgcctgcctgcagagagccctgaacctggcccccctgcagtaccaggacgtgcccctggtgaacctggccaacctgctgatccactacggcctgcacctggacgccaccaagctgctgctgcaggccctggccatcaacagcagcgagcccctgaccttcctgagcctgggcaacgcctacctggccctgaagaacatcagcggcgccctggaggccttcagacaggccctgaagctgaccaccaagtgccccgagtgcgagaacagcctgaagctgatcagatgcatgcagttctaccccttcctgtacaacatcaccagcagcgtgtgcagcggcaactgccacgagaagaccctggacaacagccacgacaagcagaagtacttcgacaacagccagagcctggacgccgccgaggaggagcccagcgagagaggcaccgaggaggaccccgtgttcagcgtggagaacagcggcagagacagcgacgccctgagactggagagcaccgtggtggaggagagcaacggcagcgacgagatggagaacagcgacgagaccaagatgagcgaggagatcctggccctggtggacgagttccagcaggcctggcccctggagggcttcggcggcgccctggagatgaagggcagaagactggacctgcagggcatcagagtgctgaagaagggcccccaggacggcgtggccagaagcagctgctacggcgactgcagaagcgaggacgacgaggccaccgagtggatcaccttccaggtgaagagagtgaagaagcccaagggcgaccacaagaagacccccggcaagaaggtggagaccggccagatcgagaacggccacagataccaggccaacctggagatcaccggccccaaggtggccagccccggcccccagggcctgctggactggaagaccagaaaggtgccctag

SEQ ID NO: 25127 - DNA, 3366 bp, Artificial Sequence
  Description of Artificial Sequence: Synthetic coding sequence
atggagcaggtgcccagcgccggcagactggtgcagatcaccgtgaccgagggctacgacctgaagggcttcaagggcgacacccccgtgaccttcatcagagccgagttcaaccaggtggtgctgggcgacagcgccaagatcaccgtgagccccgagggcagcgccaagtacaacttcaccagcagcttcgagttcaaccccgagggcggcatcaccagcgacgacctggcccacaagcccgtgttcctgaccgtgaccgaggtgctgcccaaggagaagaagcagaaggaggagaagaccctgatcctgggccaggccgtggtggacctgctgcccctgctggagggccagagcagcttccagaccaccgtgcccctgcaccccgtgcagggcagccccctggagacccccagaagcagcgccaagcagtgcagcctggaggtgaaggtgctggtggccgagcccctgctgaccaccgcccagatcagcggcggcaacctgctgaaggtgaccctggaggccgcctacagcgtgcccgagagcttcatccccaccggccccggccagaactacatggtgggcctgcaggtgcccagcctgggcgagaaggactaccccatcctgttcaagaacggcaccctgaagctgggcggcgagagagagcccgtgcccagacccaagaagtggcccatcgccaacatcctggcccccggcgccaacaacatccccgacgccttcatcgtgggcggcccctacgaggaggaggagggcgagctgaaccaccccgaggacagcgagttcagaaaccaggccgagtgcatcaagaagagaatcatctgggacctggagagcagatgctacctggaccccagcgccgtggtgagcttccagaagagaatcgccgactgcagactgtggcccgtggagatcaccagagtgcccctggtgaccatccccaagggcaaggccggcaagaccgagaagaccgacgaggaggcccagctgagcttccacggcgtggcctacgtgaacatggtgcccctgctgtaccccggcgtgaagagaatcagaggcgccttccacgtgtacccctacctggacagcgtggtgcacgagaagaccaagtgcctgctgagcctgttcagagacatcggccaccacctgatccacaacaacaagatcggcggcatcaacagcctgctgagcaagcaggccgtgagcaagaacctgaaggaggacaagcccgtgaaggagaaggacatcgacggcagacccagacccggcgacgtgcaggcccccagcatcaagagccagagcagcgacacccccctggagggcgagccccccctgagccacaaccccgagggccagcagtacgtggaggccggcacctacatcgtgctggagatccagctggacaaggccctggtgcccaagagaatgcccgaggagctggccagaagagtgaaggagatgatcccccccagaccccccctgaccagaagaaccggcggcgcccagaaggccatgagcgactaccacatccagatcaagaacatcagcagagccatcctggacgagtactacagaatgttcggcaagcaggtggccaagctggagagcgacatggacagcgagaccctggaggagcagaagtgccagctgagctacgagctgaactgcagcggcaagtacttcgccttcaaggagcagctgaagcacgccgtggtgaagatcgtgagagacaagtacctgaagaccaccagcttcgagagccaggaggagctgcagaccttcatcagcgagctgtacgtgttcctggtggaccagatgcacgtggccctgaaccagaccatgcccgacgacgtgcagggcaccgtggccaccatctacaccagcagcgagcagctgcagctgttcgccttcgaggccgaggtgaacgagaacttcgagatggccgccgcctactacaaggagagactggtgagagagccccagaacctggaccactggctggactacggcgccttctgcctgctgaccgaggacaacatcaaggcccaggagtgcttccagaaggccctgagcctgaaccagagccacatccacagcctgctgctgtgcggcgtgctggccgtgctgctggagaactacgagcaggccgagatcttcttcgaggacgccacctgcctggagcccaccaacgtggtggcctggaccctgctgggcctgtactacgagatccagaacaacgacatcagaatggagatggccttccacgaggccagcaagcagctgcaggccagaatgctgcaggcccaggtgaccaagcagaagagcaccggcgtggaggacaccgaggagagaggcaagagagagagcagcctgggcccctggggcatcaccaacggcagcgccaccgccatcaaggtggaggcccccgccggccccggcgccgccctgagcatcctggacaagttcctggaggagagcagcaagctgcagagcgacagccaggagcccatcctgaccacccagacctgggaccccagcatcagccagaagcccagcaacaccttcatcaaggagatccccaccaagaaggaggccagcaagtgccaggacagcagcgccctgctgcaccccggcctgcactacggcgtgagccagaccaccaccatcttcatggagaccatccacttcctgatgaaggtgaaggccgtgcagtacgtgcacagagtgctggcccacgagctgctgtgcccccagggcggccccagctgcgagtactacctggtgctggcccagacccacatcctgaagaagaacttcgccaaggccgaggagtacctgcagcaggccgcccagatggactacctgaaccccaacgtgtggggcctgaagggccacctgtacttcctgagcggcaaccacagcgaggccaaggcctgctacgagagaaccatcagcttcgtggtggacgccagcgagatgcacttcatcttcctgagactgggcctgatctacctggaggagaaggagtacgagaaggccaagaagacctacatgcaggcctgcaagagaagccccagctgcctgacctggctgggcctgggcatcgcctgctacagactggaggagctgaccgaggccgaggacgccctgagcgaggccaacgccctgaacaactacaacgccgaggtgtgggcctacctggccctggtgtgcctgaaggtgggcagacagctggaggccgagcaggcctacaagtacatgatcaagctgaagctgaaggacgaggccctgctggccgagatccacaccctgcaggagaccgtgggcttcggcaaccccagcttctag

SEQ ID NO: 25128 - DNA, 1086 bp, Artificial Sequence
  Description of Artificial Sequence: Synthetic coding sequence
atggagcaggtgcccagcgccggcagactggtgcagatcaccgtgaccgagggctacgacctgaagggcttcaagggcgacacccccgtgaccttcatcagagccgagttcaaccaggtggtgctgggcgacagcgccaagatcaccgtgagccccgagggcagcgccaagtacaacttcaccagcagcttcgagttcaaccccgagggcggcatcaccagcgacgacctggcccacaagcccgtgttcctgaccgtgaccgaggtgctgcccaaggagaagaagcagaaggaggagaagaccctgatcctgggccaggccgtggtggacctgctgcccctgctggagggccagagcagcttccagaccaccgtgcccctgcaccccgtgcagggcagccccctggagacccccagaagcagcgccaagcagtgcagcctggaggtgaaggtgctggtggccgagcccctgctgaccaccgcccagatcagcggcggcaacctgctgaaggtgaccctggaggccgcctacagcgtgcccgagagcttcatccccaccggccccggccagaactacatggtgggcctgcaggtgcccagcctgggcgagaaggactaccccatcctgttcaagaacggcaccctgaacggcaaccacagcgaggccaaggcctgctacgagagaaccatcagcttcgtggtggacgccagcgagatgcacttcatcttcctgagactgggcctgatctacctggaggagaaggagtacgagaaggccaagaagacctacatgcaggcctgcaagagaagccccagctgcctgacctggctgggcctgggcatcgcctgctacagactggaggagctgaccgaggccgaggacgccctgagcgaggccaacgccctgaacaactacaacgccgaggtgtgggcctacctggccctggtgtgcctgaaggtgggcagacagctggaggccgagcaggcctacaagtacatgatcaagctgaagctgaaggacgaggccctgctggccgagatccacaccctgcaggagaccgtgggcttcggcaaccccagcttctag

SEQ ID NO: 25129 - DNA, 3366 bp, Artificial Sequence; identical to SEQ ID NO: 25127
  Description of Artificial Sequence: Synthetic coding sequence

SEQ ID NO: 25130 - DNA, 1758 bp, Artificial Sequence
  Description of Artificial Sequence: Synthetic coding sequence
atggagcaggtgcccagcgccggcagactggtgcagatcaccgtgaccgagggctacgacctgaagggcttcaagggcgacacccccgtgaccttcatcagagccgagttcaaccaggtggtgctgggcgacagcgccaagatcaccgtgagccccgagggcagcgccaagtacaacttcaccagcagcttcgagttcaaccccgagggcggcatcaccagcgacgacctggcccacaagcccgtgttcctgaccgtgaccgaggtgctgcccaaggagaagaagcagaaggaggagaagaccctgatcctgggccaggccgtggtggacctgctgcccctgctggagggccagagcagcttccagaccaccgtgcccctgcaccccgtgcagggcagccccctggagacccccagaagcagcgccaagcagtgcagcctggaggtgaaggtgctggtggccgagcccctgctgaccaccgcccagatcagcggcggcaacctgctgaaggtgaccctggaggccgcctacagcgtgcccgagagcttcatccccaccggccccggccagaactacatggtgggcctgcaggtgcccagcctgggcgagaaggactaccccatcctgttcaagaacggcaccctgaagctgggcggcgagagagagcccgtgcccagacccaagaagtggcccatcgccaacatcctggcccccggcgccaacaacatccccgacgccttcatcgtgggcggcccctacgaggaggaggagggcgagctgaaccaccccgaggacagcgagttcagaaaccaggccgagtgcatcaagaagagaatcatctgggacctggagagcagatgctacctggaccccagcgccgtggtgagcttccagaagagaatcgccgactgcagactgtggcccgtggagatcaccagagtgcccctggtgaccatccccaagggcaaggccggcaagaccgagaagaccgacgaggaggcccagctgagcttccacggcgtggcctacgtgaacatggtgcccctgctgtaccccggcgtgaagagaatcagaggcgccttccacgtgtacccctacctggacagcgtggtgcacgagaagaccaagtgcctgctgagcctgttcagagacatcggccaccacctgatccacaacaacaagatcggcggcatcaacagcctgctgagcaagcaggccgtgagcaagaacctgaaggaggacaagcccgtgaaggagaaggacatcgacggcagacccagacccggcgacgtgcaggcccccagcatcaagagccagagcagcgacacccccctggagggcgagccccccctgagccacaaccccgagggccagcagtacgtggaggccggcacctacatcgtgctggagatccagctggacaaggccctggtgcccaagagaatgcccgaggagctggccagaagagtgaaggagatgatcccccccagaccccccctgaccagaagaaccggcggcgcccagaaggccatgagcgactaccacatccagatcaagaacatcagcagagccatcctggacgagtactacagaatgttcggcaagcaggtggccaagctggagagcgacatggacagcgagaccctggaggagcaggcctacaagtacatgatcaagctgaagctgaaggacgaggccctgctggccgagatccacaccctgcaggagaccgtgggcttcggcaaccccagcttctag

SEQ ID NO: 25131 - DNA, 360 bp, Artificial Sequence
  Description of Artificial Sequence: Synthetic coding sequence
atggagcaggtgcccagcgccggcagactggtgcagatcaccgtgaccgagggctacgacctgaagggcttcaagggcgacacccccgtgaccttcatcagagccgagttcaaccaggtggtgctgggcgacagcgccaagatcaccgtgagccccgagggcagcgccaagtacaacttcaccagcagcttcgagttcaaccccgagggcggcatcaccagcgacgacctggcccacaagcccgtgttcctgaccgtgaccgaggtgctgcccaaggagaagaagcagaaggaggagaagaccctgatcctgggccaggccgtggtggacctgctgcccctgctggagggccagagctag

SEQ ID NO: 25132 - DNA, 3276 bp, Artificial Sequence
  Description of Artificial Sequence: Synthetic coding sequence
atggagcaggtgcccagcgccggcagactggtgcagatcaccgtgaccgagggctacgacctgaagggcttcaagggcgacacccccgtgaccttcatcagagccgagttcaaccaggtggtgctgggcgacagcgccaagatcaccgtgagccccgagggcagcgccaagtacaacttcaccagcagcttcgagttcaaccccgagggcggcatcaccagcgacgacctggcccacaagcccgtgttcctgaccgtgaccgaggtgctgcccaaggagaagaagcagaaggaggagaagaccctgatcctgggccaggccgtggtggacctgctgcccctgctggagggccagagcagcttccagaccaccgtgcccctgcaccccgtgcagggcagccccctggagacccccagaagcagcgccaagcagtgcagcctggaggtgaaggtgctggtggccgagcccctgctgaccaccgcccagatcagcggcggcaacctgctgaaggtgaccctggaggccgcctacagcgtgcccgagagcttcatccccaccggccccggccagaactacatggtgggcctgcaggtgcccagcctgggcgagaaggactaccccatcctgttcaagaacggcaccctgaagctgggcggcgagagagagcccgtgcccagacccaagaagtggcccatcgccaacatcctggcccccggcgccaacaacatccccgacgccttcatcgtgggcggcccctacgaggaggaggagggcgagctgaaccaccccgaggacagcgagttcagaaaccaggccgagtgcatcaagaagagaatcatctgggacctggagagcagatgctacctggaccccagcgccgtggtgagcttccagaagagaatcgccgactgcagactgtggcccgtggagatcaccagagtgcccctggtgaccatccccaagggcaaggccggcaagaccgagaagaccgacgaggaggcccagctgagcttccacggcgtggcctacgtgaacatggtgcccctgctgtaccccggcgtgaagagaatcagaggcgccttccacgtgtacccctacctggacagcgtggtgcacgagaagaccaagtgcctgctgagcctgttcagagacatcggccaccacctgatccacaacaacaagatcggcggcatcaacagcctgctgagcaagcaggccgtgagcaagaacctgaaggaggacaagcccgtgaaggagaaggacatcgacggcagacccagacccggcgacgtgcaggcccccagcatcaagagccagagcagcgacacccccctggagggcgagccccccctgagccacaaccccgagggccagcagtacgtggaggccggcacctacatcgtgctggagatccagctggacaaggccctggtgcccaagagaatgcccgaggagctggccagaagagtgaaggagatgatcccccccagaccccccctgaccagaagaaccggcggcgcccagaaggccgtgagcgactaccacatccagatcaagaacatcagcagagccatcctggacgagtactacagaatgttcggcaagcaggtggccaagctggagagcgacatggacagcgagaccctggaggagcagaagtgccagctgagctacgagctgaactgcagcggcaagtacttcgccttcaaggagcagctgaagcacgccgtggtgaagatcgtgagagacaagtacctgaagaccaccagcttcgagagccaggaggagctgcagaccttcatcagcgagctgtacgtgttcctggtggaccagatgcacgtggccctgaaccagaccatgcccgacgacgtgcagggcaccgtggccaccatctacaccagcagcgagcagctgcagctgttcgccttcgaggccgaggtgaacgagaacttcgagatggccgccgcctactacaaggagagactggtgagagagccccagaacctggaccactggctggactacggcgccttctgcctgctgaccgaggacaacatcaaggcccaggagtgcttccagaaggccctgagcctgaaccagagccacatccacagcctgctgctgtgcggcgtgctggccgtgctgctggagaactacgagcaggccgagatcttcttcgaggacgccacctgcctggagcccaccaacgtggtggcctggaccctgctgggcctgtactacgagatccagaacaacgacatcagaatggagatggccttccacgaggccagcaagcagctgcaggccagaatgctgcaggcccaggtgaccaagcagaagagcaccggcgtggaggacaccgaggagagaggcaagagagagagcagcctgggcccctggggcatcaccaacggcagcgccaccgccatcaaggtggaggcccccgccggccccggcgccgccctgagcatcctggacaagttcctggaggagagcagcaagctgcagagcgacagccaggagcccatcctgaccacccagacctgggaccccagcatcagccagaagcccagcaacaccttcatcaaggagatccccaccaagaaggaggccagcaagtgccaggacagcagcgccctgctgcaccccggcctgcactacggcgtgagccagaccaccaccatcttcatggagaccatccacttcctgatgaaggtgaaggccgtgcagtacgtgcacagagtgctggcccacgagctgctgtgcccccagggcggccccagctgcgagtactacctggtgctggcccagacccacatcctgaagaagaacttcgccaaggccgaggagtacctgcagcaggccgcccagatggactacctgaaccccaacgtgtggggcctgaagggccacctgtacttcctgagcggcaaccacagcgaggccaaggcctgctacgagagaaccatcagcttcgtggtggacgccagcgagatgcacttcatcttcctgagactgggcctgatctacctggaggagaaggagctggaggagctgaccgaggccgaggacgccctgagcgaggccaacgccctgaacaactacaacgccgaggtgtgggcctacctggccctggtgtgcctgaaggtgggcagacagctggaggccgagcaggcctacaagtacatgatcaagctgaagctgaaggacgaggccctgctggccgagatccacaccctgcaggagaccgtgggcttcggcaaccccagcttctag

SEQ ID NO: 25133 - DNA, 3366 bp, Artificial Sequence
  Description of Artificial Sequence: Synthetic coding sequence
atggagcaggtgcccagcgccggcagactggtgcagatcaccgtgaccgagggctacgacctgaagggcttcaagggcgacacccccgtgaccttcatcagagccgagttcaaccaggtggtgctgggcgacagcgccaagatcaccgtgagccccgagggcagcgccaagtacaacttcaccagcagcttcgagttcaaccccgagggcggcatcaccagcgacgacctggcccacaagcccgtgttcctgaccgtgaccgaggtgctgcccaaggagaagaagcagaaggaggagaagaccctgatcctgggccaggccgtggtggacctgctgcccctgctggagggccagagcagcttccagaccaccgtgcccctgcaccccgtgcagggcagccccctggagacccccagaagcagcgccaagcagtgcagcctggaggtgaaggtgctggtggccgagcccctgctgaccaccgcccagatcagcggcggcaacctgctgaaggtgaccctggaggccgcctacagcgtgcccgagagcttcatccccaccggccccggccagaactacatggtgggcctgcaggtgcccagcctgggcgagaaggactaccccatcctgttcaagaacggcaccctgaagctgggcggcgagagagagcccgtgcccagacccaagaagtggcccatcgccaacatcctggcccccggcgccaacaacatccccgacgccttcatcgtgggcggcccctacgaggaggaggagggcgagctgaaccaccccgaggacagcgagttcagaaaccaggccgagtgcatcaagaagagaatcatctgggacctggagagcagatgctacctggaccccagcgccgtggtgagcttccagaagagaatcgccgactgcagactgtggcccgtggagatcaccagagtgcccctggtgaccatccccaagggcaaggccggcaagaccgagaagaccgacgaggaggcccagctgagcttccacggcgtggcctacgtgaacatggtgcccctgctgtaccccggcgtgaagagaatcagaggcgccttccacgtgtacccctacctggacagcgtggtgcacgagaagaccaagtgcctgctgagcctgttcagagacatcggccaccacctgatccacaacaacaagatcggcggcatcaacagcctgctgagcaagcaggccgtgagcaagaacctgaaggaggacaagcccgtgaaggagaaggacatcgacggcagacccagacccggcgacgtgcaggcccccagcatcaagagccagagcagcgacacccccctggagggcgagccccccctgagccacaaccccgagggccagcagtacgtggaggccggcacctacatcgtgctggagatccagctggacaaggccctggtgcccaagagaatgcccgaggagctggccagaagagtgaaggagatgatcccccccagaccccccctgaccagaagaaccggcggcgcccagaaggccgtgagcgactaccacatccagatcaagaacatcagcagagccatcctggacgagtactacagaatgttcggcaagcaggtggccaagctggagagcgacatggacagcgagaccctggaggagcagaagtgccagctgagctacgagctgaactgcagcggcaagtacttcgccttcaaggagcagctgaagcacgccgtggtgaagatcgtgagagacaagtacctgaagaccaccagcttcgagagccaggaggagctgcagaccttcatcagcgagctgtacgtgttcctggtggaccagatgcacgtggccctgaaccagaccatgcccgacgacgtgcagggcaccgtggccaccatctacaccagcagcgagcagctgcagctgttcgccttcgaggccgaggtgaacgagaacttcgagatggccgccgcctactacaaggagagactggtgagagagccccagaacctggaccactggctggactacggcgccttctgcctgctgaccgaggacaacatcaaggcccaggagtgcttccagaaggccctgagcctgaaccagagccacatccacagcctgctgctgtgcggcgtgctggccgtgctgctggagaactacgagcaggccgagatcttcttcgaggacgccacctgcctggagcccaccaacgtggtggcctggaccctgctgggcctgtactacgagatccagaacaacgacatcagaatggagatggccttccacgaggccagcaagcagctgcaggccagaatgctgcaggcccaggtgaccaagcagaagagcaccggcgtggaggacaccgaggagagaggcaagagagagagcagcctgggcccctggggcatcaccaacggcagcgccaccgccatcaaggtggaggcccccgccggccccggcgccgccctgagcatcctggacaagttcctggaggagagcagcaagctgcagagcgacagccaggagcccatcctgaccacccagacctgggaccccagcatcagccagaagcccagcaacaccttcatcaaggagatccccaccaagaaggaggccagcaagtgccaggacagcagcgccctgctgcaccccggcctgcactacggcgtgagccagaccaccaccatcttcatggagaccatccacttcctgatgaaggtgaaggccgtgcagtacgtgcacagagtgctggcccacgagctgctgtgcccccagggcggccccagctgcgagtactacctggtgctggcccagacccacatcctgaagaagaacttcgccaaggccgaggagtacctgcagcaggccgcccagatggactacctgaaccccaacgtgtggggcctgaagggccacctgtacttcctgagcggcaaccacagcgaggccaaggcctgctacgagagaaccatcagcttcgtggtggacgccagcgagatgcacttcatcttcctgagactgggcctgatctacctggaggagaaggagtacgagaaggccaagaagacctacatgcaggcctgcaagagaagccccagctgcctgacctggctgggcctgggcatcgcctgctacagactggaggagctgaccgaggccgaggacgccctgagcgaggccaacgccctgaacaactacaacgccgaggtgtgggcctacctggccctggtgtgcctgaaggtgggcagacagctggaggccgagcaggcctacaagtacatgatcaagctgaagctgaaggacgaggccctgctggccgagatccacaccctgcaggagaccgtgggcttcggcaaccccagcttctag

SEQ ID NO: 25134 - DNA, 1497 bp, Artificial Sequence
  Description of Artificial Sequence: Synthetic coding sequence
caggaggagctgcagaccttcatcagcgagctgtacgtgttcctggtggaccagatgcacgtggccctgaaccagaccatgcccgacgacgtgcagggcaccgtggccaccatctacaccagcagcgagcagctgcagctgttcgccttcgaggccgaggtgaacgagaacttcgagatggccgccgcctactacaaggagagactggtgagagagccccagaacctggaccactggctggactacggcgccttctgcctgctgaccgaggacaacatcaaggcccaggagtgcttccagaaggccctgagcctgaaccagagccacatccacagcctgctgctgtgcggcgtgctggccgtgctgctggagaactacgagcaggccgagatcttcttcgaggacgccacctgcctggagcccaccaacgtggtggcctggaccctgctgggcctgtactacgagatccagaacaacgacatcagaatggagatggccttccacgaggccagcaagcagctgcaggccagaatgctgcaggcccaggtgaccaagcagaagagcaccggcgtggaggacaccgaggagagaggcaagagagagagcagcctgggcccctggggcatcaccaacggcagcgccaccgccatcaaggtggaggcccccgccggccccggcgccgccctgagcatcctggacaagttcctggaggagagcagcaagctgcagagcgacagccaggagcccatcctgaccacccagacctgggaccccagcatcagccagaagcccagcaacaccttcatcaaggagatccccaccaagaaggaggccagcaagtgccaggacagcagcgccctgctgcaccccggcctgcactacggcgtgagccagaccaccaccatcttcatggagaccatccacttcctgatgaaggtgaaggccgtgcagtacgtgcacagagtgctggcccacgagctgctgtgcccccagggcggccccagctgcgagtactacctggtgctggcccagacccacatcctgaagaagaacttcgccaaggccgaggagtacctgcagcaggccgcccagatggactacctgaaccccaacgtgtggggcctgaagggccacctgtacttcctgagcggcaaccacagcgaggccaaggcctgctacgagagaaccatcagcttcgtggtggacgccagcgagatgcacttcatcttcctgagactgggcctgatctacctggaggagaaggagctggaggagctgaccgaggccgaggacgccctgagcgaggccaacgccctgaacaactacaacgccgaggtgtgggcctacctggccctggtgtgcctgaaggtgggcagacagctggaggccgagcaggcctacaagtacatgatcaagctgaagctgaaggacgaggccctgctggccgagatccacaccctgcaggagaccgtgggcttcggcaaccccagcttctag

SEQ ID NO: 25135 - DNA, 3966 bp, Artificial Sequence
  Description of Artificial Sequence: Synthetic coding sequence
atgagcagcaacgacagcagcctgatggccggcatcatctactacagccaggagaagtacttccaccacgtgcagcaggccgccgccgtgggcctggagaagttcagcaacgaccccgtgctgaagttcttcaaggcctacggcgtgctgaaggaggagcacatccaggacgccatcagcgacctggagagcatcagacaccaccccgacgtgagcctgtgcagcaccatggccctgatctacgcccacaagagatgcgagatcatcgacagagaggccatccaggagctggagtacagcctgaaggagatcagaaagaccgtgagcggcaccgccctgtactacgccggcctgttcctgtggctgatcggcagacacgacaaggccaaggagtacatcgacagaatgctgaagatcagcagaggcttcagagaggcctacgtgctgagaggctgggtggacctgaccagcgacaagccccacaccgccaagaaggccatcgagtacctggagcagggcatccaggacaccaaggacgtgctgggcctgatgggcaaggccatgtacttcatgatgcagcagaactacagcgaggccctggaggtggtgaaccagatcaccgtgaccagcggcagcttcctgcccgccctggtgctgaagatgcagctgttcctggccagacaggactgggagcagaccgtggagatgggccacagaatcctggagaaggacgagagcaacatcgacgcctgccagatcctgaccgtgcacgagctggccagagagggcaacatgaccaccgtgagcagcctgaagacccagaaggccaccaaccacgtgagaaacctgatcaaggccctggagaccagagagcccgagaaccccagcctgcacctgaagaagatcatcgtggtgagcagactgtgcggcagccaccaggtgatcctgggcctggtgtgcagcttcatcgagagaaccttcatggccacccccagctacgtgcacgtggccaccgagctgggctacctgttcatcctgaagaaccaggtgaaggaggccctgctgtggtacagcgaggccatgaagctggacaaggacggcatggccggcctgaccggcatcatcctgtgccacatcctggagggccacctggaggaggccgagtacagactggagttcctgaaggaggtgcagaagagcctgggcaagagcgaggtgctgatcttcctgcaggccctgctgatgagcagaaagcacaagggcgaggaggagaccaccgccctgctgaaggaggccgtggagctgcacttcagcagcatgcagggcatccccctgggcagcgagtacttcgagaagctggacccctacttcctggtgtgcatcgccaaggagtacctgctgttctgccccaagcagcccagactgcccggccagatcgtgagccccctgctgaagcaggtggccgtgatcctgaaccccgtggtgaaggccgcccccgccctgatcgaccccctgtacctgatggcccaggtgagatactacagcggcgagctggagaacgcccagagcatcctgcagagatgcctggagctggaccccgccagcgtggacgcccacctgctgatgtgccagatctacctggcccagggcaacttcggcatgtgcttccactgcctggagctgggcgtgagccacaacttccaggtgagagaccaccccctgtaccacctgatcaaggccagagccctgaacaaggccggcgactaccccgaggccatcaagaccctgaagatggtgatcaagctgcccgccctgaagaaggaggagggcagaaagttcctgagacccagcgtgcagcccagccagagagccagcatcctgctggagctggtggaggccctgagactgaacggcgagctgcacgaggccaccaaggtgatgcaggacaccatcaacgagttcggcggcacccccgaggagaacagaatcaccatcgccaacgtggacctggtgctgagcaagggcaacgtggacgtggccctgaacatgctgagaaacatcctgcccaagcagagctgctacatggaggccagagagaagatggccaacatctacctgcagaccctgagagacagaagactgtacatcagatgctacagagagctgtgcgagcacctgcccggcccccacaccagcctgctgctgggcgacgccctgatgagcatcctggagcccgagaaggccctggaggtgtacgacgaggcctacagacagaacccccacgacgccagcctggccagcagaatcggccacgcctacgtgaaggcccaccagtacaccgaggccatcgagtactacgaggccgcccagaagatcaacggccaggacttcctgtgctgcgacctgggcaagctgctgctgaagctgaagaaggtgaacaaggccgagaaggtgctgaagcaggccctggagcacgacatcgtgcaggacatccccagcatgatgaacgacgtgaagtgcctgctgctgctggccaaggtgtacaagagccacaagaaggaggccgtgatcgagaccctgaacaaggccctggacctgcagagcagaatcctgaagagagtgcccctggagcagcccgagatgatccccagccagaagcagctggccgccagcatctgcatccagttcgccgagcactacctggccgagaaggagtacgacaaggccgtgcagagctacaaggacgtgttcagctacctgcccaccgacaacaaggtgatgctggagctggcccagctgtacctgctgcagggccacctggacctgtgcgagcagcactgcgccatcctgctgcagaccgagcagaaccacgagaccgccagcgtgctgatggccgacctgatgttcagaaagcagaagcacgaggccgccatcaacctgtaccaccaggtgctggagaaggcccccgacaacttcctggtgctgcacaagctgatcgacctgctgagaagaagcggcaagctggaggacatccccgccttcttcgagctggccaagaaggtgagcagcagagtgcccctggagcccggcttcaactactgcagaggcatctactgctggcacatcggccagcccaacgaggccctgaagttcctgaacaaggccagaaaggacagcacctggggccagagcgccatctaccacatggtgcagatctgcctgaaccccgacaacgaggtggtgggcggcgaggccttcgagaaccagggcgccgagagcaactacatggagaagaaggagctggagcagcagggcgtgagcaccgccgagaagctgctgagagagttctacccccacagcgacagcagccagacccagctgagactgctgcagggcctgtgcagactggccaccagagagaaggccaacatggaggccgccctgggcagcttcatccagatcgcccaggccgagaaggacagcgtgcccgccctgctggccctggcccaggcctacgtgttcctgaagcagatccccaaggccagaatgcagctgaagagactggccaagaccccctgggtgctgagcgaggccgaggacctggagaagagctggctgctgctggccgacatctactgccagggcagcaagttcgacctggccctggagctgctgagaagatgcgtgcagtacaacaagagctgctacaaggcctacgagtacatgggcttcatcatggagaaggagcagagctacaaggacgccgtgaccaactacaagctggcctggaagtacagccaccacgccaaccccgccatcggcttcaagctggccttcaactacctgaaggacaagaagttcgtggaggccatcgagatctgcaacgacgtgctgagagagcaccccgactaccccaagatcagagaggagatcctggagaaggccagaagaagcctgagaccctag

SEQ ID NO: 25136 - DNA, 3912 bp, Artificial Sequence
  Description of Artificial Sequence: Synthetic coding sequence
atgagcagcaacgacagcagcctgatggccggcatcatctactacagccaggagaagtacttccaccacgtgcagcaggccgccgccgtgggcctggagaagttcagcaacgaccccgtgctgaagttcttcaaggcctacggcgtgctgaaggaggagcacatccaggacgccatcagcgacctggagagcatcagacaccaccccgacgtgagcctgtgcagcaccatggccctgatctacgcccacaagagatgcgagatcatcgacagagaggccatccaggagctggagtacagcctgaaggagatcagaaagaccgtgagcggcaccgccctgtactacgccggcctgttcctgtggctgatcggcagacacgacaaggccaaggagtacatcgacagaatgctgaagatcagcagaggcttcagagaggcctacgtgctgagaggctgggtggacctgaccagcgacaagccccacaccgccaagaaggccatcgagtacctggagcagggcatccaggacaccaaggacgtgctgggcctgatgggcaaggccatgtacttcatgatgcagcagaactacagcgaggccctggaggtggtgaaccagatcaccgtgaccagcggcagcttcctgcccgccctggtgctgaagatgcagctgttcctggccagacaggactgggagcagaccgtggagatgggccacagaatcctggagaaggacgagagcaacatcgacgcctgccagatcctgaccgtgcacgagctggccagagagggcaacatgaccaccgccaccaaccacgtgagaaacctgatcaaggccctggagaccagagagcccgagaaccccagcctgcacctgaagaagatcatcgtggtgagcagactgtgcggcagccaccaggtgatcctgggcctggtgtgcagcttcatcgagagaaccttcatggccacccccagctacgtgcacgtggccaccgagctgggctacctgttcatcctgaagaaccaggtgaaggaggccctgctgtggtacagcgaggccatgaagctggacaaggacggcatggccggcctgaccggcatcatcctgtgccacatcctggagggccacctggaggaggtgcagaagagcctgggcaagagcgaggtgctgatcttcctgcaggccctgctgatgagcagaaagcacaagggcgaggaggagaccaccgccctgctgaaggaggccgtggagctgcacttcagcagcatgcagggcatccccctgggcagcgagtacttcgagaagctggacccctacttcctggtgtgcatcgccaaggagtacctgctgttctgccccaagcagcccagactgcccggccagatcgtgagccccctgctgaagcaggtggccgtgatcctgaaccccgtggtgaaggccgcccccgccctgatcgaccccctgtacctgatggcccaggtgagatactacagcggcgagctggagaacgcccagagcatcctgcagagatgcctggagctggaccccgccagcgtggacgcccacctgctgatgtgccagatctacctggcccagggcaacttcggcatgtgcttccactgcctggagctgggcgtgagccacaacttccaggtgagagaccaccccctgtaccacctgatcaaggccagagccctgaacaaggccggcgactaccccgaggccatcaagaccctgaagatggtgatcaagctgcccgccctgaagaaggaggagggcagaaagttcctgagacccagcgtgcagcccagccagagagccagcatcctgctggagctggtggaggccctgagactgaacggcgagctgcacgaggccaccaaggtgatgcaggacaccatcaacgagttcggcggcacccccgaggagaacagaatcaccatcgccaacgtggacctggtgctgagcaagggcaacgtggacgtggccctgaacatgctgagaaacatcctgcccaagcagagctgctacatggaggccagagagaagatggccaacatctacctgcagaccctgagagacagaagactgtacatcagatgctacagagagctgtgcgagcacctgcccggcccccacaccagcctgctgctgggcgacgccctgatgagcatcctggagcccgagaaggccctggaggtgtacgacgaggcctacagacagaacccccacgacgccagcctggccagcagaatcggccacgcctacgtgaaggcccaccagtacaccgaggccatcgagtactacgaggccgcccagaagatcaacggccaggacttcctgtgctgcgacctgggcaagctgctgctgaagctgaagaaggtgaacaaggccgagaaggtgctgaagcaggccctggagcacgacatcgtgcaggacatccccagcatgatgaacgacgtgaagtgcctgctgctgctggccaaggtgtacaagagccacaagaaggaggccgtgatcgagaccctgaacaaggccctggacctgcagagcagaatcctgaagagagtgcccctggagcagcccgagatgatccccagccagaagcagctggccgccagcatctgcatccagttcgccgagcactacctggccgagaaggagtacgacaaggccgtgcagagctacaaggacgtgttcagctacctgcccaccgacaacaaggtgatgctggagctggcccagctgtacctgctgcagggccacctggacctgtgcgagcagcactgcgccatcctgctgcagaccgagcagaaccacgagaccgccagcgtgctgatggccgacctgatgttcagaaagcagaagcacgaggccgccatcaacctgtaccaccaggtgctggagaaggcccccgacaacttcctggtgctgcacaagctgatcgacctgctgagaagaagcggcaagctggaggacatccccgccttcttcgagctggccaagaaggtgagcagcagagtgcccctggagcccggcttcaactactgcagaggcatctactgctggcacatcggccagcccaacgaggccctgaagttcctgaacaaggccagaaaggacagcacctggggccagagcgccatctaccacatggtgcagatctgcctgaaccccgacaacgaggtggtgggcggcgaggccttcgagaaccagggcgccgagagcaactacatggagaagaaggagctggagcagcagggcgtgagcaccgccgagaagctgctgagagagttctacccccacagcgacagcagccagacccagctgagactgctgcagggcctgtgcagactggccaccagagagaaggccaacatggaggccgccctgggcagcttcatccagatcgcccaggccgagaaggacagcgtgcccgccctgctggccctggcccaggcctacgtgttcctgaagcagatccccaaggccagaatgcagctgaagagactggccaagaccccctgggtgctgagcgaggccgaggacctggagaagagctggctgctgctggccgacatctactgccagggcagcaagttcgacctggccctggagctgctgagaagatgcgtgcagtacaacaagagctgctacaaggcctacgagtacatgggcttcatcatggagaaggagcagagctacaaggacgccgtgaccaactacaagctggcctggaagtacagccaccacgccaaccccgccatcggcttcaagctggccttcaactacctgaaggacaagaagttcgtggaggccatcgagatctgcaacgacgtgctgagagagcaccccgactaccccaagatcagagaggagatcctggagaaggccagaagaagcctgagaccctag

SEQ ID NO: 25137 - DNA, 3963 bp, Artificial Sequence
  Description of Artificial Sequence: Synthetic coding sequence
atgagcagcaacgacagcagcctgatggccggcatcatctactacagccaggagaagtacttccaccacgtgcagcaggccgccgccgtgggcctggagaagttcagcaacgaccccgtgctgaagttcttcaaggcctacggcgtgctgaaggaggagcacatccaggacgccatcagcgacctggagagcatcagacaccaccccgacgtgagcctgtgcagcaccatggccctgatctacgcccacaagagatgcgagatcatcgacagagaggccatccaggagctggagtacagcctgaaggagatcagaaagaccgtgagcggcaccgccctgtactacgccggcctgttcctgtggctgatcggcagacacgacaaggccaaggagtacatcgacagaatgctgaagatcagcagaggcttcagagaggcctacgtgctgagaggctgggtggacctgaccagcgacaagccccacaccgccaagaaggccatcgagtacctggagcagggcatccaggacaccaaggacgtgctgggcctgatgggcaaggccatgtacttcatgatgcagcagaactacagcgaggccctggaggtggtgaaccagatcaccgtgaccagcggcagcttcctgcccgccctggtgctgaagatgcagctgttcctggccagacaggactgggagcagaccgtggagatgggccacagaatcctggagaaggacgagagcaacatcgacgcctgccagatcctgaccgtgcacgagctggccagagagggcaacatgaccaccgtgagcagcctgaagacccagaaggccaccaaccacgtgagaaacctgatcaaggccctggagaccagagagcccgagaaccccagcctgcacctgaagaagatcatcgtggtgagcagactgtgcggcagccaccaggtgatcctgggcctggtgtgcagcttcatcgagagaaccttcatggccacccccagctacgtgcacgtggccaccgagctgggctacctgttcatcctgaagaaccaggtgaaggaggccctgctgtggtacagcgaggccatgaagctggacaaggacggcatggccggcctgaccggcatcatcctgtgccacatcctggagggccacctggaggaggccgagtacagactggagttcctgaaggaggtgcagaagagcctgggcaagagcgaggtgctgatcttcctgcaggccctgctgatgagcagaaagcacaagggcgaggaggagaccaccgccctgctgaaggaggccgtggagctgcacttcagcagcatgcagggcatccccctgggcagcgagtacttcgagaagctggacccctacttcctggtgtgcatcgccaaggagtacctgctgttctgccccaagcagcccagactgcccggccagatcgtgagccccctgctgaagcaggtggccgtgatcctgaaccccgtggtgaaggccgcccccgccctgatcgaccccctgtacctgatggcccaggtgagatactacagcgagctggagaacgcccagagcatcctgcagagatgcctggagctggaccccgccagcgtggacgcccacctgctgatgtgccagatctacctggcccagggcaacttcggcatgtgcttccactgcctggagctgggcgtgagccacaacttccaggtgagagaccaccccctgtaccacctgatcaaggccagagccctgaacaaggccggcgactaccccgaggccatcaagaccctgaagatggtgatcaagctgcccgccctgaagaaggaggagggcagaaagttcctgagacccagcgtgcagcccagccagagagccagcatcctgctggagctggtggaggccctgagactgaacggcgagctgcacgaggccaccaaggtgatgcaggacaccatcaacgagttcggcggcacccccgaggagaacagaatcaccatcgccaacgtggacctggtgctgagcaagggcaacgtggacgtggccctgaacatgctgagaaacatcctgcccaagcagagctgctacatggaggccagagagaagatggccaacatctacctgcagaccctgagagacagaagactgtacatcagatgctacagagagctgtgcgagcacctgcccggcccccacaccagcctgctgctgggcgacgccctgatgagcatcctggagcccgagaaggccctggaggtgtacgacgaggcctacagacagaacccccacgacgccagcctggccagcagaatcggccacgcctacgtgaaggcccaccagtacaccgaggccatcgagtactacgaggccgcccagaagatcaacggccaggacttcctgtgctgcgacctgggcaagctgctgctgaagctgaagaaggtgaacaaggccgagaaggtgctgaagcaggccctggagcacgacatcgtgcaggacatccccagcatgatgaacgacgtgaagtgcctgctgctgctggccaaggtgtacaagagccacaagaaggaggccgtgatcgagaccctgaacaaggccctggacctgcagagcagaatcctgaagagagtgcccctggagcagcccgagatgatccccagccagaagcagctggccgccagcatctgcatccagttcgccgagcactacctggccgagaaggagtacgacaaggccgtgcagagctacaaggacgtgttcagctacctgcccaccgacaacaaggtgatgctggagctggcccagctgtacctgctgcagggccacctggacctgtgcgagcagcactgcgccatcctgctgcagaccgagcagaaccacgagaccgccagcgtgctgatggccgacctgatgttcagaaagcagaagcacgaggccgccatcaacctgtaccaccaggtgctggagaaggcccccgacaacttcctggtgctgcacaagctgatcgacctgctgagaagaagcggcaagctggaggacatccccgccttcttcgagctggccaagaaggtgagcagcagagtgcccctggagcccggcttcaactactgcagaggcatctactgctggcacatcggccagcccaacgaggccctgaagttcctgaacaaggccagaaaggacagcacctggggccagagcgccatctaccacatggtgcagatctgcctgaaccccgacaacgaggtggtgggcggcgaggccttcgagaaccagggcgccgagagcaactacatggagaagaaggagctggagcagcagggcgtgagcaccgccgagaagctgctgagagagttctacccccacagcgacagcagccagacccagctgagactgctgcagggcctgtgcagactggccaccagagagaaggccaacatggaggccgccctgggcagcttcatccagatcgcccaggccgagaaggacagcgtgcccgccctgctggccctggcccaggcctacgtgttcctgaagcagatccccaaggccagaatgcagctgaagagactggccaagaccccctgggtgctgagcgaggccgaggacctggagaagagctggctgctgctggccgacatctactgccagggcagcaagttcgacctggccctggagctgctgagaagatgcgtgcagtacaacaagagctgctacaaggcctacgagtacatgggcttcatcatggagaaggagcagagctacaaggacgccgtgaccaactacaagctggcctggaagtacagccaccacgccaaccccgccatcggcttcaagctggccttcaactacctgaaggacaagaagttcgtggaggccatcgagatctgcaacgacgtgctgagagagcaccccgactaccccaagatcagagaggagatcctggagaaggccagaagaagcctgagaccctag

SEQ ID NO: 25138 - DNA, 3819 bp, Artificial Sequence
  Description of Artificial Sequence: Synthetic coding sequence
atgagcagcaacgacagcagcctgatggccggcatcatctactacagccaggagaagtacttccaccacgtgcagcaggccgccgccgtgggcctggagaagttcagcaacgaccccgtgctgaagttcttcaaggcctacggcgtgctgaaggaggagcacatccaggacgccatcagcgacctggagagcatcagacaccaccccgacgtgagcctgtgcagcaccatggccctgatctacgcccacaagagatgcgagatcatcgacagagaggccatccaggagctggagtacagcctgaaggagatcagaaagaccgtgagcggcaccgccctgtactacgccggcctgttcctgtggctgatcggcagacacgacaaggccaaggagtacatcgacagaatgctgaagatcagcagaggcttcagagaggccatgtacttcatgatgcagcagaactacagcgaggccctggaggtggtgaaccagatcaccgtgaccagcggcagcttcctgcccgccctggtgctgaagatgcagctgttcctggccagacaggactgggagcagaccgtggagatgggccacagaatcctggagaaggacgagagcaacatcgacgcctgccagatcctgaccgtgcacgagctggccagagagggcaacatgaccaccgccaccaaccacgtgagaaacctgatcaaggccctggagaccagagagcccgagaaccccagcctgcacctgaagaagatcatcgtggtgagcagactgtgcggcagccaccaggtgatcctgggcctggtgtgcagcttcatcgagagaaccttcatggccacccccagctacgtgcacgtggccaccgagctgggctacctgttcatcctgaagaaccaggtgaaggaggccctgctgtggtacagcgaggccatgaagctggacaaggacggcatggccggcctgaccggcatcatcctgtgccacatcctggagggccacctggaggaggccgagtacagactggagttcctgaaggaggtgcagaagagcctgggcaagagcgaggtgctgatcttcctgcaggccctgctgatgagcagaaagcacaagggcgaggaggagaccaccgccctgctgaaggaggccgtggagctgcacttcagcagcatgcagggcatccccctgggcagcgagtacttcgagaagctggacccctacttcctggtgtgcatcgccaaggagtacctgctgttctgccccaagcagcccagactgcccggccagatcgtgagccccctgctgaagcaggtggccgtgatcctgaaccccgtggtgaaggccgcccccgccctgatcgaccccctgtacctgatggcccaggtgagatactacagcggcgagctggagaacgcccagagcatcctgcagagatgcctggagctggaccccgccagcgtggacgcccacctgctgatgtgccagatctacctggcccagggcaacttcggcatgtgcttccactgcctggagctgggcgtgagccacaacttccaggtgagagaccaccccctgtaccacctgatcaaggccagagccctgaacaaggccggcgactaccccgaggccatcaagaccctgaagatggtgatcaagctgcccgccctgaagaaggaggagggcagaaagttcctgagacccagcgtgcagcccagccagagagccagcatcctgctggagctggtggaggccctgagactgaacggcgagctgcacgaggccaccaaggtgatgcaggacaccatcaacgagttcggcggcacccccgaggagaacagaatcaccatcgccaacgtggacctggtgctgagcaagggcaacgtggacgtggccctgaacatgctgagaaacatcctgcccaagcagagctgctacatggaggccagagagaagatggccaacatctacctgcagaccctgagagacagaagactgtacatcagatgctacagagagctgtgcgagcacctgcccggcccccacaccagcctgctgctgggcgacgccctgatgagcatcctggagcccgagaaggccctggaggtgtacgacgaggcctacagacagaacccccacgacgccagcctggccagcagaatcggccacgcctacgtgaaggcccaccagtacaccgaggccatcgagtactacgaggccgcccagaagatcaacggccaggacttcctgtgctgcgacctgggcaagctgctgctgaagctgaagaaggtgaacaaggccgagaaggtgctgaagcaggccctggagcacgacatcgtgcaggacatccccagcatgatgaacgacgtgaagtgcctgctgctgctggccaaggtgtacaagagccacaagaaggaggccgtgatcgagaccctgaacaaggccctggacctgcagagcagaatcctgaagagagtgcccctggagcagcccgagatgatccccagccagaagcagctggccgccagcatctgcatccagttcgccgagcactacctggccgagaaggagtacgacaaggccgtgcagagctacaaggacgtgttcagctacctgcccaccgacaacaaggtgatgctggagctggcccagctgtacctgctgcagggccacctggacctgtgcgagcagcactgcgccatcctgctgcagaccgagcagaaccacgagaccgccagcgtgctgatggccgacctgatgttcagaaagcagaagcacgaggccgccatcaacctgtaccaccaggtgctggagaaggcccccgacaacttcctggtgctgcacaagctgatcgacctgctgagaagaagcggcaagctggaggacatccccgccttcttcgagctggccaagaaggtgagcagcagagtgcccctggagcccggcttcaactactgcagaggcatctactgctggcacatcggccagcccaacgaggccctgaagttcctgaacaaggccagaaaggacagcacctggggccagagcgccatctaccacatggtgcagatctgcctgaaccccgacaacgaggtggtgggcggcgaggccttcgagaaccagggcgccgagagcaactacatggagaagaaggagctggagcagcagggcgtgagcaccgccgagaagctgctgagagagttctacccccacagcgacagcagccagacccagctgagactgctgcagggcctgtgcagactggccaccagagagaaggccaacatggaggccgccctgggcagcttcatccagatcgcccaggccgagaaggacagcgtgcccgccctgctggccctggcccaggcctacgtgttcctgaagcagatccccaaggccagaatgcagctgaagagactggccaagaccccctgggtgctgagcgaggccgaggacctggagaagagctggctgctgctggccgacatctactgccagggcagcaagttcgacctggccctggagctgctgagaagatgcgtgcagtacaacaagagctgctacaaggcctacgagtacatgggcttcatcatggagaaggagcagagctacaaggacgccgtgaccaactacaagctggcctggaagtacagccaccacgccaaccccgccatcggcttcaagctggccttcaactacctgaaggacaagaagttcgtggaggccatcgagatctgcaacgacgtgctgagagagcaccccgactaccccaagatcagagaggagatcctggagaaggccagaagaagcctgagaccctag

SEQ ID NO: 25139 - DNA, 1119 bp, Artificial Sequence
  Description of Artificial Sequence: Synthetic coding sequence
atggccgagctggaggccgtggccgacgacctggacgccctgatcgacgacctggactacctgcccggccacttccacctggagatgcagctgaacttcgagcccagaagccccgccccccagagagccagagacctgaagctgcagagagagggcctgagacaggagctgcagctggccgccgccccccagagacccgccgtgagacacctgctgggcgccttcgccttctacctggaggagctggacgaggccagagagtgcttcctggaggtggcccacgagcaccccggcaacctgaacgcctgggccaacctggcccacgtgtacggcagactgggccaggaggaggaggaggaggcctgcgccgccagactggccgacctgatgggcctggccgaggagcccgaggccgccggcgacccccagctgagagccgccagatgcctggccgagcagggctacgcccacggcttcgacgtgggctgcgccagccccgaggagagagccagaggcctggccgccggcatcgccctgtacgacaaggccctgggctacggccagcagatccccatggaggagaagagaggctggtacttcaccatggccaccctgtacatcagactggacggcatcttcctggagctgggcagcgaggagcagaagagactgcccgccttcaacagaaccctggccctgctgagacaggtgctgaagagcgaggaccccagacacagagccctggcctggtgctacctgggcatgctgctggagagaaaggacaccttcagcaccacccccatgggcgtgcacgactgcggctacagcggcaccgaccccctggactgcttcggcaaggccatcgagatcgccaagaaccagccccccatcctgaacagactggccaagatcttctacttcctgggcaagcaggacatggccatcggcacctgcaacatggccctggacgtgctgagagaccccgagctgaactggcaggcctactgcaccagagccaagagaagaggcctgaccatgctgcccagactggtgagcaacagctgggcccaggccgtgctgccccccagaccccccaaggtgctggagttccaggtgtag

SEQ ID NO: 25140 - DNA, 1710 bp, Artificial Sequence
  Description of Artificial Sequence: Synthetic coding sequence
atggccgagctggaggccgtggccgacgacctggacgccctgatcgacgacctggactacctgcccggccacttccacctggagatgcagctgaacttcgagcccagaagccccgccccccagagagccagagacctgaagctgcagagagagggcctgagacaggagctgcagctggccgccgccccccagagacccgccgtgagacacctgctgggcgccttcgccttctacctggaggagctggacgaggccagagagtgcttcctggaggtggcccacgagcaccccggcaacctgaacgcctgggccaacctggcccacgtgtacggcagactgggccaggaggaggaggaggaggcctgcgccgccagactggccgacctgatgggcctggccgaggagcccgaggccgccggcgacccccagctgagagccgccagatgcctggccgagcagggctacgcccacggcttcgacgtgggctgcgccagccccgaggagagagccagaggcctggccgccggcatcgccctgtacgacaaggccctgggctacggccagcagatccccatggaggagaagagaggctggtacttcaccatggccaccctgtacatcagactggacggcatcttcctggagctgggcagcgaggagcagaagagactgcccgccttcaacagaaccctggccctgctgagacaggtgctgaagagcgaggaccccagacacagagccctggcctggtgctacctgggcatgctgctggagagaaaggacaccttcagcaccacccccatgggcgtgcacgactgcggctacagcggcaccgaccccctggactgcttcggcaaggccatcgagatcgccaagaaccagccccccatcctgaacagactggccaagatcttctacttcctgggcaagcaggacatggccatcggcacctgcaacatggccctggacgtgctgagagaccccgagctgaactggcaggcctactgcaccagagccaagatccacatcagagcctacctgcacgacctgaagagagccaagatgggcctgggcggcatgcccgacagaaaccacctggcctgcgccaaggccgacctggaggaggtggtgagagtgtgccccggcttcaaggcctacctggacatcggccaggtgtactactacatgggcgtggacgccgtgcaggagctgctggccgtggacgaggccgccctgaaccaggccctggtgttcctggccaaggccggcgagagcgagctgggcgccaccctgcccgagctgcagctgctgagaggcaagtgcctgagaatcaagggcgaggacgccaacgccgccgcctgcttcaagagagccgtggagctggacgacgccggcagcagccacaccgacggcttcggctgcctgctggaggccctgctggcccagtggagccaggcccagctgagcgacggcgagctgggcagagaggtggacgcctggctgagaagagcccaggacaagtaccccgccgccagactgagacaggagctgcagagagtgtggagaggccacaccgacgaggtgctgggcctggccagagccctggtggcccagggcagacccgccctggtgagactgctgttcgagaccatggagagagagggcgagggcgccagcgcccccagagacagaagagccgtgagcttctag

SEQ ID NO: 25141 - DNA, 1344 bp, Artificial Sequence
  Description of Artificial Sequence: Synthetic coding sequence
atgcaggagagccaggagacccacatcagcaaccacctggacgaggtggtggccgccgtgagcatcacccacagaaagaagttccagaacaagctgctgcagaccgccctgttccagccccccagagagaagctgcacctgtgcgaggagaaggccaagagctacagcaacagccacgagtacaagcaggccgtgcacgagctggtgagatgcgtggccctgaccagaatctgctacggcgacagccactggaagctggccgaggcccacgtgaacctggcccagggctacctgcagctgaagggcctgagcctgcaggccaagcagcacgccgagaaggccagacagatcctggccaacagcatcgtgcccccctacagcgagaacaccgacgtgttcaagttcagcatcgagctgttccacaccatgggcagagccctgctgagcctgcagaagttcaaggaggccgccgagaacctgaccaaggccgagagactgagcaaggagctgctgcagtgcggcagaatcatcaaggaggagtggatcgagatcgaggccagaatcagactgagcttcgcccaggtgtaccagggccagaagaagagcaaggaggccctgagccactaccaggccgccctggagtacgtggagatcagcaagggcgagaccagcagagagtgcgtgcccatcctgagagagctggccggcgtggagcaggccctgggcctgcacgacgtgagcatcaaccacttcctgcaggcccacctgatcatcctgagcagaagccccagccaggtggaggccgccgacagcgcccacatcgtggcccacgccgccgtggccagcggcagacacgagcaccacgacgtggccgagcagtacttccaggagagcatggcccacctgaaggacagcgagggcatgggcagaaccaagttcctgagcatccaggacgagttctgccacttcctgcagatgaccggccagaaggagagagccaccagcatcctgagagagagcctggaggccaaggtggaggccttcggcgacttcagccccgaggtggccgagacctacagactgctgggcggcgccgacctggcccagggcaaccacagcggcgccagaaagaagctgaagaagtgcctgcagatccagaccctgctgtacggcccccaggacaagagaaccctggccacccagcaggccatgggcatgctgagcaccgcccccaaggtggccagcaagcccagacaggccagcaaggccaaggtggccttctgcaccagcatcccccaggacaccctgctgggcaaggccagacccggcaccaccgccgactag

SEQ ID NO: 25142 - DNA, 1182 bp, Artificial Sequence
  Description of Artificial Sequence: Synthetic coding sequence
atgcaggagagccaggagacccacatcagcaaccacctggacgaggtggtggccgccgtgagcatcacccacagaaagaagttccagaacaagctgctgcagaccgccctgttccagccccccagagagaagctgcacctgtgcgaggagaaggccaagagctacagcaacagccacgagtacaagcaggccgtgcacgagctggtgagatgcgtggccctgaccagaatctgctacggcgacagccactggaagctggccgaggcccacgtgaacctggcccagggctacctgcagctgaagggcctgagcctgcaggccaagcagcacgccgagaaggccagacagatcctggccaacagcatcgtgcccccctacagcgagaacaccgacgtgttcaagttcagcatcgagctgttccacaccatgggcagagccctgctgagcctgcagaagttcaaggaggccgccgagaacctgaccaaggccgagagactgagcaaggagctgctgcagtgcggcagaatcatcaaggaggagtggatcgagatcgaggccagaatcagactgagcttcgcccaggtgtaccagggccagaagaagagcaaggaggccctgagccactaccaggccgccctggagtacgtggagatcagcaagggcgagaccagcagagagtgcgtgcccatcctgagagagctggccggcgtggagcaggccctgggcctgcacgacgtgagcatcaaccacttcctgcaggcccacctgatcatcctgagcagaagccccagccaggtggaggccgccgacagcgcccacatcgtggcccacgccgccgtggccagcggcagacacgagcaccacgacgtggccgagcagtacttccaggagagcatggcccacctgaaggacagcgagggcatgggcagaaccaagttcctgagcatccaggacgagttctgccacttcctgcagatgaccggccagaaggagagagccaccagcatcctgagagagagcctggaggccaaggtggaggccttcggcgacttcagccccgaggtggccgagacctacagactgctgggcggcgccgacctggcccagggcaaccacagcggcgccagaaagaagctgaagaagggcgacctgagcttcctgctgagcgccaccctgccctag

SEQ ID NO: 25143 - DNA, 1344 bp, Artificial Sequence; identical to SEQ ID NO: 25141
  Description of Artificial Sequence: Synthetic coding sequence

SEQ ID NO: 25144 - DNA, 1344 bp, Artificial Sequence; identical to SEQ ID NO: 25141
  Description of Artificial Sequence: Synthetic coding sequence

SEQ ID NO: 25145 - DNA, 1344 bp, Artificial Sequence; identical to SEQ ID NO: 25141
  Description of Artificial Sequence: Synthetic coding sequence

SEQ ID NO: 25146 - DNA, 171 bp, Artificial Sequence
  Description of Artificial Sequence: Synthetic coding sequence
atgcaggagagccaggagacccacatcagcaaccacctggacgaggtggtggccgccgtgagcatcacccacagaaagaagttccagaacaagctgctgcagaccgccctgttccagccccccagagagaagctgcacctgtgcgaggagaaggccaagagctacagctag

SEQ ID NO: 25147 - DNA, 1344 bp, Artificial Sequence; identical to SEQ ID NO: 25141
  Description of Artificial Sequence: Synthetic coding sequence

SEQ ID NO: 25148 - DNA, 1344 bp, Artificial Sequence; identical to SEQ ID NO: 25141
  Description of Artificial Sequence: Synthetic coding sequence

SEQ ID NO: 25149 - DNA, 162 bp, Artificial Sequence
  Description of Artificial Sequence: Synthetic coding sequence
atgcaggagagccaggagacccacatcagcaaccacctggacgaggtggtggccgccgtgagcatcacccacagaaagaagttccagaacaagctgctgcagaccgccctgttccagccccccagagagaagctgcacctgtgcgaggagaaggccaagtag

SEQ ID NO: 25150 - DNA, 456 bp, Artificial Sequence
  Description of Artificial Sequence: Synthetic coding sequence
atgcaggagagccaggagacccacatcagcaaccacctggacgaggtggtggccgccgtgagcatcacccacagaaagaagttccagaacaagctgctgcagaccgccctgttccagccccccagagagaagctgcacctgtgcgaggagaaggccaagagctacagcaacagccacgagtacaagcaggccgtgcacgagctggtgagatgcgtggccctgaccagaatctgctacggcgacagccactggaagctggccgaggcccacgtgaacctggcccagggctacctgcagctgaagggcctgagcctgcaggccaagcagcacgccgagaaggccagacagatcctggccaacagcatcgtgcccccctacagcgagaacaccgacgtgttcaagttcagcatcgagctgttccacaccatgggcagagccctgctgagcctgcagtag

SEQ ID NO: 25151 - DNA, 252 bp, Artificial Sequence
  Description of Artificial Sequence: Synthetic coding sequence
atgcaggagagccaggagacccacatcagcaaccacctggacgaggtggtggccgccgtgagcatcacccacagaaagaagttccagaacaagctgctgcagaccgccctgttccagccccccagagagaagctgcacctgtgcgaggagaaggccaagagctacagcaacagccacgagtacaagcaggccgtgcacgagctggtgagatgcgtggccctgaccagaatctgctacggcgacagccactag

SEQ ID NO: 25152 - DNA, 348 bp, Artificial Sequence
  Description of Artificial Sequence: Synthetic coding sequence
atgcaggagagccaggagacccacatcagcaaccacctggacgaggtggtggccgccgtgagcatcacccacagaaagaagttccagaacaagctgctgcagaccgccctgttccagccccccagagagaagctgcacctgtgcgaggagaaggccaagagctacagcaacagccacgagtacaagcaggccgtgcacgagctggtgagatgcgtggccctgaccagaatctgctacggcgacagccactggaagctggccgaggcccacgtgaacctggcccagggctacctgcagctgaagggcctgagcctgcaggccaagcagcacgccgagaaggccagatag

SEQ ID NO: 25153 - DNA, 474 bp, Artificial Sequence
  Description of Artificial Sequence: Synthetic coding sequence
atgcaggagagccaggagacccacatcagcaaccacctggacgaggtggtggccgccgtgagcatcacccacagaaagaagttccagaacaagctgctgcagaccgccctgttccagccccccagagagaagctgcacctgtgcgaggagaaggccaagagctacagcaacagccacgagtacaagcaggccgtgcacgagctggtgagatgcgtggccctgaccagaatctgctacggcgacagccactggaagctggccgaggcccacgtgaacctggcccagggctacctgcagctgaagggcctgagcctgcaggccaagcagcacgccgagaaggccagacagatcctggccaacagcatcgtgcccccctacagcgagaacaccgacgtgttcaagttcagcatcgagctgttccacaccatgggcagagccctgctgagcctgcagaagttcaaggaggccgcctag

SEQ ID NO: 25154 - DNA, 1344 bp, Artificial Sequence; identical to SEQ ID NO: 25141
  Description of Artificial Sequence: Synthetic coding sequence

SEQ ID NO: 25155 - DNA, 1344 bp, Artificial Sequence; identical to SEQ ID NO: 25141
  Description of Artificial Sequence: Synthetic coding sequence

SEQ ID NO: 25156 - DNA, 1344 bp, Artificial Sequence; identical to SEQ ID NO: 25141
  Description of Artificial Sequence: Synthetic coding sequence

SEQ ID NO: 25157 - DNA, 1344 bp, Artificial Sequence; identical to SEQ ID NO: 25141
  Description of Artificial Sequence: Synthetic coding sequence

SEQ ID NO: 25158 - DNA, 1086 bp, Artificial Sequence
  Description of Artificial Sequence: Synthetic coding sequence
atgcaggccagccccatcagaatccccaccgtgagcaacgacatcgactgggacttctgcttccacatgagccagcagaccgagatccccgcccaccagcagaccgacgagctgtaccccaccggcggctgcggcgagagcgaggaggagaccaaggccaaggagaaggagaaggccatcgactgcatgagccaccccaaggagaagctggcccagagccagaagaaggtggcccagctgatcaaggagaagatgaacacccaggccaacaaggagctgatcagatgcgtgatcctgagcagaatcatcttcggcgaccaccactggaagtgcgccagagccctggccaacctggcctacggctacctgaccctgagaggcctgcccgtgcaggccaagaagcacgccaccagcgccaagaacaccctgctgacctggaaggccaacaccaccagcaacaaggagaaggaggagatcctggaggccctggtgaagctgtactacaccctgggcgtggcctggctgctgcagaacagaggcagagaggcctacttcaacctgcagaaggccgagagaaacatgaaggagctgaaggagctgtacaagggcggcgtgtgcgagctgcaggtgagcgagaacgacctgaccctggccctgggcagagccagcctggccatccacagactgaacctggccctggcctacttcgagaaggccatcggcgacgtgatcgccgccaagggcgacagaaccagcgacctgatcagcctgtacgaggaggccgcccagatcgagcagctgagaagaaaccacaaccaggccatccagtacctgcagcaggcccacagcgtgtgcgtgagcctgttcaccgaggtgagccccaagaccgccgagatgagcgccctgctggccaaggcctacgccatgagcggcgaggcccagcacagagacgccgtggagatctacttcatcagaagcatcaacgcctacagagccaccctgggcagcgaggacttcgagaccctgagcaccaccgaggagttctgcaagtggctggtgcagaacggcgagaagcaggacaagtag

SEQ ID NO: 25159 - DNA, 1086 bp, Artificial Sequence
  Description of Artificial Sequence: Synthetic coding sequence
atgcaggccagccccatcagaatccccaccgtgagcaacgacatcgactgggacttctgcttccacatgagccagcagaccgagatccccgcccaccagcagaccgacgagctgtaccccaccggcggctgcggcgagagcgaggaggagaccaaggccaaggagaaggagaaggccatcgactgcatgagccaccccaaggagaagctggcccagagccagaagaaggtggcccagctgatcaaggagaagatgaacacccaggccaacaaggagctgatcagatgcgtgatcctgagcagaatcatcttcggcgaccaccactggaagtgcgccagagccctggccaacctggcctacggctacctgaccctgagaggcctgcccgtgcaggccaagaagcacgccaccagcgccaagaacaccctgctgacctggaaggccaacaccaccagcaacaaggagaaggaggagatcctggaggccctggtgaagctgtactacaccctgggcgtggcctggctgctgcagaacagatgcagagaggcctacttcaacctgcagaaggccgagagaaacatgaaggagctgaaggagctgtacaagggcggcgtgtgcgagctgcaggtgagcgagaacgacctgaccctggccctgggcagagccagcctggccatccacagactgaacctggccctggcctacttcgagaaggccatcggcgacgtgatcgccgccaagggcgacagaaccagcgacctgatcagcctgtacgaggaggccgcccagatcgagcagctgagaagaaaccacaaccaggccatccagtacctgcagcaggcccacagcgtgtgcgtgagcctgttcaccgaggtgagccccaagaccgccgagatgagcgccctgctggccaaggcctacgccatgagcggcgaggcccagcacagagacgccgtggagatctacttcatcagaagcatcaacgcctacagagccaccctgggcagcgaggacttcgagaccctgagcaccaccgaggagttctgcaagtggctggtgcagaacggcgagaagcaggacagatag

SEQ ID NO: 25160 - DNA, 1068 bp, Artificial Sequence
  Description of Artificial Sequence: Synthetic coding sequence
tgaagcaccgagagaagactgctgggccacctgtacaacgacctgggcctgggctacagccagctgcagctgttccccctggccgtggaggccttcctgcaggccctgcccctgtgctgggtgcccggcgagcaggccaccgtgctgagaaacctgggcatggcccacaacgccctgggcaactaccaggaggccagagagttccaccagaaggccgccgacctgcacggcagcgtgggccagagatgggagcagggcagaagcttcggcagcctggccttcgccctgagccagctgggcgaccacaaggccgccagagacaactacctgcacgccctgcaggccgccagagacagcggcgacatgaagggccagtggcaggcctgcgagggcctgggcgccgccgccgccagactgggccagtacgaccaggccctgaagtactacaaggaggccctggcccagtgccagaaggagcccgacagcgtgagagagagactggtggccaagctggccgacaccgtgagaaccagactggcccaggtgggcctggtgcagacccacaccctgaccagcgcccccggcagactgcaggcccccggcggcgccagccaggccgagggcacccccgccaaggccggcagcagcaccgccggcgtgcagcacagaagcagcagcggctgggaggacgaggagttcgaggagggccaccagaagaagaaggaggagagaagcgccaacgtgcccgtgagagccggccccggcagacccgagctgtgcttcctgcccggcaccgtgaaccacagccaccacctggccagcagctgccccaccttcaccaagcacaccccctgcagaggcaccgtgctgggcaaggccagcatctacagccccggccccagagcccacctgcccttcgtgggccccggcccccccagagccgagtaccccagcatcctggtgcccaacggcccccaggccaacagaagcagcagatggcccagagagagcctgagcagaagcagacagagaagacccatggagagcggcatctgcaccatcgtgtag

SEQ ID NO: 25161 - DNA, 1749 bp, Artificial Sequence
  Description of Artificial Sequence: Synthetic coding sequence
atgagcagccccaaccccgaggacgtgcccagaagacccgagcccgagcccagcagcagcaacaagaagaagaagaagagaaagtggctgagacaggaggccagcatccaggccctgaccagagccggccacggcgccctgcaggccggccagaaccacgaggccctgaacaacttccagagagccttcctgctggccagcaaggccccccagaccagagacacccccgtgctgcaggcctgcgccttcaacctgggcgccgcctacgtggagaccggcgaccccgccagaggcctggagctgctgctgagagcccaccccgaggagaaggcccagggcagaagacacggcgaccagtgcttcaacgtggccctggcctaccacgccctgggcgagctgccccaggccctggcctggtaccacagagccctgggccactaccagccccagggcgaccagggcgaggcctgggccaagatgggcgcctgctaccaggccctgggccagcccgagctggccgcccactgcctgcaggaggccagccaggcctacgcccaggagagacagctgagagccgccgccctggccctgggcgccgccgccggctgcatgctgaagagcggcagacacagagtgggcgaggtggtgcaggtgctggagaagagcagaagactggccgagagaagcaccgagagaagactgctgggccacctgtacaacgacctgggcctgggctacagccagctgcagctgttccccctggccgtggaggccttcctgcaggccctgcccctgtgctgggtgcccggcgagcaggccaccgtgctgagaaacctgggcatggcccacaacgccctgggcaactaccaggaggccagagagttccaccagaaggccgccgacctgcacggcagcgtgggccagagatgggagcagggcagaagcttcggcagcctggccttcgccctgagccagctgggcgaccacaaggccgccagagacaactacctgcacgccctgcaggccgccagagacagcggcgacatgaagggccagtggcaggcctgcgagggcctgggcgccgccgccgccagactgggccagtacgaccaggccctgaagtactacaaggaggccctggcccagtgccagaaggagcccgacagcgtgagagagagactggtggccaagctggccgacaccgtgagaaccagactggcccaggtgggcctggtgcagacccacaccctgaccagcgcccccggcagactgcaggcccccggcggcgccagccaggccgagggcacccccgccaaggccggcagcagcaccgccggcgtgcagcacagaagcagcagcggctgggaggacgaggagttcgaggagggccaccagaagaagaaggaggagagaagcgccaacgtgcccgtgagagccggccccggcagacccgagctgtgcttcctgcccggcaccgtgaaccacagccaccacctggccagcagctgccccaccttcaccaagcacaccccctgcagaggcaccgtgctgggcaaggccagcatctacagccccggccccagagcccacctgcccttcgtgggccccggcccccccagagccgagtaccccagcatcctggtgcccaacggcccccaggccaacagaagcagcagatggcccagagagagcctgagcagaagcagacagagaagacccatggagagcggcatctgcaccatcgtgtag

SEQ ID NO: 25162 - DNA, 1749 bp, Artificial Sequence; identical to SEQ ID NO: 25161
  Description of Artificial Sequence: Synthetic coding sequence

SEQ ID NO: 25163 - DNA, 552 bp, Artificial Sequence
  Description of Artificial Sequence: Synthetic coding sequence
tgacacctgtacaacgacctgggcctgggctacagccagctgcagctgttccccctggccgtggaggccttcctgcaggccctgcccctgtgctgggtgcccggcgagcaggccaccgtgctgagaaacctgggcatggcccacaacgccctgggcaactaccaggaggccagagagttccaccagaaggccgccgacctgcacggcagcgtgggccagagatgggagcagggcagaagcttcggcagcctggccttcgccctgagccagctgggcgaccacaaggccgccagagacaactacctgcacgccctgcaggccgccagagacagcggcgccagattctgcgccagaaccgccggcggccaggccggcagacacagagaggacgccctgggccccggcggcgccggccccgacagccaccccgacttcggcagcggcaagacccccggcagcagatggggccagcccggcggcggcgaccccagcaagggcagaaagcagcacagcagatgccccgcccagatcttccagtgggtgggcagatag

SEQ ID NO: 25164 - DNA, 2019 bp, Artificial Sequence
  Description of Artificial Sequence: Synthetic coding sequence
atgagcgaccccgagggcgagaccctgagaagcaccttccccagctacatggccgagggcgagagactgtacctgtgcggcgagttcagcaaggccgcccagagcttcagcaacgccctgtacctgcaggacggcgacaagaactgcctggtggccagaagcaagtgcttcctgaagatgggcgacctggagagaagcctgaaggacgccgaggccagcctgcagagcgaccccgccttctgcaagggcatcctgcagaaggccgagaccctgtacaccatgggcgacttcgagttcgccctggtgttctaccacagaggctacaagctgagacccgacagagagttcagagtgggcatccagaaggcccaggaggccatcaacaacagcgtgggcagccccagcagcatcaagctggagaacaagggcgacctgagcttcctgagcaagcaggccgagaacatcaaggcccagcagaagccccagcccatgaagcacctgctgcaccccaccaagggcgagcccaagtggaaggccagcctgaagagcgagaagaccgtgagacagctgctgggcgagctgtacgtggacaaggagtacctggagaagctgctgctggacgaggacctgatcaagggcaccatgaagggcggcctgaccgtggaggacctgatcatgaccggcatcaactacctggacacccacagcaacttctggagacagcagaagcccatctacgccagagagagagacagaaagctgatgcaggagaagtggctgagagaccacaagagaagacccagccagaccgcccactacatcctgaagagcctggaggacatcgacatgctgctgaccagcggcagcgccgagggcagcctgcagaaggccgagaaggtgctgaagaaggtgctggagtggaacaaggaggaggtgcccaacaaggacgagctggtgggcaacctgtacagctgcatcggcaacgcccagatcgagctgggccagatggaggccgccctgcagagccacagaaaggacctggagatcgccaaggagtacgacctgcccgacgccaagagcagagccctggacaacatcggcagagtgttcgccagagtgggcaagttccagcaggccatcgacacctgggaggagaagatccccctggccaagaccaccctggagaagacctggctgttccacgagatcggcagatgctacctggagctggaccaggcctggcaggcccagaactacggcgagaagagccagcagtgcgccgaggaggagggcgacatcgagtggcagctgaacgccagcgtgctggtggcccaggcccaggtgaagctgagagacttcgagagcgccgtgaacaacttcgagaaggccctggagagagccaagctggtgcacaacaacgaggcccagcaggccatcatcagcgccctggacgacgccaacaagggcatcatcagagagctgagaaagaccaactacgtggagaacctgaaggagaagagcgagggcgaggccagcctgtacgaggacagaatcatcaccagagagaaggacatgagaagagtgagagacgagcccgagaaggtggtgaagcagtgggaccacagcgaggacgagaaggagaccgacgaggacgacgaggccttcggcgaggccctgcagagccccgccagcggcaagcagagcgtggaggccggcaaggccagaagcgacctgggcgccgtggccaagggcctgagcggcgagctgggcaccagaagcggcgagaccggcagaaagctgctggaggccggcagaagagagagcagagagatctacagaagacccagcggcgagctggagcagagactgagcggcgagttcagcagacaggagcccgaggagctgaagaagctgagcgaggtgggcagaagagagcccgaggagctgggcaagacccagttcggcgagatcggcgagaccaagaagaccggcaacgagatggagaaggagtacgagtag

SEQ ID NO: 25165 - DNA, 1464 bp, Artificial Sequence
  Description of Artificial Sequence: Synthetic coding sequence
atgatgctgagcagagccaagcccgccgtgggcagaggcgtgcagcacaccgacaagagaaagaagaagggcagaaagatccccaagctggaggagctgctgagcaagagagacttcaccggcgccatcaccctgctggagttcaagagacacgtgggcgaggaggaggaggacaccaacctgtggatcggctactgcgccttccacctgggcgactacaagagagccctggaggagtacgagaacgccaccaaggaggagaactgcaacagcgaggtgtgggtgaacctggcctgcacctacttcttcctgggcatgtacaagcaggccgaggccgccggcttcaaggccagcaagagcagactgcagaacagactgctgttccacctggcccacaagttcaacgacgagaagaagctgatgagcttccaccagaacctgcaggacgtgaccgaggaccagctgagcctggccagcatccactacatgagaagccactaccaggaggccatcgacatctacaagagaatcctgctggacaacagagagtacctggccctgaacgtgtacgtggccctgtgctactacaagctggactactacgacgtgagccaggaggtgctggccgtgtacctgcagcagatccccgacagcaccatcgccctgaacctgaaggcctgcaaccacttcagactgtacaacggcagagccgccgaggccgagctgaagagcctgatggacaacgccagcagcagcttcgagttcgccaaggagctgatcagacacaacctggtggtgttcagaggcggcgagggcgccctgcaggtgctgccccccctggtggacgtgatccccgaggccagactgaacctggtgatctactacctgagacaggacgacgtgcaggaggcctacaacctgatcaaggacctggagcccaccaccccccaggagtacatcctgaagggcgtggtgaacgccgccctgggccaggagatgggcagcagagaccacatgaagatcgcccagcagttcttccagctggtgggcggcagcgccagcgagtgcgacaccatccccggcagacagtgcatggccagctgcttcttcctgctgaagcagttcgacgacgtgctgatctacctgaacagcttcaagagctacttctacaacgacgacatcttcaacttcaactacgcccaggccaaggccgccaccggcaacaccagcgagggcgaggaggccttcctgctgatccagagcgagaagatgaagaacgactacatctacctgagctggctggccagatgctacatcatgaacaagaagcccagactggcctgggagctgtacctgaagatggagaccagcggcgagagcttcagcctgctgcagctgatcgccaacgactgctacaagagagaccccagcagaagcgcccccttcaccgagaagcacagatag

SEQ ID NO: 25166 - DNA, 1665 bp, Artificial Sequence
  Description of Artificial Sequence: Synthetic coding sequence
atgatgctgagcagagccaagcccgccgtgggcagaggcgtgcagcacaccgacaagagaaagaagaagggcagaaagatccccaagctggaggagctgctgagcaagagagacttcaccggcgccatcaccctgctggagttcaagagacacgtgggcgaggaggaggaggacaccaacctgtggatcggctactgcgccttccacctgggcgactacaagagagccctggaggagtacgagaacgccaccaaggaggagaactgcaacagcgaggtgtgggtgaacctggcctgcacctacttcttcctgggcatgtacaagcaggccgaggccgccggcttcaaggccagcaagagcagactgcagaacagactgctgttccacctggcccacaagttcaacgacgagaagaagctgatgagcttccaccagaacctgcaggacgtgaccgaggaccagctgagcctggccagcatccactacatgagaagccactaccaggaggccatcgacatctacaagagaatcctgctggacaacagagagtacctggccctgaacgtgtacgtggccctgtgctactacaagctggactactacgacgtgagccaggaggtgctggccgtgtacctgcagcagatccccgacagcaccatcgccctgaacctgaaggcctgcaaccacttcagactgtacaacggcagagccgccgaggccgagctgaagagcctgatggacaacgccagcagcagcttcgagttcgccaaggagctgatcagacacaacctggtggtgttcagaggcggcgagggcgccctgcaggtgctgccccccctggtggacgtgatccccgaggccagactgaacctggtgatctactacctgagacaggacgacgtgcaggaggcctacaacctgatcaaggacctggagcccaccaccccccaggagtacatcctgaagggcgtggtgaacgccgccctgggccaggagatgggcagcagagaccacatgaagatcgcccagcagttcttccagctggtgggcggcagcgccagcgagtgcgacaccatccccggcagacagtgcatggccagctgcttcttcctgctgaagcagttcgacgacgtgctgatctacctgaacagcttcaagagctacttctacaacgacgacatcttcaacttcaactacgcccaggccaaggccgccaccggcaacaccagcgagggcgaggaggccttcctgctgatccagagcgagaagatgaagaacgactacatctacctgagctggctggccagatgctacatcatgaacaagaagcccagactggcctgggagctgtacctgaagatggagaccagcggcgagagcttcagcctgctgcagctgatcgccaacgactgctacaagatgggccagttctactacagcgccaaggccttcgacgtgctggagagactggaccccaaccccgagtactgggagggcaagagaggcgcctgcgtgggcatcttccagatgatcatcgccggcagagagcccaaggagaccctgagagaggtgctgcacctgctgagaagcaccggcaacacccaggtggagtacatgatcagaatcatgaagaagtgggccaaggagaacagagtgagcatctag

SEQ ID NO: 25167 - DNA, 1572 bp, Artificial Sequence
  Description of Artificial Sequence: Synthetic coding sequence
atgatgctgagcagagccaagcccgccgtgggcagaggcgtgcagcacaccgacaagagaaagaagaagggcagaaagatccccaagctggaggagctgctgagcaagagagacttcaccggcgccatcaccctgctggaggagtacgagaacgccaccaaggaggagaactgcaacagcgaggtgtgggtgaacctggcctgcacctacttcttcctgggcatgtacaagcaggccgaggccgccggcttcaaggccagcaagagcagactgcagaacagactgctgttccacctggcccacaagttcaacgacgagaagaagctgatgagcttccaccagaacctgcaggacgtgaccgaggaccagctgagcctggccagcatccactacatgagaagccactaccaggaggccatcgacatctacaagagaatcctgctggacaacagagagtacctggccctgaacgtgtacgtggccctgtgctactacaagctggactactacgacgtgagccaggaggtgctggccgtgtacctgcagcagatccccgacagcaccatcgccctgaacctgaaggcctgcaaccacttcagactgtacaacggcagagccgccgaggccgagctgaagagcctgatggacaacgccagcagcagcttcgagttcgccaaggagctgatcagacacaacctggtggtgttcagaggcggcgagggcgccctgcaggtgctgccccccctggtggacgtgatccccgaggccagactgaacctggtgatctactacctgagacaggacgacgtgcaggaggcctacaacctgatcaaggacctggagcccaccaccccccaggagtacatcctgaagggcgtggtgaacgccgccctgggccaggagatgggcagcagagaccacatgaagatcgcccagcagttcttccagctggtgggcggcagcgccagcgagtgcgacaccatccccggcagacagtgcatggccagctgcttcttcctgctgaagcagttcgacgacgtgctgatctacctgaacagcttcaagagctacttctacaacgacgacatcttcaacttcaactacgcccaggccaaggccgccaccggcaacaccagcgagggcgaggaggccttcctgctgatccagagcgagaagatgaagaacgactacatctacctgagctggctggccagatgctacatcatgaacaagaagcccagactggcctgggagctgtacctgaagatggagaccagcggcgagagcttcagcctgctgcagctgatcgccaacgactgctacaagatgggccagttctactacagcgccaaggccttcgacgtgctggagagactggaccccaaccccgagtactgggagggcaagagaggcgcctgcgtgggcatcttccagatgatcatcgccggcagagagcccaaggagaccctgagagaggtgctgcacctgctgagaagcaccggcaacacccaggtggagtacatgatcagaatcatgaagaagtgggccaaggagaacagagtgagcatctag

SEQ ID NO: 25168 - DNA, 2532 bp, Artificial Sequence
  Description of Artificial Sequence: Synthetic coding sequence
atgtggacccccgagctggccatcctgagaggcttccccaccgaggccgagagacagcagtggaagcaggagggcgtggtgggcagcgagagcggcagcttcctgcagctgctgctggagggcaactacgaggccatcttcctgaacagcatgacccagaacatcttcaacagcaccaccaccgccgaggagaagatcgacagctacctggagaagcaggtggtgaccttcctggactacagcaccgacctggacaccaccgagagacagcagctgatcttcctgctgggcgtgagcagcctgcagctgttcgtgcagagcaactggaccggcccccccgtggacctgcacccccaggacttcctgagcagcgtgctgttccagcagttcagcgaggtgaagggcctggacgccttcgtgctgagcctgctgaccctggacggcgagagcatctacagcctgaccagcaagcccatcctgctgctgctggccagaatcatcctggtgaacgtgagacacaagctgaccgccatccagagcctgccctggtggaccctgagatgcgtgaacatccaccagcacctgctggaggagagaagccccctgctgttcaccctggccgagaactgcatcgaccaggtgatgaagctgcagaacctgttcgtggacgacagcggcagatacctggccatccagttccacctggagtgcgcctacgtgttcctgtactactacgagtacagaaaggccaaggaccagctggacatcgccaaggacatcagccagctgcagatcgacctgaccggcgccctgggcaagagaaccagattccaggagaactacgtggcccagctgatcctggacgtgagaagagagggcgacgtgctgagcaactgcgagttcacccccgcccccaccccccaggagcacctgaccaagaacctggagctgaacgacgacaccatcctgaacgacatcaagctggccgactgcgagcagttccagatgcccgacctgtgcgccgaggagatcgccatcatcctgggcatctgcaccaacttccagaagaacaaccccgtgcacaccctgaccgaggtggagctgctggccttcaccagctgcctgctgagccagcccaagttctgggccatccagaccagcgccctgatcctgagaaccaagctggagaagggcagcaccagaagagtggagagagccatgagacagacccaggccctggccgaccagttcgaggacaagaccaccagcgtgctggagagactgaagatcttctactgctgccaggtgcccccccactgggccatccagagacagctggccagcctgctgttcgagctgggctgcaccagcagcgccctgcagatcttcgagaagctggagatgtgggaggacgtggtgatctgctacgagagagccggccagcacggcaaggccgaggagatcctgagacaggagctggagaagaaggagacccccagcctgtactgcctgctgggcgacgtgctgggcgaccacagctgctacgacaaggcctgggagctgagcagatacagaagcgccagagcccagagaagcaaggccctgctgcacctgagaaacaaggagttccaggagtgcgtggagtgcttcgagagaagcgtgaagatcaaccccatgcagctgggcgtgtggttcagcctgggctgcgcctacctggccctggaggactaccagggcagcgccaaggccttccagagatgcgtgaccctggagcccgacaacgccgaggcctggaacaacctgagcaccagctacatcagactgaagcagaaggtgaaggccttcagaaccctgcaggaggccctgaagtgcaactacgagcactggcagatctgggagaactacatcctgaccagcaccgacgtgggcgagttcagcgaggccatcaaggcctaccacagactgctggacctgagagacaagtacaaggacgtgcaggtgctgaagatcctggtgagagccgtgatcgacggcatgaccgacagaagcggcgacgtggccaccggcctgaagggcaagctgcaggagctgttcggcagagtgaccagcagagtgaccaacgacggcgagatctggagactgtacgcccacgtgtacggcaacggccagagcgagaagcccgacgagaacgagaaggccttccagtgcctgagcaaggcctacaagtgcgacacccagagcaactgctgggagaaggacatcaccagcttcaaggaggtggtgcagagagccctgggcctggcccacgtggccatcaagtgcagcaagaacaagagcagcagccaggaggccgtgcagatgctgagcagcgtgagactgaacctgagaggcctgctgagcaaggccaagcagctgttcaccgacgtggccaccggcgagatgagcagagagctggccgacgacatcaccgccatggacaccctggtgaccgagctgcaggacctgagcaaccagttcagaaaccagtactag

SEQ ID NO: 25169 - DNA, 7446 bp, Artificial Sequence
  Description of Artificial Sequence: Synthetic coding sequence
atggagcagagccccccccccgcccccgagcccacccagggccccacccccgccagaagcagaagaagaagagagcccgagagcccccccgccagcgcccccatccccctgttcggcgccgacaccatcggccagagaagccccgacggccccgtgctgagcaaggccgagttcgtggagaaggtgagacagagcaaccaggcctgccacgacggcgacttccacaccgccatcgtgctgtacaacgaggccctggccgtggacccccagaactgcatcctgtacagcaacagaagcgccgcctacatgaagatccagcagtacgacaaggccctggacgacgccatcaaggccagactgctgaaccccaagtggcccaaggcctacttcagacagggcgtggccctgcagtacctgggcagacacgccgacgccctggccgccttcgccagcggcctggcccaggaccccaagagcctgcagctgctggtgggcatggtggaggccgccatgaagagccccatgagagacagcctggagcccacctaccagcagctgcagaagatgaagctggacaagagccccttcgtggtggtgagcgtggtgggccaggagctgctgaccgccggccaccacggcgccagcgtggtggtgctggaggccgccctgaagatcggcacctgcagcctgaagctgagaggcagcgtgttcagcgccctgagcagcgcctactggagcctgggcaacaccgagaagagcaccggctacatgcagcaggacctggacgtggccaagaccctgggcgaccagaccggcgagtgcagagcccacggcaacctgggcagcgccttcttcagcaagggcaactacagagaggccctgaccaaccacagacaccagctggtgctggccatgaagctgaaggacagagaggccgccagcagcgccctgagcagcctgggccacgtgtacaccgccatcggcgactaccccaacgccctggccagccacaagcagtgcgtgctgctggccaagcagagcaaggacgagctgagcgaggccagagagctgggcaacatgggcgccgtgtacatcgccatgggcgacttcgagaacgccgtgcagtgccacgagcagcacctgaagatcgccaaggacctgggcaacaagagagaggaggccagagcctacagcaacctgggcagcgcctaccactacagaagaaacttcgacaaggccatgagctaccacaactacgtgctggagctggcccaggagctgatggagaaggccatcgagatgagagcctacgccggcctgggccacgccgccagatgcatgcaggacctggagagagccaagcagtaccacgagcagcagctgggcatcgccgaggacctgaaggacagagccgccgagggcagagccagcagcaacctgggcatcatccaccagatgaagggcgactacgacaccgccctgaagctgcacaagacccacctgtgcatcgcccaggagctgagcgactacgccgcccagggcagagcctacggcaacatgggcaacgcctacaacgccctgggcatgtacgaccaggccgtgaagtaccacagacaggagctgcagatcagcatggaggtgaacgacagagccagccaggccagcacccacggcaacctggccgtggcctaccaggccctgggcgcccacgacagagccctgcagcactaccagaaccacctgaacatcgccagagagctgagagacatccagagcgaggccagagccctgagcaacctgggcaacttccactgcagcagaggcgagtacgtgcaggccgccccctactacgagcagtacctgagactggcccccgacctgcaggacatggagggcgagggcaaggtgtgccacaacctgggctacgcccactactgcctgggcaactaccaggaggccgtgaagtactacgagcaggacctggccctggccaaggacctgcacgacaagctgagccaggccaaggcctactgcaacctgggcctggccttcaaggccctgctgaacttcagcaaggccgaggagtgccagaagtacctgctgagcctggcccagagcctgaacaacagccaggccaagttcagagccctgggcaacctgggcgacatcttcatctgcaagaaggacatcaacggcgccatcaagttctacgagcagcagctgggcctggcccaccaggtgaaggacagaagactggaggccagcgcctacgccgccctgggcaccgcctacagaatgatccagaagtacgacaaggccctgggctaccacacccaggagctggaggtgtaccaggagctgagcgacctgcccggcgagtgcagagcccacggccacctggccgccgtgtacatggccctgggcaagtacaccatggccttcaagtgctacgaggagcagctggacctgggccagaagctgaaggaccccagcctggaggcccaggtgtacggcaacatgggcatcaccaagatgaacatgaacgtgatggaggaggccatcggctacttcgagcagcagctggccatgctgcagcagctgagcggcaacgagagcgtgctggacagaggcagagcctacggcaacctgggcgactgctacgaggccctgggcgactacgaggaggccatcaagtactacgagcagtacctgagcgtggcccagagcctgaacagaatgcaggaccaggccaaggcctacagaggcctgggcaacggccacagagccatgggcagcctgcagcaggccctggtgtgcttcgagaagagactggtggtggcccacgagctgggcgaggccttcaacaaggcccaggcctacggcgagctgggcagcctgcacagccagctgggcaactacgagcaggccatcagctgcctggagagacagctgaacatcgccagagacatgaaggacagagccctggagagcgacgccgcctgcggcctgggcggcgtgtaccagcagatgggcgagtacgacaccgccctgcagtaccaccagctggacctgcagatcgccgaggagaccaacaaccccacctgccagggcagagcctacggcaacctgggcctgacctacgagagcctgggcaccttcgagagagccgtggtgtaccaggagcagcacctgagcatcgccgcccagatgaacgacctggccgccaagaccgtgagctacagcagcctgggcagaacccaccacgccctgcagaactacagccaggccgtgatgtacctgcaggagggcctgagactggccgagcagctgggcagaagagaggacgaggccaagatcagacacggcctgggcctgagcctgtgggccagcggcaacctggaggaggcccagcaccagctgtacagagccagcgccctgttcgagaccatcagacacgaggcccagctgagcaccgactacaagctgagcctgttcgacctgcagaccagcagctaccaggccctgcagagagtgctggtgagcctgggccaccacgacgaggccctggccgtggccgagagaggcagaaccagagccttcgccgacctgctggtggagagacagaccggccagcaggacagcgacccctacagccccgtgaccatcgaccagatcctggagatggtgaacggccagagaggcctggtgctgtactacagcctggccgccggctacctgtacagctggctgctggcccccggcgccggcatcgtgaagttccacgagcactacctgggcgagaacaccgtggagaacagcagcgacttccaggccagcagcagcgtgaccctgcccaccgccaccggcagcgccctggagcagcacatcgccagcgtgagagaggccctgggcgtggagagccactacagcagagcctgcgccagcagcgagaccgagagcgaggccggcgacatcatggaccagcagttcgaggagatgaacaacaagctgaacagcgtgaccgaccccaccggcttcctgagaatggtgagaagaaacaacctgttcaacagaagctgccagagcatgaccagcctgttcagcaacaccgtgagccccacccaggacggcaccagcagcctgcccagaagacagagcagcttcgccaagccccccctgagagccctgtacgacctgctgatcgcccccatggagggcggcctgatgcacagcagcggccccgtgggcagacacagacagctgatcctggtgctggagggcgagctgtacctgatccccttcgccctgctgaagggcagcagcagcaacgagtacctgtacgagagattcggcctgctggccgtgcccagcatcagaagcctgagcgtgcagagcaagagccacctgagaaagaacccccccacctacagcagcagcaccagcatggccgccgtgatcggcaaccccaagctgcccagcgccgtgatggacagatggctgtggggccccatgcccagcgccgaggaggaggcctacatggtgagcgagctgctgggctgccagcccctggtgggcagcgtggccaccaaggagagagtgatgagcgccctgacccaggccgagtgcgtgcacttcgccacccacatcagctggaagctgagcgccctggtgctgacccccagcatggacggcaaccccgccagcagcaagagcagcttcggccacccctacaccatccccgagagcctgagagtgcaggacgacgccagcgacggcgagagcatcagcgactgcccccccctgcaggagctgctgctgaccgccgccgacgtgctggacctgcagctgcccgtgaagctggtggtgctgggcagcagccaggagagcaacagcaaggtgaccgccgacggcgtgatcgccctgaccagagccttcctggccgccggcgcccagtgcgtgctggtgagcctgtggcccgtgcccgtggccgccagcaagatgttcatccacgccttctacagcagcctgctgaacggcctgaaggccagcgccgccctgggcgaggccatgaaggtggtgcagagcagcaaggccttcagccaccccagcaactgggccggcttcatgctgatcggcagcgacgtgaagctgaacagccccagcagcctgatcggccaggccctgaccgagatcctgcagcaccccgagagagccagagacgccctgagagtgctgctgcacctggtggagaagagcctgcagagaatccagaacggccagagaaacgccatgtacaccagccagcagagcgtggagaacaaggtgggcggcatccccggctggcaggccctgctgaccgccgtgggcttcagactggacccccccaccagcggcctgcccgccgccgtgttcttccccaccagcgaccccggcgacagactgcagcagtgcagcagcaccctgcagagcctgctgggcctgcccaaccccgccctgcaggccctgtgcaagctgatcaccgccagcgagaccggcgagcagctgatcagcagagccgtgaagaacatggtgggcatgctgcaccaggtgctggtgcagctgcaggccggcgagaaggagcaggacctggccagcgcccccatccaggtgagcatcagcgtgcagctgtggagactgcccggctgccacgagttcctggccgccctgggcttcgacctgtgcgaggtgggccaggaggaggtgatcctgaagaccggcaagcaggccaacagaagaaccgtgcacttcgccctgcagagcctgctgagcctgttcgacagcaccgagctgcccaagagactgagcctggacagcagcagcagcctggagagcctggccagcgcccagagcgtgagcaacgccctgcccctgggctaccagcagccccccttcagccccaccggcgccgacagcatcgccagcgacgccatcagcgtgtacagcctgagcagcatcgccagcagcatgagcttcgtgagcaagcccgagggcggcagcgagggcggcggccccggcggcagacaggaccacgacagaagcaagaacgcctacctgcagagaagcaccctgcccagaagccagctgcccccccagaccagacccgccggcaacaaggacgaggaggagtacgagggcttcagcatcatcagcaacgagcccctggccacctaccaggagaacagaaacacctgcttcagccccgaccacaagcagccccagcccggcaccgccggcggcatgagagtgagcgtgagcagcaagggcagcatcagcacccccaacagccccgtgaagatgaccctgatccccagccccaacagccccttccagaaggtgggcaagctggccagcagcgacaccggcgagagcgaccagagcagcaccgagaccgacagcaccgtgaagagccaggaggagagcaaccccaagctggacccccaggagctggcccagaagatcctggaggagacccagagccacctgatcgccgtggagagactgcagagaagcggcggccaggtgagcaagagcaacaaccccgaggacggcgtgcaggcccccagcagcaccgccgtgttcagagccagcgagaccagcgccttcagcagacccgtgctgagccaccagaagagccagcccagccccgtgaccgtgaagcccaagccccccgccagaagcagcagcctgcccaaggtgagcagcggctacagcagccccaccaccagcgagatgagcatcaaggacagccccagccagcacagcggcagacccagccccggctgcgacagccagaccagccagctggaccagcccctgttcaagctgaagtaccccagcagcccctacagcgcccacatcagcaagagccccagaaacatgagccccagcagcggccaccagagccccgccggcagcgcccccagccccgccctgagctacagcagcgccggcagcgccagaagcagccccgccgacgcccccgacatcgacaagctgaagatggccgccatcgacgagaaggtgcaggccgtgcacaacctgaagatgttctggcagagcaccccccagcacagcaccggccccatgaagatcttcagaggcgcccccggcaccatgaccagcaagagagacgtgctgagcctgctgaacctgagccccagacacaacaagaaggaggagggcgtggacaagctggagctgaaggagctgagcctgcagcagcacgacggcgccccccccaaggccccccccaacggccactggagaaccgagaccaccagcctgggcagcctgcccctgcccgccggcccccccgccaccgcccccgccagacccctgagactgcccagcggcaacggctacaagttcctgagccccggcagattcttccccagcagcaagtgctag

SEQ ID NO: 25170 - DNA, 1428 bp, Artificial Sequence
  Description of Artificial Sequence: Synthetic coding sequence
atgaccaccctgccccccctgcccatgaccagacccaagctgaccgccctggccagacagaagctgccctgcagcagcagaaagatccccagaagccagctgatcaaggagaaggacgacatcgaccactacctggaggtgaacttcaagggcctgagcaaggaggaggtggccgcctacagaaacagctacaagaagaacatctgcgtggacatgctgagagacggctaccacaagagcttcaccgagctgttcgccctgatggagagatgggacgccctgagagaggccgccagagtgagaagcctgttctggctgcagaagcccctggaggagcagcccgacaagctggactacctgtaccactacctgaccagagccgaggacgccgagagaaaggagagcttcgaggacgtgcacaacaacctgtacgccctggcctgctacttcaacaacagcgaggacaagtgggtgagaaaccacttctacgagagatgcttcaagatcgcccagctgatcaagatcgactgcggcaagaaggaggccgaggcccacatgcacatgggcctgctgtacgaggaggacggccagctgctggaggccgccgagcactacgaggccttccaccagctgacccagggcagaatctggaaggacgagaccggcagaagcctgaacctgctggcctgcgagagcctgctgagaacctacagactgctgagcgacaagatgctggagaacaaggagtacaagcaggccatcaagatcctgatcaaggccagcgagatcgccaaggagggcagcgacaagaagatggaggccgaggccagctactacctgggcctggcccacctggccgccgaggagtacgagaccgccctgaccgtgctggacacctactgcaagatcagcaccgacctggacgacgacctgagcctgggcagaggctacgaggccatcgccaaggtgctgcagagccagggcgagatgaccgaggccatcaagtacctgaagaagttcgtgaagatcgccagaaacaacttccagagcctggacctggtgagagccagcaccatgctgggcgacatctacaacgagaagggctactacaacaaggccagcgagtgcttccagcaggccttcgacaccaccgtggagctgatgagcatgcccctgatggacgagaccaaggtgcactacggcatcgccaaggcccaccagatgatgctgaccgtgaacaactacatcgagagcgccgacctgaccagcctgaactacctgctgagctggaaggagagcagaggcaacatcgagcccgaccccgtgaccgaggagttcagaggcagcaccgtggaggccgtgagccagaacagcgagagactggaggagctgagcagattccccggcgaccagaagaacgagacctag

SEQ ID NO: 25171 - DNA, 960 bp, Artificial Sequence
  Description of Artificial Sequence: Synthetic coding sequence
atgaccaccctgccccccctgcccatgaccagacccaagctgaccgccctggccagacagaagctgccctgcagcagcagaaagatccccagaagccagctgatcaaggagaaggacgacatcgaccactacctggaggtgaacttcaagggcctgagcaaggaggaggtggccgcctacagaaacagctacaagaagaacatctgcgtggacatgctgagagacggctaccacaagagcttcaccgagctgttcgccctgatggagagatgggacgccctgagagaggccgccagagtgagaagcctgttctggctgcagaagcccctggaggagcagcccgacaagctggactacctgtaccactacctgaccagagccgaggacgccgagagaaaggagagcttcgaggacgtgcacaacaacctgtacgccctggcctgctacttcaacaacagcgaggacaagtgggtgagaaaccacttctacgagagatgcttcaagatcgcccagctgatcaagatcgactgcggcaagaaggaggccgaggcccacatgcacatgggcctgctgtacgaggaggacggccagctgctggaggccgccgagcactacgaggccttccaccagctgacccagggcagaatctggaaggacgagaccggcagaagcctgaacctgctggcctgcgagagcctgctgagaacctacagactgctgagcgacaagatgctggagaacaaggagtacaagcaggccatcaagatcctgatcaaggccagcgagatcgccaaggagggcagcgacaagaagatggaggccgaggccagctactacctgggcctggcccacctggccgccgaggagtacgagaccgccctgaccgtgctggacacctactgcaagagcccccagacctggatgatgatcagcgtgtggggcgaggccatgaagccctag

SEQ ID NO: 25172 - DNA, 1506 bp, Artificial Sequence
  Description of Artificial Sequence: Synthetic coding sequence
atgatccccatgttcaccgtgaccctggaggacagcggcaccctgtggaagagcctgcacagcagcagcgagagcgagatgaccaccctgccccccctgcccatgaccagacccaagctgaccgccctggccagacagaagctgccctgcagcagcagaaagatccccagaagccagctgatcaaggagaaggacgacatcgaccactacctggaggtgaacttcaagggcctgagcaaggaggaggtggccgcctacagaaacagctacaagaagaacatctgcgtggacatgctgagagacggctaccacaagagcttcaccgagctgttcgccctgatggagagatgggacgccctgagagaggccgccagagtgagaagcctgttctggctgcagaagcccctggaggagcagcccgacaagctggactacctgtaccactacctgaccagagccgaggacgccgagagaaaggagagcttcgaggacgtgcacaacaacctgtacgccctggcctgctacttcaacaacagcgaggacaagtgggtgagaaaccacttctacgagagatgcttcaagatcgcccagctgatcaagatcgactgcggcaagaaggaggccgaggcccacatgcacatgggcctgctgtacgaggaggacggccagctgctggaggccgccgagcactacgaggccttccaccagctgacccagggcagaatctggaaggacgagaccggcagaagcctgaacctgctggcctgcgagagcctgctgagaacctacagactgctgagcgacaagatgctggagaacaaggagtacaagcaggccatcaagatcctgatcaaggccagcgagatcgccaaggagggcagcgacaagaagatggaggccgaggccagctactacctgggcctggcccacctggccgccgaggagtacgagaccgccctgaccgtgctggacacctactgcaagatcagcaccgacctggacgacgacctgagcctgggcagaggctacgaggccatcgccaaggtgctgcagagccagggcgagatgaccgaggccatcaagtacctgaagaagttcgtgaagatcgccagaaacaacttccagagcctggacctggtgagagccagcaccatgctgggcgacatctacaacgagaagggctactacaacaaggccagcgagtgcttccagcaggccttcgacaccaccgtggagctgatgagcatgcccctgatggacgagaccaaggtgcactacggcatcgccaaggcccaccagatgatgctgaccgtgaacaactacatcgagagcgccgacctgaccagcctgaactacctgctgagctggaaggagagcagaggcaacatcgagcccgaccccgtgaccgaggagttcagaggcagcaccgtggaggccgtgagccagaacagcgagagactggaggagctgagcagattccccggcgaccagaagaacgagacctag

SEQ ID NO: 25173 - DNA, 81 bp, Artificial Sequence
  Description of Artificial Sequence: Synthetic coding sequence
atgaccaccctgccccccctgcccatgaccagacccaagctgaccgccctggccagacagaagctgccctgcagcagctag

SEQ ID NO: 25174 - DNA, 1425 bp, Artificial Sequence
  Description of Artificial Sequence: Synthetic coding sequence
atgaccaccctgccccccctgcccatgaccagacccaagctgaccgccctggccagacagaagctgccctgcagcagcagaaagatccccagaagccagctgatcaaggagaaggacgacatcgaccactacctggaggtgaacttcaagggcctgagcaaggaggaggtggccgcctacagaaacagctacaagaagaacatctgcgtggacatgctgagagacggctaccacaagagcttcaccgagctgttcgccctgatggagagatgggacgccctgagagaggccgccagagtgagaagcctgttctggctgcagaagcccctggaggagcagcccgacaagctggactacctgtaccactacctgaccagagccgaggacgccgagagaaaggagagcttcgaggacgtgcacaacaacctgtacgccctggcctgctacttcaacaacagcgaggacaagtgggtgagaaaccacttctacgagagatgcttcaagatcgcccagctgatcaagatcgactgcggcaagaaggaggccgaggcccacatgcacatgggcctgctgtacgaggaggacggccagctgctggaggccgccgagcactacgaggccttccaccagctgacccagggcagaatctggaaggacgagaccggcagaagcctgaacctgctggcctgcgagagcctgctgagaacctacagactgctgagcgacaagatgctggagaacaaggagtacaagcaggccatcaagatcctgatcaaggccagcgagatcgccaaggagggcagcgacaagaagatggaggccgaggccagctactacctgggcctggcccacctggccgccgaggagtacgagaccgccctgaccgtgctggacacctactgcaagatcagcaccgacctggacgacgacctgagcctgggcagaggctacgaggccatcgccaaggtgctgcagagccagggcgagatgaccgaggccatcaagtacctgaagaagttcgtgaagatcgccagaaacaacttccagagcctggacctggtgagagccagcaccatgctgggcgacatctacaacgagaagggctactacaacaaggccagcgagtgcttccagcaggccttcgacaccaccgtggagctgatgagcatgcccctgatggacgagaccaaggtgcactacggcatcgccaaggcccaccagatgatgctgaccgtgaacaactacatcgagagcgccgacctgaccagcctgaactacctgctgagctggaaggagagcagaggcaacatcgagcccgaccccgtgaccgagttcagaggcagcaccgtggaggccgtgagccagaacagcgagagactggaggagctgagcagattccccggcgaccagaagaacgagacctag

SEQ ID NO: 25175 - DNA, 1506 bp, Artificial Sequence; identical to SEQ ID NO: 25172
  Description of Artificial Sequence: Synthetic coding sequence

SEQ ID NO: 25176 - DNA, 282 bp, Artificial Sequence
  Description of Artificial Sequence: Synthetic coding sequence
atgatccccatgttcaccgtgaccctggaggacagcggcaccctgtggaagagcctgcacagcagcagcgagagcgagatgaccaccctgccccccctgcccatgaccagacccaagctgaccgccctggccagacagaagctgccctgcagcagcagaaagatccccagaagccagctgatcaaggagaaggacgacatcgaccactacctggaggtgaacttcaagggcctgagcaaggaggaggtggccgcctacagaaacagctacaagaagaactag

SEQ ID NO: 25177 - DNA, 1998 bp, Artificial Sequence
  Description of Artificial Sequence: Synthetic coding sequence
atggccggcctgagcggcgcccagatccccgacggcgagttcaccgccctggtgtacagactgatcagagacgccagatacgccgaggccgtgcagctgctgggcagagagctgcagagaagccccagaagcagagccggcctgagcctgctgggctactgctactacagactgcaggagttcgccctggccgccgagtgctacgagcagctgggccagctgcaccccgagctggagcagtacagactgtaccaggcccaggccctgtacaaggcctgcctgtaccccgaggccaccagagtggccttcctgctgctggacaaccccgcctaccacagcagagtgctgagactgcaggccgccatcaagtacagcgagggcgacctgcccggcagcagaagcctggtggagcagctgctgagcggcgagggcggcgaggagagcggcggcgacaacgagaccgacggccaggtgaacctgggctgcctgctgtacaaggagggccagtacgaggccgcctgcagcaagttcagcgccaccctgcaggccagcggctaccagcccgacctgagctacaacctggccctggcctactacagcagcagacagtacgccagcgccctgaagcacatcgccgagatcatcgagagaggcatcagacagcaccccgagctgggcgtgggcatgaccaccgagggcttcgacgtgagaagcgtgggcaacaccctggtgctgcaccagaccgccctggtggaggccttcaacctgaaggccgccatcgagtaccagctgagaaactacgaggtggcccaggagaccctgaccgacatgccccccagagccgaggaggagctggaccccgtgaccctgcacaaccaggccctgatgaacatggacgccagacccaccgagggcttcgagaagctgcagttcctgctgcagcagaaccccttcccccccgagaccttcggcaacctgctgctgctgtactgcaagtacgagtacttcgacctggccgccgacgtgctggccgagaacgcccacctgacctacaagttcctgaccccctacctgtacgacttcctggacgccctgatcacctgccagaccgcccccgaggaggccttcatcaagctggacggcctggccggcatgctgaccgagcagctgagaagactgaccaagcaggtgcaggaggccagacacaacagagacgacgaggccatcaagaaggccgtgaacgagtacgacgagaccatggagaagtacatccccgtgctgatggcccaggccaagatctactggaacctggagaactaccccatggtggagaaggtgttcagaaagagcgtggagttctgcaacgaccacgacgtgtggaagctgaacgtggcccacgtgctgttcatgcaggagaacaagtacaaggaggccatcggcttctacgagcccatcgtgaagaagcactacgacaacatcctgaacgtgagcgccatcgtgctggccaacctgtgcgtgagctacatcatgaccagccagaacgaggaggccgaggagctgatgagaaagatcgagaaggaggaggagcagctgagctacgacgaccccaacagaaagatgtaccacctgtgcatcgtgaacctggtgatcggcaccctgtactgcgccaagggcaactacgagttcggcatcagcagagtgatcaagagcctggagccctacaacaagaagctgggcaccgacacctggtactacgccaagagatgcttcctgagcctgctggagaacatgagcaagcacatgatcgtgatccacgacagcgtgatccaggagtgcgtgcagttcctgggccactgcgagctgtacggcaccaacatccccgccgtgatcgagcagcccctggaggaggagagaatgcacgtgggcaagaacaccgtgaccgacgagagcagacagctgaaggccctgatctacgagatcatcggctggaacaagtag

SEQ ID NO: 25178 - DNA, 381 bp, Artificial Sequence
  Description of Artificial Sequence: Synthetic coding sequence
atgtaccacctgtgcatcgtgaacctggtgatcggcaccctgtactgcgccaagggcaactacgagttcggcatcagcagagtgatcaagagcctggagccctacaacaagaagctgggcaccgacacctggtactacgccaagagatgcttcctgagcctgctggagaacatgagcaagcacatgatcgtgatccacgacagcgtgatccaggagtgcgtgcagttcctgggccactgcgagctgtacggcaccaacatccccgccgtgatcgagcagcccctggaggaggagagaatgcacgtgggcaagaacaccgtgaccgacgagagcagacagctgaaggccctgatctacgagatcatcggctggaacaagtag

SEQ ID NO: 25179 - DNA, 1998 bp, Artificial Sequence
  Description of Artificial Sequence: Synthetic coding sequence
atggccggcctgagcggcgcccagatccccgacggcgagttcaccgccgtggtgtacagactgatcagaaacgccagatacgccgaggccgtgcagctgctgggcggcgagctgcagagaagccccagaagcagagccggcctgagcctgctgggctactgctactacagactgcaggagttcgccctggccgccgagtgctacgagcagctgggccagctgcaccccgagctggagcagtacagactgtaccaggcccaggccctgtacaaggcctgcctgtacgccgaggccaccagagtggccttcctgctgctggacaaccccgcctaccacagcagagtgctgagactgcaggccgccatcaagtacagcgagggcgacctgcccggcagcagaagcctggtggagcagctgcccagcagagagggcggcgaggagagcggcggcgagaacgagaccgacggccagatcaacctgggctgcctgctgtacaaggagggccagtacgaggccgcctgcagcaagttcttcgccgccctgcaggccagcggctaccagcccgacctgagctacaacctggccctggcctactacagcagcagacagtacgccagcgccctgaagcacatcgccgagatcatcgagagaggcatcagacagcaccccgagctgggcgtgggcatgaccaccgagggcatcgacgtgagaagcgtgggcaacaccctggtgctgcaccagaccgccctggtggaggccttcaacctgaaggccgccatcgagtaccagctgagaaactacgaggccgcccaggaggccctgaccgacatgccccccagagccgaggaggagctggaccccgtgaccctgcacaaccaggccctgatgaacatggacgccagacccaccgagggcttcgagaagctgcagttcctgctgcagcagaaccccttcccccccgagaccttcggcaacctgctgctgctgtactgcaagtacgagtacttcgacctggccgccgacgtgctggccgagaacgcccacctgatctacaagttcctgaccccctacctgtacgacttcctggacgccgtgatcacctgccagaccgcccccgaggaggccttcatcaagctggacggcctggccggcatgctgaccgaggtgctgagaaagctgaccatccaggtgcaggaggccagacacaacagagacgacgaggccatcaagaaggccgtgaacgagtacgacgagaccatggagaagtacatccccgtgctgatggcccaggccaagatctactggaacctggagaactaccccatggtggagaagatcttcagaaagagcgtggagttctgcaacgaccacgacgtgtggaagctgaacgtggcccacgtgctgttcatgcaggagaacaagtacaaggaggccatcggcttctacgagcccatcgtgaagaagcactacgacaacatcctgaacgtgagcgccatcgtgctggccaacctgtgcgtgagctacatcatgaccagccagaacgaggaggccgaggagctgatgagaaagatcgagaaggaggaggagcagctgagctacgacgaccccgacaagaagatgtaccacctgtgcatcgtgaacctggtgatcggcaccctgtactgcgccaagggcaactacgacttcggcatcagcagagtgatcaagagcctggagccctacaacaagaagctgggcaccgacacctggtactacgccaagagatgcttcctgagcctgctggagaacatgagcaagcacaccatcatgctgagagacagcgtgatccaggagtgcgtgcagttcctggagcactgcgagctgcacggcagaaacatccccgccgtgatcgagcagcccctggaggaggagagaatgcacgtgggcaagaacaccgtgacctacgagagcagacagctgaaggccctgatctacgagatcatcggctggaacatctag

SEQ ID NO: 25180 - DNA, 1857 bp, Artificial Sequence
  Description of Artificial Sequence: Synthetic coding sequence
atggccggcctgagcggcgcccagatccccgacggcgagttcgccctggccgccgagtgctacgagcagctgggccagctgcaccccgagctggagcagtacagactgtaccaggcccaggccctgtacaaggcctgcctgtacgccgaggccaccagagtggccttcctgctgctggacaaccccgcctaccacagcagagtgctgagactgcaggccgccatcaagtacagcgagggcgacctgcccggcagcagaagcctggtggagcagctgcccagcagagagggcggcgaggagagcggcggcgagaacgagaccgacggccagatcaacctgggctgcctgctgtacaaggagggccagtacgaggccgcctgcagcaagttcttcgccgccctgcaggccagcggctaccagcccgacctgagctacaacctggccctggcctactacagcagcagacagtacgccagcgccctgaagcacatcgccgagatcatcgagagaggcatcagacagcaccccgagctgggcgtgggcatgaccaccgagggcatcgacgtgagaagcgtgggcaacaccctggtgctgcaccagaccgccctggtggaggccttcaacctgaaggccgccatcgagtaccagctgagaaactacgaggccgcccaggaggccctgaccgacatgccccccagagccgaggaggagctggaccccgtgaccctgcacaaccaggccctgatgaacatggacgccagacccaccgagggcttcgagaagctgcagttcctgctgcagcagaaccccttcccccccgagaccttcggcaacctgctgctgctgtactgcaagtacgagtacttcgacctggccgccgacgtgctggccgagaacgcccacctgatctacaagttcctgaccccctacctgtacgacttcctggacgccgtgatcacctgccagaccgcccccgaggaggccttcatcaagctggacggcctggccggcatgctgaccgaggtgctgagaaagctgaccatccaggtgcaggaggccagacacaacagagacgacgaggccatcaagaaggccgtgaacgagtacgacgagaccatggagaagtacatccccgtgctgatggcccaggccaagatctactggaacctggagaactaccccatggtggagaagatcttcagaaagagcgtggagttctgcaacgaccacgacgtgtggaagctgaacgtggcccacgtgctgttcatgcaggagaacaagtacaaggaggccatcggcttctacgagcccatcgtgaagaagcactacgacaacatcctgaacgtgagcgccatcgtgctggccaacctgtgcgtgagctacatcatgaccagccagaacgaggaggccgaggagctgatgagaaagatcgagaaggaggaggagcagctgagctacgacgaccccgacaagaagatgtaccacctgtgcatcgtgaacctggtgatcggcaccctgtactgcgccaagggcaactacgacttcggcatcagcagagtgatcaagagcctggagccctacaacaagaagctgggcaccgacacctggtactacgccaagagatgcttcctgagcctgctggagaacatgagcaagcacaccatcatgctgagagacagcgtgatccaggagtgcgtgcagttcctggagcactgcgagctgcacggcagaaacatccccgccgtgatcgagcagcccctggaggaggagagaatgcacgtgggcaagaacaccgtgacctacgagagcagacagctgaaggccctgatctacgagatcatcggctggaacatctag

SEQ ID NO: 25181 - DNA, 468 bp, Artificial Sequence
  Description of Artificial Sequence: Synthetic coding sequence
atggcccccatccccaagaccgtgggcagaatcaagctggactgcagcctgagacccagctgccccctggaggtggccgccgcccccaagctgtgcaaggagttcggccccgaggactacggcgaggaggacatcgtggacttcctgagaagactggtggagagcgacccccagggcctgcacagaatccacgtggacggcagcagcggcagactgcagctgtggcaccacgactacctgctgggccacctggacgacgagggcaagagcaccggccagagcgacagaggcaagggcgccgagggcctgggcacctactgcggcctgagaaagagcttcctgtacccccccttcccccaggtgcccagcaagcactgcttcgaggtgccctggcccgtgagcaccctggccctgagcttcatgagccccaagcccccccagcccgcccccctgcccgacagcgagtag

SEQ ID NO: 25182 - DNA, 858 bp, Artificial Sequence
  Description of Artificial Sequence: Synthetic coding sequence
atggcccccatccccaagaccgtgggcagaatcaagctggactgcagcctgagacccagctgccccctggaggtggccgccgcccccaagctgtgcaaggagttcggccccgaggactacggcgaggaggacatcgtggacttcctgagaagactggtggagagcgacccccagggcctgcacagaatccacgtggacggcagcagcggcagactgcagctgtggcaccacgactacctgctgggccacctggacgacgagggcaagagcaccggccagagcgacagaggcaagggcgccgagggcctgggcacctactgcggcctgagaaagagcttcctgtaccccccccaggagagcgagccctgcccccagagccccagcgccagcgccaccttccccagcgtgagcgacagcctgctgcaggtggccatgccccagaagctgctggtgaccgaggaggaggccaacagactggccgaggagctggtggccgaggaggagagaatgaagcagaaggccgagaagaagagactgaagaagaagagacagaaggagagaaagagacaggagagactggagcagtactgcggcgagcccaaggccagcaccaccagcgacggcgacgagagcccccccagcagccccggcaaccccgtgcagggccagtgcggcgaggaggaggacagcctggacctgagcagcaccttcgtgagcctggccctgagaaaggtgggcgactggcccctgagcgccagaagagagaagggcctgaaccaggagccccagggcagaggcctggccctgcagaagatgggccaggaggaggagagcccccccaccaccagcccctgctag

SEQ ID NO: 25183 - DNA, 603 bp, Artificial Sequence
  Description of Artificial Sequence: Synthetic coding sequence
atgccccagaagctgctggtgaccgaggaggaggccaacagactggccgaggagctggtggccgaggaggagagaatgaagcagaaggccgagaagaagagactgaagaagaagagacagaaggagagaaagagacaggagagactggagcagtactgcggcgagcccaaggccagcaccaccagcgacggcgacgagagcccccccagcagccccggcaaccccgtgcagggccagtgcggcgaggaggaggacagcctggacctgagcagcaccttcgtgagcctggccctgagaaaggtgggcgactggcccctgagcgccagaagagagaagggcctgaaccaggagccccagggcagaggccccctggcctgcctgcacagctgcatcatcctgcacgtgaccgaggccacccccaccagccccagccccagactgagagtggagggccccatcctgagcagccccagaaccctgcagagagccggcaccagctgggacctgggcagcagcatctgcctgagacccgacgagggcgcccccgtgccccacagagccggcccctgcatctaccccctggtgggcgacatcgtgtggtag

SEQ ID NO: 25184 - DNA, 741 bp, Artificial Sequence
  Description of Artificial Sequence: Synthetic coding sequence
atgcccctgagaatcctggactacctgctgggccacctggacgacgagggcaagagcaccggccagagcgacagaggcaagggcgccgagggcctgggcacctactgcggcctgagaaagagcttcctgtaccccccccaggagagcgagccctgcccccagagccccagcgccagcgccaccttccccagcgtgagcgacagcctgctgcaggtggccatgccccagaagctgctggtgaccgaggaggaggccaacagactggccgaggagctggtggccgaggaggagagaatgaagcagaaggccgagaagaagagactgaagaagaagagacagaaggagagaaagagacaggagagactggagcagtactgcggcgagcccaaggccagcaccaccagcgacggcgacgagagcccccccagcagccccggcaaccccgtgcagggccagtgcggcgaggaggaggacagcctggacctgagcagcaccttcgtgagcctggccctgagaaaggtgggcgactggcccctgagcgccagaagagagaagggcctgaaccaggagccccagggcagaggcctggccctgcagaagatgggccaggaggaggagagcccccccagagaggagagaccccagcagagccccaaggtgcaggtgagatggctgaagaacctgatccagctggagccctggaagggccacaaggagctgctgggcagacacagagtgtag

SEQ ID NO: 25185 - DNA, 2514 bp, Artificial Sequence
  Description of Artificial Sequence: Synthetic coding sequence
atggccagaggcgagagaagaagaagagccgtgcccgccgagggcgtgagaaccgccgagagagccgccagaggcggccccggcagaagagacggcagaggcggcggccccagaagcaccgccggcggcgtggccctggccgtggtggtgctgagcctggccctgggcatgagcggcagatgggtgctggcctggtacagagccagaagagccgtgaccctgcacagcgccccccccgtgctgcccgccgacagcagcagccccgccgtggcccccgacctgttctggggcacctacagaccccacgtgtacttcggcatgaagaccagaagccccaagcccctgctgaccggcctgatgtgggcccagcagggcaccacccccggcacccccaagctgagacacacctgcgagcagggcgacggcgtgggcccctacggctgggagttccacgacggcctgagcttcggcagacagcacatccaggacggcgccctgagactgaccaccgagttcgtgaagagacccggcggccagcacggcggcgactggagctggagagtgaccgtggagccccaggacagcggcaccagcgccctgcccctggtgagcctgttcttctacgtggtgaccgacggcaaggaggtgctgctgcccgaggtgggcgccaagggccagctgaagttcatcagcggccacaccagcgagctgggcgacttcagattcaccctgctgccccccaccagccccggcgacaccgcccccaagtacggcagctacaacgtgttctggaccagcaaccccggcctgcccctgctgaccgagatggtgaagagcagactgaacagctggttccagcacagaccccccggcgccccccccgagagatacctgggcctgcccggcagcctgaagtgggaggacagaggccccagcggccagggccagggccagttcctgatccagcaggtgaccctgaagatccccatcagcatcgagttcgtgttcgagagcggcagcgcccaggccggcggcaaccaggccctgcccagactggccggcagcctgctgacccaggccctggagagccacgccgagggcttcagagagagattcgagaagaccttccagctgaaggagaagggcctgagcagcggcgagcaggtgctgggccaggccgccctgagcggcctgctgggcggcatcggctacttctacggccagggcctggtgctgcccgacatcggcgtggagggcagcgagcagaaggtggaccccgccctgttcccccccgtgcccctgttcaccgccgtgcccagcagaagcttcttccccagaggcttcctgtgggacgagggcttccaccagctggtggtgcagagatgggaccccagcctgaccagagaggccctgggccactggctgggcctgctgaacgccgacggctggatcggcagagagcagatcctgggcgacgaggccagagccagagtgccccccgagttcctggtgcagagagccgtgcacgccaacccccccaccctgctgctgcccgtggcccacatgctggaggtgggcgaccccgacgacctggccttcctgagaaaggccctgcccagactgcacgcctggttcagctggctgcaccagagccaggccggccccctgcccctgagctacagatggagaggcagagaccccgccctgcccaccctgctgaaccccaagaccctgcccagcggcctggacgactaccccagagccagccaccccagcgtgaccgagagacacctggacctgagatgctgggtggccctgggcgccagagtgctgaccagactggccgagcacctgggcgaggccgaggtggccgccgagctgggccccctggccgccagcctggaggccgccgagagcctggacgagctgcactgggcccccgagctgggcgtgttcgccgacttcggcaaccacaccaaggccgtgcagctgaagcccagacccccccagggcctggtgagagtggtgggcagaccccagccccagctgcagtacgtggacgccctgggctacgtgagcctgttccccctgctgctgagactgctggaccccaccagcagcagactgggccccctgctggacatcctggccgacagcagacacctgtggagccccttcggcctgagaagcctggccgccagcagcagcttctacggccagagaaacagcgagcacgaccccccctactggagaggcgccgtgtggctgaacgtgaactacctggccctgggcgccctgcaccactacggccacctggagggcccccaccaggccagagccgccaagctgcacggcgagctgagagccaacgtggtgggcaacgtgtggagacagtaccaggccaccggcttcctgtgggagcagtacagcgacagagacggcagaggcatgggctgcagacccttccacggctggaccagcctggtgctgctggccatggccgaggactactag

SEQ ID NO: 25186 - DNA, 456 bp, Artificial Sequence
  Description of Artificial Sequence: Synthetic coding sequence
atggagggccagagacaggagagccacgccaccctgaccctggcccaggcccacttcaacaacggcgagtacgccgaggccgaggccctgtacagcgcctacatcagaagatgcgcctgcgccgccagcagcgacgagagccccggcagcaagtgcagccccgaggacctggccaccgcctacaacaacagaggccagatcaagtacttcagagtggacttctacgaggccatggacgactacaccagcgccatcgaggtgcagcccaacttcgaggtgccctactacaacagaggcctgatcctgtacagactgggctacttcgacgacgccctggaggacttcaagaaggtgctggacctgaaccccggcttccaggacgccaccctgagcctgaagcagaccatcctggacaaggaggagaagcagagaagaaacgtggccaagaactactag

SEQ ID NO: 25187 - DNA, 789 bp, Artificial Sequence
  Description of Artificial Sequence: Synthetic coding sequence
atggccagcttcggctggaagagaaagatcggcgagaaggtgagcaaggtgaccagccagcagttcgaggccgaggccgccgacgagaaggacgtggtggacaacgacgagggcaactggctgcacgccatcaagagaagaaaggagatcctgctggagggctgcgccgagaagagcaagcagctgaaggacgagggcgccagcctggccgagaacaagagatacagagaggccatccagaagtgggacgaggccctgcagctgacccccaacgacgccaccctgtacgagatgaagagccaggtgctgatgagcctgcacgagatgttccccgccgtgcacgccgccgagatggccgtgcagcagaacccccacagctgggagagctggcagaccctgggcagagcccagctgggcctgggcgagatcatcctggccatcagaagcttccaggtggccctgcacatctaccccatgaaccccgagatctggaaggaggacctgagctgggccagaaccctgcaggagcagcagaaggtggcccagagaatcaagaagagcgaggcccccgccgaggtgacccacttcagccccaagagcatccccgactacgacttcgagagcgacgagatcgtggccgtgtgcgccgccatcgccgagaaggagaagaccgtgagcgccaacaagaccatggtgatcgtgagcgccagcggcgccatcgagaccgtgaccgagaaggaggacggcgccaccccccccgacggcagcgtgttcatcaaggccagatag

SEQ ID NO: 25188 - DNA, 1701 bp, Artificial Sequence
  Description of Artificial Sequence: Synthetic coding sequence
atgctgcagagaagccccagagccggccccagcagagcccagggcagaagagaggccgccgagaccggcggccccaccacccaggagggcgtggcctgcggcgtgcaccagctggccaccctgctgatggagctggacagcgaggacgaggccagcagactgctggccgccgacgccctgtacagactgggcagactggaggagacccacaaggccctgctggtggccctgagcagaagaccccaggccgcccccgtgctggccagactggccctgctgcagctgagaagaggcttcttctacgacgccaaccagctggtgaagaagctggtgcagagcggcgacaccgcctgcctgcagcccaccctggacgtgttctgccacgaggacagacagctgctgcagggccactgccacgccagagccctggccatcctgagagccagacccggcggcgccgacggcagagtgcacaccaaggaggccatcgcctacctgagcctggccatcttcgccgccggcagccaggccagcgagagcctgctggccagagccagatgctacggcttcctgggccagaagaagaccgccatgttcgacttcaacaccgtgctgagagccgagcccggcaacgtgcaggccctgtgcggcagagccctggtgcacctggccctggaccagctgcaggaggccgtggacgacatcgtgagcgccctgaagctgggccccggcaccgtggtgcccgagctgagaagcctgaagcccgaggcccaggccctgatcacccagggcctgtacagccactgcagagccctgctgagccagctgcccgacaccggcgcccccctggaggacaaggacacccagggcctgctggccgtgggcgaggccctgatcaagatcgacagcggccagccccactggcacctgctgctggccgacatcctgatggcccagggcagctacgaggaggccggcacccacctggagaaggccctgcacagagcccccaccagcgaggccgccagagccagactgggcctgctgcagctgaagaagggcgacgtgcccggcgccgccagagacctgcagagcctggccgaggtggacgcccccgacctgagctgcctgctgcacctgctggaggccagcgagagacagagcctggcccaggccgccgcccaggaggccggcaccctgctggacgccggccagcccagacaggccctgggctactgcagcctgagcgtgctggccagcggcagcagcgcctgccacctgagactgagagccacctgcctggccgagctgcaggagttcggcagagccctgagagacctggaccacgtgctgcaggaggccctgggcgacggcgacctgcccagaagagccgaggacttctgcagacagggcagactgctgctgagcctgggcgacgaggccgccgccgccggcgccttcgcccaggccctgaagctggcccccagcctggcccagaacagcctgtgcagacagcccggcagagcccccaccgccagaatgttcctgctgagaggccagtgctgcctggaggagcagagacacgccgaggcctggaccgccgtggagagcggcctgctggtggaccccgaccacagaggcctgaagagactgaaggccagaatcagaagagaggccagcagcggctgctggctgcagtag

SEQ ID NO: 25189 - DNA, 570 bp, Artificial Sequence
  Description of Artificial Sequence: Synthetic coding sequence
atgggcacccccaacgaccaggccgtgctgcaggccatcttcaaccccgacacccccttcggcgacatcgtgggcctggacctgggcgaggaggccgagaaggaggagagagaggaggacgaggtgttcccccaggcccagctggagcagagcaaggccctggagctgcagggcgtgatggccgccgaggccggcgacctgagcaccgccctggagagattcggccaggccatctgcctgctgcccgagagagccagcgcctacaacaacagagcccaggccagaagactgcagggcgacgtggccggcgccctggaggacctggagagagccgtggagctgagcggcggcagaggcagagccgccagacagagcttcgtgcagagaggcctgctggccagactgcagggcagagacgacgacgccagaagagacttcgagagagccgccagactgggcagccccttcgccagaagacagctggtgctgctgaacccctacgccgccctgtgcaacagaatgctggccgacatgatgggccagctgagaagacccagagacagcagatag

SEQ ID NO: 25190 - DNA, 393 bp, Artificial Sequence
  Description of Artificial Sequence: Synthetic coding sequence
atggccgccgaggccggcgacctgagcaccgccctggagagattcggccaggccatctgcctgctgcccgagagagccagcgcctacaacaacagagcccaggccagaagactgcagggcgacgtggccggcgccctggaggacctggagagagccgtggagctgagcggcggcagaggcagagccgccagacagagcttcgtgcagagaggcctgctggccagactgcagggcagagacgacgacgccagaagagacttcgagagagccgccagactgggcagccccttcgccagaagacagctggtgctgctgaacccctacgccgccctgtgcaacagaatgctggccgacatgatgggccagctgagaagacccagagacagcagatag

SEQ ID NO: 25191 - DNA, 4695 bp, Artificial Sequence
  Description of Artificial Sequence: Synthetic coding sequence
atgagcagcaaggaggtgaagaccgccctgaagagcgccagagacgccatcagaaacaaggagtacaaggaggccctgaagcactgcaagaccgtgctgaagcaggagaagaacaactacaacgcctgggtgttcatcggcgtggccgccgccgagctggagcagcccgaccaggcccagagcgcctacaagaaggccgccgagctggagcccgaccagctgctggcctggcagggcctggccaacctgtacgagaagtacaaccacatcaacgccaaggacgacctgcccggcgtgtaccagaagctgctggacctgtacgagagcgtggacaagcagaagtggtgcgacgtgtgcaagaagctggtggacctgtactaccaggagaagaagcacctggaggtggccagaacctggcacaagctgatcaagaccagacaggagcagggcgccgagaacgaggagctgcaccagctgtggagaaagctgacccagttcctggccgagagcaccgaggaccagaacaacgagacccagcagctgctgttcaccgccttcgagaacgccctgggcctgagcgacaagatccccagcgaggaccaccaggtgctgtacagacacttcatccagagcctgagcaagttcccccacgagagcgccagactgaagaaggcctgcgagggcatgatcaacatctaccccaccgtgcagtaccccctggaggtgctgtgcctgcacctgatcgagagcggcaacctgaccgacgagggccagcagtactgctgcagactggtggagatggacagcaagagcggccccggcctgatcggcctgggcatcaaggccctgcaggacaagaagtacgaggacgccgtgagaaacctgaccgagggcctgaaggagagccccgtgtgcaccagcggctggtaccacctggccgaggcccaggtgaagatgcacagacccaaggaggccgtgctgagctgcagccaggccctgaagatcgtggacaacctgggcgccagcggcaacagcctgtaccagagaaacctgtgcctgcacctgaaggccgaggccctgatcaagctgagcgactacgacagcagcgaggaggccatcagaaccctggaccagatcagcgacgccgacaacatccccggcctgctggtgctgaagagcctggcctacagaaacaagggcagcttcgacgaggccgccaagatcatggaggacctgctgagcagctaccccgacctggccgaggtgcacgccctggaggccctgatccacttcaccaagaaggactacctgcaggccgagaagtgcttccagagagccctggagaaggacaccgaggtggccgagtaccactaccagctgggcctgacctactggttcatgggcgaggagaccagaaaggacaagaccaaggccctgacccacttcctgaaggccgccagactggacacctacatgggcaaggtgttctgctacctgggccactactacagagacgtggtgggcgacaagaacagagccagaggctgctacagaaaggccttcgagctggacgacaccgacgccgagagcggcgccgccgccgtggacctgagcgtggagctggaggacatggagatggccctggccatcctgaccaccgtgacccagaaggccagcgccggcaccgccaagtgggcctggctgagaagaggcctgtactacctgaaggccggccagcacagccaggccgtggccgacctgcaggccgccctgagagccgaccccaaggacttcaactgctgggagagcctgggcgaggcctacctgagcagaggcggctacaccaccgccctgaagagcttcaccaaggccagcgagctgaaccccgagagcatctacagcgtgttcaaggtggccgccatccagcagatcctgggcaagtacaaggaggccgtggcccagtaccagatgatcatcaagaagaaggaggactacgtgcccgccctgaagggcctgggcgagtgccacctgatgatggccaaggccgccctggtggactacctggacggcaaggccgtggactacatcgagaaggccctggagtacttcacctgcgccctgcagcacagagccgacgtgagctgcctgtggaagctggccggcgacgcctgcacctgcctgtacgccgtggcccccagcaaggtgaacgtgcacgtgctgggcgtgctgctgggccagaaggagggcaagcaggtgctgaagaagaacgagctgctgcacctgggcggcagatgctacggcagagccctgaagctgatgagcaccagcaacacctggtgcgacctgggcatcaactactacagacaggcccagcacctggccgagaccggcagcaacatgaacgacctgaaggagctgctggagaagagcctgcactgcctgaagaaggccgtgagactggacagcaacaaccacctgtactggaacgccctgggcgtggtggcctgctacagcggcatcggcaactacgccctggcccagcactgcttcatcaagagcatccagagcgagcagatcaacgccgtggcctggaccaacctgggcgtgctgtacctgaccaacgagaacatcgagcaggcccacgaggccttcaagatggcccagagcctggaccccagctacctgatgtgctggatcggccaggccctgatcgccgaggccgtgggcagctacgacaccatggacctgttcagacacaccaccgagctgaacatgcacaccgagggcgccctgggctacgcctactgggtgtgcaccaccctgcaggacaagagcaacagagagaccgagctgtaccagtacaacatcctgcagatgaacgccatccccgccgcccaggtgatcctgaacaagtacgtggagagaatccagaactacgcccccgccttcaccatgctgggctacctgaacgagcacctgcagctgaagaaggaggccgccaacgcctaccagagagccatcctgctgctgcagaccgccgaggaccaggacacctacaacgtggccatcagaaactacggcagactgctgtgcagcaccggcgagtacgacaaggccatccaggccttcaagagcacccccctggaggtgctggaggacatcatcggcttcgccctggccctgttcatgaagggcctgtacaaggagagcagcaaggcctacgagagagccctgagcatcgtggagagcgagcaggacaaggcccacatcctgaccgccctggccatcaccgagtacaagcagggcaagaccgacgtggccaagaccctgctgttcaagtgcagcatcctgaaggagcccaccaccgagagcctgcaggccctgtgcgccctgggcctggccatgcaggacgccaccctgagcaaggccgccctgaacgagctgctgaagcacatcaagcacaaggacagcaactaccagagatgcctgctgaccagcgccatctacgccctgcagggcagaagcgtggccgtgcagaagcagatcagcaaggccgtgcacagcaaccccggcgaccccgccctgtggagcctgctgagcagagtggtggcccagtacgcccagagaaacgccaagggcggcgtggtggccggcaacgtggcccacatcctggacagcaaccacggcaagaaggccctgctgtacaccgccgtgaaccagctggccatgggcagcagcagcgccgaggacgagaagaacaccgccctgaagaccatccagaaggccgccctgctgagccccggcgaccccgccatctgggccggcctgatggccgcctgccacgccgacgacaagctggccctggtgaacaacacccagcccaagagaatcgacctgtacctggccctgctgagcgccgtgagcgccagcatcaaggacgagaagttcttcgagaactacaaccagagcctggagaagtggagcctgagccaggccgtgaccggcctgatcgacaccggcagaatcagcgaggccgagaccctgtgcaccaagaacctgaagagcaaccccgaccagcccgccgtgatcctgctgctgagacaggtgcagtgcaagcccctgctggagagccagaagcccctgcccgacgccgtgctggaggagctgcagaagaccgtgatgagcaacagcaccagcgtgcccgcctggcagtggctggcccacgtgtaccagagccagggcatgatgagagccgccgagatgtgctacagaaagagcctgcagctggccagccagagaggcagctggagcggcaagctgagcagcctgctgagactggccctgctggccctgaaggtgtgcatggccaacatcagcaacgaccactggcccagcctggtgcaggaggccaccaccgaggccctgaagctgtgcttctgccccctggccgtgctgctgcaggccctgctgcagttcaagagaaagatgggcgccagagagaccagaagactgctggagagagtggtgtaccagcccggctaccccaagagcatcgccagcaccgccagatggtacctgctgagacacctgtacgccaaggacgactacgagctgatcgacgtgctggtgaacaacgccaagacccacggcgacaccagagccctggagctgaaccagagactgagcagccagtag

SEQ ID NO: 25192 - DNA, 288 bp, Artificial Sequence
  Description of Artificial Sequence: Synthetic coding sequence
atgagcagcaaggaggtgaagaccgccctgaagagcgccagagacgccatcagaaacaaggagtacaaggaggccctgaagcactgcaagaccgtgctgaagcaggagaagaacaactacaacgcctgggtgttcatcggcgtggccgccgccgagctggagcagcccgaccaggcccagagcgcctacaagaaggccgccgagctggagcccgaccagctgctggcctggcagggcctggccaacctgtacgagaagtacaaccacatcaacgccaaggacgactag

SEQ ID NO: 25193 - DNA, 1236 bp, Artificial Sequence
  Description of Artificial Sequence: Synthetic coding sequence
atggccgccgccagccccctgagagactgccaggcctggaaggacgccagactgcccctgagcaccaccagcaacgaggcctgcaagctgttcgacgccaccctgacccagtacgtgaagtggaccaacgacaagagcctgggcggcatcgagggctgcctgagcaagctgaaggccgccgaccccaccttcgtgatgggccacgccatggccaccggcctggtgctgatcggcaccggcagcagcgtgaagctggacaaggagctggacctggccgtgaagaccatggtggagatcagcagaacccagcccctgaccagaagagagcagctgcacgtgagcgccgtggagaccttcgccaacggctacgtgaagggcatctacagcttcggcctgatggagaccaacttctacgaccaggccgagaagctggccaaggaggccctgagcatcaaccccaccgacgcctggagcgtgcacaccgtggcccacatccacgagatgaaggccgagatcaaggacggcctggagttcatgcagcacagcgagaccttctggaaggacagcgacatgctggcctgccacaactactggcactgggccctgtacctgatcgagaagggcgagtacgaggccgccctgaccatctacgacacccacatcctgcccagcctgcaggccaacgacgccatgctggacgtggtggacagctgcagcatgctgtacagactgcagatggagggcgtgagcgtgggccagagatggcaggacgtgctgcccgtggccagaaagcacagcagagaccacatcctgctgttcaacgacgcccacttcctgatggccagcctgggcgcccacgacccccagaccacccaggagctgctgaccaccctgagagacgccagcgagagccccggcgagaactgccagcacctgctggccagagacgtgggcctgcccctgtgccaggccctggtggaggccgaggacggcaaccccgacagagtgctggagctgctgctgcccatcagatacagaatcgtgcagctgggcggcagcaacgcccagagagacgtgttcaaccagctgctgatccacgccgccctgaactgcaccagcagcgtgcacaagaacgtggccagaagcctgctgatggagagagacgccctgaagcccaacagccccctgaccgagagactgatcagaaaggccgccaccgtgcacctgatgcagtag

SEQ ID NO: 25194 - DNA, 1410 bp, Artificial Sequence
  Description of Artificial Sequence: Synthetic coding sequence
atggccgccgccagccccctgagagactgccaggcctggaaggacgccagactgcccctgagcaccaccagcaacgaggcctgcaagctgttcgacgccaccctgacccagtacgtgaagtggaccaacgacaagagcctgggcggcatcgagggctgcctgagcaagctgaaggccgccgaccccaccttcgtgatgggccacgccatggccaccggcctggtgctgatcggcaccggcagcagcgtgaagctggacaaggagctggacctggccgtgaagaccatggtggagatcagcagaacccagcccctgaccagaagagagcagctgcacgtgagcgccgtggagaccttcgccaacggcaacttccccaaggcctgcgagctgtgggagcagatcctgcaggaccaccccaccgacatgctggccctgaagttcagccacgacgcctacttctacctgggctaccaggagcagatgagagacagcgtggccagaatctaccccttctggacccccgacatccccctgagcagctacgtgaagggcatctacagcttcggcctgatggagaccaacttctacgaccaggccgagaagctggccaaggaggccctgagcatcaaccccaccgacgcctggagcgtgcacaccgtggcccacatccacgagatgaaggccgagatcaaggacggcctggagttcatgcagcacagcgagaccttctggaaggacagcgacatgctggcctgccacaactactggcactgggccctgtacctgatcgagaagggcgagtacgaggccgccctgaccatctacgacacccacatcctgcccagcctgcaggccaacgacgccatgctggacgtggtggacagctgcagcatgctgtacagactgcagatggagggcgtgagcgtgggccagagatggcaggacgtgctgcccgtggccagaaagcacagcagagaccacatcctgctgttcaacgacgcccacttcctgatggccagcctgggcgcccacgacccccagaccacccaggagctgctgaccaccctgagagacgccagcgagagccccggcgagaactgccagcacctgctggccagagacgtgggcctgcccctgtgccaggccctggtggaggccgaggacggcaaccccgacagagtgctggagctgctgctgcccatcagatacagaatcgtgcagctgggcggcagcaacgcccagagagacgtgttcaaccagctgctgatccacgccgccctgaactgcaccagcagcgtgcacaagaacgtggccagaagcctgctgatggagagagacgccctgaagcccaacagccccctgaccgagagactgatcagaaaggccgccaccgtgcacctgatgcagtag

SEQ ID NO: 25195 - DNA, 1263 bp, Artificial Sequence
  Description of Artificial Sequence: Synthetic coding sequence
atggacagcagccccagcctgcccctgatcagaacccccgagagcagcctgcacgaggccctggaccagtgcatgaccgccctggacctgttcctgaccaaccagttcagcgaggccctgagctacctgaagcccagaaccaaggagagcatgtaccacagcctgacctacgccaccatcctggagatgcaggccatgatgaccttcgacccccaggacatcctgctggccggcaacatgatgaaggaggcccagatgctgtgccagagacacagaagaaagagcagcgtgaccgacagcttcagcagcctggtgaacagacccaccctgggccagttcaccgaggaggagatccacgccgaggtgtgctacgccgagtgcctgctgcagagagccgccctgaccttcctgcagggcagcagccacggcggcgccgtgagacccagagccctgcacgaccccagccacgcctgcagctgcccccccggccccggcagacagcacctgttcctgctgcaggacgagaacatggtgagcttcatcaagggcggcatcaaggtgagaaacagctaccagacctacaaggagctggacagcctggtgcagagcagccagtactgcaagggcgagaaccacccccacttcgagggcggcgtgaagctgggcgtgggcgccttcaacctgaccctgagcatgctgcccaccagaatcctgagactgctggagttcgtgggcttcagcggcaacaaggactacggcctgctgcagctggaggagggcgccagcggccacagcttcagaagcgtgctgtgcgtgatgctgctgctgtgctaccacaccttcctgaccttcgtgctgggcaccggcaacgtgaacatcgaggaggccgagaagctgctgaagccctacctgaacagataccccaagggcgccatcttcctgttcttcgccggcagaatcgaggtgatcaagggcaacatcgacgccgtgagcgacggcggccccggcagaggctggggcagcctgggcgtgagccagaccagcagaaagagcggcacctgcgacatcctgagagacagaatcgactggggcagaggcggcggccaggagagaaccaaccagagagccggcgccggcgaggccctgctggccgagcagcccggcaagaccagagaggaggaggccttcgtggtgcccggcatcctgaccggcagatacagaaccgccgccctgcagtggagagaggtggagggcggcgcctag

SEQ ID NO: 25196 - DNA, 1737 bp, Artificial Sequence
  Description of Artificial Sequence: Synthetic coding sequence
atgggccagaagggccacaaggacagcctgtacccctgcggcggcacccccgagagcagcctgcacgaggccctggaccagtgcatgaccgccctggacctgttcctgaccaaccagttcagcgaggccctgagctacctgaagcccagaaccaaggagagcatgtaccacagcctgacctacgccaccatcctggagatgcaggccatgatgaccttcgacccccaggacatcctgctggccggcaacatgatgaaggaggcccagatgctgtgccagagacacagaagaaagagcagcgtgaccgacagcttcagcagcctggtgaacagacccaccctgggccagttcaccgaggaggagatccacgccgaggtgtgctacgccgagtgcctgctgcagagagccgccctgaccttcctgcaggacgagaacatggtgagcttcatcaagggcggcatcaaggtgagaaacagctaccagacctacaaggagctggacagcctggtgcagagcagccagtactgcaagggcgagaaccacccccacttcgagggcggcgtgaagctgggcgtgggcgccttcaacctgaccctgagcatgctgcccaccagaatcctgagactgctggagttcgtgggcttcagcggcaacaaggactacggcctgctgcagctggaggagggcgccagcggccacagcttcagaagcgtgctgtgcgtgatgctgctgctgtgctaccacaccttcctgaccttcgtgctgggcaccggcaacgtgaacatcgaggaggccgagaagctgctgaagccctacctgaacagataccccaagggcgccatcttcctgttcttcgccggcagaatcgaggtgatcaagggcaacatcgacgccgccatcagaagattcgaggagtgctgcgaggcccagcagcactggaagcagttccaccacatgtgctactgggagctgatgtggtgcttcacctacaagggccagtggaagatgagctacttctacgccgacctgctgagcaaggagaactgctggagcaaggccacctacatctacatgaaggccgcctacctgagcatgttcggcaaggaggaccacaagcccttcggcgacgacgaggtggagctgttcagagccgtgcccggcctgaagctgaagatcgccggcaagagcctgcccaccgagaagttcgccatcagaaagagcagaagatacttcagcagcaaccccatcagcctgcccgtgcccgccctggagatgatgtacatctggaacggctacgccgtgatcggcaagcagcccaagctgaccgacggcatcctggagatcatcaccaaggccgaggagatgctggagaagggccccgagaacgagtacagcgtggacgacgagtgcctggtgaagctgctgaagggcctgtgcctgaagtacctgggcagagtgcaggaggccgaggagaacttcagaagcatcagcgccaacgagaagaagatcaagtacgaccactacctgatccccaacgccctgctggagctggccctgctgctgatggagcaggacagaaacgaggaggccatcaagctgctggagagcgccaagcagaactacaagaactacagcatggagagcagaacccacttcagaatccaggccgccaccctgcaggccaagagcagcctggagaacagcagcagaagcatggtgagcagcgtgagcctgtag

SEQ ID NO: 25197 - DNA, 1746 bp, Artificial Sequence
  Description of Artificial Sequence: Synthetic coding sequence
atggccttcctgaccacctggaaggaggccgccagcggcaagagcgacagaagaacccccgagagcagcctgcacgaggccctggaccagtgcatgaccgccctggacctgttcctgaccaaccagttcagcgaggccctgagctacctgaagcccagaaccaaggagagcatgtaccacagcctgacctacgccaccatcctggagatgcaggccatgatgaccttcgacccccaggacatcctgctggccggcaacatgatgaaggaggcccagatgctgtgccagagacacagaagaaagagcagcgtgaccgacagcttcagcagcctggtgaacagacccaccctgggccagttcaccgaggaggagatccacgccgaggtgtgctacgccgagtgcctgctgcagagagccgccctgaccttcctgcaggacgagaacatggtgagcttcatcaagggcggcatcaaggtgagaaacagctaccagacctacaaggagctggacagcctggtgcagagcagccagtactgcaagggcgagaaccacccccacttcgagggcggcgtgaagctgggcgtgggcgccttcaacctgaccctgagcatgctgcccaccagaatcctgagactgctggagttcgtgggcttcagcggcaacaaggactacggcctgctgcagctggaggagggcgccagcggccacagcttcagaagcgtgctgtgcgtgatgctgctgctgtgctaccacaccttcctgaccttcgtgctgggcaccggcaacgtgaacatcgaggaggccgagaagctgctgaagccctacctgaacagataccccaagggcgccatcttcctgttcttcgccggcagaatcgaggtgatcaagggcaacatcgacgccgccatcagaagattcgaggagtgctgcgaggcccagcagcactggaagcagttccaccacatgtgctactgggagctgatgtggtgcttcacctacaagggccagtggaagatgagctacttctacgccgacctgctgagcaaggagaactgctggagcaaggccacctacatctacatgaaggccgcctacctgagcatgttcggcaaggaggaccacaagcccttcggcgacgacgaggtggagctgttcagagccgtgcccggcctgaagctgaagatcgccggcaagagcctgcccaccgagaagttcgccatcagaaagagcagaagatacttcagcagcaaccccatcagcctgcccgtgcccgccctggagatgatgtacatctggaacggctacgccgtgatcggcaagcagcccaagctgaccgacggcatcctggagatcatcaccaaggccgaggagatgctggagaagggccccgagaacgagtacagcgtggacgacgagtgcctggtgaagctgctgaagggcctgtgcctgaagtacctgggcagagtgcaggaggccgaggagaacttcagaagcatcagcgccaacgagaagaagatcaagtacgaccactacctgatccccaacgccctgctggagctggccctgctgctgatggagcaggacagaaacgaggaggccatcaagctgctggagagcgccaagcagaactacaagaactacagcatggagagcagaacccacttcagaatccaggccgccaccctgcaggccaagagcagcctggagaacagcagcagaagcatggtgagcagcgtgagcctgtag

SEQ ID NO: 25198 - DNA, 1842 bp, Artificial Sequence
  Description of Artificial Sequence: Synthetic coding sequence
atgggccagaagggccacaaggacagcctgtacccctgcggcggcacccccgagagcagcctgcacgaggccctggaccagtgcatgaccgccctggacctgttcctgaccaaccagttcagcgaggccctgagctacctgaagcccagaaccaaggagagcatgtaccacagcctgacctacgccaccatcctggagatgcaggccatgatgaccttcgacccccaggacatcctgctggccggcaacatgatgaaggaggcccagatgctgtgccagagacacagaagaaagagcagcgtgaccgacagcttcagcagcctggtgaacagacccaccctgggccagttcaccgaggaggagatccacgccgaggtgtgctacgccgagtgcctgctgcagagagccgccctgaccttcctgcagggcagcagccacggcggcgccgtgagacccagagccctgcacgaccccagccacgcctgcagctgcccccccggccccggcagacagcacctgttcctgctgcaggacgagaacatggtgagcttcatcaagggcggcatcaaggtgagaaacagctaccagacctacaaggagctggacagcctggtgcagagcagccagtactgcaagggcgagaaccacccccacttcgagggcggcgtgaagctgggcgtgggcgccttcaacctgaccctgagcatgctgcccaccagaatcctgagactgctggagttcgtgggcttcagcggcaacaaggactacggcctgctgcagctggaggagggcgccagcggccacagcttcagaagcgtgctgtgcgtgatgctgctgctgtgctaccacaccttcctgaccttcgtgctgggcaccggcaacgtgaacatcgaggaggccgagaagctgctgaagccctacctgaacagataccccaagggcgccatcttcctgttcttcgccggcagaatcgaggtgatcaagggcaacatcgacgccgccatcagaagattcgaggagtgctgcgaggcccagcagcactggaagcagttccaccacatgtgctactgggagctgatgtggtgcttcacctacaagggccagtggaagatgagctacttctacgccgacctgctgagcaaggagaactgctggagcaaggccacctacatctacatgaaggccgcctacctgagcatgttcggcaaggaggaccacaagcccttcggcgacgacgaggtggagctgttcagagccgtgcccggcctgaagctgaagatcgccggcaagagcctgcccaccgagaagttcgccatcagaaagagcagaagatacttcagcagcaaccccatcagcctgcccgtgcccgccctggagatgatgtacatctggaacggctacgccgtgatcggcaagcagcccaagctgaccgacggcatcctggagatcatcaccaaggccgaggagatgctggagaagggccccgagaacgagtacagcgtggacgacgagtgcctggtgaagctgctgaagggcctgtgcctgaagtacctgggcagagtgcaggaggccgaggagaacttcagaagcatcagcgccaacgagaagaagatcaagtacgaccactacctgatccccaacgccctgctggagctggccctgctgctgatggagcaggacagaaacgaggaggccatcaagctgctggagagcgccaagcagaactacaagaactacagcatggagagcagaacccacttcagaatccaggccgccaccctgcaggccaagagcagcctggagaacagcagcagaagcatggtgagcagcgtgagcctgtag

SEQ ID NO: 25199 - DNA, 1734 bp, Artificial Sequence
  Description of Artificial Sequence: Synthetic coding sequence
atgaccagcgccggcggcgcccccggcgccctgcccgccggcacccccgagagcagcctgcacgaggccctggaccagtgcatgaccgccctggacctgttcctgaccaaccagttcagcgaggccctgagctacctgaagcccagaaccaaggagagcatgtaccacagcctgacctacgccaccatcctggagatgcaggccatgatgaccttcgacccccaggacatcctgctggccggcaacatgatgaaggaggcccagatgctgtgccagagacacagaagaaagagcagcgtgaccgacagcttcagcagcctggtgaacagacccaccctgggccagttcaccgaggaggagatccacgccgaggtgtgctacgccgagtgcctgctgcagagagccgccctgaccttcctgcaggacgagaacatggtgagcttcatcaagggcggcatcaaggtgagaaacagctaccagacctacaaggagctggacagcctggtgcagagcagccagtactgcaagggcgagaaccacccccacttcgagggcggcgtgaagctgggcgtgggcgccttcaacctgaccctgagcatgctgcccaccagaatcctgagactgctggagttcgtgggcttcagcggcaacaaggactacggcctgctgcagctggaggagggcgccagcggccacagcttcagaagcgtgctgtgcgtgatgctgctgctgtgctaccacaccttcctgaccttcgtgctgggcaccggcaacgtgaacatcgaggaggccgagaagctgctgaagccctacctgaacagataccccaagggcgccatcttcctgttcttcgccggcagaatcgaggtgatcaagggcaacatcgacgccgccatcagaagattcgaggagtgctgcgaggcccagcagcactggaagcagttccaccacatgtgctactgggagctgatgtggtgcttcacctacaagggccagtggaagatgagctacttctacgccgacctgctgagcaaggagaactgctggagcaaggccacctacatctacatgaaggccgcctacctgagcatgttcggcaaggaggaccacaagcccttcggcgacgacgaggtggagctgttcagagccgtgcccggcctgaagctgaagatcgccggcaagagcctgcccaccgagaagttcgccatcagaaagagcagaagatacttcagcagcaaccccatcagcctgcccgtgcccgccctggagatgatgtacatctggaacggctacgccgtgatcggcaagcagcccaagctgaccgacggcatcctggagatcatcaccaaggccgaggagatgctggagaagggccccgagaacgagtacagcgtggacgacgagtgcctggtgaagctgctgaagggcctgtgcctgaagtacctgggcagagtgcaggaggccgaggagaacttcagaagcatcagcgccaacgagaagaagatcaagtacgaccactacctgatccccaacgccctgctggagctggccctgctgctgatggagcaggacagaaacgaggaggccatcaagctgctggagagcgccaagcagaactacaagaactacagcatggagagcagaacccacttcagaatccaggccgccaccctgcaggccaagagcagcctggagaacagcagcagaagcatggtgagcagcgtgagcctgtag

SEQ ID NO: 25200 - DNA, 339 bp, Artificial Sequence
  Description of Artificial Sequence: Synthetic coding sequence
atgaaggccgcctacctgagcatgttcggcaaggaggaccacaagcccttcggcgacgacgaggtggagctgttcagagccgtgcccggcctgaagctgaagatcgccggcaagagcctgcccaccgagaagttcgccatcagaaagagcagaagatacttcagcagcaaccccatcagcctgcccgtgcccgccctggagatgatgtacatctggaacggctacgccgtgatcggcaagcagcccaagctgaccgacggcatcctggagatcatcaccaaggccgaggagatgctggagaagggccccgagaacgagtacagcgtggacgacgagtag

SEQ ID NO: 25201 - DNA, 666 bp, Artificial Sequence
  Description of Artificial Sequence: Synthetic coding sequence
atgaaggccgcctacctgagcatgttcggcaaggaggaccacaagcccttcggcgacgacgaggtggagctgttcagagccgtgcccggcctgaagctgaagatcgccggcaagagcctgcccaccgagaagttcgccatcagaaagagcagaagatacttcagcagcaaccccatcagcctgcccgtgcccgccctggagatgatgtacatctggaacggctacgccgtgatcggcaagcagcccaagctgaccgacggcatcctggagatcatcaccaaggccgaggagatgctggagaagggccccgagaacgagtacagcgtggacgacgagtgcctggtgaagctgctgaagggcctgtgcctgaagtacctgggcagagtgcaggaggccgaggagaacttcagaagcatcagcgccaacgagaagaagatcaagtacgaccactacctgatccccaacgccctgctggagctggccctgctgctgatggagcaggacagaaacgaggaggccatcaagctgctggagagcgccaagcagaactacaagaactacagcatggagagcagaacccacttcagaatccaggccgccaccctgcaggccaagagcagcctggagaacagcagcagaagcatggtgagcagcgtgagcctgtag

SEQ ID NO: 25202 - DNA, 1569 bp, Artificial Sequence
  Description of Artificial Sequence: Synthetic coding sequence
atgagcttcggcgccagcttcgtgagcttcctgaacgccatgatgaccttcgaggaggagaagatgcagctggcctgcgacgacctgaagaccaccgagaagctgtgcgagagcgaggaggccggcgtgatcgagaccatcaagaacaagatcaagaagaacgtggacgtgagaaagagcgcccccagcatggtggacagactgcagagacagatcatcatcgccgactgccaggtgtacctggccgtgctgagcttcgtgaagcaggagctgagcgcctacatcaagggcggctggatcctgagaaaggcctggaagatctacaacaagtgctacctggacatcaacgccctgcaggagctgtaccagaagaagctgaccgaggagagcctgaccagcgacgccgccaacgacaaccacatcgtggccgagggcgtgagcgaggagagcctgaacagactgaagggcgccgtgagcttcggctacggcctgttccacctgtgcatcagcatggtgccccccaacctgctgaagatcatcaacctgctgggcttccccggcgacagactgcagggcctgagcagcctgatgtacgccagcgagagcaaggacatgaaggcccccctggccaccctggccctgctgtggtaccacaccgtggtgagacccttcttcgccctggacggcagcgacaacaaggccggcctggacgaggccaaggagatcctgctgaagaaggaggccgcctaccccaacagcagcctgttcatgttcttcaagggcagaatccagagactggagtgccagatcaacagcgccctgaccagcttccacaccgccctggagctggccgtggaccagagagagatccagcacgtgtgcctgtacgagatcggctggtgcagcatgatcgagctgaacttcaaggacgccttcgacagcttcgagagactgaagaacgagagcagatggagccagtgctactacgcctacctgaccgccgtgtgccagggcgccaccggcgacgtggacggcgcccagatcgtgttcaaggaggtgcagaagctgttcaagagaaagaacaaccagatcgagcagttcagcgtgaagaaggccgagagattcagaaagcagacccccaccaaggccctgtgcgtgctggccagcatcgaggtgctgtacctgtggaaggccctgcccaactgcagcttccccaacctgcagagaatgagccaggcctgccacgaggtggacgacagcagcgtggtgggcctgaagtacctgctgctgggcgccatccacaagtgcctgggcaacagcgaggacgccgtgcagtacttccagagagccgtgaaggacgagctgtgcagacagaacaacctgtacgtgcagccctacgcctgctacgagctgggctgcctgctgctggacaagcccgagaccgtgggcagaggcagagccctgctgctgcaggccaaggaggacttcagcggctacgacttcgagaacagactgcacgtgagaatccacgccgccctggccagcctgagagagctggtgccccagtag

SEQ ID NO: 25203 - DNA, 1752 bp, Artificial Sequence
  Description of Artificial Sequence: Synthetic coding sequence
atggccggcagcgagcagcagagacccagaagaagagacgacggcgacagcgacgccgccgccgccgccgccgcccccctgcaggacgccgagctggccctggccggcatcaacatgctgctgaacaacggcttcagagagagcgaccagctgttcaagcagtacagaaaccacagccccctgatgagcttcggcgccagcttcgtgagcttcctgaacgccatgatgaccttcgaggaggagaagatgcagctggcctgcgacgacctgaagaccaccgagaagctgtgcgagagcgaggaggccggcgtgatcgagaccatcaagaacaagatcaagaagaacgtggacgtgagaaagagcgcccccagcatggtggacagactgcagagacagatcatcatcgccgactgccaggtgtacctggccgtgctgagcttcgtgaagcaggagctgagcgcctacatcaagggcggctggatcctgagaaaggcctggaagatctacaacaagtgctacctggacatcaacgccctgcaggagctgtaccagaagaagctgaccgaggagagcctgaccagcgacgccgccaacgacaaccacatcgtggccgagggcgtgagcgaggagagcctgaacagactgaagggcgccgtgagcttcggctacggcctgttccacctgtgcatcagcatggtgccccccaacctgctgaagatcatcaacctgctgggcttccccggcgacagactgcagggcctgagcagcctgatgtacgccagcgagagcaaggacatgaaggcccccctggccaccctggccctgctgtggtaccacaccgtggtgagacccttcttcgccctggacggcagcgacaacaaggccggcctggacgaggccaaggagatcctgctgaagaaggaggccgcctaccccaacagcagcctgttcatgttcttcaagggcagaatccagagactggagtgccagatcaacagcgccctgaccagcttccacaccgccctggagctggccgtggaccagagagagatccagcacgtgtgcctgtacgagatcggctggtgcagcatgatcgagctgaacttcaaggacgccttcgacagcttcgagagactgaagaacgagagcagatggagccagtgctactacgcctacctgaccgccgtgtgccagggcgccaccggcgacgtggacggcgcccagatcgtgttcaaggaggtgcagaagctgttcaagagaaagaacaaccagatcgagcagttcagcgtgaagaaggccgagagattcagaaagcagacccccaccaaggccctgtgcgtgctggccagcatcgaggtgctgtacctgtggaaggccctgcccaactgcagcttccccaacctgcagagaatgagccaggcctgccacgaggtggacgacagcagcgtggtgggcctgaagtacctgctgctgggcgccatccacaagtgcctgggcaacagcgaggacgccgtgcagtacttccagagagccgtgaaggacgagctgtgcagacagaacaacctgtacgtgcagccctacgcctgctacgagctgggctgcctgctgctggacaagcccgagaccgtgggcagaggcagagccctgctgctgcaggccaaggaggacttcagcggctacgacttcgagaacagactgcacgtgagaatccacgccgccctggccagcctgagagagctggtgccccagtag

SEQ ID NO: 25204 - DNA, 831 bp, Artificial Sequence
  Description of Artificial Sequence: Synthetic coding sequence
atgcacgcccccttcagaatcagctgccaggtggtgtggctgttcaagatctacctgctgatgtgccagatcaacagcgccctgaccagcttccacaccgccctggagctggccgtggaccagagagagatccagcacgtgtgcctgtacgagatcggctggtgcagcatgatcgagctgaacttcaaggacgccttcgacagcttcgagagactgaagaacgagagcagatggagccagtgctactacgcctacctgaccgccgtgtgccagggcgccaccggcgacgtggacggcgcccagatcgtgttcaaggaggtgcagaagctgttcaagagaaagaacaaccagatcgagcagttcagcgtgaagaaggccgagagattcagaaagcagacccccaccaaggccctgtgcgtgctggccagcatcgaggtgctgtacctgtggaaggccctgcccaactgcagcttccccaacctgcagagaatgagccaggcctgccacgaggtggacgacagcagcgtggtgggcctgaagtacctgctgctgggcgccatccacaagtgcctgggcaacagcgaggacgccgtgcagtacttccagagagccgtgaaggacgagctgtgcagacagaacaacctgtacgtgcagccctacgcctgctacgagctgggctgcctgctgctggacaagcccgagaccgtgggcagaggcagagccctgctgctgcaggccaaggaggacttcagcggctacgacttcgagaacagactgcacgtgagaatccacgccgccctggccagcctgagagagctggtgccccagtag

SEQ ID NO: 25205 - DNA, 231 bp, Artificial Sequence
  Description of Artificial Sequence: Synthetic coding sequence
atggccggcagcgagcagcagagacccagaagaagagacgacggcgacagcgacgccgccgccgccgccgccgcccccctgcaggacgccgagctggccctggccggcatcaacatgctgctgaacaacggcttcagagagagcgaccagctgttcaagcagtacagaaagagcttcctgaccagcgagaagaccagcgccctgcccggcgagacccagagaagactgtag

SEQ ID NO: 25206 - DNA, 2631 bp, Artificial Sequence
  Description of Artificial Sequence: Synthetic coding sequence
atggccgaggaggagggcagactgcacagcgtgcagggcctgctgagcctgcaggacctgcagaacgtgaacacccccctgatgagaaagctggccagactgaagctgggcctggtggagatggccctggacatgctgcagttcatctgggaggaggcccacggccagcagagcgagcagggcagcctggagaagctgctggccgactacctgcagaacaccagcgactacaccagcgtgggcctgcagtggttcaccctgaagagaaccctggcccacggcgccctggcccagctgggcagcctgcagcccctgagcgtgggctgcgtggagatcagagccagactgctgggcctggccggcagagccctgcacctgctggccatgcaggccgaccccgtgcaccccacctgctactgggaggccggccccagcgtgggcgccaagctgagcggcctgaagagcctggagctggaggtggaggaggagggcgccaccaagagcagcagagacccccccgccagcagagccgcccccgaggagcactgcagaagaggcgaggacctgaagagaagaatggtgctggcccagcagtacctggcccaggccagcgaggtgctgctgcagtgcctgcaggtggccctgggcagcggcctgctggacgtggccgccgccgccagcctggagatggtggagtgcgtgggcaccctggaccccgccaccacctgccagttcctggccctgagccagagctgcagcgccagcgagaccatgagagacgtgctgctggccgccaccgccaacaccagcagcagccagctggccgccctgctgcagctgcagcaccagctgagatgccaggacagaaccaccaccagcctgggcgccagagtggagcagagactggccgccgtgagcaaggcctggcagaacctgtgcgtgaccgagcagcacttcaacctgctgaacgagatgccccccaccttctggatcctgttcctgcacctgagcggcgacagaagcagactgtacggcgccgcctacgagaagcccaagttcatcaccgccgccaagggcaaggtgcaggccgtgggcggcagctgcaaggtgatgagactggccatcagccccaccgccttcagccacctgctggcctgcgcccagcagttcagaaagcagacccaggcccaggtgtacagcgaggacatggccctgaacatcggcagcgagcccgagggcctgcaggtggaggagaaggagagacccgtgcagagactgagcagcgtgctgggccccctggaggagctgctgcagcccctgttccccctgctgagcctgagcaaggccagagtgcagacccccgccgtggtggccgacagcggcaagagcaagggcaaggacaaggagagaaagaccagcaccggccagcacagcaccgtgcagcccgaggtggccgacaagatcgtgctggtggccgacagacacctgctggagctgcccctggagggcctgagcgtgttcgacgagggcaccatcagcagcgtgagcagagagttcagcctgcagatgctgtggaacagactgcacaaggaggagaccgagggcggcgtgaagaaggagggcagaagcagagaccccaagaagagaagcctggccaagaagggcagaaagggcagcatccccagaaccatcccccccgactgcatcatcgtggacagcgacaacttcaagttcgtggtggacccctacgaggaggcccagggccccgagatgctgacccccgtgagcatcacccaggacatcctggagagattccaggacaccttcaccagcagatgggccggccacctgggcagcaagcacttccccagccaggcccagtgggagcaggccctgggcagctgcagcggcttcttcttctacggcatggagagcttcctgagccacatcctggtggagagactggtggccatgaacctgcaggagtgccaggtggccgtgctgctggacctggccagaagctaccagagcctgaagagacacatggagagcgtggagcacagaagaagcgtgggcagatgggaggccaactggagaaacagcgccagccccagcgaggacgagtggagaagaggcggcgagcccagaagaggcttcagcgacctggagggccaggccgccgccgcccccaagctgagagcccccagccaccacgcccagctgggccccgtgtgggccgccgcccccagccacagagtggtgcaggcctggacctgcctgcccagcgccgccggcgcccccgccctggccagcgccctgggcagcgcccccctgcccacccacccccacctgcccgcccccatccccagcagccagctggccctgcccttcctgggcctgagccccgccctgggcgccgccagcgccagagaccccccccccgccaccagcagaaaggccgccgcctggaccagcagcagcgcctgcctgtgcgccccctggggcctgagaagaggctggagctgcgtgagcagcagaggccaggacaagggcggcctgcccctggccgccctggtgctgagctgcctggaccagaagaccatccagaccgtgagcctgttcctgatctag

SEQ ID NO: 25207 - DNA, 4593 bp, Artificial Sequence
  Description of Artificial Sequence: Synthetic coding sequence
atggacctggtgatcacccaggagctggccagagccgagagccagcaggacgccgccagcctgaagaaggcctacgagctgatcaagagcgccaacctgggcaagagcgagttcgaccccagcgagagcttcagccccgacctgttcgtgctgtgcgccgagcaggccctgaagatgagacagcccgaggtgagcgaggactgcatccagatgtacttcaaggtgaaggcccccatcacccagttcctgggcagagcccacctgtgcagagcccagatgtgcgcccccaagagcgccgagaacctggaggagttcgagaactgcgtgaccgagtacatgaaggccatcaacttcgccaagggcgagcccagatactacttcctggtgtacaacgccagcgtgctgtactggcagatggtgagacccttcctgaagcccggctacagacaccacctgatccccagcctgagccagatcatcaacgtgctgagccagaccgaggaggaggacaaggagtggagagccgagctgatgctggagctgctggagtgctacctgcaggccggcagaaaggaggaggccgccagattctgcagcaccgccgcccccttcatcaagagccacgtgccccagaagtacagacagatcttcagcgtgatggtgagacacgagctgatggacgagctgcagctgaaggaggagaagaagaacagcatcagcctgagcgtgaccttctacatcaacatgctgaaggccaaggccgagcagaacgacctgcccggcgacatcagcgtgatcctgagaaaggcctacagacacctgggccactacaaccaccagagattccccagcatcagcgaggagaagatgctgctgctgttcgagctggccagattcagcctgaccctgaagtgcatggagatcagcagcgcctgcctgagcgacctgaagaagatggagagcaaggaccccggcaagctgatcgagatggagtgcctggagtgcgagagcgaggccctgagactggagagcaagatgaaggtgtacaacagagccgccgtggaggcccagctggacatcatccagagactggacgtggccctgcagagagccgtgagactgggcgaccccagagtgatccacgtggtgtgcgccacccagtggaacacctgcctgcccctgctgcagcacaacctgagacaccacctgagaaagcccctggccggcgtggccgacgtgctggagaagctggacagcctgatgaccctgctgagatgccaggtgcacatggagatggcccagatcgaggaggacgaggacagactggagcccgccaccgagcacctgagaaaggccgccagactggacagcctgggcctgtacagagacagaatccagatggccagcaccagactgagactgtgcaccaccctgtaccaggcccccgagagagccgaggacaaggccatcatggccgtggagcaggccaagaaggccacccccaaggacagcgtgagaaagaagagagccctgctggtgaacgccggcctggccctggcccccgacgccttccagatcgtgctggacagcgagaacgaggccaaggtgagcaccggcaagaacagaggcagattcacctacctgtgcgccaaggcctggcaccacaccgtgagcgtggacaaggccgccggccacctgagaagactgggcaacgagaacgacaaggagagaatccagatctgggccgagctggccaaggtggccagaaagcagggcgtgtgggacgtgtgcagaaccgccagcagattctgcctgctgtacgacaacgtgaaggtgaagaagctgagactgagaagaggcaagaagaagagaggcagagacggcagcgtgcaggacacctggagccagcccgaggtggtgctgcagagacaggtgtgccccgacctgctgagaaagttcgccgaggtgggcttcatccacgccgaggccaccgtgcacctgctgagaagcgagggcgtggagctgaacgacagagccatcccccccgaggacctgagccagcaccccgccggctacgtgcccgagccccccgaggtgaacgccgagtggatcacctacagaacctggatcgagagcctgagcagatgcgccatgaacaactggctgagaagcgccgagatcggccaggagatccaggaggcctggatcgtgcagaacgccgtggtgtacgtgctgaaccacaaccaccacctgatcctggccggcagacagaaggagctggtggacgccctgtaccacctgctgagcatcgtgaaggccaccggccacagcggcgaccccgtgatgctggtgaccctgtgcaacaccctggccagaggcctgatcatcagctggatccccgtgcaggccgccgagaagagcagaaagttcatgagacccaacgccttccacagccccctggacgccggcgccaccagcgagatcaagaccgccgtggaggtgtgcgagttcgccctgaacctgaccaacggcagcgcccccgaggagaccgtgcccaccggcaccagacagcagctgatcgccacctgggtgaaggccaagcagctgctgcagcagcagatcggccccagactgggcaccgaggagcagggcaccaacgaggacgtgagcagcgtgaccagagtgctggtggccctggagatgtacagctgcaacggcctgggcctgatggacttcaccgtgcccagcctggcccagctggtgaagatggccagcgagtgcaactggagcgaccccctggtggagctgcagaccctgaccagactgacccacttcgcccacgccgccagagaccacgagaccaccatggcctgcgcccacagagccctggagatgggcatcaagtacctgaagaagttcggccccgaggagagcagactggtggccgagatgctgtgcaccgccaccgccatccagggcagaagcatcatggagaacctgaagggcagaaagcagctgagactggtggccgccaaggccttcaccgagagcgccagattcggcggcatcgccggcagcagcgccctggtgatgctggccgccagacactactggaacgcctggctgcccctgctgagcagcgccgtgtacagaaagaaggccaagggcgccctgaagagactgatcggcatcatcaacaagaccgaggccagaaagcaggagaagggcaagaccctgctgctgcaccagtggcccaccgccgacttccagggcggcggcaccaccgagggctacttcctgcccggcgccgaggacgacctggccctgagagccgccctgtacggcctgctgttccacagccacgccgaccaggacgactgggagggcggcctgaaggtgctggacgaggccgtgcaggtgctgcccagaaccgcccacagactgctgatcttcaagcacatggtgatcgtgaaggccaagctgggccagaacttcagcatggagatccagaagttcaaggccgagagcgaggactacctggccagaatgtggcacagactggccctgaacagccccagcgtgagcggcgagctggcctgctacaacaacgccatccaggccctgcagaagcccgagatggagtggcagaaggtggagtacctgatggagttcggccagtggctgcaccacagacacttccccctggaggacgtggtgttccacctgagatgggccgtggagatcctgctggccatgaagccccccggcgacgtgcccgagccccagcccacccccgacggcgagtacgtggccgtggagatgccccccagaagccccgtgagcgaggccgaggaggccgtgagcctggagcagctgagaagcgtgagacagctggaggccctggccagagtgcacatcctgctggccctggtgctgagccccggcgccgagggctacgaggactgctgcctggccgcctacgccttcttcagacacatctggcaggtgagcctgatgaccgccggcaagagcgtgctggagaacagacccctggccgccaccagcagccacctgctgctgcccaagaaggagaaggagaacgagagaagcaaggagaaggagaaggagagaagcaaggagaaggagaacgagagaagcaaggagaaggacaaggagaagggcaaggaggagaaggtgaaggagcccaagcagagccagagccccgcccccatcaagcagctggaggacctgcccatgagcatcgaggagtgggccagctacagctgccccgaggaggtgctgagcgtgctgaagcaggacagaagcgacagcaccgtgaaccccagcagcatccagaagcccacctacagcctgtacttcctggaccacctggtgaaggccctgcagaagatgtgcctgcacgagctgaccgtgcccgtgctgcagctgggcgtgctgatcagcgacagcgtggtgggcagcaagggcctgagcgacctgtaccacctgagatgggtgcagctgctgttcagaagcgtgatcagccccaagcagaacaagaacaagcagcacgtgaaggtgctgatcctgtag

SEQ ID NO: 25208 - DNA, 1218 bp, Artificial Sequence
  Description of Artificial Sequence: Synthetic coding sequence
atggacctggtgatcacccaggagctggccagagccgagagccagcaggacgccgccagcctgaagaaggcctacgagctgatcaagagcgccaacctgggcaagagcgagttcgaccccagcgagagcttcagccccgacctgttcgtgctgtgcgccgagcaggccctgaagatgagacagcccgaggtgagcgaggactgcatccagatgtacttcaaggtgaaggcccccatcacccagttcctgggcagagcccacctgtgcagagcccagatgtgcgcccccaagagcgccgagaacctggaggagttcgagaactgcgtgaccgagtacatgaaggccatcaacttcgccaagggcgagcccagatactacttcctggtgtacaacgccagcgtgctgtactggcagatggtgagacccttcctgaagcccggctacagacaccacctgatccccagcctgagccagatcatcaacgtgctgagccagaccgaggaggaggacaaggagtggagagccgagctgatgctggagctgctggagtgctacctgcaggccggcagaaaggaggaggccgccagattctgcagcaccgccgcccccttcatcaagagccacgtgccccagaagtacagacagatcttcagcgtgatggtgagacacgagctgatggacgagctgcagctgaaggaggagaagaagaacagcatcagcctgagcgtgaccttctacatcaacatgctgaaggccaaggccgagcagaacgacctgcccggcgacatcagcgtgatcctgagaaaggcctacagacacctgggccactacaaccaccagagattccccagcatcagcgaggagaagatgctgctgctgttcgagctggccagattcagcctgaccctgaagtgcatggagatcagcagcgcctgcctgagcgacctgaagaagatggagagcaaggtgagcggcttcatgaccctgctgcccggcgacgaggccctgctgaccgtgcagctggacaagagacagagaaaggaggagcagttcaccagacccagaccccccggcctgagaagcgtggtgggcaccctgcccagcttcctgcccgtgttctgcaccgtggccgtgagatggtgcctgcagttctacacctgccccttcctgttcaccttcctggtggccaccggcccccagcaccacagctgcttctag

SEQ ID NO: 25209 - DNA, 8148 bp, Artificial Sequence
  Description of Artificial Sequence: Synthetic coding sequence
atggacctggtgatcacccaggagctggccagagccgagagccagcaggacgccgccagcctgaagaaggcctacgagctgatcaagagcgccaacctgggcaagagcgagttcgaccccagcgagagcttcagccccgacctgttcgtgctgtgcgccgagcaggccctgaagatgagacagcccgaggtgagcgaggactgcatccagatgtacttcaaggtgaaggcccccatcacccagttcctgggcagagcccacctgtgcagagcccagatgtgcgcccccaagagcgccgagaacctggaggagttcgagaactgcgtgaccgagtacatgaaggccatcaacttcgccaagggcgagcccagatactacttcctggtgtacaacgccagcgtgctgtactggcagatggtgagacccttcctgaagcccggctacagacaccacctgatccccagcctgagccagatcatcaacgtgctgagccagaccgaggaggaggacaaggagtggagagccgagctgatgctggagctgctggagtgctacctgcaggccggcagaaaggaggaggccgccagattctgcagcaccgccgcccccttcatcaagagccacgtgccccagaagtacagacagatcttcagcgtgatggtgagacacgagctgatggacgagctgcagctgaaggaggagaagaagaacagcatcagcctgagcgtgaccttctacatcaacatgctgaaggccaaggccgagcagaacgacctgcccggcgacatcagcgtgatcctgagaaaggcctacagacacctgggccactacaaccaccagagattccccagcatcagcgaggagaagatgctgctgctgttcgagctggccagattcagcctgaccctgaagtgcatggagatcagcagcgcctgcctgagcgacctgaagaagatggagagcaaggaccccggcaagctgatcgagatggagtgcctggagtgcgagagcgaggccctgagactggagagcaagatgaaggtgtacaacagagccgccgtggaggcccagctggacatcatccagagactggacgtggccctgcagagagccgtgagactgggcgaccccagagtgatccacgtggtgtgcgccacccagtggaacacctgcctgcccctgctgcagcacaacctgagacaccacctgagaaagcccctggccggcgtggccgacgtgctggagaagctggacagcctgatgaccctgctgagatgccaggtgcacatggagatggcccagatcgaggaggacgaggacagactggagcccgccaccgagcacctgagaaaggccgccagactggacagcctgggcctgtacagagacagaatccagatggccagcaccagactgagactgtgcaccaccctgtaccaggcccccgagagagccgaggacaaggccatcatggccgtggagcaggccaagaaggccacccccaaggacagcgtgagaaagaagagagccctgctggtgaacgccggcctggccctggcccccgacgccttccagatcgtgctggacagcgagaacgaggccaaggtgagcaccggcaagaacagaggcagattcacctacctgtgcgccaaggcctggcaccacaccgtgagcgtggacaaggccgccggccacctgagaagactgggcaacgagaacgacaaggagagaatccagatctgggccgagctggccaaggtggccagaaagcagggcgtgtgggacgtgtgcagaaccgccagcagattctgcctgctgtacgacaacgtgaaggtgaagaagctgagactgagaagaggcaagaagaagagaggcagagacggcagcgtgcaggacacctggagccagcccgaggtggtgctgcagagacaggtgtgccccgacctgctgagaaagttcgccgaggtgggcttcatccacgccgaggccaccgtgcacctgctgagaagcgagggcgtggagctgaacgacagagccatcccccccgaggacctgagccagcaccccgccggctacgtgcccgagccccccgaggtgaacgccgagtggatcacctacagaacctggatcgagagcctgagcagatgcgccatgaacaactggctgagaagcgccgagatcggccaggagatccaggaggcctggatcgtgcagaacgccgtggtgtacgtgctgaaccacaaccaccacctgatcctggccggcagacagaaggagctggtggacgccctgtaccacctgctgagcatcgtgaaggccaccggccacagcggcgaccccgtgatgctggtgaccctgtgcaacaccctggccagaggcctgatcatcagctggatccccgtgcaggccgccgagaagagcagaaagttcatgagacccaacgccttccacagccccctggacgccggcgccaccagcgagatcaagaccgccgtggaggtgtgcgagttcgccctgaacctgaccaacggcagcgcccccgaggagaccgtgcccaccggcaccagacagcagctgatcgccacctgggtgaaggccaagcagctgctgcagcagcagatcggccccagactgggcaccgaggagcagggcaccaacgaggacgtgagcagcgtgaccagagtgctggtggccctggagatgtacagctgcaacggcctgggcctgatggacttcaccgtgcccagcctggcccagctggtgaagatggccagcgagtgcaactggagcgaccccctggtggagctgcagaccctgaccagactgacccacttcgcccacgccgccagagaccacgagaccaccatggcctgcgcccacagagccctggagatgggcatcaagtacctgaagaagttcggccccgaggagagcagactggtggccgagatgctgtgcaccgccaccgccatccagggcagaagcatcatggagaacctgaagggcagaaagcagctgagactggtggccgccaaggccttcaccgagagcgccagattcggcggcatcgccggcagcagcgccctggtgatgctggccgccagacactactggaacgcctggctgcccctgctgagcagcgccgtgtacagaaagaaggccaagggcgccctgaagagactgatcggcatcatcaacaagaccgaggccagaaagcaggagaagggcaagaccctgctgctgcaccagtggcccaccgccgacttccagggcggcggcaccaccgagggctacttcctgcccggcgccgaggacgacctggccctgagagccgccctgtacggcctgctgttccacagccacgccgaccaggacgactgggagggcggcctgaaggtgctggacgaggccgtgcaggtgctgcccagaaccgcccacagactgctgatcttcaagcacatggtgatcgtgaaggccaagctgggccagaacttcagcatggagatccagaagttcaaggccgagagcgaggactacctggccagaatgtggcacagactggccctgaacagccccagcgtgagcggcgagctggcctgctacaacaacgccatccaggccctgcagaagcccgagatggagtggcagaaggtggagtacctgatggagttcggccagtggctgcaccacagacacttccccctggaggacgtggtgttccacctgagatgggccgtggagatcctgctggccatgaagccccccggcgacgtgcccgagccccagcccacccccgacggcgagtacgtggccgtggagatgccccccagaagccccgtgagcgaggccgaggaggccgtgagcctggagcagctgagaagcgtgagacagctggaggccctggccagagtgcacatcctgctggccctggtgctgagccccggcgccgagggctacgaggactgctgcctggccgcctacgccttcttcagacacatctggcaggtgagcctgatgaccgccggcaagagcgtgctggagaacagacccctggccgccaccagcagccacctgctgctgcccaagaaggagaaggagaacgagagaagcaaggagaaggagaaggagagaagcaaggagaaggagaacgagagaagcaaggagaaggacaaggagaagggcaaggaggagaaggtgaaggagcccaagcagagccagagccccgcccccatcaagcagctggaggacctgcccatgagcatcgaggagtgggccagctacagctgccccgaggaggtgctgagcgtgctgaagcaggacagaagcgacagcaccgtgaaccccagcagcatccagaagcccacctacagcctgtacttcctggaccacctggtgaaggccctgcagaagatgtgcctgcacgagctgaccgtgcccgtgctgcagctgggcgtgctgatcagcgacagcgtggtgggcagcaagggcctgagcgacctgtaccacctgagactggcccacgcctgcagcgagctgaagctgagagaggccgccgccagacacgaggaggccgtgggccaggtgtgcgtgagcgagctggagcaggccagctgcagaaaggagatcgccctgaagaaggagaagaacaaggagcccctgctggaggagagcctgcccgccctgaacgagcagaccctgcccgtgcagcccggcgagatcaagcccctggacgccaaggacaagatcctgaagatgaacggcgagaccggcagagacctggacggcaccagcttcccccacctgtggatgctgaaggccgaggtgctgctggagatgaacctgtaccagcccgccagactgctgctgagcgaggcctacctggccttccaggagctggacgagccctgcgccgaggcccagtgcctgctgctgctggcccagctggccaacaaggagaagaactacggccaggccaagaagatgatcgcccaggcccagcacctgggcggcagcgaggagttctggtacaacagcaccctgaccctggccgaggccctgctgagcatggagcacagcggcagagaggccaccgtgtgccacatcttccagaagctgatcaacgccttcaagatcctgaagaaggagagacccaacagactgcccctgctggagttcatgatcaccgacctggaggccagatgcctgagcctgagagtgagagtggcccagcacagcgccgtgaccgagcccaccgagtgcagcctgctgctgaaggagatggacgacggcctgctggagatcgagagaaagttcatcgactgcggctgcaaggagaactgcgtggacgtgaagctggagagagccaagatcaagagactgagagcccagaacgagaaggacgaggagcagaagaccgcctactacctggaggcctacggcctggcccagggcgccgtggccgaggaggagggcagactgcacagcatccagggcctgtacggcctggcccagggcgccatggccgaggaggagggcagactgcacagcgtgcagggcctgctgagcctgcaggacctgcagaacgtgaacacccccctgatgagaaagctggccagactgaagctgggcctggtggagatggccctggacatgctgcagttcatctgggaggaggcccacggccagcagagcgagcagggcagcctggagaagctgctggccgactacctgcagaacaccagcgactacaccagcgtgggcctgcagtggttcaccctgaagagaaccctggcccacggcgccctggcccagctgggcagcctgcagcccctgagcgtgggctgcgtggagatcagagccagactgctgggcctggccggcagagccctgcacctgctggccatgcaggccgaccccgtgcaccccacctgctactgggaggccggccccagcgtgggcgccaagctgagcggcctgaagagcctggagctggaggtggaggaggagggcgccaccaagagcagcagagacccccccgccagcagagccgcccccgaggagcactgcagaagaggcgaggacctgaagagaagaatggtgctggcccagcagtacctggcccaggccagcgaggtgctgctgcagtgcctgcaggtggccctgggcagcggcctgctggacgtggccgccgccgccagcctggagatggtggagtgcgtgggcaccctggaccccgccaccacctgccagttcctggccctgagccagagctgcagcgccagcgagaccatgagagacgtgctgctggccgccaccgccaacaccagcagcagccagctggccgccctgctgcagctgcagcaccagctgagatgccaggacagaaccaccaccagcctgggcgccagagtggagcagagactggccgccgtgagcaaggcctggcagaacctgtgcgtgaccgagcagcacttcaacctgctgaacgagatgccccccaccttctggatcctgttcctgcacctgagcggcgacagaagcagactgtacggcgccgcctacgagaagcccaagttcatcaccgccgccaagggcaaggtgcaggccgtgggcggcagctgcaaggtgatgagactggccatcagccccaccgccttcagccacctgctggcctgcgcccagcagttcagaaagcagacccaggcccaggtgtacagcgaggacatggccctgaacatcggcagcgagcccgagggcctgcaggtggaggagaaggagagacccgtgcagagactgagcagcgtgctgggccccctggaggagctgctgcagcccctgttccccctgctgagcctgagcaaggccagagtgcagacccccgccgtggtggccgacagcggcaagagcaagggcaaggacaaggagagaaagaccagcaccggccagcacagcaccgtgcagcccgaggtggccgacaagatcgtgctggtggccgacagacacctgctggagctgcccctggagggcctgagcgtgttcgacgagggcaccatcagcagcgtgagcagagagttcagcctgcagatgctgtggaacagactgcacaaggaggagaccgagggcggcgtgaagaaggagggcagaagcagagaccccaagaagagaagcctggccaagaagggcagaaagggcagcatccccagaaccatcccccccgactgcatcatcgtggacagcgacaacttcaagttcgtggtggacccctacgaggaggcccagggccccgagatgctgacccccgtgagcatcacccaggacatcctggagagattccaggacaccttcaccagcagatgggccggccacctgggcagcaagcacttccccagccaggcccagtgggagcaggccctgggcagctgcagcggcttcttcttctacggcatggagagcttcctgagccacatcctggtggagagactggtggccatgaacctgcaggagtgccaggtggccgtgctgctggacctggccagaagctaccagagcctgaagagacacatggagagcgtggagcacagaagaagcgtgggcagatgggaggccaactggagaaacagcgccagccccagcgaggacgagtggagaagaggcggcgagcccagaagaggcttcagcgacctggagggccaggccgccgccgcccccaagctgagagcccccagccaccacgcccagctgggccccgtgtgggccgccgcccccagccacagagtggtgcaggcctggacctgcctgcccagcgccgccggcgcccccgccctggccagcgccctgggcagcgcccccctgcccacccacccccacctgcccgcccccatccccagcagccagctggccctgcccttcctgggcctgagccccgccctgggcgccgccagcgccagagaccccccccccgccaccagcagaaaggccgccgcctggaccagcagcagcgcctgcctgtgcgccccctggggcctgagaagaggctggagctgcgtgagcagcagaggccaggacaagggcggcctgcccctggccgccctggtgctgagctgcctggaccagaagaccatccagaccgtgagcctgttcctgatctag

SEQ ID NO: 25210 - DNA, 1563 bp, Artificial Sequence
  Description of Artificial Sequence: Synthetic coding sequence
atgatgaagtactacgacctggccaagttcaccatctaccagatcgccgagatggacaagggcctgagcgagctgagccccatgcagcaggccctgatctacagcttctgcgagaaccacgacaaggccatcgaggtgctggacggcatcagctggaacagagccgagatgaccatgtgcgccctgctggccaaggtgcagatgaaggccaagagaaccaaggaggccgtggaggtgctgaagaaggccctggacgccatcagccacagcgacaagggccccgacgccaccgccatcagcgccgactgcctgtacaacctgggcctgtgctacatggaggagggcaacctgcagatgacctacaagctggccatcaccgacctgaccaccgccatcagcatggacaagaacagctacaccgccttctacaacagagccctgtgctacaccaagatcagagagctgcagatggccctgaccgactacggcatcgtgctgctgctggacgccaccgagaccgtgaagctgaacaccttcctgaacagaggcctgatctacgtggagctgggccagtacggcttcgccctggaggacttcaagcaggccgccctgatcagcagaaccaacggcagcctgtgccacgccaccgccatgtgccaccacagaatcaacgagttcgaggaggccgtgaacttcttcacctgggccctgaagatcaacccctgcttcctggacgcctacgtgggcagaggcaacagctacatggagtacggccacgacgaggccaccaagcaggcccagaaggacttcctgaaggccctgcacatcaaccccgcctacatcaaggccagaatcagcttcggctacaacctgcaggcccagggcaagttccagaaggcctggaaccacttcaccatcgccatcgacaccgaccccaagaactacctggcctacgagggcagagccgtggtgtgcctgcagatgggcaacaacttcgccgccatgcaggacatcaacgccgccatgaagatcagcaccaccgccgagttcctgaccaacagaggcgtgatccacgagttcatgggccacaagcagaacgccatgaaggactaccaggacgccatcaccctgaaccccaagtacagcctggcctacttcaacgccggcaacatctacttccaccacagacagttcagccaggccagcgactacttcagcaaggccctgaagttcgaccccgagaacgagtacgtgctgatgaacagagccatcaccaacaccatcctgaagaagtacgaggaggccaaggaggacttcgccaacgtgatcgagagctgccccttctgggccgccgtgtacttcaacagagcccacttctactactgcctgaagcagtacgagctggccgaggaggacctgaacaaggccctgagcctgaagcccaacgacgccctggtgtacaacttcagagccaaggtgagaggcaagatcggcctgatcgaggaggccatggccgactacaaccaggccctggacctggaggactacgccagcgtgatctag

SEQ ID NO: 25211 - DNA, 1611 bp, Artificial Sequence
  Description of Artificial Sequence: Synthetic coding sequence
atggacaagggcctgagcgagctgagccccatgcagcaggccctgatctacagcttctgcgagaaccacgacaaggccatcgaggtgctggacggcatcagctggaacagagccgagatgaccatgtgcgccctgctggccaaggtgcagatgaaggccaagagaaccaaggaggccgtggaggtgctgaagaaggccctggacgccatcagccacagcgacaagggccccgacgccaccgccatcagcgccgactgcctgtacaacctgggcctgtgctacatggaggagggcaacctgcagatggccttcgacagcttcaccaaggccgtgaaggccaaccccgacttcgccgagagcttctaccagagaggcctgtgcaaggtgaagctgcacaaggacagcagcatcctggacttcaacagagccatcaccctgaaccccaagcactaccaggcctacctgagcagagtggccttctacggcctgaagggcagatacagcaaggccatcctgaactgcaacaaggccatcaagatctaccccgagagcgtgagagcctacctgtacagaggcgtgctgaagtactacaacaagacctacaagctggccatcaccgacctgaccaccgccatcagcatggacaagaacagctacaccgccttctacaacagagccctgtgctacaccaagatcagagagctgcagatggccctgaccgactacggcatcgtgctgctgctggacgccaccgagaccgtgaagctgaacaccttcctgaacagaggcctgatctacgtggagctgggccagtacggcttcgccctggaggacttcaagcaggccgccctgatcagcagaaccaacggcagcctgtgccacgccaccgccatgtgccaccacagaatcaacgagttcgaggaggccgtgaacttcttcacctgggccctgaagatcaacccctgcttcctggacgcctacgtgggcagaggcaacagctacatggagtacggccacgacgaggccaccaagcaggcccagaaggacttcctgaaggccctgcacatcaaccccgcctacatcaaggccagaatcagcttcggctacaacctgcaggcccagggcaagttccagaaggcctggaaccacttcaccatcgccatcgacaccgaccccaagaactacctggcctacgagggcagagccgtggtgtgcctgcagatgggcaacaacttcgccgccatgcaggacatcaacgccgccatgaagatcagcaccaccgccgagttcctgaccaacagaggcgtgatccacgagttcatgggccacaagcagaacgccatgaaggactaccaggacgccatcaccctgaaccccaagtacagcctggcctacttcaacgccggcaacatctacttccaccacagacagttcagccaggaggagagcctgggcctggcctggagcctgagcctggacagcttcctgagaaccggcggcgccaccttcagcagcggcgtgaaccccctgcagaccctgcacagaagaatgagcatcctgagccccctgccccccacctgccccagagacgagatggacttcaccagctag

SEQ ID NO: 25212 - DNA, 1563 bp, Artificial Sequence; identical to SEQ ID NO: 25210
  Description of Artificial Sequence: Synthetic coding sequence

SEQ ID NO: 25213 - DNA, 2532 bp, Artificial Sequence
  Description of Artificial Sequence: Synthetic coding sequence
atggccaccaagaaggccggcagcagactggagaccgagatcgagagatgcagaagcgagtgccagtgggagagaatccccgagctggtgaagcagctgagcgccaagctgatcgccaacgacgacatggccgagctgctgctgggcgagagcaagctggagcagtacctgaaggagcaccccctgagacagggcgccagccccagaggccccaagccccagctgaccgaggtgagaaagcacctgaccgccgccctggacagaggcaacctgaagagcgagttcctgcaggagagcaacctgatcatggccaagctgaactacgtggagggcgactacaaggaggccctgaacatctacgccagagtgggcctggacgacctgcccctgaccgccgtgcccccctacagactgagagtgatcgccgaggcctacgccaccaagggcctgtgcctggagaagctgcccatcagcagcagcaccagcaacctgcacgtggacagagagcaggacgtgatcacctgctacgagaaggccggcgacatcgccctgctgtacctgcaggagatcgagagagtgatcctgagcaacatccagaacagaagccccaagcccggccccgccccccacgaccaggagctgggcttcttcctggagaccggcctgcagagagcccacgtgctgtacttcaagaacggcaacctgaccagaggcgtgggcagattcagagagctgctgagagccgtggagaccagaaccacccagaacctgagaatgaccatcgccagacagctggccgagatcctgctgagaggcatgtgcgagcagagctactggaaccccctggaggaccccccctgccagagccccctggacgaccccctgagaaagggcgccaacaccaagacctacaccctgaccagaagagccagagtgtacagcggcgagaacatcttctgcccccaggagaacaccgaggaggccctgctgctgctgctgatcagcgagagcatggccaacagagacgccgtgctgagcagaatccccgagcacaagagcgacagactgatcagcctgcagagcgccagcgtggtgtacgacctgctgaccatcgccctgggcagaagaggccagtacgagatgctgagcgagtgcctggagagagccatgaagttcgccttcgaggagttccacctgtggtaccagttcgccctgagcctgatggccgccggcaagagcgccagagccgtgaaggtgctgaaggagtgcatcagactgaagcccgacgacgccaccatccccctgctggccgccaagctgtgcatgggcagcctgcactggctggaggaggccgagaagttcgccaagaccgtggtggacgtgggcgagaagaccagcgagttcaaggccaagggctacctggccctgggcctgacctacagcctgcaggccaccgacgccagcctgagaggcatgcaggaggtgctgcagagaaaggccctgctggccttccagagagcccacagcctgagccccaccgaccaccaggccgccttctacctggccctgcagctggccatcagcagacagatccccgaggccctgggctacgtgagacaggccctgcagctgcagggcgacgacgccaacagcctgcacctgctggccctgctgctgagcgcccagaagcactaccacgacgccctgaacatcatcgacatggccctgagcgagtaccccgagaacttcatcctgctgttcagcaaggtgaagctgcagagcctgtgcagaggccccgacgaggccctgctgacctgcaagcacatgctgcagatctggaagagctgctacaacctgaccaaccccagcgacagcggcagaggcagcagcctgctggacagaaccatcgccgacagaagacagctgaacaccatcaccctgcccgacttcagcgaccccgagaccggcagcgtgcacgccaccagcgtggccgccagcagagtggagcaggccctgagcgaggtggccagcagcctgcagagcagcgcccccaagcagggccccctgcacccctggatgaccctggcccagatctggctgcacgccgccgaggtgtacatcggcatcggcaagcccgccgaggccaccgcctgcacccaggaggccgccaacctgttccccatgagccacaacgtgctgtacatgagaggccagatcgccgagctgagaggcagcatggacgaggccagaagatggtacgaggaggccctggccatcagccccacccacgtgaagagcatgcagagactggccctgatcctgcaccagctgggcagatacagcctggccgagaagatcctgagagacgccgtgcaggtgaacagcaccgcccacgaggtgtggaacggcctgggcgaggtgctgcaggcccagggcaacgacgccgccgccaccgagtgcttcctgaccgccctggagctggaggccagcagccccgccgtgcccttcaccatcatccccagagtgctgtag

SEQ ID NO: 25214 - DNA, 2583 bp, Artificial Sequence
  Description of Artificial Sequence: Synthetic coding sequence
atggccaccaagaaggccggcagcagactggagaccgagatcgagagatgcagaagcgagtgccagtgggagagaatccccgagctggtgaagcagctgagcgccaagctgatcgccaacgacgacatggccgagctgctgctgggcgagagcaagctggagcagtacctgaaggagcaccccctgagacagggcgccagccccagaggccccaagccccagctgaccgaggtgagaaagcacctgaccgccgccctggacagaggcaacctgaagagcgagttcctgcaggagagcaacctgatcatggccaagctgaactacgtggagggcgactacaaggaggccctgaacatctacgccagagtgggcctggacgacctgcccctgaccgccgtgcccccctacagactgagagtgatcgccgaggcctacgccaccaagggcctgtgcctggagaagctgcccatcagcagcagcaccagcaacctgcacgtggacagagagcaggacgtgatcacctgctacgagaaggccggcgacatcgccctgctgtacctgcaggagatcgagagagtgatcctgagcaacatccagaacagaagccccaagcccggccccgccccccacgaccaggagctgggcttcttcctggagaccggcctgcagagagcccacgtgctgtacttcaagaacggcaacctgaccagaggcgtgggcagattcagagagctgctgagagccgtggagaccagaaccacccagaacctgagaatgaccatcgccagacagctggccgagatcctgctgagaggcatgtgcgagcagagctactggaaccccctggaggaccccccctgccagagccccctggacgaccccctgagaaagggcgccaacaccaagacctacaccctgaccagaagagccagagtgtacagcggcgagaacatcttctgcccccaggagaacaccgaggaggccctgctgctgctgctgatcagcgagagcatggccaacagagacgccgtgctgagcagaatccccgagcacaagagcgacagactgatcagcctgcagagcgccagcgtggtgtacgacctgctgaccatcgccctgggcagaagaggccagtacgagatgctgagcgagtgcctggagagagccatgaagttcgccttcgaggagttccacctgtggtaccagttcgccctgagcctgatggccgccggcaagagcgccagagccgtgaaggtgctgaaggagtgcatcagactgaagcccgacgacgccaccatccccctgctggccgccaagctgtgcatgggcagcctgcactggctggaggaggccgagaagttcgccaagaccgtggtggacgtgggcgagaagaccagcgagttcaaggccaagggctacctggccctgggcctgacctacagcctgcaggccaccgacgccagcctgagaggcatgcaggaggtgctgcagagaaaggccctgctggccttccagagagcccacagcctgagccccaccgaccaccaggccgccttctacctggccctgcagctggccatcagcagacagatccccgaggccctgggctacgtgagacaggccctgcagctgcagggcgacgacgccaacagcctgcacctgctggccctgctgctgagcgcccagaagcactaccacgacgccctgaacatcatcgacatggccctgagcgagtaccccgagaacttcatcctgctgttcagcaaggtgaagctgcagagcctgtgcagaggccccgacgaggccctgctgacctgcaagcacatgctgcagatctggaagagctgctacaacctgaccaaccccagcgacagcggcagaggcagcagcctgctggacagaaccatcgccgacagaagacagctgaacaccatcaccctgcccgacttcagcgaccccgagaccggcaacagccccgaggcctacttccacggcttccccagcctgttcagcgtgagcagcgtgcacgccaccagcgtggccgccagcagagtggagcaggccctgagcgaggtggccagcagcctgcagagcagcgcccccaagcagggccccctgcacccctggatgaccctggcccagatctggctgcacgccgccgaggtgtacatcggcatcggcaagcccgccgaggccaccgcctgcacccaggaggccgccaacctgttccccatgagccacaacgtgctgtacatgagaggccagatcgccgagctgagaggcagcatggacgaggccagaagatggtacgaggaggccctggccatcagccccacccacgtgaagagcatgcagagactggccctgatcctgcaccagctgggcagatacagcctggccgagaagatcctgagagacgccgtgcaggtgaacagcaccgcccacgaggtgtggaacggcctgggcgaggtgctgcaggcccagggcaacgacgccgccgccaccgagtgcttcctgaccgccctggagctggaggccagcagccccgccgtgcccttcaccatcatccccagagtgctgtag

SEQ ID NO: 25215 - DNA, 1257 bp, Artificial Sequence
  Description of Artificial Sequence: Synthetic coding sequence
atgaccatcgccagacagctggccgagatcctgctgagaggcatgtgcgagcagagctactggaaccccctggaggaccccccctgccagagccccctggacgaccccctgagaaagggcgccaacaccaagacctacaccctgaccagaagagccagagtgtacagcggcgagaacatcttctgcccccaggagaacaccgaggaggccctgctgctgctgctgatcagcgagagcatggccaacagagacgccgtgctgagcagaatccccgagcacaagagcgacagactgatcagcctgcagagcgccagcgtggtgtacgacctgctgaccatcgccctgggcagaagaggccagtacgagatgctgagcgagtgcctggagagagccatgaagttcgccttcgaggagttccacctgtggtaccagttcgccctgagcctgatggccgccggcaagagcgccagagccgtgaaggtgctgaaggagtgcatcagactgaagcccgacgacgccaccatccccctgctggccgccaagctgtgcatgggcagcctgcactggctggaggaggccgagaagttcgccaagaccgtggtggacgtgggcgagaagaccagcgagttcaaggccaagggctacctggccctgggcctgacctacagcctgcaggccaccgacgccagcctgagaggcatgcaggaggtgctgcagagaaaggccctgctggccttccagagagcccacagcctgagccccaccgaccaccaggccgccttctacctggccctgcagctggccatcagcagacagatccccgaggccctgggctacgtgagacaggccctgcagctgcagggcgacgacgccaacagcctgcacctgctggccctgctgctgagcgcccagaagcactaccacgacgccctgaacatcatcgacatggccctgagcgagtaccccgagaacttcatcctgctgttcagcaaggtgaagctgcagagcctgtgcagaggccccgacgaggccctgctgacctgcaagcacatgctgcagatctggaagagctgctacaacctgaccaaccccagcgacagcggcagaggcagcagcctgctggacagaaccatcgccgacagaagacagctgaacaccatcaccctgcccgacttcagcgaccccgagaccggcaaccagtgcagctggatcgccttcggcgagatgctggtggacatgggcatccagtgcatctag

SEQ ID NO: 25216 - DNA, 993 bp, Artificial Sequence
  Description of Artificial Sequence: Synthetic coding sequence
atccccgaggccctgggctacgtgagacaggccctgcagctgcagggcgacgacgccaacagcctgcacctgctggccctgctgctgagcgcccagaagcactaccacgacgccctgaacatcatcgacatggccctgagcgagtaccccgagaacttcatcctgctgttcagcaaggtgaagctgcagagcctgtgcagaggccccgacgaggccctgctgacctgcaagcacatgctgcagatctggaagagctgctacaacctgaccaaccccagcgacagcggcagaggcagcagcctgctggacagaaccatcgccgacagaagacagctgaacaccatcaccctgcccgacttcagcgaccccgagaccggcaacagccccgaggcctacttccacggcttccccagcctgttcagcgtgagcagcgtgcacgccaccagcgtggccgccagcagagtggagcaggccctgagcgaggtggccagcagcctgcagagcagcgcccccaagcagggccccctgcacccctggatgaccctggcccagatctggctgcacgccgccgaggtgtacatcggcatcggcaagcccgccgaggccaccgcctgcacccaggaggccgccaacctgttccccatgagccacaacgtgctgtacatgagaggccagatcgccgagctgagaggcagcatggacgaggccagaagatggtacgaggaggccctggccatcagccccacccacgtgaagagcatgcagagactggccctgatcctgcaccagctgggcagatacagcctggccgagaagatcctgagagacgccgtgcaggtgaacagcaccgcccacgaggtgtggaacggcctgggcgaggtgctgcaggcccagggcaacgacgccgccgccaccgagtgcttcctgaccgccctggagctggaggccagcagccccgccgtgcccttcaccatcatccccagagtgctgtag

SEQ ID NO: 25217 - DNA, 720 bp, Artificial Sequence
  Description of Artificial Sequence: Synthetic coding sequence
atgcagagaggcgccctgagccccgtgctgatgctgagcgccgcccccgagcccccccccagacccccccccgccctgagcccccccggcagcggccccggcagcggcagcagacacggcagcgccagacccggccccacccccgagcccagcggcagcctgggcgccgccctggacagcagcctgagagccgccgtggccttcaaggccgagggccagagatgctacagagagaagaagttcagagaggccatcggcaagtaccacagagccctgctgcagctgaaggccgcccagggcgccagacccagcggcctgcccgcccccgcccccggccccaccagcagccccggccccgccagactgagcgaggagcagagaagactggtggagagcaccgaggtggagtgctacgacagcctgaccgcctgcctgctgcagagcgagctggtgaactacgagagagtgagagagtactgcctgaaggtgctggagaagcagcagggcaacttcaaggccacctacagagccggcatcgccttctaccacctgggcgactacgccagagccctgagatacctgcaggaggccagaagcagagagcccaccgacaccaacgtgctgagatacatccagctgacccagctgaagatgaacagatgcagcctgcagagagaggacagcggcgccggcagccagaccagagacgtgatcggctag

SEQ ID NO: 25218 - DNA, 516 bp, Artificial Sequence
  Description of Artificial Sequence: Synthetic coding sequence
atggagaagagactgcaggaggcccagctgtacaaggaggagggcaaccagagatacagagagggcaagtacagagacgccgtgagcagataccacagagccctgctgcagctgagaggcctggaccccagcctgcccagccccctgcccaacctgggcccccagggccccgccctgacccccgagcaggagaacatcctgcacaccacccagaccgactgctacaacaacctggccgcctgcctgctgcagatggagcccgtgaactacgagagagtgagagagtacagccagaaggtgctggagagacagcccgacaacgccaaggccctgtacagagccggcgtggccttcttccacctgcaggactacgaccaggccagacactacctgctggccgccgtgaacagacagcccaaggacgccaacgtgagaagatacctgcagctgacccagagcgagctgagcagctaccacagaaaggagaagcagctgtacctgggcatgttcggctag

SEQ ID NO: 25219 - DNA, 648 bp, Artificial Sequence
  Description of Artificial Sequence: Synthetic coding sequence
atgctgaacaaggaggaggagctggagctgctggaggccctgtggagcttcagcaccagccccgcccacagcctgctgctgcccggcagaggcggcgccggccccatcgagagaagaaagcccgtgagccaggccttcagcagaccccagcagttcctgagcagagccctgctggagttcttcggcaagagccacccccccccccacagactgttcagaaagagcctgaacgtgggcctgcactacagccacatccccttcctgaccacctgcctgcacttcctgagaaagagactgcagaagggcgaggtgggcctgagcgtggagaccagcaagccccaggtgcccgtgggcggcctgagcagaaagaaggtgccccaggagccctgggccaccgtgatggagaagagactgcaggaggcccagctgtacaaggaggagggcaaccagagatacagagagggcaagtacagagacgccgtgagcagataccacagagccctgctgcagctgagaggcctggaccccagcctgcccagccccctgcccaacctgggcccccagggccccgccctgacccccgagcaggagaacatcctgcacaccacccagaccgactgctacaacaacctggccgtggtgaagtag

SEQ ID NO: 25220 - DNA, 423 bp, Artificial Sequence
  Description of Artificial Sequence: Synthetic coding sequence
atggagaagagactgcaggaggcccagctgtacaaggaggagggcaaccagagatacagagagggcaagtacagagacgccgtgagcagataccacagagccctgctgcagctgagaggcctggaccccagcctgcccagccccctgcccaacctgggcccccagggccccgccctgacccccgagcaggagaacatcctgcacaccacccagaccgactgctacaacaacctggccgcctgcctgctgcagatggagcccgtgaactacgagagagtgagagagtacagccagaaggtgctggagagacagcccgacaacgccaaggccctgtacagagccggcgtggccttcttccacctgcaggactacgaccaggccagacactacctgctggccgccgtgaacagacagcccaagtag

SEQ ID NO: 25221 - DNA, 516 bp, Artificial Sequence; identical to SEQ ID NO: 25218
  Description of Artificial Sequence: Synthetic coding sequence

SEQ ID NO: 25222 - DNA, 6003 bp, Artificial Sequence
  Description of Artificial Sequence: Synthetic coding sequence
atgttcagaaacagcctgaagatgctgctgaccggcggcaagagcagcagaaagaacagaagcagcgacggcggcagcgaggagccccccgacagaagacagagcagcgtggacagcagacagagcagaagcggccagggcggcatcagcaccgagagcgactgcgccttcgagcccgactacgccgtgccccccctgcccgtgagcgagggcgacgccgagcaggagctgggccccccccccagcgtggacgaggccgccaacaccctgatgaccagactgggcttcctgctgggcgagaaggtgaccgaggtgcagcccggcgaccagtacagcatggaggtgcaggacgagaaccagaccagcgccatcacccagagaatcagcccctgcagcaccctgaccagcagcaccgccagcccccccgccagcagcccctgcagcaccctgccccccatcagcaccaacgccaccgccaaggactgcagctacggcgccgtgaccagccccaccagcaccctggagagcagagacagcggcatcatcgccaccctgaccagctacagcgagaacgtggagagaaccaagtacgccggcgagagcagcaaggagctgggcagcggcggcaacatcaagccctggcagagccagaagagcagcatggacagctgcctgtacagagtggacgagaacatgaccgccagcacctacagcctgaacaagatccccgagagaaacctggagaccgtgctgagccagagcgtgcagagcatccccctgtacctgatgcccagacccaacagcgtggccgccaccagcagcgcccacctggaggacctggcctacctggacgagcagagacacacccccctgagaaccagcctgagaatgcccagacagagcatgggcggcgccagaacccagcaggacctgagagtgagattcgccccctacagaccccccgacatcagcctgaagcccctgctgttcgaggtgcccagcatcaccaccgagagcgtgttcgtgggcagagactgggtgttccacgagatcgacgcccagctgcagagcagcaacgccagcgtgaaccagggcgtggtgatcgtgggcaacatcggcttcggcaagaccgccatcatcagcagactggtggccctgagctgccacggcaccagaatgagacagatcgccagcgacagcccccacgccagccccaagcacgtggacgccaacagagagctgcccctgacccagccccccagcgcccacagcagcatcaccagcggcagctgccccggcacccccgagatgagaagaagacaggaggaggccatgagaagactggccagccaggtggtggcctaccactactgccaggccgacaacgcctacacctgcctggtgcccgagttcgtgcacaacgtggccgccctgctgtgcagaagcccccagctgaccgcctacagagagcagctgctgagagagccccacctgcagagcatgctgagcctgagaagctgcgtgcaggaccccatggccagcttcagaagaggcgtgctggagcccctggagaacctgcacaaggagagaaagatccccgacgaggacttcatcatcctgatcgacggcctgaacgaggccgagttccacaagcccgactacggcgacaccatcgtgagcttcctgagcaagatgatcggcaagttccccagctggctgaagctgatcgtgaccgtgagaaccagcctgcaggagatcaccaagctgctgcccttccacagaatcttcctggacagactggaggagaacgaggccatcgaccaggacctgcaggcctacatcctgcacagaatccacagcagcagcgagatccagaacaacatcagcctgaacggcaagatggacaacaccaccttcggcaagctgagcagccacctgaagaccctgagccagggcagctacctgtacctgaagctgaccttcgacctgatcgagaagggctacctggtgctgaagagcagcagctacaaggtggtgcccgtgagcctgagcgaggtgtacctgctgcagtgcaacatgaagttccccacccagagcagcttcgacagagtgatgcccctgctgaacgtggccgtggccagcctgcaccccctgaccgacgagcacatcttccaggccatcaacgccggcagcatcgagggcaccctggagtgggaggacttccagcagagaatggagaacctgagcatgttcctgatcaagagaagagacatgaccagaatgttcgtgcaccccagcttcagagagtggctgatctggagagaggagggcgagaagaccaagttcctgtgcgaccccagaagcggccacaccctgctggccttctggttcagcagacaggagggcaagctgaacagacagcagaccatcgagctgggccaccacatcctgaaggcccacatcttcaagggcctgagcaagaaggtgggcgtgagcagcagcatcctgcagggcctgtggatcagctacagcaccgagggcctgagcatggccctggccagcctgagaaacctgtacacccccaacatcaaggtgagcagactgctgatcctgggcggcgccaacatcaactacagaaccgaggtgctgaacaacgcccccatcctgtgcgtgcagagccacctgggctacaccgagatggtggccctgctgctggagttcggcgccaacgtggacgccagcagcgagagcggcctgacccccctgggctacgccgccgccgccggctacctgagcatcgtggtgctgctgtgcaagaagagagccaaggtggaccacctggacaagaacggccagtgcgccctggtgcacgccgccctgagaggccacctggaggtggtgaagttcctgatccagtgcgactggaccatggccggccagcagcagggcgtgttcaagaagagccacgccatccagcaggccctgatcgccgccgccagcatgggctacaccgagatcgtgagctacctgctggacctgcccgagaaggacgaggaggaggtggagagagcccagatcaacagcttcgacagcctgtggggcgagaccgccctgaccgccgccgccggcagaggcaagctggaggtgtgcagactgctgctggagcagggcgccgccgtggcccagcccaacagaagaggcgccgtgcccctgttcagcaccgtgagacagggccactggcagatcgtggacctgctgctgacccacggcgccgacgtgaacatggccgacaagcagggcagaacccccctgatgatggccgccagcgagggccacctgggcaccgtggacttcctgctggcccagggcgccagcatcgccctgatggacaaggagggcctgaccgccctgagctgggcctgcctgaagggccacctgagcgtggtgagaagcctggtggacaacggcgccgccaccgaccacgccgacaagaacggcagaacccccctggacctggccgccttctacggcgacgccgaggtggtgcagttcctggtggaccacggcgccatgatcgagcacgtggactacagcggcatgagacccctggacagagccgtgggctgcagaaacaccagcgtggtggtgaccctgctgaagaagggcgccaagatcggctgccagaccctgcccagcagacccagaggccccgccacctgggccatggccaccagcaagcccgacatcatgatcatcctgctgagcaagctgatggaggagggcgacatgttctacaagaagggcaaggtgaaggaggccgcccagagataccagtacgccctgaagaagttccccagagagggcttcggcgaggacctgaagaccttcagagagctgaaggtgagcctgctgctgaacctgagcagatgcagaagaaagatgaacgacttcggcatggccgaggagttcgccaccaaggccctggagctgaagcccaagagctacgaggcctactacgccagagccagagccaagagaagcagcagacagttcgccgccgccctggaggacctgaacgaggccatcaagctgtgccccaacaacagagagatccagagactgctgctgagagtggaggaggagtgcagacagatgcagcagccccagcagccccccccccccccccagccccagcagcagctgcccgaggaggccgagcccgagccccagcacgaggacatctacagcgtgcaggacatcttcgaggaggagtacctggagcaggacgtggagaacgtgagcatcggcctgcagaccgaggccagacccagccagggcctgcccgtgatccagagcccccccagcagccccccccacagagacagcgcctacatcagcagcagccccctgggcagccaccaggtgttcgacttcagaagcagcagcagcgtgggcagccccaccagacagacctaccagagcaccagccccgccctgagccccacccaccagaacagccactacagacccagccccccccacaccagccccgcccaccagggcggcagctacagattcagccccccccccgtgggcggccagggcaaggagtaccccagccccccccccagccccctgagaagaggcccccagtacagagccagcccccccgccgagagcatgagcgtgtacagaagccagagcggcagccccgtgagataccagcaggagaccagcgtgagccagctgcccggcagacccaagagccccctgagcaagatggcccagagaccctaccagatgccccagctgcccgtggccgtgccccagcagggcctgagactgcagcccgccaaggcccagatcgtgagaagcaaccagcccagccccgccgtgcacagcagcaccgtgatccccaccggcgcctacggccaggtggcccacagcatggccagcaagtaccagagcagccagggcgacatcggcgtgagccagagcagactggtgtaccagggcagcatcggcggcatcgtgggcgacggcagacccgtgcagcacgtgcaggccagcctgagcgccggcgccatctgccagcacggcggcctgaccaaggaggacctgccccagagacccagcagcgcctacagaggcggcgtgagatacagccagaccccccagatcggcagaagccagagcgccagctactaccccgtgtgccacagcaagctggacctggagagaagcagcagccagctgggcagccccgacgtgagccacctgatcagaagacccatcagcgtgaaccccaacgagatcaagccccacccccccacccccagacccctgctgcacagccagagcgtgggcctgagattcagccccagcagcaacagcatcagcagcaccagcaacctgacccccaccttcagacccagcagcagcatccagcagatggagatccccctgaagcccgcctacgagagaagctgcgacgagctgagccccgtgagccccacccagggcggctaccccagcgagcccaccagaagcagaaccacccccttcatgggcatcatcgacaagaccgccagaacccagcagtacccccacctgcaccagcagaacagaacctgggccgtgagcagcgtggacaccgtgctgagccccaccagccccggcaacctgccccagcccgagagcttcagcccccccagcagcatcagcaacatcgccttctacaacaagaccaacaacgcccagaacggccacctgctggaggacgactactacagcccccacggcatgctggccaacggcagcagaggcgacctgctggagagagtgagccaggccagcagctaccccgacgtgaaggtggccagaaccctgcccgtggcccaggcctaccaggacaacctgtacagacagctgagcagagacagcagacagggccagaccagccccatcaagcccaagagacccttcgtggagagcaacgtgtag

SEQ ID NO: 25223 - DNA, 5973 bp, Artificial Sequence
  Description of Artificial Sequence: Synthetic coding sequence
atgttcagaaacagcctgaagatgctgctgaccggcggcaagagcagcagaaagaacagaagcagcgacggcggcagcgaggagccccccgacagaagacagagcagcgtggacagcagacagagcagaagcggccagggcggcatcagcaccgagagcgactgcgccttcgagcccgactacgccgtgccccccctgcccgtgagcgagggcgacgccgagcaggagctgggccccccccccagcgtggacgaggccgccaacaccctgatgaccagactgggcttcctgctgggcgagaaggtgaccgaggtgcagcccggcgaccagtacagcatggaggtgcaggacgagaaccagaccagcgccatcacccagagaatcagcccctgcagcaccctgaccagcagcaccgccagcccccccgccagcagcccctgcagcaccctgccccccatcagcaccaacgccaccgccaaggactgcagctacggcgccgtgaccagccccaccagcaccctggagagcagagacagcggcatcatcgccaccctgaccagctacagcgagaacgtggagagaaccaagtacgccggcgagagcagcaaggagctgggcagcggcggcaacatcaagccctggcagagccagaagagcagcatggacagctgcctgtacagagtggacgagaacatgaccgccagcacctacagcctgaacaagatccccgagagaaacctggagaccgtgctgagccagagcgtgcagagcatccccctgtacctgatgcccagacccaacagcgtggccgccaccagcagcgcccacctggaggacctggcctacctggacgagcagagacacacccccctgagaaccagcctgagaatgcccagacagagcatgggcggcgccagaacccagcaggacctgagagtgagattcgccccctacagaccccccgacatcagcctgaagcccctgctgttcgaggtgcccagcatcaccaccgagagcgtgttcgtgggcagagactgggtgttccacgagatcgacgcccagctgcagagcagcaacgccagcgtgaaccagggcgtggtgatcgtgggcaacatcggcttcggcaagaccgccatcatcagcagactggtggccctgagctgccacggcaccagaatgagacagatcgccagcgacagcccccacgccagccccaagcacgtggacgccaacagagagctgcccctgacccagccccccagcgcccacagcagcatcaccagcggcagctgccccggcacccccgagatgagaagaagacaggaggaggccatgagaagactggccagccaggtggtggcctaccactactgccaggccgacaacgcctacacctgcctggtgcccgagttcgtgcacaacgtggccgccctgctgtgcagaagcccccagctgaccgcctacagagagcagctgctgagagagccccacctgcagagcatgctgagcctgagaagctgcgtgcaggaccccatggccagcttcagaagaggcgtgctggagcccctggagaacctgcacaaggagagaaagatccccgacgaggacttcatcatcctgatcgacggcctgaacgaggccgagttccacaagcccgactacggcgacaccatcgtgagcttcctgagcaagatgatcggcaagttccccagctggctgaagctgatcgtgaccgtgagaaccagcctgcaggagatcaccaagctgctgcccttccacagaatcttcctggacagactggaggagaacgaggccatcgaccaggacctgcaggcctacatcctgcacagaatccacagcagcagcgagatccagaacaacatcagcctgaacggcaagatggacaacaccaccttcggcaagctgagcagccacctgaagaccctgagccagggcagctacctgtacctgaagctgaccttcgacctgatcgagaagggctacctggtgctgaagagcagcagctacaaggtggtgcccgtgagcctgagcgaggtgtacctgctgcagtgcaacatgaagttccccacccagagcagcttcgacagagtgatgcccctgctgaacgtggccgtggccagcctgcaccccctgaccgacgagcacatcttccaggccatcaacgccggcagcatcgagggcaccctggagtgggaggacttccagcagagaatggagaacctgagcatgttcctgatcaagagaagagacatgaccagaatgttcgtgcaccccagcttcagagagtggctgatctggagagaggagggcgagaagaccaagttcctgtgcgaccccagaagcggccacaccctgctggccttctggttcagcagacaggagggcaagctgaacagacagcagaccatcgagctgggccaccacatcctgaaggcccacatcttcaagggcctgagcaagaaggtgggcgtgagcagcagcatcctgcagggcctgtggatcagctacagcaccgagggcctgagcatggccctggccagcctgagaaacctgtacacccccaacatcaaggtgagcagactgctgatcctgggcggcgccaacatcaactacagaaccgaggtgctgaacaacgcccccatcctgtgcgtgcagagccacctgggctacaccgagatggtggccctgctgctggagttcggcgccaacgtggacgccagcagcgagagcggcctgacccccctgggctacgccgccgccgccggctacctgagcatcgtggtgctgctgtgcaagaagagagccaaggtggaccacctggacaagaacggccagtgcgccctggtgcacgccgccctgagaggccacctggaggtggtgaagttcctgatccagtgcgactggaccatggccggccagcagcagggcgtgttcaagaagagccacgccatccagcaggccctgatcgccgccgccagcatgggctacaccgagatcgtgagctacctgctggacctgcccgagaaggacgaggaggaggtggagagagcccagatcaacagcttcgacagcctgtggggcgagaccgccctgaccgccgccgccggcagaggcaagctggaggtgtgcagactgctgctggagcagggcgccgccgtggcccagcccaacagaagaggcgccgtgcccctgttcagcaccgtgagacagggccactggcagatcgtggacctgctgctgacccacggcgccgacgtgaacatggccgacaagcagggcagaacccccctgatgatggccgccagcgagggccacctgggcaccgtggacttcctgctggcccagggcgccagcatcgccctgatggacaaggagggcctgaccgccctgagctgggcctgcctgaagggccacctgagcgtggtgagaagcctggtggacaacggcgccgccaccgaccacgccgacaagaacggcagaacccccctggacctggccgccttctacggcgacgccgaggtggtgcagttcctggtggaccacggcgccatgatcgagcacgtggactacagcggcatgagacccctggacagagccgtgggctgcagaaacaccagcgtggtggtgaccctgctgaagaagggcgccaagatcggccccgccacctgggccatggccaccagcaagcccgacatcatgatcatcctgctgagcaagctgatggaggagggcgacatgttctacaagaagggcaaggtgaaggaggccgcccagagataccagtacgccctgaagaagttccccagagagggcttcggcgaggacctgaagaccttcagagagctgaaggtgagcctgctgctgaacctgagcagatgcagaagaaagatgaacgacttcggcatggccgaggagttcgccaccaaggccctggagctgaagcccaagagctacgaggcctactacgccagagccagagccaagagaagcagcagacagttcgccgccgccctggaggacctgaacgaggccatcaagctgtgccccaacaacagagagatccagagactgctgctgagagtggaggaggagtgcagacagatgcagcagccccagcagccccccccccccccccagccccagcagcagctgcccgaggaggccgagcccgagccccagcacgaggacatctacagcgtgcaggacatcttcgaggaggagtacctggagcaggacgtggagaacgtgagcatcggcctgcagaccgaggccagacccagccagggcctgcccgtgatccagagcccccccagcagccccccccacagagacagcgcctacatcagcagcagccccctgggcagccaccaggtgttcgacttcagaagcagcagcagcgtgggcagccccaccagacagacctaccagagcaccagccccgccctgagccccacccaccagaacagccactacagacccagccccccccacaccagccccgcccaccagggcggcagctacagattcagccccccccccgtgggcggccagggcaaggagtaccccagccccccccccagccccctgagaagaggcccccagtacagagccagcccccccgccgagagcatgagcgtgtacagaagccagagcggcagccccgtgagataccagcaggagaccagcgtgagccagctgcccggcagacccaagagccccctgagcaagatggcccagagaccctaccagatgccccagctgcccgtggccgtgccccagcagggcctgagactgcagcccgccaaggcccagatcgtgagaagcaaccagcccagccccgccgtgcacagcagcaccgtgatccccaccggcgcctacggccaggtggcccacagcatggccagcaagtaccagagcagccagggcgacatcggcgtgagccagagcagactggtgtaccagggcagcatcggcggcatcgtgggcgacggcagacccgtgcagcacgtgcaggccagcctgagcgccggcgccatctgccagcacggcggcctgaccaaggaggacctgccccagagacccagcagcgcctacagaggcggcgtgagatacagccagaccccccagatcggcagaagccagagcgccagctactaccccgtgtgccacagcaagctggacctggagagaagcagcagccagctgggcagccccgacgtgagccacctgatcagaagacccatcagcgtgaaccccaacgagatcaagccccacccccccacccccagacccctgctgcacagccagagcgtgggcctgagattcagccccagcagcaacagcatcagcagcaccagcaacctgacccccaccttcagacccagcagcagcatccagcagatggagatccccctgaagcccgcctacgagagaagctgcgacgagctgagccccgtgagccccacccagggcggctaccccagcgagcccaccagaagcagaaccacccccttcatgggcatcatcgacaagaccgccagaacccagcagtacccccacctgcaccagcagaacagaacctgggccgtgagcagcgtggacaccgtgctgagccccaccagccccggcaacctgccccagcccgagagcttcagcccccccagcagcatcagcaacatcgccttctacaacaagaccaacaacgcccagaacggccacctgctggaggacgactactacagcccccacggcatgctggccaacggcagcagaggcgacctgctggagagagtgagccaggccagcagctaccccgacgtgaaggtggccagaaccctgcccgtggcccaggcctaccaggacaacctgtacagacagctgagcagagacagcagacagggccagaccagccccatcaagcccaagagacccttcgtggagagcaacgtgtag

SEQ ID NO: 25224 - DNA, 468 bp, Artificial Sequence
  Description of Artificial Sequence: Synthetic coding sequence
atgagcgacagcgacctgggcgaggacgagggcctgctgagcctggccggcaagagaaagagaagaggcaacctgcccaaggagagcgtgaagatcctgagagactggctgtacctgcacagatacaacgcctaccccagcgagcaggagaagctgagcctgagcggccagaccaacctgagcgtgctgcaggacgagttcctggacgtgatctactggttcagacagatcatcgccgtggtgctgggcgtgatctggggcgtgctgcccctgagaggcttcctgggcatcgccggcttctgcctgatcaacgccggcgtgctgtacctgtacttcagcaactacctgcagatcgacgaggaggagtacggcggcacctgggagctgaccaaggagggcttcatgaccagcttcgccctgttcatggtgatctggatcatcttctacaccgccatccactacgactag

SEQ ID NO: 25225 - DNA, 1398 bp, Artificial Sequence
  Description of Artificial Sequence: Synthetic coding sequence
atggagaaccaggagttcctgagcagcagcgcccccagcgaggtgaccgacggccaggtgagcaccgagatcagcacctgcagcgaggtgttccagaagcccatcgtgctgagaatcctggacacccacagagagctggaggagagcgaggaccccgagaagcacgagaaccccgaggagcccgaggaggtgagagagcaggaccagagagacgagagcgaggagtgcgacgagccccacgagagctacgagccccacgccccctacgccccccacaagcccagagacagctacgccccctacgagctgcacggcccccacgccgcccccaagctgctgaaggccagagagcccagacagctgagacacaccagagagcccagaaagagcagagaggccaaggagaccgagctgctgcccagcgccgccgtgatgatcagccccagcctgatcaccagagccccccccagaccccagctgagcttcctgggcgccaaccccgtgagctgcgacttcgtgagaaagtgcttcagcagcagaaagagaacccccaacctgagcaagcccaagaagcagtggggcacccccgacagaaagctgttctggggcaaccaggaccccatcagacccgtgagccagggcgccctgaaggcccagctgaccaagagactggagaacctggcccagcccaaggaggtgagctgccactacgtgcccaacagagcccagtactaccacagctgcggcagagagagcgtgatctgggagatcaccccccccgccctgttcagacagcccagcaagagaatccagagactgagccagcccaacggcttcaagagacagtgcctgctgaacagacccttcagcgacaacagcgccagagacagcctgagaatcagcgaccccagccccagaatcctgcagctgagcgtggccaagggcaccgaccccaactaccaccccagcaagaagatgcagaccaagatcagcctgagcaccctgagcgccatcgccacccccagaatcatcgagctggcccaccccagaatcaagctggagggcctgtgctacgagagacagagaagcgagctgcccatcagacccgtgccccccgccgccatgatcgccaagcccagccccagaaccatcgccctggccaagagcaagagcgtgcaccaggactacctgcccgacagagacgcccactggcccgtgagctacgccaccacccacagcaaggccagccccagaatccaggagctggccaaccccaacaagagagcccccgtgagaatcgtgtactacgaccccgacgtgttcaagaccaagcccgccgccctgaaggcccagtgcagccagagaatctgggagctgagccagcccctgaccagatag

SEQ ID NO: 25226 - DNA, 318 bp, Artificial Sequence
  Description of Artificial Sequence: Synthetic coding sequence
atggcccagggcctgatcgaggtggagagaaagttcctgcccggccccggcaccgaggagagactgcaggagctgggcggcaccctggagtacagagtgaccttcagagacacctactacgacacccccgagctgagcctgatgcaggccgaccactggctgagaagaagagaggacagcggctgggagctgaagtgccccggcgccgccggcgtgctgggcccccacaccgagtacaaggagctgaccgccgagcccaccatcgtggcccagctgtgcaaggtgtgcctgcacagaagacagcaccagcccagctag

SEQ ID NO: 25227 - DNA, 753 bp, Artificial Sequence
  Description of Artificial Sequence: Synthetic coding sequence
tgatacgccctgcccaacgccagctggtgcagcgacatgctgagcctgtaccaggagttcctggagaagaccaagagcagcggctggatcaagctgcccagcttcaagagcaacagagaccacatcagaggcctgaagctgcccagcggcctggccgtgagcagcgacaagggcgactgcagaatcttcaccagatgcatccaggtggagggccagggcttcgagtacgtgatcttcttccagcccacccagaagaagagcgtgtgcctgttccagcccggcagctacctggagggcccccccggcttcgcccacggcggcagcctggccgccatgatggacgagaccttcagcaagaccgccttcctggccggcgagggcctgttcaccctgagcctgaacatcagattcaagaacctgatccccgtggacagcctggtggtgatggacgtggagctggacaagatcgaggaccagaagctgtacatgagctgcatcgcccacagcagctggaagaagagcctgcccagcaacagccactgcgcctgcagaagagccaccgccagccccgcctgcctgctgccccccgccagccccgcctgcctgctgccccccgccagccccgcctgcctgctgccccccctgcccgccagctgcctgctgccccccctgcccgccagctgcctgctgccccccctgcccgcctgggaccccagcaagagcagagagggcagcagcagcagcaactggtag

SEQ ID NO: 25228 - DNA, 402 bp, Artificial Sequence
  Description of Artificial Sequence: Synthetic coding sequence
atgagagacctgagcgagagaagactgggccagcccgagctgaaggccgagcagcagatgcccctggagcccgtgagagccagactgagcgtgggcctggcctgctgctgcagccacaccaccgccgaggccagcagcctggagcacggcgacaaggtgttcggccagggcttccccagccccctggaggagatcaagagactgctgaagatcagcagagccctgcaggccagaagcgtgcccagcacccaggagaaggccaagtgcctgagcggcgagcccggccagcccgagggcaagggccaggagacctaccccggccccggcaaggtggagggcaaggccgagcccgccatgagaaaggacgacgtgtgccccggcatgaagtgcatcagcggctag

SEQ ID NO: 25229 - DNA, 402 bp, Artificial Sequence; identical to SEQ ID NO: 25228
  Description of Artificial Sequence: Synthetic coding sequence

SEQ ID NO: 25230 - DNA, 1551 bp, Artificial Sequence
  Description of Artificial Sequence: Synthetic coding sequence
atgcccagcagcaccagccccgaccagggcgacgacctggagaactgcatcctgagattcagcgacctggacctgaaggacatgagcctgatcaaccccagcagcagcctgaaggccgagctggacggcagcaccaagaagaagtacagcttcgccaagaagaaggccttcgccctgttcgtgaagaccaaggaggtgcccaccaagagaagcttcgagtgcaaggagaagctgtggaagtgctgcagacagctgttcaccgaccagaccagcatccacagacacgtggccacccagcacgccgacgagatctaccaccagaccgccagcatcctgaagcagctggccgtgaccctgagcaccagcaagagcctgagcagcgccgacgagaagaaccccctgaaggagtgcctgccccacagccacgacgtgagcgcctggctgcccgacatcagctgcttcaaccccgacgagctgatcagcggccagggcagcgaggagggcgaggtgctgctgtactactgctaccacgacctggaggacccccagtggatctgcgcctggcagaccgccctgtgccagcacctgcacctgaccggcaagatcagaatcgccgccgagggcatcaacggcaccgtgggcggcagcaagctggccaccagactgtacgtggaggtgatgctgagcttccccctgttcaaggacgacctgtgcaaggacgacttcaagaccagcaagggcggcgcccactgcttccccgagctgagagtgggcgtgttcgaggagatcgtgcccatgggcatcagccccaagaagatcagctacaagaagcccggcatccacctgagccccggcgagttccacaaggaggtggagaagttcctgagccaggccaaccaggagcagagcgacaccatcctgctggactgcagaaacttctacgagagcaagatcggcagattccagggctgcctggcccccgacatcagaaagttcagctacttccccagctacgtggacaagaacctggagctgttcagagagaagagagtgctgatgtactgcaccggcggcatcagatgcgagagaggcagcgcctacctgaaggccaagggcgtgtgcaaggaggtgttccagctgaagggcggcatccacaagtacctggaggagttccccgacggcttctacaagggcaagctgttcgtgttcgacgagagatacgccctgagctacaacagcgacgtggtgagcgagtgcagctactgcggcgccagatgggaccagtacaagctgtgcagcaccccccagtgcagacagctggtgctgacctgccccgcctgccagggccagggcttcaccgcctgctgcgtgacctgccaggacaagggcagcagaaaggtgagcggccccatgcaggacagcttcaaggaggagtgcgagtgcaccgccagaagacccagaatccccagagagctgctgcagcacgtgagacagcccgtgagccccgagcccggccccgacgccgacgaggacggccccgtgctgatgtag

SEQ ID NO: 25231 - DNA, 504 bp, Artificial Sequence
  Description of Artificial Sequence: Synthetic coding sequence
atggacctgtgcctggccgacagcagcgtgagcgcccccgccccccacagacagggcatccacctgagccccggcgagttccacaaggaggtggagaagttcctgagccaggccaaccaggagcagagcgacaccatcctgctggactgcagaaacttctacgagagcaagatcggcagattccagggctgcctggcccccgacatcagaaagttcagctacttccccagctacgtggacaagaacctggagctgttcagagagaagagagtgctgatgtactgcaccggcggcatcagatgcgagagaggcagcgcctacctgaaggccaagggcgtgtgcaaggaggtgttccagctgaagggcggcatccacaagtacctggaggagttccccgacggcttctacaagggcaagctgttcgtgttcgacgagagatacgccctgagctacaacagcgacgtggtgagcggcagaagcgcccaggcccagagccccaactag

SEQ ID NO: 25232 - DNA, 219 bp, Artificial Sequence
  Description of Artificial Sequence: Synthetic coding sequence
atgctgagcttccccctgttcaaggacgacctgtgcaaggacgacttcaagaccagcaagggcggcgcccactgcttccccgagctgagagtgggcgtgttcgaggagatcgtgcccatgggcatcagccccaagaagatcagctacaagaagcccggcatgctggccttcagaagactgtgcttcaacagccagggccagaacctgatcgacaagtag

SEQ ID NO: 25233 - DNA, 504 bp, Artificial Sequence; identical to SEQ ID NO: 25231
  Description of Artificial Sequence: Synthetic coding sequence

SEQ ID NO: 25234 - DNA, 648 bp, Artificial Sequence
  Description of Artificial Sequence: Synthetic coding sequence
atgctgagcttccccctgttcaaggacgacctgtgcaaggacgacttcaagaccagcaagggcggcgcccactgcttccccgagctgagagtgggcgtgttcgaggagatcgtgcccatgggcatcagccccaagaagatcagctacaagaagcccggcatccacctgagccccggcgagttccacaaggaggtggagaagttcctgagccaggccaaccaggagcagagcgacaccatcctgctggactgcagaaacttctacgagagcaagatcggcagattccagggctgcctggcccccgacatcagaaagttcagctacttccccagctacgtggacaagaacctggagctgttcagagagaagagagtgctgatgtactgcaccggcggcatcagatgcgagagaggcagcgcctacctgaaggccaagggcgtgtgcaaggaggtgttccagctgaagggcggcatccacaagtacctggaggagttccccgacggcttctacaagggcaagctgttcgtgttcgacgagagatacgccctgagctacaacagcgacgtggtgagcgagtgcagctactgcggcgccagatgggaccagtacaagctgtgcagcaccccccagctggacaccctgccctag

SEQ ID NO: 25235 - DNA, 339 bp, Artificial Sequence
  Description of Artificial Sequence: Synthetic coding sequence
atgtacgtgttcatcatgatggccttccccagcagccccgagtgcagctactgcggcgccagatgggaccagtacaagctgtgcagcaccccccagtgcagacagctggtgctgacctgccccgcctgccagggccagggcttcaccgcctgctgcgtgacctgccaggacaagggcagcagaaaggtgagcggccccatgcaggacagcttcaaggaggagtgcgagtgcaccgccagaagacccagaatccccagagagctgctgcagcacgtgagacagcccgtgagccccgagcccggccccgacgccgacgaggacggccccgtgctgatgtag

SEQ ID NO: 25236 - DNA, 711 bp, Artificial Sequence
  Description of Artificial Sequence: Synthetic coding sequence
atgagcgaggcccccagagccgagaccttcgtgttcctggacctggaggccaccggcctgcccagcgtggagcccgagatcgccgagctgagcctgttcgccgtgcacagaagcagcctggagaaccccgagcacgacgagagcggcgccctggtgctgcccagagtgctggacaagctgaccctgtgcatgtgccccgagagacccttcaccgccaaggccagcgagatcaccggcctgagcagcgagggcctggccagatgcagaaaggccggcttcgacggcgccgtggtgagaaccctgcaggccttcctgagcagacaggccggccccatctgcctggtggcccacaacggcttcgactacgacttccccctgctgtgcgccgagctgagaagactgggcgccagactgcccagagacaccgtgtgcctggacaccctgcccgccctgagaggcctggacagagcccacagccacggcaccagagccagaggcagacagggctacagcctgggcagcctgttccacagatacttcagagccgagcccagcgccgcccacagcgccgagggcgacgtgcacaccctgctgctgatcttcctgcacagagccgccgagctgctggcctgggccgacgagcaggccagaggctgggcccacatcgagcccatgtacctgccccccgacgaccccagcctggaggcctag

SEQ ID NO: 25237 - DNA, 2232 bp, Artificial Sequence
  Description of Artificial Sequence: Synthetic coding sequence
atgctgcacttcaacagatgccaccacctgaagaagatcacccagaagtgcttcagcagcatccacgtgaagaccgacaagcacgcccagagattcctgagcagaaccttcgccctggccgagctgagaaagagctggtacagcacccacagcctggtgggcgacaagaacatcatcctgatgggcccccccggcgccggcaagaccaccgtgggcagaatcatcggccagaagctgggctgctgcgtgatcgacgtggacgacgacatcctggagaagacctggaacatgagcgtgagcgagaagctgcaggacgtgggcaacgagcagttcctggaggaggagggcaaggccgtgctgaacttcagcgccagcggcagcgtgatcagcctgaccggcagcaaccccatgcacgacgccagcatgtggcacctgaagaagaacggcatcatcgtgtacctggacgtgcccctgctggacctgatctgcagactgaagctgatgaagaccgacagaatcgtgggccagaacagcggcaccagcatgaaggacctgctgaagttcagaagacagtactacaagaagtggtacgacgccagagtgttctgcgagagcggcgccagccccgaggaggtggccgacaaggtgctgaacgccatcaagagataccaggacgtggacagcgagaccttcatcagcaccagacacgtgtggcccgaggactgcgagcagaaggtgagcgccaagttcttcagcgaggccgtgatcgagggcctggccagcgacggcggcctgttcgtgcccgccaaggagttccccaagctgagctgcggcgagtggaagagcctggtgggcgccacctacgtggagagagcccagatcctgctggagagatgcatccaccccgccgacatccccgccgccagactgggcgagatgatcgagaccgcctacggcgagaacttcgcctgcagcaagatcgcccccgtgagacacctgagcggcaaccagttcatcctggagctgttccacggccccaccggcagcttcaaggacctgagcctgcagctgatgccccacatcttcgcccactgcatcccccccagctgcaactacatgatcctggtggccaccagcggcgacaccggcagcgccgtgctgaacggcttcagcagactgaacaagaacgacaagcagagaatcgccgtggtggccttcttccccgagaacggcgtgagcgacttccagaaggcccagatcatcggcagccagagagagaacggctgggccgtgggcgtggagagcgacttcgacttctgccagaccgccatcaagagaatcttcaacgacagcgacttcaccggcttcctgaccgtggagtacggcaccatcctgagcagcgccaacagcatcaactggggcagactgctgccccaggtggtgtaccacgccagcgcctacctggacctggtgagccagggcttcatcagcttcggcagccccgtggacgtgtgcatccccaccggcaacttcggcaacatcctggccgccgtgtacgccaagatgatgggcatccccatcagaaagttcatctgcgccagcaaccagaaccacgtgctgaccgacttcatcaagaccggccactacgacctgagagagagaaagctggcccagaccttcagccccagcatcgacatcctgaagagcagcaacctggagagacacctgcacctgatggccaacaaggacggccagctgatgaccgagctgttcaacagactggagagccagcaccacttccagatcgagaaggccctggtggagaagctgcagcaggacttcgtggccgactggtgcagcgagggcgagtgcctggccgccatcaacagcacctacaacaccagcggctacatcctggacccccacaccgccgtggccaaggtggtggccgacagagtgcaggacaagacctgccccgtgatcatcagcagcaccgcccactacagcaagttcgcccccgccatcatgcaggccctgaagatcaaggagatcaacgagaccagcagcagccagctgtacctgctgggcagctacaacgccctgccccccctgcacgaggccctgctggagagaaccaagcagcaggagaagatggagtaccaggtgtgcgccgccgacatgaacgtgctgaagagccacgtggagcagctggtgcagaaccagttcatctag

SEQ ID NO: 25238 - DNA, 2232 bp, Artificial Sequence; identical to SEQ ID NO: 25237
  Description of Artificial Sequence: Synthetic coding sequence

SEQ ID NO: 25239 - DNA, 2301 bp, Artificial Sequence
  Description of Artificial Sequence: Synthetic coding sequence
atggccgccgaggccctggccgccgaggccgtggccagcagactggagagacaggaggaggacatcagatggctgtggagcgaggtggagagactgagagacgagcagctgaacgccccctacagctgccaggccgagggcccctgcctgaccagagaggtggcccagctgagagccgagaactgcgacctgagacacagactgtgcagcctgagactgtgcctggccgaggagagaagcagacaggccaccctggagagcgccgagctggaggccgcccaggaggccggcgcccagcccccccccagccagagccaggacaaggacatgaagaagaagaagatgaaggagagcgaggccgacagcgaggtgaagcaccagcccatcttcatcaaggagagactgaagctgttcgagatcctgaagaaggaccaccagctgctgctggccatctacggcaagaagggcgacaccagcaacatcatcaccgtgagagtggccgacggccagaccgtgcagggcgaggtgtggaagaccaccccctaccaggtggccgccgagatcagccaggagctggccgagagcaccgtgatcgccaaggtgaacggcgagctgtgggacctggacagacccctggagggcgacagcagcctggagctgctgaccttcgacaacgaggaggcccaggccgtgtactggcacagcagcgcccacatcctgggcgaggccatggagctgtactacggcggccacctgtgctacggcccccccatcgagaacggcttctactacgacatgttcatcgaggacagagccgtgagcagcaccgagctgagcgccctggagaacatctgcaaggccatcatcaaggagaagcagcccttcgagagactggaggtgagcaaggagatcctgctggagatgttcaagtacaacaagttcaagtgcagaatcctgaacgagaaggtgaacaccgccaccaccaccgtgtacagatgcggccccctgatcgacctgtgcaagggcccccacgtgagacacaccggcaagatcaagaccatcaagatcttcaagaacagcagcacctactgggagggcaaccccgagatggagaccctgcagagaatctacggcatcagcttccccgacaacaagatgatgagagactgggagaagttccaggaggaggccaagaacagagaccacagaaagatcggcaaggagcaggagctgttcttcttccacgacctgagccccggcagctgcttcttcctgcccagaggcgccttcatctacaacaccctgaccgacttcatcagagaggagtaccacaagagagacttcaccgaggtgctgagccccaacatgtacaacagcaagctgtgggaggccagcggccactggcagcactacagcgagaacatgttcaccttcgagatcgagaaggacaccttcgccctgaagcccatgaactgccccggccactgcctgatgttcgcccacagacccagaagctggagagagatgcccatcagattcgccgacttcggcgtgctgcacagaaacgagctgagcggcaccctgagcggcctgaccagagtgagaagattccagcaggacgacgcccacatcttctgcaccgtggagcagatcgaggaggagatcaagggctgcctgcagttcctgcagagcgtgtacagcaccttcggcttcagcttccagctgaacctgagcaccagacccgagaacttcctgggcgagatcgagatgtggaacgaggccgagaagcagctgcagaacagcctgatggacttcggcgagccctggaagatgaaccccggcgacggcgccttctacggccccaagatcgacatcaagatcaaggacgccatcggcagataccaccagtgcgccaccatccagctggacttccagctgcccatcagattcaacctgacctacgtgagcaaggacggcgacgacaagaagagacccgtgatcatccacagagccatcctgggcagcgtggagagaatgatcgccatcctgagcgagaactacggcggcaagtggcccttctggctgagccccagacaggtgatggtgatccccgtgggccccacctgcgagaagtacgccctgcaggtgagcagcgagttcttcgaggagggcttcatggccgacgtggacctggaccacagctgcaccctgaacaagaagatcagaaacgcccagctggcccagtacaacttcatcctggacagattcctgcccagcgtgtggcaggaggcctggctgtag

SEQ ID NO: 25240 - DNA, 4830 bp, Artificial Sequence
  Description of Artificial Sequence: Synthetic coding sequence
atgttccccaagagcaacctgaccgtgacctgctgggtgtggagaagcatgagaaagctgttcctgctgctgagcctgctgctgagccacgccgcccacctggagggcaagaaggacaaccagttcatctggaagcccggcccctggggcagatgcaccggcgactgcggccccggcggcgtgcagagcagagccgtgtggtgcttccacgtggacggctggaccagccacctgagcaactgcggcgagagcaacagaccccccaaggagagaagctgcttcagagtgtgcgactggcacagcgacctgttccagtgggaggtgagcgactggcaccactgcgtgctggtgccctacgccagaggcgaggtgaagcccagaaccgccgagtgcgtgaccgcccagcacggcctgcagcacagaatggtgagatgcatccagaagctgaacagaaccgtggtggccaacgagatctgcgagcacttcgccctgcagccccccaccgagcaggcctgcctgatcccctgccccagagactgcgtggtgagcgagttcctgccctggagcaactgcagcaagggctgcggcaagaagctgcagcacagaaccagagccgtgatcgccccccccctgttcggcggcctgcagtgccccaacctgaccgagagcagagcctgcgacgcccccatcagctgccccctgggcgaggaggagtacaccttcagcctgaaggtgggcccctggagcaagtgcagactgccccacctgaaggagatcaaccccagcggcagaaccgtgctggacttcaacagcgacagcaacgagagagtgaccttcaagcaccagagctacaaggcccaccaccacagcaagagctgggccatcgagatcggctaccagaccagacaggtgagctgcaccagaagcgacggccagaacgccatgctgagcctgtgcctgcaggacagcttccccctgaccgtgcagagctgcatcatgcccaaggactgcgagaccagccagtggagcagctggagcccctgcagcaagacctgcagaagcggcagcctgctgcccggcttcagaagcagaagcagaaacgtgaagcacatggccatcggcggcggcaaggagtgccccgagctgctggagaaggaggcctgcatcgtggagggcgagctgctgcagcagtgccccagatacagctggagaaccagcgagtggaaggagtgccaggtgagcctgctgctggagcagcaggacccccactggcacgtgaccggccccgtgtgcggcggcggcatccagaccagagaggtgtactgcgcccagagcgtgcccgccgccgccgccctgagagccaaggaggtgagcagacccgtggagaaggccctgtgcgtgggccccgcccccctgcccagccagctgtgcaacatcccctgcagcaccgactgcatcgtgagcagctggagcgcctggggcctgtgcatccacgagaactgccacgacccccagggcaagaagggcttcagaaccagacagagacacgtgctgatggagagcaccggccccgccggccactgcccccacctggtggagagcgtgccctgcgaggaccccatgtgctacagatggctggccagcgagggcatctgcttccccgaccacggcaagtgcggcctgggccacagaatcctgaaggccgtgtgccagaacgacagaggcgaggacgtgagcggcagcctgtgccccgtgccccccccccccgagagaaagagctgcgagatcccctgcagaatggactgcgtgctgagcgagtggaccgagtggagcagctgcagccagagctgcagcaacaagaacagcgacggcaagcagaccagaagcagaaccatcctggccctggccggcgagggcggcaagccctgcccccccagccaggccctgcaggagcacagactgtgcaacgaccacagctgcatgcagctgcactgggagaccagcccctggggcccctgcagcgaggacaccctggtgaccgccctgaacgccaccatcggctggaacggcgaggccacctgcggcgtgggcatccagaccagaagagtgttctgcgtgaagagccacgtgggccaggtgatgaccaagagatgccccgacagcaccagacccgagaccgtgagaccctgcttcctgccctgcaagaaggactgcatcgtgaccgccttcagcgagtggaccccctgccccagaatgtgccaggccggcaacgccaccgtgaagcagagcagatacagaatcatcatccaggaggccgccaacggcggccaggagtgccccgacaccctgtacgaggagagagagtgcgaggacgtgagcctgtgccccgtgtacagatggaagccccagaagtggagcccctgcatcctggtgcccgagagcgtgtggcagggcatcaccggcagcagcgaggcctgcggcaagggcctgcagaccagagccgtgagctgcatcagcgacgacaacagaagcgccgagatgatggagtgcctgaagcagaccaacggcatgcccctgctggtgcaggagtgcaccgtgccctgcagagaggactgcaccttcaccgcctggagcaagttcaccccctgcagcaccaactgcgaggccaccaagagcagaagaagacagctgaccggcaagagcagaaagaaggagaagtgccaggacagcgacctgtaccccctggtggagaccgagctgtgcccctgcgacgagttcatcagccagccctacggcaactggagcgactgcatcctgcccgagggcagaagagagccccacagaggcctgagagtgcaggccgacagcaaggagtgcggcgagggcctgagattcagagccgtggcctgcagcgacaagaacggcagacccgtggaccccagcttctgcagcagcagcggctacatccaggagaagtgcgtgatcccctgccccttcgactgcaagctgagcgactggagcagctggggcagctgcagcagcagctgcggcatcggcgtgagaatcagaagcaagtggctgaaggagaagccctacaacggcggcagaccctgccccaagctggacctgaagaaccagaacgcccaggtgcacgaggccgtgccctgctacagcgagtgcaaccagtacagctgggtggtggagcactggagcagctgcaagatcaacaacgagctgagaagcctgagatgcggcggcggcacccagagcagaaagatcagatgcgtgaacaccgccgacggcgagggcggcgccgtggacagcaacctgtgcaaccaggacgagatcccccccgagacccagagctgcagcctgatgtgccccaacgagtgcgtgatgagcgagtggggcctgtggagcaagtgcccccagagctgcgacccccacaccatgcagagaagaaccagacacctgctgagacccagcctgaacagcagaacctgcgccgaggacagccaggtgcagccctgcctgctgaacgagaactgcttccagttccagtacaacctgaccgagtggagcacctgccagctgagcgagaacgccccctgcggccagggcgtgagaaccagactgctgagctgcgtgtgcagcgacggcaagcccgtgagcatggaccagtgcgagcagcacaacctggagaagccccagagaatgagcatcccctgcctggtggagtgcgtggtgaactgccagctgagcggctggaccgcctggaccgagtgcagccagacctgcggccacggcggcagaatgagcagaaccagattcatcatcatgcccacccagggcgagggcagaccctgccccaccgagctgacccaggagaagacctgccccgtgaccccctgctacagctgggtgctgggcaactggagcgcctgcaagctggagggcggcgactgcggcgagggcgtgcagatcagaagcctgagctgcatggtgcacagcggcagcatcagccacgccgccggcagagtggaggacgccctgtgcggcgagatgcccttccaggacagcatcctgaagcagctgtgcagcgtgccctgccccggcgactgccacctgaccgagtggagcgagtggagcacctgcgagctgacctgcatcgacggcagaagcttcgagaccgtgggcagacagagcagaagcagaaccttcatcatccagagcttcgagaaccaggacagctgcccccagcaggtgctggagaccagaccctgcaccggcggcaagtgctaccactacacctggaaggccagcctgtggaacaacaacgagagaaccgtgtggtgccagagaagcgacggcgtgaacgtgaccggcggctgcagcccccaggccagacccgccgccatcagacagtgcatccccgcctgcagaaagcccttcagctactgcacccagggcggcgtgtgcggctgcgagaagggctacaccgagatcatgaagagcaacggcttcctggactactgcatgaaggtgcccggcagcgaggacaagaaggccgacgtgaagaacctgagcggcaagaacagacccgtgaacagcaagatccacgacatcttcaagggctggagcctgcagcccctggaccccgacggcagagtgaagatctgggtgtacggcgtgagcggcggcgccttcctgatcatgatcttcctgatcttcaccagctacctggtgtgcaagaagcccaagccccaccagagcacccccccccagcagaagcccctgaccctggcctacgacggcgacctggacatgtag

SEQ ID NO: 25241 - DNA, 4737 bp, Artificial Sequence
  Description of Artificial Sequence: Synthetic coding sequence
atgcacaacaccgccgacgaggtggtgctgtaccacaagctggccggcccctggggcagatgcaccggcgactgcggccccggcggcgtgcagagcagagccgtgtggtgcttccacgtggacggctggaccagccacctgagcaactgcggcgagagcaacagaccccccaaggagagaagctgcttcagagtgtgcgactggcacagcgacctgttccagtgggaggtgagcgactggcaccactgcgtgctggtgccctacgccagaggcgaggtgaagcccagaaccgccgagtgcgtgaccgcccagcacggcctgcagcacagaatggtgagatgcatccagaagctgaacagaaccgtggtggccaacgagatctgcgagcacttcgccctgcagccccccaccgagcaggcctgcctgatcccctgccccagagactgcgtggtgagcgagttcctgccctggagcaactgcagcaagggctgcggcaagaagctgcagcacagaaccagagccgtgatcgccccccccctgttcggcggcctgcagtgccccaacctgaccgagagcagagcctgcgacgcccccatcagctgccccctgggcgaggaggagtacaccttcagcctgaaggtgggcccctggagcaagtgcagactgccccacctgaaggagatcaaccccagcggcagaaccgtgctggacttcaacagcgacagcaacgagagagtgaccttcaagcaccagagctacaaggcccaccaccacagcaagagctgggccatcgagatcggctaccagaccagacaggtgagctgcaccagaagcgacggccagaacgccatgctgagcctgtgcctgcaggacagcttccccctgaccgtgcagagctgcatcatgcccaaggactgcgagaccagccagtggagcagctggagcccctgcagcaagacctgcagaagcggcagcctgctgcccggcttcagaagcagaagcagaaacgtgaagcacatggccatcggcggcggcaaggagtgccccgagctgctggagaaggaggcctgcatcgtggagggcgagctgctgcagcagtgccccagatacagctggagaaccagcgagtggaaggagtgccaggtgagcctgctgctggagcagcaggacccccactggcacgtgaccggccccgtgtgcggcggcggcatccagaccagagaggtgtactgcgcccagagcgtgcccgccgccgccgccctgagagccaaggaggtgagcagacccgtggagaaggccctgtgcgtgggccccgcccccctgcccagccagctgtgcaacatcccctgcagcaccgactgcatcgtgagcagctggagcgcctggggcctgtgcatccacgagaactgccacgacccccagggcaagaagggcttcagaaccagacagagacacgtgctgatggagagcaccggccccgccggccactgcccccacctggtggagagcgtgccctgcgaggaccccatgtgctacagatggctggccagcgagggcatctgcttccccgaccacggcaagtgcggcctgggccacagaatcctgaaggccgtgtgccagaacgacagaggcgaggacgtgagcggcagcctgtgccccgtgccccccccccccgagagaaagagctgcgagatcccctgcagaatggactgcgtgctgagcgagtggaccgagtggagcagctgcagccagagctgcagcaacaagaacagcgacggcaagcagaccagaagcagaaccatcctggccctggccggcgagggcggcaagccctgcccccccagccaggccctgcaggagcacagactgtgcaacgaccacagctgcatgcagctgcactgggagaccagcccctggggcccctgcagcgaggacaccctggtgaccgccctgaacgccaccatcggctggaacggcgaggccacctgcggcgtgggcatccagaccagaagagtgttctgcgtgaagagccacgtgggccaggtgatgaccaagagatgccccgacagcaccagacccgagaccgtgagaccctgcttcctgccctgcaagaaggactgcatcgtgaccgccttcagcgagtggaccccctgccccagaatgtgccaggccggcaacgccaccgtgaagcagagcagatacagaatcatcatccaggaggccgccaacggcggccaggagtgccccgacaccctgtacgaggagagagagtgcgaggacgtgagcctgtgccccgtgtacagatggaagccccagaagtggagcccctgcatcctggtgcccgagagcgtgtggcagggcatcaccggcagcagcgaggcctgcggcaagggcctgcagaccagagccgtgagctgcatcagcgacgacaacagaagcgccgagatgatggagtgcctgaagcagaccaacggcatgcccctgctggtgcaggagtgcaccgtgccctgcagagaggactgcaccttcaccgcctggagcaagttcaccccctgcagcaccaactgcgaggccaccaagagcagaagaagacagctgaccggcaagagcagaaagaaggagaagtgccaggacagcgacctgtaccccctggtggagaccgagctgtgcccctgcgacgagttcatcagccagccctacggcaactggagcgactgcatcctgcccgagggcagaagagagccccacagaggcctgagagtgcaggccgacagcaaggagtgcggcgagggcctgagattcagagccgtggcctgcagcgacaagaacggcagacccgtggaccccagcttctgcagcagcagcggctacatccaggagaagtgcgtgatcccctgccccttcgactgcaagctgagcgactggagcagctggggcagctgcagcagcagctgcggcatcggcgtgagaatcagaagcaagtggctgaaggagaagccctacaacggcggcagaccctgccccaagctggacctgaagaaccagaacgcccaggtgcacgaggccgtgccctgctacagcgagtgcaaccagtacagctgggtggtggagcactggagcagctgcaagatcaacaacgagctgagaagcctgagatgcggcggcggcacccagagcagaaagatcagatgcgtgaacaccgccgacggcgagggcggcgccgtggacagcaacctgtgcaaccaggacgagatcccccccgagacccagagctgcagcctgatgtgccccaacgagtgcgtgatgagcgagtggggcctgtggagcaagtgcccccagagctgcgacccccacaccatgcagagaagaaccagacacctgctgagacccagcctgaacagcagaacctgcgccgaggacagccaggtgcagccctgcctgctgaacgagaactgcttccagttccagtacaacctgaccgagtggagcacctgccagctgagcgagaacgccccctgcggccagggcgtgagaaccagactgctgagctgcgtgtgcagcgacggcaagcccgtgagcatggaccagtgcgagcagcacaacctggagaagccccagagaatgagcatcccctgcctggtggagtgcgtggtgaactgccagctgagcggctggaccgcctggaccgagtgcagccagacctgcggccacggcggcagaatgagcagaaccagattcatcatcatgcccacccagggcgagggcagaccctgccccaccgagctgacccaggagaagacctgccccgtgaccccctgctacagctgggtgctgggcaactggagcgcctgcaagctggagggcggcgactgcggcgagggcgtgcagatcagaagcctgagctgcatggtgcacagcggcagcatcagccacgccgccggcagagtggaggacgccctgtgcggcgagatgcccttccaggacagcatcctgaagcagctgtgcagcgtgccctgccccggcgactgccacctgaccgagtggagcgagtggagcacctgcgagctgacctgcatcgacggcagaagcttcgagaccgtgggcagacagagcagaagcagaaccttcatcatccagagcttcgagaaccaggacagctgcccccagcaggtgctggagaccagaccctgcaccggcggcaagtgctaccactacacctggaaggccagcctgtggaacaacaacgagagaaccgtgtggtgccagagaagcgacggcgtgaacgtgaccggcggctgcagcccccaggccagacccgccgccatcagacagtgcatccccgcctgcagaaagcccttcagctactgcacccagggcggcgtgtgcggctgcgagaagggctacaccgagatcatgaagagcaacggcttcctggactactgcatgaaggtgcccggcagcgaggacaagaaggccgacgtgaagaacctgagcggcaagaacagacccgtgaacagcaagatccacgacatcttcaagggctggagcctgcagcccctggaccccgacggcagagtgaagatctgggtgtacggcgtgagcggcggcgccttcctgatcatgatcttcctgatcttcaccagctacctggtgtgcaagaagcccaagccccaccagagcacccccccccagcagaagcccctgaccctggcctacgacggcgacctggacatgtag

SEQ ID NO: 25242 - DNA, 1002 bp, Artificial Sequence
  Description of Artificial Sequence: Synthetic coding sequence
atggtgagatgcatccagaagctgaacagaaccgtggtggccaacgagatctgcgagcacttcgccctgcagccccccaccgagcaggcctgcctgatcccctgccccagagactgcgtggtgagcgagttcctgccctggagcaactgcagcaagggctgcggcaagaagctgcagcacagaaccagagccgtgatcgccccccccctgttcggcggcctgcagtgccccaacctgaccgagagcagagcctgcgacgcccccatcagctgccccctgggcgaggaggagtacaccttcagcctgaaggtgggcccctggagcaagtgcagactgccccacctgaaggagatcaaccccagcggcagaaccgtgctggacttcaacagcgacagcaacgagagagtgaccttcaagcaccagagctacaaggcccaccaccacagcaagagctgggccatcgagatcggctaccagaccagacaggtgagctgcaccagaagcgacggccagaacgccatgctgagcctgtgcctgcaggacagcttccccctgaccgtgcagagctgcatcatgcccaaggactgcgagaccagccagtggagcagctggagcccctgcagcaagacctgcagaagcggcagcctgctgcccggcttcagaagcagaagcagaaacgtgaagcacatggccatcggcggcggcaaggagtgccccgagctgctggagaaggaggcctgcatcgtggagggcgagctgctgcagcagtgccccagatacagctggagaaccagcgagtggaaggagtgccagcaggtgttcggcaccatcaccaacgagctgtacggcgccagcgtgcagatggccctgatgagccaggaggccgcccccctgagacccgtgctgctgcccttcggcagcgccttccagcccgccgagaacctgagccccaccgtgcacagagtggagagcgtggtggtgagaagagccatccagagatag

SEQ ID NO: 25243 - DNA, 1062 bp, Artificial Sequence
  Description of Artificial Sequence: Synthetic coding sequence
atggccgcccccgcccagcagaccacccagcccggcggcggcaagagaaagggcaaggcccagtacgtgctggccaagagagccagaagatgcgacgccggcggccccagacagctggagcccggcctgcagggcatcctgatcacctgcaacatgaacgagagaaagtgcgtggaggaggcctacagcctgctgaacgagtacggcgacgacatgtacggccccgagaagttcaccgacaaggaccagcagcccagcggcagcgagggcgaggacgacgacgccgaggccgccctgaagaaggaggtgggcgacatcaaggccagcaccgagatgagactgagaagattccagagcgtggagagcggcgccaacaacgtggtgttcatcagaaccctgggcatcgagcccgagaagctggtgcaccacatcctgcaggacatgtacaagaccaagaagaagaagaccagagtgatcctgagaatgctgcccatcagcggcacctgcaaggccttcctggaggacatgaagaagtacgccgagaccttcctggagccctggttcaaggcccccaacaagggcaccttccagatcgtgtacaagagcagaaacaacagccacgtgaacagagaggaggtgatcagagagctggccggcatcgtgtgcaccctgaacagcgagaacaaggtggacctgaccaacccccagtacaccgtggtggtggagatcatcaaggccgtgtgctgcctgagcgtggtgaaggactacatgctgttcagaaagtacaacctgcaggaggtggtgaagagccccaaggaccccagccagctgaacagcaagcagggcaacggcaaggaggccaagctggagagcgccgacaagagcgaccagaacaacaccgccgagggcaagaacaaccagcaggtgcccgagaacaccgaggagctgggccagaccaagcccaccagcaacccccaggtggtgaacgagggcggcgccaagcccgagctggccagccaggccaccgagggcagcaagagcaacgagaacgacttcagctag

SEQ ID NO: 25244 - DNA, 1062 bp, Artificial Sequence; identical to SEQ ID NO: 25243
  Description of Artificial Sequence: Synthetic coding sequence

SEQ ID NO: 25245 - DNA, 1320 bp, Artificial Sequence
  Description of Artificial Sequence: Synthetic coding sequence
atggccgccatgctgcccctgctggacagcggctgcagcagagaggccggccaggaggccggcctgggcagagtgagcctgcaccccttccacgactgcagacccgccctgggccccggcgccgccagaaacgaggccagcagacccgccagaggcggcagaagaagctaccccaccagccccgtgagagccggcgacagaagaggcagacagcagcagagaagaaacgtgagcctgagcagccagttcgcccacaccatggccgcccccgcccagcagaccacccagcccggcggcggcaagagaaagggcaaggcccagtacgtgctggccaagagagccagaagatgcgacgccggcggccccagacagctggagcccggcctgcagggcatcctgatcacctgcaacatgaacgagagaaagtgcgtggaggaggcctacagcctgctgaacgagtacggcgacgacatgtacggccccgagaagttcaccgacaaggaccagcagcccagcggcagcgagggcgaggacgacgacgccgaggccgccctgaagaaggaggtgggcgacatcaaggccagcaccgagatgagactgagaagattccagagcgtggagagcggcgccaacaacgtggtgttcatcagaaccctgggcatcgagcccgagaagctggtgcaccacatcctgcaggacatgtacaagaccaagaagaagaagaccagagtgatcctgagaatgctgcccatcagcggcacctgcaaggccttcctggaggacatgaagaagtacgccgagaccttcctggagccctggttcaaggcccccaacaagggcaccttccagatcgtgtacaagagcagaaacaacagccacgtgaacagagaggaggtgatcagagagctggccggcatcgtgtgcaccctgaacagcgagaacaaggtggacctgaccaacccccagtacaccgtggtggtggagatcatcaaggccgtgtgctgcctgagcgtggtgaaggactacatgctgttcagaaagtacaacctgcaggaggtggtgaagagccccaaggaccccagccagctgaacagcaagcagggcaacggcaaggaggccaagctggagagcgccgacaagagcgaccagaacaacaccgccgagggcaagaacaaccagcaggtgcccgagaacaccgaggagctgggccagaccaagcccaccagcaacccccaggtggtgaacgagggcggcgccaagcccgagctggccagccaggccaccgagggcagcaagagcaacgagaacgacttcagctag

SEQ ID NO: 25246 - DNA, 1524 bp, Artificial Sequence
  Description of Artificial Sequence: Synthetic coding sequence
atgtgcgacatcgaggaggccaccaaccagctgctggacgtgaacctgcacgagaaccagaagagcgtgcaggtgaccgagagcgacctgggcagcgagagcgagctgctggtgaccatcggcgccaccgtgcccaccggcttcgagcagaccgccgccgacgaggtgagagagaagctgggcagcagctgcaagatcagcagagacagaggcaagatctacttcgtgatcagcgtggagagcctggcccaggtgcactgcctgagaagcgtggacaacctgttcgtggtggtgcaggagttccaggactaccagttcaagcagaccaaggaggaggtgctgaaggacttcgaggacctggccggcaagctgccctggagcaaccccctgaaggtgtggaagatcaacgccagcttcaagaagaagaaggccaagagaaagaagatcaaccagaacagcagcaaggagaagatcaacaacggccaggaggtgaagatcgaccagagaaacgtgaagaaggagttcaccagccacgccctggacagccacatcctggactactacgagaaccccgccatcaaggaggacgtgagcaccctgatcggcgacgacctggccagctgcaaggacgagaccgacgagagcagcaaggaggagaccgagccccaggtgctgaagttcagagtgacctgcaacagagccggcgagaagcactgcttcaccagcaacgaggccgccagagacttcggcggcgccgtgcaggactacttcaagtggaaggccgacatgaccaacttcgacgtggaggtgctgctgaacatccacgacaacgaggtgatcgtgggcatcgccctgaccgaggagagcctgcacagaagaaacatcacccacttcggccccaccaccctgagaagcaccctggcctacggcatgctgagactgtgcgaccccctgccctacgacatcatcgtggaccccatgtgcggcaccggcgccatccccatcgagggcgccaccgagtggagcgactgcttccacatcgccggcgacaacaaccccctggccgtgaacagagccgccaacaacatcgccagcctgctgaccaagagccagatcaaggagggcaagcccagctggggcctgcccatcgacgccgtgcagtgggacatctgcaacctgcccctgagaaccggcagcgtggacatcatcgtgaccgacctgcccttcggcaagagaatgggcagcaagaagagaaactggaacctgtaccccgcctgcctgagagagatgagcagagtgtgcacccccaccaccggcagagccgtgctgctgacccaggacaccaagtgcttcaccaaggccctgagcggcatgagacacgtgtggagaaaggtggacaccgtgtgggtgaacgtgggcggcctgagagccgccgtgtacgtgctgatcagaaccccccaggccttcgtgcaccccagcgagcaggacggcgagagaggcaccctgtggcagtgcaaggagtag

SEQ ID NO: 25247 - DNA, 126 bp, Artificial Sequence
  Description of Artificial Sequence: Synthetic coding sequence
atgtgcgacatcgaggaggccaccaaccagctgctggacgtgaacctgcacgagaaccagaagagcgtgcaggtgaccgagagcgacctgggcagcgagagcgagctgctggtgaccatcggctag

SEQ ID NO: 25248 - DNA, 372 bp, Artificial Sequence
  Description of Artificial Sequence: Synthetic coding sequence
atgtgcgacatcgaggaggccaccaaccagctgctggacgtgaacctgcacgagaaccagaagagcgtgcaggtgaccgagagcgacctgggcagcgagagcgagctgctggtgaccatcggcgccaccgtgcccaccggcttcgagcagaccgccgccgacgaggtgagagagaagctgggcagcagctgcaagatcagcagagacagaggcaagatctacttcgtgatcagcgtggagagcctggcccaggtgcactgcctgagaagcgtggacaacctgttcgtggtggtgcaggagttccaggactaccagttcaagcagaccaaggaggaggtgctgaaggacttcgaggacctggccggcaagtag

SEQ ID NO: 25249 - DNA, 1524 bp, Artificial Sequence; identical to SEQ ID NO: 25246
  Description of Artificial Sequence: Synthetic coding sequence

SEQ ID NO: 25250 - DNA, 1524 bp, Artificial Sequence; identical to SEQ ID NO: 25246
  Description of Artificial Sequence: Synthetic coding sequence

SEQ ID NO: 25251 - DNA, 1566 bp, Artificial Sequence; identical to SEQ ID NO: 23599
  Description of Artificial Sequence: Synthetic coding sequence

SEQ ID NO: 25252 - DNA, 1152 bp, Artificial Sequence
  Description of Artificial Sequence: Synthetic coding sequence
atgaccggcggcaccaacaagaccagcagcagcatcagcgagatcctggacaaggtgcaggaggacgccgaggacgtgctgttcagcctgggcttcggccaggaggaccacaaggacaccagcagaatccccgccagattcttcaccacccccagccaggccaagggcatcgacttccagctgttcctgaagagccaggtgagaagaatcgagatggaggacccctgcctgatgctggccagcagattcaagcaggtgcagaccctggccgtgaccgccgacgccttcttctgcctgtacagctacgtgagcaagacccccgtgcagaagttcacccccagccacatgttctggaactgcaaccaccccaccgacgtgcccagcatcagaatcctgagcagagagcccgagccccagagccccagagacagactgagaaaggccatcagcaagatgtgcctgtacacctgccccagagacagacccccccccccccacaacacccccaagagaaacagcctggaccaggtggtgctggaggtgatggacaaggtgaaggaggagaagcagttcctgcagcaggacagcgacctgggccagttcagccaggaggaccccgtgccccccgccgagggcaagaagctgcccaccagcccctacccctgcgtgttctgctgcgaggaggagacccagcagagaatgagcaccgtgctggcccccagccagaccctggacagcaaccccaaggtgccctgctgcacccacagcctgcccatcgaggacccccagtggagcaccgaccccgcccagatcagaagagagctgtgcagcctgcccgccaccaacaccgagacccaccccgccaaggacgagaccttctggaagagaaagagcagagccagaaagagcctgttccagaagaacctgatgggcagaaaggtgaagagcctggacctgagcatcacccagcagaagtggaagcagagcgtggacagacccgagctgagaagaagcctgagccagcagccccaggacaccttcgacctggaggaggtgcagagcaacagcgaggaggagcagagccagagcagatggcccagcagacccagacacccccaccaccaccagaccttcgccggcaaggacagctag

SEQ ID NO: 25253 - DNA, 249 bp, Artificial Sequence
  Description of Artificial Sequence: Synthetic coding sequence
atggaggccagcgtgctgagccccaccagctgggagaagagaagagcctggctgagacagagcagaaactggcagacccaggtgctggaggaggaggccgccgccgccctgcaggacgtgcccgaccccgagcccagcagcctggacgacgtgttccaggagggcaaccccatcaacaagatcgaggactggctgcaggactgcggctacagcgaggagggcttcagcgaggaggccggccagttctag

SEQ ID NO: 25254 - DNA, 147 bp, Artificial Sequence
  Description of Artificial Sequence: Synthetic coding sequence
atggaggccagcgtgctgagccccaccagctgggagaagagaagagcctggctgagacagagcagaaactggcagacccaggtgctggaggaggaggccgccgccgccctgcaggacgtgcccgaccccgagcccagcagcctgtag

SEQ ID NO: 25255 - DNA, 138 bp, Artificial Sequence
  Description of Artificial Sequence: Synthetic coding sequence
atgagcgacaagcccgacctgagcgaggtggagaagttcgacagaagcaagctgaagaagaccaacaccgaggagaagaacaccctgcccagcaaggagaccatccagcaggagaaggagtgcgtgcagaccagctag

SEQ ID NO: 25256 - DNA, 588 bp, Artificial Sequence
  Description of Artificial Sequence: Synthetic coding sequence
atgcccaacttcctgggcctgcacagagccagaagcttcaccgtgctgtgcttctggagcaccgccgacgtgctgaacgccagcggccccagaagacagtggcaccccctggccagctgcagcagctggagcagaccccagagccagggcagcacccccggcgtgctgtgcaagaccggcatgggcagagagcccatccccgagacccagtgccacttcgccaacagcatgtgcagcctgcacgtgagcgtgccctacttcggcaacagccccaacatcagcaacttcttcagatggagcctggccctgagccccagacagtggtgcgacctgggcagcctgcagccccccagccccagattcaagggcttcagctgcctgagcctgcccagcagctgggactacagaagagcccccagccccgccaacttctgcatcctggtggagatgggcttccaccacgtgggccaggccgacctggagctgctgaccagcgccgacctgcccaccagcgccagccagagcgccggcatcaccggcgtgagccaccacgcctggccccagaccctgagcctgctgctgtactag

SEQ ID NO: 25257 - DNA, 795 bp, Artificial Sequence
  Description of Artificial Sequence: Synthetic coding sequence
atggcccccaccggcctgctggtggccggcgccagcttcctggccttcagaggcctgcactggggcctgagaagactgcccacccccgagagcgccgccagagacagatggcagtggtggaacctgtgcgtgagcctggcccacagcctgctgagcggcaccggcgccctgctgggcctgagcctgtacccccagatggccgccgaccccatccacggccaccccagatgggccctggtgctggtggccgtgagcgtgggctacttcctggccgacggcgccgacctgctgtggaaccagaccctgggcaagacctgggacctgctgtgccaccacctggtggtggtgagctgcctgagcaccgccgtgctgagcggccactacgtgggcttcagcatggtgagcctgctgctggagctgaacagcgcctgcctgcacctgagaaagctgctgctgctgagcagacaggcccccagcctggccttcagcgtgaccagctgggccagcctggccaccctggccctgttcagactggtgcccctgggctggatgagcctgtggctgttcagacagcaccaccaggtgcccctggccctggtgaccctgggcggcatcggcctggtgaccgtgggcatcatgagcatcatcctgggcatcagaatcctggtgaacgacgtgctgcagagcagaccccacccccccagccccggccacgagaagaccagaggcaccagaaccagaagagacaacggccccgtgaccagcaacagcagcaccctgagcctgaaggactag

SEQ ID NO: 25258 - DNA, 3561 bp, Artificial Sequence
  Description of Artificial Sequence: Synthetic coding sequence
tgatgcgccgcccccgcccccctgaccagcgccgagagagagctgcagcagatcagaatcaacgaggtgaagaccgagatcagcgtggagagcaagcaccagaccctgcagggcctggccttccccctgcagcccgaggcccagagagccctgcagcagctgaagcagaagatggtgaactacatccagatgaagctggacctggagagagagaccatcgagctggtgcacaccgagcccaccgacgtggcccagctgcccagcagagtgcccagagacgccgccagataccacttcttcctgtacaagcacacccacgagggcgaccccctggagagcgtggtgttcatctacagcatgcccggctacaagtgcagcatcaaggagagaatgctgtacagcagctgcaagagcagactgctggacagcgtggagcaggacttccacctggagatcgccaagaagggcttctgcagaagcgccctgcaccccctgagcctgctggtgcaggccatcatgctggccatgaccctggccctgggcaccctgcccgccttcctgccctgcgagctgcagccccacggcctggtgaactgcaactggctgttcctgaagagcgtgccccacttcagcatggccgcccccagaggcaacgtgaccagcctgagcctgagcagcaacagaatccaccacctgcacgacagcgacttcgcccacctgcccagcctgagacacctgaacctgaagtggaactgcccccccgtgggcctgagccccatgcacttcccctgccacatgaccatcgagcccagcaccttcctggccgtgcccaccctggaggagctgaacctgagctacaacaacatcatgaccgtgcccgccctgcccaagagcctgatcagcctgagcctgagccacaccaacatcctgatgctggacagcgccagcctggccggcctgcacgccctgagattcctgttcatggacggcaactgctactacaagaacccctgcagacaggccctggaggtggcccccggcgccctgctgggcctgggcaacctgacccacctgagcctgaagtacaacaacctgaccgtggtgcccagaaacctgcccagcagcctggagtacctgctgctgagctacaacagaatcgtgaagctggcccccgaggacctggccaacctgaccgccctgagagtgctggacgtgggcggcaactgcagaagatgcgaccacgcccccaacccctgcatggagtgccccagacacttcccccagctgcaccccgacaccttcagccacctgagcagactggagggcctggtgctgaaggacagcagcctgagctggctgaacgccagctggttcagaggcctgggcaacctgagagtgctggacctgagcgagaacttcctgtacaagtgcatcaccaagaccaaggccttccagggcctgacccagctgagaaagctgaacctgagcttcaactaccagaagagagtgagcttcgcccacctgagcctggcccccagcttcggcagcctggtggccctgaaggagctggacatgcacggcatcttcttcagaagcctggacgagaccaccctgagacccctggccagactgcccatgctgcagaccctgagactgcagatgaacttcatcaaccaggcccagctgggcatcttcagagccttccccggcctgagatacgtggacctgagcgacaacagaatcagcggcgccagcgagctgaccgccaccatgggcgaggccgacggcggcgagaaggtgtggctgcagcccggcgacctggcccccgcccccgtggacacccccagcagcgaggacttcagacccaactgcagcaccctgaacttcaccctggacctgagcagaaacaacctggtgaccgtgcagcccgagatgttcgcccagctgagccacctgcagtgcctgagactgagccacaactgcatcagccaggccgtgaacggcagccagttcctgcccctgaccggcctgcaggtgctggacctgagccacaacaagctggacctgtaccacgagcacagcttcaccgagctgcccagactggaggccctggacctgagctacaacagccagcccttcggcatgcagggcgtgggccacaacttcagcttcgtggcccacctgagaaccctgagacacctgagcctggcccacaacaacatccacagccaggtgagccagcagctgtgcagcaccagcctgagagccctggacttcagcggcaacgccctgggccacatgtgggccgagggcgacctgtacctgcacttcttccagggcctgagcggcctgatctggctggacctgagccagaacagactgcacaccctgctgccccagaccctgagaaacctgcccaagagcctgcaggtgctgagactgagagacaactacctggccttcttcaagtggtggagcctgcacttcctgcccaagctggaggtgctggacctggccggcaaccagctgaaggccctgaccaacggcagcctgcccgccggcaccagactgagaagactggacgtgagctgcaacagcatcagcttcgtggcccccggcttcttcagcaaggccaaggagctgagagagctgaacctgagcgccaacgccctgaagaccgtggaccacagctggttcggccccctggccagcgccctgcagatcctggacgtgagcgccaaccccctgcactgcgcctgcggcgccgccttcatggacttcctgctggaggtgcaggccgccgtgcccggcctgcccagcagagtgaagtgcggcagccccggccagctgcagggcctgagcatcttcgcccaggacctgagactgtgcctggacgaggccctgagctgggactgcttcgccctgagcctgctggccgtggccctgggcctgggcgtgcccatgctgcaccacctgtgcggctgggacctgtggtactgcttccacctgtgcctggcctggctgccctggagaggcagacagagcggcagagacgaggacgccctgccctacgacgccttcgtggtgttcgacaagacccagagcgccgtggccgactgggtgtacaacgagctgagaggccagctggaggagtgcagaggcagatgggccctgagactgtgcctggaggagagagactggctgcccggcaagaccctgttcgagaacctgtgggccagcgtgtacggcagcagaaagaccctgttcgtgctggcccacaccgacagagtgagcggcctgctgagagccagcttcctgctggcccagcagagactgctggaggacagaaaggacgtggtggtgctggtgatcctgagccccgacggcagaagaagcagatacgtgagactgagacagagactgtgcagacagagcgtgctgctgtggccccaccagcccagcggccagagaagcttctgggcccagctgggcatggccctgaccagagacaaccaccacttctacaacagaaacttctgccagggccccaccgccgagtag

SEQ ID NO: 25259 - DNA, 1113 bp, Artificial Sequence
  Description of Artificial Sequence: Synthetic coding sequence
atggccggcgccgagaactggcccggccagcagctggagctggacgaggacgaggccagctgctgcagatggggcgcccagcacgccggcgccagagagctggccgccctgtacagccccggcaagagactgcaggagtggtgcagcgtgatcctgtgcttcagcctgatcgcccacaacctggtgcacctgctgctgctggccagatgggaggacacccccctggtgatcctgggcgtggtggccggcgccctgatcgccgacttcctgagcggcctggtgcactggggcgccgacacctggggcagcgtggagctgcccatcgtgggcaaggccttcatcagacccttcagagagcaccacatcgaccccaccgccatcaccagacacgacttcatcgagaccaacggcgacaactgcctggtgaccctgctgcccctgctgaacatggcctacaagttcagaacccacagccccgaggccctggagcagctgtacccctgggagtgcttcgtgttctgcctgatcatcttcggcaccttcaccaaccagatccacaagtggagccacacctacttcggcctgcccagatgggtgaccctgctgcaggactggcacgtgatcctgcccagaaagcaccacagaatccaccacgtgagcccccacgagacctacttctgcatcaccaccggcgtgaaggtgcccagaaacttcagactgctggaggagctggaggagggccagaagggcgtgggcgacggcaccgtgagctggggcctggaggacgacgaggacatgaccctgaccagatggaccggcatgatcatcggcccccccagaaccatctacgagaacagaatctacagcctgaagatcgagtgcggccccaagtaccccgaggccccccccttcgtgagattcgtgaccaagatcaacatgaacggcgtgaacagcagcaacggcgtggtggaccccagagccatcagcgtgctggccaagtggcagaacagctacagcatcaaggtggtgctgcaggagctgagaagactgatgatgagcaaggagaacatgaagctgccccagccccccgagggccagtgctacagcaactag

SEQ ID NO: 25260 - DNA, 978 bp, Artificial Sequence
  Description of Artificial Sequence: Synthetic coding sequence
atggcccacttcgtgcagggcaccagcagaatgatcgccgccgagagcagcaccgagcacaaggagtgcgccgagcccagcaccagaaagaacctgatgaacagcctggagcagaagatcagatgcctggagaagcagagaaaggagctgctggaggtgaaccagcagtgggaccagcagttcagaagcatgaaggagctgtacgagagaaaggtggccgagctgaagaccaagctggacgccgccgagagattcctgagcaccagagagaaggacccccaccagagacagagaaaggacgacagacagagagaggacgacagacagagagacctgaccagagacagactgcagagagaggagaaggagaaggagagactgaacgaggagctgcacgagctgaaggaggagaacaagctgctgaagggcaagaacaccctggccaacaaggagaaggagcactacgagtgcgagatcaagagactgaacaaggccctgcaggacgccctgaacatcaagtgcagcttcagcgaggactgcctgagaaagagcagagtggagttctgccacgaggagatgagaaccgagatggaggtgctgaagcagcaggtgcagatctacgaggaggacttcaagaaggagagaagcgacagagagagactgaaccaggagaaggaggagctgcagcagatcaacgagaccagccagagccagctgaacagactgaacagccagatcaaggcctgccagatggagaaggagaagctggagaagcagctgaagcagatgtactgccccccctgcaactgcggcctggtgttccacctgcaggacccctgggtgcccaccggccccggcgccgtgcagaagcagagagagcacccccccgactaccagtggtacgccctggaccagctgccccccgacgtgcagcacaaggccaacggcctgagcagcgtgaagaaggtgcacccctag

SEQ ID NO: 25261 - DNA, 978 bp, Artificial Sequence; identical to SEQ ID NO: 25260
  Description of Artificial Sequence: Synthetic coding sequence

SEQ ID NO: 25262 - DNA, 1110 bp, Artificial Sequence
  Description of Artificial Sequence: Synthetic coding sequence
atgaacaagaacgagaagcacgacgacaagctggtgatgttcaccaaccagagcgaggacagcgagagatgcgagagcatggagctggacaagaagatccaggacctgatcgagagaaacgccagcccccaccccaagagattcacccccgaggccatgcccacccacagaaacctgtgcagcctgaagacccccggcaagaccgccagcatggcccacttcgtgcagggcaccagcagaatgatcgccgccgagagcagcaccgagcacaaggagtgcgccgagcccagcaccagaaagaacctgatgaacagcctggagcagaagatcagatgcctggagaagcagagaaaggagctgctggaggtgaaccagcagtgggaccagcagttcagaagcatgaaggagctgtacgagagaaaggtggccgagctgaagaccaagctggacgccgccgagagattcctgagcaccagagagaaggacccccaccagagacagagaaaggacgacagacagagagaggacgacagacagagagacctgaccagagacagactgcagagagaggagaaggagaaggagagactgaacgaggagctgcacgagctgaaggaggagaacaagctgctgaagggcaagaacaccctggccaacaaggagaaggagcactacgagtgcgagatcaagagactgaacaaggccctgcaggacgccctgaacatcaagtgcagcttcagcgaggactgcctgagaaagagcagagtggagttctgccacgaggagatgagaaccgagatggaggtgctgaagcagcaggtgcagatctacgaggaggacttcaagaaggagagaagcgacagagagagactgaaccaggagaaggaggagctgcagcagatcaacgagaccagccagagccagctgaacagactgaacagccagatcaaggcctgccagatggagaaggagaagctggagaagcagctgaagcagatgtactgccccccctgcaactgcggcctggtgttccacctgcaggacccctgggtgcccaccggccccggcgccgtgcagaagcagagagagcaccccgtgtacccccagtag

SEQ ID NO: 25263 - DNA, 1029 bp, Artificial Sequence
  Description of Artificial Sequence: Synthetic coding sequence
atgagcgaggagagcgacagcctgagaaccagccccagcgtggccagcctgagcgagaacgagctgccccccccccccgagccccccggctacgtgtgcagcctgaccgaggacctggtgaccaaggccagagaggagctgcaggagaagcccgagtggagactgagagacgtgcaggccctgagagacatggtgagaaaggagtaccccaacctgagcaccagcctggacgacgccttcctgctgagattcctgagagccagaaagttcgactacgacagagccctgcagctgctggtgaactaccacagctgcagaagaagctggcccgaggtgttcaacaacctgaagcccagcgccctgaaggacgtgctggccagcggcttcctgaccgtgctgccccacaccgaccccagaggctgccacgtggtgtgcatcagacccgacagatggatccccagcaactaccccatcaccgagaacatcagagccatctacctgaccctggagaagctgatccagagcgaggagacccaggtgaacggcatcgtgatcctggccgactacaagggcgtgagcctgagcaaggccagccacttcggccccttcatcgccaagaaggtgatcggcatcctgcaggacggcttccccatcagaatcaaggccgtgcacgtggtgaacgagcccagaatcttcaagggcatcttcgccatcatcaagcccttcctgaaggagaagatcgccaacagattcttcctgcacggcagcgacctgaacagcctgcacaccaacctgcccagaagcatcctgcccaaggagtacggcggcaccgccggcgagctggacaccgccacctggaacgccgtgctgctggccagcgaggacgacttcgtgaaggagttctgccagcccgtgcccgcctgcgacagcatcctgggccagaccctgctgcccgagggcctgaccagcgacgcccagtgcgacgacagcctgagagccgtgaagagccagctgtacagctgctactag

SEQ ID NO: 25264 - DNA, 1029 bp, Artificial Sequence; identical to SEQ ID NO: 25263
  Description of Artificial Sequence: Synthetic coding sequence

SEQ ID NO: 25265 - DNA, 840 bp, Artificial Sequence
  Description of Artificial Sequence: Synthetic coding sequence
atgagcgaggagagcgacagcctgagaaccagccccagcgtggccagcctgagcgagaacgagctgccccccccccccgagccccccggctacgtgtgcagcctgaccgaggacctggtgaccaaggccagagaggagctgcaggagaagcccgagtggagactgagagacgtgcaggccctgagagacatggtgagaaaggagtaccccaacctgagcaccagcctggacgacgccttcctgctgagattcctgagagccagaaagttcgactacgacagagccctgcagctgctggtgaactaccacagctgcagaagaagctggcccgaggtgttcaacaacctgaagcccagcgccctgaaggacgtgctggccagcggcttcctgaccgtgctgccccacaccgaccccagaggctgccacgtggtgtgcatcagacccgacagatggatccccagcaactaccccatcaccgagaacatcagagccatctacctgaccctggagaagctgatccagagcgaggagacccaggacggcttccccatcagaatcaaggccgtgcacgtggtgaacgagcccagaatcttcaagggcatcttcgccatcatcaagcccttcctgaaggagaagatcgccaacagattcttcctgcacggcagcgacctgaacagcctgcacaccaacctgcccagaagcatcctgcccaaggagtacggcggcaccgccggcgagctggacaccgccacctggaacgccgtgctgctggccagcgaggacgacttcgtgaaggagttctgccagcccgtgcccgcctgcgacagcatcctgggctag

SEQ ID NO: 25266 - DNA, 309 bp, Artificial Sequence
  Description of Artificial Sequence: Synthetic coding sequence
atgagagccagcccctgcatcagccagcccgccgccagctggcaccccagacccagcgccctgagacccaccgccggcagcggccccgacaccagaacccccggcaccgtggaggacggcagcgccccctgccccgccttcagaagccccgccgtgagcccctgcggcgaggagccctgctgcttccagatcagccccgccgaggagaccctggagctgggcagactggtgagccccggctgccacaagagcagcgccccccaggagagaagactggaccccagagccagatgcgtggtgcacatctag

SEQ ID NO: 25267 - DNA, 375 bp, Artificial Sequence
  Description of Artificial Sequence: Synthetic coding sequence
atgagagccagcccctgcatcagccagcccgccgccagctggcaccccagacccagcgccctgagacccaccgccggcagcggccccgacaccagaacccccggcaccgtggaggacggcagcgccccctgccccgccttcagaagccccgccgtgagcccctgcggcgaggagccctgctgcttccagatcagccccgccgaggagaccctggagctgggcagactggtgagccccggcaactgcgacaccctgagccccagagccgccggcttctacgcctgccacgtgagaagcctgatcccctgcagaagcaccaagggcagatggcccctgaccgccagcgccgccggcctgagcagcttcagcggctag

SEQ ID NO: 25268 - DNA, 1131 bp, Artificial Sequence
  Description of Artificial Sequence: Synthetic coding sequence
atggacggcgaggagcagcagcccccccacgaggccaacgtggagcccgtggtgcccagcgaggccagcgagcccgtgcccagagtgctgagcggcgacccccagaacctgagcgacgtggacgccttcaacctgctgctggagatgaagctgaagagaagaagacagagacccaacctgcccagaaccgtgacccagctggtggccgaggacggcagcagagtgtacgtggtgggcaccgcccacttcagcgacgacagcaagagagacgtggtgaagaccatcagagaggtgcagcccgacgtggtggtggtggagctgtgccagtacagagtgagcatgctgaagatggacgagagcaccctgctgagagaggcccaggagctgagcctggagaagctgcagcaggccgtgagacagaacggcctgatgagcggcctgatgcagatgctgctgctgaaggtgagcgcccacatcaccgagcagctgggcatggcccccggcggcgagttcagagaggccttcaaggaggccagcaaggtgcccttctgcaagttccacctgggcgacagacccatccccgtgaccttcaagagagccatcgccgccctgagcttctggcagaaggtgagactggcctggggcctgtgcttcctgagcgaccccatcagcaaggacgacgtggagagatgcaagcagaaggacctgctggagcagatgatggccgagatgatcggcgagttccccgacctgcacagaaccatcgtgagcgagagagacgtgtacctgacctacatgctgagacaggccgccagaagactggagctgcccagagccagcgacgccgagcccagaaagtgcgtgcccagcgtggtggtgggcgtggtgggcatgggccacgtgcccggcatcgagaagaactggagcaccgacctgaacatccaggagatcatgaccgtgcccccccccagcgtgagcggcagagtgagcagactggccgtgaaggccgccttcttcggcctgctgggctacagcctgtactggatgggcagaagaaccgccagcctggtgctgagcctgcccgccgcccagtactgcctgcagagagtgaccgaggccagacacaagtag

SEQ ID NO: 25269 - DNA, 1131 bp, Artificial Sequence; identical to SEQ ID NO: 25268
  Description of Artificial Sequence: Synthetic coding sequence

SEQ ID NO: 25270 - DNA, 1131 bp, Artificial Sequence; identical to SEQ ID NO: 25268
  Description of Artificial Sequence: Synthetic coding sequence

SEQ ID NO: 25271 - DNA, 1554 bp, Artificial Sequence
  Description of Artificial Sequence: Synthetic coding sequence
atgcacgccgccctggccggccccctgctggccgccctgctggccaccgccagagccagaccccagccccccgacggcggccagtgcagaccccccggcagccagagagacctgaacagcttcctgtggaccatcagaagagacccccccgcctacctgttcggcaccatccacgtgccctacaccagagtgtgggacttcatccccgacaacagcaaggccgccttccaggccagcaccagagtgtacttcgagctggacctgaccgacccctacaccatcagcgccctggccagctgccagctgctgccccacggcgagaacctgcaggacgtgctgccccacgagctgtactggagactgaagagacacctggactacgtgaagctgatgatgcccagctggatgacccccgcccagagaggcaagggcctgtacgccgactacctgttcaacgccatcgccggcaactgggagagaaagagacccgtgtgggtgatgctgatggtgaacagcctgaccgagagagacgtgagattcagaggcgtgcccgtgctggacctgtacctggcccagcaggccgagaagatgaagaagaccaccggcgccgtggagcaggtggaggagcagtgccaccccctgaacaacggcctgaacttcagccaggtgctgttcgccctgaaccagaccctgctgcagcaggagagcgtgagagccggcagcctgcaggccagctacaccaccgaggacctgatcaagcactacaactgcggcgacctgagcgccgtgatcttcaaccacgacaccagccagctgcccaacttcatcaacaccaccctgcccccccacgagcaggtgaccgcccaggagatcgacagctacttcagacaggagctgatctacaagagaaacgagagaatgggcaagagagtgatggccctgctgagagagaacgaggacaagatctgcttcttcgccttcggcgccggccacttcctgggcaacaacaccgtgatcgacatcctgagacaggccggcctggaggtggaccacacccccgccggccaggccatccacagccccgccccccagagccccgcccccagccccgagggcaccagcaccagccccgcccccgtgacccccgccgccgccgtgcccgaggcccccagcgtgacccccaccgccccccccgaggacgaggaccccgccctgagcccccacctgctgctgcccgacagcctgagccagctggaggagttcggcagacagagaaagtggcacaagagacagagcacccaccagagacccagacagttcaacgacctgtgggtgagaatcgaggacagcaccaccgccagccccccccccctgcccctgcagcccacccacagcagcggcaccgccaagccccccttccagctgagcgaccagctgcagcagcaggacccccccggccccgccagcagcagcgcccccaccctgggcctgctgcccgccatcgccaccaccatcgccgtgtgcttcctgctgcacagcctgggccccagctag

SEQ ID NO: 25272 - DNA, 555 bp, Artificial Sequence
  Description of Artificial Sequence: Synthetic coding sequence
atgaccagcttcgaggacgccgacaccgaggagaccgtgacctgcctgcagatgaccgtgtaccaccccggccagctgcagtgcggcatcttccagagcatcagcttcaacagagagaagctgcccagcagcgaggtggtgaagttcggcagaaacagcaacatctgccactacaccttccaggacaagcaggtgagcagagtgcagttcagcctgcagctgttcaagaagttcaacagcagcgtgctgagcttcgagatcaagaacatgagcaagaagaccaacctgatcgtggacagcagagagctgggctacctgaacaagatggacctgccctacagatgcatggtgagattcggcgagtaccagttcctgatggagaaggaggacggcgagagcctggagttcttcgagacccagttcatcctgagccccagaagcctgctgcaggagaacaactggcccccccacagacccatccccgagtacggcacctacagcctgtgcagcagccagagcagcagccccaccgagatggacgagaacgagagctag

SEQ ID NO: 25273 - DNA, 255 bp, Artificial Sequence
  Description of Artificial Sequence: Synthetic coding sequence
atgaccagcttcgaggacgccgacaccgaggagaccgtgacctgcctgcagatgaccgtgtaccaccccggccagctgcagtgcggcatcttccagagcatcagcttcaacagagagaagctgcccagcagcgaggtggtgaagttcggcagaaacagcaacatctgccactacaccttccaggacaagcaggtgagcagagtgcagttcagcctgcagctgttcaagatccagcagctgagcagcctgctgtag

SEQ ID NO: 25274 - DNA, 555 bp, Artificial Sequence; identical to SEQ ID NO: 25272
  Description of Artificial Sequence: Synthetic coding sequence

SEQ ID NO: 25275 - DNA, 552 bp, Artificial Sequence
  Description of Artificial Sequence: Synthetic coding sequence
atggagaagccctacaacaagaacgagggcaacctggagaacgagggcaagcccgaggacgaggtggagcccgacgacgagggcaagagcgacgaggaggagaagcccgacgccgagggcaagaccgagtgcgagggcaagagaaaggccgagggcgagcccggcgacgagggccagctggaggacaagggcagccaggagaagcagggcaagagcgagggcgagggcaagccccagggcgagggcaagcccgccagccaggccaagcccgagggccagcccagagccgccgagaagagacccgccggcgactacgtgcccagaaaggccaagagaaagaccgacagaggcaccgacgacagccccaaggacagccaggaggacctgcaggagagacacctgagcagcgaggagatgatgagagagtgcggcgacgtgagcagagcccaggaggagctgagaaagaagcagaagatgggcggcttccactggatgcagagagacgtgcaggaccccttcgcccagggcgacaacggcgtgagcggcgagtag

SEQ ID NO: 25276 - DNA, 1641 bp, Artificial Sequence
  Description of Artificial Sequence: Synthetic coding sequence
atggccgccggcagcaccaccctgagagccgtgggcaagctgcaggtgagactggccaccaagaccgagcccaagaagctggagaagtacctgcagaagctgagcgccctgcccatgaccgccgacatcctggccgagaccggcatcagaaagaccgtgaagagactgagaaagcaccagcacgtgggcgacttcgccagagacctggccgccagatggaagaagctggtgctggtggacagaaacaccggccccgacccccaggaccccgaggagagcgccagcagacagagattcggcgaggccctgcaggagagagagaaggcctggggcttccccgagaacgccaccgcccccagaagccccagccacagccccgagcacagaagaaccgccagaagaaccccccccggccagcagagaccccaccccagaagccccagcagagagcccagagccgagagaaagagacccagaatggcccccgccgacagcggcccccacagagacccccccaccagaaccgcccccctgcccatgcccgagggccccgagcccgccgtgcccggcgagcagcccggcagaggccacgcccacgccgcccagggcggccccctgctgggccagggctgccagggccagccccagggcgaggccgtgggcagccacagcaagggccacaagagcagcagaggcgccagcgcccagaagagcccccccgtgcaggagagccagagcgagagactgcaggccgccgtggccgacagcgccggccccaagaccgtgcccagccacgtgttcagcgagctgtgggaccccagcgaggcctggatgcaggccaactacgacctgctgagcgccttcgaggccatgaccagccaggccaaccccgaggccctgagcgcccccaccctgcaggaggaggccgccttccccggcagaagagtgaacgccaagatgcccgtgtacagcggcagcagacccgcctgccagctgcaggtgcccaccctgagacagcagtgcctgagagtgcccagaaacaaccccgacgccctgggcgacgtggagggcgtgccctacagcgccctggagcccgtgctggagggctggacccccgaccagccctacagaaccgagaaggacaacgccgccctggccagagagaccgacgagctgtggagaatccactgcctgcaggacttcaaggaggagaagccccaggagcacgagagctggagagagctgtacctgagactgagagacgccagagagcagagactgagagtggtgaccaccaagatcagaagcgccagagagaacaagcccagcggcagacagaccaagatgatctgcttcaacagcgtggccaagaccccctacgacgccagcagaagacaggagaagagcgccggcgccgccgaccccggcaacggcgagatggagcccgcccccaagcccgccggcagcagccaggcccccagcggcctgggcgacggcgacggcggcagcgtgagcggcggcggcagcagcaacagacacgccgcccccgccgacaagaccagaaagcaggccgccaagaaggtggcccccctgatggccaaggccatcagagactacaagggcagattcagcagaagatag

SEQ ID NO: 25277 - DNA, 1761 bp, Artificial Sequence
  Description of Artificial Sequence: Synthetic coding sequence
atgcaggccggcgccagattccagagaagaagaagacagctgcagcagcagcagcccagaagaagacagcccctgctgtggcccatggacgccgagcccccccccccccccccctgggtgtggatggtgcccggcagcgccggcctgctgagactgagcgccggcgtggtggtgccccccgtgctgctggccagcgcccccccccccgccgcccccctgctgcccggcctgcccggctggcccgcccccagcgagcccgtgctgcccctgctgcccctgcccagcgcccccgacagcgccgccgccgccgccgcccaccccttccccgccctgcacggccagtggctgttcggcggccacagccccagcctgggcctgccccccagcagcaccgtggagctggtgcccgtgttcccccacctgtgccccagcgccctggccacccccatcggcaagagctggatcgacaagagaatccccaactgcaagatcttcttcaacaacagcttcgccctggacagcacctggatccaccccgaggagagcagattcttccacggccacgagaagcccagactgctggccaaccaggtggccgtgagcctgagcagacccgcccccgccagcagacccctgcccaccgtggtgctggccccccagcccatccccggcggctgccacaacagcctgaaggtgaccagcagccccgccatcgccatcgccaccgccgccgccgccgccatggtgagcgtggaccccgagaacctgagaggccccagccccagcagcgtgcagcccagacacttcctgaccctggcccccatcaagatccccctgagaaccagccccgtgagcgacaccagaaccgagagaggcagagtggccagaccccccgccctgatgctgagagcccagaagagcagagacggcgacaaggaggacaaggagcccccccccatgctgggcggcggcgaggacagcaccgccagaggcaacagacccgtggccagcacccccgtgcccggcagcccctggtgcgtggtgtggaccggcgacgacagagtgttcttcttcaaccccaccatgcacctgagcgtgtgggagaagcccatggacctgaaggacagaggcgacctgaacagaatcatcgaggaccccccccacaagagaaagctggaggcccccgccaccgacaacagcgacggcagcagcagcgaggacaacagagaggaccaggacgtgaagaccaagagaaacagaaccgagggctgcggcagccccaagcccgaggaggccaagagagaggacaagggcaccagaaccccccccccccagatcctgctgcccctggaggagagagtgacccacttcagagacatgctgctggagagaggcgtgagcgccttcagcacctgggagaaggagctgcacaagatcgtgttcgaccccagatacctgctgctgaacagcgaggagagaaagcagatcttcgagcagttcgtgaagaccagaatcaaggaggagtacaaggagaagaagagcaagctgctgctggccaaggaggagttcaagaagctgctggaggagagcaaggtgagccccagaaccaccttcaaggagttcgccgagaagtacggcagagaccagagattcagactggtgcagaagagaaaggaccaggagcacttcttcaaccagttcatcctgatcctgaagaagagagacaaggagaacagactgagactgagaaagatgagatag

SEQ ID NO: 25278 - DNA, 504 bp, Artificial Sequence
  Description of Artificial Sequence: Synthetic coding sequence
atggacagaggcagacccgccggcagccccctgagcgccagcgccgagcccgcccccctggccgccgccatcagagacagcagacccggcagaaccggccccggccccgccggccccggcggcggcagcagaagcggcagcggcagacccgccgccgccaacgccgccagagagagaagcagagtgcagaccctgagacacgccttcctggagctgcagagaaccctgcccagcgtgccccccgacaccaagctgagcaagctggacgtgctgctgctggccaccacctacatcgcccacctgaccagaagcctgcaggacgacgccgaggcccccgccgacgccggcctgggcgccctgagaggcgacggctacctgcaccccgtgaagaagtggcccatgagaagcagactgtacatcggcgccaccggccagttcctgaagcacagcgtgagcggcgagaagaccaaccacgacaacacccccaccgacagccagccctag

SEQ ID NO: 25279 - DNA, 11580 bp, Artificial Sequence
  Description of Artificial Sequence: Synthetic coding sequence
atggccttcgtggccacccagggcgccaccgtggtggaccagaccaccctgatgaagaagtacctgcagttcgtggccgccctgaccgacgtgaacacccccgacgagaccaagctgaagatgatgcaggaggtgagcgagaacttcgagaacgtgaccagcagcccccagtacagcaccttcctggagcacatcatccccagattcctgaccttcctgcaggacggcgaggtgcagttcctgcaggagaagcccgcccagcagctgagaaagctggtgctggagatcatccacagaatccccaccaacgagcacctgagaccccacaccaagaacgtgctgagcgtgatgttcagattcctggagaccgagaacgaggagaacgtgctgatctgcctgagaatcatcatcgagctgcacaagcagttcagaccccccatcacccaggagatccaccacttcctggacttcgtgaagcagatctacaaggagctgcccaaggtggtgaacagatacttcgagaacccccaggtgatccccgagaacaccgtgcccccccccgagatggtgggcatgatcaccaccatcgccgtgaaggtgaaccccgagagagaggacagcgagaccagaacccacagcatcatccccagaggcagcctgagcctgaaggtgctggccgagctgcccatcatcgtggtgctgatgtaccagctgtacaagctgaacatccacaacgtggtggccgagttcgtgcccctgatcatgaacaccatcgccatccaggtgagcgcccaggccagacagcacaagctgtacaacaaggagctgtacgccgacttcatcgccgcccagatcaagaccctgagcttcctggcctacatcatcagaatctaccaggagctggtgaccaagtacagccagcagatggtgaagggcatgctgcagctgctgagcaactgccccgccgagaccgcccacctgagaaaggagctgctgatcgccgccaagcacatcctgaccaccgagctgagaaaccagttcatcccctgcatggacaagctgttcgacgagagcatcctgatcggcagcggctacaccgccagagagaccctgagacccctggcctacagcaccctggccgacctggtgcaccacgtgagacagcacctgcccctgagcgacctgagcctggccgtgcagctgttcgccaagaacatcgacgacgagagcctgcccagcagcatccagaccatgagctgcaagctgctgctgaacctggtggactgcatcagaagcaagagcgagcaggagagcggcaacggcagagacgtgctgatgagaatgctggaggtgttcgtgctgaagttccacaccatcgccagataccagctgagcgccatcttcaagaagtgcaagccccagagcgagctgggcgccgtggaggccgccctgcccggcgtgcccaccgcccccgccgcccccggccccgcccccagccccgcccccgtgcccgccccccccccccccccccccccccccccccccgccacccccgtgacccccgcccccgtgccccccttcgagaagcagggcgagaaggacaaggaggacaagcagaccttccaggtgaccgactgcagaagcctggtgaagaccctggtgtgcggcgtgaagaccatcacctggggcatcaccagctgcaaggcccccggcgaggcccagttcatccccaacaagcagctgcagcccaaggagacccagatctacatcaagctggtgaagtacgccatgcaggccctggacatctaccaggtgcagatcgccggcaacggccagacctacatcagagtggccaactgccagaccgtgagaatgaaggaggagaaggaggtgctggagcacttcgccggcgtgttcaccatgatgaaccccctgaccttcaaggagatcttccagaccaccgtgccctacatggtggagagaatcagcaagaactacgccctgcagatcgtggccaacagcttcctggccaaccccaccaccagcgccctgttcgccaccatcctggtggagtacctgctggacagactgcccgagatgggcagcaacgtggagctgagcaacctgtacctgaagctgttcaagctggtgttcggcagcgtgagcctgttcgccgccgagaacgagcagatgctgaagccccacctgcacaagatcgtgaacagcagcatggagctggcccagaccgccaaggagccctacaactacttcctgctgctgagagccctgttcagaagcatcggcggcggcagccacgacctgctgtaccaggagttcctgcccctgctgcccaacctgctgcagggcctgaacatgctgcagagcggcctgcacaagcagcacatgaaggacctgttcgtggagctgtgcctgaccgtgcccgtgagactgagcagcctgctgccctacctgcccatgctgatggaccccctggtgagcgccctgaacggcagccagaccctggtgagccagggcctgagaaccctggagctgtgcgtggacaacctgcagcccgacttcctgtacgaccacatccagcccgtgagagccgagctgatgcaggccctgtggagaaccctgagaaaccccgccgacagcatcagccacgtggcctacagagtgctgggcaagttcggcggcagcaacagaaagatgctgaaggagagccagaagctgcactacgtggtgaccgaggtgcagggccccagcatcaccgtggagttcagcgactgcaaggccagcctgcagctgcccatggagaaggccatcgagaccgccctggactgcctgaagagcgccaacaccgagccctactacagaagacaggcctgggaggtgatcaagtgcttcctggtggccatgatgagcctggaggacaacaagcacgccctgtaccagctgctggcccaccccaacttcaccgagaagaccatccccaacgtgatcatcagccacagatacaaggcccaggacacccccgccagaaagaccttcgagcaggccctgaccggcgccttcatgagcgccgtgatcaaggacctgagacccagcgccctgcccttcgtggccagcctgatcagacactacaccatggtggccgtggcccagcagtgcggccccttcctgctgccctgctaccaggtgggcagccagcccagcaccgccatgttccacagcgaggagaacggcagcaagggcatggaccccctggtgctgatcgacgccatcgccatctgcatggcctacgaggagaaggagctgtgcaagatcggcgaggtggccctggccgtgatcttcgacgtggccagcatcatcctgggcagcaaggagagagcctgccagctgcccctgttcagctacatcgtggagagactgtgcgcctgctgctacgagcaggcctggtacgccaagctgggcggcgtggtgagcatcaagttcctgatggagagactgcccctgacctgggtgctgcagaaccagcagaccttcctgaaggccctgctgttcgtgatgatggacctgaccggcgaggtgagcaacggcgccgtggccatggccaagaccaccctggagcagctgctgatgagatgcgccacccccctgaaggacgaggagagagccgaggagatcgtggccgcccaggagaagagcttccaccacgtgacccacgacctggtgagagaggtgaccagccccaacagcaccgtgagaaagcaggccatgcacagcctgcaggtgctggcccaggtgaccggcaagagcgtgaccgtgatcatggagccccacaaggaggtgctgcaggacatggtgccccccaagaagcacctgctgagacaccagcccgccaacgcccagatcggcctgatggagggcaacaccttctgcaccaccctgcagcccagactgttcaccatggacctgaacgtggtggagcacaaggtgttctacaccgagctgctgaacctgtgcgaggccgaggacagcgccctgaccaagctgccctgctacaagagcctgcccagcctggtgcccctgagaatcgccgccctgaacgccctggccgcctgcaactacctgccccagagcagagagaagatcatcgccgccctgttcaaggccctgaacagcaccaacagcgagctgcaggaggccggcgaggcctgcatgagaaagttcctggagggcgccaccatcgaggtggaccagatccacacccacatgagacccctgctgatgatgctgggcgactacagaagcctgaccctgaacgtggtgaacagactgaccagcgtgaccagactgttccccaacagcttcaacgacaagttctgcgaccagatgatgcagcacctgagaaagtggatggaggtggtggtgatcacccacaagggcggccagagaagcgacggcaacgagagcatcagcgagtgcggcagatgccccctgagccccttctgccagttcgaggagatgaagatctgcagcgccatcatcaacctgttccacctgatccccgccgccccccagaccctggtgaagcccctgctggaggtggtgatgaagaccgagagagccatgctgatcgaggccggcagccccttcagagagcccctgatcaagttcctgaccagacaccccagccagaccgtggagctgttcatgatggaggccaccctgaacgacccccagtggagcagaatgttcatgagcttcctgaagcacaaggacgccagacccctgagagacgtgctggccgccaaccccaacagattcatcaccctgctgctgcccggcggcgcccagaccgccgtgagacccggcagccccagcaccagcaccatgagactggacctgcagttccaggccatcaagatcatcagcatcatcgtgaagaacgacgacagctggctggccagccagcacagcctggtgagccagctgagaagagtgtgggtgagcgagaacttccaggagagacacagaaaggagaacatggccgccaccaactggaaggagcccaagctgctggcctactgcctgctgaactactgcaagagaaactacggcgacatcgagctgctgttccagctgctgagagccttcaccggcagattcctgtgcaacatgaccttcctgaaggagtacatggaggaggagatccccaagaactacagcatcgcccagaagagagccctgttcttcagattcgtggacttcaacgaccccaacttcggcgacgagctgaaggccaaggtgctgcagcacatcctgaaccccgccttcctgtacagcttcgagaagggcgagggcgagcagctgctgggcccccccaaccccgagggcgacaaccccgagagcatcaccagcgtgttcatcaccaaggtgctggaccccgagaagcaggccgacatgctggacagcctgagaatctacctgctgcagtacgccaccctgctggtggagcacgccccccaccacatccacgacaacaacaagaacagaaacagcaagctgagaagactgatgaccttcgcctggccctgcctgctgagcaaggcctgcgtggaccccgcctgcaagtacagcggccacctgctgctggcccacatcatcgccaagttcgccatccacaagaagatcgtgctgcaggtgttccacagcctgctgaaggcccacgccatggaggccagagccatcgtgagacaggccatggccatcctgacccccgccgtgcccgccagaatggaggacggccaccagatgctgacccactggaccagaaagatcatcgtggaggagggccacaccgtgccccagctggtgcacatcctgcacctgatcgtgcagcacttcaaggtgtactaccccgtgagacaccacctggtgcagcacatggtgagcgccatgcagagactgggcttcacccccagcgtgaccatcgagcagagaagactggccgtggacctgagcgaggtggtgatcaagtgggagctgcagagaatcaaggaccagcagcccgacagcgacatggaccccaacagcagcggcgagggcgtgaacagcgtgagcagcagcatcaagagaggcctgagcgtggacagcgcccaggaggtgaagagattcagaaccgccaccggcgccatcagcgccgtgttcggcagaagccagagcctgcccggcgccgacagcctgctggccaagcccatcgacaagcagcacaccgacaccgtggtgaacttcctgatcagagtggcctgccaggtgaacgacaacaccaacaccgccggcagccccggcgaggtgctgagcagaagatgcgtgaacctgctgaagaccgccctgagacccgacatgtggcccaagagcgagctgaagctgcagtggttcgacaagctgctgatgaccgtggagcagcccaaccaggtgaactacggcaacatctgcaccggcctggaggtgctgagcttcctgctgaccgtgctgcagagccccgccatcctgagcagcttcaagcccctgcagagaggcatcgccgcctgcatgacctgcggcaacaccaaggtgctgagagccgtgcacagcctgctgagcagactgatgagcatcttccccaccgagcccagcaccagcagcgtggccagcaagtacgaggagctggagtgcctgtacgccgccgtgggcaaggtgatctacgagggcctgaccaactacgagaaggccaccaacgccaaccccagccagctgttcggcaccctgatgatcctgaagagcgcctgcagcaacaaccccagctacatcgacagactgatcagcgtgttcatgagaagcctgcagaagatggtgagagagcacctgaacccccaggccgccagcggcagcaccgaggccaccagcggcaccagcgagctggtgatgctgagcctggagctggtgaagaccagactggccgtgatgagcatggagatgagaaagaacttcatccaggccatcctgaccagcctgatcgagaagagccccgacgccaagatcctgagagccgtggtgaagatcgtggaggagtgggtgaagaacaacagccccatggccgccaaccagacccccaccctgagagagaagagcatcctgctggtgaagatgatgacctacatcgagaagagattccccgaggacctggagctgaacgcccagttcctggacctggtgaactacgtgtacagagacgagaccctgagcggcagcgagctgaccgccaagctggagcccgccttcctgagcggcctgagatgcgcccagcccctgatcagagccaagttcttcgaggtgttcgacaacagcatgaagagaagagtgtacgagagactgctgtacgtgacctgcagccagaactgggaggccatgggcaaccacttctggatcaagcagtgcatcgagctgctgctggccgtgtgcgagaagagcacccccatcggcaccagctgccagggcgccatgctgcccagcatcaccaacgtgatcaacctggccgacagccacgacagagccgccttcgccatggtgacccacgtgaagcaggagcccagagagagagagaacagcgagagcaaggaggaggacgtggagatcgacatcgagctggcccccggcgaccagaccagcacccccaagaccaaggagctgagcgagaaggacatcggcaaccagctgcacatgctgaccaacagacacgacaagttcctggacaccctgagagaggtgaagaccggcgccctgctgagcgccttcgtgcagctgtgccacatcagcaccaccctggccgagaagacctgggtgcagctgttccccagactgtggaagatcctgagcgacagacagcagcacgccctggccggcgagatcagccccttcctgtgcagcggcagccaccaggtgcagagagactgccagcccagcgccctgaactgcttcgtggaggccatgagccagtgcgtgccccccatccccatcagaccctgcgtgctgaagtacctgggcaagacccacaacctgtggttcagaagcaccctgatgctggagcaccaggccttcgagaagggcctgagcctgcagatcaagcccaagcagaccaccgagttctacgagcaggagagcatcacccccccccagcaggagatcctggacagcctggccgagctgtacagcctgctgcaggaggaggacatgtgggccggcctgtggcagaagagatgcaagtacagcgagaccgccaccgccatcgcctacgagcagcacggcttcttcgagcaggcccaggagagctacgagaaggccatggacaaggccaagaaggagcacgagagaagcaacgccagccccgccatcttccccgagtaccagctgtgggaggaccactggatcagatgcagcaaggagctgaaccagtgggaggccctgaccgagtacggccagagcaagggccacatcaacccctacctggtgctggagtgcgcctggagagtgagcaactggaccgccatgaaggaggccctggtgcaggtggaggtgagctgccccaaggagatggcctggaaggtgaacatgtacagaggctacctggccatctgccaccccgaggagcagcagctgagcttcatcgagagactggtggagatggccagcagcctggccatcagagagtggagaagactgccccacgtggtgagccacgtgcacacccccctgctgcaggccgcccagcagatcatcgagctgcaggaggccgcccagatcaacgccggcctgcagcccaccaacctgggcagaaacaacagcctgcacgacatgaagaccgtggtgaagacctggagaaacagactgcccatcgtgagcgacgacctgagccactggagcagcatcttcatgtggagacagcaccactaccagggcaagcccacctggagcggcatgcacagcagcagcatcgtgaccgcctacgagaacagcagccagcacgaccccagcagcaacaacgccatgctgggcgtgcacgccagcgccagcgccatcatccagtacggcaagatcgccagaaagcagggcctggtgaacgtggccctggacatcctgagcagaatccacaccatccccaccgtgcccatcgtggactgcttccagaagatcagacagcaggtgaagtgctacctgcagctggccggcgtgatgggcaagaacgagtgcatgcagggcctggaggtgatcgagagcaccaacctgaagtacttcaccaaggagatgaccgccgagttctacgccctgaagggcatgttcctggcccagatcaacaagagcgaggaggccaacaaggccttcagcgccgccgtgcagatgcacgacgtgctggtgaaggcctgggccatgtggggcgactacctggagaacatcttcgtgaaggagagacagctgcacctgggcgtgagcgccatcacctgctacctgcacgcctgcagacaccagaacgagagcaagagcagaaagtacctggccaaggtgctgtggctgctgagcttcgacgacgacaagaacaccctggccgacgccgtggacaagtactgcatcggcgtgccccccatccagtggctggcctggatcccccagctgctgacctgcctggtgggcagcgagggcaagctgctgctgaacctgatcagccaggtgggcagagtgtacccccaggccgtgtacttccccatcagaaccctgtacctgaccctgaagatcgagcagagagagagatacaagagcgaccccggccccatcagagccaccgcccccatgtggagatgcagcagaatcatgcacatgcagagagagctgcaccccaccctgctgagcagcctggagggcatcgtggaccagatggtgtggttcagagagaactggcacgaggaggtgctgagacagctgcagcagggcctggccaagtgctacagcgtggccttcgagaagagcggcgccgtgagcgacgccaagatcaccccccacaccctgaacttcgtgaagaagctggtgagcaccttcggcgtgggcctggagaacgtgagcaacgtgagcaccatgttcagcagcgccgccagcgagagcctggccagaagagcccaggccaccgcccaggaccccgtgttccagaagctgaagggccagttcaccaccgacttcgacttcagcgtgcccggcagcatgaagctgcacaacctgatcagcaagctgaagaagtggatcaagatcctggaggccaagaccaagcagctgcccaagttcttcctgatcgaggagaagtgcagattcctgagcaacttcagcgcccagaccgccgaggtggagatccccggcgagttcctgatgcccaagcccacccactactacatcaagatcgccagattcatgcccagagtggagatcgtgcagaagcacaacaccgccgccagaagactgtacatcagaggccacaacggcaagatctacccctacctggtgatgaacgacgcctgcctgaccgagagcagaagagaggagagagtgctgcagctgctgagactgctgaacccctgcctggagaagagaaaggagaccaccaagagacacctgttcttcaccgtgcccagagtggtggccgtgagcccccagatgagactggtggaggacaaccccagcagcctgagcctggtggagatctacaagcagagatgcgccaagaagggcatcgagcacgacaaccccatcagcagatactacgacagactggccaccgtgcaggccagaggcacccaggccagccaccaggtgctgagagacatcctgaaggaggtgcagagcaacatggtgcccagaagcatgctgaaggagtgggccctgcacaccttccccaacgccaccgactactggaccttcagaaagatgttcaccatccagctggccctgatcggcttcgccgagttcgtgctgcacctgaacagactgaaccccgagatgctgcagatcgcccaggacaccggcaagctgaacgtggcctacttcagattcgacatcaacgacgccaccggcgacctggacgccaacagacccgtgcccttcagactgacccccaacatcagcgagttcctgaccaccatcggcgtgagcggccccctgaccgccagcatgatcgccgtggccagatgcttcgcccagcccaacttcaaggtggacggcatcctgaagaccgtgctgagagacgagatcatcgcctggcacaagaagacccaggaggacaccagcagccccctgagcgccgccggccagcccgagaacatggacagccagcagctggtgagcctggtgcagaaggccgtgaccgccatcatgaccagactgcacaacctggcccagttcgagggcggcgagagcaaggtgaacaccctggtggccgccgccaacagcctggacaacctgtgcagaatggaccccgcctggcacccctggctgtag

SEQ ID NO: 25280 - DNA, 951 bp, Artificial Sequence
  Description of Artificial Sequence: Synthetic coding sequence
atgggcgagagcgccgccgccaccgccagcctgttccagagaagaagaagaggcagaggcggcagagtgaccttccccggcggcctgaagggcagcgccagattcctgagcttcggcccccccttccccgccccccccgccccccccttccccgccgcccccggcccctggctgagaagacccctgttcagcctgaagctgagcgacaccgaggacgtgttccccagaagagccggccccctggaggtgcccgccgacagcagagtgttcgtgcaggccgccctggccagacccagccccagatggggcctggccctgcacagatgcagcgtgacccccagcagcagacccgcccccggccccgccctggccctgctgagagagggctgccccgccgacaccagcgtggccttcccccccccccccccccccagccccggcgccgccagacccgccagattcagcttcagactgagacccgtgttcaacgccagcgtgcagttcctgcactgccagctgagcagatgcagaagactgagaggcgtgagaagagcccccgcccccctgacccccccccccccccccccccccagcagatgcctgccccaggacgaggcctgcgccgacaccggcagcggcagcgccgagggcctggccgccgacggcccccacctgcacaccctgacccagcccatcgtggtgaccgtgcccagacccccccccagaccccccaagagcgtgcccggcagagccgtgagacccgagccccccgcccccgcccccgccgccctggagcccgcccccgtggtggccctggtgctggccgccttcgtgctgggcgccgccctggccgccggcctgggcctggtgtgcgcccacagcgccccccacgcccccggcccccccgccagagccagccccagcggcccccagcccagaagaagccagtag

SEQ ID NO: 25281 - DNA, 600 bp, Artificial Sequence
  Description of Artificial Sequence: Synthetic coding sequence
atggccaacagaggccccagctacggcctgagcagagaggtgcaggagaagatcgagcagaagtacgacgccgacctggagaacaagctggtggactggatcatcctgcagtgcgccgaggacatcgagcaccccccccccggcagagcccacttccagaagtggctgatggacggcaccgtgctgtgcaagctgatcaacagcctgtacccccccggccaggagcccatccccaagatcagcgagagcaagatggccttcaagcagatggagcagatcagccagttcctgaaggccgccgagacctacggcgtgagaaccaccgacatcttccagaccgtggacctgtgggagggcaaggacatggccgccgtgcagagaaccctgatggccctgggcagcgtggccgtgaccaaggacgacggctgctacagaggcgagcccagctggttccacagaaaggcccagcagaacagaagaggcttcagcgaggagcagctgagacagggccagaacgtgatcggcctgcagatgggcagcaacaagggcgccagccaggccggcatgaccggctacggcatgcccagacagatcatgtag

SEQ ID NO: 25282 - DNA, 600 bp, Artificial Sequence; identical to SEQ ID NO: 25281
  Description of Artificial Sequence: Synthetic coding sequence

SEQ ID NO: 25283 - DNA, 600 bp, Artificial Sequence; identical to SEQ ID NO: 25281
  Description of Artificial Sequence: Synthetic coding sequence

SEQ ID NO: 25284 - DNA, 600 bp, Artificial Sequence; identical to SEQ ID NO: 25281
  Description of Artificial Sequence: Synthetic coding sequence

SEQ ID NO: 25285 - DNA, 666 bp, Artificial Sequence
  Description of Artificial Sequence: Synthetic coding sequence
atggccaacagaggccccagctacggcctgagcagagaggtgcaggagaagatcgagcagaagtacgacgccgacctggagaacaagctggtggactggatcatcctgcagtgcgccgaggacatcgagcaccccccccccggcagagcccacttccagaagtggctgatggacggcaccgtgctgtgcaagctgatcaacagcctgtacccccccggccaggagcccatccccaagatcagcgagagcaagatggccttcaagcagatggagcagatcagccagttcctgaaggccgccgagacctacggcgtgagaaccaccgacatcttccagaccgtggacctgtgggagggcaaggacatggccgccgtgcagagaaccctgatggccctgggcagcgtggccgtgaccaaggacgacggctgctacagaggcgagcccagctggttccacagaaaggcccagcagaacagaagaggcttcagcgaggagcagctgagacagggccagaacgtgatcggcctgcagatgggcagcaacaagggcgccagccaggccggcatgaccggctacggcatgcccggcagaagctgcagaaccagacacctgcccctggtggagagaaccaacgtgccccaccacggcctgtacgagaagaagtag

SEQ ID NO: 25286 - DNA, 2520 bp, Artificial Sequence
  Description of Artificial Sequence: Synthetic coding sequence
atgaagaagtggagcagcaccgacctgggcgccgccgccgaccccctgcagaaggacacctgccccgaccccctggacggcgaccccaacagcagacccccccccgccaagccccagctgagcaccgccaagagcagaaccagactgttcggcaagggcgacagcgaggaggccttccccgtggactgcccccacgaggagggcgagctggacagctgccccaccatcaccgtgagccccgtgatcaccatccagagacccggcgacggccccaccggcgccagactgctgagccaggacagcgtggccgccagcaccgagaagaccctgagactgtacgacagaagaagcatcttcgaggccgtggcccagaacaactgccaggacctggagagcctgctgctgttcctgcagaagagcaagaagcacctgaccgacaacgagttcaaggaccccgagaccggcaagacctgcctgctgaaggccatgctgaacctgcacgacggccagaacaccaccatccccctgctgctggagatcgccagacagaccgacagcctgaaggagctggtgaacgccagctacaccgacagctactacaagggccagaccgccctgcacatcgccatcgagagaagaaacatggccctggtgaccctgctggtggagaacggcgccgacgtgcaggccgccgcccacggcgacttcttcaagaagaccaagggcagacccggcttctacttcggcgagctgcccctgagcctggccgcctgcaccaaccagctgggcatcgtgaagttcctgctgcagaacagctggcagaccgccgacatcagcgccagagacagcgtgggcaacaccgtgctgcacgccctggtggaggtggccgacaacaccgccgacaacaccaagttcgtgaccagcatgtacaacgagatcctgatgctgggcgccaagctgcaccccaccctgaagctggaggagctgaccaacaagaagggcatgacccccctggccctggccgccggcaccggcaagatcggcgtgctggcctacatcctgcagagagagatccaggagcccgagtgcagacacctgagcagaaagttcaccgagtgggcctacggccccgtgcacagcagcctgtacgacctgagctgcatcgacacctgcgagaagaacagcgtgctggaggtgatcgcctacagcagcagcgagacccccaacagacacgacatgctgctggtggagcccctgaacagactgctgcaggacaagtgggacagattcgtgaagagaatcttctacttcaacttcctggtgtactgcctgtacatgatcatcttcaccatggccgcctactacagacccgtggacggcctgccccccttcaagatggagaagaccggcgactacttcagagtgaccggcgagatcctgagcgtgctgggcggcgtgtacttcttcttcagaggcatccagtacttcctgcagagaagacccagcatgaagaccctgttcgtggacagctacagcgagatgctgttcttcctgcagagcctgttcatgctggccaccgtggtgctgtacttcagccacctgaaggagtacgtggccagcatggtgttcagcctggccctgggctggaccaacatgctgtactacaccagaggcttccagcagatgggcatctacgccgtgatgatcgagaagatgatcctgagagacctgtgcagattcatgttcgtgtacatcgtgttcctgttcggcttcagcaccgccgtggtgaccctgatcgaggacggcaagaacgacagcctgcccagcgagagcaccagccacagatggagaggccccgcctgcagaccccccgacagcagctacaacagcctgtacagcacctgcctggagctgttcaagttcaccatcggcatgggcgacctggagttcaccgagaactacgacttcaaggccgtgttcatcatcctgctgctggcctacgtgatcctgacctacatcctgctgctgaacatgctgatcgccctgatgggcgagaccgtgaacaagatcgcccaggagagcaagaacatctggaagctgcagagagccatcaccatcctggacaccgagaagagcttcctgaagtgcatgagaaaggccttcagaagcggcaagctgctgcaggtgggctacacccccgacggcaaggacgactacagatggtgcttcagagtggacgaggtgaactggaccacctggaacaccaacgtgggcatcatcaacgaggaccccggcaactgcgagggcgtgaagagaaccctgagcttcagcctgagaagcagcagagtgagcggcagacactggaagaacttcgccctggtgcccctgctgagagaggccagcgccagagacagacagagcgcccagcccgaggaggtgtacctgagacagttcagcggcagcctgaagcccgaggacgccgaggtgttcaagagccccgccgccagcggcgagaagtag

SEQ ID NO: 25287 - DNA, 1791 bp, Artificial Sequence
  Description of Artificial Sequence: Synthetic coding sequence
atggccgacgccgaggccagagccgagttccccgaggaggccagacccgacagaggcaccctgcaggtgctgcaggacatggccagcagactgagaatccacagcatcagagccacctgcagcaccagcagcggccaccccaccagctgcagcagcagcagcgagatcatgagcgtgctgttcttctacatcatgagatacaagcagagcgaccccgagaaccccgacaacgacagattcgtgctggccaagagactgagcttcgtggacgtggccaccggctggctgggccagggcctgggcgtggcctgcggcatggcctacaccggcaagtacttcgacagagccagctacagagtgttctgcctgatgagcgacggcgagagcagcgagggcagcgtgtgggaggccatggccttcgccagctactacagcctggacaacctggtggccatcttcgacgtgaacagactgggccacagcggcgccctgcccgccgagcactgcatcaacatctaccagagaagatgcgaggccttcggctggaacacctacgtggtggacggcagagacgtggaggccctgtgccaggtgttctggcaggccagccaggtgaagcacaagcccaccgccgtggtggccaagaccttcaagggcagaggcacccccagcatcgaggacgccgagagctggcacgccaagcccatgcccagagagagagccgacgccatcatcaagctgatcgagagccagatccagaccagcagaaacctggacccccagccccccatcgaggacagccccgaggtgaacatcaccgacgtgagaatgaccagcccccccgactacagagtgggcgacaagatcgccaccagaaaggcctgcggcctggccctggccaagctgggctacgccaacaacagagtggtggtgctggacggcgacaccagatacagcaccttcagcgagatcttcaacaaggagtaccccgagagattcatcgagtgcttcatggccgagcagaacatggtgagcgtggccctgggctgcgccagcagaggcagaaccatcgccttcgccagcaccttcgccgccttcctgaccagagccttcgaccacatcagaatcggcggcctggccgagagcaacatcaacatcatcggcagccactgcggcgtgagcgtgggcgacgacggcgccagccagatggccctggaggacatcgccatgttcagaaccatccccaagtgcaccatcttctaccccaccgacgccgtgagcaccgagcacgccgtggccctggccgccaacgccaagggcatgtgcttcatcagaaccaccagacccgagaccatggtgatctacaccccccaggagagattcgagatcggccaggccaaggtgctgagacactgcgtgagcgacaaggtgaccgtgatcggcgccggcatcaccgtgtacgaggccctggccgccgccgacgagctgagcaagcaggacatcttcatcagagtgatcgacctgttcaccatcaagcccctggacgtggccaccatcgtgagcagcgccaaggccaccgagggcagaatcatcaccgtggaggaccactacccccagggcggcatcggcgaggccgtgtgcgccgccgtgagcatggaccccgacatccaggtgcacagcctggccgtgagcggcgtgccccagagcggcaagagcgaggagctgctggacatgtacggcatcagcgccagacacatcatcgtggccgtgaagtgcatgctgctgaactag

SEQ ID NO: 25288 - DNA, 1500 bp, Artificial Sequence
  Description of Artificial Sequence: Synthetic coding sequence
atgtggagcagaagacagggcagactgagacccaccgtgtgcggcgtggaggagctgagaagaagaagaagagagagagaggccgccctgagaaaggccagaagagagcagcagctggtgagcaagagactgctgagaaacgacgcccccgaggaggccggcgagggctgcgtggccgccatcctgggcgagaccgaggtgcagcagttcctgagacaggcccagagaggcaccgaggagaaggagagagagggcgccctggtgagcctgagaagaggcctgcagcaccccgagacccagcagaccttcatcagactggagggcagcatgagaaccctggtgggcctgctgaccagcaaccaggccctgctgcagctggaggccgccagatgcctgcacgagctgagccacagcgagcagagcaccgtggccgaggcctgcctgcccgccaccagctacctgctgacctacctgagcagccacagcagcgacttcatcgagctgtgcctgtacaccctgggcaacctgatcgtggagagcgaggccgtgagaagacagctgctgccccagggcatcgtgcccgccctggccgcctgcatccagagcccccacgtggccgtgctggaggccctgggctacgccctgagccagctgctgcaggccgaggaggcccccgagaagatcatcccccccgccagcgccagcagcagcatcctggccagcaccctgccccagcacatgctgcagatgctgcagcccggccccaagctgaaccccggcgtggccgtggagttcgcctggtgcctgcactacatcatctgcagccaggtgagcaaccccctgctgatcggccacggcgccctgagcaccctgggcctgctgctgctggacctggccggcgccgtgcagaagaccgaggacgccggcctggagctgctggcctgccccgtgctgagatgcctgagcaacctgctgaccgaggccgccgtggagaccgtgggcggccagatgcagctgagagacgagagagtggtggccgccctgttcatcctgctgcagttcttcttccagaagcagcccagcctgctgcccgagggcctgtggctgctgaacaacctgaccgccaacagccccagcttctgcaccagcctgctgagcctggacctgatcgagcccctgctgcagctgctgcccgtgagcaacgtggtgagcgtgatggtgctgaccgtgctgtgcaacgtggccgagaagggccccgcctactgccagagactgtggcccggccccctgctgcccgccctgctgcacaccctggccttcagcgacaccgaggtggtgggccagagcctggagctgctgcacctgctgttcctgtaccagcccgaggccgtgcaggtgttcctgcagcagagcggcctgcaggccctggagagacaccaggaggaggcccagctgcaggacagagtgtacgccctgcagcagaccgccctgcagggctag

SEQ ID NO: 25289 - DNA, 1482 bp, Artificial Sequence
  Description of Artificial Sequence: Synthetic coding sequence
atgtggagcagaagacagggcagactgagacccaccgtgtgcggcgtggaggagctgagaagaagaagaagagagagagaggccgccctgagaaaggccagaagagagcagcagctggtgagcaagagactgctgagaaacgacgcccccgaggaggccggcgagggctgcgtggccgccatcctgggcgagaccgaggtgcagcagttcctgagacaggcccagagaggcaccgaggagaaggagagagagggcgccctggtgagcctgagaagaggcctgcagcaccccgagacccagcagaccttcatcagactggagggcagcatgagaaccctggtgggcctgctgaccagcaaccaggccctgctgcagctggaggccgccagatgcctgcacgagctgagccacagcgagcagagcaccgtggccgaggcctgcctgcccgccaccagctacctgctgacctacctgagcagccacagcagcgacttcatcgagctgtgcctgtacaccctgggcaacctgatcgtggagagcgaggccgtgagaagacagctgctgccccagggcatcgtgcccgccctggccgcctgcatccagagcccccacgtggccgtgctggaggccctgggctacgccctgagccagctgctgcaggccgaggaggcccccgagaagatcatccccagcatcctggccagcaccctgccccagcacatgctgcagatgctgcagcccggccccaagctgaaccccggcgtggccgtggagttcgcctggtgcctgcactacatcatctgcagccaggtgagcaaccccctgctgatcggccacggcgccctgagcaccctgggcctgctgctgctggacctggccggcgccgtgcagaagaccgaggacgccggcctggagctgctggcctgccccgtgctgagatgcctgagcaacctgctgaccgaggccgccgtggagaccgtgggcggccagatgcagctgagagacgagagagtggtggccgccctgttcatcctgctgcagttcttcttccagaagcagcccagcctgctgcccgagggcctgtggctgctgaacaacctgaccgccaacagccccagcttctgcaccagcctgctgagcctggacctgatcgagcccctgctgcagctgctgcccgtgagcaacgtggtgagcgtgatggtgctgaccgtgctgtgcaacgtggccgagaagggccccgcctactgccagagactgtggcccggccccctgctgcccgccctgctgcacaccctggccttcagcgacaccgaggtggtgggccagagcctggagctgctgcacctgctgttcctgtaccagcccgaggccgtgcaggtgttcctgcagcagagcggcctgcaggccctggagagacaccaggaggaggcccagctgcaggacagagtgtacgccctgcagcagaccgccctgcagggctag

SEQ ID NO: 25290 - DNA, 357 bp, Artificial Sequence
  Description of Artificial Sequence: Synthetic coding sequence
atgtggagcagaagacagggcagactgagacccaccgtgtgcggcgtggaggagctgagaagaagaagaagagagagagaggccgccctgagaaaggccagaagagagcagcagctggtgagcaagagactgctgagaaacgacgcccccgaggaggccggcgagggctgcgtggccgccatcctgggcgagaccgaggtgcagcagttcctgagacaggcccagagaggcaccgaggagaaggagagagagggcgccctggtgagcctgagaagaggcctgcagcaccccgagacccagcagaccttcatcagaagcgtgtggatggtgtggtggagagaggagctgggcctgtag

SEQ ID NO: 25291 - DNA, 762 bp, Artificial Sequence
  Description of Artificial Sequence: Synthetic coding sequence
atgctgcagatgctgcagcccggccccaagctgaaccccggcgtggccgtggagttcgcctggtgcctgcactacatcatctgcagccaggtgagcaaccccctgctgatcggccacggcgccctgagcaccctgggcctgctgctgctggacctggccggcgccgtgcagaagaccgaggacgccggcctggagctgctggcctgccccgtgctgagatgcctgagcaacctgctgaccgaggccgccgtggagaccgtgggcggccagatgcagctgagagacgagagagtggtggccgccctgttcatcctgctgcagttcttcttccagaagcagcccagcctgctgcccgagggcctgtggctgctgaacaacctgaccgccaacagccccagcttctgcaccagcctgctgagcctggacctgatcgagcccctgctgcagctgctgcccgtgagcaacgtggtgagcgtgatggtgctgaccgtgctgtgcaacgtggccgagaagggccccgcctactgccagagactgtggcccggccccctgctgcccgccctgctgcacaccctggccttcagcgacaccgaggtggtgggccagagcctggagctgctgcacctgctgttcctgtaccagcccgaggccgtgcaggtgttcctgcagcagagcggcctgcaggccctggagagacaccaggaggaggcccagctgcaggacagagtgtacgccctgcagcagaccgccctgcagggctag

SEQ ID NO: 25292 - DNA, 903 bp, Artificial Sequence
  Description of Artificial Sequence: Synthetic coding sequence
atgctgcccctgctggccgccctgctggccgccgcctgccccctgccccccgtgagaggcggcgccgccgacgcccccggcctgctgggcgtgcccagcaacgccagcgtgaacgccagcagcgccgacgagcccatcgcccccagactgctggccagcgccgcccccggcccccccgagagacccggccccgaggaggccgccgccgccgccgccccctgcaacatcagcgtgcagagacagatgctgagcagcctgctggtgagatggggcagacccagaggcttccagtgcgacctgctgctgttcagcaccaacgcccacggcagagccttcttcgccgccgccttccacagagtgggcccccccctgctgatcgagcacctgggcctggccgccggcggcgcccagcaggacctgagactgtgcgtgggctgcggctgggtgagaggcagaagaaccggcagactgagacccgccgccgcccccagcgccgccgccgccaccgccggcgcccccaccgccctgcccgcctaccccgccgccgagccccccggccccctgtggctgcagggcgagcccctgcacttctgctgcctggacttcagcctggaggagctgcagggcgagcccggctggagactgaacagaaagcccatcgagagcaccctggtggcctgcttcatgaccctggtgatcgtggtgtggagcgtggccgccctgatctggcccgtgcccatcatcgccggcttcctgcccaacggcatggagcagagaagaaccaccgccagcaccaccgccgccacccccgccgccgtgcccgccggcaccaccgccgccgccgccgccgccgccgccgccgccgccgccgccgccgtgaccagcggcgtggccaccaagtag

SEQ ID NO: 25293 - DNA, 2526 bp, Artificial Sequence
  Description of Artificial Sequence: Synthetic coding sequence
atgcccctggccgcctactgctacctgagagtggtgggcaagggcagctacggcgaggtgaccctggtgaagcacagaagagacggcaagcagtacgtgatcaagaagctgaacctgagaaacgccagcagcagagagagaagagccgccgagcaggaggcccagctgctgagccagctgaagcaccccaacatcgtgacctacaaggagagctgggagggcggcgacggcctgctgtacatcgtgatgggcttctgcgagggcggcgacctgtacagaaagctgaaggagcagaagggccagctgctgcccgagaaccaggtggtggagtggttcgtgcagatcgccatggccctgcagtacctgcacgagaagcacatcctgcacagagacctgaagacccagaacgtgttcctgaccagaaccaacatcatcaaggtgggcgacctgggcatcgccagagtgctggagaaccactgcgacatggccagcaccctgatcggcaccccctactacatgagccccgagctgttcagcaacaagccctacaactacaagagcgacgtgtgggccctgggctgctgcgtgtacgagatggccaccctgaagcacgccttcaacgccaaggacatgaacagcctggtgtacagaatcatcgagggcaagctgccccccatgcccagagactacagccccgagctggccgagctgatcagaaccatgctgagcaagagacccgaggagagacccagcgtgagaagcatcctgagacagccctacatcaagagacagatcagcttcttcctggaggccaccaagatcaagaccagcaagaacaacatcaagaacggcgacagccagagcaagcccttcgccaccgtggtgagcggcgaggccgagagcaaccacgaggtgatccacccccagcccctgagcagcgagggcagccagacctacatcatgggcgagggcaagtgcctgagccaggagaagcccagagccagcggcctgctgaagagccccgccagcctgaaggcccacacctgcaagcaggacctgagcaacaccaccgagctggccaccatcagcagcgtgaacatcgacatcctgcccgccaagggcagagacagcgtgagcgacggcttcgtgcaggagaaccagcccagatacctggacgccagcaacgagctgggcggcatctgcagcatcagccaggtggaggaggagatgctgcaggacaacaccaagagcagcgcccagcccgagaacctgatccccatgtggagcagcgacatcgtgaccggcgagaagaacgagcccgtgaagcccctgcagcccctgatcaaggagcagaagcccaaggaccagagcctggccctgagccccaagctggagtgcagcggcaccatcctggcccacagcaacctgagactgctgggcagcagcgacagccccgccagcgccagcagagtggccggcatcaccggcgtgtgccaccacgcccaggaccaggtggccggcgagtgcatcatcgagaagcagggcagaatccaccccgacctgcagccccacaacagcggcagcgagcccagcctgagcagacagagaagacagaagagaagagagcagaccgagcacagaggcgagaagagacaggtgagaagagacctgttcgccttccaggagagcccccccagattcctgcccagccaccccatcgtgggcaaggtggacgtgaccagcacccagaaggaggccgagaaccagagaagagtggtgaccggcagcgtgagcagcagcagaagcagcgagatgagcagcagcaaggacagacccctgagcgccagagagagaagaagactgaagcagagccaggaggagatgagcagcagcggccccagcgtgagaaaggccagcctgagcgtggccggccccggcaagccccaggaggaggaccagcccctgcccgccagaagactgagcagcgactgcagcgtgacccaggagagaaagcagatccactgcctgagcgaggacgagctgagcagcagcaccagcagcaccgacaagagcgacggcgactacggcgagggcaagggccagaccaacgagatcaacgccctggtgcagctgatgacccagaccctgaagctggacagcaaggagagctgcgaggacgtgcccgtggccaaccccgtgagcgagttcaagctgcacagaaagtacagagacaccctgatcctgcacggcaaggtggccgaggaggccgaggagatccacttcaaggagctgcccagcgccatcatgcccggcagcgagaagatcagaagactggtggaggtgctgagaaccgacgtgatcagaggcctgggcgtgcagctgctggagcaggtgtacgacctgctggaggaggaggacgagttcgacagagaggtgagactgagagagcacatgggcgagaagtacaccacctacagcgtgaaggccagacagctgaagttcttcgaggagaacatgaacttctag

SEQ ID NO: 25294 - DNA, 486 bp, Artificial Sequence
  Description of Artificial Sequence: Synthetic coding sequence
atggccaaggaggagccccagagcatcagcagagacctgcaggagctgcagaagaagctgagcctgctgatcgacagcttccagaacaacagcaaggtggtggccttcatgaagagccccgtgggccagtacctggacagccaccccttcctggccttcaccctgctggtgttcatcgtgatgagcgccgtgcccgtgggcttcttcctgctgatcgtggtgctgaccaccctggccgccctgctgggcgtgatcatcctggagggcctggtgatcagcgtgggcggcttcagcctgctgtgcatcctgtgcggcctgggcttcgtgagcctggccatgagcggcatgatgatcgccagctacgtggtggtgagcagcctgatcagctgctggttcagccccagacccctgacccagcagaacaccagctgcgacttcctgcccgccatgaagagcgccgagttcgagggcctgtaccaggagtag

SEQ ID NO: 25295 - DNA, 558 bp, Artificial Sequence
  Description of Artificial Sequence: Synthetic coding sequence
atggccaaggaggagccccagagcatcagcagagacctgcaggagctgcagaagaagctgagcctgctgatcgacagcttccagaacaacagcaagctgccccagcacagcagaatcagcctggacagcgacgacggcgtgagcagactgggcagcgccggcagcaaggtggtggccttcatgaagagccccgtgggccagtacctggacagccaccccttcctggccttcaccctgctggtgttcatcgtgatgagcgccgtgcccgtgggcttcttcctgctgatcgtggtgctgaccaccctggccgccctgctgggcgtgatcatcctggagggcctggtgatcagcgtgggcggcttcagcctgctgtgcatcctgtgcggcctgggcttcgtgagcctggccatgagcggcatgatgatcgccagctacgtggtggtgagcagcctgatcagctgctggttcagccccagacccctgacccagcagaacaccagctgcgacttcctgcccgccatgaagagcgccgagttcgagggcctgtaccaggagtag

SEQ ID NO: 25296 - DNA, 885 bp, Artificial Sequence
  Description of Artificial Sequence: Synthetic coding sequence
atggccgccggcagactgctgctgtacaccggcctgagcctggccctgtgcgccctgggcatgctggccgtggccatctgcagcgaccactggtacgagaccgacgccagaaagcacagagacagatgcaaggccttcaacaccagaagagtggaccccggcttcatctacaacaacaacaacaacctgcccctgagagccagcagaagcagactggacagatgggagggcaagctgctgagagccagaaacagaagacagctgttcgccatgagccccgccgacgagtgcagcagacagtacaacagcaccaacatgggcctgtggagaaagtgccacagacagggcttcgaccccgagatcgccgccctgatcagaaagggcgagatcgagagatgcacctacatcaagtaccactacagcagcgccaccatccccagaaacctgaccttcaacatcaccaagaccatcagacaggacgagtggcacgccctgcacctgagaagaatgaccgccggcttcatgggcatggccgtggccatcatcctgttcggctggatcatcggcgtgctgggctgctgctgggacagaggcctgatgcagtacgtggccggcctgctgttcctgatgggcggcaccttctgcatcatcagcctgtgcacctgcgtggccggcatcaacttcgagctgagcagataccccagatacctgtacggcctgcccgacgacatcagccacggctacggctggagcatgttctgcgcctggggcggcctgggcctgaccctgatcagcggcttcttctgcaccctggcccccagcgtgcagcccgtgcccagaaccaactaccccaagagcagacccgagaacggcaccgtgtgctag

SEQ ID NO: 25297 - DNA, 1053 bp, Artificial Sequence
  Description of Artificial Sequence: Synthetic coding sequence
atgaacctgagaggcctgttccaggacttcaaccccagcaagttcctgatctacgcctgcctgctgctgttcagcgtgctgctggccctgagactggacggcatcatccagtggagctactgggccgtgttcgcccccatctggctgtggaagctgatggtgatcgtgggcgccagcgtgggcaccggcgtgtgggccagaaacccccagtacagagccgagggcgagacctgcgtggagttcaaggccatgctgatcgccgtgggcatccacctgctgctgctgatgttcgaggtgctggtgtgcgacagaatcgagagaggcagccacttctggctgctggtgttcatgcccctgttcttcgtgagccccgtgagcgtggccgcctgcgtgtggggcttcagacacgacagaagcctggagctggagatcctgtgcagcgtgaacatcctgcagttcatcttcatcgccctgagactggacaagatcatccactggccctggctggtggtgtgcgtgcccctgtggatcctgatgagcttcctgtgcctggtggtgctgtactacatcgtgtggagcgtgctgttcctgagaagcatggacgtgatcgccgagcagagaagaacccacatcaccatggccctgagctggatgaccatcgtggtgcccctgctgaccttcgagatcctgctggtgcacaagctggacggccacaacgccttcagcagcatccccatcttcgtgcccctgtggctgagcctgatcaccctgatggccaccaccttcggccagaagggcggcaaccactggtggttcggcatcagaaaggacttctgccagttcctgctggagatcttccccttcctgagagagtacggcaacatcagctacgacctgcaccacgaggacaacgaggagaccgaggagacccccgtgcccgagccccccaagatcgcccccatgttcagaaagaaggccagagtggtgatcacccagagccccggcaagtacgtgctgcccccccccaagctgaacatcgagatgcccgactag

SEQ ID NO: 25298 - DNA, 876 bp, Artificial Sequence
  Description of Artificial Sequence: Synthetic coding sequence
atgaacctgagaggcctgttccaggacttcaaccccagagccgagggcgagacctgcgtggagttcaaggccatgctgatcgccgtgggcatccacctgctgctgctgatgttcgaggtgctggtgtgcgacagaatcgagagaggcagccacttctggctgctggtgttcatgcccctgttcttcgtgagccccgtgagcgtggccgcctgcgtgtggggcttcagacacgacagaagcctggagctggagatcctgtgcagcgtgaacatcctgcagttcatcttcatcgccctgagactggacaagatcatccactggccctggctggtggtgtgcgtgcccctgtggatcctgatgagcttcctgtgcctggtggtgctgtactacatcgtgtggagcgtgctgttcctgagaagcatggacgtgatcgccgagcagagaagaacccacatcaccatggccctgagctggatgaccatcgtggtgcccctgctgaccttcgagatcctgctggtgcacaagctggacggccacaacgccttcagcagcatccccatcttcgtgcccctgtggctgagcctgatcaccctgatggccaccaccttcggccagaagggcggcaaccactggtggttcggcatcagaaaggacttctgccagttcctgctggagatcttccccttcctgagagagtacggcaacatcagctacgacctgcaccacgaggacaacgaggagaccgaggagacccccgtgcccgagccccccaagatcgcccccatgttcagaaagaaggccagagtggtgatcacccagagccccggcaagtacgtgctgcccccccccaagctgaacatcgagatgcccgactag

SEQ ID NO: 25299 - DNA, 519 bp, Artificial Sequence
  Description of Artificial Sequence: Synthetic coding sequence
atgagcttcctgtgcctggtggtgctgtactacatcgtgtggagcgtgctgttcctgagaagcatggacgtgatcgccgagcagagaagaacccacatcaccatggccctgagctggatgaccatcgtggtgcccctgctgaccttcgagatcctgctggtgcacaagctggacggccacaacgccttcagcagcatccccatcttcgtgcccctgtggctgagcctgatcaccctgatggccaccaccttcggccagaagggcggcaaccactggtggttcggcatcagaaaggacttctgccagttcctgctggagatcttccccttcctgagagagtacggcaacatcagctacgacctgcaccacgaggacaacgaggagaccgaggagacccccgtgcccgagccccccaagatcgcccccatgttcagaaagaaggccagagtggtgatcacccagagccccggcaagtacgtgctgcccccccccaagctgaacatcgagatgcccgactag

SEQ ID NO: 25300 - DNA, 1254 bp, Artificial Sequence
  Description of Artificial Sequence: Synthetic coding sequence
atgggccccagacagggcagatggtggctgctgctgtggctgccccccctggccaccctgcccgtgagaggcgaggccgccgccgccgccctgagcgtgagaagatgcaaggccctgaaggagaaggacctgatcagaaccagcgagagcgactgctactgctacaaccagaacagccaggtggagtggaagtacatctggagcaccatgcaggtgaagatcaccagccccggcctgttcagaatcgtgtacatcgccgagagacacaactgccagtaccccgagaacatcctgagcttcatcaagtgcgtgatccacaacttctggatccccaaggagagcaacgagatcaccatcatcatcaacccctacagagagaccgtgtgcttcagcgtggagcccgtgaagaagatcttcaactacatgatccacgtgaacagaaacatcatggacttcaagctgttcctggtgttcgtggccggcgtgttcctgttcttctacgccagaaccctgagccagagccccaccttctactacagcagcggcaccgtgctgggcgtgctgatgaccctggtgttcgtgctgctgctggtgaagagattcatccccaagtacagcaccttctgggccctgatggtgggctgctggttcgccagcgtgtacatcgtgtgccagctgatggaggacctgaagtggctgtggtacgagaacagaatctacgtgctgggctacgtgctgatcgtgggcttcttcagcttcgtggtgtgctacaagcacggccccctggccgacgacagaagcagaagcctgctgatgtggatgctgagactgctgagcctggtgctggtgtacgccggcgtggccgtgccccagttcgcctacgccgccatcatcctgctgatgagcagctggagcctgcactaccccctgagagcctgcagctacatgagatggaagatggagcagtggttcaccagcaaggagctggtggtgaagtacctgaccgaggacgagtacagagagcaggccgacgccgagaccaacagcgccctggaggagctgagaagagcctgcagaaagcccgacttccccagctggctggtggtgagcagactgcacacccccagcaagttcgccgacttcgtgctgggcggcagccacctgagccccgaggagatcagcctgcacgaggagcagtacggcctgggcggcgccttcctggaggagcagctgttcaaccccagcaccgcctag

SEQ ID NO: 25301 - DNA, 822 bp, Artificial Sequence
  Description of Artificial Sequence: Synthetic coding sequence
atggagagaagagagcacctgaccctgaccttccacagccccgaggtgcccaagatcaagggcaacagaaagtaccagagacccaccgtgcccgccaagaagcaccccagcgccagcatgagctgccagagacagcagcagctgatggaccaggcccacatctacatcagaaccctgtgcggcagcctgtgcagcttcagcctgctgatgctgatcgccatgagccccctgaactgggtgcagttcctggtgatcaagaacggcctggagctgtacgccggcctgtggaccctgtgcaaccacgagctgtgctggagccacacccccaagcccccctactacctgcagtacagcagagccttcttcctgatcagcgtgttcaccatcctgaccggcctgggctggctgttcagcagctggatcctgaacagaggcagcatgaccaccaacctggacctgaaggtgagcatgctgagcttcatcagcgccacctgcctgctgctgtgcctgaacctgttcgtggcccaggtgcactggcacaccagagacgccatggagagcgacctgctgtggacctactacctgaactggtgcagcgacatcttctacatgttcgccggcatcatcagcctgctgaactacctgaccagcagaagccccgcctgcgacgagaacgtgaccgtgatccccaccgagagaagcagactgggcgtgggccccgtgaccaccgtgagccccgccaaggacgagggccccagaagcgagatggagagcctgagcgtgagagagaagaacctgcccaagagcggcctgtggtggtag

SEQ ID NO: 25302 - DNA, 585 bp, Artificial Sequence
  Description of Artificial Sequence: Synthetic coding sequence
atgaagggcctgtaccaggccgccggcagaatcctggtgaccctgggcatcctgagcgtgtgcagcggcgtgatcgccttcttccccgtgttcagctacaagccctggttcaccggctggagcgtgagaatcgcctgccccatctggaacggcgccctggccatcaccaccggcgtgctgctgctgctggcctacagagagtggacccagagatacctgggcgaggccaccttcaccttcgtgatcctgagcatcatgggctgccccctgcacttcgccatcgccctggagagcgccctgctgggcccctactgcttctacagcttcagcggcatcgccggcaccaactacctgggctacgccgtgaccttcccctacccctacgccaagttccccctggcctgcgtggaccccccccactacgaggagtaccacctgaccctgcaggccctggacctgtgcctgagcttcaccctgctgtgcaccagcctgaccgtgttcatcaagctgagcgccagactgatccagaacggccacatcaacatgcagctgcccgccggcaaccccaaccccttcagcccctag

SEQ ID NO: 25303 - DNA, 453 bp, Artificial Sequence
  Description of Artificial Sequence: Synthetic coding sequence
gcctgccccatctggaacggcgccctggccatcaccaccggcgtgctgctgctgctggcctacagagagtggacccagagatacctgggcgaggccaccttcaccttcgtgatcctgagcatcatgggctgccccctgcacttcgccatcgccctggagagcgccctgctgggcccctactgcttctacagcttcagcggcatcgccggcaccaactacctgggctacgccgtgaccttcccctacccctacgccaagttccccctggcctgcgtggaccccccccactacgaggagtaccacctgaccctgcaggccctggacctgtgcctgagcttcaccctgctgtgcaccagcctgaccgtgttcatcaagctgagcgccagactgatccagaacggccacatcaacatgcagctgcccgccggcaaccccaaccccttcagcccctag

SEQ ID NO: 25304 - DNA, 876 bp, Artificial Sequence
  Description of Artificial Sequence: Synthetic coding sequence
atggccagaagctacggcggcagagtgctggccgccatgaccctgctgggcatcgccgccgccgtgctggccgccctgggcgcccagctgctgttccagctgcaggccggcagagccgagctgagaggcctgagagccgagggcctgggccaggagctgggcgccggccccggcctgcccgaggacgccgccggcaccctgctgcccctggccgccgccctggccgccctggtgctggtgctgggcttcacctgcctgctgctggccgccctgtgcggccacctgggcgccgagctggccagaggccccggccccagaagaagcgactggttcctgtacgactgcagactgctgagacacgtggccctgggcctgttctgctgcggcatcagcgtgtacctggccgccctgagcatctacgccctgctgctgttcgagatcgagaccggcgccgccgccgccagcatcctgggcagcggcaccctggtgctggtggccgtgctgacccacaccctgctgagagccgccagagccgccagaagaggcctgcacgagctgagcccccccagcttcgaggacgacctggccagacccgccgaggtgagcaaggccagccccagagcccagccccagcagggcatccacagaagaaccccctacagcacctgccccgagcccggcgaccccttcggcagcatggccaccgccaccgcccccgccgccctggagggcggctgggagagcagcctgcccgccagcagaatgcacagaaccctgagcgccggcctgggccactgggacggcgtgacccacgagatgagaagaatgctgggccacagacccggcagcatgggcaaggacagcaccctggtgtag

SEQ ID NO: 25305 - DNA, 1056 bp, Artificial Sequence
  Description of Artificial Sequence: Synthetic coding sequence
atggccagcggcagactgatcaagttcgtggtgttcgagctgctggagttcgccgccttcagcatccccaccctggtgatcaccgagcagttcgccaccgcctaccagggcaccagagccagaagcgacaacacccactactggctgatcatcagctgcagcatcgcctacgtggccctggtgaccctgctgatctgggtgcccgtgaaggtgatcctgcacaagaagagatacatctacagaaagatcaagggctggagacccgtgctgatgatgtgcgtggtgctgaccaccctgccctgcctgaccttcagcatcgccgtgaccgaggtgcagaagagcatcaacggcagcgccgacgtgctgcccgacatgctgcccgacctgcccgtgagcctggtgctgctgagcctgatcatggtggacatcatcgagaagctgagaatctaccccctgagaggcagccagaagagcagcgagaacggccacatccacagcaccagcctgcagcacatcaagaccgtgaccgagcaggtgagacagagccccgagaacgccgccagcccccaggccaccaacagcacccaggtgagccagcccagcggcgccatgaccagaagccaggagagcgtgttcatgggcccccaggagcccagctgcgacagcggcatcctgagaatgatgagcagaagagacgtgagagccgagctgttcctgtggagcttcctgctgtggagcgacaccatcgagatggtgagagtggccggccaccccaacgtgtacaagagcagctggctgtaccccgtgtacatcttcagcttcatcagcctgctgagaatcaccttcaccccccagaaccccctgctgaacagcctgagcgtgctgctgcaggacctgcccttcgtgttcgtgagactgggcctgatcatcgccctgggcaccatcacccccgtgctgggcctgtgcaagaacatcctggtgaccctgagctacatctacttcaactacctgaccagaatcagaatcttcagcgccttcgagatgagccccttctag

SEQ ID NO: 25306 - DNA, 531 bp, Artificial Sequence
  Description of Artificial Sequence: Synthetic coding sequence
atggccgccgcccccgccgtgtgcgccagccagggcagcccccccggcgcccccagcgcccccgccgccgcccccgcccccgccgccggcctgggcagatgcagaatggccctgctgctggccgtggccctggacgtggccggcatggccgccctgctgaccggcgtgttcgcccagctgcaggtgagaggcagagacttcggcgacctgctgatctacagcggcgccctgctggtgttcctgagcctgctgggctggatcctgtggtacaccggcaacatcgagatcagcagacaggagctggagagagactacggcctgagacccagcgccctggccagactggccagaaagctgagcagaagatggagcgcccccgccgccgccggccagagacccgcccccggcagcagaagagccagaagagccgccagagccccccccccccccgccgccggcagcagaagagtgagactgcagctggccaccctggaggccggccccggcgccgccggcgccggcagcgagtag

SEQ ID NO: 25307 - DNA, 588 bp, Artificial Sequence
  Description of Artificial Sequence: Synthetic coding sequence
atgagagtgggcacctggatctgcctgcccggcagacccggcagatgcagaaagcagcacgacctgggcaactgccccgaggtgcccggcatcttcaagaccctggccctgagccccggcgcccccgacatgatgcagcagcccagagtggagaccgacaccatcggcgccggcgagggcccccagcaggccgtgccctggagcgcctgggtgaccagacacggctgggtgagatggtgggtgagccacatgccccccagctggatccagtggtggagcaccagcaactggagacagcccctgcagagactgctgtggggcctggagggcatcctgtacctgctgctggccctgatgctgtgccacgccctgttcaccaccggcagccacctgctgagcagcctgtggcccgtggtggccgccgtgtggagacacctgctgcccgccctgctgctgctggtgctgagcgccctgcccgccctgctgttcaccgccagcttcctgctgctgttcagcaccctgctgagcctggtgggcctgctgaccagcatgacccaccccggcgacacccaggacctggaccagtag

SEQ ID NO: 25308 - DNA, 765 bp, Artificial Sequence
  Description of Artificial Sequence: Synthetic coding sequence
atgaccagactgtgcctgcccagacccgaggccagagaggaccccatccccgtgccccccagaggcctgggcgccggcgagggcagcggcagccccgtgagaccccccgtgagcacctggggccccagctgggcccagctgctggacagcgtgctgtggctgggcgccctgggcctgaccatccaggccgtgttcagcaccaccggccccgccctgctgctgctgctggtgagcttcctgaccttcgacctgctgcacagatgcaccagacacgacgccgccgccgccagcggcgacagataccacagaggctggagaggcgccaccgccggcagcgccctggtgagcctgggccacgaggcctggctgggcgccctggtgggcgagccccacgcccccgagctggaccccgtggtggagcacctggagctggccgccaccgccgccgcccccgccgtgggcagcggcggcgacaccctgcccgccgccggcaccgacgtggtgccctgcaccctgcaccactggctgccccccgccgagctgctggtggcctgcagaggcagaggcgtggccccccccgccaccggcagccccgccgccggcgcccagtgcagcgcctgcccccccctgcacggcctgctgcccgccgccctgctgcacaccgccgagccctgcggccccccccacctgcacgacagccccagaagacacagcggcttcggcagcatcgagggccagccccaccccaccgcctgcgtgtgctag

SEQ ID NO: 25309 - DNA, 459 bp, Artificial Sequence
  Description of Artificial Sequence: Synthetic coding sequence
atgatgcagcagcccagagtggagaccgacaccatcggcgccggcgagggcccccagcaggccgtgccctggagcgcctgggtgaccagacacggctgggtgagatggtgggtgagccacatgccccccagctggatccagtggtggagcaccagcaactggagacagcccctgcagagactgctgtggggcctggagggcatcctgtacctgctgctggccctgatgctgtgccacgccctgttcaccaccggcagccacctgctgagcagcctgtggcccgtggtggccgccgtgtggagacacctgctgcccgccctgctgctgctggtgctgagcgccctgcccgccctgctgttcaccgccagcttcctgctgctgttcagcaccctgctgagcctggtgggcctgctgaccagcatgacccaccccggcgacacccaggacctggaccagtag

SEQ ID NO: 25310 - DNA, 969 bp, Artificial Sequence
  Description of Artificial Sequence: Synthetic coding sequence
atggccctgccccccggccccgccgccctgagacacaccctgctgctgctgcccgccctgctgagcagcggctggggcgagctggagccccagatcgacggccagacctgggccgagagagccctgagagagaacgagagacacgccttcacctgcagagtggccggcggccccggcacccccagactggcctggtacctggacggccagctgcaggaggccagcaccagcagactgctgagcgtgggcggcgaggccttcagcggcggcaccagcaccttcaccgtgaccgcccacagagcccagcacgagctgaactgcagcctgcaggaccccagaagcggcagaagcgccaacgccagcgtgatcctgaacgtgcagttcaagcccgagatcgcccaggtgggcgccaagtaccaggaggcccagggccccggcctgctggtggtgctgttcgccctggtgagagccaacccccccgccaacgtgacctggatcgaccaggacggccccgtgaccgtgaacaccagcgacttcctggtgctggacgcccagaactacccctggctgaccaaccacaccgtgcagctgcagctgagaagcctggcccacaacctgagcgtggtggccaccaacgacgtgggcgtgaccagcgccagcctgcccgcccccggccccagcagacaccccagcctgatcagcagcgacagcaacaacctgaagctgaacaacgtgagactgcccagagagaacatgagcctgcccagcaacctgcagctgaacgacctgacccccgacagcagagccgtgaagcccgccgacagacagatggcccagaacaacagcagacccgagctgctggaccccgagcccggcggcctgctgaccagccagggcttcatcagactgcccgtgctgggctacatctacagagtgagcagcgtgagcagcgacgagatctggctgtag

SEQ ID NO: 25311 - DNA, 969 bp, Artificial Sequence; identical to SEQ ID NO: 25310
  Description of Artificial Sequence: Synthetic coding sequence

SEQ ID NO: 25312 - DNA, 660 bp, Artificial Sequence
  Description of Artificial Sequence: Synthetic coding sequence
atggccgccgaggacagagagatgatggaggccagaggcgccggcgagagctgccccaccttccccaagatggtgcccggcgacagcaagagcgagggcaagcccagagcctacctggaggccgagagccagaagcccgacagcagctacgactacctggaggagatggaggcctgcgaggacggcggctgccagggccccctgaagagcctgagccccaagagctgcagagccaccaagggccaggccggcgacggccccaagcccgccgagctgccccccacccccggcaccgagagaaaccccgagatggagctggagaaggtgagaatggagttcgagctgaccagactgaagtacctgcacgagaagaaccagagacagagacagcacgaggtggtgatggagcagctgcagagagagagacagcacgaggtggtgatggagcagctgcagcaggaggccgcccccagactgttcagcggcggcctgcagaacttcctgctgccccagaaccagttcgccatgttcctgtactgcttcatcttcatccacatcatctacgtgaccaaggagatggtgttcttcctgttcgccaagcactacctgttctgcatcgccgccatcctgctgtgcctgatcaagaccttctggagctag

SEQ ID NO: 25313 - DNA, 1320 bp, Artificial Sequence
  Description of Artificial Sequence: Synthetic coding sequence
atgggcgaggcccccagccccgcccccgccctgtgggactgggactacctggacagatgcttcgccagacacagagtgtgcatcagcttcggcctgtggatctgcgccagcagctgctggatcgccgcccacgccctgctgctgtacctgagatgcgcccagaagcccagacaggaccagagcgccctgtgcgccgcctgctgcctgctgaccagcctgtgcgacaccgtgggcgccctgctggccagacagctgaccatccaggtgttcaccggcgcctacctggccgccatcgacctggtgaacttcatgttcatcctgttccccgtgtgcggcagcaagttcaagagcaacagcgacagagaggccagagagagaaagagaagaagacagctgagagccagcgtgttcgccctggccctgcccctgagcctgggcccctgctgggccctgtgggtggccgtgcccaaggccagcgccaccatcagaggcccccagagaagactgctggccagcctgctgcaggagaacaccgagatcctgggctacctgctgggcagcgtggccgccttcggcagctgggccagcagaatcccccccctgagcagaatctgcagaggcaagaccttccccagcatccacctgtggaccagactgctgagcgccctggccggcctgctgtacgccagcgccatcgtggcccacgaccagcaccccgagtacctgctgagagccaccccctggttcctgaccagcctgggcagagccgccctggacctggccatcatcttcctgagctgcgtgatgaagagcaagatgagacaggccctgggcttcgccaaggaggccagagagagccccgacacccaggccctgctgacctgcgccgagaaggaggaggagaaccaggagaacctggactgggtgcccctgaccaccctgagccactgcaagagcctgagaaccatgaccgccatcagcagatacatggagctgaccatcgagcccgtgcagcaggccggctgcagcgccaccagactgcccggcgacggccagaccagcgccggcgacgccagcctgcaggacccccccagctacccccccgtgcaggtgatcagagccagagtgagcagcggcagcagcagcgaggtgagcagcatcaacagcgacctggagcagaagtactgggaggccctgaacagcgagcagtgggaccccgaggacgtgaacctggagggcagcaaggagaacgtggagctgctgggcagccaggtgcaccaggacagcgtgagaaccgcccacctgagcgacgacgactag

SEQ ID NO: 25314 - DNA, 342 bp, Artificial Sequence
  Description of Artificial Sequence: Synthetic coding sequence
atgttcatcctgttccccgtgtgcggcagcaagttcaagagcaacagcgacagagaggccagagagagaaagagaagaagacagctgagagccagcgtgttcgccctggccctgcccctgagcctgggcccctgctgggccctgtgggtggccgtgcccaaggccagcgccaccatcagaggcccccagagaagactgctggccagcctgctgcaggagaacaccgagatcctgggctacctgctgggcagcgtggccgccttcggcagctgggccagcagaatcccccccctgagcagaatcgtgagacccggcgtgggcatgggcctgtgggtgacctag

SEQ ID NO: 25315 - DNA, 1287 bp, Artificial Sequence
  Description of Artificial Sequence: Synthetic coding sequence
atgggcgaggcccccagccccgcccccgccctgtgggactgggactacctggacagatgcttcgccagacacagagtgtgcatcagcttcggcctgtggatctgcgccagcagctgctggatcgccgcccacgccctgctgctgtacctgagatgcgcccagaagcccagacaggaccagagcgccctgtgcgccgcctgctgcctgctgaccagcctgtgcgacaccgtgggcgccctgctggccagacagctgaccatccaggtgttcaccggcgcctacctggccgccatcgacctggtgaacttcatgttcatcctgttccccgtgtgcggcagcaagttcaagagcaacagcgacagagaggccagagagagaaagagaagaagacagctgagagccagcgtgttcgccctggccctgcccctgagcctgggcccctgctgggccctgtgggtggccgtgcccaaggccagcgccaccatcagaggcccccagagaagactgctggccagcctgctgcaggagaacaccgagatcctgggctacctgctgggcagcgtggccgccttcggcagctgggccagcagaatcccccccctgagcagaatctgcagaggcaagaccttccccagcatccacctgtggaccagactgctgagcgccctggccggcctgctgtacgccagcgccatcgtggcccacgaccagcaccccgagtacctgctgagagccaccccctggttcctgaccagcctgggcagagccgccctggacctggccatcatcttcctgagctgcgtgatgaagagcaagatgagacaggccctgggcttcgccaaggaggccagagagagccccgacacccaggccctgctgacctgcgccgagaaggaggaggagaaccaggagaacctggactgggtgcccctgaccaccctgagccactgcaagagcctgagaaccatgaccgccatcagcagatacatggagctgaccatcgagcccgtgcagcaggccggctgcagcgccaccagactgcccggcgacggccagaccagcgccggcgacgccagcctgcaggacccccccagctacccccccgtgcaggtgatcagagccagagtgagcagcggcagcagcagcgaggtgagcagcatcaacagcgacctggagtgggaccccgaggacgtgaacctggagggcagcaaggagaacgtggagctgctgggcagccaggtgcaccaggacagcgtgagaaccgcccacctgagcgacgacgactag

SEQ ID NO: 25316 - DNA, 1191 bp, Artificial Sequence
  Description of Artificial Sequence: Synthetic coding sequence
atgggcgaggcccccagccccgcccccgccctgtgggactgggactacctggacagatgcttcgccagacacagagtgtgcatcagcttcggcctgtggatctgcgccagcagctgctggatcgccgcccacgccctgctgctgtacctgagatgcgcccagaagcccagacaggaccagagcgccctgtgcgccgcctgctgcctgctgaccagcctgtgcgacaccgtgggcgccctgctggccagacagctgaccatccaggtgttcaccggcgcctacctggccgccatcgacctggtgaacttcatgttcatcctgttccccgtgtgcggcagcaagttcaagagcaacagcgacagagaggccagagagagaaagagaagaagacagctgagagccagcgtgttcgccctggccctgcccctgagcctgggcccctgctgggccctgtgggtggccgtgcccaaggccagcgccaccatcagaggcccccagagaagactgctggccagcctgctgcaggagaacaccgagatcctgggctacctgctgggcagcgtggccgccttcggcagctgggccagcagaatcccccccctgagcagaatctgcagaggcaagaccttccccagcatccacctgtggaccagactgctgagcgccctggccggcctgctgtacgccagcgccatcgtggcccacgaccagcaccccgagtacctgctgagagccaccccctggttcctgaccagcctgggcagagccgccctggacctggccatcatcttcctgagctgcgtgatgaagagcaagatgagacaggccctgggcttcgccaaggaggccagagagagccccgacacccaggccctgctgacctgcgccgagaaggaggaggagaaccaggagaacctggactgggtgcccctgaccaccctgagccactgcaagagcctgagaaccatgaccgccatcagcagatacatggagctgaccatcgagcccgtgcagcaggccgccgtgccccccggctgccaggtgaccggcagaagagcccccgagatgagaccctgcagaacccccagaagaaccctgcccttcagaagcagcggccccggctgcctgcccgccgcccccctgagaagcccccccagcacccccacctggagcggcaccctgaagatgtag

SEQ ID NO: 25317 - DNA, 1428 bp, Artificial Sequence
  Description of Artificial Sequence: Synthetic coding sequence
atgggcgaggcccccagccccgcccccgccctgtgggactgggactacctggacagatgcttcgccagacacagagtgtgcatcagcttcggcctgtggatctgcgccagcagctgctggatcgccgcccacgccctgctgctgtacctgagatgcgcccagaagcccagacaggaccagagcgccctgtgcgccgcctgctgcctgctgaccagcctgtgcgacaccgtgggcgccctgctggccagacagctgaccatccaggtgttcaccggcgcctacctggccgccatcgacctggtgaacttcatgttcatcctgttccccgtgtgcggcagcaagttcaagagcaacagcgacagagaggccagagagagaaagagaagaagacagctgagagccagcgtgttcgccctggccctgcccctgagcctgggcccctgctgggccctgtgggtggccgtgcccaaggccagcgccaccatcagaggcccccagagaagactgctggccagcctgctgcaggagaacaccgagatcctgggctacctgctgggcagcgtggccgccttcggcagctgggccagcagaatcccccccctgagcagaatcgcccccccccccaccctgggcatcaccacccagcacgagatctggagaggccagatgagcaagcccagccagagccccagcagaagccccagcggccactggagagccgccgcccagagacaggtgctgggcaccgagatgtgcagaggcaagaccttccccagcatccacctgtggaccagactgctgagcgccctggccggcctgctgtacgccagcgccatcgtggcccacgaccagcaccccgagtacctgctgagagccaccccctggttcctgaccagcctgggcagagccgccctggacctggccatcatcttcctgagctgcgtgatgaagagcaagatgagacaggccctgggcttcgccaaggaggccagagagagccccgacacccaggccctgctgacctgcgccgagaaggaggaggagaaccaggagaacctggactgggtgcccctgaccaccctgagccactgcaagagcctgagaaccatgaccgccatcagcagatacatggagctgaccatcgagcccgtgcagcaggccggctgcagcgccaccagactgcccggcgacggccagaccagcgccggcgacgccagcctgcaggacccccccagctacccccccgtgcaggtgatcagagccagagtgagcagcggcagcagcagcgaggtgagcagcatcaacagcgacctggagtgggaccccgaggacgtgaacctggagggcagcaaggagaacgtggagctgctgggcagccaggtgcaccaggacagcgtgagaaccgcccacctgagcgacgacgactag

SEQ ID NO: 25318 - DNA, 1317 bp, Artificial Sequence
  Description of Artificial Sequence: Synthetic coding sequence
atgggcgaggcccccagccccgcccccgccctgtgggactgggactacctggacagatgcttcgccagacacagagtgtgcatcagcttcggcctgtggatctgcgccagcagctgctggatcgccgcccacgccctgctgctgtacctgagatgcgcccagaagcccagacaggaccagagcgccctgtgcgccgcctgctgcctgctgaccagcctgtgcgacaccgtgggcgccctgctggccagacagctgaccatccaggtgttcaccggcgcctacctggccgccatcgacctggtgaacttcatgttcatcctgttccccgtgtgcggcagcaagttcaagagcaacagcgacagagaggccagagagagaaagagaagaagacagctgagagccagcgtgttcgccctggccctgcccctgagcctgggcccctgctgggccctgtgggtggccgtgcccaaggccagcgccaccatcagaggcccccagagaagactgctggccagcctgctgcaggagaacaccgagatcctgggctacctgctgggcagcgtggccgccttcggcagctgggccagcagaatcccccccctgagcagaatctgcagaggcaagaccttccccagcatccacctgtggaccagactgctgagcgccctggccggcctgctgtacgccagcgccatcgtggcccacgaccagcaccccgagtacctgctgagagccaccccctggttcctgaccagcctgggcagagccgccctggacctggccatcatcttcctgagctgcgtgatgaagagcaagatgagacaggccctgggcttcgccaaggaggccagagagagccccgacacccaggccctgctgacctgcgccgagaaggaggaggagaaccaggagaacctggactgggtgcccctgaccaccctgagccactgcaagagcctgagaaccatgaccgccatcagcagatacatggagctgaccatcgagcccgtgcagcaggccggctgcagcgccaccagactgcccggcgacggccagaccagcgccggcgacgccagcctgcaggacccccccagctacccccccgtgcaggtgatcagagccagagtgagcagcggcagcagcagcgaggtgagcagcatcaacagcgacctggagaagtactgggaggccctgaacagcgagcagtgggaccccgaggacgtgaacctggagggcagcaaggagaacgtggagctgctgggcagccaggtgcaccaggacagcgtgagaaccgcccacctgagcgacgacgactag

SEQ ID NO: 25319 - DNA, 477 bp, Artificial Sequence
  Description of Artificial Sequence: Synthetic coding sequence
atggccggcttcctggacaacttcagatggcccgagtgcgagtgcatcgactggagcgagagaagaaacgccgtggccagcgtggtggccggcatcctgttcttcaccggctggtggatcatgatcgacgccgccgtggtgtaccccaagcccgagcagctgaaccacgccttccacacctgcggcgtgttcagcaccctggccttcttcatgatcaacgccgtgagcaacgcccaggtgagaggcgacagctacgagagcggctgcctgggcagaaccggcgccagagtgtggctgttcatcggcttcatgctgatgttcggcagcctgatcgccagcatgtggatcctgttcggcgcctacgtgacccagaacaccgacgtgtaccccggcctggccgtgttcttccagaacgccctgatcttcttcagcaccctgatctacaagttcggcagaaccgaggagctgtggacctag

SEQ ID NO: 25320 - DNA, 831 bp, Artificial Sequence
  Description of Artificial Sequence: Synthetic coding sequence
atgtacagaatcagccagctgatgagcacccccgtggccagcagcagcagactggagagagagtacgccggcgagctgagccccacctgcatcttccccagcttcacctgcgacagcctggacggctaccacagcttcgagtgcggcagcatcgaccccctgaccggcagccactacacctgcagaagaagccccagactgctgaccaacggctactacatctggaccgaggacagcttcctgtgcgacaaggacggcaacatcaccctgaaccccagccagaccagcgtgatgtacaaggagaacctggtgagcaccagcaagagctggctgcacggcagcatcttcggcgacatcaacagcagccccagcgaggacaactggctgaagggcaccagaagactggacaccgaccactgcaacggcaacgccgacgacctggactgcagcagcctgaccgacgactgggagagcggcaagatgaacgccgagagcgtgatcaccagcagcagcagccacatcatcagccagccccccggcggcaacagccacagcctgagcctgcagagccagctgaccgccagcgagagattccaggagaacagcagcgaccacagcgagaccagactgctgcaggaggtgttcttccaggccatcctgctggccgtgtgcctgatcatcagcgcctgcgccagatggttcatgggcgagatcctggccagcgtgttcacctgcagcctgatgatcaccgtggcctacgtgaagagcctgttcctgagcctggccagctacttcaagaccaccgcctgcgccagattcgtgaagatctag

SEQ ID NO: 25321 - DNA, 699 bp, Artificial Sequence
  Description of Artificial Sequence: Synthetic coding sequence
atgtacagaatcagccagctgatgagcacccccgtggccagcagcagcagactggagagagagtacgccggcgagctgagccccacctgcatcttccccagcttcacctgcgacagcctggacggctaccacagcttcgagtgcggcagcatcgaccccctgaccggcagccactacacctgcagaagaagccccagactgctgaccaacggctactacatctggaccgaggacagcttcctgtgcgacaaggacggcaacatcaccctgaaccccagccagaccagcgtgatgtacaaggagaacctggtgagaatcttcagaaagaagaagagaatctgccacagcttcagcagcctgttcaacctgagcaccagcaagagctggctgcacggcagcatcttcggcgacatcaacagcagccccagcgaggacaactggctgaagggcaccagaagactggacaccgaccactgcaacggcaacgagaccagactgctgcaggaggtgttcttccaggccatcctgctggccgtgtgcctgatcatcagcgcctgcgccagatggttcatgggcgagatcctggccagcgtgttcacctgcagcctgatgatcaccgtggcctacgtgaagagcctgttcctgagcctggccagctacttcaagaccaccgcctgcgccagattcgtgaagatctag

SEQ ID NO: 25322 - DNA, 300 bp, Artificial Sequence
  Description of Artificial Sequence: Synthetic coding sequence
atgtacagaatcagccagctgatgagcacccccgtggccagcagcagcagactggagagagagtacgccggcgagctgagccccacctgcatcttccccagcttcacctgcgacagcctggacggctaccacagcttcgagtgcggcagcatcgaccccctgaccggcagccactacacctgcagaagaagccccagactgctgaccaacggctactacatctggaccgaggacagcttcctgtgcgacaaggacggcaacatcaccctgaaccccagccagaccagcgtgatgtactag

SEQ ID NO: 25323 - DNA, 279 bp, Artificial Sequence
  Description of Artificial Sequence: Synthetic coding sequence
atgtacagaatcagccagctgatgagcacccccgtggccagcagcagcagactggagagagagtacgccggcgagctgagccccacctgcatcttccccagcttcacctgcgacagcctggacggctaccacagcttcgagtgcggcagcatcgaccccctgaccggcagccactacacctgcagaagaagccccagactgctgaccaacggctactacatctggaccgaggacagcttcctgtgcgacaaggacggcaacatcaccctgaacccctag

SEQ ID NO: 25324 - DNA, 666 bp, Artificial Sequence
  Description of Artificial Sequence: Synthetic coding sequence
atgggcaccctggtggccaagctgctgctgcccaccctgagcagcctggccttcctgcccaccgtgagcatcgccgccaagagaagattccacatggaggccatggtgtacctgttcaccctgttcttcgtggccctgcaccacgcctgcaacggccccggcctgagcgtgctgtgcttcatgagacacgacatcctggagtacttcagcgtgtacggcaccgccctgagcatgtgggtgagcctgatggccctggccgacttcgacgagcccaagagaagcaccttcgtgatgttcggcgtgctgaccatcgccgtgagaatctaccacgacagatggggctacggcgtgtacagcggccccatcggcaccgccatcctgatcatcgccgccaagtggctgcagaagatgaaggagaagaagggcctgtaccccgacaagagcgtgtacacccagcagatcggccccggcctgtgcttcggcgccctggccctgatgctgagattcttcttcgaggactgggactacacctacgtgcacagcttctaccactgcgccctggccatgagcttcgtgctgctgctgcccaaggtgaacaagaaggccggcagccccggcacccccgccaagctggactgcagcaccctgtgctgcgcctgcgtgtag

SEQ ID NO: 25325 - DNA, 555 bp, Artificial Sequence
  Description of Artificial Sequence: Synthetic coding sequence
atgtggagactggccctgggcggcgtgttcctggccgccgcccaggcctgcgtgttctgcagactgcccgcccacgacctgagcggcagactggccagactgtgcagccagatggaggccagacagaaggagtgcggcgccagccccgacttcagcgccttcgccctggacgaggtgagcatgaacaaggtgaccgagaagacccacagagtgctgagagtgatggagatcaaggaggccgtgagcagcctgcccagctactggagctggctgagaaagaccaagctgcccgagtacaccagagaggccctgtgcccccccgcctgccccctgcccctgctgagccccgccggcggcagcaccaccctgtacaactgcagcacctgcaagggcaccgaggtgagctgctggcccagaaagagatgcttccccggcagccaggacctgtgggaggccaagatcctgctgctgagcatcttcggcgccttcctgctgctgggcgtgctgagcctgctggtggagagccaccacctgcaggccaagagcggcctgtag

SEQ ID NO: 25326 - DNA, 612 bp, Artificial Sequence
  Description of Artificial Sequence: Synthetic coding sequence
atgtggagactggccctgggcggcgtgttcctggccgccgcccaggcctgcgtgttctgcagactgcccgcccacgacctgagcggcagactggccagactgtgcagccagatggaggccagacagaaggagtgcggcgccagccccgacttcagcgccttcgccctggacgaggtgagcatgaacaaggtgaccgagaagacccacagagtgctgagagtgatggagatcaaggaggccgtgagcagcctgcccagctactggagctggctgagaaagaccaagctgcccgagtacaccagagaggccctgtgcccccccgcctgcagaggcagcaccaccctgtacaactgcagcacctgcaagggcaccgaggtgagctgctggcccagaaagagatgcttccccggcagcctgggcagccaggacagcgcccccctgcacctgagaagcttccccgccagcggctgcagcgagccccccggcggcgtgccccccccccccagcaagaagtggctggtgaagaccctgaagaccagccagccccccgccctgagaggcatgcacagccagctgccccaccccctggagggcaaccagagcgccccctag

SEQ ID NO: 25327 - DNA, 1755 bp, Artificial Sequence
  Description of Artificial Sequence: Synthetic coding sequence
atgcccggcagaacctgggagctgtgcctgctgctgctgctgggcctgggcctgggcagccaggaggccctgccccccccctgcgagagcgagatctactgccacggcgagctgctgaaccaggtgcagatggccaagctgtaccaggacgacaagcagttcgtggacatgcccctgagcatcgcccccgagcaggtgctgcagaccttcaccgagctgagcagagaccacaaccacagcatccccagagagcagctgcaggccttcgtgcacgagcacttccaggccaagggccaggagctgcagccctggacccccgccgactggaaggacagcccccagttcctgcagaagatcagcgacgccaagctgagagcctgggccggccagctgcaccagctgtggaagaagctgggcaagaagatgaagcccgaggtgctgagccaccccgagagattcagcctgatctacagcgagcaccccttcatcgtgcccggcggcagattcgtggagttctactactgggacagctactgggtgatggagggcctgctgctgagcgagatggccgagaccgtgaagggcatgctgcagaacttcctggacctggtgaagacctacggccacgtgcccaacggcggcagagtgtactacctgcagagaagccagccccccctgctgaccctgatgatggactgctacctgacccacaccaacgacaccgccttcctgcaggagaacatcgagaccctggccctggagctggacttctggaccaagaacagaaccgtgagcgtgagcctggagggcaagaactacctgctgaacagatactacgtgccctacggcggccccagacccgagagctacagcaaggacgtggagctggccgacaccctgcccgagggcgacagagaggccctgtgggccgagctgaaggccggcgccgagagcggctgggacttcagcagcagatggctgatcggcggccccaaccccaacagcctgagcggcatcagaaccagcaagctggtgcccgtggacctgaacgccttcctgtgccaggccgaggagctgatgagcaacttctacagcagactggccggcaacgacagccaggccaccaagtacagaatcctgagaagccagagactggccgccctgaacaccgtgctgtgggacgagcagaccggcgcctggttcgactacgacctggagaagaagaagaagaacagagagttctaccccagcaacctgacccccctgtgggccggctgcttcagcgaccccggcgtggccgacaaggccctgaagtacctggaggacaacagaatcctgacctaccagtacggcatccccaccagcctgcagaagaccggccagcagtgggacttccccaacgcctgggcccccctgcaggacctggtgatcagaggcctggccaaggcccccctgagaagagcccaggaggtggccttccagctggcccagaactggatcagaaccaacttcgacgtgtacagccagaagagcgccatgtacgagaagtacgacgtgagcaacggcggccagcccggcggcggcggcgagtacgaggtgcaggagggcttcggctggaccaacggcgtggtgctgatgctgctggacagatacggcgacagactgaccagcggcgccaagctggccttcctggagccccactgcctggccgccaccctgctgcccagcctgctgctgagcctgctgccctggtag

SEQ ID NO: 25328 - DNA, 2715 bp, Artificial Sequence
  Description of Artificial Sequence: Synthetic coding sequence
atgccccagctgctgagaaacgtgctgtgcgtgatcgagaccttccacaagtacgccagcgaggacagcaacggcgccaccctgaccggcagagagctgaagcagctgatccagggcgagttcggcgacttcttccagccctgcgtgctgcacgccgtggagaagaacagcaacctgctgaacatcgacagcaacggcatcatcagcttcgacgagttcgtgctggccatcttcaacctgctgaacctgtgctacctggacatcaagagcctgctgagcagcgagctgagacaggtgaccaagcccgagaaggagaagctggacgacgtggacgtgcaggccaccaccggcgacggccagtggaccgtgggcaccagccccacccaggagaagagaatgctgcccagcggcatggccagcagcagccagctgatccccgaggagagcggcgccgtgggcaacaacagagtggacccctggagagaggccaagacccacaacttccccggcgaggccagcgagcacaacgaccccaagaacaagcacctggagggcgacgagcagagccaggaggtggcccaggacatccagaccaccgaggacaacgagggccagctgaagaccaacaagcccatggccggcagcaagaagaccagcagccccaccgagagaaagggccaggacaaggagatcagccaggagggcgacgagcccgccagagagcagagcgtgagcaagatcagagaccagttcggcgagcaggagggcaacctggccacccagagcagcccccccaaggaggccacccagagaccctgcgaggaccaggaggtgagaaccgagaaggagaagcacagcaacatccaggagccccccctgcagagagaggacgagcccagcagccagcacgccgacctgcccgagcaggccgccgccagaagccccagccagacccagaagagcaccgacagcaaggacgtgtgcagaatgttcgacacccaggagcccggcaaggacgccgaccagacccccgccaagaccaagaacctgggcgagcccgaggactacggcagaaccagcgagacccaggagaaggagtgcgagaccaaggacctgcccgtgcagtacggcagcagaaacggcagcgagaccagcgacatgagagacgagagaaaggagagaagaggccccgaggcccacggcaccgccggccagaaggagagagacagaaagaccagacccctggtgctggagacccagacccaggacggcaagtaccaggagctgcagggcctgagcaagagcaaggacgccgagaagggcagcgagacccagtacctgagcagcgagggcggcgaccagacccaccccgagctggagggcaccgccgtgagcggcgaggaggccgagcacaccaaggagggcaccgccgaggccttcgtgaacagcaagaacgcccccgccgccgagagaaccctgggcgccagagagagaacccaggacctggcccccctggagaagcagagcgtgggcgagaacaccagagtgaccaagacccacgaccagcccgtggaggaggaggacggctaccagggcgaggaccccgagagccccttcacccagagcgacgagggcagcagcgagacccccaacagcctggccagcgaggagggcaacagcagcagcgagaccggcgagctgcccgtgcagggcgacagccagagccagggcgaccagcacggcgagagcgtgcagggcggccacaacaacaaccccgacacccagagacagggcacccccggcgagaagaacagagccctggaggccgtggtgcccgccgtgagaggcgaggacgtgcagctgaccgaggaccaggagcagcccgccagaggcgagcacaagaaccagggccccggcaccaagggccccggcgccgccgtggagcccaacggccaccccgaggcccaggagagcaccgccggcgacgagaacagaaagagcctggagatcgagatcaccggcgccctggacgaggacttcaccgaccagctgagcctgatgcagctgcccggcaagggcgacagcagaaacgagctgaaggtgcagggccccagcagcaaggaggagaagggcagagccaccgaggcccagaacaccctgctggagagcctggacgaggacaacagcgccagcctgaagatccagctggagaccaaggagcccgtgaccagcgaggaggaggacgagagcccccaggagctggccggcgagggcggcgaccagaagagccccgccaagaaggagcacaacagcagcgtgccctggagcagcctggagaagcagatgcagagagaccaggagccctgcagcgtggagagaggcgccgtgtacagcagccccctgtaccagtacctgcaggagaagatcctgcagcagaccaacgtgacccaggaggagcaccagaagcaggtgcagatcgcccaggccagcggccccgagctgtgcagcgtgagcctgaccagcgagatcagcgactgcagcgtgttcttcaactacagccaggccagccagccctacaccagaggcctgcccctggacgagagccccgccggcgcccaggagacccccgccccccaggccctggaggacaagcagggccacccccagagagagagactggtgctgcagagagaggccagcaccaccaagcagtag

SEQ ID NO: 25329 - DNA, 1248 bp, Artificial Sequence
  Description of Artificial Sequence: Synthetic coding sequence
gagatcgccaagcagctgcaggccgtgaagagaaagatcagagacgagagcctgtgcccccagcaccacgaggccctgagcctgttctgctacgaggaccaggaggccgtgtgcctgatctgcgccatcagccacacccacagagcccacaccgtggtgcccctggacgacgccacccaggagtacaaggagaagctgcagaagtgcctggagcccctggagcagaagctgcaggagatcaccagatgcaagagcagcgaggagaagaagcccggcgagctgaagagactggtggagagcagaagacagcagatcctgagagagttcgaggagctgcacagaagactggacgaggagcagcaggtgctgctgagcagactggaggaggaggagcaggacatcctgcagagactgagagagaacgccgcccacctgggcgacaagagaagagacctggcccacctggccgccgaggtggagggcaagtgcctgcagagcggcttcgagatgctgaaggacgtgaagagcaccctggagaagtgcgagaaggtgaagaccatggaggtgaccagcgtgagcatcgagctggagaagaacttcagcaacttccccagacagtacttcgccctgagaaagatcctgaagcagctgatcgccgacgtgaccctggaccccgagaccgcccaccccaacctggtgctgagcgaggacagaaagagcgtgaagttcgtggagaccagactgagagacctgcccgacacccccagaagattcaccttctacccctgcgtgctggccaccgagggcttcaccagcggcagacactactgggaggtggaggccgcccactgcgtgctggcccaggaccccgagaaccaggccctggccagattctactgctacaccgagagaaccatcgccaagagactggtgctgagaagagaccccagcgtgaagagaaccctgtgcagaggctgcagcagcctgctggtgcccggcctgacctgcacccagagacagagaagatgcagaggccagagatggaccgtgcagacctgcctgacctgccagagaagccagagattcctgaacgaccccggccacctgctgtggggcgacagacccgaggcccagctgggcagccaggccgacagcaagcccctgcagcccctgcccaacaccgcccacagcatcagcgacagactgcccgaggagaagatgcagacccagggcagcagcaaccagtag

SEQ ID NO: 25330 - DNA, 1602 bp, Artificial Sequence
  Description of Artificial Sequence: Synthetic coding sequence
atggaggagaagggcagcaagagaggcctggaggccgccggcaaggccggcctggccaccgccggccccggcctgctgcccagaaagccccccggcctggccgccggccccgccggcacctacggcaaggccgtgagccccccccccagccccagagccagccccgtggccgccctgaaggccaaggtgatccagaagctggaggacgtgagcaagccccccgcctacgcctaccccgccacccccagcagccaccccaccagccccccccccgccagccccccccccacccccggcatcaccagaaaggaggaggcccccgagaacgtggtggagaagaaggacctggagctggagaaggaggcccccagccccttccaggccctgttcagcgacatcccccccagataccccttccaggccctgcccccccactacggcagaccctaccccttcctgctgcagcccaccgccgccgccgacgccgacggcctggcccccgacgtgcccctgcccgccgacggccccgagagactggccctgagccccgaggacaagcccatcagactgagccccagcaagatcaccgagcccctgagagagggccccgaggaggagcccctggccgagagagaggtgaaggccgaggtggaggacatggacgagggccccaccgagctgccccccctggagagccccctgcccctgcccgccgccgaggccatggccacccccagccccgccggcggctgcggcggcggcctgctggaggcccaggccctgagcgccaccggccagagctgcgccgagcccagcgagtgccccgacttcgtggagggccccgagcccagagtggacagccccggcagaaccgagccctgcaccgccgccctggacctgggcgtgcagctgacccccgagaccctggtggaggccaaggaggagcccgtggaggtgcccgtggccgtgcccgtggtggaggccgtgcccgaggagggcctggcccaggtggcccccagcgagagccagcccaccctggagatgagcgactgcgacgtgcccgccggcgagggccagtgccccagcctggagccccaggaggccgtgcccgtgctgggcagcacctgcttcctggaggaggccagcagcgaccagttcctgcccagcctggaggaccccctggccggcatgaacgccctggccgccgccgccgagctgccccaggccagacccctgcccagccccggcgccgccggcgcccaggccctggagaagctggaggccgccgagagcctggtgctggagcagagcttcctgcacggcatcaccctgctgagcgagatcgccgagctggagctggagagaagaagccccccccagggcctgcccccctgcatgggccagggcagccccatgcccgccggcctgcccgactgcgccagaggccccgcccccaccctgagcggctggcccagactgggcgagcagagcagagtgggcctgcagcccggcgtgagcgtgaagggcaccagatggagaggccccggcaccggccccccctggagcaagcccagccactacagaaagccccagtggtgctag

SEQ ID NO: 25331 - DNA, 8907 bp, Artificial Sequence
  Description of Artificial Sequence: Synthetic coding sequence
atggacggcagagacttcggcccccagagaagcgtgcacggcccccccccccccctgctgagcggcctggccatggacagccacagagtgggcgccgccaccgccggcagactgcccgccagcggcctgcccggccccctgccccccggcaagtacatggccggcctgaacctgcacccccaccccggcgaggccttcctgggcagcttcgtggccagcggcatgggccccagcgccagcagccacggcagccccgtgcccctgcccagcgacctgagcttcagaagccccacccccagcaacctgcccatggtgcagctgtgggccgcccacgcccacgagggcttcagccacctgcccagcggcctgtaccccagctacctgcacctgaaccacctggagccccccagcagcggcagccccctgctgagccagctgggccagcccagcatcttcgacacccagaagggccagggccccggcggcgacggcttctacctgcccaccgccggcgcccccggcagcctgcacagccacgcccccagcgccagaacccccggcggcggccacagcagcggcgcccccgccaagggcagcagcagcagagacggccccgccaaggagagagccggcagaggcggcgagcccccccccctgttcggcaagaaggaccccagagccagaggcgaggaggccagcggccccagaggcgtggtggacctgacccaggaggccagagccgagggcagacaggacagaggcccccccagactggccgagagactgagccccttcctggccgagagcaagaccaagaacgccgccctgcagcccagcgtgctgaccatgtgcaacggcggcgccggcgacgtgggcctgcccgccctggtggccgaggccggcagaggcggcgccaaggaggccgccagacaggacgagggcgccagactgctgagaagaaccgagaccctgctgcccggccccagaccctgccccagccccctgccccccccccccgccccccccaagggcccccccgccccccccgccgccacccccgccggcgtgtacaccgtgttcagagagcagggcagagagcacagagtggtggcccccaccttcgtgcccagcgtggaggccttcgacgagagacccggccccatccagatcgccagccaggccagagacgccagagccagagagagagaggccggcagacccggcgtgctgcaggccccccccggcagccccagacccctggacagacccgagggcctgagagagaagaacagcgtgatcagaagcctgaagagacccccccccgccgacgcccccaccgtgagagccaccagagccagccccgaccccagagcctacgtgcccgccaaggagctgctgaagcccgaggccgaccccagaccctgcgagagagcccccagaggccccgccggccccgccgcccagcaggccgccaagctgttcggcctggagcccggcagacccccccccaccggccccgagcacaagtggaagcccttcgagctgggcaacttcgccgccacccagatggccgtgctggccgcccagcaccaccacagcagagccgaggaggaggccgccgtggtggccgccagcagcagcaagaaggcctacctggaccccggcgccgtgctgcccagaagcgccgccacctgcggcagacccgtggccgacatgcacagcgccgcccacggcagcggcgaggccagcgccatgcagagcctgatcaagtacagcggcagcttcgccagagacgccgtggccgtgagacccggcggctgcggcaagaagagccccttcggcggcctgggcaccatgaagcccgagcccgcccccaccagcgccggcgccagcagagcccaggccagactgccccacagcggcggccccgccgccggcggcggcagacagctgaagagagaccccgagagacccgagagcgccaaggccttcggcagagagggcagcggcgcccagggcgaggccgaggtgagacacccccccgtgggcatcgccgtggccgtggccagacagaaggacagcggcggcagcggcagactgggccccggcctggtggaccaggagagaagcctgagcctgagcaacgtgaagggccacggcagagccgacgaggactgcgtggacgacagagccagacacagagaggagagactgctgggcgccagactggacagagaccaggagaagctgctgagagagagcaaggagctggccgacctggccagactgcaccccaccagctgcgcccccaacggcctgaaccccaacctgatggtgaccggcggccccgccctggccggcagcggcagatggagcgccgaccccgccgcccacctggccacccacccctggctgcccagaagcggcaacgccagcatgtggctggccggccacccctacggcctgggcccccccagcctgcaccagggcatggcccccgccttcccccccggcctgggcggcagcctgcccagcgcctaccagttcgtgagagacccccagagcggccagctggtggtgatccccagcgaccacctgccccacttcgccgagctgatggagagagccaccgtgccccccctgtggcccgccctgtacccccccggcagaagccccctgcaccacgcccagcagctgcagctgttcagccagcagcacttcctgagacagcaggagttcctgtacctgcagcagcaggccgcccaggccctggagctgcagagaagcgcccagctggtgcaggagagactgaaggcccaggagcacagagccgagatggaggagaagggcagcaagagaggcctggaggccgccggcaaggccggcctggccaccgccggccccggcctgctgcccagaaagccccccggcctggccgccggccccgccggcacctacggcaaggccgtgagccccccccccagccccagagccagccccgtggccgccctgaaggccaaggtgatccagaagctggaggacgtgagcaagccccccgcctacgcctaccccgccacccccagcagccaccccaccagccccccccccgccagccccccccccacccccggcatcaccagaaaggaggaggcccccgagaacgtggtggagaagaaggacctggagctggagaaggaggcccccagccccttccaggccctgttcagcgacatcccccccagataccccttccaggccctgcccccccactacggcagaccctaccccttcctgctgcagcccaccgccgccgccgacgccgacggcctggcccccgacgtgcccctgcccgccgacggccccgagagactggccctgagccccgaggacaagcccatcagactgagccccagcaagatcaccgagcccctgagagagggccccgaggaggagcccctggccgagagagaggtgaaggccgaggtggaggacatggacgagggccccaccgagctgccccccctggagagccccctgcccctgcccgccgccgaggccatggccacccccagccccgccggcggctgcggcggcggcctgctggaggcccaggccctgagcgccaccggccagagctgcgccgagcccagcgagtgccccgacttcgtggagggccccgagcccagagtggacagccccggcagaaccgagccctgcaccgccgccctggacctgggcgtgcagctgacccccgagaccctggtggaggccaaggaggagcccgtggaggtgcccgtggccgtgcccgtggtggaggccgtgcccgaggagggcctggcccaggtggcccccagcgagagccagcccaccctggagatgagcgactgcgacgtgcccgccggcgagggccagtgccccagcctggagccccaggaggccgtgcccgtgctgggcagcacctgcttcctggaggaggccagcagcgaccagttcctgcccagcctggaggaccccctggccggcatgaacgccctggccgccgccgccgagctgccccaggccagacccctgcccagccccggcgccgccggcgcccaggccctggagaagctggaggccgccgagagcctggtgctggagcagagcttcctgcacggcatcaccctgctgagcgagatcgccgagctggagctggagagaagaagccaggagatgggcggcgccgagagagccctggtggccagacccagcctggagagcctgctggccgccggcagccacatgctgagagaggtgctggacggccccgtggtggaccccctgaagaacctgagactgcccagagagctgaagcccaacaagaagtacagctggatgagaaagaaggaggagagaatgtacgccatgaagagcagcctggaggacatggacgccctggagctggacttcagaatgagactggccgaggtgcagagacagtacaaggagaagcagagagagctggtgaagctgcagagaagaagagacagcgaggacagaagagaggagccccacagaagcctggccagaagaggccccggcagacccagaaagagaacccacgcccccagcgccctgagcccccccagaaagagaggcaagagcggccacagcagcggcaagctgagcagcaagagcctgctgaccagcgacgactacgagctgggcgccggcatcagaaagagacacaagggcagcgaggaggagcacgacgccctgatcggcatgggcaaggccagaggcagaaaccagacctgggacgagcacgaggccagcagcgacttcatcagccagctgaagatcaagaagaagaagatggccagcgaccaggagcagctggccagcaagctggacaaggccctgagcctgaccaagcaggacaagctgaagagccccttcaagttcagcgacagcgccggcggcaagagcaagaccagcggcggctgcggcagatacctgaccccctacgacagcctgctgggcaagaacagaaaggccctggccaagggcctgggcctgagcctgaagagcagcagagagggcaagcacaagagagccgccaagaccagaaagatggaggtgggcttcaaggccagaggccagcccaagagcgcccacagccccttcgccagcgaggtgagcagctacagctacaacaccgacagcgaggaggacgaggagttcctgaaggacgagtggcccgcccagggccccagcagcagcaagctgacccccagcctgctgtgcagcatggtggccaagaacagcaaggccgccggcggccccaagctgaccaagagaggcctggccgcccccagaaccctgaagcccaagcccgccaccagcagaaagcagcccttctgcctgctgctgagagaggccgaggccagaagcagcttcagcgacagcagcgaggagagcttcgaccaggacgagagcagcgaggaggaggacgaggaggaggagctggaggaggaggacgaggccagcggcggcggctacagactgggcgccagagagagagccctgagccccggcctggaggagagcggcctgggcctgctggccagattcgccgccagcgccctgcccagccccaccgtgggccccagcctgagcgtggtgcagctggaggccaagcagaaggccagaaagaaggaggagagacagagcctgctgggcaccgagttcgagtacaccgacagcgagagcgaggtgaaggtgagaaagagaagccccgccggcctgctgagacccaagaagggcctgggcgagcccggccccagcctggccgcccccacccccggcgccagaggccccgaccccagcagccccgacaaggccaagctggccgtggagaagggcagaaaggccagaaagctgagaggccccaaggagcccggcttcgaggccggccccgaggccagcgacgacgacctgtggaccagaagaagaagcgagagaatcttcctgcacgacgccagcgccgccgcccccgcccccgtgagcaccgcccccgccaccaagaccagcagatgcgccaagggcggccccctgagccccagaaaggacgccggcagagccaaggacagaaaggaccccagaaagaagaagaagggcaaggaggccggccccggcgccggcctgcccccccccagagcccccgccctgcccagcgaggccagagccccccacgccagcagcctgaccgccgccaagagaagcaaggccaaggccaagggcaaggaggtgaagaaggagaacagaggcaagggcggcgccgtgagcaagctgatggagagcatggccgccgaggaggacttcgagcccaaccaggacagcagcttcagcgaggacgagcacctgcccagaggcggcgccgtggagagacccctgacccccgcccccagaagctgcatcatcgacaaggacgagctgaaggacggcctgagagtgctgatccccatggacgacaagctgctgtacgccggccacgtgcagaccgtgcacagccccgacatctacagagtggtggtggagggcgagagaggcaacagaccccacatctactgcctggagcagctgctgcaggaggccatcatcgacgtgagacccgccagcaccagattcctgccccagggcaccagaatcgccgcctactggagccagcagtacagatgcctgtaccccggcaccgtggtgagaggcctgctggacctggaggacgacggcgacctgatcaccgtggagttcgacgacggcgacaccggcagaatccccctgagccacatcagactgctgccccccgactacaagatccagtgcgccgagcccagccccgccctgctggtgcccagcgccaagagaagaagcagaaagaccagcaaggacaccggcgagggcaaggacggcggcaccgccggcagcgaggagcccggcgccaaggccagaggcagaggcagaaagcccagcgccaaggccaagggcggcagagccgccaccctggaggagggcaaccccaccgacgaggtgcccagcacccccctggccctggagcccagcagcacccccggcagcaagaagagcccccccgagcccgtggacaagagagccaaggcccccaaggccagacccgcccccccccagcccagccccgccccccccgccttcaccagctgccccgcccccgagcccttcgccgagctgcccgcccccgccaccagcctggcccccgcccccctgatcaccatgcccgccaccagacccaagcccaagaaggccagagccgccgaggagagcggcgccaagggccccagaagacccggcgaggaggccgagctgctggtgaagctggaccacgagggcgtgaccagccccaagagcaagaaggccaaggaggccctgctgctgagagaggaccccggcgccggcggctggcaggagcccaagagcctgctgagcctgggcagctacccccccgccgccggcagcagcgagcccaaggccccctggcccaaggccaccgacggcgacctggcccaggagcccggccccggcctgaccttcgaggacagcggcaaccccaagagccccgacaaggcccaggccgagcaggacggcgccgaggagagcgagagcagcagcagcagcagcagcggcagcagcagcagcagcagcagcagcagcagcagcggcagcgagaccgagggcgaggaggagggcgacaagaacggcgacggcggctgcggcaccggcggcagaaactgcagcgccgccagcagcagagccgccagccccgccagcagcagcagcagcagcagcagcagcagcagcagcagcagcagcagcagcagcagcagcagcagcagcagcagcagcagcagcagcagcagcagcagcagcagcagcagcagcagcagcagcagcagcagcagcagcagcagcagcagcagcagcagcagcagcagcagcagcaccaccgacgaggacagcagctgcagcagcgacgacgaggccgcccccgcccccaccgccggccccagcgcccaggccgccctgcccaccaaggccaccaagcaggccggcaaggccagacccagcgcccacagccccggcaagaagacccccgccccccagccccaggccccccccccccagcccacccagcccctgcagcccaaggcccaggccggcgccaagagcagacccaagaagagagagggcgtgcacctgcccaccaccaaggagctggccaagagacagagactgcccagcgtggagaacagacccaagatcgccgccttcctgcccgccagacagctgtggaagtggttcggcaagcccacccagagaagaggcatgaagggcaaggccagaaagctgttctacaaggccatcgtgagaggcaaggagatgatcagaatcggcgactgcgccgtgttcctgagcgccggcagacccaacctgccctacatcggcagaatccagagcatgtgggagagctggggcaacaacatggtggtgagagtgaagtggttctaccaccccgaggagaccagccccggcaagcagttccaccagggccagcactgggaccagaagagcagcagaagcctgcccgccgccctgagagtgagcagccagagaaaggacttcatggagagagccctgtaccagagcagccacgtggacgagaacgacgtgcagaccgtgagccacaagtgcctggtggtgggcctggagcagtacgagcagatgctgaagaccaagaagtaccaggacagcgagggcctgtactacctggccggcacctacgagcccaccaccggcatgatcttcagcaccgacggcgtgcccgtgctgtgctag

SEQ ID NO: 25332 - DNA, 3939 bp, Artificial Sequence
  Description of Artificial Sequence: Synthetic coding sequence
atggaggagaagggcagcaagagaggcctggaggccgccggcaaggccggcctggccaccgccggccccggcctgctgcccagaaagccccccggcctggccgccggccccgccggcacctacggcaaggccgtgagccccccccccagccccagagccagccccgtggccgccctgaaggccaaggtgatccagaagctggaggacgtgagcaagccccccgcctacgcctaccccgccacccccagcagccaccccaccagccccccccccgccagccccccccccacccccggcatcaccagaaaggaggaggcccccgagaacgtggtggagaagaaggacctggagctggagaaggaggcccccagccccttccaggccctgttcagcgacatcccccccagataccccttccaggccctgcccccccactacggcagaccctaccccttcctgctgcagcccaccgccgccgccgacgccgacggcctggcccccgacgtgcccctgcccgccgacggccccgagagactggccctgagccccgaggacaagcccatcagactgagccccagcaagatcaccgagcccctgagagagggccccgaggaggagcccctggccgagagagaggtgaaggccgaggtggaggacatggacgagggccccaccgagctgccccccctggagagccccctgcccctgcccgccgccgaggccatggccacccccagccccgccggcggctgcggcggcggcctgctggaggcccaggccctgagcgccaccggccagagctgcgccgagcccagcgagtgccccgacttcgtggagggccccgagcccagagtggacagccccggcagaaccgagccctgcaccgccgccctggacctgggcgtgcagctgacccccgagaccctggtggaggccaaggaggagcccgtggaggtgcccgtggccgtgcccgtggtggaggccgtgcccgaggagggcctggcccaggtggcccccagcgagagccagcccaccctggagatgagcgactgcgacgtgcccgccggcgagggccagtgccccagcctggagccccaggaggccgtgcccgtgctgggcagcacctgcttcctggaggaggccagcagcgaccagttcctgcccagcctggaggaccccctggccggcatgaacgccctggccgccgccgccgagctgccccaggccagacccctgcccagccccggcgccgccggcgcccaggccctggagaagctggaggccgccgagagcctggtgctggagcagagcttcctgcacggcatcaccctgctgagcgagatcgccgagctggagctggagagaagaagccaggagatgggcggcgccgagagagccctggtggccagacccagcctggagagcctgctggccgccggcagccacatgctgagagaggtgctggacggccccgtggtggaccccctgaagaacctgagactgcccagagagctgaagcccaacaagaagtacagctggatgagaaagaaggaggagagaatgtacgccatgaagagcagcctggaggacatggacgccctggagctggacttcagaatgagactggccgaggtgcagagacagtacaaggagaagcagagagagctggtgaagctgcagagaagaagagacagcgaggacagaagagaggagccccacagaagcctggccagaagaggccccggcagacccagaaagagaacccacgcccccagcgccctgagcccccccagaaagagaggcaagagcggccacagcagcggcaagctgagcagcaagagcctgctgaccagcgacgactacgagctgggcgccggcatcagaaagagacacaagggcagcgaggaggagcacgacgccctgatcggcatgggcaaggccagaggcagaaaccagacctgggacgagcacgaggccagcagcgacttcatcagccagctgaagatcaagaagaagaagatggccagcgaccaggagcagctggccagcaagctggacaaggccctgagcctgaccaagcaggacaagctgaagagccccttcaagttcagcgacagcgccggcggcaagagcaagaccagcggcggctgcggcagatacctgaccccctacgacagcctgctgggcaagaacagaaaggccctggccaagggcctgggcctgagcctgaagagcagcagagagggcaagcacaagagagccgccaagaccagaaagatggaggtgggcttcaaggccagaggccagcccaagagcgcccacagccccttcgccagcgaggtgagcagctacagctacaacaccgacagcgaggaggacgaggagttcctgaaggacgagtggcccgcccagggccccagcagcagcaagctgacccccagcctgctgtgcagcatggtggccaagaacagcaaggccgccggcggccccaagctgaccaagagaggcctggccgcccccagaaccctgaagcccaagcccgccaccagcagaaagcagcccttctgcctgctgctgagagaggccgaggccagaagcagcttcagcgacagcagcgaggagagcttcgaccaggacgagagcagcgaggaggaggacgaggaggaggagctggaggaggaggacgaggccagcggcggcggctacagactgggcgccagagagagagccctgagccccggcctggaggagagcggcctgggcctgctggccagattcgccgccagcgccctgcccagccccaccgtgggccccagcctgagcgtggtgcagctggaggccaagcagaaggccagaaagaaggaggagagacagagcctgctgggcaccgagttcgagtacaccgacagcgagagcgaggtgaaggtgagaaagagaagccccgccggcctgctgagacccaagaagggcctgggcgagcccggccccagcctggccgcccccacccccggcgccagaggccccgaccccagcagccccgacaaggccaagctggccgtggagaagggcagaaaggccagaaagctgagaggccccaaggagcccggcttcgaggccggccccgaggccagcgacgacgacctgtggaccagaagaagaagcgagagaatcttcctgcacgacgccagcgccgccgcccccgcccccgtgagcaccgcccccgccaccaagaccagcagatgcgccaagggcggccccctgagccccagaaaggacgccggcagagccaaggacagaaaggaccccagaaagaagaagaagggcaaggaggccggccccggcgccggcctgcccccccccagagcccccgccctgcccagcgaggccagagcccccccccccccccccccccccccccccccccacccccccctgccccccccccccctgccccccccccccctgcccctgagactgccccccctgccccccccccccctgcccagaccccacccccccccccccccccccctgccccccctgctgccccccccccagaccagaaccctgcccgccgccagaaccatgagacagccccccccccccagactggccctgcccagaagaagaagaagcccccccagaccccccagcagacccgccagaagaggccccagacccaccccccaggccagaagaagacccagacccagccccagaagactgctgagaagcccccacagcctgtgcagccccagactgagacccggccccagagccgaccccagaagagagagagccagcaccagccccccccccagaagctggcccagcggcagcgcctgcagaccctggagaaccggccccagaagcccccccagctgccagcccggcagcagcggcagcggcagcgccagcccccccagcggcgtggcctag

SEQ ID NO: 25333 - DNA, 912 bp, Artificial Sequence
  Description of Artificial Sequence: Synthetic coding sequence
atggacggcagagacttcggcccccagagaagcgtgcacggcccccccccccccctgctgagcggcctggccatggacagccacagagtgggcgccgccaccgccggcagactgcccgccagcggcctgcccggccccctgccccccggcaagtacatggccggcctgaacctgcacccccaccccggcaagtgccccgccccctgccccagcccccccgtgttccccggcagaagcaccagacccggcccccccgtgcacagcagacccggcctgggcgacagccccagcgtgggccacggcggcgccggcagactgggcagccagggctgggagacccccggccccggcgccaaggccgtggagagcgtggccagactgggctacctgttcagaagcgtgctgggccccagagagcccaaggccggcgtggtggccagagccaccggcgccatccccatccccggcgcccccgccgccagagcctgggccggcgtgttcaagatctgggccagaaaggagcagaccggccccgcccccagagagacccccctgcccgagctggagagcttcagctggcagaccctgctgctggccctggtgggcccccccggcttctgcagccagctgcaccacagcagaagagccggcagcctggccgtgaccgagagaagaggcatgagagagtacgccggcggctgcggcagcaccgtgacccccgccctgggcccctggcccagaggcggcagagacgcccccttcttccccggcagaaccgccgccctgggcacctgcacccccgtgggcggcagaagacccagacccagcggcaccccctgcttccccgccagaaagagagtgagaagatgcggcagagacaccgagaccggccccagcagaagcagaacctag

SEQ ID NO: 25334 - DNA, 8907 bp, Artificial Sequence
  Description of Artificial Sequence: Synthetic coding sequence
atggacggcagagacttcggcccccagagaagcgtgcacggcccccccccccccctgctgagcggcctggccatggacagccacagagtgggcgccgccaccgccggcagactgcccgccagcggcctgcccggccccctgccccccggcaagtacatggccggcctgaacctgcacccccaccccggcgaggccttcctgggcagcttcgtggccagcggcatgggccccagcgccagcagccacggcagccccgtgcccctgcccagcgacctgagcttcagaagccccacccccagcaacctgcccatggtgcagctgtgggccgcccacgcccacgagggcttcagccacctgcccagcggcctgtaccccagctacctgcacctgaaccacctggagccccccagcagcggcagccccctgctgagccagctgggccagcccagcatcttcgacacccagaagggccagggccccggcggcgacggcttctacctgcccaccgccggcgcccccggcagcctgcacagccacgcccccagcgccagaacccccggcggcggccacagcagcggcgcccccgccaagggcagcagcagcagagacggccccgccaaggagagagccggcagaggcggcgagcccccccccctgttcggcaagaaggaccccagagccagaggcgaggaggccagcggccccagaggcgtggtggacctgacccaggaggccagagccgagggcagacaggacagaggcccccccagactggccgagagactgagccccttcctggccgagagcaagaccaagaacgccgccctgcagcccagcgtgctgaccatgtgcaacggcggcgccggcgacgtgggcctgcccgccctggtggccgaggccggcagaggcggcgccaaggaggccgccagacaggacgagggcgccagactgctgagaagaaccgagaccctgctgcccggccccagaccctgccccagccccctgccccccccccccgccccccccaagggcccccccgccccccccgccgccacccccgccggcgtgtacaccgtgttcagagagcagggcagagagcacagagtggtggcccccaccttcgtgcccagcgtggaggccttcgacgagagacccggccccatccagatcgccagccaggccagagacgccagagccagagagagagaggccggcagacccggcgtgctgcaggccccccccggcagccccagacccctggacagacccgagggcctgagagagaagaacagcgtgatcagaagcctgaagagacccccccccgccgacgcccccaccgtgagagccaccagagccagccccgaccccagagcctacgtgcccgccaaggagctgctgaagcccgaggccgaccccagaccctgcgagagagcccccagaggccccgccggccccgccgcccagcaggccgccaagctgttcggcctggagcccggcagacccccccccaccggccccgagcacaagtggaagcccttcgagctgggcaacttcgccgccacccagatggccgtgctggccgcccagcaccaccacagcagagccgaggaggaggccgccgtggtggccgccagcagcagcaagaaggcctacctggaccccggcgccgtgctgcccagaagcgccgccacctgcggcagacccgtggccgacatgcacagcgccgcccacggcagcggcgaggccagcgccatgcagagcctgatcaagtacagcggcagcttcgccagagacgccgtggccgtgagacccggcggctgcggcaagaagagccccttcggcggcctgggcaccatgaagcccgagcccgcccccaccagcgccggcgccagcagagcccaggccagactgccccacagcggcggccccgccgccggcggcggcagacagctgaagagagaccccgagagacccgagagcgccaaggccttcggcagagagggcagcggcgcccagggcgaggccgaggtgagacacccccccgtgggcatcgccgtggccgtggccagacagaaggacagcggcggcagcggcagactgggccccggcctggtggaccaggagagaagcctgagcctgagcaacgtgaagggccacggcagagccgacgaggactgcgtggacgacagagccagacacagagaggagagactgctgggcgccagactggacagagaccaggagaagctgctgagagagagcaaggagctggccgacctggccagactgcaccccaccagctgcgcccccaacggcctgaaccccaacctgatggtgaccggcggccccgccctggccggcagcggcagatggagcgccgaccccgccgcccacctggccacccacccctggctgcccagaagcggcaacgccagcatgtggctggccggccacccctacggcctgggcccccccagcctgcaccagggcatggcccccgccttcccccccggcctgggcggcagcctgcccagcgcctaccagttcgtgagagacccccagagcggccagctggtggtgatccccagcgaccacctgccccacttcgccgagctgatggagagagccaccgtgccccccctgtggcccgccctgtacccccccggcagaagccccctgcaccacgcccagcagctgcagctgttcagccagcagcacttcctgagacagcaggagttcctgtacctgcagcagcaggccgcccaggccctggagctgcagagaagcgcccagctggtgcaggagagactgaaggcccaggagcacagagccgagatggaggagaagggcagcaagagaggcctggaggccgccggcaaggccggcctggccaccgccggccccggcctgctgcccagaaagccccccggcctggccgccggccccgccggcacctacggcaaggccgtgagccccccccccagccccagagccagccccgtggccgccctgaaggccaaggtgatccagaagctggaggacgtgagcaagccccccgcctacgcctaccccgccacccccagcagccaccccaccagccccccccccgccagccccccccccacccccggcatcaccagaaaggaggaggcccccgagaacgtggtggagaagaaggacctggagctggagaaggaggcccccagccccttccaggccctgttcagcgacatcccccccagataccccttccaggccctgcccccccactacggcagaccctaccccttcctgctgcagcccaccgccgccgccgacgccgacggcctggcccccgacgtgcccctgcccgccgacggccccgagagactggccctgagccccgaggacaagcccatcagactgagccccagcaagatcaccgagcccctgagagagggccccgaggaggagcccctggccgagagagaggtgaaggccgaggtggaggacatggacgagggccccaccgagctgccccccctggagagccccctgcccctgcccgccgccgaggccatggccacccccagccccgccggcggctgcggcggcggcctgctggaggcccaggccctgagcgccaccggccagagctgcgccgagcccagcgagtgccccgacttcgtggagggccccgagcccagagtggacagccccggcagaaccgagccctgcaccgccgccctggacctgggcgtgcagctgacccccgagaccctggtggaggccaaggaggagcccgtggaggtgcccgtggccgtgcccgtggtggaggccgtgcccgaggagggcctggcccaggtggcccccagcgagagccagcccaccctggagatgagcgactgcgacgtgcccgccggcgagggccagtgccccagcctggagccccaggaggccgtgcccgtgctgggcagcacctgcttcctggaggaggccagcagcgaccagttcctgcccagcctggaggaccccctggccggcatgaacgccctggccgccgccgccgagctgccccaggccagacccctgcccagccccggcgccgccggcgcccaggccctggagaagctggaggccgccgagagcctggtgctggagcagagcttcctgcacggcatcaccctgctgagcgagatcgccgagctggagctggagagaagaagccaggagatgggcggcgccgagagagccctggtggccagacccagcctggagagcctgctggccgccggcagccacatgctgagagaggtgctggacggccccgtggtggaccccctgaagaacctgagactgcccagagagctgaagcccaacaagaagtacagctggatgagaaagaaggaggagagaatgtacgccatgaagagcagcctggaggacatggacgccctggagctggacttcagaatgagactggccgaggtgcagagacagtacaaggagaagcagagagagctggtgaagctgcagagaagaagagacagcgaggacagaagagaggagccccacagaagcctggccagaagaggccccggcagacccagaaagagaacccacgcccccagcgccctgagcccccccagaaagagaggcaagagcggccacagcagcggcaagctgagcagcaagagcctgctgaccagcgacgactacgagctgggcgccggcatcagaaagagacacaagggcagcgaggaggagcacgacgccctgatcggcatgggcaaggccagaggcagaaaccagacctgggacgagcacgaggccagcagcgacttcatcagccagctgaagatcaagaagaagaagatggccagcgaccaggagcagctggccagcaagctggacaaggccctgagcctgaccaagcaggacaagctgaagagccccttcaagttcagcgacagcgccggcggcaagagcaagaccagcggcggctgcggcagatacctgaccccctacgacagcctgctgggcaagaacagaaaggccctggccaagggcctgggcctgagcctgaagagcagcagagagggcaagcacaagagagccgccaagaccagaaagatggaggtgggcttcaaggccagaggccagcccaagagcgcccacagccccttcgccagcgaggtgagcagctacagctacaacaccgacagcgaggaggacgaggagttcctgaaggacgagtggcccgcccagggccccagcagcagcaagctgacccccagcctgctgtgcagcatggtggccaagaacagcaaggccgccggcggccccaagctgaccaagagaggcctggccgcccccagaaccctgaagcccaagcccgccaccagcagaaagcagcccttctgcctgctgctgagagaggccgaggccagaagcagcttcagcgacagcagcgaggagagcttcgaccaggacgagagcagcgaggaggaggacgaggaggaggagctggaggaggaggacgaggccagcggcggcggctacagactgggcgccagagagagagccctgagccccggcctggaggagagcggcctgggcctgctggccagattcgccgccagcgccctgcccagccccaccgtgggccccagcctgagcgtggtgcagctggaggccaagcagaaggccagaaagaaggaggagagacagagcctgctgggcaccgagttcgagtacaccgacagcgagagcgaggtgaaggtgagaaagagaagccccgccggcctgctgagacccaagaagggcctgggcgagcccggccccagcctggccgcccccacccccggcgccagaggccccgaccccagcagccccgacaaggccaagctggccgtggagaagggcagaaaggccagaaagctgagaggccccaaggagcccggcttcgaggccggccccgaggccagcgacgacgacctgtggaccagaagaagaagcgagagaatcttcctgcacgacgccagcgccgccgcccccgcccccgtgagcaccgcccccgccaccaagaccagcagatgcgccaagggcggccccctgagccccagaaaggacgccggcagagccaaggacagaaaggaccccagaaagaagaagaagggcaaggaggccggccccggcgccggcctgcccccccccagagcccccgccctgcccagcgaggccagagccccccacgccagcagcctgaccgccgccaagagaagcaaggccaaggccaagggcaaggaggtgaagaaggagaacagaggcaagggcggcgccgtgagcaagctgatggagagcatggccgccgaggaggacttcgagcccaaccaggacagcagcttcagcgaggacgagcacctgcccagaggcggcgccgtggagagacccctgacccccgcccccagaagctgcatcatcgacaaggacgagctgaaggacggcctgagagtgctgatccccatggacgacaagctgctgtacgccggccacgtgcagaccgtgcacagccccgacatctacagagtggtggtggagggcgagagaggcaacagaccccacatctactgcctggagcagctgctgcaggaggccatcatcgacgtgagacccgccagcaccagattcctgccccagggcaccagaatcgccgcctactggagccagcagtacagatgcctgtaccccggcaccgtggtgagaggcctgctggacctggaggacgacggcgacctgatcaccgtggagttcgacgacggcgacaccggcagaatccccctgagccacatcagactgctgccccccgactacaagatccagtgcgccgagcccagccccgccctgctggtgcccagcgccaagagaagaagcagaaagaccagcaaggacaccggcgagggcaaggacggcggcaccgccggcagcgaggagcccggcgccaaggccagaggcagaggcagaaagcccagcgccaaggccaagggcgacagagccgccaccctggaggagggcaaccccaccgacgaggtgcccagcacccccctggccctggagcccagcagcacccccggcagcaagaagagcccccccgagcccgtggacaagagagccaaggcccccaaggccagacccgcccccccccagcccagccccgccccccccgccttcaccagctgccccgcccccgagcccttcgccgagctgcccgcccccgccaccagcctggcccccgcccccctgatcaccatgcccgccaccagacccaagcccaagaaggccagagccgccgaggagagcggcgccaagggccccagaagacccggcgaggaggccgagctgctggtgaagctggaccacgagggcgtgaccagccccaagagcaagaaggccaaggaggccctgctgctgagagaggaccccggcgccggcggctggcaggagcccaagagcctgctgagcctgggcagctacccccccgccgccggcagcagcgagcccaaggccccctggcccaaggccaccgacggcgacctggcccaggagcccggccccggcctgaccttcgaggacagcggcaaccccaagagccccgacaaggcccaggccgagcaggacggcgccgaggagagcgagagcagcagcagcagcagcagcggcagcagcagcagcagcagcagcagcagcagcagcggcagcgagaccgagggcgaggaggagggcgacaagaacggcgacggcggctgcggcaccggcggcagaaactgcagcgccgccagcagcagagccgccagccccgccagcagcagcagcagcagcagcagcagcagcagcagcagcagcagcagcagcagcagcagcagcagcagcagcagcagcagcagcagcagcagcagcagcagcagcagcagcagcagcagcagcagcagcagcagcagcagcagcagcagcagcagcagcagcagcagcagcagcaccaccgacgaggacagcagctgcagcagcgacgacgaggccgcccccgcccccaccgccggccccagcgcccaggccgccctgcccaccaaggccaccaagcaggccggcaaggccagacccagcgcccacagccccggcaagaagacccccgccccccagccccaggccccccccccccagcccacccagcccctgcagcccaaggcccaggccggcgccaagagcagacccaagaagagagagggcgtgcacctgcccaccaccaaggagctggccaagagacagagactgcccagcgtggagaacagacccaagatcgccgccttcctgcccgccagacagctgtggaagtggttcggcaagcccacccagagaagaggcatgaagggcaaggccagaaagctgttctacaaggccatcgtgagaggcaaggagatgatcagaatcggcgactgcgccgtgttcctgagcgccggcagacccaacctgccctacatcggcagaatccagagcatgtgggagagctggggcaacaacatggtggtgagagtgaagtggttctaccaccccgaggagaccagccccggcaagcagttccaccagggccagcactgggaccagaagagcagcagaagcctgcccgccgccctgagagtgagcagccagagaaaggacttcatggagagagccctgtaccagagcagccacgtggacgagaacgacgtgcagaccgtgagccacaagtgcctggtggtgggcctggagcagtacgagcagatgctgaagaccaagaagtaccaggacagcgagggcctgtactacctggccggcacctacgagcccaccaccggcatgatcttcagcaccgacggcgtgcccgtgctgtgctag

SEQ ID NO: 25335 - DNA, 504 bp, Artificial Sequence
  Description of Artificial Sequence: Synthetic coding sequence
atgatcaaggactgcggcgccacctgggtggtgctgggccacagcgagagaagacacgtgttcggcgagagcgacgagctgatcggccagaaggtggcccacgccctggccgagggcctgggcgtgatcgcctgcatcggcgagaagctggacgagagagaggccggcatcaccgagaaggtggtgttcgagcagaccaaggtgatcgccgacaacgtgaaggactggagcaaggtggtgctggcctacgagcccgtgtgggccatcggcaccggcaagaccgccaccccccagcaggcccaggaggtgcacgagaagctgagaggctggctgaagagcaacgtgagcgacgccgtggcccagagcaccagaatcatctacggcggcagcgtgaccggcgccacctgcaaggagctggccagccagcccgacgtggacggcttcctggtgggcggcgccagcctgaagcccgagttcgtggacatcatcaacgccaagcagtag

SEQ ID NO: 25336 - DNA, 1398 bp, Artificial Sequence
  Description of Artificial Sequence: Synthetic coding sequence
atgcccgccacccccagcctgaaggtggtgcacgagctgcccgcctgcaccctgtgcgccggccccctggaggacgccgtgaccatcccctgcggccacaccttctgcagactgtgcctgcccgccctgagccagatgggcgcccagagcagcggcaagatcctgctgtgccccctgtgccaggaggaggagcaggccgagacccccatggcccccgtgcccctgggccccctgggcgagacctactgcgaggagcacggcgagaagatctacttcttctgcgagaacgacgccgagttcctgtgcgtgttctgcagagagggccccacccaccaggcccacaccgtgggcttcctggacgaggccatccagccctacagagacagactgagaagcagactggaggccctgagcaccgagagagacgagatcgaggacgtgaagtgccaggaggaccagaagctgcaggtgctgctgacccagatcgagagcaagaagcaccaggtggagaccgccttcgagagactgcagcaggagctggagcagcagagatgcctgctgctggccagactgagagagctggagcagcagatctggaaggagagagacgagtacatcaccaaggtgagcgaggaggtgaccagactgggcgcccaggtgaaggagctggaggagaagtgccagcagcccgccagcgagctgctgcaggacgtgagagtgaaccagagcagatgcgagatgaagaccttcgtgagccccgaggccatcagccccgacctggtgaagaagatcagagacttccacagaaagatcctgaccctgcccgagatgatgagaatgttcagcgagaacctggcccaccacctggagatcgacagcggcgtgatcaccctggacccccagaccgccagcagaagcctggtgctgagcgaggacagaaagagcgtgagatacaccagacagaagaagagcctgcccgacagccccctgagattcgacggcctgcccgccgtgctgggcttccccggcttcagcagcggcagacacagatggcaggtggacctgcagctgggcgacggcggcggctgcaccgtgggcgtggccggcgagggcgtgagaagaaagggcgagatgggcctgagcgccgaggacggcgtgtgggccgtgatcatcagccaccagcagtgctgggccagcaccagccccggcaccgacctgcccctgagcgagatccccagaggcgtgagagtggccctggactacgaggccggccaggtgaccctgcacaacgcccagacccaggagcccatcttcaccttcaccgccagcttcagcggcaaggtgttccccttcttcgccgtgtggaagaagggcagctgcctgaccctgaagggctag

SEQ ID NO: 25337 - DNA, 348 bp, Artificial Sequence
  Description of Artificial Sequence: Synthetic coding sequence
atgcccgccacccccagcctgaaggtggtgcacgagctgcccgcctgcaccctgtgcgccggccccctggaggacgccgtgaccatcccctgcggccacaccttctgcagactgtgcctgcccgccctgagccagatgggcgcccagagcagcggcaagatcctgctgtgccccctgtgccaggaggaggagcaggccgagacccccatggcccccgtgcccctgggccccctgggcgagacctactgcgaggagcacggcgagaagatctacttcttctgcgagaacgacgccgagttcctgtgcgtgagcgagtgcagaaccaccgacggcttcggctgcgcctag

SEQ ID NO: 25338 - DNA, 1398 bp, Artificial Sequence; identical to SEQ ID NO: 25336
  Description of Artificial Sequence: Synthetic coding sequence

SEQ ID NO: 25339 - DNA, 1191 bp, Artificial Sequence
  Description of Artificial Sequence: Synthetic coding sequence
atggcccccgtgcccctgggccccctgggcgagacctactgcgaggagcacggcgagaagatctacttcttctgcgagaacgacgccgagttcctgtgcgtgttctgcagagagggccccacccaccaggcccacaccgtgggcttcctggacgaggccatccagccctacagagacagactgagaagcagactggaggccctgagcaccgagagagacgagatcgaggacgtgaagtgccaggaggaccagaagctgcaggtgctgctgacccagatcgagagcaagaagcaccaggtggagaccgccttcgagagactgcagcaggagctggagcagcagagatgcctgctgctggccagactgagagagctggagcagcagatctggaaggagagagacgagtacatcaccaaggtgagcgaggaggtgaccagactgggcgcccaggtgaaggagctggaggagaagtgccagcagcccgccagcgagctgctgcaggtgatcagagagggcctgcacggctgcgagatgaagaccttcgtgagccccgaggccatcagccccgacctggtgaagaagatcagagacttccacagaaagatcctgaccctgcccgagatgatgagaatgttcagcgagaacctggcccaccacctggagatcgacagcggcgtgatcaccctggacccccagaccgccagcagaagcctggtgctgagcgaggacagaaagagcgtgagatacaccagacagaagaagagcctgcccgacagccccctgagattcgacggcctgcccgccgtgctgggcttccccggcttcagcagcggcagacacagatggcaggtggacctgcagctgggcgacggcggcggctgcaccgtgggcgtggccggcgagggcgtgagaagaaagggcgagatgggcctgagcgccgaggacggcgtgtgggccgtgatcatcagccaccagcagtgctgggccagcaccagccccggcaccgacctgcccctgagcgagatccccagaggcgtgagagtggccctggactacgaggccggccaggtgaccctgcacaacgcccagacccaggagcccatcttcaccttcaccgccagcttcagcggcaaggtgttccccttcttcgccgtgtggaagaagggcagctgcctgaccctgaagggctag

SEQ ID NO: 25340 - DNA, 1398 bp, Artificial Sequence; identical to SEQ ID NO: 25336
  Description of Artificial Sequence: Synthetic coding sequence

SEQ ID NO: 25341 - DNA, 1398 bp, Artificial Sequence; identical to SEQ ID NO: 25336
  Description of Artificial Sequence: Synthetic coding sequence

SEQ ID NO: 25342 - DNA, 495 bp, Artificial Sequence
  Description of Artificial Sequence: Synthetic coding sequence
tgaaagaagcaccaggtggagaccgccttcgagagactgcagcaggagctggagcagcagagatgcctgctgctggccagactgagagagctggagcagcagatctggaaggagagagacgagtacatcaccaaggtgagcgaggaggtgaccagactgggcgcccaggtgaaggagctggaggagaagtgccagcagcccgccagcgagctgctgcaggacgtgagagtgaaccagagcagatgcgagatgaagaccttcgtgagccccgaggccatcagccccgacctggtgaagaagatcagagacttccacagaaagatcctgaccctgcccgagatgatgagaatgttcagcgagaacctggcccaccacctggagatcgacagcgacagacagcccgagcccggcagcctgggcagacaggaggtgagcgaggtgcaccccgccgaggaggagcccgccagacagccccccgccctgagaagaccctag

SEQ ID NO: 25343 - DNA, 495 bp, Artificial Sequence; identical to SEQ ID NO: 25342
  Description of Artificial Sequence: Synthetic coding sequence

SEQ ID NO: 25344 - DNA, 495 bp, Artificial Sequence; identical to SEQ ID NO: 25342
  Description of Artificial Sequence: Synthetic coding sequence

SEQ ID NO: 25345 - DNA, 495 bp, Artificial Sequence; identical to SEQ ID NO: 25342
  Description of Artificial Sequence: Synthetic coding sequence

SEQ ID NO: 25346 - DNA, 1398 bp, Artificial Sequence; identical to SEQ ID NO: 25336
  Description of Artificial Sequence: Synthetic coding sequence

SEQ ID NO: 25347 - DNA, 495 bp, Artificial Sequence; identical to SEQ ID NO: 25342
  Description of Artificial Sequence: Synthetic coding sequence

SEQ ID NO: 25348 - DNA, 1398 bp, Artificial Sequence
  Description of Artificial Sequence: Synthetic coding sequence
atgcccgccacccccagcctgaaggtggtgcacgagctgcccgcctgcaccctgtgcgccggccccctggaggacgccgtgaccatcccctgcggccacaccttctgcagactgtgcctgcccgccctgagccagatgggcgcccagagcagcggcaagatcctgctgtgccccctgtgccaggaggaggagcaggccgagacccccatggcccccgtgcccctgggccccctgggcgagacctactgcgaggagcacggcgagaagatctacttcttctgcgagaacgacgccgagttcctgtgcgtgttctgcagagagggccccacccaccaggcccacaccgtgggcttcctggacgaggccatccagccctacagagacagactgagaagcagactggaggccctgagcaccgagagagacgagatcgaggacgtgaagtgccaggaggaccagaagctgcaggtgctgctgacccagatcgagagcaagaagcaccaggtggagaccgccttcgagagactgcagcaggagctggagcagcagagatgcctgctgctggccagactgagagagctggagcagcagatctggaaggagagagacgagtacatcaccaaggtgagcgaggaggtgaccagactgggcgcccaggtgaaggagctggaggagaagtgccagcagcccgccagcgagctgctgcaggacgtgagagtgaaccagagcagatgcgagatgaagaccttcgtgagccccgaggccatcagccccgacctggtgaagaagatcagagacttccacagaaagatcctgaccctgcccgagatgatgagaatgttcagcgagaacctggcccaccacctggagatcgacagcggcgtgatcaccctggacccccagaccgccagcagaagcctggtgctgagcgaggacagaaagagcgtgagatacaccagacagaagaagaacctgcccgacagccccctgagattcgacggcctgcccgccgtgctgggcttccccggcttcagcagcggcagacacagatggcaggtggacctgcagctgggcgacggcggcggctgcaccgtgggcgtggccggcgagggcgtgagaagaaagggcgagatgggcctgagcgccgaggacggcgtgtgggccgtgatcatcagccaccagcagtgctgggccagcaccagccccggcaccgacctgcccctgagcgagatccccagaggcgtgagagtggccctggactacgaggccggccaggtgaccctgcacaacgcccagacccaggagcccatcttcaccttcaccgccagcttcagcggcaaggtgttccccttcttcgccgtgtggaagaagggcagctgcctgaccctgaagggctag

SEQ ID NO: 25349 - DNA, 1398 bp, Artificial Sequence; identical to SEQ ID NO: 25348
  Description of Artificial Sequence: Synthetic coding sequence

SEQ ID NO: 25350 - DNA, 1398 bp, Artificial Sequence; identical to SEQ ID NO: 25336
  Description of Artificial Sequence: Synthetic coding sequence

SEQ ID NO: 25351 - DNA, 495 bp, Artificial Sequence; identical to SEQ ID NO: 25342
  Description of Artificial Sequence: Synthetic coding sequence

SEQ ID NO: 25352 - DNA, 495 bp, Artificial Sequence; identical to SEQ ID NO: 25342
  Description of Artificial Sequence: Synthetic coding sequence

SEQ ID NO: 25353 - DNA, 495 bp, Artificial Sequence; identical to SEQ ID NO: 25342
  Description of Artificial Sequence: Synthetic coding sequence

SEQ ID NO: 25354 - DNA, 1191 bp, Artificial Sequence
  Description of Artificial Sequence: Synthetic coding sequence
atggcccccgtgcccctgggccccctgggcgagacctactgcgaggagcacggcgagaagatctacttcttctgcgagaacgacgccgagttcctgtgcgtgttctgcagagagggccccacccaccaggcccacaccgtgggcttcctggacgaggccatccagccctacagagacagactgagaagcagactggaggccctgagcaccgagagagacgagatcgaggacgtgaagtgccaggaggaccagaagctgcaggtgctgctgacccagatcgagagcaagaagcaccaggtggagaccgccttcgagagactgcagcaggagctggagcagcagagatgcctgctgctggccagactgagagagctggagcagcagatctggaaggagagagacgagtacatcaccaaggtgagcgaggaggtgaccagactgggcgcccaggtgaaggagctggaggagaagtgccagcagcccgccagcgagctgctgcaggtgatcagagagggcctgcacggctgcgagatgaagaccttcgtgagccccgaggccatcagccccgacctggtgaagaagatcagagacttccacagaaagatcctgaccctgcccgagatgatgagaatgttcagcgagaacctggcccaccacctggagatcgacagcggcgtgatcaccctggacccccagaccgccagcagaagcctggtgctgagcgaggacagaaagagcgtgagatacaccagacagaagaagaacctgcccgacagccccctgagattcgacggcctgcccgccgtgctgggcttccccggcttcagcagcggcagacacagatggcaggtggacctgcagctgggcgacggcggcggctgcaccgtgggcgtggccggcgagggcgtgagaagaaagggcgagatgggcctgagcgccgaggacggcgtgtgggccgtgatcatcagccaccagcagtgctgggccagcaccagccccggcaccgacctgcccctgagcgagatccccagaggcgtgagagtggccctggactacgaggccggccaggtgaccctgcacaacgcccagacccaggagcccatcttcaccttcaccgccagcttcagcggcaaggtgttccccttcttcgccgtgtggaagaagggcagctgcctgaccctgaagggctag

SEQ ID NO: 25355 - DNA, 348 bp, Artificial Sequence; identical to SEQ ID NO: 25337
  Description of Artificial Sequence: Synthetic coding sequence

SEQ ID NO: 25356 - DNA, 348 bp, Artificial Sequence; identical to SEQ ID NO: 25337
  Description of Artificial Sequence: Synthetic coding sequence

SEQ ID NO: 25357 - DNA, 1191 bp, Artificial Sequence; identical to SEQ ID NO: 25339
  Description of Artificial Sequence: Synthetic coding sequence

SEQ ID NO: 25358 - DNA, 1191 bp, Artificial Sequence; identical to SEQ ID NO: 25339
  Description of Artificial Sequence: Synthetic coding sequence

SEQ ID NO: 25359 - DNA, 348 bp, Artificial Sequence; identical to SEQ ID NO: 25337
  Description of Artificial Sequence: Synthetic coding sequence

SEQ ID NO: 25360 - DNA, 348 bp, Artificial Sequence; identical to SEQ ID NO: 25337
  Description of Artificial Sequence: Synthetic coding sequence

SEQ ID NO: 25361 - DNA, 1191 bp, Artificial Sequence; identical to SEQ ID NO: 25339
  Description of Artificial Sequence: Synthetic coding sequence

SEQ ID NO: 25362 - DNA, 1191 bp, Artificial Sequence; identical to SEQ ID NO: 25354
  Description of Artificial Sequence: Synthetic coding sequence

SEQ ID NO: 25363 - DNA, 1191 bp, Artificial Sequence; identical to SEQ ID NO: 25339
  Description of Artificial Sequence: Synthetic coding sequence

SEQ ID NO: 25364 - DNA, 348 bp, Artificial Sequence; identical to SEQ ID NO: 25337
  Description of Artificial Sequence: Synthetic coding sequence

SEQ ID NO: 25365 - DNA, 1191 bp, Artificial Sequence; identical to SEQ ID NO: 25339
  Description of Artificial Sequence: Synthetic coding sequence

SEQ ID NO: 25366 - DNA, 348 bp, Artificial Sequence; identical to SEQ ID NO: 25337
  Description of Artificial Sequence: Synthetic coding sequence

SEQ ID NO: 25367 - DNA, 348 bp, Artificial Sequence; identical to SEQ ID NO: 25337
  Description of Artificial Sequence: Synthetic coding sequence

SEQ ID NO: 25368 - DNA, 1434 bp, Artificial Sequence
  Description of Artificial Sequence: Synthetic coding sequence
atggaggccgtggagctggccagaaagctgcaggaggaggccacctgcagcatctgcctggactacttcaccgaccccgtgatgaccacctgcggccacaacttctgcagagcctgcatccagctgagctgggagaaggccagaggcaagaagggcagaagaaagagaaagggcagcttcccctgccccgagtgcagagagatgagcccccagagaaacctgctgcccaacagactgctgaccaaggtggccgagatggcccagcagcaccccggcctgcagaagcaggacctgtgccaggagcaccacgagcccctgaagctgttctgccagaaggaccagagccccatctgcgtggtgtgcagagagagcagagagcacagactgcacagagtgctgcccgccgaggaggccgtgcagggctacaagctgaagctggaggaggacatggagtacctgagagagcagatcaccagaaccggcaacctgcaggccagagaggagcagagcctggccgagtggcagggcaaggtgaaggagagaagagagagaatcgtgctggagttcgagaagatgaacctgtacctggtggaggaggagcagagactgctgcaggccctggagaccgaggaggaggagaccgccagcagactgagagagagcgtggcctgcctggacagacagggccacagcctggagctgctgctgctgcagctggaggagagaagcacccagggccccctgcagatgctgcaggacatgaaggagcccctgagcagaaagaacaacgtgagcgtgcagtgccccgaggtggccccccccaccagacccagaaccgtgtgcagagtgcccggccagatcgaggtgctgagaggcttcctggaggacgtggtgcccgacgccaccagcgcctacccctacctgctgctgtacgagagcagacagagaagatacctgggcagcagccccgagggcagcggcttctgcagcaaggacagattcgtggcctacccctgcgccgtgggccagaccgccttcagcagcggcagacactactgggaggtgggcatgaacatcaccggcgacgccctgtgggccctgggcgtgtgcagagacaacgtgagcagaaaggacagagtgcccaagtgccccgagaacggcttctgggtggtgcagctgagcaagggcaccaagtacctgagcaccttcagcgccctgacccccgtgatgctgatggagccccccagccacatgggcatcttcctggacttcgaggccggcgaggtgagcttctacagcgtgagcgacggcagccacctgcacacctacagccaggccaccttccccggccccctgcagcccttcttctgcctgggcgcccccaagagcggccagatggtgatcagcaccgtgaccatgtgggtgaagggctag

SEQ ID NO: 25369 - DNA, 528 bp, Artificial Sequence
  Description of Artificial Sequence: Synthetic coding sequence
atggaggccgtggagctggccagaaagctgcaggaggaggccacctgcagcatctgcctggactacttcaccgaccccgtgatgaccacctgcggccacaacttctgcagagcctgcatccagctgagctgggagaaggccagaggcaagaagggcagaagaaagagaaagggcagcttcccctgccccgagtgcagagagatgagcccccagagaaacctgctgcccaacagactgctgaccaaggtggccgagatggcccagcagcaccccggcctgcagaagcaggacctgtgccaggagcaccacgagcccctgaagctgttctgccagaaggaccagagccccatctgcgtggtgtgcagagagagcagagagcacagactgcacagagtgctgcccgccgaggaggccgtgcagggctacaagctgaagctggaggaggacatggagtacctgagagagcagatcaccagaaccggcaacctgcaggccagagaggagcagagcctggccgagtggcagtag

SEQ ID NO: 25370 - DNA, 1434 bp, Artificial Sequence; identical to SEQ ID NO: 25368
  Description of Artificial Sequence: Synthetic coding sequence

SEQ ID NO: 25371 - DNA, 1434 bp, Artificial Sequence; identical to SEQ ID NO: 25368
  Description of Artificial Sequence: Synthetic coding sequence

SEQ ID NO: 25372 - DNA, 1032 bp, Artificial Sequence
  Description of Artificial Sequence: Synthetic coding sequence
atggaggccgtggagctggccagaaagctgcaggaggaggccacctgcagcatctgcctggactacttcaccgaccccgtgatgaccacctgcggccacaacttctgcagagcctgcatccagctgagctgggagaaggccagaggcaagaagggcagaagaaagagaaagggcagcttcccctgccccgagtgcagagagatgagcccccagagaaacctgctgcccaacagactgctgaccaaggtggccgagatggcccagcagcaccccggcctgcagaagcaggacctgtgccaggagcaccacgagcccctgaagctgttctgccagaaggaccagagccccatctgcgtggtgtgcagagagagcagagagcacagactgcacagagtgctgcccgccgaggaggccgtgcagggctacaagctgaagctggaggaggacatggagtacctgagagagcagatcaccagaaccggcaacctgcaggccagagaggagcagagcctggccgagtggcagggcaaggtgaaggagagaagagagagaatcgtgctggagttcgagaagatgaacctgtacctggtggaggaggagcagagactgctgcaggccctggagaccgaggaggaggagaccgccagcagactgagagagagcgtggcctgcctggacagacagggccacagcctggagctgctgctgctgcagctggaggagagaagcacccagggccccctgcagatgctgcaggacatgaaggagcccctgagcagaaagaacaacgtgagcgtgcagtgccccgaggtggccccccccaccagacccagaaccgtgtgcagagtgcccggccagatcgaggtgctgagaggcttcctgggcaagtgggcccccagagccagaaccagcgaccccggcagcctgggcgacgcccccctgtaccccctggccagcgaggccaccaacggcggcggcagcaccagcgccctgcccggcgacggccactggctgttcaccgtgcccagctag

SEQ ID NO: 25373 - DNA, 153 bp, Artificial Sequence
  Description of Artificial Sequence: Synthetic coding sequence
atggaggccgtggagctggccagaaagctgcaggaggaggccacctgcagcatctgcctggactacttcaccgaccccgtgatgaccacctgcggccacaacttctgcagagcctgcatccagctgagctgggagaaggccagaggcaagtag

SEQ ID NO: 25374 - DNA, 1398 bp, Artificial Sequence
  Description of Artificial Sequence: Synthetic coding sequence
atggccagcaccaccagcaccaagaagatgatggaggaggccacctgcagcatctgcctgagcctgatgaccaaccccgtgagcatcaactgcggccacagctactgccacctgtgcatcaccgacttcttcaagaaccccagccagaagcagctgagacaggagaccttctgctgcccccagtgcagagcccccttccacatggacagcctgagacccaacaagcagctgggcagcctgatcgaggccctgaaggagaccgaccaggagatgagctgcgaggagcacggcgagcagttccacctgttctgcgaggacgagggccagctgatctgctggagatgcgagagagccccccagcacaagggccacaccaccgccctggtggaggacgtgtgccagggctacaaggagaagctgcagaaggccgtgaccaagctgaagcagctggaggacagatgcaccgagcagaagctgagcaccgccatgagaatcaccaagtggaaggagaaggtgcagatccagagacagaagatcagaagcgacttcaagaacctgcagtgcttcctgcacgaggaggagaagagctacctgtggagactggagaaggaggagcagcagaccctgagcagactgagagactacgaggccggcctgggcctgaagagcaacgagctgaagagccacatcctggagctggaggagaagtgccagggcagcgcccagaagctgctgcagaacgtgaacgacaccctgagcagaagctgggccgtgaagctggagaccagcgaggccgtgagcctggagctgcacaccatgtgcaacgtgagcaagctgtacttcgacgtgaagaagatgctgagaagccaccaggtgagcgtgaccctggaccccgacaccgcccaccacgagctgatcctgagcgaggacagaagacaggtgaccagaggctacacccaggagaaccaggacaccagcagcagaagattcaccgccttcccctgcgtgctgggctgcgagggcttcaccagcggcagaagatacttcgaggtggacgtgggcgagggcaccggctgggacctgggcgtgtgcatggagaacgtgcagagaggcaccggcatgaagcaggagccccagagcggcttctggaccctgagactgtgcaagaagaagggctacgtggccctgaccagcccccccaccagcctgcacctgcacgagcagcccctgctggtgggcatcttcctggactacgaggccggcgtggtgagcttctacaacggcaacaccggctgccacatcttcaccttccccaaggccagcttcagcgacaccctgagaccctacttccaggtgtaccagtacagccccctgttcctgcccccccccggcgactag

SEQ ID NO: 25375 - DNA, 1398 bp, Artificial Sequence; identical to SEQ ID NO: 25374
  Description of Artificial Sequence: Synthetic coding sequence

SEQ ID NO: 25376 - DNA, 1398 bp, Artificial Sequence; identical to SEQ ID NO: 25374
  Description of Artificial Sequence: Synthetic coding sequence

SEQ ID NO: 25377 - DNA, 690 bp, Artificial Sequence
  Description of Artificial Sequence: Synthetic coding sequence
atgatccccctgcagaaggacaaccaggaggagggcgtgtgccccatctgccaggagagcctgaaggaggccgtgagcaccaactgcggccacctgttctgcagagtgtgcctgacccagcacgtggagaaggccagcgccagcggcgtgttctgctgccccctgtgcagaaagccctgcagcgaggaggtgctgggcaccggctacatctgccccaaccaccagaagagagtgtgcagattctgcgaggagagcagactgctgctgtgcgtggagtgcctggtgagccccgagcacatgagccaccacgagctgaccatcgagaacgccctgagccactacaaggagagactgaacagaagaagcagaaagctgagaaaggacatcgccgagctgcagagactgaaggcccagcaggagaagaagctgcaggccctgcagcagtggctgggccagctggagcacatgcccgccgaggccgccagaatcctggacatcagcagagccgtgacccagctgagaagcctggtgatcgacctggagagaaccgccaaggagctggacaccaacaccctgaagaacgccggcgacctgctgaacagaagcgccccccagaagctggaggtgatctacccccagctggagaagggcgtgagcgagctgctgctgcagcccccccagaagctgtag

SEQ ID NO: 25378 - DNA, 777 bp, Artificial Sequence
  Description of Artificial Sequence: Synthetic coding sequence
atgatccccctgcagaaggacaaccaggaggagggcgtgtgccccatctgccaggagagcctgaaggaggccgtgagcaccaactgcggccacctgttctgcagagtgtgcctgacccagcacgtggagaaggccagcgccagcggcgtgttctgctgccccctgtgcagaaagccctgcagcgaggaggtgctgggcaccggctacatctgccccaaccaccagaagagagtgtgcagattctgcgaggagagcagactgctgctgtgcgtggagtgcctggtgagccccgagcacatgagccaccacgagctgaccatcgagaacgccctgagccactacaaggagagactgaacagaagaagcagaaagctgagaaaggacatcgccgagctgcagagactgaaggcccagcaggagaagaagctgcaggccctgcagttccaggtggaccacggcaaccacagactggaggccggccccgagagccagcaccagaccagagagcagctgggcgccctgccccagcagtggctgggccagctggagcacatgcccgccgaggccgccagaatcctggacatcagcagagccgtgacccagctgagaagcctggtgatcgacctggagagaaccgccaaggagctggacaccaacaccctgaagaacgccggcgacctgctgaacagaagcgccccccagaagctggaggtgatctacccccagctggagaagggcgtgagcgagctgctgctgcagcccccccagaagctgtag

SEQ ID NO: 25379 - DNA, 777 bp, Artificial Sequence; identical to SEQ ID NO: 25378
  Description of Artificial Sequence: Synthetic coding sequence

SEQ ID NO: 25380 - DNA, 777 bp, Artificial Sequence; identical to SEQ ID NO: 25378
  Description of Artificial Sequence: Synthetic coding sequence

SEQ ID NO: 25381 - DNA, 690 bp, Artificial Sequence; identical to SEQ ID NO: 25377
  Description of Artificial Sequence: Synthetic coding sequence

SEQ ID NO: 25382 - DNA, 690 bp, Artificial Sequence
  Description of Artificial Sequence: Synthetic coding sequence
atgatccccctgcagaaggacaaccaggaggagggcgtgtgccccatctgccaggagagcctgaaggaggccgtgagcaccaactgcggccacctgttctgcagagtgtgcctgacccagcacgtggagaaggccagcgccagcggcgtgttctgctgccccctgtgcagaaagccctgcagcgaggaggtgctgggcaccggctacatctgccccaaccaccagaagagagtgtgcagattctgcgaggagagcagactgctgctgtgcgtggagtgcctggtgagccccgagcacatgagccaccacgagctgaccatcgagaacgccctgagccactacaaggagagactgaacagaagaagcagaaagctgagaaaggacatcgccgagctgcagagactgaaggcccagcaggagaagaagctgcaggccctgcagcagtggctgggccagctggagcacatgcccgccgaggccgccagaatcctggacatcagcagagccgtgacccagctgagaagcctggtgatcgacctggagagaatggccaaggagctggacaccaacaccctgaagaacgccggcgacctgctgaacagaagcgccccccagaagctggaggtgatctacccccagctgaagaagggcgtgagcgagctgctgctgcagcccccccagaagctgtag

SEQ ID NO: 25383 - DNA, 690 bp, Artificial Sequence; identical to SEQ ID NO: 25377
  Description of Artificial Sequence: Synthetic coding sequence

SEQ ID NO: 25384 - DNA, 777 bp, Artificial Sequence
  Description of Artificial Sequence: Synthetic coding sequence
atgatccccctgcagaaggacaaccaggaggagggcgtgtgccccatctgccaggagagcctgaaggaggccgtgagcaccaactgcggccacctgttctgcagagtgtgcctgacccagcacgtggagaaggccagcgccagcggcgtgttctgctgccccctgtgcagaaagccctgcagcgaggaggtgctgggcaccggctacatctgccccaaccaccagaagagagtgtgcagattctgcgaggagagcagactgctgctgtgcgtggagtgcctggtgagccccgagcacatgagccaccacgagctgaccatcgagaacgccctgagccactacaaggagagactgaacagaagaagcagaaagctgagaaaggacatcgccgagctgcagagactgaaggcccagcaggagaagaagctgcaggccctgcagttccaggtggaccacggcaaccacagactggaggccggccccgagagccagcaccagaccagagagcagctgggcgccctgccccagcagtggctgggccagctggagcacatgcccgccgaggccgccagaatcctggacatcagcagagccgtgacccagctgagaagcctggtgatcgacctggagagaatggccaaggagctggacaccaacaccctgaagaacgccggcgacctgctgaacagaagcgccccccagaagctggaggtgatctacccccagctgaagaagggcgtgagcgagctgctgctgcagcccccccagaagctgtag

SEQ ID NO: 25385 - DNA, 690 bp, Artificial Sequence; identical to SEQ ID NO: 25377
  Description of Artificial Sequence: Synthetic coding sequence

SEQ ID NO: 25386 - DNA, 777 bp, Artificial Sequence; identical to SEQ ID NO: 25384
  Description of Artificial Sequence: Synthetic coding sequence

SEQ ID NO: 25387 - DNA, 777 bp, Artificial Sequence
  Description of Artificial Sequence: Synthetic coding sequence
atgatccccctgcagaaggacaaccaggaggagggcgtgtgccccatctgccaggagagcctgaaggaggccgtgagcaccaactgcggccacctgttctgcagagtgtgcctgacccagcacgtggagaaggccagcgccagcggcgtgttctgctgccccctgtgcagaaagccctgcagcgaggaggtgctgggcaccggctacatctgccccaaccaccagaagagagtgtgcagattctgcgaggagagcagactgctgctgtgcgtggagtgcctggtgagccccgagcacatgagccaccacgagctgaccatcgagaacgccctgagccactgcaaggagagactgaacagaagaagcagaaagctgagaaaggacatcgccgagctgcagagactgaaggcccagcaggagaagaagctgcaggccctgcagttccaggtggaccacggcaaccacagactggaggccggccccgagagccagcaccagaccagagagcagctgggcgccctgccccagcagtggctgggccagctggagcacatgcccgccgaggccgccagaatcctggacatcagcagagccgtgacccagctgagaagcctggtgatcgacctggagagaaccgccaaggagctggacaccaacaccctgaagaacgccggcgacctgctgaacagaagcgccccccagaagctggaggtgatctacccccagctggagaagggcgtgagcgagctgctgctgcagcccccccagaagctgtag

SEQ ID NO: 25388 - DNA, 777 bp, Artificial Sequence; identical to SEQ ID NO: 25378
  Description of Artificial Sequence: Synthetic coding sequence

SEQ ID NO: 25389 - DNA, 777 bp, Artificial Sequence; identical to SEQ ID NO: 25378
  Description of Artificial Sequence: Synthetic coding sequence

SEQ ID NO: 25390 - DNA, 690 bp, Artificial Sequence; identical to SEQ ID NO: 25377
  Description of Artificial Sequence: Synthetic coding sequence

SEQ ID NO: 25391 - DNA, 777 bp, Artificial Sequence; identical to SEQ ID NO: 25378
  Description of Artificial Sequence: Synthetic coding sequence

SEQ ID NO: 25392 - DNA, 690 bp, Artificial Sequence
  Description of Artificial Sequence: Synthetic coding sequence
atgatccccctgcagaaggacaaccaggaggagggcgtgtgccccatctgccaggagagcctgaaggaggccgtgagcaccaactgcggccacctgttctgcagagtgtgcctgacccagcacgtggagaaggccagcgccagcggcgtgttctgctgccccctgtgcagaaagccctgcagcgaggaggtgctgggcaccggctacatctgccccaaccaccagaagagagtgtgcagattctgcgaggagagcagactgctgctgtgcgtggagtgcctggtgagccccgagcacatgagccaccacgagctgaccatcgagaacgccctgagccactgcaaggagagactgaacagaagaagcagaaagctgagaaaggacatcgccgagctgcagagactgaaggcccagcaggagaagaagctgcaggccctgcagcagtggctgggccagctggagcacatgcccgccgaggccgccagaatcctggacatcagcagagccgtgacccagctgagaagcctggtgatcgacctggagagaaccgccaaggagctggacaccaacaccctgaagaacgccggcgacctgctgaacagaagcgccccccagaagctggaggtgatctacccccagctggagaagggcgtgagcgagctgctgctgcagcccccccagaagctgtag

SEQ ID NO: 25393 - DNA, 690 bp, Artificial Sequence; identical to SEQ ID NO: 25382
  Description of Artificial Sequence: Synthetic coding sequence

SEQ ID NO: 25394 - DNA, 777 bp, Artificial Sequence; identical to SEQ ID NO: 25378
  Description of Artificial Sequence: Synthetic coding sequence

SEQ ID NO: 25395 - DNA, 777 bp, Artificial Sequence; identical to SEQ ID NO: 25387
  Description of Artificial Sequence: Synthetic coding sequence

SEQ ID NO: 25396 - DNA, 777 bp, Artificial Sequence; identical to SEQ ID NO: 25378
  Description of Artificial Sequence: Synthetic coding sequence

SEQ ID NO: 25397 - DNA, 777 bp, Artificial Sequence; identical to SEQ ID NO: 25378
  Description of Artificial Sequence: Synthetic coding sequence

SEQ ID NO: 25398 - DNA, 2172 bp, Artificial Sequence
  Description of Artificial Sequence: Synthetic coding sequence
atggagaccgccatgtgcgtgtgctgcccctgctgcacctggcagagatgctgcccccagctgtgcagctgcctgtgctgcaagttcatcttcaccagcgagagaaactgcacctgcttcccctgcccctacaaggacgagagaaactgccagttctgccactgcacctgcagcgagagccccaactgccactggtgctgctgcagctgggccaacgaccccaactgcaagtgctgctgcaccgccagcagcaacctgaactgctactactacgagagcagatgctgcagaaacaccatcatcaccttccacaagggcagactgagaagcatccacaccagcagcaagaccgccctgagaaccggcagcagcgacacccaggtggacgaggtgaagagcatccccgccaacagccacctggtgaaccacctgaactgccccatgtgcagcagactgagactgcacagcttcatgctgccctgcaaccacagcctgtgcgagaagtgcctgagacagctgcagaagcacgccgaggtgaccgagaacttcttcatcctgatctgccccgtgtgcgacagaagccactgcatgccctacagcaacaagatgcagctgcccgagaactacctgcacggcagactgaccaagagatacatgcaggagcacggctacctgaagtggagattcgacagaagcagcggccccatcctgtgccaggtgtgcagaaacaagagaatcgcctacaagagatgcatcacctgcagactgaacctgtgcaacgactgcctgaaggccttccacagcgacgtggccatgcaggaccacgtgttcgtggacaccagcgccgaggagcaggacgagaagatctgcatccaccaccccagcagcagaatcatcgagtactgcagaaacgacaacaagctgctgtgcaccttctgcaagttcagcttccacaacggccacgacaccatcagcctgatcgacgcctgcagcgagagagccgccagcctgttcagcgccatcgccaagttcaaggccgtgagatacgagatcgacaacgacctgatggagttcaacatcctgaagaacagcttcaaggccgacaaggaggccaagagaaaggagatcagaaacggcttcctgaagctgagaagcatcctgcaggagaaggagaagatcatcatggagcagatcgagaacctggaggtgagcagacagaaggagatcgagaagtacgtgtacgtgaccaccatgaaggtgaacgagatggacggcctgatcgcctacagcaaggaggccctgaaggagaccggccaggtggccttcctgcagagcgccaagatcctggtggaccagatcgaggacggcatccagaccacctacagacccgacccccagctgagactgcacagcatcaactacgtgcccctggacttcgtggagctgagcagcgccatccacgagctgttccccaccggccccaagaaggtgagaagcagcggcgacagcctgcccagcccctaccccgtgcacagcgagaccatgatcgccagaaaggtgaccttcagcacccacagcctgggcaaccagcacatctaccagagaagcagcagcatgctgagcttcagcaacaccgacaagaaggccaaggtgggcctggaggcctgcggcagagcccagagcgccacccccgccaagcccaccgacggcctgtacacctactggagcgccggcgccgacagccagagcgtgcagaacagcagcagcttccacaactggtacagcttcaacgacggcagcgtgaagacccccggccccatcgtgatctaccagaccctggtgtaccccagagccgccaaggtgtactggacctgccccgccgaggacgtggacagcttcgagatggagttctacgaggtgatcaccagcccccccaacaacgtgcagatggagctgtgcggccagatcagagacatcatgcagcagaacctggagctgcacaacctgacccccaacaccgagtacgtgttcaaggtgagagccatcaacgacaacggccccggccagtggagcgacatctgcaaggtggtgacccccgacggccacggcaagaacagagccaagtggggcctgctgaagaacatccagagcgccctgcagaagcacttctag

SEQ ID NO: 25399 - DNA, 1341 bp, Artificial Sequence
  Description of Artificial Sequence: Synthetic coding sequence
atggacagcgacttcagccacgccttccagaaggagctgacctgcgtgatctgcctgaactacctggtggaccccgtgaccatctgctgcggccacagcttctgcagaccctgcctgtgcctgagctgggaggaggcccagagccccgccaactgccccgcctgcagagagcccagccccaagatggacttcaagaccaacatcctgctgaagaacctggtgaccatcgccagaaaggccagcctgtggcagttcctgagcagcgagaagcagatctgcggcacccacagacagaccaagaagatgttctgcgacatggacaagagcctgctgtgcctgctgtgcagcaacagccaggagcacggcgcccacaagcaccaccccatcgaggaggccgccgaggagcacagagagaagctgctgaagcagatgagaatcctgtggaagaagatccaggagaaccagagaaacctgtacgaggagggcagaaccgccttcctgtggagaggcaacgtggtgctgagagcccagatgatcagaaacgagtacagaaagctgcaccccgtgctgcacaaggaggagaagcagcacctggagagactgaacaaggagtaccaggagatcttccagcagctgcagagaagctgggtgaagatggaccagaagagcaagcacctgaaggagatgtaccaggagctgatggagatgtgccacaagcccgacgtggagctgctgcaggacctgggcgacatcgtggccagaagcgagagcgtgctgctgcacatgccccagcccgtgaaccccgagctgaccgccggccccatcaccggcctggtgtacagactgaacagattcagagtggagatcagcttccacttcgaggtgaccaaccacaacatcagactgttcgaggacgtgagaagctggatgttcagaagaggccccctgaacagcgacagaagcgactacttcgccgcctggggcgccagagtgttcagcttcggcaagcactactgggagctggacgtggacaacagctgcgactgggccctgggcgtgtgcaacaacagctggatcagaaagaacagcaccatggtgaacagcgaggacatcttcctgctgctgtgcctgaaggtggacaaccacttcaacctgctgaccaccagccccgtgttcccccactacatcgagaagcccctgggcagagtgggcgtgttcctggacttcgagagcggcagcgtgagcttcctgaacgtgaccaagagcagcctgatctggagctaccccgccggcagcctgaccttccccgtgagacccttcttctacaccggccacagatag

SEQ ID NO: 25400 - DNA, 2280 bp, Artificial Sequence
  Description of Artificial Sequence: Synthetic coding sequence
atggccgagggcgaggacatgcagaccttcaccagcatcatggacgccctggtgagaatcagcaccagcatgaagaacatggagaaggagctgctgtgccccgtgtgccaggagatgtacaagcagcccctggtgctgccctgcacccacaacgtgtgccaggcctgcgccagagaggtgctgggccagcagggctacatcggccacggcggcgaccccagcagcgagcccaccagccccgccagcacccccagcaccagaagccccagactgagcagaagaaccctgcccaagcccgacagactggacagactgctgaagagcggcttcggcacctaccccggcagaaagagaggcgccctgcacccccaggtgatcatgttcccctgccccgcctgccagggcgacgtggagctgggcgagagaggcctggccggcctgttcagaaacctgaccctggagagagtggtggagagatacagacagagcgtgagcgtgggcggcgccatcctgtgccagctgtgcaagcccccccccctggaggccaccaagggctgcaccgagtgcagagccaccttctgcaacgagtgcttcaagctgttccacccctggggcacccagaaggcccagcacgagcccaccctgcccaccctgagcttcagacccaagggcctgatgtgccccgaccacaaggaggaggtgacccactactgcaagacctgccagagactggtgtgccagctgtgcagagtgagaagaacccacagcggccacaagatcacccccgtgctgagcgcctaccaggccctgaaggacaagctgaccaagagcctgacctacatcctgggcaaccaggacaccgtgcagacccagatctgcgagctggaggaggccgtgagacacaccgaggtgagcggccagcaggccaaggaggaggtgagccagctggtgagaggcctgggcgccgtgctggaggagaagagagccagcctgctgcaggccatcgaggagtgccagcaggagagactggccagactgagcgcccagatccaggagcacagaagcctgctggacggcagcggcctggtgggctacgcccaggaggtgctgaaggagaccgaccagccctgcttcgtgcaggccgccaagcagctgcacaacagaatcgccagagccaccgaggccctgcagaccttcagacccgccgccagcagcagcttcagacactgccagctggacgtgggcagagagatgaagctgctgaccgagctgaacttcctgagagtgcccgaggcccccgtgatcgacacccagagaaccttcgcctacgaccagatcttcctgtgctggagactgcccccccacagcccccccgcctggcactacaccgtggagttcagaagaaccgacgtgcccgcccagcccggccccaccagatggcagagaagagaggaggtgagaggcaccagcgccctgctggagaaccccgacaccggcagcgtgtacgtgctgagagtgagaggctgcaacaaggccggctacggcgagtacagcgaggacgtgcacctgcacaccccccccgcccccgtgctgcacttcttcctggacagcagatggggcgccagcagagagagactggccatcagcaaggaccagagagccgtgagaagcgtgcccggcctgcccctgctgctggccgccgacagactgctgaccggctgccacctgagcgtggacgtggtgctgggcgacgtggccgtgacccagggcagaagctactgggcctgcgccgtggaccccgccagctacctggtgaaggtgggcgtgggcctggagagcaagctgcaggagagcttccagggcgcccccgacgtgatcagccccagatacgaccccgacagcggccacgacagcggcgccgaggacgccaccgtggaggccagcccccccttcgccttcctgaccatcggcatgggcaagatcctgctgggcagcggcgccagcagcaacgccggcctgaccggcagagacggccccaccgccggctgcaccgtgcccctgccccccagactgggcatctgcctggactacgagagaggcagagtgagcttcctggacgccgtgagcttcagaggcctgctggagtgccccctggactgcagcggccccgtgtgccccgccttctgcttcatcggcggcggcgccgtgcagctgcaggagcccgtgggcaccaagcccgagagaaaggtgaccatcggcggcttcgccaagctggactag

SEQ ID NO: 25401 - DNA, 2211 bp, Artificial Sequence
  Description of Artificial Sequence: Synthetic coding sequence
atgaagaacatggagaaggagctgctgtgccccgtgtgccaggagatgtacaagcagcccctggtgctgccctgcacccacaacgtgtgccaggcctgcgccagagaggtgctgggccagcagggctacatcggccacggcggcgaccccagcagcgagcccaccagccccgccagcacccccagcaccagaagccccagactgagcagaagaaccctgcccaagcccgacagactggacagactgctgaagagcggcttcggcacctaccccggcagaaagagaggcgccctgcacccccaggtgatcatgttcccctgccccgcctgccagggcgacgtggagctgggcgagagaggcctggccggcctgttcagaaacctgaccctggagagagtggtggagagatacagacagagcgtgagcgtgggcggcgccatcctgtgccagctgtgcaagcccccccccctggaggccaccaagggctgcaccgagtgcagagccaccttctgcaacgagtgcttcaagctgttccacccctggggcacccagaaggcccagcacgagcccaccctgcccaccctgagcttcagacccaagggcctgatgtgccccgaccacaaggaggaggtgacccactactgcaagacctgccagagactggtgtgccagctgtgcagagtgagaagaacccacagcggccacaagatcacccccgtgctgagcgcctaccaggccctgaaggacaagctgaccaagagcctgacctacatcctgggcaaccaggacaccgtgcagacccagatctgcgagctggaggaggccgtgagacacaccgaggtgagcggccagcaggccaaggaggaggtgagccagctggtgagaggcctgggcgccgtgctggaggagaagagagccagcctgctgcaggccatcgaggagtgccagcaggagagactggccagactgagcgcccagatccaggagcacagaagcctgctggacggcagcggcctggtgggctacgcccaggaggtgctgaaggagaccgaccagccctgcttcgtgcaggccgccaagcagctgcacaacagaatcgccagagccaccgaggccctgcagaccttcagacccgccgccagcagcagcttcagacactgccagctggacgtgggcagagagatgaagctgctgaccgagctgaacttcctgagagtgcccgaggcccccgtgatcgacacccagagaaccttcgcctacgaccagatcttcctgtgctggagactgcccccccacagcccccccgcctggcactacaccgtggagttcagaagaaccgacgtgcccgcccagcccggccccaccagatggcagagaagagaggaggtgagaggcaccagcgccctgctggagaaccccgacaccggcagcgtgtacgtgctgagagtgagaggctgcaacaaggccggctacggcgagtacagcgaggacgtgcacctgcacaccccccccgcccccgtgctgcacttcttcctggacagcagatggggcgccagcagagagagactggccatcagcaaggaccagagagccgtgagaagcgtgcccggcctgcccctgctgctggccgccgacagactgctgaccggctgccacctgagcgtggacgtggtgctgggcgacgtggccgtgacccagggcagaagctactgggcctgcgccgtggaccccgccagctacctggtgaaggtgggcgtgggcctggagagcaagctgcaggagagcttccagggcgcccccgacgtgatcagccccagatacgaccccgacagcggccacgacagcggcgccgaggacgccaccgtggaggccagcccccccttcgccttcctgaccatcggcatgggcaagatcctgctgggcagcggcgccagcagcaacgccggcctgaccggcagagacggccccaccgccggctgcaccgtgcccctgccccccagactgggcatctgcctggactacgagagaggcagagtgagcttcctggacgccgtgagcttcagaggcctgctggagtgccccctggactgcagcggccccgtgtgccccgccttctgcttcatcggcggcggcgccgtgcagctgcaggagcccgtgggcaccaagcccgagagaaaggtgaccatcggcggcttcgccaagctggactag

SEQ ID NO: 25402 - DNA, 1935 bp, Artificial Sequence
  Description of Artificial Sequence: Synthetic coding sequence
atggccgagggcgaggacatgcagaccttcaccagcatcatggacgccctggtgagaatcagcaccagcatgaagaacatggagaaggagctgctgtgccccgtgtgccaggagatgtacaagcagcccctggtgctgccctgcacccacaacgtgtgccaggcctgcgccagagaggtgctgggccagcagggctacatcggccacggcggcgaccccagcagcgagcccaccagccccgccagcacccccagcaccagaagccccagactgagcagaagaaccctgcccaagcccgacagactggacagactgctgaagagcggcttcggcacctaccccggcagaaagagaggcgccctgcacccccaggtgatcatgttcccctgccccgcctgccagggcgacgtggagctgggcgagagaggcctggccggcctgttcagaaacctgaccctggagagagtggtggagagatacagacagagcgtgagcgtgggcggcgccatcctgtgccagctgtgcaagcccccccccctggaggccaccaagggctgcaccgagtgcagagccaccttctgcaacgagtgcttcaagctgttccacccctggggcacccagaaggcccagcacgagcccaccctgcccaccctgagcttcagacccaagggcctgatgtgccccgaccacaaggaggaggtgacccactactgcaagacctgccagagactggtgtgccagctgtgcagagtgagaagaacccacagcggccacaagatcacccccgtgctgagcgcctaccaggccctgaaggacaagctgaccaagagcctgacctacatcctgggcaaccaggacaccgtgcagacccagatctgcgagctggaggaggccgtgagacacaccgaggtgagcggccagcaggccaaggaggaggtgagccagctggtgagaggcctgggcgccgtgctggaggagaagagagccagcctgctgcaggccatcgaggagtgccagcaggagagactggccagactgagcgcccagatccaggagcacagaagcctgctggacggcagcggcctggtgggctacgcccaggaggtgctgaaggagaccgaccagccctgcttcgtgcaggccgccaagcagctgcacaacagaatcgccagagccaccgaggccctgcagaccttcagacccgccgccagcagcagcttcagacactgccagctggacgtgggcagagagatgaagctgctgaccgagctgaacttcctgagagtgcccgaggcccccgtgatcgacacccagagaaccttcgcctacgaccagatcttcctgtgctggagactgcccccccacagcccccccgcctggcactacaccgtggagttcagaagaaccgacgtgcccgcccagcccggccccaccagatggcagagaagagaggaggtgagaggcaccagcgccctgctggagaaccccgacaccggcagcgtgtacgtgctgagagtgagaggctgcaacaaggccggctacggcgagtacagcgaggacgtgcacctgcacaccccccccgcccccgtgctgcacttcttcctggacagcagatggggcgccagcagagagagactggccatcagcaaggaccagagagccgtgagaagcgtgcccggcctgcccctgctgctggccgccgacagactgctgaccggctgccacctgagcgtggacgtggtgctgggcgacgtggccgtgacccagggcagaagctactgggcctgcgccgtggaccccgccagctacctggtgaaggtgggcgtgggcctggagagcaagctgcaggagagcttccagggcgcccccgacgtgatcagccccagaagcgaccccagcggcagagacggcgtgtggggcagctggtgggagtag

SEQ ID NO: 25403 - DNA, 1656 bp, Artificial Sequence
  Description of Artificial Sequence: Synthetic coding sequence
atggccgagggcgaggacatgcagaccttcaccagcatcatggacgccctggtgagaatcagcaccagcatgaagaacatggagaaggagctgctgtgccccgtgtgccaggagatgtacaagcagcccctggtgctgccctgcacccacaacgtgtgccaggcctgcgccagagaggtgctgggccagcagggctacatcggccacggcggcgaccccagcagcgagcccaccagccccgccagcacccccagcaccagaagccccagactgagcagaagaaccctgcccaagcccgacagactggacagactgctgaagagcggcttcggcacctaccccggcagaaagagaggcgccctgcacccccaggtgatcatgttcccctgccccgcctgccagggcgacgtggagctgggcgagagaggcctggccggcctgttcagaaacctgaccctggagagagtggtggagagatacagacagagcgtgagcgtgggcggcgccatcctgtgccagctgtgcaagcccccccccctggaggccaccaagggctgcaccgagtgcagagccaccttctgcaacgagtgcttcaagctgttccacccctggggcacccagaaggcccagcacgagcccaccctgcccaccctgagcttcagacccaagggcctgatgtgccccgaccacaaggaggaggtgacccactactgcaagacctgccagagactggtgtgccagctgtgcagagtgagaagaacccacagcggccacaagatcacccccgtgctgagcgcctaccaggccctgaaggacaagctgaccaagagcctgacctacatcctgggcaaccaggacaccgtgcagacccagatctgcgagctggaggaggccgtgagacacaccgaggtgagcggccagcaggccaaggaggaggtgagccagctggtgagaggcctgggcgccgtgctggaggagaagagagccagcctgctgcaggccatcgaggagtgccagcaggagagactggccagactgagcgcccagatccaggagcacagaagcctgctggacggcagcggcctggtgggctacgcccaggaggtgctgaaggagaccgaccagccctgcttcgtgcaggccgccaagcagctgcacaacagaatcgccagagccaccgaggccctgcagaccttcagacccgccgccagcagcagcttcagacactgccagctggacgtgggcagagagatgaagctgctgaccgagctgaacttcctgagagtgcccgaggcccccgtgatcgacacccagagaaccttcgcctacgaccagatcttcctgtgctggagactgcccccccacagcccccccgcctggcactacaccgtggagttcagaagaaccgacgtgcccgcccagcccggccccaccagatggcagagaagagaggaggtgagaggcaccagcgccctgctggagaaccccgacaccggcagcgtgtacgtgctgagagtgagaggctgcaacaaggccggctacggcgagtacagcgaggacgtgcacctgcacaccccccccgcccccggcatccagaacctggccagaagaggcggcgcctgcctgcagttccagctgctgggcagactgagatag

SEQ ID NO: 25404 - DNA, 1497 bp, Artificial Sequence
  Description of Artificial Sequence: Synthetic coding sequence
atggccgagggcgaggacatgcagaccttcaccagcatcatggacgccctggtgagaatcagcaccagcatgaagaacatggagaaggagctgctgtgccccgtgtgccaggagatgtacaagcagcccctggtgctgccctgcacccacaacgtgtgccaggcctgcgccagagaggtgctgggccagcagggctacatcggccacggcggcgaccccagcagcgagcccaccagccccgccagcacccccagcaccagaagccccagactgagcagaagaaccctgcccaagcccgacagactggacagactgctgaagagcggcttcggcacctaccccggcagaaagagaggcgccctgcacccccaggtgatcatgttcccctgccccgcctgccagggcgacgtggagctgggcgagagaggcctggccggcctgttcagaaacctgaccctggagagagtggtggagagatacagacagagcgtgagcgtgggcggcgccatcctgtgccagctgtgcaagcccccccccctggaggccaccaagggctgcaccgagtgcagagccaccttctgcaacgagtgcttcaagctgttccacccctggggcacccagaaggcccagcacgagcccaccctgcccaccctgagcttcagacccaagggcctgatgtgccccgaccacaaggaggaggtgacccactactgcaagacctgccagagactggtgtgccagctgtgcagagtgagaagaacccacagcggccacaagatcacccccgtgctgagcgcctaccaggccctgaaggacaagctgaccaagagcctgacctacatcctgggcaaccaggacaccgtgcagacccagatctgcgagctggaggaggccgtgagacacaccgaggtgagcggccagcaggccaaggaggaggtgagccagctggtgagaggcctgggcgccgtgctggaggagaagagagccagcctgctgcaggccatcgaggagtgccagcaggagagactggccagactgagcgcccagatccaggagcacagaagcctgctggacggcagcggcctggtgggctacgcccaggaggtgctgaaggagaccgaccagccctgcttcgtgcaggccgccaagcagctgcacaacagaatcgccagagccaccgaggccctgcagaccttcagacccgccgccagcagcagcttcagacactgccagctggacgtgggcagagagatgaagctgctgaccgagctgaacttcctgagaggctgcggccacagaggcctgtgcagcggcgccccccagtgcctgagaccccccagcctgacccccagcgcccccctgcccatgatcagaagcagctgcgccggcggctgcccccccatccaccacctgcccggcaccatccccctgagcagcggcgccagaatgtgcctgctgagccaggccccccccgccggcagcggcggcagaagatag

SEQ ID NO: 25405 - DNA, 2154 bp, Artificial Sequence
  Description of Artificial Sequence: Synthetic coding sequence
atggccgccaagagaggcaccaagaccagcatgaagaacatggagaaggagctgctgtgccccgtgtgccaggagatgtacaagcagcccctggtgctgccctgcacccacaacgtgtgccaggcctgcgccagagaggtgctgggccagcagggctacatcggccacggcggcgaccccagcagcgagcccaccagccccgccagcacccccagcaccagaagccccagactgagcagaagaaccctgcccaagcccgacagactggacagactgctgaagagcggcttcggcacctaccccggcagaaagagaggcgccctgcacccccaggtgatcatgttcccctgccccgcctgccagggcgacgtggagctgggcgagagaggcctggccggcctgttcagaaacctgaccctggagagagtggtggagagatacagacagagcgtgagcgtgggcggcgccatcctgtgccagctgtgcaagcccccccccctggaggccaccaagggctgcaccgagtgcagagccaccttctgcaacgagtgcttcaagctgttccacccctggggcacccagaaggcccagcacgagcccaccctgcccaccctgagcttcagacccaagggcctgatgtgccccgaccacaaggaggaggtgacccactactgcaagacctgccagagactggtgtgccagctgtgcagagtgagaagaacccacagcggccacaagatcacccccgtgctgagcgcctaccaggccctgaaggacaagctgaccaagagcctgacctacatcctgggcaaccaggacaccgtgcagacccagatctgcgagctggaggagaagagagccagcctgctgcaggccatcgaggagtgccagcaggagagactggccagactgagcgcccagatccaggagcacagaagcctgctggacggcagcggcctggtgggctacgcccaggaggtgctgaaggagaccgaccagccctgcttcgtgcaggccgccaagcagctgcacaacagaatcgccagagccaccgaggccctgcagaccttcagacccgccgccagcagcagcttcagacactgccagctggacgtgggcagagagatgaagctgctgaccgagctgaacttcctgagagtgcccgaggcccccgtgatcgacacccagagaaccttcgcctacgaccagatcttcctgtgctggagactgcccccccacagcccccccgcctggcactacaccgtggagttcagaagaaccgacgtgcccgcccagcccggccccaccagatggcagagaagagaggaggtgagaggcaccagcgccctgctggagaaccccgacaccggcagcgtgtacgtgctgagagtgagaggctgcaacaaggccggctacggcgagtacagcgaggacgtgcacctgcacaccccccccgcccccgtgctgcacttcttcctggacagcagatggggcgccagcagagagagactggccatcagcaaggaccagagagccgtgagaagcgtgcccggcctgcccctgctgctggccgccgacagactgctgaccggctgccacctgagcgtggacgtggtgctgggcgacgtggccgtgacccagggcagaagctactgggcctgcgccgtggaccccgccagctacctggtgaaggtgggcgtgggcctggagagcaagctgcaggagagcttccagggcgcccccgacgtgatcagccccagatacgaccccgacagcggccacgacagcggcgccgaggacgccaccgtggaggccagcccccccttcgccttcctgaccatcggcatgggcaagatcctgctgggcagcggcgccagcagcaacgccggcctgaccggcagagacggccccaccgccggctgcaccgtgcccctgccccccagactgggcatctgcctggactacgagagaggcagagtgagcttcctggacgccgtgagcttcagaggcctgctggagtgccccctggactgcagcggccccgtgtgccccgccttctgcttcatcggcggcggcgccgtgcagctgcaggagcccgtgggcaccaagcccgagagaaaggtgaccatcggcggcttcgccaagctggactag

SEQ ID NO: 25406 - DNA, 1518 bp, Artificial Sequence
  Description of Artificial Sequence: Synthetic coding sequence
atgagaagaggcggcatcctgggccacagacccggcccccaggccttcctggtgcccggcgccagcgccgccaccctgtacaagaccagcatgaagaacatggagaaggagctgctgtgccccgtgtgccaggagatgtacaagcagcccctggtgctgccctgcacccacaacgtgtgccaggcctgcgccagagaggtgctgggccagcagggctacatcggccacggcggcgaccccagcagcgagcccaccagccccgccagcacccccagcaccagaagccccagactgagcagaagaaccctgcccaagcccgacagactggacagactgctgaagagcggcttcggcacctaccccggcagaaagagaggcgccctgcacccccaggtgatcatgttcccctgccccgcctgccagggcgacgtggagctgggcgagagaggcctggccggcctgttcagaaacctgaccctggagagagtggtggagagatacagacagagcgtgagcgtgggcggcgccatcctgtgccagctgtgcaagcccccccccctggaggccaccaagggctgcaccgagtgcagagccaccttctgcaacgagtgcttcaagctgttccacccctggggcacccagaaggcccagcacgagcccaccctgcccaccctgagcttcagacccaagggcctgatgtgccccgaccacaaggaggaggtgacccactactgcaagacctgccagagactggtgtgccagctgtgcagagtgagaagaacccacagcggccacaagatcacccccgtgctgagcgcctaccaggccctgaaggacaagctgaccaagagcctgacctacatcctgggcaaccaggacaccgtgcagacccagatctgcgagctggaggaggccgtgagacacaccgaggtgagcggccagcaggccaaggaggaggtgagccagctggtgagaggcctgggcgccgtgctggaggagaagagagccagcctgctgcaggccatcgaggagtgccagcaggagagactggccagactgagcgcccagatccaggagcacagaagcctgctggacggcagcggcctggtgggctacgcccaggaggtgctgaaggagaccgaccagccctgcttcgtgcaggccgccaagcagctgcacaacagaatcgccagagccaccgaggccctgcagaccttcagacccgccgccagcagcagcttcagacactgccagctggacgtgggcagagagatgaagctgctgaccgagctgaacttcctgagaggctgcggccacagaggcctgtgcagcggcgccccccagtgcctgagaccccccagcctgacccccagcgcccccctgcccatgatcagaagcagctgcgccggcggctgcccccccatccaccacctgcccggcaccatccccctgagcagcggcgccagaatgtgcctgctgagccaggccccccccgccggcagcggcggcagaagatag

SEQ ID NO: 25407 - DNA, 1902 bp, Artificial Sequence
  Description of Artificial Sequence: Synthetic coding sequence
atgttcccctgccccgcctgccagggcgacgtggagctgggcgagagaggcctggccggcctgttcagaaacctgaccctggagagagtggtggagagatacagacagagcgtgagcgtgggcggcgccatcctgtgccagctgtgcaagcccccccccctggaggccaccaagggctgcaccgagtgcagagccaccttctgcaacgagtgcttcaagctgttccacccctggggcacccagaaggcccagcacgagcccaccctgcccaccctgagcttcagacccaagggcctgatgtgccccgaccacaaggaggaggtgacccactactgcaagacctgccagagactggtgtgccagctgtgcagagtgagaagaacccacagcggccacaagatcacccccgtgctgagcgcctaccaggccctgaaggacaagctgaccaagagcctgacctacatcctgggcaaccaggacaccgtgcagacccagatctgcgagctggaggaggccgtgagacacaccgaggtgagcggccagcaggccaaggaggaggtgagccagctggtgagaggcctgggcgccgtgctggaggagaagagagccagcctgctgcaggccatcgaggagtgccagcaggagagactggccagactgagcgcccagatccaggagcacagaagcctgctggacggcagcggcctggtgggctacgcccaggaggtgctgaaggagaccgaccagccctgcttcgtgcaggccgccaagcagctgcacaacagaatcgccagagccaccgaggccctgcagaccttcagacccgccgccagcagcagcttcagacactgccagctggacgtgggcagagagatgaagctgctgaccgagctgaacttcctgagagtgcccgaggcccccgtgatcgacacccagagaaccttcgcctacgaccagatcttcctgtgctggagactgcccccccacagcccccccgcctggcactacaccgtggagttcagaagaaccgacgtgcccgcccagcccggccccaccagatggcagagaagagaggaggtgagaggcaccagcgccctgctggagaaccccgacaccggcagcgtgtacgtgctgagagtgagaggctgcaacaaggccggctacggcgagtacagcgaggacgtgcacctgcacaccccccccgcccccgtgctgcacttcttcctggacagcagatggggcgccagcagagagagactggccatcagcaaggaccagagagccgtgagaagcgtgcccggcctgcccctgctgctggccgccgacagactgctgaccggctgccacctgagcgtggacgtggtgctgggcgacgtggccgtgacccagggcagaagctactgggcctgcgccgtggaccccgccagctacctggtgaaggtgggcgtgggcctggagagcaagctgcaggagagcttccagggcgcccccgacgtgatcagccccagatacgaccccgacagcggccacgacagcggcgccgaggacgccaccgtggaggccagcccccccttcgccttcctgaccatcggcatgggcaagatcctgctgggcagcggcgccagcagcaacgccggcctgaccggcagagacggccccaccgccggctgcaccgtgcccctgccccccagactgggcatctgcctggactacgagagaggcagagtgagcttcctggacgccgtgagcttcagaggcctgctggagtgccccctggactgcagcggccccgtgtgccccgccttctgcttcatcggcggcggcgccgtgcagctgcaggagcccgtgggcaccaagcccgagagaaaggtgaccatcggcggcttcgccaagctggactag

SEQ ID NO: 25408 - DNA, 675 bp, Artificial Sequence
  Description of Artificial Sequence: Synthetic coding sequence
atgagcagaagaatcatcgtgggcaccctgcagagaacccagagaaacatgaacagcggcatcagccaggtgttccagagagagctgacctgccccatctgcatgaactacttcatcgaccccgtgaccatcgactgcggccacagcttctgcagaccctgcttctacctgaactggcaggacatccccatcctgacccagtgcttcgagtgcatcaagaccatccagcagagaaacctgaagaccaacatcagactgaagaagatggccagcctggccagaaaggccagcctgtggctgttcctgagcagcgaggagcagatgtgcggcatccacagagagaccaagaagatgttctgcgaggtggacagaagcctgctgtgcctgctgtgcagcagcagccaggagcacagataccacagacactgccccgccgagtgggccgccgaggagcactgggagaagctgctgaagaagatgcagagcctgtgggagaaggcctgcgagaaccagagaaacctgaacgtggagaccaccagaatcagccactggaaggccttcggcgacatcctgtacagaagcgagagcgtgctgctgcacatgccccagcccctgaacctggccctgagagccggccccatcaccggcctgagagacagactgaaccagttctag

SEQ ID NO: 25409 - DNA, 1359 bp, Artificial Sequence
  Description of Artificial Sequence: Synthetic coding sequence
atgaacagcggcatcctgcaggtgttccagggcgagctgatctgccccctgtgcatgaactacttcatcgaccccgtgaccatcgactgcggccacagcttctgcagaccctgcttctacctgaactggcaggacatccccttcctggtgcagtgcagcgagtgcaccaagagcaccgagcagatcaacctgaagaccaacatccacctgaagaagatggccagcctggccagaaaggtgagcctgtggctgttcctgagcagcgaggagcagatgtgcggcacccacagagagaccaagaagatcttctgcgaggtggacagaagcctgctgtgcctgctgtgcagcagcagccaggagcacagataccacagacacagacccatcgagtgggccgccgaggagcacagagagaagctgctgcagaagatgcagagcctgtgggagaaggcctgcgagaaccacagaaacctgaacgtggagaccaccagaaccagatgctggaaggactacgtgaacctgagactggaggccatcagagccgagtaccagaagatgcccgccttccaccacgaggaggagaagcacaacctggagatgctgaagaagaagggcaaggagatcttccacagactgcacctgagcaaggccaagatggcccacagaatggagatcctgagaggcatgtacgaggagctgaacgagatgtgccacaagcccgacgtggagctgctgcaggccttcggcgacatcctgcacagaagcgagagcgtgctgctgcacatgccccagcccctgaaccccgagctgagcgccggccccatcaccggcctgagagacagactgaaccagttcagagtgcacatcaccctgcaccacgaggaggccaacaacgacatcttcctgtacgagatcctgagaagcatgtgcatcggctgcgaccaccaggacgtgccctacttcaccgccacccccagaagcttcctggcctggggcgtgcagaccttcaccagcggcaagtactactgggaggtgcacgtgggcgacagctggaactgggccttcggcgtgtgcaacatgtacagaaaggagaagaaccagaacgagaagatcgacggcaaggccggcctgttcctgctgggctgcgtgaagaacgacatccagtgcagcctgttcaccaccagccccctgatgctgcagtacatccccaagcccaccagcagagtgggcctgttcctggactgcgaggccaagaccgtgagcttcgtggacgtgaaccagagcagcctgatctacaccatccccaactgcagcttcagcccccccctgagacccatcttctgctgcatccacttctag

SEQ ID NO: 25410 - DNA, 1341 bp, Artificial Sequence
  Description of Artificial Sequence: Synthetic coding sequence
atgaacagcggcatcctgcaggtgttccagggcgagctgatctgccccctgtgcatgaactacttcatcgaccccgtgaccatcgactgcggccacagcttctgcagaccctgcttctacctgaactggcaggacatccccttcctggtgcagtgcagcgagtgcaccaagagcaccgagcagatcaacctgaagaccaacatccacctgaagaagatggccagcctggccagaaaggtgagcctgtggctgttcctgagcagcgaggagcagatgtgcggcacccacagagagaccaagaagatcttctgcgaggtggacagaagcctgctgtgcctgctgtgcagcagcagccaggagcacagataccacagacacagacccatcgagtgggccgccgaggagcacagagagaagctgctgcagaagatgcagagcctgtgggagaaggcctgcgagaaccacagaaacctgaacgtggagaccaccagaaccagatgctggaaggactacgtgaacctgagactggaggccatcagagccgagtaccagaagatgcccgccttccaccacgaggaggagaagcacaacctggagatgctgaagaagaagggcaaggagatcttccacagactgcacctgagcaaggccaagatggcccacagaatggagatcctgagaggcatgtacgaggagctgaacgagatgtgccacaagcccgacgtggagctgctgcaggacctgggcgacatggtggccagaagcgagagcgtgctgctgcacatgctgcagcccgtgaaccccgagctgcccaccggccccatcaccggccccgtggacagactgaaccacttcagagtggagatcagcttcacctgggagggcaccaactacaacatcggcctgttcgaggacgtgagaagcctgatgttcagaagaggcagcctgaacagcgacagaagcgactacttcgccgcctggggcgcctgggtgttcagcagcggcaagcactactgggagctggacgtggacaacagctgggactgggccctgggcgtgtgcaaggacagctggatcagaaagaacagcaccatgttcaacagcaaggacatcttcctgctgctgtgcgtgaaggtggacaaccacttcagcctgctgaccaccagccccatgttcccccactacgtggagaagcccctggtgagagtgggcgtgttcctgaacttcgagagcggcagcgtgagcttcctgaacgtgaccaagaacagcctgatctggaactaccccgccggcagcctgaacttccccgtgagaagcttcttctacaccggccacagatag

SEQ ID NO: 25411 - DNA, 1359 bp, Artificial Sequence
  Description of Artificial Sequence: Synthetic coding sequence
atgaacagcggcatcctgcaggtgttccagggcgagctgatctgccccctgtgcatgaactacttcatcgaccccgtgaccatcgactgcggccacagcttctgcagaccctgcttctacctgaactggcaggacatccccttcctggtgcagtgcagcgagtgcaccaagagcaccgagcagatcaacctgaagaccaacatccacctgaagaagatggccagcctggccagaaaggtgagcctgtggctgttcctgagcagcgaggagcagatgtgcggcacccacagagagaccaagaagatcttctgcgaggtggacagaagcctgctgtgcctgctgtgcagcagcagccaggagcacagataccacagacacagacccatcgagtgggccgccgaggagcacagagagaagctgctgcagaagatgcagagcctgtgggagaaggcctgcgagaaccacagaaacctgaacgtggagaccaccagaaccagatgctggaaggactacgtgaacctgagactggaggccatcagagccgagtaccagaagatgcccgccttccaccacgaggaggagaagcacaacctggagatgctgaagaagaagggcaaggagatcttccacagactgcacctgagcaaggccaagatggcccacagaatggagatcctgagaggcatgtacgaggagctgaacgagatgtgccacaagcccgacgtggagctgctgcaggccttcggcgacatcctgcacagaagcgagagcgtgctgctgcacatgccccagcccctgaaccccgagctgagcgccggccccatcaccggcctgagagacagactgaaccagttcagagtgcacatcaccctgcaccacgaggaggccaacagcgacatcttcctgtacgagatcctgagaagcatgtgcatcggctgcgaccaccaggacgtgccctacttcaccgccacccccagaagcttcctggcctggggcgtgcagaccttcaccagcggcaagtactactgggaggtgcacgtgggcgacagctggaactgggccttcggcgtgtgcaacatgtacagaaaggagaagaaccagaacgagaagatcgacggcaaggagggcctgttcctgctgggctgcatcaagaacgacatccagtgcagcctgttcaccaccagccccctgatgctgcagtacatccccaagcccaccagcagagtgggcctgttcctggactgcgaggccaagaccgtgagcttcgtggacgtgaaccagagcagcctgatctacaccatccccaactgcagcttcagcccccccctgagacccatcttctgctgcatccacttctag

SEQ ID NO: 25412 - DNA, 894 bp, Artificial Sequence
  Description of Artificial Sequence: Synthetic coding sequence
atggccggctacgccaccacccccagccccatgcagaccctgcaggaggaggccgtgtgcgccatctgcctggactacttcaaggaccccgtgagcatcagctgcggccacaacttctgcagaggctgcgtgacccagctgtggagcaaggaggacgaggaggaccagaacgaggaggaggacgagtgggaggaggaggaggacgaggaggccgtgggcgccatggacggctgggacggcagcatcagagaggtgctgtacagaggcaacgccgacgaggagctgttccaggaccaggacgacgacgagctgtggctgggcgacagcggcatcaccaactgggacaacgtggactacatgtgggacgaggaggaggaggaggaggaggaggaccaggactactacctgggcggcctgagacccgacctgagaatcgacgtgtacagagaggaggagatcctggaggcctacgacgaggacgaggacgaggagctgtaccccgacatccaccccccccccagcctgcccctgcccggccagttcacctgcccccagtgcagaaagagcttcaccagaagaagcttcagacccaacctgcagctggccaacatggtgcagatcatcagacagatgtgccccaccccctacagaggcaacagaagcaacgaccagggcatgtgcttcaagcaccaggaggccctgaagctgttctgcgaggtggacaaggaggccatctgcgtggtgtgcagagagagcagaagccacaagcagcacagcgtgctgcccctggaggaggtggtgcaggagtaccaggagatcaagctggagaccaccctggtgggcatcctgcagatcgagcaggagagcatccacagcaaggcctacaaccagtag

SEQ ID NO: 25413 - DNA, 1461 bp, Artificial Sequence
  Description of Artificial Sequence: Synthetic coding sequence
atggcctgggccccccccggcgagagactgagagaggacgccagatgccccgtgtgcctggacttcctgcaggagcccgtgagcgtggactgcggccacagcttctgcctgagatgcatcagcgagttctgcgagaagagcgacggcgcccagggcggcgtgtacgcctgcccccagtgcagaggccccttcagacccagcggcttcagacccaacagacagctggccggcctggtggagagcgtgagaagactgggcctgggcgccggccccggcgccagaagatgcgccagacacggcgaggacctgagcagattctgcgaggaggacgaggccgccctgtgctgggtgtgcgacgccggccccgagcacagaacccacagaaccgcccccctgcaggaggccgccggcagctaccaggtgaagctgcagatggccctggagctgatgagaaaggagctggaggacgccctgacccaggaggccaacgtgggcaagaagaccgtgatctggaaggagaaggtggagatgcagagacagagattcagactggagttcgagaagcacagaggcttcctggcccaggaggagcagagacagctgagaagactggaggccgaggagagagccaccctgcagagactgagagagagcaagagcagactggtgcagcagagcaaggccctgaaggagctggccgacgagctgcaggagagatgccagagacccgccctgggcctgctggagggcgtgagaggcgtgctgagcagaagcaaggccgtgaccagactggaggccgagaacatccccatggagctgaagaccgcctgctgcatccccggcagaagagagctgctgagaaagttccaggtggacgtgaagctggaccccgccaccgcccaccccagcctgctgctgaccgccgacctgagaagcgtgcaggacggcgagccctggagagacgtgcccaacaaccccgagagattcgacacctggccctgcatcctgggcctgcagagcttcagcagcggcagacactactgggaggtgctggtgggcgagggcgccgagtggggcctgggcgtgtgccaggacaccctgcccagaaagggcgagaccacccccagccccgagaacggcgtgtgggccctgtggctgctgaagggcaacgagtacatggtgctggccagccccagcgtgcccctgctgcagctggagagccccagatgcatcggcatcttcctggactacgaggccggcgagatcagcttctacaacgtgaccgacggcagctacatctacaccttcaaccagctgttcagcggcctgctgagaccctacttcttcatctgcgacgccacccccctgatcctgccccccaccaccatcgccggcagcggcaactgggccagcagagaccacctggaccccgccagcgacgtgagagacgaccacctgtag

SEQ ID NO: 25414 - DNA, 1416 bp, Artificial Sequence
  Description of Artificial Sequence: Synthetic coding sequence
atggagttcgtgaccgccctggtgaacctgcaggaggagagcagctgccccatctgcctggagtacctgaaggaccccgtgaccatcaactgcggccacaacttctgcagaagctgcctgagcgtgagctggaaggacctggacgacaccttcccctgccccgtgtgcagattctgcttcccctacaagagcttcagaagaaacccccagctgagaaacctgaccgagatcgccaagcagctgcagatcagaagaagcaagagaaagagacagaaggagaacgccatgtgcgagaagcacaaccagttcctgaccctgttctgcgtgaaggacctggagatcctgtgcacccagtgcagcttcagcaccaagcaccagaagcactacatctgccccatcaagaaggccgccagctaccacagagagatcctggagggcagcctggagcccctgagaaacaacatcgagagagtggagaaggtgatcatcctgcagggcagcaagagcgtggagctgaagaagaaggtggagtacaagagagaggagatcaacagcgagttcgagcagatcagactgttcctgcagaacgagcaggagatgatcctgagacagatccaggacgaggagatgaacatcctggccaagctgaacgagaacctggtggagctgagcgactacgtgagcaccctgaagcacctgctgagagaggtggagggcaagagcgtgcagagcaacctggagctgctgacccaggccaagagcatgcaccacaagtaccagaacctgaagtgccccgagctgttcagcttcagactgaccaagtacggcttcagcctgcccccccagtacagcggcctggacagaatcatcaagcccttccaggtggacgtgatcctggacctgaacaccgcccacccccagctgctggtgagcgaggacagaaaggccgtgagatacgagagaaagaagagaaacatctgctacgaccccagaagattctacgtgtgccccgccgtgctgggcagccagagattcagcagcggcagacactactgggaggtggaggtgggcaacaagcccaagtggatcctgggcgtgtgccaggactgcctgctgagaaactggcaggaccagcccagcgtgctgggcggcttctgggccatcggcagatacatgaagagcggctacgtggccagcggccccaagaccacccagctgctgcccgtggtgaagcccagcaagatcggcatcttcctggactacgagctgggcgacctgagcttctacaacatgaacgacagaagcatcctgtacaccttcaacgactgcttcaccgaggccgtgtggccctacttctacaccggcaccgacagcgagcccctgaagatctgcagcgtgagcgacagcgagagatag

SEQ ID NO: 25415 - DNA, 273 bp, Artificial Sequence
  Description of Artificial Sequence: Synthetic coding sequence
atggagttcgtgaccgccctggtgaacctgcaggaggagagcagctgccccatctgcctggagtacctgaaggaccccgtgaccatcaactgcggccacaacttctgcagaagctgcctgagcgtgagctggaaggacctggacgacaccttcccctgccccgtgtgcagattctgcttcccctacaagagcttcagaagaaacccccagctgagaaacctgaccgagatcgccaagcagctgcagatcagaagaagcaagagaaagagatag

SEQ ID NO: 25416 - DNA, 1416 bp, Artificial Sequence; identical to SEQ ID NO: 25414
  Description of Artificial Sequence: Synthetic coding sequence

SEQ ID NO: 25417 - DNA, 1416 bp, Artificial Sequence; identical to SEQ ID NO: 25414
  Description of Artificial Sequence: Synthetic coding sequence

SEQ ID NO: 25418 - DNA, 630 bp, Artificial Sequence
  Description of Artificial Sequence: Synthetic coding sequence
atggagttcgtgaccgccctggccgacctgagagccgaggccagctgccccatctgcctggactacctgaaggaccccgtgaccatcagctgcggccacaacttctgcctgagctgcatcatcatgagctggaaggacctgcacgacagcttcccctgccccttctgccacttctgctgccccgagagaaagttcatcagcaacccccagctgggcagcctgaccgagatcgccaagcagctgcagatcagaagcaagaagagaaagagacaggaggagaagcacgtgtgcaagaagcacaaccaggtgctgaccttcttctgccagaaggacctggagctgctgtgccccagatgcagcctgagcaccgaccaccagcaccactgcgtgtggcccatcaagaaggccgccagctaccacagaaagaagctggaggagtacaacgccccctggaaggagagagtggagctgatcgagaaggtgatcaccatgcagaccagaaagagcctggagctgaagaagaagatggagagccccagcgtgaccagactggagtgcagctgcaccatcagcgcccacttcaacctgagactgcccggcagcagcgacagcagcgccagcggcagctag

SEQ ID NO: 25419 - DNA, 1428 bp, Artificial Sequence
  Description of Artificial Sequence: Synthetic coding sequence
atggcctgcagcctgaaggacgagctgctgtgcagcatctgcctgagcatctaccaggaccccgtgagcctgggctgcgagcactacttctgcagaagatgcatcaccgagcactgggtgagacaggaggcccagggcgccagagactgccccgagtgcagaagaaccttcgccgagcccgccctggcccccagcctgaagctggccaacatcgtggagagatacagcagcttccccctggacgccatcctgaacgccagaagagccgccagaccctgccaggcccacgacaaggtgaagctgttctgcctgaccgacagagccctgctgtgcttcttctgcgacgagcccgccctgcacgagcagcaccaggtgaccggcatcgacgacgccttcgacgagctgcagagagagctgaaggaccagctgcaggccctgcaggacagcgagagagagcacaccgaggccctgcagctgctgaagagacagctggccgagaccaagagcagcaccaagagcctgagaaccaccatcggcgaggccttcgagagactgcacagactgctgagagagagacagaaggccatgctggaggagctggaggccgacaccgccagaaccctgaccgacatcgagcagaaggtgcagagatacagccagcagctgagaaaggtgcaggagggcgcccagatcctgcaggagagactggccgagaccgacagacacaccttcctggccggcgtggccagcctgagcgagagactgaagggcaagatccacgagaccaacctgacctacgaggacttccccaccagcaagtacaccggccccctgcagtacaccatctggaagagcctgttccaggacatccaccccgtgcccgccgccctgaccctggaccccggcaccgcccaccagagactgatcctgagcgacgactgcaccatcgtggcctacggcaacctgcacccccagcccctgcaggacagccccaagagattcgacgtggaggtgagcgtgctgggcagcgaggccttcagcagcggcgtgcactactgggaggtggtggtggccgagaagacccagtgggtgatcggcctggcccacgaggccgccagcagaaagggcagcatccagatccagcccagcagaggcttctactgcatcgtgatgcacgacggcaaccagtacagcgcctgcaccgagccctggaccagactgaacgtgagagacaagctggacaaggtgggcgtgttcctggactacgaccagggcctgctgatcttctacaacgccgacgacatgagctggctgtacaccttcagagagaagttccccggcaagctgtgcagctacttcagccccggccagagccacgccaacggcaagaacgtgcagcccctgagaatcaacaccgtgagaatctag

SEQ ID NO: 25420 - DNA, 1185 bp, Artificial Sequence
  Description of Artificial Sequence: Synthetic coding sequence
atggcctgcagcctgaaggacgagctgctgtgcagcatctgcctgagcatctaccaggaccccgtgagcctgggctgcgagcactacttctgcagaagatgcatcaccgagcactgggtgagacaggaggcccagggcgccagagactgccccgagtgcagaagaaccttcgccgagcccgccctggcccccagcctgaagctggccaacatcgtggagagatacagcagcttccccctggacgccatcctgaacgccagaagagccgccagaccctgccaggcccacgacaaggtgaagctgttctgcctgaccgacagagccctgctgtgcttcttctgcgacgagcccgccctgcacgagcagcaccaggtgaccggcatcgacgacgccttcgacgagctgcagagagagctgaaggaccagctgcaggccctgcaggacagcgagagagagcacaccgaggccctgcagctgctgaagagacagctggccgagaccaagagcagcaccaagagcctgagaaccaccatcggcgaggccttcgagagactgcacagactgctgagagagagacagaaggccatgctggaggagctggaggccgacaccgccagaaccctgaccgacatcgagcagaaggtgcagagatacagccagcagctgagaaaggtgcaggagggcgcccagatcctgcaggagagactggccgagaccgacagacacaccttcctggccggcgtggccagcctgagcgagagactgaagggcaagatccacgagaccaacctgacctacgaggacttccccaccagcaagtacaccggccccctgcagtacaccatctggaagagcctgttccaggacatccaccccgtgcccgccgccctgaccctggaccccggcaccgcccaccagagactgatcctgagcgacgactgcaccatcgtggcctacggcaacctgcacccccagcccctgcaggacagccccaagagattcgacgtggaggtgagcgtgctgggcagcgaggccttcagcagcggcgtgcactactgggaggtggtggtggccgagaagacccagtgggtgatcggcctggcccacgaggccgccagcagaaagggcagcatccagatccagaacctgggctgcaagggcgtgtgggagatgagcttcccctag

SEQ ID NO: 25421 - DNA, 1185 bp, Artificial Sequence; identical to SEQ ID NO: 25420
  Description of Artificial Sequence: Synthetic coding sequence

SEQ ID NO: 25422 - DNA, 1428 bp, Artificial Sequence; identical to SEQ ID NO: 25419
  Description of Artificial Sequence: Synthetic coding sequence

SEQ ID NO: 25423 - DNA, 1065 bp, Artificial Sequence
  Description of Artificial Sequence: Synthetic coding sequence
atgcccgagaagaccgccgtggaccagccctggacccaggccctgagagagctgaaggaccagctgcaggccctgcaggacagcgagagagagcacaccgaggccctgcagctgctgaagagacagctggccgagaccaagagcagcaccaagagcctgagaaccaccatcggcgaggccttcgagagactgcacagactgctgagagagagacagaaggccatgctggaggagctggaggccgacaccgccagaaccctgaccgacatcgagcagaaggtgcagagatacagccagcagctgagaaaggtgcaggagggcgcccagatcctgcaggagagactggccgagaccgacagacacaccttcctggccggcgtggccagcctgagcgagagactgaagggcaagatccacgagaccaacctgacctacgaggacttccccaccagcaagtacaccggccccctgcagtacaccatctggaagagcctgttccaggacatccaccccgtgcccgccgccctgaccctggaccccggcaccgcccaccagagactgatcctgagcgacgactgcaccatcgtggcctacggcaacctgcacccccagcccctgcaggacagccccaagagattcgacgtggaggtgagcgtgctgggcagcgaggccttcagcagcggcgtgcactactgggaggtggtggtggccgagaagacccagtgggtgatcggcctggcccacgaggccgccagcagaaagggcagcatccagatccagcccagcagaggcttctactgcatcgtgatgcacgacggcaaccagtacagcgcctgcaccgagccctggaccagactgaacgtgagagacaagctggacaaggtgggcgtgttcctggactacgaccagggcctgctgatcttctacaacgccgacgacatgagctggctgtacaccttcagagagaagttccccggcaagctgtgcagctacttcagccccggccagagccacgccaacggcaagaacgtgcagcccctgagaatcaacaccgtgagaatctag

SEQ ID NO: 25424 - DNA, 1350 bp, Artificial Sequence
  Description of Artificial Sequence: Synthetic coding sequence
atggacagcgacgacctgcaggtgttccagaacgagctgatctgctgcatctgcgtgaactacttcatcgaccccgtgaccatcgactgcggccacagcttctgcagaccctgcctgtgcctgtgcagcgaggagggcagagcccccatgagatgccccagctgcagaaagaccagcgagaagcccaacttcaacaccaacctggtgctgaagaagctgagcagcctggccagacagaccagaccccagaacatcaacagcagcgacaacatctgcgtgctgcacgaggagaccaaggagctgttctgcgaggccgacaagagactgctgtgcggcccctgcagcgagagccccgagcacatggcccacagccacagccccatcggctgggccgccgaggagtgcagagagaagctgatcaaggagatggactacctgtgggagatcaaccaggagaccagaaacaacctgaaccaggagaccagcaccttccacagcctgaaggactacgtgagcgtgagaaagagaatcatcaccatccagtaccagaagatgcccatcttcctggacgaggaggagcagagacacctgcaggccctggagagagaggccgaggagctgttccagcagctgcaggacagccaggtgagaatgacccagcacctggagagaatgaaggacatgtacagagagctgtgggagacctgccacatgcccgacgtggtgctgctgcaggacgtgagaaacgtgagcgccagaaccgacctggcccagatgcagaagccccagcccgtgaaccccgagctgaccagctggtgcatcaccggcgtgctggacatgctgaacaacttcagagtggacagcgccctgagcaccgagatgatcccctgctacatcagcctgagcgaggacgtgagatacgtgatcttcggcgacgaccacctgagcgcccccaccgacccccagggcgtggacagcttcgccgtgtggggcgcccaggccttcaccagcggcaagcactactgggaggtggacgtgaccctgagcagcaactggatcctgggcgtgtgcagagacagcagaaccgccgacgccaacttcgtgatcgacagcgacgagagattcttcctgatcagcagcaagagaagcaaccactacagcctgagcaccaacagcccccccctgatccagtacgtgcagagacccctgggcagagtgggcgtgttcctggactacgacaacggcagcgtgagcttcttcgacgtgagcaagggcagcctgatctacggcttcccccccagcagcttcagcagccccctgagacccttcttctgcttcggctgcacctag

SEQ ID NO: 25425 - DNA, 1344 bp, Artificial Sequence
  Description of Artificial Sequence: Synthetic coding sequence
atggacagcgacaccctgagagtgttccagaacgagctgatctgctgcatctgcgtgaactacttcatcgaccccgtgaccaccgactgcgtgcacagcttctgcagaccctgcctgtgcctgtgcagcgaggagggcagagcccccatgagatgccccctgtgcagaaagatcagcgagaagcccaacttcaacaccaacgtggccctgaagaagctggccagcctggccagacagaccagaccccagaacatcaacagcagcgacaacatctgcgtgctgcacgaggagaccaaggagctgttctgcgaggccgacaagagactgctgtgcggcccctgcagcgagagccccgagcacatggcccacagccacagccccatcggctgggccgccgaggagtgcagagtgcagaagctgatcaaggagatggactacctgtggaagatcaaccaggagacccagaacaacctgaaccaggagaccagcaagttctgcagcctggtggaggacaagagaaacagaatcgtgtacagataccagaagatgcacatcttcctggacgaggaggagcagagacacctgcaggccctggagagagaggccaaggagctgttccagcagctgcaggacagccaggtgagaatgacccagcacctggagggcatgaaggacatgtacagagagctgtgggagacctaccacatgcccgacgtggagctgctgcaggacgtgggcaacatcagcgccagaaccgacctggcccagatgcccaagccccagcccgtgaaccccgagctgaccagctggtgcatcaccggcgtgctggacatgctgaacaacttcagagtggacaacgccctgagcaccgagatgaccccctgctacatcagcctgagcgaggacgtgagaagagtgatcttcggcgacgaccacagaagcgcccccatggacccccagggcgtggagagcttcgccgtgtggtgcgcccaggccttcaccagcggcaagcactactgggaggtggacgtgacccacagcagcaactggatcctgggcgtgtgcagagacagcagaaccgccgacaccaacatcgtgatcgacagcgacaagaccttcttcagcatcagcagcaagaccagcaaccactacagcctgagcaccaacagcccccccctgatccagtacgtgcagagacccctgggctgggtgggcgtgttcctggactacgacaacggcagcgtgagcttcttcgacgtgagcaagggcagcctgatctacggcttcccccccagcagcttcagcagccccctgagacccttcttctgcttcggctgcacctag

SEQ ID NO: 25426 - DNA, 1554 bp, Artificial Sequence
  Description of Artificial Sequence: Synthetic coding sequence
atggccgcccagctgctggaggagaagctgacctgcgccatctgcctgggcctgtaccaggaccccgtgaccctgccctgcggccacaacttctgcggcgcctgcatcagagactggtgggacagatgcggcaaggcctgccccgagtgcagagagcccttccccgacggcgccgagctgagaagaaacgtggccctgagcggcgtgctggaggtggtgagagccggccccgccagagaccccggccccgaccccggccccggccccgaccccgccgccagatgccccagacacggcagacccctggagctgttctgcagaaccgagggcagatgcgtgtgcagcgtgtgcaccgtgagagagtgcagactgcacgagagagccctgctggacgccgagagactgaagagagaggcccagctgagagccagcctggaggtgacccagcagcaggccacccaggccgagggccagctgctggagctgagaaagcagagcagccagatccagaacagcgcctgcatcctggccagctgggtgagcggcaagttcagcagcctgctgcaggccctggagatccagcacaccaccgccctgagaagcatcgaggtggccaagacccaggccctggcccaggccagagacgaggagcagagactgagagtgcacctggaggccgtggccagacacggctgcagaatcagagagctgctggagcaggtggacgagcagaccttcctgcaggagagccagctgctgcagccccccggccccctgggccccctgacccccctgcagtgggacgaggaccagcagctgggcgacctgaagcagctgctgagcagactgtgcggcctgctgctggaggagggcagccaccccggcgcccccgccaagcccgtggacctggcccccgtggaggcccccggccccctggcccccgtgcccagcaccgtgtgccccctgagaagaaagctgtggcagaactacagaaacctgaccttcgaccccgtgagcgccaacagacacttctacctgagcagacaggaccagcaggtgaagcactgcagacagagcagaggccccggcggccccggcagcttcgagctgtggcaggtgcagtgcgcccagagcttccaggccggccaccactactgggaggtgagagccagcgaccacagcgtgaccctgggcgtgagctacccccagctgcccagatgcagactgggcccccacaccgacaacatcggcagaggcccctgcagctggggcctgtgcgtgcaggaggacagcctgcaggcctggcacaacggcgaggcccagagactgcccggcgtgagcggcagactgctgggcatggacctggacctggccagcggctgcctgaccttctacagcctggagccccagacccagcccctgtacaccttccacgccctgttcaaccagcccctgacccccgtgttctggctgctggagggcagaaccctgaccctgtgccaccagcccggcgccgtgttccccctgggcccccaggaggaggtgctgagctag

SEQ ID NO: 25427 - DNA, 1407 bp, Artificial Sequence
  Description of Artificial Sequence: Synthetic coding sequence
atgagcaccgccgacctgatggagaacctgagagaggagctgacctgcttcatctgcctggactacttcagcagccccgtgaccaccgagtgcggccacagcttctgcctggtgtgcctgctgagaagctgggaggagcacaacacccccctgagctgccccgagtgctggagaaccctggagggcccccacttccagagcaacgagagactgggcagactggccagcatcgccagacagctgagaagccaggtgctgcagagcgaggacgagcagggcagctacggcagaatgcccaccaccgccaaggccctgagcgacgacgagcagggcggcagcgccttcgtggcccagagccacggcgccaacagagtgcacctgagcagcgaggccgaggagcaccacagagagaagctgcaggagatcctgaacctgctgagagtgagaagaaaggaggcccaggccgtgctgacccacgagaaggagagagtgaagctgtgccaggaggagaccaagacctgcaagcaggtggtggtgagcgagtacatgaagatgcaccagttcctgaaggaggaggagcagctgcagctgcagctgctggagcaggaggagaaggagaacatgagaaagctgagaaacaacgagatcaagctgacccagcagatcagaagcctgagcaagatgatcgcccagatcgagagcagcagccagagcagcgccttcgagagcctggaggaggtgagaggcgccctggagagaagcgagcccctgctgctgcagtgccccgaggccaccaccaccgagctgagcctgtgcagaatcaccggcatgaaggagatgctgagaaagttcagcaccgagatcaccctggaccccgccaccgccaacgcctacctggtgctgagcgaggacctgaagagcgtgaagtacggcggcagcagacagcagctgcccgacaaccccgagagattcgaccagagcgccaccgtgctgggcacccagatcttcaccagcggcagacactactgggaggtggaggtgggcaacaagaccgagtgggaggtgggcatctgcaaggacagcgtgagcagaaagggcaacctgcccaagccccccggcgacctgttcagcctgatcggcctgaagatcggcgacgactacagcctgtgggtgagcagccccctgaagggccagcacgtgagagagcccgtgtgcaaggtgggcgtgttcctggactacgagagcggccacatcgccttctacaacggcaccgacgagagcctgatctacagcttcccccaggccagcttccaggaggccctgagacccatcttcagcccctgcctgcccaacgagggcaccaacaccgaccccctgaccatctgcagcctgaacagccacgtgtag

SEQ ID NO: 25428 - DNA, 1164 bp, Artificial Sequence
  Description of Artificial Sequence: Synthetic coding sequence
atggtgtgcggcatccaggaggccgccgagaactacagaaagctgttccaggagatcctgaacaccagcagagagaagctggaggccgccaagagcatcctgaccgacgagcaggagagaatggccatgatccaggaggaggagcagaacttcaagaagatgatcgagagcgagtacagcatgagactgagactgctgaacgaggagtgcgagcagaacctgcagagacagcaggagtgcatcagcgacctgaacctgagagagaccctgctgaaccaggccatcaagctggccaccgagctggaggagatgttccaggagatgctgcagagactgggcagagtgggcagagagaacatggagaagctgaaggagagcgaggccagagccagcgagcaggtgagaagcctgctgaagctgatcgtggagctggagaagaagtgcggcgagggcaccctggccctgctgaagaacgccaagtacagcctggagagaagcaagagcctgctgctggagcacctggagcccgcccacatcaccgacctgagcctgtgccacatcagaggcctgagcagcatgttcagagtgctgcagagacacctgaccctggaccccgagaccgcccacccctgcctggccctgagcgaggacctgagaaccatgagactgagacacggccagcaggacggcgccggcaaccccgagagactggacttcagcgccatggtgctggccgccgagagcttcaccagcggcagacactactgggaggtggacgtggagaaggccaccagatggcaggtgggcatctaccacggcagcgccgacgccaagggcagcaccgccagagccagcggcgagaaggtgctgctgaccggcagcgtgatgggcaccgagtggaccctgtgggtgttcccccccctgaagagactgttcctggagaagaagctggacaccgtgggcgtgttcctggactgcgagcacggccagatcagcttctacaacgtgaccgagatgagcctgatctacaacttcagccactgcgccttccagggcgccctgagacccgtgttcagcctgtgcatccccaacggcgacaccagccccgacagcctgaccatcctgcagcacggccccagctgcgacgccaccgtgagcccctag

SEQ ID NO: 25429 - DNA, 666 bp, Artificial Sequence
  Description of Artificial Sequence: Synthetic coding sequence
atgagcaagagactgagcccccagctgcagcacaacatcaccgaggacgcctactgcgagacccacctggagcccaccagactgttctgcgacgtggaccagatcaccctgtgcagcaagtgcttccagagccaggagcacaagcaccacatggtgtgcggcatccaggaggccgccgagaactacagaaagctgttccaggagatcctgaacaccagcagagagaagctggaggccgccaagagcatcctgaccgacgagcaggagagaatggccatgatccaggaggaggagcagaacttcaagaagatgatcgagagcgagtacagcatgagactgagactgctgaacgaggagtgcgagcagaacctgcagagacagcaggagtgcatcagcgacctgaacctgagagagaccctgctgaaccaggccatcaagctggccaccgagctggaggagatgttccaggagatgctgcagagactgggcagagtgggcagagagaacatggagaagctgaaggagagcgaggccagagccagcgagcaggtgagaagcctgctgaagctgatcgtggagctggagaagaagtgcggcgagggcaccctggccctgctgaaggtgagatgctgggagaaggagaacaagatccacagcagcatctag

SEQ ID NO: 25430 - DNA, 1173 bp, Artificial Sequence
  Description of Artificial Sequence: Synthetic coding sequence
atgtgcatctgccacctgccctgcagacccgtgaagcccaacatcatcggcgagcagatcaccagcaagatgggcgcccactaccactgcatcatctgcagcgccaccatcaccagaagaaccgacatgctgggccacgtgagaagacacatgaacaagggcgagaccaagagcagctacatcgccgccagcaccgccaagccccccaaggagatcctgaaggaggccgacaccgacgtgcaggtgtgccccaactacagcatcccccagaagaccgacagctacttcaaccccaagatgaagctgaacagacagctgatcttctgcaccctggccgccctggccgaggagagaaagcccctggagtgcctggacgccttcggcgccaccggcatcatgggcctgcagtgggccaagcacctgggcaacgccgtgaaggtgaccatcaacgacctgaacgagaacagcgtgaccctgatccaggagaactgccacctgaacaagctgaaggtggtggtggacagcaaggagaaggagaagagcgacgacatcctggaggagggcgagaagaacctgggcaacatcaaggtgaccaagatggacgccaacgtgctgatgcacctgagaagcttcgacttcatccacctggaccccttcggcaccagcgtgaactacctggacagcgccttcagaaacatcagaaacctgggcatcgtgagcgtgaccagcaccgacatcagcagcctgtacgccaaggcccagcacgtggccagaagacactacggctgcaacatcgtgagaaccgagtactacaaggagctggccgccagaatcgtggtggccgccgtggccagagccgccgccagatgcaacaagggcatcgaggtgctgttcgccgtggccctggagcacttcgtgctggtggtggtgagagtgctgagaggccccaccagcgccgacgagaccgccaagaagatccagtacctgatccactgccagtggtgcgaggagagaatcttccagaaggacggcaacatggtggaggactacagcgccaacttcgtgatcagctacaccggcttccccttcgtgaacagacaggacatcagaaagacccacatcgacagctgcctggtgaccgtgatggaggcctgcctggagagacagcagtag

SEQ ID NO: 25431 - DNA, 2202 bp, Artificial Sequence
  Description of Artificial Sequence: Synthetic coding sequence
atggagaacatggccgaggaggagctgctgcccctggagaaggaggaggtggaggtggcccaggtgcaggtgcccacccccgccagagacagcgccggcgtgcccgcccccgcccccgacagcgccctggacagcgcccccacccccgccagcgcccccgcccccgcccccgccctggcccaggcccccgccctgagccccagcctggccagcgcccccgaggaggccaagagcaagagacacatcagcatccagagacagctggccgacctggagaacctggccttcgtgaccgacggcaacttcgacagcgccagcagcctgaacagcgacaacctggacgccggcaacagacaggcctgccccctgtgccccaaggagaagttcagagcctgcaacagccacaagctgagaagacacctgcagaacctgcactggaaggtgagcgtggagttcgagggctacagaatgtgcatctgccacctgccctgcagacccgtgaagcccaacatcatcggcgagcagatcaccagcaagatgggcgcccactaccactgcatcatctgcagcgccaccatcaccagaagaaccgacatgctgggccacgtgagaagacacatgaacaagggcgagaccaagagcagctacatcgccgccagcaccgccaagccccccaaggagatcctgaaggaggccgacaccgacgtgcaggtgtgccccaactacagcatcccccagaagaccgacagctacttcaaccccaagatgaagctgaacagacagctgatcttctgcaccctggccgccctggccgaggagagaaagcccctggagtgcctggacgccttcggcgccaccggcatcatgggcctgcagtgggccaagcacctgggcaacgccgtgaaggtgaccatcaacgacctgaacgagaacagcgtgaccctgatccaggagaactgccacctgaacaagctgaaggtggtggtggacagcaaggagaaggagaagagcgacgacatcctggaggagggcgagaagaacctgggcaacatcaaggtgaccaagatggacgccaacgtgctgatgcacctgagaagcttcgacttcatccacctggaccccttcggcaccagcgtgaactacctggacagcgccttcagaaacatcagaaacctgggcatcgtgagcgtgaccagcaccgacatcagcagcctgtacgccaaggcccagcacgtggccagaagacactacggctgcaacatcgtgagaaccgagtactacaaggagctggccgccagaatcgtggtggccgccgtggccagagccgccgccagatgcaacaagggcatcgaggtgctgttcgccgtggccctggagcacttcgtgctggtggtggtgagagtgctgagaggccccaccagcgccgacgagaccgccaagaagatccagtacctgatccactgccagtggtgcgaggagagaatcttccagaaggacggcaacatggtggaggagaacccctacagacagctgccctgcaactgccacggcagcatgcccggcaagaccgccatcgagctgggccccctgtggagcagcagcctgttcaacaccggcttcctgaagagaatgctgttcgagagcctgcaccacggcctggacgacatccagaccctgatcaagaccctgatcttcgagagcgagtgcaccccccagagccagttcagcatccacgccagcagcaacgtgaacaagcaggaggagaacggcgtgttcatcaagaccaccgacgacaccaccaccgacaactacatcgcccagggcaagagaaagagcaacgagatgatcaccaacctgggcaagaagcagaagaccgacgtgagcaccgagcacccccccttctactacaacatccacagacacagcatcaagggcatgaacatgcccaagctgaagaagttcctgtgctacctgagccaggccggcttcagagtgagcagaacccacttcgaccccatgggcgtgagaaccgacgcccccctgatgcagttcaagagcatcctgctgaagtacagcacccccacctacaccggcggccagagcgagagccacgtgcagagcgccagcgaggacaccgtgaccgagagagtggagatgagcgtgaacgacaaggccgaggccagcggctgcagaagatggtag

SEQ ID NO: 25432 - DNA, 639 bp, Artificial Sequence
  Description of Artificial Sequence: Synthetic coding sequence
accagcgtgaactacctggacagcgccttcagaaacatcagaaacctgggcatcgtgagcgtgaccagcaccgacatcagcagcctgtacgccaaggcccagcacgtggccagaagacactacggctgcaacatcgtgagaaccgagtactacaaggagctggccgccagaatcgtggtggccgccgtggccagagccgccgccagatgcaacaagggcatcgaggtgctgttcgccgtggccctggagcacttcgtgctggtggtggtgagagtgctgagaggccccaccagcgccgacgagaccgccaagaagatccagtacctgatccactgccagtggtgcgaggagagaatcttccagaaggacggcaacatggtggaggagaacccctacagacagctgccctgcaactgccacggcagcatgcccggcaagaccgccatcgagctgggccccctgtggagcagcagcctgttcaacaccggcttcctgaagagaatgctgttcgagagcctgcaccacggcctggacgacatccagaccctgatcaagaccctgatcttcgagagcgagtgcaccccccagagccagttcagcatccacgccagcagcaacgtgaacaagcagggcgactag

SEQ ID NO: 25433 - DNA, 1392 bp, Artificial Sequence
  Description of Artificial Sequence: Synthetic coding sequence
atggccctgagctgcaccctgaacagatacctgctgctgatggcccaggagcacctggagttcagactgcccgagatcaagagcctgctgctgctgttcggcggccagttcgccagcagccaggagacctacggcaagagccccttctggatcctgagcatccccagcgaggacatcgccagaaacctgatgaagagaaccgtgtgcgccaagagcatcttcgagctgtggggccacggccagagccccgaggagctgtacagcagcctgaagaactaccccgtggagaagatggtgcccttcctgcacagcgacagcacctacaagatcaagatccacaccttcaacaagaccctgacccaggaggagaagatcaagagaatcgacgccctggagttcctgcccttcgagggcaaggtgaacctgaagaagccccagcacgtgttcagcgtgctggaggactacggcctggaccccaactgcatccccgagaacccccacaacatctacttcggcagatggatcgccgacggccagagagagctgatcgagagctacagcgtgaagaagagacacttcatcggcaacaccagcatggacgccggcctgagcttcatcatggccaaccacggcaaggtgaaggagaacgacatcgtgttcgaccccttcgtgggcaccggcggcctgctgatcgcctgcgcccacttcggcgcctacgtgtacggcaccgacatcgactacaacaccgtgcacggcctgggcaaggccaccagaaagaaccagaagtggagaggccccgacgagaacatcagagccaacctgagacagtacggcctggagaagtactacctggacgtgctggtgagcgacgccagcaagcccagctggagaaagggcacctacttcgacgccatcatcaccgaccccccctacggcatcagagagagcaccagaagaaccggcagccagaaggagatccccaagggcatcgagaagtgggagaagtgccccgagagccacgtgcccgtgagcctgagctaccacctgagcgacatgttcctggacctgctgaacttcgccgccgagaccctggtgctgggcggcagactggtgtactggctgcccgtgtacacccccgagtacaccgaggagatggtgccctggcacccctgcctggagctggtgagcaactgcgagcagaagctgagcagccacaccagcagaagactgatcaccatggagaaggtgaagaagttcgagaacagagaccagtacagccacctgctgagcgaccacttcctgccctaccagggccacaacagcttcagagagaagtacttcagcggcgtgaccaagagaatcgccaaggaggagaagagcacccaggagtag

SEQ ID NO: 25434 - DNA, 1377 bp, Artificial Sequence
  Description of Artificial Sequence: Synthetic coding sequence
atggccctgagctgcaccctgaacagatacctgctgctgatggcccaggagcacctggagttcagactgcccgagatcaagagcctgctgctgctgttcggcggccagttcgccagcagccaggagacctacggcaagagccccttctggatcctgagcatccccagcgaggacatcgccagaaacctgatgaagagaaccgtgtgcgccaagagcatcttcgagctgtggggccacggccagagccccgaggagctgtacagcagcctgaagaactaccccgtggagaagatggtgcccttcctgcacagcgacagcacctacaagatcaagatccacaccttcaacaagaccctgacccaggaggagaagatcaagagaatcgacgccctggagttcctgcccttcgagggcaaggtgaacctgaagaagccccagcacgtgttcagcgtgctggaggactacggcctggaccccaactgcatccccgagaacccccacaacatctacttcggcagatggatcgccgacggccagagagagctgatcgagagctacagcgtgaagaagagacacttcatcggcaacaccagcatggacgccggcctgagcttcatcatggccaaccacggcaaggtgaaggagaacgacatcgtgttcgaccccttcgtgggcaccggcggcctgctgatcgcctgcgcccacttcggcgcctacgtgtacggcaccgacatcgactacaacaccgtgcacggcctgggcaaggccaccagaaagaaccagaagtggagaggccccgacgagaacatcagagccaacctgagacagtacggcctggagaagtactacctggacgtgctggtgagcgacgccagcaagcccagctggagaaagggcacctacttcgacgccatcatcaccgaccccccctacggcatcagagagagcaccagaagaaccggcagccagaaggagatccccaagggcatcgagaagtgggagaagtgccccgagagccacgtgcccgtgagcctgagctaccacctgagcgacatgttcctggacctgctgaacttcgccgccgagaccctggtgctgggcggcagactggtgtactggctgcccgtgtacacccccgagtacaccgaggagatggtgccctggcacccctgcctggagctggtgagcaactgcgagcagaagctgagcagccacaccagcagaagactgatcaccatggagaagaacagagaccagtacagccacctgctgagcgaccacttcctgccctaccagggccacaacagcttcagagagaagtacttcagcggcgtgaccaagagaatcgccaaggaggagaagagcacccaggagtag

SEQ ID NO: 25435 - DNA, 282 bp, Artificial Sequence
  Description of Artificial Sequence: Synthetic coding sequence
atgaagagaaccgtgtgcgccaagagcatcttcgagctgtggggccacggccagagccccgaggagctgtacagcagcctgaagaactaccccgtggagaagatggtgcccttcctgcacagcgacagcacctacaagatcaagatccacaccttcaacaagaccctgacccaggaggagaagatcaagagaatcgacgccctggagttcctgcccttcgagggcaaggtgaacctgaagaagccccagcacgtgttcagcgtgctggaggactacggctag

SEQ ID NO: 25436 - DNA, 405 bp, Artificial Sequence
  Description of Artificial Sequence: Synthetic coding sequence
atgaagagaaccgtgtgcgccaagagcatcttcgagctgtggggccacggccagagccccgaggagctgtacagcagcctgaagaactaccccgtggagaagatggtgcccttcctgcacagcgacagcacctacaagatcaagatccacaccttcaacaagaccctgacccaggaggagaagatcaagagaatcgacgccctggagttcctgcccttcgagggcaaggtgaacctgaagaagccccagcacgtgttcagcgtgctggaggactacggcctggaccccaactgcatccccgagaacccccacaacatctacttcggcagatggatcgccgacggccagagagagctgatcgagagctacagcgtgaagaagagacacttcatcggcaacacctag

SEQ ID NO: 25437 - DNA, 774 bp, Artificial Sequence
  Description of Artificial Sequence: Synthetic coding sequence
atggccctgagctgcaccctgaacagatacctgctgctgatggcccaggagcacctggagttcagactgcccgagatcaagagcctgctgctgctgttcggcggccagttcgccagcagccaggagacctacggcaagagccccttctggatcctgagcatccccagcgaggacatcgccagaaacctgatgaagagaaccgtgtgcgccaagagcatcttcgagctgtggggccacggccagagccccgaggagctgtacagcagcctgaagaactaccccgtggagaagatggtgcccttcctgcacagcgacagcacctacaagatcaagatccacaccttcaacaagaccctgacccaggaggagaagatcaagagaatcgacgccctggagttcctgcccttcgagggcaaggtgaacctgaagaagccccagcacgtgttcagcgtgctggaggactacggcctggaccccaactgcatccccgagaacccccacaacatctacttcggcagatggatcgccgacggccagagagagctgatcgagagctacagcgtgaagaagagacacttcatcggcaacaccagcatggacgccggcctgagcttcatcatggccaaccacggcaaggtgaaggagaacgacatcgtgttcgaccccttcgtgggcaccggcggcctgctgatcgcctgcgcccacttcggcgcctacgtgtacggcaccgacatcgactacaacaccgtgcacggcctggcctgcagcacctag

SEQ ID NO: 25438 - DNA, 513 bp, Artificial Sequence
  Description of Artificial Sequence: Synthetic coding sequence
tgactgagcttcatcatggccaaccacggcaaggtgaaggagaacgacatcgtgttcgaccccttcgtgggcaccggcggcctgctgatcgcctgcgcccacttcggcgcctacgtgtacggcaccgacatcgactacaacaccgtgcacggcctgggcaaggccaccagaaagaaccagaagtggagaggccccgacgagaacatcagagccaacctgagacagtacggcctggagaagtactacctggacgtgctggtgagcgacgccagcaagcccagctggagaaagggcacctacttcgacgccatcatcaccgaccccccctacggcatcagagagagcaccagaagaaccggcagccagaaggagatccccaagggcatcgagaagtgccccgagagccacgtgcccgtgagcctgagctaccacctgagcgacatgttcctggacctgctgaacttcgccgccgagaccctggtgctgggcggcagactggtgtactggctgtag

SEQ ID NO: 25439 - DNA, 378 bp, Artificial Sequence
  Description of Artificial Sequence: Synthetic coding sequence
atgaagctgctgacccacaacctgctgagcagccacgtgagaggcgtgggcagcagaggcttccccctgagactgcaggccaccgaggtgagaatctgccccgtggagttcaaccccaacttcgtggccagaatgatccccaaggtggagtggagcgccttcctggaggccgccgacaacctgagactgatccaggtgcccaagggccccgtggagggctacgaggagaacgaggagttcctgagaaccatgcaccacctgctgctggaggtggaggtgatcgagggcaccctgcagtgccccgagagcggcagaatgttccccatcagcagaggcatccccaacatgctgctgagcgaggaggagaccgagagctag

SEQ ID NO: 25440 - DNA, 1347 bp, Artificial Sequence
  Description of Artificial Sequence: Synthetic coding sequence
atgagagagaacgtggtggtgagcaacatggagagagagagcggcaagcccgtggccgtggtggccgtggtgaccgagccctggttcacccagagatacagagagtacctgcagagacagaagctgttcgacacccagcacagagtggagaagatgcccgacggcagcgtggccctgcccgtgctgggcgagaccctgcccgagcagcacctgcaggagctgagaaacagagtggcccccggcagcccctgcatgctgacccagctgcccgaccccgtgcccagcaagagagcccagggctgcagccccgcccagaagctgtgcctggaggtgagcagatgggtggagggcagaggcgtgaagtggagcgccgagctggaggccgacctgcccagaagctggcagagacacggcaacctgctgctgctgagcgaggactgcttccaggccaagcagtggaagaacctgggccccgagctgtgggagaccgtggccctggccctgggcgtgcagagactggccaagagaggcagagtgagccccgacggcaccagaacccccgccgtgaccctgctgctgggcgaccacggctgggtggagcacgtggacaacggcatcagatacaagttcgacgtgacccagtgcatgttcagcttcggcaacatcaccgagaagctgagagtggccagcctgagctgcgccggcgaggtgctggtggacctgtacgccggcatcggctacttcaccctgcccttcctggtgcacgccggcgccgccttcgtgcacgcctgcgagtggaacccccacgccgtggtggccctgagaaacaacctggagatcaacggcgtggccgacagatgccagatccacttcggcgacaacagaaagctgaagctgagcaacatcgccgacagagtgatcctgggcctgatccccagcagcgaggagggctggcccatcgcctgccaggtgctgagacaggacgccggcggcatcctgcacatccaccagaacgtggagagcttccccggcaagaacctgcaggccctgggcgtgagcaaggtggagaaggagcactggctgtacccccagcagatcaccaccaaccagtggaagaacggcgccaccagagacagcagaggcaagatgctgagccccgccaccaagcccgagtggcagagatgggccgagagcgccgagaccagaatcgccaccctgctgcagcaggtgcacggcaagccctggaagacccagatcctgcacatccagcccgtgaagagctacgccccccacgtggaccacatcgtgctggacctggagtgctgcccctgccccagcgtgggctag

SEQ ID NO: 25441 - DNA, 1434 bp, Artificial Sequence
  Description of Artificial Sequence: Synthetic coding sequence
atgctgatggcctggtgcagaggccccgtgctgctgtgcctgagacagggcctgggcaccaacagcttcctgcacggcctgggccaggagcccttcgagggcgccagaagcctgtgctgcagaagcagccccagagacctgagagacggcgagagagagcacgaggccgcccagagaaaggcccccggcgccgagagctgccccagcctgcccctgagcatcagcgacatcggcaccggctgcctgagcagcctggagaacctgagactgcccaccctgagagaggagagcagccccagagagctggaggacagcagcggcgaccagggcagatgcggccccacccaccagggcagcgaggaccccagcatgctgagccaggcccagagcgccaccgaggtggaggagagacacgtgagccccagctgcagcaccagcagagagagacccttccaggccggcgagctgatcctggccgagaccggcgagggcgagaccaagttcaagaagctgttcagactgaacaacttcggcctgctgaacagcaactggggcgccgtgcccttcggcaagatcgtgggcaagttccccggccagatcctgagaagcagcttcggcaagcagtacatgctgagaagacccgccctggaggactacgtggtgctgatgaagagaggcaccgccatcaccttccccaaggacatcaacatgatcctgagcatgatggacatcaaccccggcgacaccgtgctggaggccggcagcggcagcggcggcatgagcctgttcctgagcaaggccgtgggcagccagggcagagtgatcagcttcgaggtgagaaaggaccaccacgacctggccaagaagaactacaagcactggagagacagctggaagctgagccacgtggaggagtggcccgacaacgtggacttcatccacaaggacatcagcggcgccaccgaggacatcaagagcctgaccttcgacgccgtggccctggacatgctgaacccccacgtgaccctgcccgtgttctacccccacctgaagcacggcggcgtgtgcgccgtgtacgtggtgaacatcacccaggtgatcgagctgctggacggcatcagaacctgcgagctggccctgagctgcgagaagatcagcgaggtgatcgtgagagactggctggtgtgcctggccaagcagaagaacggcatcctggcccagaaggtggagagcaagatcaacaccgacgtgcagctggacagccaggagaagatcggcgtgaagggcgagctgttccaggaggacgaccacgaggagagccacagcgacttcccctacggcagcttcccctacgtggccagacccgtgcactggcagcccggccacaccgccttcctggtgaagctgagaaaggtgaagccccagctgaactag

SEQ ID NO: 25442 - DNA, 933 bp, Artificial Sequence
  Description of Artificial Sequence: Synthetic coding sequence
atgctggtggtggaggtggccaacggcagaagcctggtgtggggcgccgaggccgtgcaggccctgagagagagactgggcgtgggcggcagaaccgtgggcgccctgcccagaggccccagacagaacagcagactgggcctgcccctgctgctgatgcccgaggaggccagactgctggccgagatcggcgccgtgaccctggtgagcgcccccagacccgacagcagacaccacagcctggccctgaccagcttcaagagacagcaggaggagagcttccaggagcagagcgccctggccgccgaggccagagagaccagaagacaggagctgctggagaagatcaccgagggccaggccgccaagaagcagaagctggagcaggccagcggcgccagcagcagccaggaggccggcagcagccaggccgccaaggaggacgagaccagcgacggccaggccagcggcgagcaggaggaggccggccccagcagcagccaggccggccccagcaacggcgtggcccccctgcccagaagcgccctgctggtgcagctggccaccgccagacccagacccgtgaaggccagacccctggactggagagtgcagagcaaggactggccccacgccggcagacccgcccacgagctgagatacagcatctacagagacctgtgggagagaggcttcttcctgagcgccgccggcaagttcggcggcgacttcctggtgtaccccggcgaccccctgagattccacgcccactacatcgcccagtgctgggcccccgaggacaccatccccctgcaggacctggtggccgccggcagactgggcaccagcgtgagaaagaccctgctgctgtgcagcccccagcccgacggcaaggtggtgtacaccagcctgcagtgggccagcctgcagtag

SEQ ID NO: 25443 - DNA, 933 bp, Artificial Sequence; identical to SEQ ID NO: 25442
  Description of Artificial Sequence: Synthetic coding sequence

SEQ ID NO: 25444 - DNA, 933 bp, Artificial Sequence; identical to SEQ ID NO: 25442
  Description of Artificial Sequence: Synthetic coding sequence

SEQ ID NO: 25445 - DNA, 933 bp, Artificial Sequence; identical to SEQ ID NO: 25442
  Description of Artificial Sequence: Synthetic coding sequence

SEQ ID NO: 25446 - DNA, 933 bp, Artificial Sequence; identical to SEQ ID NO: 25442
  Description of Artificial Sequence: Synthetic coding sequence

SEQ ID NO: 25447 - DNA, 933 bp, Artificial Sequence; identical to SEQ ID NO: 25442
  Description of Artificial Sequence: Synthetic coding sequence

SEQ ID NO: 25448 - DNA, 933 bp, Artificial Sequence; identical to SEQ ID NO: 25442
  Description of Artificial Sequence: Synthetic coding sequence

SEQ ID NO: 25449 - DNA, 933 bp, Artificial Sequence; identical to SEQ ID NO: 25442
  Description of Artificial Sequence: Synthetic coding sequence

SEQ ID NO: 25450 - DNA, 933 bp, Artificial Sequence; identical to SEQ ID NO: 25442
  Description of Artificial Sequence: Synthetic coding sequence

SEQ ID NO: 25451 - DNA, 933 bp, Artificial Sequence; identical to SEQ ID NO: 25442
  Description of Artificial Sequence: Synthetic coding sequence

SEQ ID NO: 25452 - DNA, 933 bp, Artificial Sequence; identical to SEQ ID NO: 25442
  Description of Artificial Sequence: Synthetic coding sequence

SEQ ID NO: 25453 - DNA, 933 bp, Artificial Sequence; identical to SEQ ID NO: 25442
  Description of Artificial Sequence: Synthetic coding sequence

SEQ ID NO: 25454 - DNA, 2199 bp, Artificial Sequence
  Description of Artificial Sequence: Synthetic coding sequence
atggaccccagcgccgacacctgggacctgttcagccccctgatcagcctgtggatcaacagattctacatctacctgggcttcgccgtgagcatcagcctgtggatctgcgtgcagatcgtgatcaagacccagggcaagaacctgcaggagaagagcgtgcccaaggccgcccaggacctgatgaccaacggctacgtgagcctgcaggagaaggacatcttcgtgagcggcgtgaagatcttctacggcagccagaccggcaccgccaagggcttcgccaccgtgctggccgaggccgtgaccagcctggacctgcccgtggccatcatcaacctgaaggagtacgaccccgacgaccacctgatcgaggaggtgaccagcaagaacgtgtgcgtgttcctggtggccacctacaccgacggcctgcccaccgagagcgccgagtggttctgcaagtggctggaggaggccagcatcgacttcagattcggcaagacctacctgaagggcatgagatacgccgtgttcggcctgggcaacagcgcctacgccagccacttcaacaaggtgggcaagaacgtggacaagtggctgtggatgctgggcgcccacagagtgatgagcagaggcgagggcgactgcgacgtggtgaagagcaagcacggcagcatcgaggccgacttcagagcctggaagaccaagttcatcagccagctgcaggccctgcagaagggcgagagaaagaagagctgcggcggccactgcaagaagggcaagtgcgagagccaccagcacggcagcgaggagagagaggagggcagccacgagcaggacgagctgcaccacagagacaccgaggaggaggagcccttcgagagcagcagcgaggaggagttcggcggcgaggaccaccagagcctgaacagcatcgtggacgtggaggacctgggcaagatcatggaccacgtgaagaaggagaagagagagaaggagcagcaggaggagaagagcggcctgttcagaaacatgggcagaaacgaggacggcgagagaagagccatgatcacccccgccctgagagaggccctgaccaagcagggctaccagctgatcggcagccacagcggcgtgaagctgtgcagatggaccaagagcatgctgagaggcagaggcggctgctacaagcacaccttctacggcatcgagagccacagatgcatggagaccacccccagcctggcctgcgccaacaagtgcgtgttctgctggagacaccacaccaaccccgtgggcaccgagtggagatggaagatggaccagcccgagatgatcctgaaggaggccatcgagaaccaccagaacatgatcaagcagttcaagggcgtgcccggcgtgaaggccgagagattcgaggagggcatgaccgtgaagcactgcgccctgagcctggtgggcgagcccatcatgtaccccgagatcaacagattcctgaagctgctgcaccagtgcaagatcagcagcttcctggtgaccaacgcccagttccccgccgagatcagaaacctggagcccgtgacccagctgtacgtgagcgtggacgccagcaccaaggacagcctgaagaagatcgacagacccctgttcaaggacttctggcagagattcctggacagcctgaaggccctggccgtgaagcagcagagaaccgtgtacagactgaccctggtgaaggcctggaacgtggacgagctgcaggcctacgcccagctggtgagcctgggcaaccccgacttcatcgaggtgaagggcgtgacctactgcggcgagagcagcgccagcagcctgaccatggcccacgtgccctggcacgaggaggtggtgcagttcgtgcacgagctggtggacctgatccccgagtacgagatcgcctgcgagcacgagcacagcaactgcctgctgatcgcccacagaaagttcaagatcggcggcgagtggtggacctggatcgactacaacagattccaggagctgatccaggagtacgaggacagcggcggcagcaagaccttcagcgccaaggactacatggccagaaccccccactgggccctgttcggcgccagcgagagaggcttcgaccccaaggacaccagacaccagagaaagaacaagagcaaggccatcagcggctgctag

SEQ ID NO: 25455 - DNA, 1017 bp, Artificial Sequence
  Description of Artificial Sequence: Synthetic coding sequence
atggaccccagcgccgacacctgggacctgttcagccccctgatcagcctgtggatcaacagattctacatctacctgggcttcgccgtgagcatcagcctgtggatctgcgtgcagatcgtgatcaagacccagggcttcgccaccgtgctggccgaggccgtgaccagcctggacctgcccgtggccatcatcaacctgaaggagtacgaccccgacgaccacctgatcgaggaggtgaccagcaagaacgtgtgcgtgttcctggtggccacctacaccgacggcctgcccaccgagagcgccgagtggttctgcaagtggctggaggaggccagcatcgacttcagattcggcaagacctacctgaagggcatgagatacgccgtgttcggcctgggcaacagcgcctacgccagccacttcaacaaggtgggcaagaacgtggacaagtggctgtggatgctgggcgcccacagagtgatgagcagaggcgagggcgactgcgacgtggtgaagagcaagcacggcagcatcgaggccgacttcagagcctggaagaccaagttcatcagccagctgcaggccctgcagaagggcgagagaaagaagagctgcggcggccactgcaagaagggcaagtgcgagagccaccagcacggcagcgaggagagagaggagggcagccacgagcaggacgagctgcaccacagagacaccgaggaggaggagcccttcgagagcagcagcgaggaggagttcggcggcgaggaccaccagagcctgaacagcatcgtggacgtggaggacctgggcaagatcatggaccacgtgaagaaggagaagagagagaaggagcagcaggaggagaagagcggcctgttcagaaacatgggcagaaacgaggacggcgagagaagagccatgatcacccccgccctgagagaggccctgaccaagcaggtgcacgcccccagagagagaagactgctgcagacccacatcctgtggaactag

SEQ ID NO: 25456 - DNA, 531 bp, Artificial Sequence
  Description of Artificial Sequence: Synthetic coding sequence
atggaccccagcgccgacacctgggacctgttcagccccctgatcagcctgtggatcaacagattctacatctacctgggcttcgccgtgagcatcagcctgtggatctgcgtgcagatcgtgatcaagacccagggcttcgccaccgtgctggccgaggccgtgaccagcctggacctgcccgtggccatcatcaacctgaaggagtacgaccccgacgaccacctgatcgaggaggaggaggagcccttcgagagcagcagcgaggaggagttcggcggcgaggaccaccagagcctgaacagcatcgtggacgtggaggacctgggcaagatcatggaccacgtgaagaaggagaagagagagaaggagcagcaggaggagaagagcggcctgttcagaaacatgggcagaaacgaggacggcgagagaagagccatgatcacccccgccctgagagaggccctgaccaagcaggtgcacgcccccagagagagaagactgctgcagacccacatcctgtggaactag

SEQ ID NO: 25457 - DNA, 780 bp, Artificial Sequence
  Description of Artificial Sequence: Synthetic coding sequence
atggacagaagcgccgagttcagaaagtggaaggcccagtgcctgagcaaggccgacctgagcagaaagggcagcgtggacgaggacgtggtggagctggtgcagttcctgaacatgagagaccagttcttcaccaccagcagctgcgccggcagaatcctgctgctggacagaggcatcaacggcttcgaggtgcagaagcagaactgctgctggctgctggtgacccacaagctgtgcgtgaaggacgacgtgatcgtggccctgaagaaggccaacggcgacgccaccctgaagttcgagcccttcgtgctgcacgtgcagtgcagacagctgcaggacgcccagatcctgcacagcatggccatcgacagcggcttcagaaacagcggcatcaccgtgggcaagagaggcaagaccatgctggccgtgagaagcacccacggcctggaggtgcccctgagccacaagggcaagctgatggtgaccgaggagtacatcgacttcctgctgaacgtggccaaccagaagatggaggagaacaagaagagaatcgagagattctacaactgcctgcagcacgccctggagagagagaccatgaccaacctgcaccccaagatcaaggagaagaacaacagcagctacatccacaagaagaagagaaaccccgagaagaccagagcccagtgcatcaccaaggagagcgacgaggagctggagaacgacgacgacgacgacctgggcatcaacgtgaccatcttccccgaggactactag

SEQ ID NO: 25458 - DNA, 528 bp, Artificial Sequence
  Description of Artificial Sequence: Synthetic coding sequence
atggacagaagcgccgagttcagaaagtggaaggcccagtgcctgagcaaggccgacctgagcagaaagggcagcgtggacgaggacgtggtggagctggtgcagttcctgaacatgagagaccagttcttcaccaccagcagctgcgccggcagaatcctgctgctggacagagccgtgagaagcacccacggcctggaggtgcccctgagccacaagggcaagctgatggtgaccgaggagtacatcgacttcctgctgaacgtggccaaccagaagatggaggagaacaagaagagaatcgagagattctacaactgcctgcagcacgccctggagagagagaccatgaccaacctgcaccccaagatcaaggagaagaacaacagcagctacatccacaagaagaagagaaaccccgagaagaccagagcccagtgcatcaccaaggagagcgacgaggagctggagaacgacgacgacgacgacctgggcatcaacgtgaccatcttccccgaggactactag

SEQ ID NO: 25459 - DNA, 681 bp, Artificial Sequence
  Description of Artificial Sequence: Synthetic coding sequence
atggacagaagcgccgagttcagaaagtggaaggcccagtgcctgagcaaggccgacctgagcagaaagggcagcgtggacgaggacgtggtggagctggtgcagttcctgaacatgagagaccagttcttcaccaccagcagctgcgccggcagaatcctgctgctggacagaggcatcaacggcttcgaggtgcagaagcagaactgctgctggctgctggtgacccacaagctgtgcgtgaaggacgacgtgcacagcatggccatcgacagcggcttcagaaacagcggcatcaccgtgggcaagagaggcaagaccatgctggccgtgagaagcacccacggcctggaggtgcccctgagccacaagggcaagctgatggtgaccgaggagtacatcgacttcctgctgaacgtggccaaccagaagatggaggagaacaagaagagaatcgagagattctacaactgcctgcagcacgccctggagagagagaccatgaccaacctgcaccccaagatcaaggagaagaacaacagcagctacatccacaagaagaagagaaaccccgagaagaccagagcccagtgcatcaccaaggagagcgacgaggagctggagaacgacgacgacgacgacctgggcatcaacgtgaccatcttccccgaggactactag

SEQ ID NO: 25460 - DNA, 948 bp, Artificial Sequence
  Description of Artificial Sequence: Synthetic coding sequence
atggccggccagcacctgcccgtgcccagactggagggcgtgagcagagagcagttcatgcagcacctgtacccccagagaaagcccctggtgctggagggcatcgacctgggcccctgcaccagcaagtggaccgtggactacctgagccaggtgggcggcaagaaggaggtgaagatccacgtggccgccgtggcccagatggacttcatcagcaagaacttcgtgtacagaaccctgcccttcgaccagctggtgcagagagccgccgaggagaagcacaaggagttcttcgtgagcgaggacgagaagtactacctgagaagcctgggcgaggaccccagaaaggacgtggccgacatcagaaagcagttccccctgctgaagggcgacatcaagttccccgagttcttcaaggaggagcagttcttcagcagcgtgttcagaatcagcagccccggcctgcagctgtggacccactacgacgtgatggacaacctgctgatccaggtgaccggcaagaagagagtggtgctgttcagccccagagacgcccagtacctgtacctgaagggcaccaagagcgaggtgctgaacatcgacaaccccgacctggccaagtaccccctgttcagcaaggccagaagatacgagtgcagcctggaggccggcgacgtgctgttcatccccgccctgtggttccacaacgtgatcagcgaggagttcggcgtgggcgtgaacatcttctggaagcacctgcccagcgagtgctacgacaagaccgacacctacggcaacaaggaccccaccgccgccagcagagccgcccagatcctggacagagccctgaagaccctggccgagctgcccgaggagtacagagacttctacgccagaagaatggtgctgcacatccaggacaaggcctacagcaagaacagcgagtag

SEQ ID NO: 25461 - DNA, 825 bp, Artificial Sequence
  Description of Artificial Sequence: Synthetic coding sequence
atgctgaacctgctgctgctggccctgcccgtgctggccagcagagcctacgccgcccccgcccccggccaggccctgcagagagtgggcatcgtgggcggccaggaggcccccagaagcaagtggccctggcaggtgagcctgagagtgagagacagatactggatgcacttctgcggcggcagcctgatccacccccagtgggtgctgaccgccgcccactgcgtgggccccgacgtgaaggacctggccgccctgagagtgcagctgagagagcagcacctgtactaccaggaccagctgctgcccgtgagcagaatcatcgtgcacccccagttctacaccgcccagatcggcgccgacatcgccctgctggagctggaggagcccgtgaacgtgagcagccacgtgcacaccgtgaccctgccccccgccagcgagaccttcccccccatgccctgctgggtgaccggctggggcgacgtggacaacgacgagagactgcccccccccttccccctgaagcaggtgaaggtgcccatcatggagaaccacatctgcgacgccaagtaccacctgggcgcctacaccggcgacgacgtgagaatcgtgagagacgacatgctgtgcgccggcaacaccagaagagacagctgccagggcgacagcggcggccccctggtgtgcaaggtgaacggcacctggctgcaggccggcgtggtgagctggggcgagggctgcgcccagcccaacagacccggcatctacaccagagtgacctactacctggactggatccaccactacgtgcccaagaagccctag

SEQ ID NO: 25462 - DNA, 2271 bp, Artificial Sequence
  Description of Artificial Sequence: Synthetic coding sequence
atgagcaagatgcccgccaagaagaagagctgcttccagatcaccagcgtgaccaccgcccaggtggccaccagcatcaccgaggacaccgagagcctggacgaccccgacgagagcagaaccgaggacgtgagcagcgagatcttcgacgtgagcagagccaccgactacggccccgaggaggtgtgcgagagaagcagcagcgaggagaccctgaacaacgtgggcgacgccgagacccccggcaccgtgagccccaacctgctgctggacggccagctggccgccgccgccgccgcccccgccaacggcggcggcgtggtgagcgccagaagcgtgagcggcgccctggccagcaccctggccgccgccgccaccagcgcccccgcccccggcgcccccggcggcccccagctggccggcagcagcgccggccccgtgaccgccgcccccagccagccccccaccacctgcagcagcagattcagagtgatcaagctggaccacggcagcggcgagccctacagaagaggcagatggacctgcatggagtactacgagagagacagcgacagcagcgtgctgaccagaagcggcgactgcatcagacacagcagcaccttcgaccagaccgccgagagagacagcggcctgggcgccaccggcggcagcgtggtggtggtggtggccagcatgcagggcgcccacggccccgagagcggcaccgacagcagcctgaccgccgtgagccagctgccccccagcgagaagatgagccagcccacccccgcccagccccagagcttcagcgtgggccagccccagcccccccccccccccgtgggcggcgccgtggcccagagcagcgcccccctgccccccttccccggcgccgccaccggcccccagcccatgatggccgccgcccagcccagccagccccagggcgccggccccggcggccagaccctgccccccaccaacgtgaccctggcccagcccgccatgagcctgcccccccagcccggccccgccgtgggcgcccccgccgcccagcagccccagcagttcgcctacccccagccccagatcccccccggccacctgctgcccgtgcagcccagcggccagagcgagtacctgcagcagcacgtggccggcctgcagccccccagccccgcccagcccagcagcaccggcgccgccgccagccccgccaccgccgccaccctgcccgtgggcaccggccagaacgccagcagcgtgggcgcccagctgatgggcgccagcagccagcccagcgaggccatggcccccagaaccggccccgcccagggcggccaggtggccccctgccagcccaccggcgtgccccccgccaccgtgggcggcgtggtgcagccctgcctgggccccgccggcgccggccagccccagagcgtgccccccccccagatgggcggcagcggccccctgagcgccgtgcccggcggcccccacgccgtggtgcccggcgtgcccaacgtgcccgccgccgtgcccgcccccagcgtgcccagcgtgagcaccaccagcgtgaccatgcccaacgtgcccgcccccctggcccagagccagcagctgagcagccacacccccgtgagcagaagcagcagcatcatccagcacgtgggcctgcccctggcccccggcacccacagcgcccccaccagcctgccccagagcgacctgagccagttccagacccagacccagcccctggtgggccaggtggacgacaccagaagaaagagcgagcccctgccccagccccccctgagcctgatcgccgagaacaagcccgtggtgaagccccccgtggccgacagcctggccaaccccctgcagctgacccccatgaacagcctggccaccagcgtgttcagcatcgccatccccgtggacggcgacgaggacagcgccagcggcggcggcgtggtggccatcgacaacaagatcgagcaggccatggacctggtgaagagccacctgatgtacgccgtgagagaggaggtggaggtgctgaaggagcagatcaaggagctggtggagagaaacagcctgctggagagagagaacgccctgctgaagagcctgagcagcaacgaccagctgagccagctgcccacccagcaggccaaccccggcagcaccagccagcagcaggccgtgatcgcccagcccccccagcccacccagcccccccagcagcccaacgtgagcagcgcctag

SEQ ID NO: 25463 - DNA, 2343 bp, Artificial Sequence
  Description of Artificial Sequence: Synthetic coding sequence
atgagcaagatgcccgccaagaagaagagctgcttccagatcaccagcgtgaccaccgcccaggtggccaccagcatcaccgaggacaccgagagcctggacgaccccgacgagagcagaaccgaggacgtgagcagcgagatcttcgacgtgagcagagccaccgactacggccccgaggaggtgtgcgagagaagcagcagcgaggagaccctgaacaacgtgggcgacgccgagacccccggcaccgtgagccccaacctgctgctggacggccagctggccgccgccgccgccgcccccgccaacggcggcggcgtggtgagcgccagaagcgtgagcggcgccctggccagcaccctggccgccgccgccaccagcgcccccgcccccggcgcccccggcggcccccagctggccggcagcagcgccggccccgtgaccgccgcccccagccagccccccaccacctgcagcagcagattcagagtgatcaagctggaccacggcagcggcgagccctacagaagaggcagatggacctgcatggagtactacgagagagacagcgacagcagcgtgctgaccagaagcggcgactgcatcagacacagcagcaccttcgaccagaccgccgagagagacagcggcctgggcgccaccggcggcagcgtggtggtggtggtggccagcatgcagggcgcccacggccccgagagcggcaccgacagcagcctgaccgccgtgagccagctgccccccagcgagaagatgagccagcccacccccgcccagccccagagcttcagcgtgggccagccccagcccccccccccccccgtgggcggcgccgtggcccagagcagcgcccccctgccccccttccccggcgccgccaccggcccccagcccatgatggccgccgcccagcccagccagccccagggcgccggccccggcggccagaccctgccccccaccaacgtgaccctggcccagcccgccatgagcctgcccccccagcccggccccgccgtgggcgcccccgccgcccagcagccccagcagttcgcctacccccagccccagatcccccccggccacctgctgcccgtgcagcccagcggccagagcgagtacctgcagcagcacgtggccggcctgcagccccccagccccgcccagcccagcagcaccggcgccgccgccagccccgccaccgccgccaccctgcccgtgggcaccggccagaacgccagcagcgtgggcgcccagctgatgggcgccagcagccagcccagcgaggccatggcccccagaaccggccccgcccagggcggccaggtggccccctgccagcccaccggcgtgccccccgccaccgtgggcggcgtggtgcagccctgcctgggccccgccggcgccggccagccccagagcgtgccccccccccagatgggcggcagcggccccctgagcgccgtgcccggcggcccccacgccgtggtgcccggcgtgcccaacgtgcccgccgccgtgcccgcccccagcgtgcccagcgtgagcaccaccagcgtgaccatgcccaacgtgcccgcccccctggcccagagccagcagctgagcagccacacccccgtgagcagaagcagcagcatcatccagcacgtgggcctgcccctggcccccggcacccacagcgcccccaccagcctgccccagagcgacctgagccagttccagacccagacccagcccctggtgggccaggtggacgacaccagaagaaagagcgagcccctgccccagccccccctgagcctgatcgccgagaacaagcccgtggtgaagccccccgtggccgacagcctggccaaccccctgcagctgacccccatgaacagcctggccaccagcgtgttcagcatcgccatccccgtggacggcgacgaggacagaaaccccagcaccgccttctaccaggccttccacctgaacaccctgaaggagagcaagagcctgtgggacagcgccagcggcggcggcgtggtggccatcgacaacaagatcgagcaggccatggacctggtgaagagccacctgatgtacgccgtgagagaggaggtggaggtgctgaaggagcagatcaaggagctggtggagagaaacagcctgctggagagagagaacgccctgctgaagagcctgagcagcaacgaccagctgagccagctgcccacccagcaggccaaccccggcagcaccagccagcagcaggccgtgatcgcccagcccccccagcccacccagcccccccagcagcccaacgtgagcagcgcctag

SEQ ID NO: 25464 - DNA, 690 bp, Artificial Sequence
  Description of Artificial Sequence: Synthetic coding sequence
atgcccaacgtgcccgcccccctggcccagagccagcagctgagcagccacacccccgtgagcagaagcagcagcatcatccagcacgtgggcctgcccctggcccccggcacccacagcgcccccaccagcctgccccagagcgacctgagccagttccagacccagacccagcccctggtgggccaggtggacgacaccagaagaaagagcgagcccctgccccagccccccctgagcctgatcgccgagaacaagcccgtggtgaagccccccgtggccgacagcctggccaaccccctgcagctgacccccatgaacagcctggccaccagcgtgttcagcatcgccatccccgtggacggcgacgaggacagcgccagcggcggcggcgtggtggccatcgacaacaagatcgagcaggccatggacctggtgaagagccacctgatgtacgccgtgagagaggaggtggaggtgctgaaggagcagatcaaggagctggtggagagaaacagcctgctggagagagagaacgccctgctgaagagcctgagcagcaacgaccagctgagccagctgcccacccagcaggccaaccccggcagcaccagccagcagcaggccgtgatcgcccagcccccccagcccacccagcccccccagcagcccaacgtgagcagcgcctag

SEQ ID NO: 25465 - DNA, 576 bp, Artificial Sequence
  Description of Artificial Sequence: Synthetic coding sequence
atggccggcgccgccgaggacgccagagccctgttcagagccggcgtgtgcgccgccctggaggcctggcccgccctgcagatcgccgtggagaacggcttcggcggcgtgcacagccaggagaaggccaagtggctgggcggcgccgtggaggactacttcatgagaaacgccgacctggagctggacgaggtggaggacttcctgggcgagctgctgaccaacgagttcgacaccgtggtggaggacggcagcctgccccaggtgagccagcagctgcagaccatgttccaccacttccagagaggcgacggcgccgccctgagagagatggccagctgcatcacccagagaaagtgcaaggtgaccgccaccgccctgaagaccgccagagagaccgacgaggacgaggacgacgtggacagcgtggaggagatggaggtgaccgccaccaacgacggcgccgccaccgacggcgtgtgcccccagcccgagcccagcgaccccgacgcccagaccatcaaggaggaggacatcgtggaggacggctggaccatcgtgagaagaaagaagtag

SEQ ID NO: 25466 - DNA, 801 bp, Artificial Sequence
  Description of Artificial Sequence: Synthetic coding sequence
atgatgaagaccctgagcagcggcaactgcaccctgagcgtgcccgccaagaacagctacagaatggtggtgctgggcgccagcagagtgggcaagagcagcatcgtgagcagattcctgaacggcagattcgaggaccagtacacccccaccatcgaggacttccacagaaaggtgtacaacatcagaggcgacatgtaccagctggacatcctggacaccagcggcaaccaccccttccccgccatgagaagactgagcatcctgaccggcgacgtgttcatcctggtgttcagcctggacaacagagagagcttcgacgaggtgaagagactgcagaagcagatcctggaggtgaagagctgcctgaagaacaagaccaaggaggccgccgagctgcccatggtgatctgcggcaacaagaacgaccacggcgagctgtgcagacaggtgcccaccaccgaggccgagctgctggtgagcggcgacgagaactgcgcctacttcgaggtgagcgccaagaagaacaccaacgtggacgagatgttctacgtgctgttcagcatggccaagctgccccacgagatgagccccgccctgcacagaaagatcagcgtgcagtacggcgacgccttccaccccagacccttctgcatgagaagagtgaaggagatggacgcctacggcatggtgagccccttcgccagaagacccagcgtgaacagcgacctgaagtacatcaaggccaaggtgctgagagagggccaggccagagagagagacaagtgcaccatccagtag

SEQ ID NO: 25467 - DNA, 636 bp, Artificial Sequence
  Description of Artificial Sequence: Synthetic coding sequence
atggaggccgagagaggccccgagagaagacccgccgagagaagcagccccggccagacccccgaggagggcgcccaggccctggccgagttcgccgccctgcacggccccgccctgagagccagcggcgtgcccgagagatactggggcagactgctgcacaagctggagcacgaggtgttcgacgccggcgaggtgttcggcatcatgcaggtggaggaggtggaggaggaggaggacgaggccgccagagaggtgagaaagcagcagcccaaccccggcaacgagctgtgctacaaggtgatcgtgaccagagagagcggcctgcaggccgcccaccccaacagcatcttcctgatcgaccacgcctggacctgcagagtggagcacgccagacagcagctgcagcaggtgcccggcctgctgcacagaatggccaacctgatgggcatcgagttccacggcgagctgcccagcaccgaggccgtggccctggtgctggaggagatgtggaagttcaaccagacctacagacacgtgtgcagaagaccccacgccgaggtgggccagagacccagatggaaggccggcgacgccgccgccgaccccggcggcgagctgcagcccagactgtag

SEQ ID NO: 25468 - DNA, 1380 bp, Artificial Sequence
  Description of Artificial Sequence: Synthetic coding sequence
atggagcccagcacctgcagaaccatggagagcgaggaggactacgtggaggagaaggagagcgagaagtgcgtgaaggagggcgtgaccaaccccagcaacagcagccagcaggccctgctgaaggccgactacaaggccctgaagaacggcgtgcccagccccatcatggccaccaagatccccaagaaggtgatcgcccccgtggacaccggcgacctggaggccggcagaagaaagagaagaagaaagagaagaagcctggccatcaacctgaccaactgcaagtacgagagcgtgagaagagccgcccagatgtgcggcctgaaggaggtgggcgaggacgaggagtggaccctgtactggaccgactgcgccgtgagcctggagagagtgatggacatgaagagattccagaagatcaaccacttccccggcatgaccgagatctgcagaaaggacctgctggccagaaacctgaacagaatgtacaagctgtaccccagcgagtacaacatcttccccagaacctggtgcctgcccgccgactacggcgacttccagagctacggcagacagagaaaggccagaacctacatctgcaagcccgacagcggctgccagggcagaggcatcttcatcaccagaaaccccagagagatcaagcccggcgagcacatgatctgccagcagtacatcagcaagcccctgctgatcgacggcttcaagttcgacatgagagtgtacgtgctgatcaccagctgcgaccccctgagaatcttcacctacgaggagggcctggccagattcgccaccaccccctacatggagcccagccacaacaacctggacaacgtgtgcatgcacctgaccaactacgccatcaacaagcacaacgagaacttcgtgagagacggcgccgtgggcagcaagagaaagctgagcaccctgaacatctggctgcaggagcacagctacaaccccggcgagctgtggggcgacatcgaggacatcatcatcaagaccatcatcagcgcccacagcgtgctgagacacaactacagaacctgcttcccccagtacctgaacggcggcacctgcgcctgcttcgagatcctgggcttcgacatcctgctggaccacaagctgaagccctggctgctggaggtgaaccacagccccagcttcaccaccgacagctgcctggaccaggaggtgaaggacgccctgctgtgcgacgccatgaccctggtgaacctgagaggctgcgacaagagaaaggtgatggaggaggacaagagaagagtgaaggagagactgttccagtgctacagacagcccagagagagcagatgcgccagatgcctggcctgcgtgtag

SEQ ID NO: 25469 - DNA, 2448 bp, Artificial Sequence
  Description of Artificial Sequence: Synthetic coding sequence
atggagcccagcacctgcagaaccatggagagcgaggaggactacgtggaggagaaggagagcgagaagtgcgtgaaggagggcgtgaccaaccccagcaacagcagccagcaggccctgctgaaggccgactacaaggccctgaagaacggcgtgcccagccccatcatggccaccaagatccccaagaaggtgatcgcccccgtggacaccggcgacctggaggccggcagaagaaagagaagaagaaagagaagaagcctggccatcaacctgaccaactgcaagtacgagagcgtgagaagagccgcccagatgtgcggcctgaaggaggtgggcgaggacgaggagtggaccctgtactggaccgactgcgccgtgagcctggagagagtgatggacatgaagagattccagaagatcaaccacttccccggcatgaccgagatctgcagaaaggacctgctggccagaaacctgaacagaatgtacaagctgtaccccagcgagtacaacatcttccccagaacctggtgcctgcccgccgactacggcgacttccagagctacggcagacagagaaaggccagaacctacatctgcaagcccgacagcggctgccagggcagaggcatcttcatcaccagaaaccccagagagatcaagcccggcgagcacatgatctgccagcagtacatcagcaagcccctgctgatcgacggcttcaagttcgacatgagagtgtacgtgctgatcaccagctgcgaccccctgagaatcttcacctacgaggagggcctggccagattcgccaccaccccctacatggagcccagccacaacaacctggacaacgtgtgcatgcacctgaccaactacgccatcaacaagcacaacgagaacttcgtgagagacggcgccgtgggcagcaagagaaagctgagcaccctgaacatctggctgcaggagcacagctacaaccccggcgagctgtggggcgacatcgaggacatcatcatcaagaccatcatcagcgcccacagcgtgctgagacacaactacagaacctgcttcccccagtacctgaacggcggcacctgcgcctgcttcgagatcctgggcttcgacatcctgctggaccacaagctgaagccctggctgctggaggtgaaccacagccccagcttcaccaccgacagctgcctggaccaggaggtgaaggacgccctgctgtgcgacgccatgaccctggtgaacctgagaggctgcgacaagagaaaggtgatggaggaggacaagagaagagtgaaggagagactgttccagtgctacagacagcccagagagagcagaaaggagaagaccgagagcagccacgtggccatgctggaccaggagagatacgaggacagccacctgggcaagtacagaagaatctaccccggccccgacaccgagaagtacgccagattcttcaagcacaacggcagcctgttccaggagaccgccgccagcaaggccagagaggagtgcgccagacagcagctggaggagatcagactgaagcaggagcagcaggagaccagcggcaccaagagacagaaggccagagaccagaaccagggcgagagcgccggcgagaagagcagacccagagccggcctgcagagcctgagcacccacctggcctacagaaacagaaactgggagaaggagctgctgcccggccagctggacaccatgagaccccaggagatcgtggaggaggaggagctggagagaatgaaggccctgctgcagagagagaccctgatcagaagcctgggcatcgtggagcagctgaccagactgcagcaccccggcccccagggccagaagaagctgcacgagagcagagacagactgggcagccaggagctgaagagcatgagcctggtgctgctggtgctgctgagaggcgccgccaccgagcagggcgccccccacttcctgcaccccgtgctgccccacgagagcatccccagaatcctgggcgccctgcccagcatgaacgccgccatcccccacgtgcccagataccacctgcagcccaagaacttcaactggaccggcgagcccgccgccatcaacagctgcagcctgagcatgaagaaggccggcagatgctacttcagcagcgccagaatcagactgaccagccagggccaggccagcagaagactggaggccatcaacagagtgctggccggcagcgtgccccccaccctgacccccaagcagggctacttcctgcagcccgagagagtggccagcgacagctggaccgagtgcaccctgcccagcatggtgaacagcgagcacagagccgccaaggtgcccctgtgccccgccagcgcccccatgctgcagagaagcagagccctgctgaacatcaaccagttcagatag

SEQ ID NO: 25470 - DNA, 1779 bp, Artificial Sequence
  Description of Artificial Sequence: Synthetic coding sequence
atgagaggcagagacctgtgcagcagcacccagagccaggccctgggcagcctgagaaccaccacccccgccttcaccctgaacatccccagcgaggccaaccacaccgagcagccccccgccggcctgggcgccagactgcaggaggccggcgtgagcatcccccccagaagaggcagacccacccccaccctggagaagaagaagaagccccacctgatggccgaggacgagcccagcggcgccctgctgaagcccctggtgttcagagtggacgagaccacccccgccgtggtgcagagcgtgctgctggagagaggctggaacaagttcgacaagcaggagcagaacgccgaggactggaacctgtactggagaaccagcagcttcagaatgaccgagcacaacagcgtgaagccctggcagcagctgaaccaccaccccggcaccaccaagctgaccagaaaggactgcctggccaagcacctgaagcacatgagaagaatgtacggcaccagcctgtaccagttcatccccctgaccttcgtgatgcccaacgactacaccaagttcgtggccgagtacttccaggagagacagatgctgggcaccaagcacagctactggatctgcaagcccgccgagctgagcagaggcagaggcatcctgatcttcagcgacttcaaggacttcatcttcgacgacatgtacatcgtgcagaagtacatcagcaaccccctgctgatcggcagatacaagtgcgacctgagaatctacgtgtgcgtgaccggcttcaagcccctgaccatctacgtgtaccaggagggcctggtgagattcgccaccgagaagttcgacctgagcaacctgcagaacaactacgcccacctgaccaacagcagcatcaacaagagcggcgccagctacgagaagatcaaggaggtgatcggccacggctgcaagtggaccctgagcagattcttcagctacctgagaagctgggacgtggacgacctgctgctgtggaagaagatccacagaatggtgatcctgaccatcctggccatcgcccccagcgtgcccttcgccgccaactgcttcgagctgttcggcttcgacatcctgatcgacgacaacctgaagccctggctgctggaggtgaactacagccccgccctgaccctggactgcagcaccgacgtgctggtgaagagaaagctggtgcacgacatcatcgacctgatctacctgaacggcctgagaaacgagggcagagaggccagcaacgccacccacggcaacagcaacatcgacgccgccaagagcgacagaggcggcctggacgcccccgactgcctgccctacgacagcctgagcttcaccagcagaatgtacaacgaggacgacagcgtggtggagaaggccgtgagcgtgagacccgaggccgcccccgccagccagctggagggcgagatgagcggccaggacttccacctgagcaccagagagatgccccagagcaagcccaagctgagaagcagacacaccccccacaagaccctgatgccctacgccagcctgttccagagccacagctgcaagaccaagaccagcccctgcgtgctgagcgacagaggcaaggcccccgacccccaggccggcaacttcgtgctggtgttccccttcaacgaggccaccctgggcgccagcagaaacggcctgaacgtgaagagaatcatccaggagctgcagaagctgatgaacaagcagcacagctag

SEQ ID NO: 25471 - DNA, 1560 bp, Artificial Sequence
  Description of Artificial Sequence: Synthetic coding sequence
atggccgaggacgagcccagcggcgccctgctgaagcccctggtgttcagagtggacgagaccacccccgccgtggtgcagagcgtgctgctggagagaggctggaacaagttcgacaagcaggagcagaacgccgaggactggaacctgtactggagaaccagcagcttcagaatgaccgagcacaacagcgtgaagccctggcagcagctgaaccaccaccccggcaccaccaagctgaccagaaaggactgcctggccaagcacctgaagcacatgagaagaatgtacggcaccagcctgtaccagttcatccccctgaccttcgtgatgcccaacgactacaccaagttcgtggccgagtacttccaggagagacagatgctgggcaccaagcacagctactggatctgcaagcccgccgagctgagcagaggcagaggcatcctgatcttcagcgacttcaaggacttcatcttcgacgacatgtacatcgtgcagaagtacatcagcaaccccctgctgatcggcagatacaagtgcgacctgagaatctacgtgtgcgtgaccggcttcaagcccctgaccatctacgtgtaccaggagggcctggtgagattcgccaccgagaagttcgacctgagcaacctgcagaacaactacgcccacctgaccaacagcagcatcaacaagagcggcgccagctacgagaagatcaaggaggtgatcggccacggctgcaagtggaccctgagcagattcttcagctacctgagaagctgggacgtggacgacctgctgctgtggaagaagatccacagaatggtgatcctgaccatcctggccatcgcccccagcgtgcccttcgccgccaactgcttcgagctgttcggcttcgacatcctgatcgacgacaacctgaagccctggctgctggaggtgaactacagccccgccctgaccctggactgcagcaccgacgtgctggtgaagagaaagctggtgcacgacatcatcgacctgatctacctgaacggcctgagaaacgagggcagagaggccagcaacgccacccacggcaacagcaacatcgacgccgccaagagcgacagaggcggcctggacgcccccgactgcctgccctacgacagcctgagcttcaccagcagaatgtacaacgaggacgacagcgtggtggagaaggccgtgagcgtgagacccgaggccgcccccgccagccagctggagggcgagatgagcggccaggacttccacctgagcaccagagagatgccccagagcaagcccaagctgagaagcagacacaccccccacaagaccctgatgccctacgccagcctgttccagagccacagctgcaagaccaagaccagcccctgcgtgctgagcgacagaggcaaggcccccgacccccaggccggcaacttcgtgctggtgttccccttcaacgaggccaccctgggcgccagcagaaacggcctgaacgtgaagagaatcatccaggagctgcagaagctgatgaacaagcagcacagctag

SEQ ID NO: 25472 - DNA, 2013 bp, Artificial Sequence
  Description of Artificial Sequence: Synthetic coding sequence
atgcccagcctgccccaggagggcgtgatccagggccccagccccctggacctgaacaccgagctgccctaccagagcaccatgaagagaaaggtgagaaagaagaagaagaagggcaccatcaccgccaacgtggccggcaccaagttcgagatcgtgagactggtgatcgacgagatgggcttcatgaagacccccgacgaggacgagaccagcaacctgatctggtgcgacagcgccgtgcagcaggagaagatcagcgagctgcagaactaccagagaatcaaccacttccccggcatgggcgagatctgcagaaaggacttcctggccagaaacatgaccaagatgatcaagagcagacccctggactacaccttcgtgcccagaacctggatcttccccgccgagtacacccagttccagaactacgtgaaggagctgaagaagaagagaaagcagaagaccttcatcgtgaagcccgccaacggcgccatgggccacggcatcagcctgatcagaaacggcgacaagctgcccagccaggaccacctgatcgtgcaggagtacatcgagaagcccttcctgatggagggctacaagttcgacctgagaatctacatcctggtgaccagctgcgaccccctgaagatcttcctgtaccacgacggcctggtgagaatgggcaccgagaagtacatcccccccaacgagagcaacctgacccagctgtacatgcacctgaccaactacagcgtgaacaagcacaacgagcacttcgagagagacgagaccgagaacaagggcagcaagagaagcatcaagtggttcaccgagttcctgcaggccaaccagcacgacgtggccaagttctggagcgacatcagcgagctggtggtgaagaccctgatcgtggccgagccccacgtgctgcacgcctacagaatgtgcagacccggccagccccccggcagcgagagcgtgtgcttcgaggtgctgggcttcgacatcctgctggacagaaagctgaagccctggctgctggagatcaacagagcccccagcttcggcaccgaccagaagatcgactacgacgtgaagagaggcgtgctgctgaacgccctgaagctgctgaacatcagaaccagcgacaagagaagaaacctggccaagcagaaggccgaggcccagagaagactgtacggccagaacagcatcaagagactgctgcccggcagcagcgactgggagcagcagagacaccagctggagagaagaaaggaggagctgaaggagagactggcccaggtgagaaagcagatcagcagagaggagcacgagaacagacacatgggcaactacagaagaatctacccccccgaggacaaggccctgctggagaagtacgagaacctgctggccgtggccttccagaccttcctgagcggcagagccgccagcttccagagagagctgaacaaccccctgaagagaatgaaggaggaggacatcctggacctgctggagcagtgcgagatcgacgacgagaagctgatgggcaagaccaccaagaccagaggccccaagcccctgtgcagcatgcccgagagcaccgagatcatgaagagacccaagtactgcagcagcgacagcagctacgacagcagcagcagcagcagcgagagcgacgagaacgagaaggaggagtaccagaacaagaagagagagaagcaggtgacctacaacctgaagcccagcaaccactacaagctgatccagcagcccagcagcatcagaagaagcgtgagctgccccagaagcatcagcgcccagagccccagcagcggcgacaccagacccttcagcgcccagcagatgatcagcgtgagcagacccaccagcgccagcagaagccacagcctgaacagagccagcagctacatgagacacctgccccacagcaacgacgcctgcagcaccaacagccaggtggtggccatcatcagacagtag

SEQ ID NO: 25473 - DNA, 1710 bp, Artificial Sequence
  Description of Artificial Sequence: Synthetic coding sequence
ctgggccagagacagctgttccaggccctgagagtggagcacagaagccccgagccctggctgcccagagccgtgggcggcagaagaagagcccccgaccaccagtgcagactgcccagcagaggcggcagacccagaggcagctgcgaggccagagagcacctgggcgacagactgcagagaggcagagaggaccccggctgggccttcctgaccagagagctggtggtgaagaccctgatcgtggccgagccccacgtgctgcacgcctacagaatgtgcagacccggccagccccccggcagcgagagcgtgtgcttcgaggtgctgggcttcgacatcctgctggacagaaagctgaagccctggctgctggagatcaacagagcccccagcttcggcaccgaccagaagatcgactacgacgtgaagagaggcgtgctgctgaacgccctgaagctgctgaacatcagaaccagcgacaagagaagaaacctggccaagcagaaggccgaggcccagagaagactgtacggccagaacagcatcaagagactgctgcccggcagcagcgactgggagcagcagagacaccagctggagagaagaaaggaggagctgaaggagagactggcccaggtgagaaagcagatcagcagagaggagcacgagaacagacacatgggcaactacagaagaatctacccccccgaggacaaggccctgctggagaagtacgagaacctgctggccgtggccttccagaccttcctgagcggcagagccgccagcttccagagagagctgaacaaccccctgaagagaatgaaggaggaggacatcctggacctgctggagcagtgcgagatcgacgacgagaagctgatgggcaagaccaccaagaccagaggccccaagcccctgtgcagcatgcccgagagcaccgagatcatgaagagacccaagtactgcagcagcgacagcagctacgacagcagcagcagcagcagcgagagcgacgagaacgagaaggaggagtaccagaacaagaagagagagaagcaggtgacctacaacctgaagcccagcaaccactacaagctgatccagcagcccagcagcatcagaagaagcgtgagctgccccagaagcatcagcgcccagagccccagcagcggcgacaccagacccttcagcgcccagcagatgatcagcgtgagcagacccaccagcgccagcagaagccacagcctgaacagagccagcagctacatgagacacctgccccacagcaacgacgcctgcagcaccaacagccaggtgagcgagagcctgagacagctgaagaccaaggagcaggaggacgacctgaccagccagaccctgttcgtgctgaaggacatgaagatcagattccccggcaagagcgacgccgagagcgagctgctgatcgaggacatcatcgacaactggaagtaccacaagaccaaggtggccagctactggctgatcaagctggacagcgtgaagcagagaaaggtgctggacatcgtgaagaccagcatcagaaccgtgctgcccagaatctggaaggtgcccgacgtggaggaggtgaacctgtacagaatcttcaacagagtgttcaacagactgctgtggagcagaggccagggcctgtggaactgcttctgcgacagcggctacctgtag

SEQ ID NO: 25474 - DNA, 1101 bp, Artificial Sequence
  Description of Artificial Sequence: Synthetic coding sequence
atgagctggaacatcagccacccccagctgagcgacaagctgttcggcaagaacggcgtgctggaggagcagaagagccccggcttcaagaagagagagaccgaggtgtacgtgggcaacctgcccctggacatcagcaaggaggagatcctgtacctgctgaaggacttcaaccccctggacgtgcacaagatccagaacggctgcaagtgcttcgccttcgtggacctgggcagcatgcagaaggtgaccctggccatccaggagctgaacggcaagctgttccacaagagaaagctgttcgtgaacaccagcaagagaccccccaagagaacccccgacatgatccagcagcccagagcccccctggtgctggagaaggccagcggcgagggcttcggcaagaccgccgccatcatccagctggcccccaaggcccccgtggacctgtgcgagaccgagaagctgagagccgccttcttcgccgtgcccctggagatgagaggcagcttcctggtgctgctgctgagagagtgcttcagagacctgagctggctggccctgatccacagcgtgagaggcgaggccggcctgctggtgaccagcatcgtgcccaagacccccttcttctgggccatgcacgtgaccgaggccctgcaccagaacatgcaggccctgttcagcaccctggcccaggccgaggagcagcagccctacctggagggcagcaccgtgatgagaggcaccagatgcctggccgagtaccacctgggcgactacggccacgcctggaacagatgctgggtgctggacagagtggacacctgggccgtggtgatgttcatcgacttcggccagctggccaccatccccgtgcagagcctgagaagcctggacagcgacgacttctggaccatcccccccctgacccagcccttcatgctggagaaggacatcctgagcagctacgaggtggtgcacagaatcctgaagggcaagatcaccggcgccctgaacagcgccgtgaccgcccccgccagcaacctggccgtggtgccccccctgctgcccctgggctgcctgcagcaggccgccgcctag

SEQ ID NO: 25475 - DNA, 1056 bp, Artificial Sequence
  Description of Artificial Sequence: Synthetic coding sequence
atgagctggaacatcagccacccccagctgagcgacaagctgttcggcaagaacggcgtgctggaggagcagaagagccccggcttcaagaagagagagaccgaggtgtacgtgggcaacctgcccctggacatcagcaaggaggagatcctgtacctgctgaaggacttcaaccccctggacgtgcacaagatccagaacggctgcaagtgcttcgccttcgtggacctgggcagcatgcagaaggtgaccctggccatccaggagctgaacggcaagctgttccacaagagaaagctgttcgtgaacaccagcaagagaccccccaagagaacccccgacatgatccagcagcccagagcccccctggtgctggagaaggccagcggcgagggcttcggcaagaccgccgccatcatccagctggcccccaaggcccccgtggacctgtgcgagaccgagaagctgagagccgccttcttcgccgtgcccctggagatgagaggcagcttcctggtgctgctgctgagagagtgcttcagagacctgagctggctggccctgatccacagcgtgagaggcgaggccggcctgctggtgaccagcatcgtgcccaagacccccttcttctgggccatgcacgtgaccgaggccctgcaccagaacatgcaggccctgttcagcaccctggcccaggccgaggagcagcagccctacctggagggcagcaccgtgatgagaggcaccagatgcctggccgagtaccacctgggcgactacggccacgcctggaacagatgctgggtgctggacagagtggacacctgggccgtggtgatgttcatcgacttcggccagctggccaccatccccgtgcagagcctgagaagcctggacagcgacgacttctggaccatcccccccctgacccagcccttcatgctggagaaggacatcctgagcagctacgaggtggtgcacagaatcctgaagggcaagatcaccggcgccctgaacagcgccctgcacatcctgaagttcgaggagagcaagtag

SEQ ID NO: 25476 - DNA, 1188 bp, Artificial Sequence
  Description of Artificial Sequence: Synthetic coding sequence
atgctgcagctgctggtgctgaagatcgaggaccccggctgcttctgggtgatcatcaagggctgcagccccttcctggaccacgacgtggactaccagaagctgaacagcgccatgaacgacttctacaacagcacctgccaggacatcgagatcaagcccctgaccctggaggagggccaggtgtgcgtggtgtactgcgaggagctgaagtgctggtgcagagccatcgtgaagagcatcaccagcagcgccgaccagtacctggccgagtgcttcctggtggacttcgccaagaacatccccgtgaagagcaagaacatcagagtggtggtggagagcttcatgcagctgccctacagagccaagaagttcagcctgtactgcaccaagcccgtgaccctgcacatcgacttctgcagagacagcaccgacatcgtgcccgccaagaagtgggacaacgccgccatccagtacttccagaacctgctgaaggccaccacccaggtggaggccagactgtgcgccgtggaggaggacaccttcgaggtgtacctgtacgtgaccatcaaggacgagaaggtgtgcgtgaacgacgacctggtggccaagaactacgcctgctacatgagccccaccaagaacaagaacctggactacctggagaagcccagactgaacatcaagagcgcccccagcttcaacaagctgaaccccgccctgaccctgtggcccatgttcctgcagggcaaggacgtgcagggcatggaggacagccacggcgtgaacttccccgcccagagcctgcagcacacctggtgcaagggcatcgtgggcgacctgagacccaccgccaccgcccaggacaaggccgtgaagtgcaacatggacagcctgagagacagccccaaggacaagagcgagaagaagcaccactgcatcagcctgaaggacaccaacaagagagtggagagcagcgtgtactggcccgccaagagaggcatcaccatctacgccgaccccgacgtgcccgaggccagcgccctgagccagaagagcaacgagaagcccctgagactgaccgagaagaaggagtacgacgagaagaacagctgcgtgaagctgctgcagttcctgaaccccgaccccctgagagccgacggcatcagcgacctgcagcagacctag

SEQ ID NO: 25477 - DNA, 3534 bp, Artificial Sequence
  Description of Artificial Sequence: Synthetic coding sequence
atgctgcagctgctggtgctgaagatcgaggaccccggctgcttctgggtgatcatcaagggctgcagccccttcctggaccacgacgtggactaccagaagctgaacagcgccatgaacgacttctacaacagcacctgccaggacatcgagatcaagcccctgaccctggaggagggccaggtgtgcgtggtgtactgcgaggagctgaagtgctggtgcagagccatcgtgaagagcatcaccagcagcgccgaccagtacctggccgagtgcttcctggtggacttcgccaagaacatccccgtgaagagcaagaacatcagagtggtggtggagagcttcatgcagctgccctacagagccaagaagttcagcctgtactgcaccaagcccgtgaccctgcacatcgacttctgcagagacagcaccgacatcgtgcccgccaagaagtgggacaacgccgccatccagtacttccagaacctgctgaaggccaccacccaggtggaggccagactgtgcgccgtggaggaggacaccttcgaggtgtacctgtacgtgaccatcaaggacgagaaggtgtgcgtgaacgacgacctggtggccaagaactacgcctgctacatgagccccaccaagaacaagaacctggactacctggagaagcccagactgaacatcaagagcgcccccagcttcaacaagctgaaccccgccctgaccctgtggcccatgttcctgcagggcaaggacgtgcagggcatggaggacagccacggcgtgaacttccccgcccagagcctgcagcacacctggtgcaagggcatcgtgggcgacctgagacccaccgccaccgcccaggacaaggccgtgaagtgcaacatggacagcctgagagacagccccaaggacaagagcgagaagaagcaccactgcatcagcctgaaggacaccaacaagagagtggagagcagcgtgtactggcccgccaagagaggcatcaccatctacgccgaccccgacgtgcccgaggccagcgccctgagccagaagagcaacgagaagcccctgagactgaccgagaagaaggagtacgacgagaagaacagctgcgtgaagctgctgcagttcctgaaccccgaccccctgagagccgacggcatcagcgacctgcagcagctgcagaagctgaagggcctgcagccccccgtggtggtgctgagaaacaagatcaagccctgcctgaccatcgacagcagccccctgagcgccgacctgaagaaggccctgcagagaaacaagttccccggccccagccacaccgagagctacagctggccccccatcgccagaggctgcgacgtggtggtgatcagccactgcgagagcaaccccctgctgtacctgctgcccgtgctgaccgtgctgcagaccggcgcctgctacaagagcctgcccagcagaaacggccccctggccgtgatcgtgtgccccggctggaagaaggcccagttcatcttcgagctgctgggcgagtacagcatgagcagcagacccctgcaccccgtgctgctgaccatcggcctgcacaaggaggaggccaagaacaccaagctgcccagaggctgcgacgtgatcgtgaccaccccctacagcctgctgagactgctggcctgccagagcctgctgttcctgagactgtgccacctgatcctggacgaggtggaggtgctgttcctggaggccaacgagcagatgttcgccatcctggacaacttcaagaagaacatcgaggtggaggagagagagagcgccccccaccagatcgtggccgtgggcgtgcactggaacaagcacatcgagcacctgatcaaggagttcatgaacgacccctacatcgtgatcaccgccatggaggaggccgccctgtacggcaacgtgcagcaggtggtgcacctgtgcctggagtgcgagaagaccagcagcctgctgcaggccctggacttcatccccagccaggcccagaagaccctgatcttcacctgcagcgtggccgagaccgagatcgtgtgcaaggtggtggagagcagcagcatcttctgcctgaagatgcacaaggagatgatcttcaacctgcagaacgtgctggagcagtggaagaagaagctgagcagcggcagccagatcatcctggccctgaccgacgactgcgtgcccctgctggccatcaccgacgccacctgcgtgatccacttcagcttccccgccagccccaaggtgttcggcggcagactgtactgcatgagcgaccacttccacgccgagcagggcagccccgccgagcagggcgacaagaaggccaagagcgtgctgctgctgaccgagaaggacgccagccacgccgtgggcgtgctgagatacctggagagagccgacgccaaggtgcccgccgagctgtacgagttcaccgccggcgtgctggaggccaaggaggacaagaaggccggcagacccctgtgcccctacctgaaggccttcggcttctgcaaggacaagagaatctgccccgacagacacagaatcaaccccgagaccgacctgcccagaaagctgagcagccaggccctgcccagcttcggctacatcaagatcatccccttctacatcctgaacgccaccaactacttcggcagaatcgtggacaagcacatggacctgtacgccaccctgaacgccgagatgaacgagtacttcaaggacagcaacaagaccaccgtggagaaggtggagaagttcggcctgtacggcctggccgagaagaccctgttccacagagtgcaggtgctggaggtgaaccagaaggaggacgcctgggccctggacgacatcctggtggagttcatcgacgagggcagaaccggcctggtgaccagagaccagctgctgcacctgcccgagcacttccacaccctgcccccccaggccgtggagttcatcgtgtgcagagtgaagcccgccgacaacgagatcgagtggaaccccaaggtgaccagatacatccaccacaagatcgtgggcaagctgcacgacgccaaggtgatcctggccctgggcaacaccgtgtggatcgaccccatggtgcacatcaccaacctgagcagcctgaagaccagcgtgatcgactacaacgtgagagccgagatcctgagcatgggcatgggcatcgacaaccccgagcacatcgagcagctgaagaagctgagagaggacgccaagatccccgcctgcgaggagagcctgagccagaccccccccagagtgaccggcaccagccccgcccaggaccaggaccaccccagcgaggagcagggcggccagggcaccccccccgccgaggacgccgcctgcctgcagagcccccagcccgaggacaccggcgccgagggcggcgccgagagcaagaccagcagcgagaaccagaagcccggcggctacctggtgttcaagagatggctgagcagcaacagatag

SEQ ID NO: 25478 - DNA, 561 bp, Artificial Sequence
  Description of Artificial Sequence: Synthetic coding sequence
atggacaccttcagcaccaagagcctggccctgcaggcccagaagaagctgctgagcaagatggccagcaaggccgtggtggccgtgctggtggacgacaccagcagcgaggtgctggacgagctgtacagagccaccagagagttcaccagaagcagaaaggaggcccagaagatgctgaagaacctggtgaaggtggccctgaagctgggcctgctgctgagaggcgaccagctgggcggcgaggagctggccctgctgagaagattcagacacagagccagatgcctggccatgaccgccgtgagcttccaccaggtggacttcaccttcgacagaagagtgctggccgccggcctgctggagtgcagagacctgctgcaccaggccgtgggcccccacctgaccgccaagagccacggcagaatcaaccacgtgttcggccacctggccgactgcgacttcctggccgccctgtacggccccgccgagccctacagaagccacctgagaagaatctgcgagggcctgggcagaatgctggacgagggcagcctgtag

SEQ ID NO: 25479 - DNA, 561 bp, Artificial Sequence; identical to SEQ ID NO: 25478
  Description of Artificial Sequence: Synthetic coding sequence

SEQ ID NO: 25480 - DNA, 879 bp, Artificial Sequence
  Description of Artificial Sequence: Synthetic coding sequence
atgggcaagcccagacagaaccccagcaccctggtgagcaccctgtgcgaggccgagcccaagggcaagctgtgggtgaacggctacgccggcacccagggcaccagagacgccaccctgcagaccagactgatccccctgagcttccacctgcagagaggcaagggcctggccgcccccctgagcgccctgagcgcccccagactgcccgagagacccgccgacggcagagtggccgtggacgcccagcccgccgccagaagcatggacagcgacagcggcgagcagagcgagggcgagcccgtgaccgccgccggccccgacgtgttcagcagcaagagcctggccctgcaggcccagaagaagatcctgagcaagatcgccagcaagaccgtggccaacatgctgatcgacgacaccagcagcgagatcttcgacgagctgtacaaggtgaccaaggagcacacccacaacaagaaggaggcccacaagatcatgaaggacctgatcaaggtggccatcaagatcggcatcctgtacagaaacaaccagttcagccaggaggagctggtgatcgtggagaagttcagaaagaagctgaaccagaccgccatgaccatcgtgagcttctacgaggtggagtacaccttcgacagaaacgtgctgagcaacctgctgcacgagtgcaaggacctggtgcacgagctggtgcagagacacctgacccccagaacccacggcagaatcaaccacgtgttcaaccacttcgccgacgtggagttcctgagcaccctgtacagcctggacggcgactgcagacccaacctgaagagaatctgcgagggcatcaacaagctgctggacgagaaggtgctgtag

SEQ ID NO: 25481 - DNA, 411 bp, Artificial Sequence
  Description of Artificial Sequence: Synthetic coding sequence
atgccccacgccagaaccgagaccagcgtgggcacctacgagagccacagcaccagcgagctggaggacctgaccgagcccgagcagagagagctgaagaccaagctgaccaagctggaggccgagatcgtgaccctgagacacgtgctggccgccaaggagagaagatgcggcgagctgaagagaaagctgggcctgaccgccctggtgggcctgagacagaacctgagcaagagctggctggacgtgcaggtgagcaacacctacgtgaagcagaagaccagcgccgccctgagcaccatgggcaccctgatctgcagaaagctgggcggcgtgaagaagagcgccaccttcagaagcttcgagggcctgatcttcaacaagtacaccctgaaccagggcagaaactag

SEQ ID NO: 25482 - DNA, 423 bp, Artificial Sequence
  Description of Artificial Sequence: Synthetic coding sequence
atgccccacgccagaaccgagaccagcgtgggcacctacgagagccacagcaccagcgagctggaggacctgaccgagcccgagcagagagagctgaagaccaagctgaccaagctggaggccgagatcgtgaccctgagacacgtgctggccgccaaggagagaagatgcggcgagctgaagagaaagctgggcctgaccgccctggtgggcctgagacagaacctgagcaagagctggctggacgtgcaggtgagcaacacctacgtgaagcagaagaccagcgccgccctgagcaccatgggcaccctgatctgcagaaagctgggcggcgtgaagaagagcgccaccttcagaagcttcgagggcctgatgggcaccatcaagagcaaggtgagcggcggcaagagagcctggccctag

SEQ ID NO: 25483 - DNA, 399 bp, Artificial Sequence
  Description of Artificial Sequence: Synthetic coding sequence
atgccccacgccagaaccgagaccagcgtgggcacctacgagagccacagcaccagcgagctggaggacctgaccgagcccgagcagagagagctgaagaccaagctgaccaagctggaggccgagatcgtgaccctgagacacgtgctggccgccaaggagagaagatgcggcgagctgaagagaaagctgggcctgaccgccctggtgggcctgagacagaacctgagcaagagctggctggacgtgcaggtgagcaacacctacgtgaagcagaagaccagcgccgccctgagcaccatgggcaccctgatctgcagaaagctgggcggcgtgaagaagagcgccaccttcagaagcttcgagggcaaccccaagggcgagggcagcagaatctag

SEQ ID NO: 25484 - DNA, 999 bp, Artificial Sequence
  Description of Artificial Sequence: Synthetic coding sequence
atgctggccgtgcacttcgacaagcccggcggccccgagaacctgtacgtgaaggaggtggccaagcccagccccggcgagggcgaggtgctgctgaaggtggccgccagcgccctgaacagagccgacctgatgcagagacagggccagtacgaccccccccccggcgccagcaacatcctgggcctggaggccagcggccacgtggccgagctgggccccggctgccagggccactggaagatcggcgacaccgccatggccctgctgcccggcggcggccaggcccagtacgtgaccgtgcccgagggcctgctgatgcccatccccgagggcctgaccctgacccaggccgccgccatccccgaggcctggctgaccgccttccagctgctgcacctggtgggcaacgtgcaggccggcgactacgtgctgatccacgccggcctgagcggcgtgggcaccgccgccatccagctgaccagaatggccggcgccatccccctggtgaccgccggcagccagaagaagctgcagatggccgagaagctgggcgccgccgccggcttcaactacaagaaggaggacttcagcgaggccaccctgaagttcaccaagggcgccggcgtgaacctgatcctggactgcatcggcggcagctactgggagaagaacgtgaactgcctggccctggacggcagatgggtgctgtacggcctgatgggcggcggcgacatcaacggccccctgttcagcaagctgctgttcaagagaggcagcctgatcaccagcctgctgagaagcagagacaacaagtacaagcagatgctggtgaacgccttcaccgagcagatcctgccccacttcagcaccgagggcccccagagactgctgcccgtgctggacagaatctaccccgtgaccgagatccaggaggcccacaagtacatggaggccaacaagaacatcggcaagatcgtgctggagctgccccagtag

SEQ ID NO: 25485 - DNA, 747 bp, Artificial Sequence
  Description of Artificial Sequence: Synthetic coding sequence
atgctggccgtgcacttcgacaagcccggcggccccgagaacctgtacgtgaaggaggtggccaagcccagccccggcgagggcgaggtgctgctgaaggtggccgccagcgccctgaacagagccgacctgatgcagagacagggccagtacgaccccccccccggcgccagcaacatcctgggcctggaggccagcggccacgtggccgagctgggccccggctgccagggccactggaagatcggcgacaccgccatggccctgctgcccggcggcggccaggcccagtacgtgaccgtgcccgagggcctgctgatgcccatccccgagggcctgaccctgacccaggccgccgccatccccgaggcctggctgaccgccttccagctgctgcacctggtgggcaacgtgcaggccggcgactacgtgctgatccacgccggcctgagcggcgtgggcaccgccgccatccagctgaccagaatggccggcgccatccccctggtgaccgccggcagccagaagaagctgcagatggccgagaagctgggcgccgccgccggcttcaactacaagaaggaggacttcagcgaggccaccctgaagttcaccaaggtgcaggccaacgccggcgagtgcttccacggcgccaacagcgccagcctgctgcacggcggcccccccaccagcgccgccggcagcggccagaacctgcccagcgacagaaaccccggcggcccctag

SEQ ID NO: 25486 - DNA, 999 bp, Artificial Sequence; identical to SEQ ID NO: 25484
  Description of Artificial Sequence: Synthetic coding sequence

SEQ ID NO: 25487 - DNA, 651 bp, Artificial Sequence
  Description of Artificial Sequence: Synthetic coding sequence
ttcgacaagcccggcggccccgagaacctgtacgtgaaggaggtggccaagcccagccccggcgagggcgaggtgctgctgaaggtggccgccagcgccctgaacagagccgacctgatgcagagacagggccagtacgaccccccccccggcgccagcaacatcctgggcctggaggccagcggccacgtggccgagctgggccccggctgccagggccactggaagatcggcgacaccgccatggccctgctgcccggcggcggccaggcccagtacgtgaccgtgcccgagggcctgctgatgcccatccccgagggcctgaccctgacccaggccgccgccatccccgaggcctggctgaccgccttccagctgctgcacctggtgggcaacgtgcaggccggcgactacgtgctgatccacgccggcctgagcggcgtgggcaccgccgccatccagctgaccagaatggccggcgccatccccctggtgaccgccggcagccagaagaagctgcagatggccgagaagctgggcgccgccgccggcttcaactacaagaaggaggacttcagcgaggccaccctgaagttcaccaagggcaagcagctgctgctgcagttcagcagaaacctgagagacgactag

SEQ ID NO: 25488 - DNA, 261 bp, Artificial Sequence
  Description of Artificial Sequence: Synthetic coding sequence
atgggcagcagcagcgaggccagcttcagaagcgcccaggccagctgcagcggcgccagaagacagggcctgggcagaggcgaccagaacctgagcgtgatgccccccaacggcagagcccagacccacacccccggctgggtgagcgaccccctggtgctgggcgcccaggtgcacggcggctgcagaggcatcgaggccctgagcgtgagcagcggcagctggagcagcgccaccgtgtggatcctgaccgtgcagtag

SEQ ID NO: 25489 - DNA, 363 bp, Artificial Sequence
  Description of Artificial Sequence: Synthetic coding sequence
atgggcagcagcagcgaggccagcttcagaagcgcccaggccagctgcagcggcgccagaagacagggcctgggcagaggcgaccagaacctgagcgtgatgccccccaacggcagagcccagacccacacccccggctgggtgagcgaccccctggtgctgggcgcccaggtgcacggcggctgcagaggcatcgaggccctgagcgtgagcagcggcagctggagcagcgccaccgtgtggatcctgaccggcctgagcagacccttcctgcccggcgccaccgtgctgagagacagacccctgggcagcgccttcgagctgagctacgaccagaagaaggcccccctgagactgcagtag

SEQ ID NO: 25490 - DNA, 837 bp, Artificial Sequence
  Description of Artificial Sequence: Synthetic coding sequence
  Description of Combined DNA/RNA Molecule: Synthetic coding sequence
atgctgagaagcctgctgctgcacagcctgagactgtgcgcccagaccgccagctgcctggtgctgttccccagattcctgggcaccgccttcatgctgtggctgctggacttcctgtgcatcagaaagcacttcctgggcagaagaagaagaggccagcccgagcccgaggtggagctgaacagcgagggcgaggaggtgccccccgacgacccccccatctgcgtgagcgacgacaacagactgtgcaccctggccagcctgaaggccgtgtggcacggccagaagctggacttcttcaagcaggcccacgagggcggccccgcccccaacagcgaggtggtgctgcccgacggcttccagagccagcacatcctggactacgcccagggcaacagacccctggtgctgaacttcggcagctgcaccugaccccccttcatggccagaatgagcgccttccagagactggtgaccaagtaccagagagacgtggacttcctgatcatctacatcgaggaggcccaccccagcgacggctgggtgaccaccgacagcccctacatcatcccccagcacagaagcctggaggacagagtgagcgccgccagagtgctgcagcagggcgcccccggctgcgccctggtgctggacaccatggccaacagcagcagcagcgcctacggcgcctacttcgagagactgtacgtgatccagagcggcaccatcatgtaccagggcggcagaggccccgacggctaccaggtgagcgagctgagaacctggctggagagatacgacgagcagctgcacggcgccagacccagaagagtgtag

SEQ ID NO: 25491 - DNA, 4209 bp, Artificial Sequence
  Description of Artificial Sequence: Synthetic coding sequence
atgcaccagaccctgtgcctgaaccccgagagcctgaagatgagcgcctgcagcgacttcgtggagcacatctggaagcccggcagctgcaagaactgcttctgcctgagaagcgaccaccagctggtggccggccccccccagcccagagccggcagcctgccccccccccccagactgccccccagacccgagaactgcagactggaggacgagggcgtgaacagcagcccctacagcaagcccaccatcgccgtgaagcccaccatgatgagcagcgaggccagcgacgtgtggaccgaggccaacctgagcgccgaggtgagccaggtgatctggagaagagcccccggcaagctgcccctgcccaagcaggaggacgcccccgtggtgtacctgggcagcttcagaggcgtgcagaagcccgccggccccagcaccagccccgacggcaacagcagatgcccccccgcctacaccatggtgggcctgcacaacctggagcccagaggcgagagaaacatcgccttccaccccgtgagcttccccgaggagaaggccgtgcacaaggagaagcccagcttcccctaccaggacagacccagcacccaggagagcttcagacagaagctggccgccttcgccggcaccaccagcggctgccaccagggccccggccccctgagagagagcctgcccagcgaggacgacagcgaccagagatgcagccccagcggcgacagcgagggcggcgagtactgcagcatcctggactgctgccccggcagccccgtggccaaggccgccagccagaccgccggcagcagaggcagacacggcggcagagactgcagccccacctgctgggagcagggcaagtgcagcggccccgccgagcaggagaagagaggccccagcttccccaaggagtgctgcagccagggccccaccgcccaccccagctgcctgggccccaagaagctgagcctgaccagcgaggccgccatcagcagcgacggcctgagctgcggcagcggcagcggcagcggcgccagcagccccttcgtgccccacctggagagcgactactgcagcctgatgaaggagcccgcccccgagaagcagcaggaccccggctgccccggcgtgacccccagcagatgcctgggcctgaccggcgagccccagccccccgcccaccccagagaggccacccagcccgagcccatctacgccgagagcaccaagagaaagaaggccgcccccgtgcccagcaagagccaggccaagatcgagcacgccgccgccgcccagggccagggccaggtgtgcaccggcaacgcctgggcccagaaggccgccagcggctggggcagagacagccccgaccccaccccccaggtgagcgccaccatcaccgtgatggccgcccaccccgaggaggaccacagaaccatctacctgagcagccccgacagcgccgtgggcgtgcagtggcccagaggccccgtgagccagaacagcgaggtgggcgaggaggagaccagcgccggccagggcctgagcagcagagagagccacgcccacagcgccagcgagagcaagcccaaggagagacccgccatcccccccaagctgagcaagagcagccccgtgggcagccccgtgagccccagcgccggcggcccccccgtgagccccctggccgacctgagcgacggcagcagcggcggcagcagcatcggcccccagccccccagccagggccccgccgaccccgcccccagctgcagaaccaacggcgtggccatcagcgaccccagcagatgcccccagcccgccgccagcagcgccagcgagcagagaagacccagattccaggccggcacctggagcagacagtgcagaatcgaggaggaggaggaggtggagcaggagctgctgagccacagctggggcagagagaccaagaacggccccaccgaccacagcaacagcaccacctggcacagactgcaccccaccgacggcagcagcggccagaacagcaaggtgggcaccggcatgagcaagagcgccagcttcgccttcgagttccccaaggacagaagcggcatcgagaccttcagcccccccccccccccccccaagagcagacacctgctgaagatgaacaagagcagcagcgacctggagaaggtgagccagggcagcgccgagagcctgagccccagcttcagaggcgtgcacgtgagcttcaccaccggcagcaccgacagcctggccagcgacagcagaacctgcagcgacggcggccccagcagcgagctggcccacagccccaccaacagcggcaagaagctgttcgcccccgtgcccttccccagcggcagcaccgaggacgtgagccccagcggcccccagcagcccccccccctgccccagaagaagatcgtgagcagagccgccagcagccccgacggcttcttctggacccagggcagccccaagcccggcaccgccagccccaagctgaacctgagccacagcgagaccaacgtgcacgacgagagccacttcagctacagcctgagccccggcaacagacaccaccccgtgttcagcagcagcgaccccctggagaaggccttcaagggcagcggccactggctgcccgccgccggcctggccggcaacagaggcggctgcggcagccccggcctgcagtgcaagggcgcccccagcgccagcagcagccagctgagcgtgagcagccaggccagcaccggcagcacccagctgcagctgcacggcctgctgagcaacatcagcagcaaggagggcacctacgccaagctgggcggcctgtacacccagagcctggccagactggtggccaagtgcgaggacctgttcatgggcggccagaagaaggagctgcacttcaacgagaacaactggagcctgttcaagctgacctgcaacaagccctgctgcgacagcggcgacgccatctactactgcgccacctgcagcgaggaccccggcagcacctacgccgtgaagatctgcaaggcccccgagcccaagaccgtgagctactgcagccccagcgtgcccgtgcacttcaacatccagcaggactgcggccacttcgtggccagcgtgcccagcagcatgctgagcagccccgacgcccccaaggaccccgtgcccgccctgcccacccacccccccgcccaggagcaggactgcgtggtggtgatcaccagagaggtgccccaccagaccgccagcgacttcgtgagagacagcgccgccagccaccaggccgagcccgaggcctacgagagaagagtgtgcttcctgctgctgcagctgtgcaacggcctggagcacctgaaggagcacggcatcatccacagagacctgtgcctggagaacctgctgctggtgcactgcaccctgcaggccggccccggccccgcccccgcccccgcccccgcccccgccgccgccgcccccccctgcagcagcgccgccccccccgccggcggcaccctgagccccgccgccggccccgccagccccgagggccccagagagaagcagctgcccagactgatcatcagcaacttcctgaaggccaagcagaagcccggcggcacccccaacctgcagcagaagaagagccaggccagactggcccccgagatcgtgagcgccagccagtacagaaagttcgacgagttccagaccggcatcctgatctacgagctgctgcaccagcccaaccccttcgaggtgagagcccagctgagagagagagactacagacaggaggacctgccccccctgcccgccctgagcctgtacagccccggcctgcagcagctggcccacctgctgctggaggccgaccccatcaagagaatcagaatcggcgaggccaagagagtgctgcagtgcctgctgtggggccccagaagagagctggtgcagcagcccggcaccagcgaggaggccctgtgcggcaccctgcacaactggatcgacatgaagagagccctgatgatgatgaagttcgccgagaaggccgtggacagaagaagaggcgtggagctggaggactggctgtgctgccagtacctggccagcgccgagcccggcgccctgctgcagagcctgaagctgctgcagctgctgtag

SEQ ID NO: 25492 - DNA, 4209 bp, Artificial Sequence; identical to SEQ ID NO: 25491
  Description of Artificial Sequence: Synthetic coding sequence

SEQ ID NO: 25493 - DNA, 1416 bp, Artificial Sequence
  Description of Artificial Sequence: Synthetic coding sequence
atgagcgacttcgacgagttcgagagacagctgaacgagaacaagcaggagagagacaaggagaacagacacagaaagagaagccacagcagaagcagaagcagagacagaaagagaagaagcagaagcagagacagaagaaacagagaccagagaagcgccagcagagacagaagaagaagaagcaagcccctgaccagaggcgccaaggaggagcacggcggcctgatcagaagccccagacacgagaagaagaagaaggtgagaaagtactgggacgtgcccccccccggcttcgagcacatcacccccatgcagtacaaggccatgcaggccgccggccagatccccgccaccgccctgctgcccaccatgacccccgacggcctggccgtgacccccacccccgtgcccgtggtgggcagccagatgaccagacaggccagaagactgtacgtgggcaacatccccttcggcatcaccgaggaggccatgatggacttcttcaacgcccagatgagactgggcggcctgacccaggcccccggcaaccccgtgctggccgtgcagatcaaccaggacaagaacttcgccttcctggagttcagaagcgtggacgagaccacccaggccatggccttcgacggcatcatcttccagggccagagcctgaagatcagaagaccccacgactaccagcccctgcccggcatgagcgagaaccccagcgtgtacgtgcccggcgtggtgagcaccgtggtgcccgacagcgcccacaagctgttcatcggcggcctgcccaactacctgaacgacgaccaggtgaaggagctgctgaccagcttcggccccctgaaggccttcaacctggtgaaggacagcgccaccggcctgagcaagggctacgccttctgcgagtacgtggacatcaacgtgaccgaccaggccatcgccggcctgaacggcatgcagctgggcgacaagaagctgctggtgcagagagccagcgtgggcgccaagaacgccaccctgagcaccatcaaccagacccccgtgaccctgcaggtgcccggcctgatgagcagccaggtgcagatgggcggccaccccaccgaggtgctgtgcctgatgaacatggtgctgcccgaggagctgctggacgacgaggagtacgaggagatcgtggaggacgtgagagacgagtgcagcaagtacggcctggtgaagagcatcgagatccccagacccgtggacggcgtggaggtgcccggctgcggcaagatcttcgtggagttcaccagcgtgttcgactgccagaaggccatgcagggcctgaccggcagaaagttcgccaacagagtggtggtgaccaagtactgcgaccccgacagctaccacagaagagacttctggtag

SEQ ID NO: 25494 - DNA, 783 bp, Artificial Sequence
  Description of Artificial Sequence: Synthetic coding sequence
atgtggcacgccatcagcagaaccagcagaatgagccagagcggctgccccagcggcctgctggccgacaagaacatcagcagcagcgccaccagagtgatcgtgaagaccgccggcaaccagaaggacttcatggtggccgacgacatcagcgtgagacagttcaaggagatgctgctggcccacttccagtgccagatggaccagctggtgctggtgttcatgggctgcctgctgaaggaccacgacaccctgagccagagaggcatcatggacggccacaccatctacctggtgatcaagagcaagcagggcagcagaagcctggcccacagcttcagagacctgcccaccaacgacccctgccacagagacagaaacaccaaggccaacgacaccctgaacaaggtgaaccacaccagcaaggccaacaccgccatgatcagcaccaagggccagagccacatctgcgccaccagacagcccgcctggatccccgccctgcccagcatcgagctgacccagcagctgcaggaggagtacaaggacgccaccgtgagcctgagcagcagcagacagaccctgaagggcgacctgcagctgagcgacgagcagagcagcagccagatcaccggcggcatgatgcagctgctgatgaacaacccctacctggccgcccagatcatgctgttcaccagcatgccccagctgagcgagcagtggagacagcagctgcccaccttcctgcagcagacccagatcagcgacctgctgagcgcctag

SEQ ID NO: 25495 - DNA, 1428 bp, Artificial Sequence
  Description of Artificial Sequence: Synthetic coding sequence
atgtggcacgccatcagcagaaccagcagaatgagccagagcggctgccccagcggcctgctggccgacaagaacatcagcagcagcgccaccagagtgatcgtgaagaccgccggcaaccagaaggacttcatggtggccgacgacatcagcgtgagacagttcaaggagatgctgctggcccacttccagtgccagatggaccagctggtgctggtgttcatgggctgcctgctgaaggaccacgacaccctgagccagagaggcatcatggacggccacaccatctacctggtgatcaagagcaagcagggcagcagaagcctggcccacagcttcagagacctgcccaccaacgacccctgccacagagacagaaacaccaagggcaacagcagcagagtgcaccagcccaccggcatgaaccaggcccccgtggagctggcccacttcgtgggcagcgacgcccccaaggtgcacacccagaacctggaggtgagccaccccgagtgcaaggcccagatgctggagaaccccagcatccagagactgctgagcaacatggagttcatgtggcagttcatcagcgagcacctggacacccagcagctgatgcagcagaaccccgaggtgagcagactgctgctggacaacagcgagatcctgctgcagaccctggagctggccagaaacctggccatgatccaggagatcatgcagatccagcagcccagccagaacctggagtaccccctgaacccccagccctacctgggcctggagaccatgcccggcggcaacaacgccctgggccagaactacgccgacatcaacgaccagatgctgaacagcatgcaggaccccttcggcggcaaccccttcaccgccctgctggccggccaggtgctggagcaggtgcagagcagcccccccccccccccccccagccaggagcagcaggaccagctgacccagcaccccgccaccagagtgatctacaacagcagcggcggcttcagcagcaacaccagcgccaacgacaccctgaacaaggtgaaccacaccagcaaggccaacaccgccatgatcagcaccaagggccagagccacatctgcgccaccagacagcccgcctggatccccgccctgcccagcatcgagctgacccagcagctgcaggaggagtacaaggacgccaccgtgagcctgagcagcagcagacagaccctgaagggcgacctgcagctgagcgacgagcagagcagcagccagatcaccggcggcatgatgcagctgctgatgaacaacccctacctggccgcccagatcatgctgttcaccagcatgccccagctgagcgagcagtggagacagcagctgcccaccttcctgcagcagacccagatcagcgacctgctgagcgcctag

SEQ ID NO: 25496 - DNA, 1146 bp, Artificial Sequence
  Description of Artificial Sequence: Synthetic coding sequence
atgaacgccctggacggcgtgcccttcaagctgcccaagggcttcgtgatcggcaccgagcccctgcccggccccgagctgagcgtgcccgcctgcggcgaggtgctgctgggcagcatgcacgacttcagcctggagagaaccgccctgttctgggtggaggccgccggccagggccccagcccctaccagtgcggcgaccccggcaccgccagcgccccccccgcctggctgctgctggtgagccccgagcacggcctggcccccgcccccaccaccatcagagaccccgaggccggccaccaggagagacccgaggaggagggcgaggacgaggccgaggccagcagcggcagcgaggaggagcccgcccccagcagcctgcagcccggcagccccgccagccccggccccggcagaagactgtgcagcctggacgtgctgagaggcgtgagactggagctggccggcgccagaagaagactgagcgagggcaagctggtgagcagacccagagccctgctgcacggcctgagaggccacagagccctgagcctgtgccccagccccgcccagagccccagaagcgccagcccccccggccccgccccccagcaccccgccgcccccgccagcccccccagacccagcaccgccggcgccatcccccccctgagaagccacaagcccaccgtggccagcctgagcccctacacctgcctgccccccctgggcggcgccccccagcccctgaacccccacaagagccaccccgacaccgccgccgacctgctgagcgccctgagccaggaggagcaggacctgatcggccccgtggtggccctgggctaccccctgagaagagccatcatcgccctgcagaagaccggcagacagagcctgagccagttcctgagctacctgagcgcctgcgacagactgctgagacagggctacgaggagggcctggtggacgaggccatggagatgttccagttcagcgagagccaggccggcgagttcctgagactgtgggagcagttcagcgacatgggcttccagcaggacagaatcaaggaggtgctgctggtgcacggcaacagaagagagcaggccctggaggagctggtggcctgcgcccagtag

SEQ ID NO: 25497 - DNA, 1146 bp, Artificial Sequence; identical to SEQ ID NO: 25496
  Description of Artificial Sequence: Synthetic coding sequence

SEQ ID NO: 25498 - DNA, 1746 bp, Artificial Sequence
  Description of Artificial Sequence: Synthetic coding sequence
atgatgaccagcgtgagcagcgaccactgcagaggcgccagagagaagccccagatcagcgccgcccagagcacccagccccagaagcaggtggtgcaggccaccgccgagcagatgagactggcccaggtgatcttcgacaagaacgacagcgacttcgaggccaaggtgaagcagctgatggaggtgaccggcaagaaccaggacgagtgcatcgtggccctgcacgactgcaacggcgacgtgaacaaggccatcaacatcctgctggagggcaacagcgacaccaccagctgggagaccgtgggctgcaagaagaagaacttcgccaaggagaacagcgagaacaaggagaacagagagaagaagaagcacaccggcgacctgaccagcagccccctgagccagctgagcagcagcctgagcagccaccagagcagcctgagcgcccacgccgccctgagcagcagcaccagccacacccacgccagcgtggagagcgccagcagccaccagagcagcgccaccttcagcaccgccgccaccagcgtgagcagcagcgccagcagcggcgccagcctgagcagcagcatgaacaccgccaacagcctgtgcctgggcggcacccccgccagcgccagcagcagcagcagcagagccgcccccctggtgaccagcggcaaggccccccccaacctgccccagggcgtgccccccctgctgcacaaccagtacctggtgggccccggcggcctgctgcccgcctaccccatctacggctacgacgagctgcagatgctgcagagcagactgcccgtggactactacggcatccccttcgccgcccccaccgccctggccagcagagacggcagcctggccaacaacccctaccccggcgacgtgaccaagttcggcagaggcgacagcgccagccccgcccccgccaccaccagcagcgccaccgccgagcccatcaccgaccccccccacagccccgccgccctgagagagagctgcaccgccacctggagctacaccggcctgccctactacaccggcatgcccagcgccttccagtacggccccaccatgttcgtgccccccgccagcgccaagcagcacggcgtgaacctgagcacccccaccccccccttccagcaggccagcggctacggccagcacggctacagcaccggctacgacgacctgacccagggcaccgccgccggcgactacagcaagggcggctacgccggcagcagccaggcccccaacaagagcgccggcagcggccccggcaagggcgtgagcgtgagcagcagcaccaccggcctgcccgacatgaccggcagcgtgtacaacaagacccagaccttcgacaagcagggcttccacgccggcacccccccccccttcagcctgcccagcgtgctgggcagcaccggccccctggccagcggcgccgcccccggctacgcccccccccccttcctgcacatcctgcccgcccaccagcagccccacagccagctgctgcaccaccacctgccccaggacgcccagagcggcagcggccagagaagccccgccccctgcagccccagcctgaagccccccaacctgcccaccctgagcatcctggacaagctgaaccccgaggagagaggcggcctgggccagggcctgagctgggccggcgagaacaccagagccagaatctgggagcccagcgccctgagctag

SEQ ID NO: 25499 - DNA, 3360 bp, Artificial Sequence
  Description of Artificial Sequence: Synthetic coding sequence
atgatgaccagcgtgagcagcgaccactgcagaggcgccagagagaagccccagatcagcgccgcccagagcacccagccccagaagcaggtggtgcaggccaccgccgagcagatgagactggcccaggtgatcttcgacaagaacgacagcgacttcgaggccaaggtgaagcagctgatggaggtgaccggcaagaaccaggacgagtgcatcgtggccctgcacgactgcaacggcgacgtgaacaaggccatcaacatcctgctggagggcaacagcgacaccaccagctgggagaccgtgggctgcaagaagaagaacttcgccaaggagaacagcgagaacaaggagaacagagagaagaagagcgagaaggagagcagcagaggcagaggcaacaacaacagaaagggcagaggcggcaacagaggcagagagttcagaggcgaggagaacggcatcgactgcaaccaggtggacaagcccagcgacagaggcaagagagccagaggcagaggcttcggcagaggcagaggcagaggcgccggcagattcagcacccagggcatgggcaccttcaaccccgccgactacagcgacagcaccagcaccgacgtgtgcggcaccaagctggtggtgtgggaggccgcccagaacggcgccgacgagggcaccgagctggccagcaacacccacaacatcgcccaggacctgagcaacaagagcagctacggcctgaagggcgcctggaagaacagcgtggaggagtggaccaccgaggactggaccgaggacctgagcgagaccaaggtgttcaccgccagcagcgcccccgccgagaaccacatcctgcccggccagagcatcgacctggtggccctgctgcagaagcccgtgccccacagccaggccagcgaggccaacagcttcgagaccagccagcagcagggcttcggccaggccctggtgttcaccaacagccagcacaacaaccagatggcccccggcaccggcagcagcaccgccgtgaacagctgcagcccccagagcctgagcagcgtgctgggcagcggcttcggcgagctggccccccccaagatggccaacatcaccagcagccagatcctggaccagctgaaggcccccagcctgggccagttcaccaccacccccagcacccagcagaacagcaccagccaccccaccaccaccaccagctgggacctgaagccccccaccagccagagcagcgtgctgagccacctggacttcaagagccagcccgagcccagccccgtgctgagccagctgagccagagacagcagcaccagagccaggccgtgaccgtgcccccccccggcctggagagcttccccagccaggccaagctgagagagagcacccccggcgacagccccagcaccgtgaacaagctgctgcagctgcccagcaccaccatcgagaacatcagcgtgagcgtgcaccagccccagcccaagcacatcaagctggccaagagaagaatcccccccgccagcaagatccccgccagcgccgtggagatgcccggcagcgccgacgtgaccggcctgaacgtgcagttcggcgccctggagttcggcagcgagcccagcctgagcgagttcggcagcgcccccagcagcgagaacagcaaccagatccccatcagcctgtacagcaagagcctgagcgagcccctgaacaccagcctgagcatgaccagcgccgtgcagaacagcacctacaccaccagcgtgatcaccagctgcagcctgaccagcagcagcctgaacagcgccagccccgtggccatgagcagcagctacgaccagagcagcgtgcacaacagaatcccctaccagagccccgtgagcagcagcgagagcgcccccggcaccatcatgaacggccacggcggcggcagaagccagcagaccctggacacccccaagaccaccggcccccccagcgccctgcccagcgtgagcagcctgcccagcaccaccagctgcaccgccctgctgcccagcaccagccagcacaccggcgacctgaccagcagccccctgagccagctgagcagcagcctgagcagccaccagagcagcctgagcgcccacgccgccctgagcagcagcaccagccacacccacgccagcgtggagagcgccagcagccaccagagcagcgccaccttcagcaccgccgccaccagcgtgagcagcagcgccagcagcggcgccagcctgagcagcagcatgaacaccgccaacagcctgtgcctgggcggcacccccgccagcgccagcagcagcagcagcagagccgcccccctggtgaccagcggcaaggccccccccaacctgccccagggcgtgccccccctgctgcacaaccagtacctggtgggccccggcggcctgctgcccgcctaccccatctacggctacgacgagctgcagatgctgcagagcagactgcccgtggactactacggcatccccttcgccgcccccaccgccctggccagcagagacggcagcctggccaacaacccctaccccggcgacgtgaccaagttcggcagaggcgacagcgccagccccgcccccgccaccacccccgcccagccccagcagagccagagccagacccaccacaccgcccagcagcccttcgtgaaccccgccctgccccccggctacagctacaccggcctgccctactacaccggcatgcccagcgccttccagtacggccccaccatgttcgtgccccccgccagcgccaagcagcacggcgtgaacctgagcacccccaccccccccttccagcaggccagcggctacggccagcacggctacagcaccggctacgacgacctgacccagggcaccgccgccggcgactacagcaagggcggctacgccggcagcagccaggcccccaacaagagcgccggcagcggccccggcaagggcgtgagcgtgagcagcagcaccaccggcctgcccgacatgaccggcagcgtgtacaacaagacccagaccttcgacaagcagggcttccacgccggcacccccccccccttcagcctgcccagcgtgctgggcagcaccggccccctggccagcggcgccgcccccggctacgcccccccccccttcctgcacatcctgcccgcccaccagcagccccacagccagctgctgcaccaccacctgccccaggacgcccagagcggcagcggccagagaagccagcccagcagcctgcagcccaagagccaggccagcaagcccgcctacggcaacagcccctactggaccaactag

SEQ ID NO: 25500 - DNA, 978 bp, Artificial Sequence
  Description of Artificial Sequence: Synthetic coding sequence
atggccaacatcaccagcagccagatcctggaccagctgaaggcccccagcctgggccagttcaccaccacccccagcacccagcagaacagcaccagccaccccaccaccaccaccagctgggacctgaagccccccaccagccagagcagcgtgctgagccacctggacttcaagagccagcccgagcccagccccgtgctgagccagctgagccagagacagcagcaccagagccaggccgtgaccgtgcccccccccggcctggagagcttccccagccaggccaagctgagagagagcacccccggcgacagccccagcaccgtgaacaagctgctgcagctgcccagcaccaccatcgagaacatcagcgtgagcgtgcaccagccccagcccaagcacatcaagctggccaagagaagaatcccccccgccagcaagatccccgccagcgccgtggagatgcccggcagcgccgacgtgaccggcctgaacgtgcagttcggcgccctggagttcggcagcgagcccagcctgagcgagttcggcagcgcccccagcagcgagaacagcaaccagatccccatcagcctgtacagcaagagcctgagcgagcccctgaacaccagcctgagcatgaccagcgccgtgcagaacagcacctacaccaccagcgtgatcaccagctgcagcctgaccagcagcagcctgaacagcgccagccccgtggccatgagcagcagctacgaccagagcagcgtgcacaacagaatcccctaccagagccccgtgagcagcagcgagagcgcccccggcaccatcatgaacggccacggcggcggcagaagccagcagaccctggacagcaagtacagcagcaagctgctgctgagctggctggtgcccaccaagcagagaaagagaatcgcccacgtgatgtggaagacccccgtgggccagtggctgatcagatag

SEQ ID NO: 25501 - DNA, 1077 bp, Artificial Sequence
  Description of Artificial Sequence: Synthetic coding sequence
atgaacaccgccaacagcctgtgcctgggcggcacccccgccagcgccagcagcagcagcagcagagccgcccccctggtgaccagcggcaaggccccccccaacctgccccagggcgtgccccccctgctgcacaaccagtacctggtgggccccggcggcctgctgcccgcctaccccatctacggctacgacgagctgcagatgctgcagagcagactgcccgtggactactacggcatccccttcgccgcccccaccgccctggccagcagagacggcagcctggccaacaacccctaccccggcgacgtgaccaagttcggcagaggcgacagcgccagccccgcccccgccaccacccccgcccagccccagcagagccagagccagacccaccacaccgcccagcagcccttcgtgaaccccgccctgccccccggctacagctacaccggcctgccctactacaccggcatgcccagcgccttccagtacggccccaccatgttcgtgccccccgccagcgccaagcagcacggcgtgaacctgagcacccccaccccccccttccagcaggccagcggctacggccagcacggctacagcaccggctacgacgacctgacccagggcaccgccgccggcgactacagcaagggcggctacgccggcagcagccaggcccccaacaagagcgccggcagcggccccggcaagggcgtgagcgtgagcagcagcaccaccggcctgcccgacatgaccggcagcgtgtacaacaagacccagaccttcgacaagcagggcttccacgccggcacccccccccccttcagcctgcccagcgtgctgggcagcaccggccccctggccagcggcgccgcccccggctacgcccccccccccttcctgcacatcctgcccgcccaccagcagccccacagccagctgctgcaccaccacctgccccaggacgcccagagcggcagcggccagagaagccagcccagcagcctgcagcccaagagccaggccagcaagcccgcctacggcaacagcccctactggaccaactag

SEQ ID NO: 25502 - DNA, 3360 bp, Artificial Sequence; identical to SEQ ID NO: 25499
  Description of Artificial Sequence: Synthetic coding sequence

SEQ ID NO: 25503 - DNA, 2559 bp, Artificial Sequence
  Description of Artificial Sequence: Synthetic coding sequence
atggacagcaagggcctgggcagaatcctgtggaagagcggccagcagaagaccggcctgaagatcatcgacctggtggccctgctgcagaagcccgtgccccacagccaggccagcgaggccaacagcttcgagaccagccagcagcagggcttcggccaggccctggtgttcaccaacagccagcacaacaaccagatggcccccggcaccggcagcagcaccgccgtgaacagctgcagcccccagagcctgagcagcgtgctgggcagcggcttcggcgagctggccccccccaagatggccaacatcaccagcagccagatcctggaccagctgaaggcccccagcctgggccagttcaccaccacccccagcacccagcagaacagcaccagccaccccaccaccaccaccagctgggacctgaagccccccaccagccagagcagcgtgctgagccacctggacttcaagagccagcccgagcccagccccgtgctgagccagctgagccagagacagcagcaccagagccaggccgtgaccgtgcccccccccggcctggagagcttccccagccaggccaagctgagagagagcacccccggcgacagccccagcaccgtgaacaagctgctgcagctgcccagcaccaccatcgagaacatcagcgtgagcgtgcaccagccccagcccaagcacatcaagctggccaagagaagaatcccccccgccagcaagatccccgccagcgccgtggagatgcccggcagcgccgacgtgaccggcctgaacgtgcagttcggcgccctggagttcggcagcgagcccagcctgagcgagttcggcagcgcccccagcagcgagaacagcaaccagatccccatcagcctgtacagcaagagcctgagcgagcccctgaacaccagcctgagcatgaccagcgccgtgcagaacagcacctacaccaccagcgtgatcaccagctgcagcctgaccagcagcagcctgaacagcgccagccccgtggccatgagcagcagctacgaccagagcagcgtgcacaacagaatcccctaccagagccccgtgagcagcagcgagagcgcccccggcaccatcatgaacggccacggcggcggcagaagccagcagaccctggacacccccaagaccaccggcccccccagcgccctgcccagcgtgagcagcctgcccagcaccaccagctgcaccgccctgctgcccagcaccagccagcacaccggcgacctgaccagcagccccctgagccagctgagcagcagcctgagcagccaccagagcagcctgagcgcccacgccgccctgagcagcagcaccagccacacccacgccagcgtggagagcgccagcagccaccagagcagcgccaccttcagcaccgccgccaccagcgtgagcagcagcgccagcagcggcgccagcctgagcagcagcatgaacaccgccaacagcctgtgcctgggcggcacccccgccagcgccagcagcagcagcagcagagccgcccccctggtgaccagcggcaaggccccccccaacctgccccagggcgtgccccccctgctgcacaaccagtacctggtgggccccggcggcctgctgcccgcctaccccatctacggctacgacgagctgcagatgctgcagagcagactgcccgtggactactacggcatccccttcgccgcccccaccgccctggccagcagagacggcagcctggccaacaacccctaccccggcgacgtgaccaagttcggcagaggcgacagcgccagccccgcccccgccaccacccccgcccagccccagcagagccagagccagacccaccacaccgcccagcagcccttcgtgaaccccgccctgccccccggctacagctacaccggcctgccctactacaccggcatgcccagcgccttccagtacggccccaccatgttcgtgccccccgccagcgccaagcagcacggcgtgaacctgagcacccccaccccccccttccagcaggccagcggctacggccagcacggctacagcaccggctacgacgacctgacccagggcaccgccgccggcgactacagcaagggcggctacgccggcagcagccaggcccccaacaagagcgccggcagcggccccggcaagggcgtgagcgtgagcagcagcaccaccggcctgcccgacatgaccggcagcgtgtacaacaagacccagaccttcgacaagcagggcttccacgccggcacccccccccccttcagcctgcccagcgtgctgggcagcaccggccccctggccagcggcgccgcccccggctacgcccccccccccttcctgcacatcctgcccgcccaccagcagccccacagccagctgctgcaccaccacctgccccaggacgcccagagcggcagcggccagagaagccagcccagcagcctgcagcccaagagccaggccagcaagcccgcctacggcaacagcccctactggaccaactag

SEQ ID NO: 25504 - DNA, 1023 bp, Artificial Sequence
  Description of Artificial Sequence: Synthetic coding sequence
atggaggtgaccggcaagaaccaggacgagtgcatcgtggccctgcacgactgcaacggcgacgtgaacaaggccatcaacatcctgctggagggcaacagcgacaccaccagctgggagaccgtgggctgcaagaagaagaacttcgccaaggagaacagcgagaacaaggagaacagagagaagaagagcgagaaggagagcagcagaggcagaggcaacaacaacagaaagggcagaggcggcaacagaggcagagagttcagaggcgaggagaacggcatcgactgcaaccaggtggacaagcccagcgacagaggcaagagagccagaggcagaggcttcggcagaggcagaggcagaggcgccggcagattcagcacccagggcatgggcaccttcaaccccgccgactacagcgacagcaccagcaccgacgtgtgcggcaccaagctggtggtgtgggaggccgcccagaacggcgccgacgagggcaccggcgcctggaagaacagcgtggaggagtggaccaccgaggactggaccgaggacctgagcgagaccaaggtgttcaccgccagcagcgcccccgccgagaaccacatcctgcccggccagagcatcgacctggtggccctgctgcagaagcccgtgccccacagccaggccagcgaggccaacagcttcgagaccagccagcagcagggcttcggccaggccctggtgttcaccaacagccagcacaacaaccagatggcccccggcaccggcagcagcaccgccgtgaacagctgcagcccccagagcctgagcagcgtgctgggcagcggcttcggcgagctggccccccccaagatggccaacatcaccagcagccagatcctggaccagctgaaggcccccagcctgggccagttcaccaccacccccagcacccagcagaacagcaccagccaccccaccaccaccaccagctgggacctgaagccccccaccagccagagcagcgtgctgagccactag

SEQ ID NO: 25505 - DNA, 1239 bp, Artificial Sequence
  Description of Artificial Sequence: Synthetic coding sequence
atgatgaccagcgtgagcagcgaccactgcagaggcgccagagagaagccccagatcagcgccgcccagagcacccagccccagaagcaggtggtgcaggccaccgccgagcagatgagactggcccaggtgatcttcgacaagaacgacagcgacttcgaggccaaggtgaagcagctgatggaggtgaccggcaagaaccaggacgagtgcatcgtggccctgcacgactgcaacggcgacgtgaacaaggccatcaacatcctgctggagggcaacagcgacaccaccagctgggagaccgtgggctgcaagaagaagaacttcgccaaggagaacagcgagaacaaggagaacagagagaagaagagcgagaaggagagcagcagaggcagaggcaacaacaacagaaagggcagaggcggcaacagaggcagagagttcagaggcgaggagaacggcatcgactgcaaccaggtggacaagcccagcgacagaggcaagagagccagaggcagagagctggccagcaacacccacaacatcgcccaggacctgagcaacaagagcagctacggcctgaagggcgcctggaagaacagcgtggaggagtggaccaccgaggactggaccgaggacctgagcgagaccaaggtgttcaccgccagcagcgcccccgccgagaaccacatcctgcccggccagagcatcgacctggtggccctgctgcagaagcccgtgccccacagccaggccagcgaggccaacagcttcgagaccagccagcagcagggcttcggccaggccctggtgttcaccaacagccagcacaacaaccagatggcccccggcaccggcagcagcaccgccgtgaacagctgcagcccccagagcctgagcagcgtgctgggcagcggcttcggcgagctggccccccccaagatggccaacatcaccagcagccagatcctggaccagctgaaggcccccagcctgggccagttcaccaccacccccagcacccagcagaacagcaccagccaccccaccaccaccaccagctgggacctgaagccccccaccagccagagcagcgtgctgagccacctggacttcaagagccagcccgagcccagccccgtgctgagccagctgagccagagacagcagcaccagagccaggccgtgaccgtgcccccccccggcctggagagcttccccagccaggccaagctgtag

SEQ ID NO: 25506 - DNA, 2061 bp, Artificial Sequence
  Description of Artificial Sequence: Synthetic coding sequence
atgatgaccagcgtgagcagcgaccactgcagaggcgccagagagaagccccagatcagcgccgcccagagcacccagccccagaagcaggtggtgcaggccaccgccgagcagatgagactggcccaggtgatcttcgacaagaacgacagcgacttcgaggccaaggtgaagcagctgatggaggtgaccggcaagaaccaggacgagtgcatcgtggccctgcacgactgcaacggcgacgtgaacaaggccatcaacatcctgctggagggcaacagcgacaccaccagctgggagaccgtgggctgcaagaagaagaacttcgccaaggagaacagcgagaacaaggagaacagagagaagaagagcgagaaggagagcagcagaggcagaggcaacaacaacagaaagggcagaggcggcaacagaggcagagagttcagaggcgaggagaacggcatcgactgcaaccaggtggacaagcccagcgacagaggcaagagagccagaggcagagagctggccagcaacacccacaacatcgcccaggacctgagcaacaagagcagctacggcctgaagggcgcctggaagaacagcgtggaggagtggaccaccgaggactggaccgaggacctgagcgagaccaaggtgttcaccgccagcagcgcccccgccgagaaccacatcctgcccggccagagcatcgacctggtggccctgctgcagaagcccgtgccccacagccaggccagcgaggccaacagcttcgagaccagccagcagcagggcttcggccaggccctggtgttcaccaacagccagcacaacaaccagatggcccccggcaccggcagcagcaccgccgtgaacagctgcagcccccagagcctgagcagcgtgctgggcagcggcttcggcgagctggccccccccaagatggccaacatcaccagcagccagatcctggaccagctgaaggcccccagcctgggccagttcaccaccacccccagcacccagcagaacagcaccagccaccccaccaccaccaccagctgggacctgaagccccccaccagccagagcagcgtgctgagccacctggacttcaagagccagcccgagcccagccccgtgctgagccagctgagccagagacagcagcaccagagccaggccgtgaccgtgcccccccccggcctggagagcttccccagccaggccaagctgagagagagcacccccggcgacagccccagcaccgtgaacaagctgctgcagctgcccagcaccaccatcgagaacatcagcgtgagcgtgcaccagccccagcccaagcacatcaagctggccaagagaagaatcccccccgccagcaagatccccgccagcgccgtggagatgcccggcagcgccgacgtgaccggcctgaacgtgcagttcggcgccctggagttcggcagcgagcccagcctgagcgagttcggcagcgcccccagcagcgagaacagcaaccagatccccatcagcctgtacagcaagagcctgagcgagcccctgaacaccagcctgagcatgaccagcgccgtgcagaacagcacctacaccaccagcgtgatcaccagctgcagcctgaccagcagcagcctgaacagcgccagccccgtggccatgagcagcagctacgaccagagcagcgtgcacaacagaatcccctaccagagccccgtgagcagcagcgagagcgcccccggcaccatcatgaacggccacggcggcggcagaagccagcagaccctggacacccccaagaccaccggcccccccagcgccctgcccagcgtgagcagcctgcccagcaccaccagctgcaccgccctgctgcccagcaccagccagcacaccggcgacctgaccagcagccccctgagccagctgagcagcatgcccgtgtggagagcccccctgcccaccagcccccagccccccagccccagacagagaccccccagccaggtgccccacccccaggcccccgcctgccccgtggcctag

SEQ ID NO: 25507 - DNA, 831 bp, Artificial Sequence
  Description of Artificial Sequence: Synthetic coding sequence
gagaaggagagcagcagaggcagaggcaacaacaacagaaagggcagaggcggcaacagaggcagagagttcagaggcgaggagaacggcatcgactgcaaccaggtggacaagcccagcgacagaggcaagagagccagaggcagaggcttcggcagaggcagaggcagaggcgccggcagattcagcacccagggcatgggcaccttcaaccccgccgactacagcgacagcaccagcaccgacgtgtgcggcaccaagctggtggtgtgggaggccgcccagaacggcgccgacgagggcaccggcgcctggaagaacagcgtggaggagtggaccaccgaggactggaccgaggacctgagcgagaccaaggtgttcaccgccagcagcgcccccgccgagaaccacatcctgcccggccagagcatcgacctggtggccctgctgcagaagcccgtgccccacagccaggccagcgaggccaacagcttcgagaccagccagcagcagggcttcggccaggccctggtgttcaccaacagccagcacaacaaccagatggcccccggcaccggcagcagcaccgccgtgaacagctgcagcccccagagcctgagcagcgtgctgggcagcggcttcggcgagctggccccccccaagatggccaacatcaccagcagccagatcctggaccagctgaaggcccccagcctgggccagttcaccaccacccccagcacccagcagaacagcaccagccaccccaccaccaccaccagctgggacctgaagccccccaccagccagagcagcgtgctgagccactag

SEQ ID NO: 25508 - DNA, 3087 bp, Artificial Sequence
  Description of Artificial Sequence: Synthetic coding sequence
atgagactggcccaggtgatcttcgacaagaacgacagcgacttcgaggccaaggtgaagcagctgatggaggtgaccggcaagaaccaggacgagtgcatcgtggccctgcacgactgcaacggcgacgtgaacaaggccatcaacatcctgctggagggcaacagcgacaccaccagctgggagaccgtgggctgcaagaagaagaacttcgccaaggagaacagcgagaacaaggagaacagagagaagaagagcgagaaggagagcagcagaggcagaggcaacaacaacagaaagggcagaggcggcaacagaggcagagagttcagaggcgaggagaacggcatcgactgcaaccaggtggacaagcccagcgacagaggcaagagagccagaggcagagagctggccagcaacacccacaacatcgcccaggacctgagcaacaagagcagctacggcctgaagggcgcctggaagaacagcgtggaggagtggaccaccgaggactggaccgaggacctgagcgagaccaaggtgttcaccgccagcagcgcccccgccgagaaccacatcctgcccggccagagcatcgacctggtggccctgctgcagaagcccgtgccccacagccaggccagcgaggccaacagcttcgagaccagccagcagcagggcttcggccaggccctggtgttcaccaacagccagcacaacaaccagatggcccccggcaccggcagcagcaccgccgtgaacagctgcagcccccagagcctgagcagcgtgctgggcagcggcttcggcgagctggccccccccaagatggccaacatcaccagcagccagatcctggaccagctgaaggcccccagcctgggccagttcaccaccacccccagcacccagcagaacagcaccagccaccccaccaccaccaccagctgggacctgaagccccccaccagccagagcagcgtgctgagccacctggacttcaagagccagcccgagcccagccccgtgctgagccagctgagccagagacagcagcaccagagccaggccgtgaccgtgcccccccccggcctggagagcttccccagccaggccaagctgagagagagcacccccggcgacagccccagcaccgtgaacaagctgctgcagctgcccagcaccaccatcgagaacatcagcgtgagcgtgcaccagccccagcccaagcacatcaagctggccaagagaagaatcccccccgccagcaagatccccgccagcgccgtggagatgcccggcagcgccgacgtgaccggcctgaacgtgcagttcggcgccctggagttcggcagcgagcccagcctgagcgagttcggcagcgcccccagcagcgagaacagcaaccagatccccatcagcctgtacagcaagagcctgagcgagcccctgaacaccagcctgagcatgaccagcgccgtgcagaacagcacctacaccaccagcgtgatcaccagctgcagcctgaccagcagcagcctgaacagcgccagccccgtggccatgagcagcagctacgaccagagcagcgtgcacaacagaatcccctaccagagccccgtgagcagcagcgagagcgcccccggcaccatcatgaacggccacggcggcggcagaagccagcagaccctggacacccccaagaccaccggcccccccagcgccctgcccagcgtgagcagcctgcccagcaccaccagctgcaccgccctgctgcccagcaccagccagcacaccggcgacctgaccagcagccccctgagccagctgagcagcagcctgagcagccaccagagcagcctgagcgcccacgccgccctgagcagcagcaccagccacacccacgccagcgtggagagcgccagcagccaccagagcagcgccaccttcagcaccgccgccaccagcgtgagcagcagcgccagcagcggcgccagcctgagcagcagcatgaacaccgccaacagcctgtgcctgggcggcacccccgccagcgccagcagcagcagcagcagagccgcccccctggtgaccagcggcaaggccccccccaacctgccccagggcgtgccccccctgctgcacaaccagtacctggtgggccccggcggcctgctgcccgcctaccccatctacggctacgacgagctgcagatgctgcagagcagactgcccgtggactactacggcatccccttcgccgcccccaccgccctggccagcagagacggcagcctggccaacaacccctaccccggcgacgtgaccaagttcggcagaggcgacagcgccagccccgcccccgccaccacccccgcccagccccagcagagccagagccagacccaccacaccgcccagcagcccttcgtgaaccccgccctgccccccggctacagctacaccggcctgccctactacaccggcatgcccagcgccttccagtacggccccaccatgttcgtgccccccgccagcgccaagcagcacggcgtgaacctgagcacccccaccccccccttccagcaggccagcggctacggccagcacggctacagcaccggctacgacgacctgacccagggcaccgccgccggcgactacagcaagggcggctacgccggcagcagccaggcccccaacaagagcgccggcagcggccccggcaagggcgtgagcgtgagcagcagcaccaccggcctgcccgacatgaccggcagcgtgtacaacaagacccagaccttcgacaagcagggcttccacgccggcacccccccccccttcagcctgcccagcgtgctgggcagcaccggccccctggccagcggcgccgcccccggctacgcccccccccccttcctgcacatcctgcccgcccaccagcagccccacagccagctgctgcaccaccacctgccccaggacgcccagagcggcagcggccagagaagccagcccagcagcctgcagcccaagagccaggccagcaagcccgcctacggcaacagcccctactggaccaactag

SEQ ID NO: 25509 - DNA, 3360 bp, Artificial Sequence; identical to SEQ ID NO: 25499
  Description of Artificial Sequence: Synthetic coding sequence

SEQ ID NO: 25510 - DNA, 2625 bp, Artificial Sequence
  Description of Artificial Sequence: Synthetic coding sequence
atgagactggcccaggtgatcttcgacaagaacgacagcgacttcgaggccaaggtgaagcagctgagcgagaccaaggtgttcaccgccagcagcgcccccgccgagaaccacatcctgcccggccagagcatcgacctggtggccctgctgcagaagcccgtgccccacagccaggccagcgaggccaacagcttcgagaccagccagcagcagggcttcggccaggccctggtgttcaccaacagccagcacaacaaccagatggcccccggcaccggcagcagcaccgccgtgaacagctgcagcccccagagcctgagcagcgtgctgggcagcggcttcggcgagctggccccccccaagatggccaacatcaccagcagccagatcctggaccagctgaaggcccccagcctgggccagttcaccaccacccccagcacccagcagaacagcaccagccaccccaccaccaccaccagctgggacctgaagccccccaccagccagagcagcgtgctgagccacctggacttcaagagccagcccgagcccagccccgtgctgagccagctgagccagagacagcagcaccagagccaggccgtgaccgtgcccccccccggcctggagagcttccccagccaggccaagctgagagagagcacccccggcgacagccccagcaccgtgaacaagctgctgcagctgcccagcaccaccatcgagaacatcagcgtgagcgtgcaccagccccagcccaagcacatcaagctggccaagagaagaatcccccccgccagcaagatccccgccagcgccgtggagatgcccggcagcgccgacgtgaccggcctgaacgtgcagttcggcgccctggagttcggcagcgagcccagcctgagcgagttcggcagcgcccccagcagcgagaacagcaaccagatccccatcagcctgtacagcaagagcctgagcgagcccctgaacaccagcctgagcatgaccagcgccgtgcagaacagcacctacaccaccagcgtgatcaccagctgcagcctgaccagcagcagcctgaacagcgccagccccgtggccatgagcagcagctacgaccagagcagcgtgcacaacagaatcccctaccagagccccgtgagcagcagcgagagcgcccccggcaccatcatgaacggccacggcggcggcagaagccagcagaccctggacacccccaagaccaccggcccccccagcgccctgcccagcgtgagcagcctgcccagcaccaccagctgcaccgccctgctgcccagcaccagccagcacaccggcgacctgaccagcagccccctgagccagctgagcagcagcctgagcagccaccagagcagcctgagcgcccacgccgccctgagcagcagcaccagccacacccacgccagcgtggagagcgccagcagccaccagagcagcgccaccttcagcaccgccgccaccagcgtgagcagcagcgccagcagcggcgccagcctgagcagcagcatgaacaccgccaacagcctgtgcctgggcggcacccccgccagcgccagcagcagcagcagcagagccgcccccctggtgaccagcggcaaggccccccccaacctgccccagggcgtgccccccctgctgcacaaccagtacctggtgggccccggcggcctgctgcccgcctaccccatctacggctacgacgagctgcagatgctgcagagcagactgcccgtggactactacggcatccccttcgccgcccccaccgccctggccagcagagacggcagcctggccaacaacccctaccccggcgacgtgaccaagttcggcagaggcgacagcgccagccccgcccccgccaccacccccgcccagccccagcagagccagagccagacccaccacaccgcccagcagcccttcgtgaaccccgccctgccccccggctacagctacaccggcctgccctactacaccggcatgcccagcgccttccagtacggccccaccatgttcgtgccccccgccagcgccaagcagcacggcgtgaacctgagcacccccaccccccccttccagcaggccagcggctacggccagcacggctacagcaccggctacgacgacctgacccagggcaccgccgccggcgactacagcaagggcggctacgccggcagcagccaggcccccaacaagagcgccggcagcggccccggcaagggcgtgagcgtgagcagcagcaccaccggcctgcccgacatgaccggcagcgtgtacaacaagacccagaccttcgacaagcagggcttccacgccggcacccccccccccttcagcctgcccagcgtgctgggcagcaccggccccctggccagcggcgccgcccccggctacgcccccccccccttcctgcacatcctgcccgcccaccagcagccccacagccagctgctgcaccaccacctgccccaggacgcccagagcggcagcggccagagaagccagcccagcagcctgcagcccaagagccaggccagcaagcccgcctacggcaacagcccctactggaccaactag

SEQ ID NO: 25511 - DNA, 1593 bp, Artificial Sequence
  Description of Artificial Sequence: Synthetic coding sequence
atggaggacgacagcctgtacctgggcggcgagtggcagttcaaccacttcagcaagctgaccagcagcagacccgacgccgccttcgccgagatccagagaaccagcctgcccgagaagagccccctgagctgcgagaccagagtggacctgtgcgacgacctggcccccgtggccagacagctggcccccagagagaagctgcccctgagcagcagaagacccgccgccgtgggcgccggcctgcagaacatgggcaacacctgctacgtgaacgccagcctgcagtgcctgacctacaccccccccctggccaactacatgctgagcagagagcacagccagacctgccacagacacaagggctgcatgctgtgcaccatgcaggcccacatcaccagagccctgcacaaccccggccacgtgatccagcccagccaggccctggccgccggcttccacagaggcaagcaggaggacgcccacgagttcctgatgttcaccgtggacgccatgaagaaggcctgcctgcccggccacaagcaggtggaccaccccagcaaggacaccaccctgatccaccagatcttcggcggctactggagaagccagatcaagtgcctgcactgccacggcatcagcgacaccttcgacccctacctggacatcgccctggacatccaggccgcccagagcgtgcagcaggccctggagcagctggtgaagcccgaggagctgaacggcgagaacgcctaccactgcggcgtgtgcctgcagagagcccccgccagcaagaccctgaccctgcacaccagcgccaaggtgctgatcctggtgctgaagagattcagcgacgtgaccggcaacaagatcgccaagaacgtgcagtaccccgagtgcctggacatgcagccctacatgagccagcagaacaccggccccctggtgtacgtgctgtacgccgtgctggtgcacgccggctggagctgccacaacggccactacttcagctacgtgaaggcccaggagggccagtggtacaagatggacgacgccgaggtgaccgccgccagcatcaccagcgtgctgagccagcaggcctacgtgctgttctacatccagaagagcgagtgggagagacacagcgagagcgtgagcagaggcagagagcccagagccctgggcgccgaggacaccgacagaagagccacccagggcgagctgaagagagaccacccctgcctgcaggcccccgagctggacgagcacctggtggagagagccacccaggagagcaccctggacagatggaagttcctgcaggagcagaacaagaccaagcccgagttcaacgtgagaaaggtggagggcaccctgccccccgacgtgctggtgatccaccagagcaagtacaagtgcggcatgaagaaccaccaccccgagcagcagagcagcctgctgaacctgagcagcagcacccccacccaccaggagagcatgaacaccggcaccctggccagcctgagaggcagagccagaagaagcaagggcaagaacaagcacagcaagagagccctgctggtgtgccagtag

SEQ ID NO: 25512 - DNA, 684 bp, Artificial Sequence
  Description of Artificial Sequence: Synthetic coding sequence
atgggcaactgcgtgggcagacagagaagagagagacccgccgcccccggccaccccagaaagagagccggcagaaacgagcccctgaagaaggagagactgaagtggaagagcgactaccccatgaccgacggccagctgagaagcaagagagacgagttctgggacaccgcccccgccttcgagggcagaaaggagatctgggacgccctgaaggccgccgcctacgccgccgaggccaacgaccacgagctggcccaggccatcctggacggcgccagcatcaccctgccccacggcaccctgtgcgagtgctacgacgagctgggcaacagataccagctgcccatctactgcctgagcccccccgtgaacctgctgctggagcacaccgaggaggagagcctggagccccccgagcccccccccagcgtgagaagagagttccccctgaaggtgagactgagcaccggcaaggacgtgagactgagcgccagcctgcccgacaccgtgggccagctgaagagacagctgcacgcccaggagggcatcgagcccagctggcagagatggttcttcagcggcaagctgctgaccgacagaaccagactgcaggagaccaagatccagaaggacttcgtgatccaggtgatcatcaaccagcccccccccccccaggactag

SEQ ID NO: 25513 - DNA, 3261 bp, Artificial Sequence
  Description of Artificial Sequence: Synthetic coding sequence
atggccaccgtgggcgagtggagctgcgtgagatgcaccttcctgaaccccgccggccagagacagtgcagcatctgcgaggcccccagacacaagcccgacctgaaccacatcctgagactgagcgtggaggagcagaagtggccctgcgccagatgcaccttcagaaacttcctgggcaaggaggcctgcgaggtgtgcggcttcacccccgagcccgcccccggcgccgccttcctgcccgtgctgaacggcgtgctgcccaagccccccgccatcctgggcgagcccaagggcagctgccaggaggaggccggccccgtgagaaccgccggcctggtggccaccgagcccgccagaggccagtgcgaggacaaggacgaggaggagaaggaggagcaggaggaggaggagggcgccgccgagcccagaggcggctgggcctgccccagatgcaccctgcacaacacccccgtggccagcagctgcagcgtgtgcggcggccccagaagactgagcctgcccagaatcccccccgaggccctggtggtgcccgaggtggtggcccccgccggcttccacgtggtgcccgccgcccccccccccggcctgcccggcgagggcgccgaggccaacccccccgccaccagccagggccccgccgccgagcccgagccccccagagtgccccccttcagccccttcagcagcaccctgcagaacaaccccgtgcccagaagcagaagagaggtgcccccccagctgcagccccccgtgcccgaggccgcccagcccagccccagcgccggctgcagaggcgccccccagggcagcggctgggccggcgccagcagactggccgagctgctgagcggcaagagactgagcgtgctggaggaggaggccaccgagggcggcaccagcagagtggaggccggcagcagcaccagcggcagcgacatcatcgacctggccggcgacaccgtgagatacacccccgccagccccagcagccccgacttcaccacctggagctgcgccaagtgcaccctgagaaaccccaccgtggcccccagatgcagcgcctgcggctgcagcaagctgcacggcttccaggagcacggcgagccccccacccactgccccgactgcggcgccgacaagcccagcccctgcggcagaagctgcggcagagtgagcagcgcccagaaggccgccagagtgctgcccgagagacccggccagtgggcctgccccgcctgcaccctgctgaacgccctgagagccaagcactgcgccgcctgccacaccccccagctgctggtggcccagagaagaggcgccgcccccctgagaagaagagagagcatgcacgtggagcagagaagacagaccgacgagggcgaggccaaggccctgtgggagaacatcgtggccttctgcagagagaacaacgtgagcttcgtggacgacagcttcccccccggccccgagagcgtgggcttccccgccggcgacagcgtgcagcagagagtgagacagtggctgagaccccaggagatcaactgcagcgtgttcagagaccacagagccacctggagcgtgttccacaccctgagacccagcgacatcctgcagggcctgctgggcaactgctggttcctgagcgccctggccgtgctggccgagagacccgacctggtggagagagtgatggtgaccagaagcctgtgcgccgagggcgcctaccaggtgagactgtgcaaggacggcacctggaccaccgtgctggtggacgacatgctgccctgcgacgaggccggctgcctgctgttcagccaggcccagagaaagcagctgtgggtggccctgatcgagaaggccctggccaagctgcacggcagctacttcgccctgcaggccggcagagccatcgagggcctggccaccctgaccggcgccccctgcgagagcctggccctgcagctgagcagcaccaaccccagagaggagcccgtggacaccgacctgatctgggccaagatgctgagcagcaaggaggccggcttcctgatgggcgccagctgcggcggcggcaacatgaaggtggacgacagcgcctacgagagcctgggcctgagacccagacacgcctacagcatcctggacgtgagagacgtgcagggcaccagactgctgagactgagaaacccctggggcagattcagctggaacggcagctggagcgacgagtggccccactggcccggccacctgagaggcgagctgatgccccacggcagcagcgagggcgtgttctggatggagtacggcgacttcgtgagatacttcgacagcgtggacatctgcaaggtgcacagcgactggcaggaggccagagtgcagggctgcttccccagcagcgccagcgcccccgtgggcgtgaccgccctgaccgtgctggagagagccagcctggagttcgccctgttccaggagggcagcagaagaagcgacgccgtggacagccacctgctggacctgtgcatcctggtgttcagagccaccttcggcagcggcggccacctgagcctgggcagactgctggcccacagcaagagagccgtgaagaagttcgtgagctgcgacgtgatgctggagcccggcgagtacgccgtggtgtgctgcgccttcaaccactggggcccccccctgcccggcacccccgccccccaggccagcagccccagcgccggcgtgcccagagccagccccgagccccccggccacgtgctggccgtgtacagcagcagactggtgatggtggagcccgtggaggcccagcccaccaccctggccgacgccatcatcctgctgaccgagagcagaggcgagagacacgagggcagagagggcatgacctgctactacctgacccacggctgggccggcctgatcgtggtggtggagaacagacaccccaaggcctacctgcacgtgcagtgcgactgcaccgacagcttcaacgtggtgagcaccagaggcagcctgagaacccaggacagcgtgccccccctgcacagacaggtgctggtgatcctgagccagctggagggcaacgccggcttcagcatcacccacagactggcccacagaaaggccgcccaggccttcctgagcgactggaccgccagcaagggcacccacagcccccccctgacccccgaggtggccggcctgcacggccccagacccctgtag

SEQ ID NO: 25514 - DNA, 930 bp, Artificial Sequence
  Description of Artificial Sequence: Synthetic coding sequence
atggccgccgccggcgcccccgacggcatggaggagcccggcatggacaccgaggccgagaccgtggccaccgaggcccccgccagacccgtgaactgcctggaggccgaggccgccgccggcgccgccgccgaggacagcggcgccgccagaggcagcctgcagcccgcccccgcccagccccccggcgaccccgccgcccaggccagcgtgagcaacggcgaggacgccggcggcggcgccggcagagagctggtggacctgaagatcatctggaacaagaccaagcacgacgtgaagttccccctggacagcaccggcagcgagctgaagcagaagatccacagcatcaccggcctgccccccgccatgcagaaggtgatgtacaagggcctggtgcccgaggacaagaccctgagagagatcaaggtgaccagcggcgccaagatcatggtggtgggcagcaccatcaacgacgtgctggccgtgaacacccccaaggacgccgcccagcaggacgccaaggccgaggagaacaagaaggagcccctgtgcagacagaagcagcacagaaaggtgctggacaagggcaagcccgaggacgtgatgcccagcgtgaagggcgcccaggagagactgcccaccgtgcccctgagcggcatgtacaacaagagcggcggcaaggtgagactgaccttcaagctggagcaggaccagctgtggatcggcaccaaggagagaaccgagaagctgcccatgggcagcatcaagaacgtggtgagcgagcccatcgagggccacgaggactaccacatgatggccttccagctgggccccaccgaggccagctactactgggtgtactgggtgcccacccagtacgtggacgccatcaaggacaccgtgctgggcaagtggcagtacttctag

SEQ ID NO: 25515 - DNA, 561 bp, Artificial Sequence
  Description of Artificial Sequence: Synthetic coding sequence
atgcagaaggtgatgtacaagggcctggtgcccgaggacaagaccctgagagagatcaaggtgaccagcggcgccaagatcatggtggtgggcagcaccatcaacgacgtgctggccgtgaacacccccaaggacgccgcccagcaggacgccaaggccgaggagaacaagaaggagcccctgtgcagacagaagcagcacagaaaggtgctggacaagggcaagcccgaggacgtgatgcccagcgtgaagggcgcccaggagagactgcccaccgtgcccctgagcggcatgtacaacaagagcggcggcaaggtgagactgaccttcaagctggagcaggaccagctgtggatcggcaccaaggagagaaccgagaagctgcccatgggcagcatcaagaacgtggtgagcgagcccatcgagggccacgaggactaccacatgatggccttccagctgggccccaccgaggccagctactactgggtgtactgggtgcccacccagtacgtggacgccatcaaggacaccgtgctgggcaagtggcagtacttctag

SEQ ID NO: 25516 - DNA, 2127 bp, Artificial Sequence
  Description of Artificial Sequence: Synthetic coding sequence
atgttcaccctgagccagaccagcagagcctggttcatcgacagagccagacaggccagagaggagagactggtgcagaaggagagagagagagccgccgtggtgatccaggcccacgtgagaagcttcctgtgcagaagcagactgcagagagacatcagaagagagatcgacgacttcttcaaggccgacgaccccgagagcaccaagagaagcgccctgtgcatcttcaagatcgccagaaagctgctgttcctgttcagaatcaaggaggacaacgagagattcgagaagctgtgcagaagcatcctgagcagcatggacgccgagaacgagcccaaggtgtggtacgtgagcctggcctgcagcaaggacctgaccctgctgtggatccagcagatcaagaacatcctgtggtactgctgcgacttcctgaagcagctgaagcccgagatcctgcaggacagcagactgatcaccctgtacctgaccatgctggtgaccttcaccgacaccagcacctggaagatcctgagaggcaagggcgagagcctgagacccgccatgaaccacatctgcgccaacatcatgggccacctgaaccagcacggcttctacagcgtgctgcagatcctgctgaccagaggcctggccagacccagaccctgcctgagcaagggcaccctgaccgccgccttcagcctggccctgagacccgtgatcgccgcccagttcagcgacaacctgatcagacccttcctgatccacatcatgagcgtgcccgccctggtgacccacctgagcaccgtgacccccgagagactgaccgtgctggagagccacgacatgctgagaaagttcatcatcttcctgagagaccaggacagatgcagagacgtgtgcgagagcctggagggctgccacaccctgtgcctgatgggcaacctgctgcacctgggcagcctgagccccagagtgctggaggaggagaccgacggcttcgtgagcctgctgacccagaccctgtgctactgcagaaagtacgtgagccagaagaagagcaacctgacccactggcaccccgtgctgggctggttcagccagagcgtggactacggcctgaacgagagcatgcacctgatcaccaagcagctgcagttcctgtggggcgtgcccctgatcagaatcttcttctgcgacatcctgagcaagaagctgctggagagccaggagcccgcccacgcccagcccgccagcccccagaacgtgctgcccgtgaagagcctgctgaagagagccttccagaagagcgccagcgtgagaaacatcctgagacccgtgggcggcaagagagtggacagcgccgaggtgcagaaggtgtgcaacatctgcgtgctgtaccagaccagcctgaccaccctgacccagatcagactgcagatcctgaccggcctgacctacctggacgacctgctgcccaagctgtgggccttcatctgcgagctgggcccccacggcggcctgaagctgttcctggagtgcctgaacaacgacaccgaggagagcaagcagctgctggccatgctgatgctgttctgcgactgcagcagacacctgatcaccatcctggacgacatcgaggtgtacgaggagcagatcagcttcaagctggaggagctggtgaccatcagcagcttcctgaacagcttcgtgttcaagatgatctgggacggcatcgtggagaacgccaagggcgagaccctggagctgttccagagcgtgcacggctggctgatggtgctgtacgagagagactgcagaagaagattcacccccgaggaccactggctgagaaaggacctgaagcccagcgtgctgttccaggagctggacagagacagaaagagagcccagctgatcctgcagtacatcccccacgtgatcccccacaagaacagagtgctgctgttcagaaccatggtgaccaaggagaaggagaagctgggcctggtggagaccagcagcgccagcccccacgtgacccacatcaccatcagaagaagcagaatgctggagagcctgttcgagtgcccctggcccctggtgatcaacgccgagagctgctag

SEQ ID NO: 25517 - DNA, 735 bp, Artificial Sequence
  Description of Artificial Sequence: Synthetic coding sequence
atgttcaccctgagccagaccagcagagcctggttcatcgacagagccagacaggccagagaggagagactggtgcagaaggagagagagagagccgccgtggtgatccaggcccacgtgagaagcttcctgtgcagaagcagactgcagagagacatcagaagagagatcgacgacttcttcaaggccgacgaccccgagagcaccaagagaagcgccctgtgcatcttcaagatcgccagaaagctgctgttcctgttcagaatcaaggaggacaacgagagattcgagaagctgtgcagaagcatcctgagcagcatggacgccgagaacgagcccaaggtgtggtacgtgagcctggcctgcagcaaggacctgaccctgctgtggatccagcagatcaagaacatcctgtggtactgctgcgacttcctgaagcagctgaagcccgagatcctgcaggacagcagactgatcaccctgtacctgaccatgctggtgaccttcaccgacaccagcacctggaagatcctgagaggcaagggcgagagcctgagacccgccatgaaccacatctgcgccaacatcatgggccacctgaaccagcacggcttctacagcgtgctgcagtgctgcgacggcctgttccccgacctggtgagctacgccccccacaacaaccccgtgagatggagcgtgggcagaagctggtacgactggcagctgagcagatag

SEQ ID NO: 25518 - DNA, 3207 bp, Artificial Sequence
  Description of Artificial Sequence: Synthetic coding sequence
atgttcaccctgagccagaccagcagagcctggttcatcgacagagccagacaggccagagaggagagactggtgcagaaggagagagagagagccgccgtggtgatccaggcccacgtgagaagcttcctgtgcagaagcagactgcagagagacatcagaagagagatcgacgacttcttcaaggccgacgaccccgagagcaccaagagaagcgccctgtgcatcttcaagatcgccagaaagctgctgttcctgttcagaatcaaggaggacaacgagagattcgagaagctgtgcagaagcatcctgagcagcatggacgccgagaacgagcccaaggtgtggtacgtgagcctggcctgcagcaaggacctgaccctgctgtggatccagcagatcaagaacatcctgtggtactgctgcgacttcctgaagcagctgaagcccgagatcctgcaggacagcagactgatcaccctgtacctgaccatgctggtgaccttcaccgacaccagcacctggaagatcctgagaggcaagggcgagagcctgagacccgccatgaaccacatctgcgccaacatcatgggccacctgaaccagcacggcttctacagcgtgctgcagatcctgctgaccagaggcctggccagacccagaccctgcctgagcaagggcaccctgaccgccgccttcagcctggccctgagacccgtgatcgccgcccagttcagcgacaacctgatcagacccttcctgatccacatcatgagcgtgcccgccctggtgacccacctgagcaccgtgacccccgagagactgaccgtgctggagagccacgacatgctgagaaagttcatcatcttcctgagagaccaggacagatgcagagacgtgtgcgagagcctggagggctgccacaccctgtgcctgatgggcaacctgctgcacctgggcagcctgagccccagagtgctggaggaggagaccgacggcttcgtgagcctgctgacccagaccctgtgctactgcagaaagtacgtgagccagaagaagagcaacctgacccactggcaccccgtgctgggctggttcagccagagcgtggactacggcctgaacgagagcatgcacctgatcaccaagcagctgcagttcctgtggggcgtgcccctgatcagaatcttcttctgcgacatcctgagcaagaagctgctggagagccaggagcccgcccacgcccagcccgccagcccccagaacgtgctgcccgtgaagagcctgctgaagagagccttccagaagagcgccagcgtgagaaacatcctgagacccgtgggcggcaagagagtggacagcgccgaggtgcagaaggtgtgcaacatctgcgtgctgtaccagaccagcctgaccaccctgacccagatcagactgcagatcctgaccggcctgacctacctggacgacctgctgcccaagctgtgggccttcatctgcgagctgggcccccacggcggcctgaagctgttcctggagtgcctgaacaacgacaccgaggagagcaagcagctgctggccatgctgatgctgttctgcgactgcagcagacacctgatcaccatcctggacgacatcgaggtgtacgaggagcagatcagcttcaagctggaggagctggtgaccatcagcagcttcctgaacagcttcgtgttcaagatgatctgggacggcatcgtggagaacgccaagggcgagaccctggagctgttccagagcgtgcacggctggctgatggtgctgtacgagagagactgcagaagaagattcacccccgaggaccactggctgagaaaggacctgaagcccagcgtgctgttccaggagctggacagagacagaaagagagcccagctgatcctgcagtacatcccccacgtgatcccccacaagaacagagtgctgctgttcagaaccatggtgaccaaggagaaggagaagctgggcctggtggagaccagcagcgccagcccccacgtgacccacatcaccatcagaagaagcagaatgctggaggacggctacgagcagctgagacagctgagccagcacgccatgaagggcgtgatcagagtgaagttcgtgaacgacctgggcgtggacgaggccggcatcgaccaggacggcgtgttcaaggagttcctggaggagatcatcaagagagtgttcgaccccgccctgaacctgttcaagaccaccagcggcgacgagagactgtaccccagccccaccagctacatccacgagaactacctgcagctgttcgagttcgtgggcaagatgctgggcaaggccgtgtacgagggcatcgtggtggacgtgcccttcgccagcttcttcctgagccagctgctgggccaccaccacagcgtgttctacagcagcgtggacgagctgcccagcctggacagcgagttctacaagaacctgaccagcatcaagagatacgacggcgacatcaccgacctgggcctgaccctgagctacgacgaggacgtgatgggccagctggtgtgccacgagctgatccccggcggcaagaccatccccgtgaccaacgagaacaagatcagctacatccacctgatggcccacttcagaatgcacacccagatcaagaaccagaccgccgccctgatcagcggcttcagaagcatcatcaagcccgagtggatcagaatgttcagcacccccgagctgcagagactgatcagcggcgacaacgccgagatcgacctggaggacctgaagaagcacaccgtgtactacggcggcttccacggcagccacagagtgatcatctggctgtgggacatcctggccagcgacttcacccccgacgagagagccatgttcctgaagttcgtgaccagctgcagcagaccccccctgctgggcttcgcctacctgaagccccccttcagcatcagatgcgtggaggtgagcgacgaccaggacaccggcgacaccctgggcagcgtgctgagaggcttcttcaccatcagaaagagagagcccggcggcagactgcccaccagcagcacctgcttcaacctgctgaagctgcccaactacagcaagaagagcgtgctgagagagaagctgagatacgccatcagcatgaacaccggcttcgagctgagctag

SEQ ID NO: 25519 - DNA, 3207 bp, Artificial Sequence; identical to SEQ ID NO: 25518
  Description of Artificial Sequence: Synthetic coding sequence

SEQ ID NO: 25520 - DNA, 456 bp, Artificial Sequence
  Description of Artificial Sequence: Synthetic coding sequence
atgttcagcacccccgagctgcagagactgatcagcggcgacaacgccgagatcgacctggaggacctgaagaagcacaccgtgtactacggcggcttccacggcagccacagagtgatcatctggctgtgggacatcctggccagcgacttcacccccgacgagagagccatgttcctgaagttcgtgaccagctgcagcagaccccccctgctgggcttcgcctacctgaagccccccttcagcatcagatgcgtggaggtgagcgacgaccagcagggcagacagctggaccccagcgagcccagcgaggagggccccaccgtgctgaccgccggcgagcccgccagccccagagagaccgcccacggcctgagccccctgagcgccgcccccttcagcttcctgccccagggcagagtgcccggcgtgggcgtgggcacctgctgcttctag

SEQ ID NO: 25521 - DNA, 735 bp, Artificial Sequence; identical to SEQ ID NO: 25517
  Description of Artificial Sequence: Synthetic coding sequence

SEQ ID NO: 25522 - DNA, 1017 bp, Artificial Sequence
  Description of Artificial Sequence: Synthetic coding sequence
atgaagggcgtgatcagagtgaagttcgtgaacgacctgggcgtggacgaggccggcatcgaccaggacggcgtgttcaaggagttcctggaggagatcatcaagagagtgttcgaccccgccctgaacctgttcaagaccaccagcggcgacgagagactgtaccccagccccaccagctacatccacgagaactacctgcagctgttcgagttcgtgggcaagatgctgggcaaggccgtgtacgagggcatcgtggtggacgtgcccttcgccagcttcttcctgagccagctgctgggccaccaccacagcgtgttctacagcagcgtggacgagctgcccagcctggacagcgagttctacaagaacctgaccagcatcaagagatacgacggcgacatcaccgacctgggcctgaccctgagctacgacgaggacgtgatgggccagctggtgtgccacgagctgatccccggcggcaagaccatccccgtgaccaacgagaacaagatcagctacatccacctgatggcccacttcagaatgcacacccagatcaagaaccagaccgccgccctgatcagcggcttcagaagcatcatcaagcccgagtggatcagaatgttcagcacccccgagctgcagagactgatcagcggcgacaacgccgagatcgacctggaggacctgaagaagcacaccgtgtactacggcggcttccacggcagccacagagtgatcatctggctgtgggacatcctggccagcgacttcacccccgacgagagagccatgttcctgaagttcgtgaccagctgcagcagaccccccctgctgggcttcgcctacctgaagccccccttcagcatcagatgcgtggaggtgagcgacgaccaggccgtgcacgtgcaggccagatgcttcatcagcagcctggccaagggcgagggcaagcccagcggcctgagaagcagcgtgtgcctgaagcccggccccctgtgggtgctgaagtag

SEQ ID NO: 25523 - DNA, 2619 bp, Artificial Sequence
  Description of Artificial Sequence: Synthetic coding sequence
atgttcaccctgagccagaccagcagagcctggttcatcgacagagccagacaggccagagaggagagactggtgcagaaggagagagagagagccgccgtggtgatccaggcccacgtgagaagcttcctgtgcagaagcagactgcagagagacatcagaagagagatcgacgacttcttcaaggccgacgaccccgagagcaccaagagaagcgccctgtgcatcttcaagatcgccagaaagctgctgttcctgttcagaatcaaggaggacaacgagagattcgagaagctgtgcagaagcatcctgagcagcatggacgccgagaacgagcccaaggtgtggtacgtgagcctggcctgcagcaaggacctgaccctgctgtggatccagcagatcaagaacatcctgtggtactgctgcgacttcctgaagcagctgaagcccgagatcctgcaggacagcagactgatcaccctgtacctgaccatgctggtgaccttcaccgacaccagcacctggaagatcctgagaggcaagggcgagagcctgagacccgccatgaaccacatctgcgccaacatcatgggccacctgaaccagcacggcttctacagcgtgctgcagatcctgctgaccagaggcctggccagacccagaccctgcctgagcaagggcaccctgaccgccgccttcagcctggccctgagacccgtgatcgccgcccagttcagcgacaacctgatcagacccttcctgatccacatcatgagcgtgcccgccctggtgacccacctgagcaccgtgacccccgagagactgaccgtgctggagagccacgacatgctgagaaagttcatcatcttcctgagagaccaggacagatgcagagacgtgtgcgagagcctggagggctgccacaccctgtgcctgatgggcaacctgctgcacctgggcagcctgagccccagagtgctggaggaggagaccgacggcttcgtgagcctgctgacccagaccctgtgctactgcagaaagtacgtgagccagaagaagagcaacctgacccactggcaccccgtgctgggctggttcagccagagcgtggactacggcctgaacgagagcatgcacctgatcaccaagcagctgcagttcctgtggggcgtgcccctgatcagaatcttcttctgcgacatcctgagcaagaagctgctggagagccaggagcccgcccacgcccagcccgccagcccccagaacgtgctgcccgtgaagagcctgctgaagagagccttccagaagagcgccagcgtgagaaacatcctgagacccgtgggcggcaagagagtggacagcgccgaggtgcagaaggtgtgcaacatctgcgtgctgtaccagaccagcctgaccaccctgacccagatcagactgcagatcctgaccggcctgacctacctggacgacctgctgcccaagctgtgggccttcatctgcgagctgggcccccacggcggcctgaagctgttcctggagtgcctgaacaacgacaccgaggagagcaagcagctgctggccatgctgatgctgttctgcgactgcagcagacacctgatcaccatcctggacgacatcgaggtgtacgaggagcagatcagcttcaagctggaggagctggtgaccatcagcagcttcctgaacagcttcgtgttcaagatgatctgggacggcatcgtggagaacgccaagggcgagaccctggagctgttccagagcgtgcacggctggctgatggtgctgtacgagagagactgcagaagaagattcacccccgaggaccactggctgagaaaggacctgaagcccagcgtgctgttccaggagctggacagagacagaaagagagcccagctgatcctgcagtacatcccccacgtgatcccccacaagaacagagtgctgctgttcagaaccatggtgaccaaggagaaggagaagctgggcctggtggagaccagcagcgccagcccccacgtgacccacatcaccatcagaagaagcagaatgctggaggacggctacgagcagctgagacagctgagccagcacgccatgaagggcgtgatcagagtgaagttcgtgaacgacctgggcgtggacgaggccggcatcgaccaggacggcgtgttcaaggagttcctggaggagatcatcaagagagtgttcgaccccgccctgaacctgttcaagaccaccagcggcgacgagagactgtaccccagccccaccagctacatccacgagaactacctgcagctgttcgagttcgtgggcaagatgctgggcaaggccgtgtacgagggcatcgtggtggacgtgcccttcgccagcttcttcctgagccagctgctgggccaccaccacagcgtgttctacagcagcgtggacgagctgcccagcctggacagcgagttctacaagaacctgaccagcatcaagagatacgacggcgacatcaccgacctgggcctgaccctgagctacgacgaggacgtgatgggccagctggtgtgccacgagctgatccccggcggcaagaccatccccgtgacctag

SEQ ID NO: 25524 - DNA, 735 bp, Artificial Sequence; identical to SEQ ID NO: 25517
  Description of Artificial Sequence: Synthetic coding sequence

SEQ ID NO: 25525 - DNA, 2946 bp, Artificial Sequence
  Description of Artificial Sequence: Synthetic coding sequence
atggccgagggcggcgccgccgacctggacacccagagaagcgacatcgccaccctgctgaagaccagcctgagaaagggcgacacctggtacctggtggacagcagatggttcaagcagtggaagaagtacgtgggcttcgacagctgggacaagtaccagatgggcgaccagaacgtgtaccccggccccatcgacaacagcggcctgctgaaggacggcgacgcccagagcctgaaggagcacctgatcgacgagctggactacatcctgctgcccaccgagggctggaacaagctggtgagctggtacaccctgatggagggccaggagcccatcgccagaaaggtggtggagcagggcatgttcgtgaagcactgcaaggtggaggtgtacctgaccgagctgaagctgtgcgagaacggcaacatgaacaacgtggtgaccagaagattcagcaaggccgacaccatcgacaccatcgagaaggagatcagaaagatcttcagcatccccgacgagaaggagaccagactgtggaacaagtacatgagcaacaccttcgagcccctgaacaagcccgacagcaccatccaggacgccggcctgtaccagggccaggtgctggtgatcgagcagaagaacgaggacggcacctggcccagaggccccagcacccccaagagccccggcgccagcaacttcagcaccctgcccaagatcagccccagcagcctgagcaacaactacaacaacatgaacaacagaaacgtgaagaacagcaactactgcctgcccagctacaccgcctacaagaactacgactacagcgagcccggcagaaacaacgagcagcccggcctgtgcggcctgagcaacctgggcaacacctgcttcatgaacagcgccatccagtgcctgagcaacaccccccccctgaccgagtacttcctgaacgacaagtaccaggaggagctgaacttcgacaaccccctgggcatgagaggcgagatcgccaagagctacgccgagctgatcaagcagatgtggagcggcaagttcagctacgtgacccccagagccttcaagacccaggtgggcagattcgccccccagttcagcggctaccagcagcaggactgccaggagctgctggccttcctgctggacggcctgcacgaggacctgaacagaatcagaaagaagccctacatccagctgaaggacgccgacggcagacccgacaaggtggtggccgaggaggcctgggagaaccacctgaagagaaacgacagcatcatcgtggacatcttccacggcctgttcaagagcaccctggtgtgccccgagtgcgccaagatcagcgtgaccttcgaccccttctgctacctgaccctgcccctgcccatgaagaaggagagaaccctggaggtgtacctggtgagaatggaccccctgaccaagcccatgcagtacaaggtggtggtgcccaagatcggcaacatcctggacctgtgcaccgccctgagcgccctgagcggcatccccgccgacaagatgatcgtgaccgacatctacaaccacagattccacagaatcttcgccatggacgagaacctgagcagcatcatggagagagacgacatctacgtgttcgagatcaacatcaacagaaccgaggacaccgagcacgtgatcatccccgtgtgcctgagagagaagttcagacacagcagctacacccaccacaccggcagcagcctgttcggccagcccttcctgatggccgtgcccagaaacaacaccgaggacaagctgtacaacctgctgctgctgagaatgtgcagatacgtgaagatcagcaccgagaccgaggagaccgagggcagcctgcactgctgcaaggaccagaacatcaacggcaacggccccaacggcatccacgaggagggcagccccagcgagatggagaccgacgagcccgacgacgagagcagccaggaccaggagctgcccagcgagaacgagaacagccagagcgaggacagcgtgggcggcgacaacgacagcgagaacggcctgtgcaccgaggacacctgcaagggccagctgaccggccacaagaagagactgttcaccttccagttcaacaacctgggcaacaccgacatcaactacatcaaggacgacaccagacacatcagattcgacgacagacagctgagactggacgagagaagcttcctggccctggactgggaccccgacctgaagaagagatacttcgacgagaacgccgccgaggacttcgagaagcacgagagcgtggagtacaagccccccaagaagcccttcgtgaagctgaaggactgcatcgagctgttcaccaccaaggagaagctgggcgccgaggacccctggtactgccccaactgcaaggagcaccagcaggccaccaagaagctggacctgtggagcctgccccccgtgctggtggtgcacctgaagagattcagctacagcagatacatgagagacaagctggacaccctggtggacttccccatcaacgacctggacatgagcgagttcctgatcaaccccaacgccggcccctgcagatacaacctgatcgccgtgagcaaccactacggcggcatgggcggcggccactacaccgccttcgccaagaacaaggacgacggcaagtggtactacttcgacgacagcagcgtgagcaccgccagcgaggaccagatcgtgagcaaggccgcctacgtgctgttctaccagagacaggacaccttcagcggcaccggcttcttccccctggacagagagaccaagggcgccagcgccgccaccggcatccccctggagagcgacgaggacagcaacgacaacgacaacgacatcgagaacgagaactgcatgcacaccaactag

SEQ ID NO: 25526 - DNA, 2859 bp, Artificial Sequence
  Description of Artificial Sequence: Synthetic coding sequence
atggccgagggcggcgccgccgacctggacacccagagaagcgacatcgccaccctgctgaagaccagcctgagaaagggcgacacctggtacctggtggacagcagatggttcaagcagtggaagaagtacgtgggcttcgacagctgggacaagtaccagatgggcgaccagaacgtgtaccccggccccatcgacaacagcggcctgctgaaggacggcgacgcccagagcctgaaggagcacctgatcgacgagctggactacatcctgctgcccaccgagggctggaacaagctggtgagctggtacaccctgatggagggccaggagcccatcgccagaaaggtggtggagcagggcatgttcgtgaagcactgcaaggtggaggtgtacctgaccgagctgaagctgtgcgagaacggcaacatgaacaacgtggtgaccagaagattcagcaaggccgacaccatcgacaccatcgagaaggagatcagaaagatcttcagcatccccgacgagaaggagaccagactgtggaacaagtacatgagcaacaccttcgagcccctgaacaagcccgacagcaccatccaggacgccggcctgtaccagggccaggtgctggtgatcgagcagaagaacgaggacggcacctggcccagaggccccagcacccccaacgtgaagaacagcaactactgcctgcccagctacaccgcctacaagaactacgactacagcgagcccggcagaaacaacgagcagcccggcctgtgcggcctgagcaacctgggcaacacctgcttcatgaacagcgccatccagtgcctgagcaacaccccccccctgaccgagtacttcctgaacgacaagtaccaggaggagctgaacttcgacaaccccctgggcatgagaggcgagatcgccaagagctacgccgagctgatcaagcagatgtggagcggcaagttcagctacgtgacccccagagccttcaagacccaggtgggcagattcgccccccagttcagcggctaccagcagcaggactgccaggagctgctggccttcctgctggacggcctgcacgaggacctgaacagaatcagaaagaagccctacatccagctgaaggacgccgacggcagacccgacaaggtggtggccgaggaggcctgggagaaccacctgaagagaaacgacagcatcatcgtggacatcttccacggcctgttcaagagcaccctggtgtgccccgagtgcgccaagatcagcgtgaccttcgaccccttctgctacctgaccctgcccctgcccatgaagaaggagagaaccctggaggtgtacctggtgagaatggaccccctgaccaagcccatgcagtacaaggtggtggtgcccaagatcggcaacatcctggacctgtgcaccgccctgagcgccctgagcggcatccccgccgacaagatgatcgtgaccgacatctacaaccacagattccacagaatcttcgccatggacgagaacctgagcagcatcatggagagagacgacatctacgtgttcgagatcaacatcaacagaaccgaggacaccgagcacgtgatcatccccgtgtgcctgagagagaagttcagacacagcagctacacccaccacaccggcagcagcctgttcggccagcccttcctgatggccgtgcccagaaacaacaccgaggacaagctgtacaacctgctgctgctgagaatgtgcagatacgtgaagatcagcaccgagaccgaggagaccgagggcagcctgcactgctgcaaggaccagaacatcaacggcaacggccccaacggcatccacgaggagggcagccccagcgagatggagaccgacgagcccgacgacgagagcagccaggaccaggagctgcccagcgagaacgagaacagccagagcgaggacagcgtgggcggcgacaacgacagcgagaacggcctgtgcaccgaggacacctgcaagggccagctgaccggccacaagaagagactgttcaccttccagttcaacaacctgggcaacaccgacatcaactacatcaaggacgacaccagacacatcagattcgacgacagacagctgagactggacgagagaagcttcctggccctggactgggaccccgacctgaagaagagatacttcgacgagaacgccgccgaggacttcgagaagcacgagagcgtggagtacaagccccccaagaagcccttcgtgaagctgaaggactgcatcgagctgttcaccaccaaggagaagctgggcgccgaggacccctggtactgccccaactgcaaggagcaccagcaggccaccaagaagctggacctgtggagcctgccccccgtgctggtggtgcacctgaagagattcagctacagcagatacatgagagacaagctggacaccctggtggacttccccatcaacgacctggacatgagcgagttcctgatcaaccccaacgccggcccctgcagatacaacctgatcgccgtgagcaaccactacggcggcatgggcggcggccactacaccgccttcgccaagaacaaggacgacggcaagtggtactacttcgacgacagcagcgtgagcaccgccagcgaggaccagatcgtgagcaaggccgcctacgtgctgttctaccagagacaggacaccttcagcggcaccggcttcttccccctggacagagagaccaagggcgccagcgccgccaccggcatccccctggagagcgacgaggacagcaacgacaacgacaacgacatcgagaacgagaactgcatgcacaccaactag

SEQ ID NO: 25527 - DNA, 2871 bp, Artificial Sequence
  Description of Artificial Sequence: Synthetic coding sequence
atggccgagggcggcgccgccgacctggacacccagagaagcgacatcgccaccctgctgaagaccagcctgagaaagggcgacacctggtacctggtggacagcagatggttcaagcagtggaagaagtacgtgggcttcgacagctgggacaagtaccagatgggcgaccagaacgtgtaccccggccccatcgacaacagcggcctgctgaaggacggcgacgcccagagcctgaaggagcacctgatcgacgagctggactacatcctgctgcccaccgagggctggaacaagctggtgagctggtacaccctgatggagggccaggagcccatcgccagaaaggtggtggagcagggcatgttcgtgaagcactgcaaggtggaggtgtacctgaccgagctgaagctgtgcgagaacggcaacatgaacaacgtggtgaccagaagattcagcaaggccgacaccatcgacaccatcgagaaggagatcagaaagatcttcagcatccccgacgagaaggagaccagactgtggaacaagtacatgagcaacaccttcgagcccctgaacaagcccgacagcaccatccaggacgccggcctgtaccagggccaggtgctgttcatcgtgctggtgatcgagcagaagaacgaggacggcacctggcccagaggccccagcacccccaacgtgaagaacagcaactactgcctgcccagctacaccgcctacaagaactacgactacagcgagcccggcagaaacaacgagcagcccggcctgtgcggcctgagcaacctgggcaacacctgcttcatgaacagcgccatccagtgcctgagcaacaccccccccctgaccgagtacttcctgaacgacaagtaccaggaggagctgaacttcgacaaccccctgggcatgagaggcgagatcgccaagagctacgccgagctgatcaagcagatgtggagcggcaagttcagctacgtgacccccagagccttcaagacccaggtgggcagattcgccccccagttcagcggctaccagcagcaggactgccaggagctgctggccttcctgctggacggcctgcacgaggacctgaacagaatcagaaagaagccctacatccagctgaaggacgccgacggcagacccgacaaggtggtggccgaggaggcctgggagaaccacctgaagagaaacgacagcatcatcgtggacatcttccacggcctgttcaagagcaccctggtgtgccccgagtgcgccaagatcagcgtgaccttcgaccccttctgctacctgaccctgcccctgcccatgaagaaggagagaaccctggaggtgtacctggtgagaatggaccccctgaccaagcccatgcagtacaaggtggtggtgcccaagatcggcaacatcctggacctgtgcaccgccctgagcgccctgagcggcatccccgccgacaagatgatcgtgaccgacatctacaaccacagattccacagaatcttcgccatggacgagaacctgagcagcatcatggagagagacgacatctacgtgttcgagatcaacatcaacagaaccgaggacaccgagcacgtgatcatccccgtgtgcctgagagagaagttcagacacagcagctacacccaccacaccggcagcagcctgttcggccagcccttcctgatggccgtgcccagaaacaacaccgaggacaagctgtacaacctgctgctgctgagaatgtgcagatacgtgaagatcagcaccgagaccgaggagaccgagggcagcctgcactgctgcaaggaccagaacatcaacggcaacggccccaacggcatccacgaggagggcagccccagcgagatggagaccgacgagcccgacgacgagagcagccaggaccaggagctgcccagcgagaacgagaacagccagagcgaggacagcgtgggcggcgacaacgacagcgagaacggcctgtgcaccgaggacacctgcaagggccagctgaccggccacaagaagagactgttcaccttccagttcaacaacctgggcaacaccgacatcaactacatcaaggacgacaccagacacatcagattcgacgacagacagctgagactggacgagagaagcttcctggccctggactgggaccccgacctgaagaagagatacttcgacgagaacgccgccgaggacttcgagaagcacgagagcgtggagtacaagccccccaagaagcccttcgtgaagctgaaggactgcatcgagctgttcaccaccaaggagaagctgggcgccgaggacccctggtactgccccaactgcaaggagcaccagcaggccaccaagaagctggacctgtggagcctgccccccgtgctggtggtgcacctgaagagattcagctacagcagatacatgagagacaagctggacaccctggtggacttccccatcaacgacctggacatgagcgagttcctgatcaaccccaacgccggcccctgcagatacaacctgatcgccgtgagcaaccactacggcggcatgggcggcggccactacaccgccttcgccaagaacaaggacgacggcaagtggtactacttcgacgacagcagcgtgagcaccgccagcgaggaccagatcgtgagcaaggccgcctacgtgctgttctaccagagacaggacaccttcagcggcaccggcttcttccccctggacagagagaccaagggcgccagcgccgccaccggcatccccctggagagcgacgaggacagcaacgacaacgacaacgacatcgagaacgagaactgcatgcacaccaactag

SEQ ID NO: 25528 - DNA, 708 bp, Artificial Sequence
  Description of Artificial Sequence: Synthetic coding sequence
atggccgagggcggcgccgccgacctggacacccagagaagcgacatcgccaccctgctgaagaccagcctgagaaagggcgacacctggtacctggtggacagcagatggttcaagcagtggaagaagtacgtgggcttcgacagctgggacaagtaccagatgggcgaccagaacgtgtaccccggccccatcgacaacagcggcctgctgaaggacggcgacgcccagagcctgaaggagcacctgatcgacgagctggactacatcctgctgcccaccgagggctggaacaagctggtgagctggtacaccctgatggagggccaggagcccatcgccagaaaggtggtggagcagggcatgttcgtgaagcactgcaaggtggaggtgtacctgaccgagctgaagctgtgcgagaacggcaacatgaacaacgtggtgaccagaagattcagcaaggccgacaccatcgacaccatcgagaaggagatcagaaagatcttcagcatccccgacgagaaggagaccagactgtggaacaagtacatgagcaacaccttcgagcccctgaacaagcccgacagcaccatccaggacgccggcctgtaccagggccaggtgctggtgatcgagcagaagaacgaggacggcacctggcccagaggccccagcacccccaagaagcccctggagcagagctgctag

SEQ ID NO: 25529 - DNA, 2769 bp, Artificial Sequence
  Description of Artificial Sequence: Synthetic coding sequence
atgatcagcctgaaggtgtgcggcttcatccagatctggagccagaagaccggcatgaccaagctgaaggaggccctgatcgagaccgtgcagagacagaaggagatcaagctggtggtgaccttcaagagcggcaagttcatcagaatcttccagctgagcaacaacatcagaagcgtggtgctgagacactgcaagaagagacagagccacctgagactgaccctgaagaacaacgtgttcctgttcatcgacaagctgagctacagagacgccaagcagctgaacatgttcctggacatcatccaccagaacaagagccagcagcccatgaagagcgacgacgactggagcgtgttcgagagcagaaacatgctgaaggagatcgacaagaccagcttctacagcatctgcaacaagcccagctaccagaagatgcccctgttcatgagcaagagccccacccacgtgaagaagggcatcctggagaaccagggcggcaagggccagaacaccctgagcagcgacgtgcagaccaacgaggacatcctgaaggaggacaaccccgtgcccaacaagaagtacaagaccgacagcctgaagtacatccagagcaacagaaagaaccccagcagcctggaggacctggagaaggacagagacctgaagctgggccccagcttcaacaccaactgcaacggcaaccccaacctggacgagaccgtgctggccacccagaccctgaacgccaagaacggcctgaccagccccctggagcccgagcacagccagggcgaccccagatgcaacaaggcccaggtgcccctggacagccacagccagcagctgcagcagggcttccccaacctgggcaacacctgctacatgaacgccgtgctgcagagcctgttcgccatccccagcttcgccgacgacctgctgacccagggcgtgccctgggagtacatccccttcgaggccctgatcatgaccctgacccagctgctggccctgaaggacttctgcagcaccaagatcaagagagagctgctgggcaacgtgaagaaggtgatcagcgccgtggccgagatcttcagcggcaacatgcagaacgacgcccacgagttcctgggccagtgcctggaccagctgaaggaggacatggagaagctgaacgccaccctgaacaccggcaaggagtgcggcgacgagaacagcagcccccagatgcacgtgggcagcgccgccaccaaggtgttcgtgtgccccgtggtggccaacttcgagttcgagctgcagctgagcctgatctgcaaggcctgcggccacgccgtgctgaaggtggagcccaacaactacctgagcatcaacctgcaccaggagaccaagcccctgcccctgagcatccagaacagcctggacctgttcttcaaggaggaggagctggagtacaactgccagatgtgcaagcagaagagctgcgtggccagacacaccttcagcagactgagcagagtgctgatcatccacctgaagagatacagcttcaacaacgcctggctgctggtgaagaacaacgagcaggtgtacatccccaagagcctgagcctgagcagctactgcaacgagagcaccaagccccccctgcccctgagcagcagcgcccccgtgggcaagtgcgaggtgctggaggtgagccaggagatgatcagcgagatcaacagccccctgacccccagcatgaagctgaccagcgagagcagcgacagcctggtgctgcccgtggagcccgacaagaacgccgacctgcagagattccagagagactgcggcgacgccagccaggagcagcaccagagagacctggagaacggcagcgccctggagagcgagctggtgcacttcagagacagagccatcggcgagaaggagctgcccgtggccgacagcctgatggaccagggcgacatcagcctgcccgtgatgtacgaggacggcggcaagctgatcagcagccccgacaccagactggtggaggtgcacctgcaggaggtgccccagcaccccgagctgcagaagtacgagaagaccaacaccttcgtggagttcaacttcgacagcgtgaccgagagcaccaacggcttctacgactgcaaggagaacagaatccccgagggcagccagggcatggccgagcagctgcagcagtgcatcgaggagagcatcatcgacgagttcctgcagcaggcccccccccccggcgtgagaaagctggacgcccaggagcacaccgaggagaccctgaaccagagcaccgagctgagactgcagaaggccgacctgaaccacctgggcgccctgggcagcgacaaccccggcaacaagaacatcctggacgccgagaacaccagaggcgaggccaaggagctgaccagaaacgtgaagatgggcgaccccctgcaggcctacagactgatcagcgtggtgagccacatcggcagcagccccaacagcggccactacatcagcgacgtgtacgacttccagaagcaggcctggttcacctacaacgacctgtgcgtgagcgagatcagcgagaccaagatgcaggaggccagactgcacagcggctacatcttcttctacatgcacaacggcatcttcgaggagctgctgagaaaggccgagaacagcagactgcccagcacccaggccggcgtgatcccccagggcgagtacgagggcgacagcctgtacagacccgcctag

SEQ ID NO: 25530 - DNA, 786 bp, Artificial Sequence
  Description of Artificial Sequence: Synthetic coding sequence
atgagcggcgagatcgccatgtgcgagcccgagttcggcaacgacaaggccagagagcccagcgtgggcggcagatggagagtgagctggtacgagagattcgtgcagccctgcctggtggagctgctgggcagcgccctgttcatcttcatcggctgcctgagcgtgatcgagaacggcaccgacaccggcctgctgcagcccgccctggcccacggcctggccctgggcctggtgatcgccaccctgggcaacatcagcggcggccacttcaaccccgccgtgagcctggccgccatgctgatcggcggcctgaacctggtgatgctgctgccctactgggtgagccagctgctgggcggcatgctgggcgccgccctggccaaggccgtgagccccgaggagagattctggaacgccagcggcgccgccttcgtgaccgtgcaggagcagggccaggtggccggcgccctggtggccgagatcatcctgaccaccctgctggccctggccgtgtgcatgggcgccatcaacgagaagaccaagggccccctggcccccttcagcatcggcttcgccgtgaccgtggacatcctggccggcggccccgtgagcggcggctgcatgaaccccgccagagccttcggccccgccgtggtggccaaccactggaacttccactggatctactggctgggccccctgctggccggcctgctggtgggcctgctgatcagatgcttcatcggcgacggcaagaccagactgatcctgaaggccagatag

SEQ ID NO: 25531 - DNA, 1332 bp, Artificial Sequence
  Description of Artificial Sequence: Synthetic coding sequence
atgagccagagagacggcgtgtgcggcagccacgaggtggccggcgccgccagccccggcgccgacggcggcctgagcctggccgcctactgcaagaacagcgtggacggcctgtggtactgcttcgacgacagcgacgtgcagcagctgagcgaggacgaggtgtgcacccagaccgcctacatcctgttctaccagagaagaaccgccatccccagctggagcgccaacagcagcgtggccggcagcaccagcagcagcctgtgcgagcactgggtgagcagactgcccggcagcaagcccgccagcgtgaccagcgccgccagcagcagaagaaccagcctggccagcctgagcgagagcgtggagatgaccggcgagagaagcgaggacgacggcggcttcagcaccagacccttcgtgagaagcgtgcagagacagagcctgagcagcagaagcagcgtgaccagccccctggccgtgaacgagaactgcatgagacccagctggagcctgagcgccaagctgcagatgagaagcaacagccccagcagattcagcggcgacagccccatccacagcagcgccagcaccctggagaagatcggcgaggccgccgacgacaaggtgagcatcagctgcttcggcagcctgagaaacctgagcagcagctaccaggagcccagcgacagccacagcagaagagagcacaaggccgtgggcagagcccccctggccgtgatggagggcgtgttcaaggacgagagcgacaccagaagactgaacagcagcgtggtggacacccagagcaagcacagcgcccagggcgacagactgccccccctgagcggccccttcgacaacaacaaccagatcgcctacgtggaccagagcgacagcgtggacagcagccccgtgaaggaggtgaaggcccccagccaccccggcagcctggccaagaagcccgagagcaccaccaagagaagccccagcagcaagggcaccagcgagcccgagaagagcctgagaaagggcagacccgccctggccagccaggagagcagcctgagcagcaccagccccagcagccccctgcccgtgaaggtgagcctgaagcccagcagaagcagaagcaaggccgacagcagcagcagaggcagcggcagacacagcagccccgcccccgcccagacccagttccccagcggcgagcccggccccagcagaggcggccagggcggcagagaggccagagccgagctgctgcacggccagcccgccctgccccagcacaagcaccaggtgtggttcgaggagggccagcaggtgtag

SEQ ID NO: 25532 - DNA, 10185 bp, Artificial Sequence
  Description of Artificial Sequence: Synthetic coding sequence
atgagaagaaagaacagctactacgtgtggcagatcttccagatccagttccccctgtacaccgcctacaagcacaacacccaccccaccatcgaggacatcagcacccaggagagcaacatcctgggcgccttctgcgacatgaacgacgtggaggtgcccctgcacctgctgagatacgtgtgcctgttctgcggcaagaacggcctgagcctgatgaaggactgcttcgagtacggcacccccgagaccctgcccttcctgatcgcccacgccttcatcaccgtggtgagcaacatcagaatctggctgcacatccccgccgtgatgcagcacatcatccccttcagaacctacgtgatcagatacctgtgcaagctgagcgaccaggagctgagacagagcgccgccagaaacatggccgacctgatgtggagcaccgtgaaggagcccctggacaccaccctgtgcttcgacaaggagagcctggacctggccttcaagtacttcatgagccccaccctgaccatgagactggccggcctgagccagatcaccaaccagctgcacaccttcaacgacgtgtgcaacaacgagagcctggtgagcgacaccgagaccagcatcgccaaggagctggccgactggctgatcagcaacaacgtggtggagcacatcttcggccccaacctgcacatcgagatcatcaagcagtgccaggtgatcctgaacttcctggccgccgagggcagactgagcacccagcacatcgactgcatctgggccgccgcccagctgaagcactgcagcagatacatccacgacctgttccccagcctgatcaagaacctggaccccgtgcccctgagacacctgctgaacctggtgagcgccctggagcccagcgtgcacaccgagcagaccctgtacctggccagcatgctgatcaaggccctgtggaacaacgccctggccgccaaggcccagctgagcaagcagagcagcttcgccagcctgctgaacaccaacatccccatcggcaacaagaaggaggaggaggagctgagaagaaccgcccccagcccctggagccccgccgccagcccccagagcagcgacaacagcgacacccaccagagcggcggcagcgacatcgagatggacgagcagctgatcaacagaaccaagcacgtgcagcagagactgagcgacaccgaggagagcatgcagggcagcagcgacgagaccgccaacagcggcgaggacggcagcagcggccccggcagcagcagcggccacagcgacggcagcagcaacgaggtgaacagcagccacgccagccagagcgccggcagccccggcagcgaggtgcagagcgaggacatcgccgacatcgaggccctgaaggaggaggacgaggacgacgaccacggccacaacccccccaagagcagctgcggcaccgacctgagaaacagaaagctggagagccaggccggcatctgcctgggcgacagccagggcatgagcgagagaaacggcaccagcagcggcaccggcaaggacctggtgttcaacaccgagagcctgcccagcgtggacaacagaatgagaatgctggacgcctgcagccacagcgaggaccccgagcacgacatcagcggcgagatgaacgccacccacatcgcccagggcagccaggagagctgcatcaccagaaccggcgacttcctgggcgagaccatcggcaacgagctgttcaactgcagacagttcatcggcccccagcaccaccaccaccaccaccaccaccaccaccaccacgacggccacatggtggacgacatgctgagcgccgacgacgtgagctgcagcagcagccaggtgagcgccaagagcgagaagaacatggccgacttcgacggcgaggagagcggctgcgaggaggagctggtgcagatcaacagccacgccgagctgaccagccacctgcagcagcacctgcccaacctggccagcatctaccacgagcacctgagccagggccccgtggtgcacaagcaccagttcaacagcaacgccgtgaccgacatcaacctggacaacgtgtgcaagaagggcaacaccctgctgtgggacatcgtgcaggacgaggacgccgtgaacctgagcgagggcctgatcaacgaggccgagaagctgctgtgcagcctggtgtgctggttcaccgacagacagatcagaatgagattcatcgagggctgcctggagaacctgggcaacaacagaagcgtggtgatcagcctgagactgctgcccaagctgttcggcaccttccagcagttcggcagcagctacgacacccactggatcaccatgtgggccgagaaggagctgaacatgatgaagctgttcttcgacaacctggtgtactacatccagaccgtgagagagggcagacagaagcacgccctgtacagccacagcgccgaggtgcaggtgagactgcagttcctgacctgcgtgttcagcaccctgggcagccccgaccacttcagactgagcctggagcaggtggacatcctgtggcactgcctggtggaggacagcgagtgctacgacgacgccctgcactggttcctgaaccaggtgagaagcaaggaccagcacgccatgggcatggagacctacaagcacctgttcctggagaagatgccccagctgaagcccgagaccatcagcatgaccggcctgaacctgttccagcacctgtgcaacctggccagactggccaccagcgcctacgacggctgcagcaacagcgagctgtgcggcatggaccagttctggggcatcgccctgagagcccagagcggcgacgtgagcagagccgccatccagtacatcaacagctactacatcaacggcaagaccggcctggagaaggagcaggagttcatcagcaagtgcatggagagcctgatgatcgccagcagcagcctggagcaggagagccacagcagcctgatggtgatcgagagaggcctgctgatgctgaagacccacctggaggccttcagaagaagattcgcctaccacctgagacagtggcagatcgagggcaccggcatcagcagccacctgaaggccctgagcgacaagcagagcctgcccctgagagtggtgtgccagcccgccggcctgcccgacaagatgaccatcgagatgtaccccagcgaccaggtggccgacctgagagccgaggtgacccactggtacgagaacctgcagaaggagcagatcaaccagcaggcccagctgcaggagttcggccagagcaacagaaagggcgagttccccggcggcctgatgggccccgtgagaatgatcagcagcggccacgagctgaccaccgactacgacgagaaggccctgcacgagctgggcttcaaggacatgcagatggtgttcgtgagcctgggcgcccccagaagagagagaaagggcgagggcgtgcagctgcccgccagctgcctgccccccccccagaaggacaacatccccatgctgctgctgctgcaggagccccacctgaccaccctgttcgacctgctggagatgctggccagcttcaagccccccagcggcaaggtggccgtggacgacagcgagagcctgagatgcgaggagctgcacctgcacgccgagaacctgagcagaagagtgtgggagctgctgatgctgctgcccacctgccccaacatgctgatggccttccagaacatcagcgacgagcagagcaacgacggcttcaactggaaggagctgctgaagatcaagagcgcccacaagctgctgtacgccctggagatcatcgaggccctgggcaagcccaacagaagaatcagaagagagagcaccggcagctacagcgacctgtaccccgacagcgacgacagcagcgaggaccaggtggagaacagcaagaacagctggagctgcaagttcgtggccgccggcggcctgcagcagctgctggagatcttcaacagcggcatcctggagcccaaggagcaggagagctggaccgtgtggcagctggactgcctggcctgcctgctgaagctgatctgccagttcgccgtggaccccagcgacctggacctggcctaccacgacgtgttcgcctggagcggcatcgccgagagccacagaaagagaacctggcccggcaagagcagaaaggccgccggcgaccacgccaagggcctgcacatccccagactgaccgaggtgttcctggtgctggtgcagggcaccagcctgatccagagactgatgagcgtggcctacacctacgacaacctggcccccagagtgctgaaggcccagagcgaccacagaagcagacacgaggtgagccactacagcatgtggctgctggtgagctgggcccactgctgcagcctggtgaagagcagcctggccgacagcgaccacctgcaggactggctgaagaagctgaccctgctgatccccgagaccgccgtgagacacgagagctgcagcggcctgtacaagctgagcctgagcggcctggacggcggcgacagcatcaacagaagcttcctgctgctggccgccagcaccctgctgaagttcctgcccgacgcccaggccctgaagcccatcagaatcgacgactacgaggaggagcccatcctgaagcccggctgcaaggagtacttctggctgctgtgcaagctggtggacaacatccacatcaaggacgccagccagaccaccctgctggacctggacgccctggccagacacctggccgactgcatcagaagcagagagatcctggaccaccaggacggcaacgtggaggacgacggcctgaccggcctgctgagactggccaccagcgtggtgaagcacaagccccccttcaagttcagcagagagggccaggagttcctgagagacatcttcaacctgctgttcctgctgcccagcctgaaggacagacagcagcccaagtgcaagagccacagcagcagagccgccgcctacgacctgctggtggagatggtgaagggcagcgtggagaactacagactgatccacaactgggtgatggcccagcacatgcagagccacgccccctacaagtgggactactggccccacgaggacgtgagagccgagtgcagattcgtgggcctgaccaacctgggcgccacctgctacctggccagcaccatccagcagctgtacatgatccccgaggccagacaggccgtgttcaccgccaagtacagcgaggacatgaagcacaagaccaccctgctggagctgcagaagatgttcacctacctgatggagagcgagtgcaaggcctacaaccccagacccttctgcaagacctacaccatggacaagcagcccctgaacaccggcgagcagaaggacatgaccgagttcttcaccgacctgatcaccaagatcgaggagatgagccccgagctgaagaacaccgtgaagagcctgttcggcggcgtgatcaccaacaacgtggtgagcctggactgcgagcacgtgagccagaccgccgaggagttctacaccgtgagatgccaggtggccgacatgaagaacatctacgagagcctggacgaggtgaccatcaaggacaccctggagggcgacaacatgtacacctgcagccactgcggcaagaaggtgagagccgagaagagagcctgcttcaagaagctgcccagaatcctgagcttcaacaccatgagatacaccttcaacatggtgaccatgatgaaggagaaggtgaacacccacttcagcttccccctgagactggacatgaccccctacaccgaggacttcctgatgggcaagagcgagagaaaggagggcttcaaggaggtgagcgaccacagcaaggacagcgagagctacgagtacgacctgatcggcgtgaccgtgcacaccggcaccgccgacggcggccactactacagcttcatcagagacatcgtgaacccccacgcctacaagaacaacaagtggtacctgttcaacgacgccgaggtgaagcccttcgacagcgcccagctggccagcgagtgcttcggcggcgagatgaccaccaagacctacgacagcgtgaccgacaagttcatggacttcagcttcgagaagacccacagcgcctacatgctgttctacaagagaatggagcccgaggaggagaacggcagagagtacaagttcgacgtgagcagcgagctgctggagtggatctggcacgacaacatgcagttcctgcaggacaagaacatcttcgagcacacctacttcggcttcatgtggcagctgtgcagctgcatccccagcaccctgcccgaccccaaggccgtgagcctgatgaccgccaagctgagcaccagcttcgtgctggagaccttcatccacagcaaggagaagcccaccatgctgcagtggatcgagctgctgaccaagcagttcaacaacagccaggccgcctgcgagtggttcctggacagaatggccgacgacgactggtggcccatgcagatcctgatcaagtgccccaaccagatcgtgagacagatgttccagagactgtgcatccacgtgatccagagactgagacccgtgcacgcccacctgtacctgcagcccggcatggaggacggcagcgacgacatggacaccagcgtggaggacatcggcggcagaagctgcgtgaccagattcgtgagaaccctgctgctgatcatggagcacggcgtgaagccccacagcaagcacctgaccgagtacttcgccttcctgtacgagttcgccaagatgggcgaggaggagagccagttcctgctgagcctgcaggccatcagcaccatggtgcacttctacatgggcaccaagggccccgagaacccccaggtggaggtgctgagcgaggaggagggcgaggaggaggaggaggaggaggacatcctgagcctggccgaggagaagtacagacccgccgccctggagaagatgatcgccctggtggccctgctggtggagcagagcagaagcgagagacacctgaccctgagccagaccgacatggccgccctgaccggcggcaagggcttccccttcctgttccagcacatcagagacggcatcaacatcagacagacctgcaacctgatcttcagcctgtgcagatacaacaacagactggccgagcacatcgtgagcatgctgttcaccagcatcgccaagctgacccccgaggccgccaaccccttcttcaagctgctgaccatgctgatggagttcgccggcggcccccccggcatgccccccttcgccagctacatcctgcagagaatctgggaggtgatcgagtacaaccccagccagtgcctggactggctggccgtgcagacccccagaaacaagctggcccacagctgggtgctgcagaacatggagaactgggtggagagattcctgctggcccacaactaccccagagtgagaaccagcgccgcctacctgctggtgagcctgatccccagcaacagcttcagacagatgttcagaagcaccagaagcctgcacatccccaccagagacctgcccctgagccccgacaccaccgtggtgctgcaccaggtgtacaacgtgctgctgggcctgctgagcagagccaagctgtacgtggacgccgccgtgcacggcaccaccaagctggtgccctacttcagcttcatgacctactgcctgatcagcaagaccgagaagctgatgttcagcacctacttcatggacctgtggaacctgttccagcccaagctgagcgagcccgccatcgccaccaaccacaacaagcaggccctgctgagcttctggtacaacgtgtgcgccgactgccccgagaacatcagactgatcgtgcagaaccccgtggtgaccaagaacatcgccttcaactacatcctggccgaccacgacgaccaggacgtggtgctgttcaacagaggcatgctgcccgcctactacggcatcctgagactgtgctgcgagcagagccccgccttcaccagacagctggccagccaccagaacatccagtgggccttcaagaacctgaccccccacgccagccagtaccccggcgccgtggaggagctgttcaacctgatgcagctgttcatcgcccagagacccgacatgagagaggaggagctggaggacatcaagcagttcaagaagaccaccatcagctgctacctgagatgcctggacggcagaagctgctggaccaccctgatcagcgccttcagaatcctgctggagagcgacgaggacagactgctggtggtgttcaacagaggcctgatcctgatgaccgagagcttcaacaccctgcacatgatgtaccacgaggccaccgcctgccacgtgaccggcgacctggtggagctgctgagcatcttcctgagcgtgctgaagagcaccagaccctacctgcagagaaaggacgtgaagcaggccctgatccagtggcaggagagaatcgagttcgcccacaagctgctgaccctgctgaacagctacagcccccccgagctgagaaacgcctgcatcgacgtgctgaaggagctggtgctgctgagcccccacgacttcctgcacaccctggtgcccttcctgcagcacaaccactgcacctaccaccacagcaacatccccatgagcctgggcccctacttcccctgcagagagaacatcaagctgatcggcggcaagagcaacatcagaccccccagacccgagctgaacatgtgcctgctgcccaccatggtggagaccagcaagggcaaggacgacgtgtacgacagaatgctgctggactacttcttcagctaccaccagttcatccacctgctgtgcagagtggccatcaactgcgagaagttcaccgagaccctggtgaagctgagcgtgctggtggcctacgagggcctgcccctgcacctggccctgttccccaagctgtggaccgagctgtgccagacccagagcgccatgagcaagaactgcatcaagctgctgtgcgaggaccccgtgttcgccgagtacatcaagtgcatcctgatggacgagagaaccttcctgaacaacaacatcgtgtacaccttcatgacccacttcctgctgaaggtgcagagccaggtgttcagcgaggccaactgcgccaacctgatcagcaccctgatcaccaacctgatcagccagtaccagaacctgcagagcgacttcagcaacagagtggagatcagcaaggccagcgccagcctgaacggcgacctgagagccctggccctgctgctgagcgtgcacacccccaagcagctgaaccccgccctgatccccaccctgcaggagctgctgagcaagtgcagaacctgcctgcagcagagaaacagcctgcaggagcaggaggccaaggagagaaagaccaaggacgacgagggcgccacccccatcaagagaagaagagtgagcagcgacgaggagcacaccgtggacagctgcatcagcgacatgaagaccgagaccagagaggtgctgacccccaccagcaccagcgacaacgagaccagagacagcagcatcatcgaccccggcaccgagcaggacctgcccagccccgagaacagcagcgtgaaggagtacagaatggaggtgcccagcagcttcagcgaggacatgagcaacatcagaagccagcacgccgaggagcagagcaacaacggcagatacgacgactgcaaggagttcaaggacctgcactgcagcaaggacagcaccctggccgaggaggagagcgagttccccagcaccagcatcagcgccgtgctgagcgacctggccgacctgagaagctgcgacggccaggccctgcccagccaggaccccgaggtggccctgagcctgagctgcggccacagcagaggcctgttcagccacatgcagcagcacgacatcctggacaccctgtgcagaaccatcgagagcaccatccacgtggtgaccagaatcagcggcaagggcaaccaggccgccagctag

SEQ ID NO: 25533 - DNA, 9936 bp, Artificial Sequence
  Description of Artificial Sequence: Synthetic coding sequence
atgagaagaaagaacagctactacgtgtggcagatcttccagatccagttccccctgtacaccgcctacaagcacaacacccaccccaccatcgaggacatcagcacccaggagagcaacatcctgggcgccttctgcgacatgaacgacgtggaggtgcccctgcacctgctgagatacgtgtgcctgttctgcggcaagaacggcctgagcctgatgaaggactgcttcgagtacggcacccccgagaccctgcccttcctgatcgcccacgccttcatcaccgtggtgagcaacatcagaatctggctgcacatccccgccgtgatgcagcacatcatccccttcagaacctacgtgatcagatacctgtgcaagctgagcgaccaggagctgagacagagcgccgccagaaacatggccgacctgatgtggagcaccgtgaaggagcccctggacaccaccctgtgcttcgacaaggagagcctggacctggccttcaagtacttcatgagccccaccctgaccatgagactggccggcctgagccagatcaccaaccagctgcacaccttcaacgacgtgtgcaacaacgagagcctggtgagcgacaccgagaccagcatcgccaaggagctggccgactggctgatcagcaacaacgtggtggagcacatcttcggccccaacctgcacatcgagatcatcaagcagtgccaggtgatcctgaacttcctggccgccgagggcagactgagcacccagcacatcgactgcatctgggccgccgcccagctgaagcactgcagcagatacatccacgacctgttccccagcctgatcaagaacctggaccccgtgcccctgagacacctgctgaacctggtgagcgccctggagcccagcgtgcacaccgagcagaccctgtacctggccagcatgctgatcaaggccctgtggaacaacgccctggccgccaaggcccagctgagcaagcagagcagcttcgccagcctgctgaacaccaacatccccatcggcaacaagaaggaggaggaggagctgagaagaaccgcccccagcccctggagccccgccgccagcccccagagcagcgacaacagcgacacccaccagagcggcggcagcgacatcgagatggacgagcagctgatcaacagaaccaagcacgtgcagcagagactgagcgacaccgaggagagcatgcagggcagcagcgacgagaccgccaacagcggcgaggacggcagcagcggccccggcagcagcagcggccacagcgacggcagcagcaacgaggtgaacagcagccacgccagccagagcgccggcagccccggcagcgaggtgcagagcgaggacatcgccgacatcgaggccctgaaggaggaggacgaggacgacgaccacggccacaacccccccaagagcagctgcggcaccgacctgagaaacagaaagctggagagccaggccggcatctgcctgggcgacagccagggcatgagcgagagaaacggcaccagcagcggcaccggcaaggacctggtgttcaacaccgagagcctgcccagcgtggacaacagaatgagaatgctggacgcctgcagccacagcgaggaccccgagcacgacatcagcggcgagatgaacgccacccacatcgcccagggcagccaggagagctgcatcaccagaaccggcgacttcctgggcgagaccatcggcaacgagctgttcaactgcagacagttcatcggcccccagcaccaccaccaccaccaccaccaccaccaccaccacgacggccacatggtggacgacatgctgagcgccgacgacgtgagctgcagcagcagccaggtgagcgccaagagcgagaagaacatggccgacttcgacggcgaggagagcggctgcgaggaggagctggtgcagatcaacagccacgccgagctgaccagccacctgcagcagcacctgcccaacctggccagcatctaccacgagcacctgagccagggccccgtggtgcacaagcaccagttcaacagcaacgccgtgaccgacatcaacctggacaacgtgtgcaagaagggcaacaccctgctgtgggacatcgtgcaggacgaggacgccgtgaacctgagcgagggcctgatcaacgaggccgagaagctgctgtgcagcctggtgtgctggttcaccgacagacagatcagaatgagattcatcgagggctgcctggagaacctgggcaacaacagaagcgtggtgatcagcctgagactgctgcccaagctgttcggcaccttccagcagttcggcagcagctacgacacccactggatcaccatgtgggccgagaaggagctgaacatgatgaagctgttcttcgacaacctggtgtactacatccagaccgtgagagagggcagacagaagcacgccctgtacagccacagcgccgaggtgcaggtgagactgcagttcctgacctgcgtgttcagcaccctgggcagccccgaccacttcagactgagcctggagcaggtggacatcctgtggcactgcctggtggaggacagcgagtgctacgacgacgccctgcactggttcctgaaccaggtgagaagcaaggaccagcacgccatgggcatggagacctacaagcacctgttcctggagaagatgccccagctgaagcccgagaccatcagcatgaccggcctgaacctgttccagcacctgtgcaacctggccagactggccaccagcgcctacgacggctgcagcaacagcgagctgtgcggcatggaccagttctggggcatcgccctgagagcccagagcggcgacgtgagcagagccgccatccagtacatcaacagctactacatcaacggcaagaccggcctggagaaggagcaggagttcatcagcaagtgcatggagagcctgatgatcgccagcagcagcctggagcaggagagccacagcagcctgatggtgatcgagagaggcctgctgatgctgaagacccacctggaggccttcagaagaagattcgcctaccacctgagacagtggcagatcgagggcaccggcatcagcagccacctgaaggccctgagcgacaagcagagcctgcccctgagagtggtgtgccagcccgccggcctgcccgacaagatgaccatcgagatgtaccccagcgaccaggtggccgacctgagagccgaggtgacccactggtacgagaacctgcagaaggagcagatcaaccagcaggcccagctgcaggagttcggccagagcaacagaaagggcgagttccccggcggcctgatgggccccgtgagaatgatcagcagcggccacgagctgaccaccgactacgacgagaaggccctgcacgagctgggcttcaaggacatgcagatggtgttcgtgagcctgggcgcccccagaagagagagaaagggcgagggcgtgcagctgcccgccagctgcctgccccccccccagaaggacaacatccccatgctgctgctgctgcaggagccccacctgaccaccctgttcgacctgctggagatgctggccagcttcaagccccccagcggcaaggtggccgtggacgacagcgagagcctgagatgcgaggagctgcacctgcacgccgagaacctgagcagaagagtgtgggagctgctgatgctgctgcccacctgccccaacatgctgatggccttccagaacatcagcgacgagcagagcaacgacggcttcaactggaaggagctgctgaagatcaagagcgcccacaagctgctgtacgccctggagatcatcgaggccctgggcaagcccaacagaagaatcagaagagagagcaccggcagctacagcgacctgtaccccgacagcgacgacagcagcgaggaccaggtggagaacagcaagaacagctggagctgcaagttcgtggccgccggcggcctgcagcagctgctggagatcttcaacagcggcatcctggagcccaaggagcaggagagctggaccgtgtggcagctggactgcctggcctgcctgctgaagctgatctgccagttcgccgtggaccccagcgacctggacctggcctaccacgacgtgttcgcctggagcggcatcgccgagagccacagaaagagaacctggcccggcaagagcagaaaggccgccggcgaccacgccaagggcctgcacatccccagactgaccgaggtgttcctggtgctggtgcagggcaccagcctgatccagagactgatgagcgtggcctacacctacgacaacctggcccccagagtgctgaaggcccagagcgaccacagaagcagacacgaggtgagccactacagcatgtggctgctggtgagctgggcccactgctgcagcctggtgaagagcagcctggccgacagcgaccacctgcaggactggctgaagaagctgaccctgctgatccccgagaccgccgtgagacacgagagctgcagcggcctgtacaagctgagcctgagcggcctggacggcggcgacagcatcaacagaagcttcctgctgctggccgccagcaccctgctgaagttcctgcccgacgcccaggccctgaagcccatcagaatcgacgactacgaggaggagcccatcctgaagcccggctgcaaggagtacttctggctgctgtgcaagctggtggacaacatccacatcaaggacgccagccagaccaccctgctggacctggacgccctggccagacacctggccgactgcatcagaagcagagagatcctggaccaccaggacggcaacgtggaggacgacggcctgaccggcctgctgagactggccaccagcgtggtgaagcacaagccccccttcaagttcagcagagagggccaggagttcctgagagacatcttcaacctgctgttcctgctgcccagcctgaaggacagacagcagcccaagtgcaagagccacagcagcagagccgccgcctacgacctgctggtggagatggtgaagggcagcgtggagaactacagactgatccacaactgggtgatggcccagcacatgcagagccacgccccctacaagtgggactactggccccacgaggacgtgagagccgagtgcagattcgtgggcctgaccaacctgggcgccacctgctacctggccagcaccatccagcagctgtacatgatccccgaggccagacaggccgtgttcaccgccaagtacagcgaggacatgaagcacaagaccaccctgctggagctgcagaagatgttcacctacctgatggagagcgagtgcaaggcctacaaccccagacccttctgcaagacctacaccatggacaagcagcccctgaacaccggcgagcagaaggacatgaccgagttcttcaccgacctgatcaccaagatcgaggagatgagccccgagctgaagaacaccgtgaagagcctgttcggcggcgtgatcaccaacaacgtggtgagcctggactgcgagcacgtgagccagaccgccgaggagttctacaccgtgagatgccaggtggccgacatgaagaacatctacgagagcctggacgaggtgaccatcaaggacaccctggagggcgacaacatgtacacctgcagccactgcggcaagaaggtgagagccgagaagagagcctgcttcaagaagctgcccagaatcctgagcttcaacaccatgagatacaccttcaacatggtgaccatgatgaaggagaaggtgaacacccacttcagcttccccctgagactggacatgaccccctacaccgaggacttcctgatgggcaagagcgagagaaaggagggcttcaaggaggtgagcgaccacagcaaggacagcgagagctacgagtacgacctgatcggcgtgaccgtgcacaccggcaccgccgacggcggccactactacagcttcatcagagacatcgtgaacccccacgcctacaagaacaacaagtggtacctgttcaacgacgccgaggtgaagcccttcgacagcgcccagctggccagcgagtgcttcggcggcgagatgaccaccaagacctacgacagcgtgaccgacaagttcatggacttcagcttcgagaagacccacagcgcctacatgctgttctacaagagaatggagcccgaggaggagaacggcagagagtacaagttcgacgtgagcagcgagctgctggagtggatctggcacgacaacatgcagttcctgcaggacaagaacatcttcgagcacacctacttcggcttcatgtggcagctgtgcagctgcatccccagcaccctgcccgaccccaaggccgtgagcctgatgaccgccaagctgagcaccagcttcgtgctggagaccttcatccacagcaaggagaagcccaccatgctgcagtggatcgagctgctgaccaagcagttcaacaacagccaggccgcctgcgagtggttcctggacagaatggccgacgacgactggtggcccatgcagatcctgatcaagtgccccaaccagatcgtgagacagatgttccagagactgtgcatccacgtgatccagagactgagacccgtgcacgcccacctgtacctgcagcccggcatggaggacggcagcgacgacatggacaccagcgtggaggacatcggcggcagaagctgcgtgaccagattcgtgagaaccctgctgctgatcatggagcacggcgtgaagccccacagcaagcacctgaccgagtacttcgccttcctgtacgagttcgccaagatgggcgaggaggagagccagttcctgctgagcctgcaggccatcagcaccatggtgcacttctacatgggcaccaagggccccgagaacccccaggtggaggtgctgagcgaggaggagggcgaggaggaggaggaggaggaggacatcctgagcctggccgaggagaagtacagacccgccgccctggagaagatgatcgccctggtggccctgctggtggagcagagcagaagcgagagacacctgaccctgagccagaccgacatggccgccctgaccggcggcaagggcttccccttcctgttccagcacatcagagacggcatcaacatcagacagacctgcaacctgatcttcagcctgtgcagatacaacaacagactggccgagcacatcgtgagcatgctgttcaccagcatcgccaagctgacccccgaggccgccaaccccttcttcaagctgctgaccatgctgatggagttcgccggcggcccccccggcatgccccccttcgccagctacatcctgcagagaatctgggaggtgatcgagtacaaccccagccagtgcctggactggctggccgtgcagacccccagaaacaagctggcccacagctgggtgctgcagaacatggagaactgggtggagagattcctgctggcccacaactaccccagagtgagaaccagcgccgcctacctgctggtgagcctgatccccagcaacagcttcagacagatgttcagaagcaccagaagcctgcacatccccaccagagacctgcccctgagccccgacaccaccgtggtgctgcaccaggtgtacaacgtgctgctgggcctgctgagcagagccaagctgtacgtggacgccgccgtgcacggcaccaccaagctggtgccctacttcagcttcatgacctactgcctgatcagcaagaccgagaagctgatgttcagcacctacttcatggacctgtggaacctgttccagcccaagctgagcgagcccgccatcgccaccaaccacaacaagcaggccctgctgagcttctggtacaacgtgtgcgccgactgccccgagaacatcagactgatcgtgcagaaccccgtggtgaccaagaacatcgccttcaactacatcctggccgaccacgacgaccaggacgtggtgctgttcaacagaggcatgctgcccgcctactacggcatcctgagactgtgctgcgagcagagccccgccttcaccagacagctggccagccaccagaacatccagtgggccttcaagaacctgaccccccacgccagccagtaccccggcgccgtggaggagctgttcaacctgatgcagctgttcatcgcccagagacccgacatgagagaggaggagctggaggacatcaagcagttcaagaagaccaccatcagctgctacctgagatgccaggccctgatccagtggcaggagagaatcgagttcgcccacaagctgctgaccctgctgaacagctacagcccccccgagctgagaaacgcctgcatcgacgtgctgaaggagctggtgctgctgagcccccacgacttcctgcacaccctggtgcccttcctgcagcacaaccactgcacctaccaccacagcaacatccccatgagcctgggcccctacttcccctgcagagagaacatcaagctgatcggcggcaagagcaacatcagaccccccagacccgagctgaacatgtgcctgctgcccaccatggtggagaccagcaagggcaaggacgacgtgtacgacagaatgctgctggactacttcttcagctaccaccagttcatccacctgctgtgcagagtggccatcaactgcgagaagttcaccgagaccctggtgaagctgagcgtgctggtggcctacgagggcctgcccctgcacctggccctgttccccaagctgtggaccgagctgtgccagacccagagcgccatgagcaagaactgcatcaagctgctgtgcgaggaccccgtgttcgccgagtacatcaagtgcatcctgatggacgagagaaccttcctgaacaacaacatcgtgtacaccttcatgacccacttcctgctgaaggtgcagagccaggtgttcagcgaggccaactgcgccaacctgatcagcaccctgatcaccaacctgatcagccagtaccagaacctgcagagcgacttcagcaacagagtggagatcagcaaggccagcgccagcctgaacggcgacctgagagccctggccctgctgctgagcgtgcacacccccaagcagctgaaccccgccctgatccccaccctgcaggagctgctgagcaagtgcagaacctgcctgcagcagagaaacagcctgcaggagcaggaggccaaggagagaaagaccaaggacgacgagggcgccacccccatcaagagaagaagagtgagcagcgacgaggagcacaccgtggacagctgcatcagcgacatgaagaccgagaccagagaggtgctgacccccaccagcaccagcgacaacgagaccagagacagcagcatcatcgaccccggcaccgagcaggacctgcccagccccgagaacagcagcgtgaaggagtacagaatggaggtgcccagcagcttcagcgaggacatgagcaacatcagaagccagcacgccgaggagcagagcaacaacggcagatacgacgactgcaaggagttcaaggacctgcactgcagcaaggacagcaccctggccgaggaggagagcgagttccccagcaccagcatcagcgccgtgctgagcgacctggccgacctgagaagctgcgacggccaggccctgcccagccaggaccccgaggtggccctgagcctgagctgcggccacagcagaggcctgttcagccacatgcagcagcacgacatcctggacaccctgtgcagaaccatcgagagcaccatccacgtggtgaccagaatcagcggcaagggcaaccaggccgccagctag

SEQ ID NO: 25534 - DNA, 10641 bp, Artificial Sequence
  Description of Artificial Sequence: Synthetic coding sequence
atgtgcgagaactgcgccgacctggtggaggtgctgaacgagatcagcgacgtggagggcggcgacggcctgcagctgagaaaggagcacaccctgaagatcttcacctacatcaacagctggacccagagacagtgcctgtgctgcttcaaggagtacaagcacctggagatcttcaaccaggtggtgtgcgccctgatcaacctggtgatcgcccaggtgcaggtgctgagagaccagctgtgcaagcactgcaccaccatcaacatcgacagcacctggcaggacgagagcaaccaggccgaggagcccctgaacatcgacagagagtgcaacgagggcagcaccgagagacagaagagcatcgagaagaagagcaacagcaccagaatctgcaacctgaccgaggaggagagcagcaagagcagcgaccccttcagcctgtggagcaccgacgagaaggagaagctgctgctgtgcgtggccaagatcttccagatccagttccccctgtacaccgcctacaagcacaacacccaccccaccatcgaggacatcagcacccaggagagcaacatcctgggcgccttctgcgacatgaacgacgtggaggtgcccctgcacctgctgagatacgtgtgcctgttctgcggcaagaacggcctgagcctgatgaaggactgcttcgagtacggcacccccgagaccctgcccttcctgatcgcccacgccttcatcaccgtggtgagcaacatcagaatctggctgcacatccccgccgtgatgcagcacatcatccccttcagaacctacgtgatcagatacctgtgcaagctgagcgaccaggagctgagacagagcgccgccagaaacatggccgacctgatgtggagcaccgtgaaggagcccctggacaccaccctgtgcttcgacaaggagagcctggacctggccttcaagtacttcatgagccccaccctgaccatgagactggccggcctgagccagatcaccaaccagctgcacaccttcaacgacgtgtgcaacaacgagagcctggtgagcgacaccgagaccagcatcgccaaggagctggccgactggctgatcagcaacaacgtggtggagcacatcttcggccccaacctgcacatcgagatcatcaagcagtgccaggtgatcctgaacttcctggccgccgagggcagactgagcacccagcacatcgactgcatctgggccgccgcccagctgaagcactgcagcagatacatccacgacctgttccccagcctgatcaagaacctggaccccgtgcccctgagacacctgctgaacctggtgagcgccctggagcccagcgtgcacaccgagcagaccctgtacctggccagcatgctgatcaaggccctgtggaacaacgccctggccgccaaggcccagctgagcaagcagagcagcttcgccagcctgctgaacaccaacatccccatcggcaacaagaaggaggaggaggagctgagaagaaccgcccccagcccctggagccccgccgccagcccccagagcagcgacaacagcgacacccaccagagcggcggcagcgacatcgagatggacgagcagctgatcaacagaaccaagcacgtgcagcagagactgagcgacaccgaggagagcatgcagggcagcagcgacgagaccgccaacagcggcgaggacggcagcagcggccccggcagcagcagcggccacagcgacggcagcagcaacgaggtgaacagcagccacgccagccagagcgccggcagccccggcagcgaggtgcagagcgaggacatcgccgacatcgaggccctgaaggaggaggacgaggacgacgaccacggccacaacccccccaagagcagctgcggcaccgacctgagaaacagaaagctggagagccaggccggcatctgcctgggcgacagccagggcatgagcgagagaaacggcaccagcagcggcaccggcaaggacctggtgttcaacaccgagagcctgcccagcgtggacaacagaatgagaatgctggacgcctgcagccacagcgaggaccccgagcacgacatcagcggcgagatgaacgccacccacatcgcccagggcagccaggagagctgcatcaccagaaccggcgacttcctgggcgagaccatcggcaacgagctgttcaactgcagacagttcatcggcccccagcaccaccaccaccaccaccaccaccaccaccaccacgacggccacatggtggacgacatgctgagcgccgacgacgtgagctgcagcagcagccaggtgagcgccaagagcgagaagaacatggccgacttcgacggcgaggagagcggctgcgaggaggagctggtgcagatcaacagccacgccgagctgaccagccacctgcagcagcacctgcccaacctggccagcatctaccacgagcacctgagccagggccccgtggtgcacaagcaccagttcaacagcaacgccgtgaccgacatcaacctggacaacgtgtgcaagaagggcaacaccctgctgtgggacatcgtgcaggacgaggacgccgtgaacctgagcgagggcctgatcaacgaggccgagaagctgctgtgcagcctggtgtgctggttcaccgacagacagatcagaatgagattcatcgagggctgcctggagaacctgggcaacaacagaagcgtggtgatcagcctgagactgctgcccaagctgttcggcaccttccagcagttcggcagcagctacgacacccactggatcaccatgtgggccgagaaggagctgaacatgatgaagctgttcttcgacaacctggtgtactacatccagaccgtgagagagggcagacagaagcacgccctgtacagccacagcgccgaggtgcaggtgagactgcagttcctgacctgcgtgttcagcaccctgggcagccccgaccacttcagactgagcctggagcaggtggacatcctgtggcactgcctggtggaggacagcgagtgctacgacgacgccctgcactggttcctgaaccaggtgagaagcaaggaccagcacgccatgggcatggagacctacaagcacctgttcctggagaagatgccccagctgaagcccgagaccatcagcatgaccggcctgaacctgttccagcacctgtgcaacctggccagactggccaccagcgcctacgacggctgcagcaacagcgagctgtgcggcatggaccagttctggggcatcgccctgagagcccagagcggcgacgtgagcagagccgccatccagtacatcaacagctactacatcaacggcaagaccggcctggagaaggagcaggagttcatcagcaagtgcatggagagcctgatgatcgccagcagcagcctggagcaggagagccacagcagcctgatggtgatcgagagaggcctgctgatgctgaagacccacctggaggccttcagaagaagattcgcctaccacctgagacagtggcagatcgagggcaccggcatcagcagccacctgaaggccctgagcgacaagcagagcctgcccctgagagtggtgtgccagcccgccggcctgcccgacaagatgaccatcgagatgtaccccagcgaccaggtggccgacctgagagccgaggtgacccactggtacgagaacctgcagaaggagcagatcaaccagcaggcccagctgcaggagttcggccagagcaacagaaagggcgagttccccggcggcctgatgggccccgtgagaatgatcagcagcggccacgagctgaccaccgactacgacgagaaggccctgcacgagctgggcttcaaggacatgcagatggtgttcgtgagcctgggcgcccccagaagagagagaaagggcgagggcgtgcagctgcccgccagctgcctgccccccccccagaaggacaacatccccatgctgctgctgctgcaggagccccacctgaccaccctgttcgacctgctggagatgctggccagcttcaagccccccagcggcaaggtggccgtggacgacagcgagagcctgagatgcgaggagctgcacctgcacgccgagaacctgagcagaagagtgtgggagctgctgatgctgctgcccacctgccccaacatgctgatggccttccagaacatcagcgacgagcagagcaacgacggcttcaactggaaggagctgctgaagatcaagagcgcccacaagctgctgtacgccctggagatcatcgaggccctgggcaagcccaacagaagaatcagaagagagagcaccggcagctacagcgacctgtaccccgacagcgacgacagcagcgaggaccaggtggagaacagcaagaacagctggagctgcaagttcgtggccgccggcggcctgcagcagctgctggagatcttcaacagcggcatcctggagcccaaggagcaggagagctggaccgtgtggcagctggactgcctggcctgcctgctgaagctgatctgccagttcgccgtggaccccagcgacctggacctggcctaccacgacgtgttcgcctggagcggcatcgccgagagccacagaaagagaacctggcccggcaagagcagaaaggccgccggcgaccacgccaagggcctgcacatccccagactgaccgaggtgttcctggtgctggtgcagggcaccagcctgatccagagactgatgagcgtggcctacacctacgacaacctggcccccagagtgctgaaggcccagagcgaccacagaagcagacacgaggtgagccactacagcatgtggctgctggtgagctgggcccactgctgcagcctggtgaagagcagcctggccgacagcgaccacctgcaggactggctgaagaagctgaccctgctgatccccgagaccgccgtgagacacgagagctgcagcggcctgtacaagctgagcctgagcggcctggacggcggcgacagcatcaacagaagcttcctgctgctggccgccagcaccctgctgaagttcctgcccgacgcccaggccctgaagcccatcagaatcgacgactacgaggaggagcccatcctgaagcccggctgcaaggagtacttctggctgctgtgcaagctggtggacaacatccacatcaaggacgccagccagaccaccctgctggacctggacgccctggccagacacctggccgactgcatcagaagcagagagatcctggaccaccaggacggcaacgtggaggacgacggcctgaccggcctgctgagactggccaccagcgtggtgaagcacaagccccccttcaagttcagcagagagggccaggagttcctgagagacatcttcaacctgctgttcctgctgcccagcctgaaggacagacagcagcccaagtgcaagagccacagcagcagagccgccgcctacgacctgctggtggagatggtgaagggcagcgtggagaactacagactgatccacaactgggtgatggcccagcacatgcagagccacgccccctacaagtgggactactggccccacgaggacgtgagagccgagtgcagattcgtgggcctgaccaacctgggcgccacctgctacctggccagcaccatccagcagctgtacatgatccccgaggccagacaggccgtgttcaccgccaagtacagcgaggacatgaagcacaagaccaccctgctggagctgcagaagatgttcacctacctgatggagagcgagtgcaaggcctacaaccccagacccttctgcaagacctacaccatggacaagcagcccctgaacaccggcgagcagaaggacatgaccgagttcttcaccgacctgatcaccaagatcgaggagatgagccccgagctgaagaacaccgtgaagagcctgttcggcggcgtgatcaccaacaacgtggtgagcctggactgcgagcacgtgagccagaccgccgaggagttctacaccgtgagatgccaggtggccgacatgaagaacatctacgagagcctggacgaggtgaccatcaaggacaccctggagggcgacaacatgtacacctgcagccactgcggcaagaaggtgagagccgagaagagagcctgcttcaagaagctgcccagaatcctgagcttcaacaccatgagatacaccttcaacatggtgaccatgatgaaggagaaggtgaacacccacttcagcttccccctgagactggacatgaccccctacaccgaggacttcctgatgggcaagagcgagagaaaggagggcttcaaggaggtgagcgaccacagcaaggacagcgagagctacgagtacgacctgatcggcgtgaccgtgcacaccggcaccgccgacggcggccactactacagcttcatcagagacatcgtgaacccccacgcctacaagaacaacaagtggtacctgttcaacgacgccgaggtgaagcccttcgacagcgcccagctggccagcgagtgcttcggcggcgagatgaccaccaagacctacgacagcgtgaccgacaagttcatggacttcagcttcgagaagacccacagcgcctacatgctgttctacaagagaatggagcccgaggaggagaacggcagagagtacaagttcgacgtgagcagcgagctgctggagtggatctggcacgacaacatgcagttcctgcaggacaagaacatcttcgagcacacctacttcggcttcatgtggcagctgtgcagctgcatccccagcaccctgcccgaccccaaggccgtgagcctgatgaccgccaagctgagcaccagcttcgtgctggagaccttcatccacagcaaggagaagcccaccatgctgcagtggatcgagctgctgaccaagcagttcaacaacagccaggccgcctgcgagtggttcctggacagaatggccgacgacgactggtggcccatgcagatcctgatcaagtgccccaaccagatcgtgagacagatgttccagagactgtgcatccacgtgatccagagactgagacccgtgcacgcccacctgtacctgcagcccggcatggaggacggcagcgacgacatggacaccagcgtggaggacatcggcggcagaagctgcgtgaccagattcgtgagaaccctgctgctgatcatggagcacggcgtgaagccccacagcaagcacctgaccgagtacttcgccttcctgtacgagttcgccaagatgggcgaggaggagagccagttcctgctgagcctgcaggccatcagcaccatggtgcacttctacatgggcaccaagggccccgagaacccccaggtggaggtgctgagcgaggaggagggcgaggaggaggaggaggaggaggacatcctgagcctggccgaggagaagtacagacccgccgccctggagaagatgatcgccctggtggccctgctggtggagcagagcagaagcgagagacacctgaccctgagccagaccgacatggccgccctgaccggcggcaagggcttccccttcctgttccagcacatcagagacggcatcaacatcagacagacctgcaacctgatcttcagcctgtgcagatacaacaacagactggccgagcacatcgtgagcatgctgttcaccagcatcgccaagctgacccccgaggccgccaaccccttcttcaagctgctgaccatgctgatggagttcgccggcggcccccccggcatgccccccttcgccagctacatcctgcagagaatctgggaggtgatcgagtacaaccccagccagtgcctggactggctggccgtgcagacccccagaaacaagctggcccacagctgggtgctgcagaacatggagaactgggtggagagattcctgctggcccacaactaccccagagtgagaaccagcgccgcctacctgctggtgagcctgatccccagcaacagcttcagacagatgttcagaagcaccagaagcctgcacatccccaccagagacctgcccctgagccccgacaccaccgtggtgctgcaccaggtgtacaacgtgctgctgggcctgctgagcagagccaagctgtacgtggacgccgccgtgcacggcaccaccaagctggtgccctacttcagcttcatgacctactgcctgatcagcaagaccgagaagctgatgttcagcacctacttcatggacctgtggaacctgttccagcccaagctgagcgagcccgccatcgccaccaaccacaacaagcaggccctgctgagcttctggtacaacgtgtgcgccgactgccccgagaacatcagactgatcgtgcagaaccccgtggtgaccaagaacatcgccttcaactacatcctggccgaccacgacgaccaggacgtggtgctgttcaacagaggcatgctgcccgcctactacggcatcctgagactgtgctgcgagcagagccccgccttcaccagacagctggccagccaccagaacatccagtgggccttcaagaacctgaccccccacgccagccagtaccccggcgccgtggaggagctgttcaacctgatgcagctgttcatcgcccagagacccgacatgagagaggaggagctggaggacatcaagcagttcaagaagaccaccatcagctgctacctgagatgcctggacggcagaagctgctggaccaccctgatcagcgccttcagaatcctgctggagagcgacgaggacagactgctggtggtgttcaacagaggcctgatcctgatgaccgagagcttcaacaccctgcacatgatgtaccacgaggccaccgcctgccacgtgaccggcgacctggtggagctgctgagcatcttcctgagcgtgctgaagagcaccagaccctacctgcagagaaaggacgtgaagcaggccctgatccagtggcaggagagaatcgagttcgcccacaagctgctgaccctgctgaacagctacagcccccccgagctgagaaacgcctgcatcgacgtgctgaaggagctggtgctgctgagcccccacgacttcctgcacaccctggtgcccttcctgcagcacaaccactgcacctaccaccacagcaacatccccatgagcctgggcccctacttcccctgcagagagaacatcaagctgatcggcggcaagagcaacatcagaccccccagacccgagctgaacatgtgcctgctgcccaccatggtggagaccagcaagggcaaggacgacgtgtacgacagaatgctgctggactacttcttcagctaccaccagttcatccacctgctgtgcagagtggccatcaactgcgagaagttcaccgagaccctggtgaagctgagcgtgctggtggcctacgagggcctgcccctgcacctggccctgttccccaagctgtggaccgagctgtgccagacccagagcgccatgagcaagaactgcatcaagctgctgtgcgaggaccccgtgttcgccgagtacatcaagtgcatcctgatggacgagagaaccttcctgaacaacaacatcgtgtacaccttcatgacccacttcctgctgaaggtgcagagccaggtgttcagcgaggccaactgcgccaacctgatcagcaccctgatcaccaacctgatcagccagtaccagaacctgcagagcgacttcagcaacagagtggagatcagcaaggccagcgccagcctgaacggcgacctgagagccctggccctgctgctgagcgtgcacacccccaagcagctgaaccccgccctgatccccaccctgcaggagctgctgagcaagtgcagaacctgcctgcagcagagaaacagcctgcaggagcaggaggccaaggagagaaagaccaaggacgacgagggcgccacccccatcaagagaagaagagtgagcagcgacgaggagcacaccgtggacagctgcatcagcgacatgaagaccgagaccagagaggtgctgacccccaccagcaccagcgacaacgagaccagagacagcagcatcatcgaccccggcaccgagcaggacctgcccagccccgagaacagcagcgtgaaggagtacagaatggaggtgcccagcagcttcagcgaggacatgagcaacatcagaagccagcacgccgaggagcagagcaacaacggcagatacgacgactgcaaggagttcaaggacctgcactgcagcaaggacagcaccctggccgaggaggagagcgagttccccagcaccagcatcagcgccgtgctgagcgacctggccgacctgagaagctgcgacggccaggccctgcccagccaggaccccgaggtggccctgagcctgagctgcggccacagcagaggcctgttcagccacatgcagcagcacgacatcctggacaccctgtgcagaaccatcgagagcaccatccacgtggtgaccagaatcagcggcaagggcaaccaggccgccagctag

SEQ ID NO: 25535 - DNA, 1815 bp, Artificial Sequence
  Description of Artificial Sequence: Synthetic coding sequence
atgcccggcctgagaagaagagccagctggagagtgagcatccccggcagctggcccagccagaccagagccagactggtgagcagcacctgggccacccacgccatgagcaccgccagcttcagaccctacagctggagactgagcagcttcagacactgcgtgctgagactgaccgagaacaacagccagcccctgatgaccaagctgcagtggctgttcggcttcctggagcacagccagagacccgccatcagccccgagaacttcctgagcgccagctggaccccctggttcagccccggcacccagcaggactgcagcgagtacctgaagtacctgctggacagactgcacgaggaggagaagaccggcaccagaatctgccagaagctgaagcagagcagcagccccagcccccccgaggagccccccgcccccagcagcaccagcgtggagaagatgttcggcggcaagatcgtgaccagaatctgctgcctgtgctgcctgaacgtgagcagcagagaggaggccttcaccgacctgagcctggccttccccccccccgagagatgcagaagaagaagactgggcagcgtgatgagacccaccgaggacatcaccgccagagagctgcccccccccaccagcgcccagggccccggcagagtgggccccagaagacagagaaagcactgcatcaccgaggacaccccccccaccagcctgtacatcgagggcctggacagcaaggaggccggcggccagagcagccaggaggagagaatcgagagagaggaggagggcaaggaggagagaaccgagaaggaggaggtgggcgaggaggaggagagcaccagaggcgagggcgagagagagaaggaggaggaggtggaggaggaggaggagaaggtggagaaggagaccgagaaggaggccgagcaggagaaggaggaggacagcctgggcgccggcacccaccccgacgccgccatccccagcggcgagagaacctgcggcagcgagggcagcagaagcgtgctggacctggtgaactacttcctgagccccgagaagctgaccgccgagaacagatactactgcgagagctgcgccagcctgcaggacgccgagaaggtggtggagctgagccagggcccctgctacctgatcctgaccctgctgagattcagcttcgacctgagaaccatgagaagaagaaagatcctggacgacgtgagcatccccctgctgctgagactgcccctggccggcggcagaggccaggcctacgacctgtgcagcgtggtggtgcacagcggcgtgagcagcgagagcggccactactactgctacgccagagagggcgccgccagacccgccgccagcctgggcaccgccgacagacccgagcccgagaaccagtggtacctgttcaacgacaccagagtgagcttcagcagcttcgagagcgtgagcaacgtgaccagcttcttccccaaggacaccgcctacgtgctgttctacagacagagacccagagagggccccgaggccgagctgggcagcagcagagtgagaaccgagcccaccctgcacaaggacctgatggaggccatcagcaaggacaacatcctgtacctgcaggagcaggagaaggaggccagaagcagagccgcctacatcagcgccctgcccaccagcccccactggggcagaggcttcgacgaggacaaggacgaggacgagggcagccccggcggctgcaaccccgccggcggcaacggcggcgacttccacagactggtgttctag

SEQ ID NO: 25536 - DNA, 3057 bp, Artificial Sequence
  Description of Artificial Sequence: Synthetic coding sequence
atggacaagatcctggaggccgtggtgaccagcagctaccccgtgagcgtgaagcagggcctggtgagaagagtgctggaggccgccagacagcccctggagagagagcagtgcctggccctgctggccctgggcgccagactgtacgtgggcggcgccgaggagctgcccagaagagtgggctgccagctgctgcacgtggccggcagacaccaccccgacgtgttcgccgagttcttcagcgccagaagagtgctgagactgctgcagggcggcgccggcccccccggccccagagccctggcctgcgtgcagctgggcctgcagctgctgcccgagggccccgccgccgacgaggtgttcgccctgctgagaagagaggtgctgagaaccgtgtgcgagagacccggccccgccgcctgcgcccaggtggccagactgctggccagacaccccagatgcgtgcccgacggcccccacagactgctgttctgccagcagctggtgagatgcctgggcagattcagatgccccgccgagggcgaggagggcgccgtggagttcctggagcaggcccagcaggtgagcggcctgctggcccagctgtggagagcccagcccgccgccatcctgccctgcctgaaggagctgttcgccgtgatcagctgcgccgaggaggagccccccagcagcgccctggccagcgtggtgcagcacctgcccctggagctgatggacggcgtggtgagaaacctgagcaacgacgacagcgtgaccgacagccagatgctgaccgccatcagcagaatgatcgactgggtgagctggcccctgggcaagaacatcgacaagtggatcatcgccctgctgaagggcctggccgccgtgaagaagttcagcatcctgatcgaggtgagcctgaccaagatcgagaaggtgttcagcaagctgctgtaccccatcgtgagaggcgccgccctgagcgtgctgaagtacatgctgctgaccttccagcacagccacgaggccttccacctgctgctgccccacatcccccccatggtggccagcctggtgaaggaggacagcaacagcggcaccagctgcctggagcagctggccgagctggtgcactgcatggtgttcagattccccggcttccccgacctgtacgagcccgtgatggaggccatcaaggacctgcacgtgcccaacgaggacagaatcaagcagctgctgggccaggacgcctggaccagccagaagagcgagctggccggcttctaccccagactgatggccaagagcgacaccggcaagatcggcctgatcaacctgggcaacacctgctacgtgaacagcatcctgcaggccctgttcatggccagcgacttcagacactgcgtgctgagactgaccgagaacaacagccagcccctgatgaccaagctgcagtggctgttcggcttcctggagcacagccagagacccgccatcagccccgagaacttcctgagcgccagctggaccccctggttcagccccggcacccagcaggactgcagcgagtacctgaagtacctgctggacagactgcacgaggaggagaagaccggcaccagaatctgccagaagctgaagcagagcagcagccccagcccccccgaggagccccccgcccccagcagcaccagcgtggagaagatgttcggcggcaagatcgtgaccagaatctgctgcctgtgctgcctgaacgtgagcagcagagaggaggccttcaccgacctgagcctggccttccccccccccgagagatgcagaagaagaagactgggcagcgtgatgagacccaccgaggacatcaccgccagagagctgcccccccccaccagcgcccagggccccggcagagtgggccccagaagacagagaaagcactgcatcaccgaggacaccccccccaccagcctgtacatcgagggcctggacagcaaggaggccggcggccagagcagccaggaggagagaatcgagagagaggaggagggcaaggaggagagaaccgagaaggaggaggtgggcgaggaggaggagagcaccagaggcgagggcgagagagagaaggaggaggaggtggaggaggaggaggagaaggtggagaaggagaccgagaaggaggccgagcaggagaaggaggaggacagcctgggcgccggcacccaccccgacgccgccatccccagcggcgagagaacctgcggcagcgagggcagcagaagcgtgctggacctggtgaactacttcctgagccccgagaagctgaccgccgagaacagatactactgcgagagctgcgccagcctgcaggacgccgagaaggtggtggagctgagccagggcccctgctacctgatcctgaccctgctgagattcagcttcgacctgagaaccatgagaagaagaaagatcctggacgacgtgagcatccccctgctgctgagactgcccctggccggcggcagaggccaggcctacgacctgtgcagcgtggtggtgcacagcggcgtgagcagcgagagcggccactactactgctacgccagagagggcgccgccagacccgccgccagcctgggcaccgccgacagacccgagcccgagaaccagtggtacctgttcaacgacaccagagtgagcttcagcagcttcgagagcgtgagcaacgtgaccagcttcttccccaaggacaccgcctacgtgctgttctacagacagagacccagagagggccccgaggccgagctgggcagcagcagagtgagaaccgagcccaccctgcacaaggacctgatggaggccatcagcaaggacaacatcctgtacctgcaggagcaggagaaggaggccagaagcagagccgcctacatcagcgccctgcccaccagcccccactggggcagaggcttcgacgaggacaaggacgaggacgagggcagccccggcggctgcaaccccgccggcggcaacggcggcgacttccacagactggtgttctag

SEQ ID NO: 25537 - DNA, 3129 bp, Artificial Sequence
  Description of Artificial Sequence: Synthetic coding sequence
atggacaagatcctggagggcctggtgagcagcagccaccccctgcccctgaagagagtgatcgtgagaaaggtggtggagagcgccgagcactggctggacgaggcccagtgcgaggccatgttcgacctgaccaccagactgatcctggagggccaggaccccttccagagacaggtgggccaccaggtgctggaggcctacgccagataccacagacccgagttcgagagcttcttcaacaagaccttcgtgctgggcctgctgcaccagggctaccacagcctggacagaaaggacgtggccatcctggactacatccacaacggcctgaagctgatcatgagctgccccagcgtgctggacctgttcagcctgctgcaggtggaggtgctgagaatggtgtgcgagagacccgagccccagctgtgcgccagactgagcgacctgctgaccgacttcgtgcagtgcatccccaagggcaagctgagcatcaccttctgccagcagctggtgagaaccatcggccacttccagtgcgtgagcacccaggagagagagctgagagagtacgtgagccaggtgaccaaggtgagcaacctgctgcagaacatctggaaggccgagcccgccaccctgctgcccagcctgcaggaggtgttcgccagcatcagcagcaccgacgccagcttcgagcccagcgtggccctggccagcctggtgcagcacatccccctgcagatgatcaccgtgctgatcagaagcctgaccaccgaccccaacgtgaaggacgccagcatgacccaggccctgtgcagaatgatcgactggctgagctggcccctggcccagcacgtggacacctgggtgatcgccctgctgaagggcctggccgccgtgcagaagttcaccatcctgatcgacgtgaccctgctgaagatcgagctggtgttcaacagactgtggttccccctggtgagacccggcgccctggccgtgctgagccacatgctgctgagcttccagcacagccccgaggccttccacctgatcgtgccccacgtggtgaacctggtgcacagcttcaagaacgacggcctgcccagcagcaccgccttcctggtgcagctgaccgagctgatccactgcatgatgtaccactacagcggcttccccgacctgtacgagcccatcctggaggccatcaaggacttccccaagcccagcgaggagaagatcaagctgatcctgaaccagagcgcctggaccagccagagcaacagcctggccagctgcctgagcagactgagcggcaagagcgagaccggcaagaccggcctgatcaacctgggcaacacctgctacatgaacagcgtgatccaggccctgttcatggccaccgacttcagaagacaggtgctgagcctgaacctgaacggctgcaacagcctgatgaagaagctgcagcacctgttcgccttcctggcccacacccagagagaggcctacgcccccagaatcttcttcgaggccagcagacccccctggttcacccccagaagccagcaggactgcagcgagtacctgagattcctgctggacagactgcacgaggaggagaagatcctgaaggtgcaggccagccacaagcccagcgagatcctggagtgcagcgagaccagcctgcaggaggtggccagcaaggccgccgtgctgaccgagacccccagaaccagcgacggcgagaagaccctgatcgagaagatgttcggcggcaagctgagaacccacatcagatgcctgaactgcagaagcaccagccagaaggtggaggccttcaccgacctgagcctggccttctgccccagcagcagcctggagaacatgagcgtgcaggaccccgccagcagccccagcatccaggacggcggcctgatgcaggccagcgtgcccggccccagcgaggagcccgtggtgtacaaccccaccaccgccgccttcatctgcgacagcctggtgaacgagaagaccatcggcagcccccccaacgagttctactgcagcgagaacaccagcgtgcccaacgagagcaacaagatcctggtgaacaaggacgtgccccagaagcccggcggcgagaccacccccagcgtgaccgacctgctgaactacttcctggcccccgagatcctgaccggcgacaaccagtactactgcgagaactgcgccagcctgcagaacgccgagaagaccatgcagatcaccgaggagcccgagtacctgatcctgaccctgctgagattcagctacgaccagaagtaccacgtgagaagaaagatcctggacaacgtgagcctgcccctggtgctggagctgcccgtgaagagaatcaccagcttcagcagcctgagcgagagctggagcgtggacgtggacttcaccgacctgagcgagaacctggccaagaagctgaagcccagcggcaccgacgaggccagctgcaccaagctggtgccctacctgctgagcagcgtggtggtgcacagcggcatcagcagcgagagcggccactactacagctacgccagaaacatcaccagcaccgacagcagctaccagatgtaccaccagagcgaggccctggccctggccagcagccagagccacctgctgggcagagacagccccagcgccgtgttcgagcaggacctggagaacaaggagatgagcaaggagtggttcctgttcaacgacagcagagtgaccttcaccagcttccagagcgtgcagaagatcaccagcagattccccaaggacaccgcctacgtgctgctgtacaagaagcagcacagcaccaacggcctgagcggcaacaaccccaccagcggcctgtggatcaacggcgacccccccctgcagaaggagctgatggacgccatcaccaaggacaacaagctgtacctgcaggagcaggagctgaacgccagagccagagccctgcaggccgccagcgccagctgcagcttcagacccaacggcttcgacgacaacgacccccccggcagctgcggccccaccggcggcggcggcggcggcggcttcaacaccgtgggcagactggtgttctag

SEQ ID NO: 25538 - DNA, 3708 bp, Artificial Sequence
  Description of Artificial Sequence: Synthetic coding sequence
atgttcggcgacctgttcgaggaggagtacagcaccgtgagcaacaaccagtacggcaagggcaagaagctgaagaccaaggccctggagccccccgcccccagagagttcaccaacctgagcggcatcagaaaccagggcggcacctgctacctgaacagcctgctgcagaccctgcacttcacccccgagttcagagaggccctgttcagcctgggccccgaggagctgggcctgttcgaggacaaggacaagcccgacgccaaggtgagaatcatccccctgcagctgcagagactgttcgcccagctgctgctgctggaccaggaggccgccagcaccgccgacctgaccgacagcttcggctggaccagcaacgaggagatgagacagcacgacgtgcaggagctgaacagaatcctgttcagcgccctggagaccagcctggtgggcaccagcggccacgacctgatctacagactgtaccacggcaccatcgtgaaccagatcgtgtgcaaggagtgcaagaacgtgagcgagagacaggaggacttcctggacctgaccgtggccgtgaagaacgtgagcggcctggaggacgccctgtggaacatgtacgtggaggaggaggtgttcgactgcgacaacctgtaccactgcggcacctgcgacagactggtgaaggccgccaagagcgccaagctgagaaagctgccccccttcctgaccgtgagcctgctgagattcaacttcgacttcgtgaagtgcgagagatacaaggagaccagctgctacaccttccccctgagaatcaacctgaagcccttctgcgagcagagcgagctggacgacctggagtacatctacgacctgttcagcgtgatcatccacaagggcggctgctacggcggccactaccacgtgtacatcaaggacgtggaccacctgggcaactggcagttccaggaggagaagagcaagcccgacgtgaacctgaaggacctgcagagcgaggaggagatcgaccaccccctgatgatcctgaaggccatcctgctggaggagaacaacctgatccccgtggaccagctgggccagaagctgctgaagaagatcggcatcagctggaacaagaagtacagaaagcagcacggccccctgagaaagttcctgcagctgcacagccagatcttcctgctgagcagcgacgagagcaccgtgagactgctgaagaacagcagcctgcaggccgagagcgacttccagagaaacgaccagcagatcttcaagatgctgccccccgagagccccggcctgaacaacagcatcagctgcccccactggttcgacatcaacgacagcaaggtgcagcccatcagagagaaggacatcgagcagcagttccagggcaaggagagcgcctacatgctgttctacagaaagagccagctgcagagaccccccgaggccagagccaaccccagatacggcgtgccctgccacctgctgaacgagatggacgccgccaacatcgagctgcagaccaagagagccgagtgcgacagcgccaacaacaccttcgagctgcacctgcacctgggcccccagtaccacttcttcaacggcgccctgcaccccgtggtgagccagaccgagagcgtgtgggacctgaccttcgacaagagaaagaccctgggcgacctgagacagagcatcttccagctgctggagttctgggagggcgacatggtgctgagcgtggccaagctggtgcccgccggcctgcacatctaccagagcctgggcggcgacgagctgaccctgtgcgagaccgagatcgccgacggcgaggacatcttcgtgtggaacggcgtggaggtgggcggcgtgcacatccagaccggcatcgactgcgagcccctgctgctgaacgtgctgcacctggacaccagcagcgacggcgagaagtgctgccaggtgatcgagagcccccacgtgttccccgccaacgccgaggtgggcaccgtgctgaccgccctggccatccccgccggcgtgatcttcatcaacagcgccggctgccccggcggcgagggctggaccgccatccccaaggaggacatgagaaagaccttcagagagcagggcctgagaaacggcagcagcatcctgatccaggacagccacgacgacaacagcctgctgaccaaggaggagaagtgggtgaccagcatgaacgagatcgactggctgcacgtgaagaacctgtgccagctggagagcgaggagaagcaggtgaagatcagcgccaccgtgaacaccatggtgttcgacatcagaatcaaggccatcaaggagctgaagctgatgaaggagctggccgacaacagctgcctgagacccatcgacagaaacggcaagctgctgtgccccgtgcccgacagctacaccctgaaggaggccgagctgaagatgggcagcagcctgggcctgtgcctgggcaaggcccccagcagcagccagctgttcctgttcttcgccatgggcagcgacgtgcagcccggcaccgagatggagatcgtggtggaggagaccatcagcgtgagagactgcctgaagctgatgctgaagaagagcggcctgcagggcgacgcctggcacctgagaaagatggactggtgctacgaggccggcgagcccctgtgcgaggaggacgccaccctgaaggagctgctgatctgcagcggcgacaccctgctgctgatcgagggccagctgccccccctgggcttcctgaaggtgcccatctggtggtaccagctgcagggccccagcggccactgggagagccaccaggaccagaccaactgcaccagcagctggggcagagtgtggagagccaccagcagccagggcgccagcggcaacgagcccgcccaggtgagcctgctgtacctgggcgacatcgagatcagcgaggacgccaccctggccgagctgaagagccaggccatgaccctgccccccttcctggagttcggcgtgcccagccccgcccacctgagagcctggaccgtggagagaaagagacccggcagactgctgagaaccgacagacagcccctgagagagtacaagctgggcagaagaatcgagatctgcctggagcccctgcagaagggcgagaacctgggcccccaggacgtgctgctgagaacccaggtgagaatccccggcgagagaacctacgcccccgccctggacctggtgtggaacgccgcccagggcggcaccgccggcagcctgagacagagagtggccgacttctacagactgcccgtggagaagatcgagatcgccaagtacttccccgagaagttcgagtggctgcccatcagcagctggaaccagcagatcaccaagagaaagaagaagaagaagcaggactacctgcagggcgccccctactacctgaaggacggcgacaccatcggcgtgaagaacctgctgatcgacgacgacgacgacttcagcaccatcagagacgacaccggcaaggagaagcagaagcagagagccctgggcagaagaaagagccaggaggccctgcacgagcagagcagctacatcctgagcagcgccgagacccccgccagacccagagcccccgagaccagcctgagcatccacgtgggcagcttcagatag

SEQ ID NO: 25539 - DNA, 492 bp, Artificial Sequence
  Description of Artificial Sequence: Synthetic coding sequence
atgggcagcagcctgggcctgtgcctgggcaaggcccccagcagcagccagctgttcctgttcttcgccatgggcagcgacgtgcagcccggcaccgagatggagatcgtggtggaggagaccatcagcgtgagagactgcctgaagctgatgctgaagaagagcggcctgcagggcgacgcctggcacctgagaaagatggactggtgctacgaggccggcgagcccctgtgcgaggaggacgccaccctgaaggagctgctgatctgcagcggcgacaccctgctgctgatcgagggccagctgccccccctgggcttcctgaaggtgcccatctggtggtaccagctgcagggccccagcggccactgggagagccaccaggaccagaccaactgcaccagcagctggggcagagtgtggagagccaccagcagccagggcgagaacagaatgggcttccagcagcccgtgcaccacaaggagaagtag

SEQ ID NO: 25540 - DNA, 3708 bp, Artificial Sequence; identical to SEQ ID NO: 25538
  Description of Artificial Sequence: Synthetic coding sequence

SEQ ID NO: 25541 - DNA, 987 bp, Artificial Sequence
  Description of Artificial Sequence: Synthetic coding sequence
atgttcggcgacctgttcgaggaggagtacagcaccgtgagcaacaaccagtacggcaagggcaagaagctgaagaccaaggccctggagccccccgcccccagagagttcaccaacctgagcggcatcagaaaccagggcggcacctgctacctgaacagcctgctgcagaccctgcacttcacccccgagttcagagaggccctgttcagcctgggccccgaggagctgggcctgttcgaggacaaggacaagcccgacgccaaggtgagaatcatccccctgcagctgcagagactgttcgcccagctgctgctgctggaccaggaggccgccagcaccgccgacctgaccgacagcttcggctggaccagcaacgaggagatgagacagcacgacgtgcaggagctgaacagaatcctgttcagcgccctggagaccagcctggtgggcaccagcggccacgacctgatctacagactgtaccacggcaccatcgtgaaccagatcgtgtgcaaggagtgcaagaacgtgagcgagagacaggaggacttcctggacctgaccgtggccgtgaagaacgtgagcggcctggaggacgccctgtggaacatgtacgtggaggaggaggtgttcgactgcgacaacctgtaccactgcggcacctgcgacagactggtgaaggccgccaagagcgccaagctgagaaagctgccccccttcctgaccgtgagcctgctgagattcaacttcgacttcgtgaagtgcgagagatacaaggagaccagctgctacaccttccccctgagaatcaacctgaagcccttctgcgagcagagcgagctggacgacctggagtacatgaccagcagccagctgctgtacaccaaggtggccgccaccgaggccatcaccatgtacatcctgaagatgctgatcatctgggagaccggcagcttcaagagaaagaaggtgaaccagatgtag

SEQ ID NO: 25542 - DNA, 3744 bp, Artificial Sequence
  Description of Artificial Sequence: Synthetic coding sequence
atgagcctgttcctgagagtggtgttcagcttcaccatgttcggcgacctgttcgaggaggagtacagcaccgtgagcaacaaccagtacggcaagggcaagaagctgaagaccaaggccctggagccccccgcccccagagagttcaccaacctgagcggcatcagaaaccagggcggcacctgctacctgaacagcctgctgcagaccctgcacttcacccccgagttcagagaggccctgttcagcctgggccccgaggagctgggcctgttcgaggacaaggacaagcccgacgccaaggtgagaatcatccccctgcagctgcagagactgttcgcccagctgctgctgctggaccaggaggccgccagcaccgccgacctgaccgacagcttcggctggaccagcaacgaggagatgagacagcacgacgtgcaggagctgaacagaatcctgttcagcgccctggagaccagcctggtgggcaccagcggccacgacctgatctacagactgtaccacggcaccatcgtgaaccagatcgtgtgcaaggagtgcaagaacgtgagcgagagacaggaggacttcctggacctgaccgtggccgtgaagaacgtgagcggcctggaggacgccctgtggaacatgtacgtggaggaggaggtgttcgactgcgacaacctgtaccactgcggcacctgcgacagactggtgaaggccgccaagagcgccaagctgagaaagctgccccccttcctgaccgtgagcctgctgagattcaacttcgacttcgtgaagtgcgagagatacaaggagaccagctgctacaccttccccctgagaatcaacctgaagcccttctgcgagcagagcgagctggacgacctggagtacatctacgacctgttcagcgtgatcatccacaagggcggctgctacggcggccactaccacgtgtacatcaaggacgtggaccacctgggcaactggcagttccaggaggagaagagcaagcccgacgtgaacctgaaggacctgcagagcgaggaggagatcgaccaccccctgatgatcctgaaggccatcctgctggaggagaacaacctgatccccgtggaccagctgggccagaagctgctgaagaagatcggcatcagctggaacaagaagtacagaaagcagcacggccccctgagaaagttcctgcagctgcacagccagatcttcctgctgagcagcgacgagagcaccgtgagactgctgaagaacagcagcctgcaggccgagagcgacttccagagaaacgaccagcagatcttcaagatgctgccccccgagagccccggcctgaacaacagcatcagctgcccccactggttcgacatcaacgacagcaaggtgcagcccatcagagagaaggacatcgagcagcagttccagggcaaggagagcgcctacatgctgttctacagaaagagccagctgcagagaccccccgaggccagagccaaccccagatacggcgtgccctgccacctgctgaacgagatggacgccgccaacatcgagctgcagaccaagagagccgagtgcgacagcgccaacaacaccttcgagctgcacctgcacctgggcccccagtaccacttcttcaacggcgccctgcaccccgtggtgagccagaccgagagcgtgtgggacctgaccttcgacaagagaaagaccctgggcgacctgagacagagcatcttccagctgctggagttctgggagggcgacatggtgctgagcgtggccaagctggtgcccgccggcctgcacatctaccagagcctgggcggcgacgagctgaccctgtgcgagaccgagatcgccgacggcgaggacatcttcgtgtggaacggcgtggaggtgggcggcgtgcacatccagaccggcatcgactgcgagcccctgctgctgaacgtgctgcacctggacaccagcagcgacggcgagaagtgctgccaggtgatcgagagcccccacgtgttccccgccaacgccgaggtgggcaccgtgctgaccgccctggccatccccgccggcgtgatcttcatcaacagcgccggctgccccggcggcgagggctggaccgccatccccaaggaggacatgagaaagaccttcagagagcagggcctgagaaacggcagcagcatcctgatccaggacagccacgacgacaacagcctgctgaccaaggaggagaagtgggtgaccagcatgaacgagatcgactggctgcacgtgaagaacctgtgccagctggagagcgaggagaagcaggtgaagatcagcgccaccgtgaacaccatggtgttcgacatcagaatcaaggccatcaaggagctgaagctgatgaaggagctggccgacaacagctgcctgagacccatcgacagaaacggcaagctgctgtgccccgtgcccgacagctacaccctgaaggaggccgagctgaagatgggcagcagcctgggcctgtgcctgggcaaggcccccagcagcagccagctgttcctgttcttcgccatgggcagcgacgtgcagcccggcaccgagatggagatcgtggtggaggagaccatcagcgtgagagactgcctgaagctgatgctgaagaagagcggcctgcagggcgacgcctggcacctgagaaagatggactggtgctacgaggccggcgagcccctgtgcgaggaggacgccaccctgaaggagctgctgatctgcagcggcgacaccctgctgctgatcgagggccagctgccccccctgggcttcctgaaggtgcccatctggtggtaccagctgcagggccccagcggccactgggagagccaccaggaccagaccaactgcaccagcagctggggcagagtgtggagagccaccagcagccagggcgccagcggcaacgagcccgcccaggtgagcctgctgtacctgggcgacatcgagatcagcgaggacgccaccctggccgagctgaagagccaggccatgaccctgccccccttcctggagttcggcgtgcccagccccgcccacctgagagcctggaccgtggagagaaagagacccggcagactgctgagaaccgacagacagcccctgagagagtacaagctgggcagaagaatcgagatctgcctggagcccctgcagaagggcgagaacctgggcccccaggacgtgctgctgagaacccaggtgagaatccccggcgagagaacctacgcccccgccctggacctggtgtggaacgccgcccagggcggcaccgccggcagcctgagacagagagtggccgacttctacagactgcccgtggagaagatcgagatcgccaagtacttccccgagaagttcgagtggctgcccatcagcagctggaaccagcagatcaccaagagaaagaagaagaagaagcaggactacctgcagggcgccccctactacctgaaggacggcgacaccatcggcgtgaagaacctgctgatcgacgacgacgacgacttcagcaccatcagagacgacaccggcaaggagaagcagaagcagagagccctgggcagaagaaagagccaggaggccctgcacgagcagagcagctacatcctgagcagcgccgagacccccgccagacccagagcccccgagaccagcctgagcatccacgtgggcagcttcagatag

SEQ ID NO: 25543 - DNA, 1074 bp, Artificial Sequence
  Description of Artificial Sequence: Synthetic coding sequence
atggacggcgtgctgttcagagcccaccagtgccagtacgtgcacccctgcgtgcacgtgtacgtgaccgtgggcctgatggaccccctgtgcctgcagagacacaaggagcacgccaagggcagagagcccccctgccccgccctgagcaccagcggcctggtgggcctgcacaacatcggccagacctgctgcctgaacagcctgatccaggtgttcgtgatgaacgtggacttcgccagaatcctgaagagaatcaccgtgcccagaggcgccgacgagcagagaagaagcgtgcccttccagatgctgctgctgctggagaagatgcaggacagcagacagaaggccgtgtggcccctggagctggcctactgcctgcagaagtacaacgtgcccctgttcgtgcagcacgacgccgcccagctgtacctgaagctgtggaacctgatcaaggaccagatcgccgacgtgcacctggtggagagactgcaggccctgtacatgatcagaatgaaggacagcctgatctgcctggactgcgccatggagagcagcagaaacagcagcatgctgaccctgagactgagcttcttcgacgtggacagcaagcccctgaagaccctggaggacgccctgcactgcttcttccagcccagagagctgagcagcaagagcaagtgcttctgcgagaactgcggcaagaagaccagaggcaagcaggtgctgaagctgacccacctgccccagaccctgaccatccacctgatgagattcagcatcagaaacagccagaccagaaagatctgccacagcctgtacttcccccagagcctggacttcagccagatcctgcccatgaagagagagagctgcgacgccgaggagcagagcggcggccagtacgagctgttcgccgtgatcgcccacgtgggcatggccgacagcggccactactgcgtgtacatcagaaacgccgtggacggcaagtggttctgcttcaacgacagcaacatctgcctggtgagctgggaggacatccagtgcacctacggcaaccccaactaccactag

SEQ ID NO: 25544 - DNA, 3951 bp, Artificial Sequence
  Description of Artificial Sequence: Synthetic coding sequence
atgaccatcgtggacaaggccagcgagagcagcgaccccagcgcctaccagaaccagcccggcagcagcgaggccgtgagccccggcgacatggacgccggcagcgccagctggggcgccgtgagcagcctgaacgacgtgagcaaccacaccctgagcctgggccccgtgcccggcgccgtggtgtacagcagcagcagcgtgcccgacaagagcaagcccagcccccagaaggaccaggccctgggcgacggcatcgcccccccccagaaggtgctgttccccagcgagaagatctgcctgaagtggcagcagacccacagagtgggcgccggcctgcagaacctgggcaacacctgcttcgccaacgccgccctgcagtgcctgacctacaccccccccctggccaactacatgctgagccacgagcacagcaagacctgccacgccgagggcttctgcatgatgtgcaccatgcaggcccacatcacccaggccctgagcaaccccggcgacgtgatcaagcccatgttcgtgatcaacgagatgagaagaatcgccagacacttcagattcggcaaccaggaggacgcccacgagttcctgcagtacaccgtggacgccatgcagaaggcctgcctgaacggcagcaacaagctggacagacacacccaggccaccaccctggtgtgccagatcttcggcggctacctgagaagcagagtgaagtgcctgaactgcaagggcgtgagcgacaccttcgacccctacctggacatcaccctggagatcaaggccgcccagagcgtgaacaaggccctggagcagttcgtgaagcccgagcagctggacggcgagaacagctacaagtgcagcaagtgcaagaagatggtgcccgccagcaagagattcaccatccacagaagcagcaacgtgctgaccctgagcctgaagagattcgccaacttcaccggcggcaagatcgccaaggacgtgaagtaccccgagtacctggacatcagaccctacatgagccagcccaacggcgagcccatcgtgtacgtgctgtacgccgtgctggtgcacaccggcttcaactgccacgccggccactacttctgctacatcaaggccagcaacggcctgtggtaccagatgaacgacagcatcgtgagcaccagcgacatcagaagcgtgctgagccagcaggcctacgtgctgttctacatcagaagccacgacgtgaagaacggcggcgagctgacccaccccacccacagccccggccagagcagccccagacccgtgatcagccagagagtggtgaccaacaagcaggccgcccccggcttcatcggcccccagctgcccagccacatgatcaagaaccccccccacctgaacggcaccggccccctgaaggacacccccagcagcagcatgagcagccccaacggcaacagcagcgtgaacagagccagccccgtgaacgccagcgccagcgtgcagaactggagcgtgaacagaagcagcgtgatccccgagcaccccaagaagcagaagatcaccatcagcatccacaacaagctgcccgtgagacagtgccagagccagcccaacctgcacagcaacagcctggagaaccccaccaagcccgtgcccagcagcaccatcaccaacagcgccgtgcagagcaccagcaacgccagcaccatgagcgtgagcagcaaggtgaccaagcccatccccagaagcgagagctgcagccagcccgtgatgaacggcaagagcaagctgaacagcagcgtgctggtgccctacggcgccgagagcagcgaggacagcgacgaggagagcaagggcctgggcaaggagaacggcatcggcaccatcgtgagcagccacagccccggccaggacgccgaggacgaggaggccaccccccacgagctgcaggagcccatgaccctgaacggcgccaacagcgccgacagcgacagcgaccccaaggagaacggcctggcccccgacggcgccagctgccagggccagcccgccctgcacagcgagaaccccttcgccaaggccaacggcctgcccggcaagctgatgcccgcccccctgctgagcctgcccgaggacaagatcctggagaccttcagactgagcaacaagctgaagggcagcaccgacgagatgagcgcccccggcgccgagagaggcccccccgaggacagagacgccgagccccagcccggcagccccgccgccgagagcctggaggagcccgacgccgccgccggcctgagcagcaccaagaaggcccccccccccagagaccccggcacccccgccaccaaggagggcgcctgggaggccatggccgtggcccccgaggagcccccccccagcgccggcgaggacatcgtgggcgacaccgccccccccgacctgtgcgaccccggcagcctgaccggcgacgccagccccctgagccaggacgccaagggcatgatcgccgagggccccagagacagcgccctggccgaggcccccgagggcctgagccccgccccccccgccagaagcgaggagccctgcgagcagcccctgctggtgcaccccagcggcgaccacgccagagacgcccaggaccccagccagagcctgggcgcccccgaggccgccgagagaccccccgcccccgtgctggacatggcccccgccggccaccccgagggcgacgccgagcccagccccggcgagagagtggaggacgccgccgcccccaaggcccccggccccagccccgccaaggagaagatcggcagcctgagaaaggtggacagaggccactacagaagcagaagagagagaagcagcagcggcgagcccgccagagagagcagaagcaagaccgagggccacagacacagaagaagaagaacctgccccagagagagagacagacaggacagacacgcccccgagcaccaccccggccacggcgacagactgagccccggcgagagaagaagcctgggcagatgcagccaccaccacagcagacacagaagcggcgtggagctggactgggtgagacaccactacaccgagggcgagagaggctggggcagagagaagttctaccccgacagacccagatgggacagatgcagatactaccacgacagatacgccctgtacgccgccagagactggaagcccttccacggcggcagagagcacgagagagccggcctgcacgagagaccccacaaggaccacaacagaggcagaagaggctgcgagcccgccagagagagagagagacacagacccagcagccccagagccggcgccccccacgccctggccccccaccccgacagattcagccacgacagaaccgccctggtggccggcgacaactgcaacctgagcgacagattccacgagcacgagaacggcaagagcagaaagagaagacacgacagcgtggagaacagcgacagccacgtggagaagaaggccagaagaagcgagcagaaggaccccctggaggagcccaaggccaagaagcacaagaagagcaagaagaagaagaagagcaaggacaagcacagagacagagacagcagacaccagcaggacagcgacctgagcgccgcctgcagcgacgccgacctgcacagacacaagaagaagaagaagaagaagaagagacacagcagaaagagcgaggacttcgtgaaggacagcgagctgcacctgcccagagtgaccagcctggagaccgtggcccagttcagaagagcccagggcggcttccccctgagcggcggcccccccctggagggcgtgggccccttcagagagaagaccaagcacctgagaatggagagcagagacgacagatgcagactgttcgagtacggccagggcgactag

SEQ ID NO: 25545 - DNA, 3372 bp, Artificial Sequence
  Description of Artificial Sequence: Synthetic coding sequence
atggacctgggccccggcgacgccgccggcggcggccccctggcccccagacccagaagaagaagaagcctgagaagactgttcagcagattcctgctggccctgggcagcagaagcagacccggcgacagcccccccagaccccagcccggccactgcgacggcgacggcgagggcggcttcgcctgcgcccccggccccgtgcccgccgcccccggcagccccggcgaggagagaccccccggcccccagccccagctgcagctgcccgccggcgacggcgccagaccccccggcgcccagggcctgaagaaccacggcaacacctgcttcatgaacgccgtggtgcagtgcctgagcaacaccgacctgctggccgagttcctggccctgggcagatacagagccgcccccggcagagccgaggtgaccgagcagctggccgccctggtgagagccctgtggaccagagagtacaccccccagctgagcgccgagttcaagaacgccgtgagcaagtacggcagccagttccagggcaacagccagcacgacgccctggagttcctgctgtggctgctggacagagtgcacgaggacctggagggcagcagcagaggccccgtgagcgagaagctgccccccgaggccaccaagaccagcgagaactgcctgagccccagcgcccagctgcccctgggccagagcttcgtgcagagccacttccaggcccagtacagaagcagcctgacctgcccccactgcctgaagcagagcaacaccttcgaccccttcctgtgcgtgagcctgcccatccccctgagacagaccagattcctgagcgtgaccctggtgttccccagcaagagccagagattcctgagagtgggcctggccgtgcccatcctgagcaccgtggccgccctgagaaagatggtggccgaggagggcggcgtgcccgccgacgaggtgatcctggtggagctgtaccccagcggcttccagagaagcttcttcgacgaggaggacctgaacaccatcgccgagggcgacaacgtgtacgccttccaggtgccccccagccccagccagggcaccctgagcgcccaccccctgggcctgagcgccagccccagactggccgccagagagggccagagattcagcctgagcctgcacagcgagagcaaggtgctgatcctgttctgcaacctggtgggcagcggccagcaggccagcagattcggcccccccttcctgatcagagaggacagagccgtgagctgggcccagctgcagcagagcatcctgagcaaggtgagacacctgatgaagagcgaggcccccgtgcagaacctgggcagcctgttcagcatcagagtggtgggcctgagcgtggcctgcagctacctgagccccaaggacagcagacccctgtgccactgggccgtggacagagtgctgcacctgagaagacccggcggccccccccacgtgaagctggccgtggagtgggacagcagcgtgaaggagagactgttcggcagcctgcaggaggagagagcccaggacgccgacagcgtgtggcagcagcagcaggcccaccagcagcacagctgcaccctggacgagtgcttccagttctacaccaaggaggagcagctggcccaggacgacgcctggaagtgcccccactgccaggtgctgcagcagggcatggtgaagctgagcctgtggaccctgcccgacatcctgatcatccacctgaagagattctgccaggtgggcgagagaagaaacaagctgagcaccctggtgaagttccccctgagcggcctgaacatggccccccacgtggcccagagaagcaccagccccgaggccggcctgggcccctggcccagctggaagcagcccgactgcctgcccaccagctaccccctggacttcctgtacgacctgtacgccgtgtgcaaccaccacggcaacctgcagggcggccactacaccgcctactgcagaaacagcctggacggccagtggtacagctacgacgacagcaccgtggagcccctgagagaggacgaggtgaacaccagaggcgcctacatcctgttctaccagaagagaaacagcatccccccctggagcgccagcagcagcatgagaggcagcaccagcagcagcctgagcgaccactggctgctgagactgggcagccacgccggcagcaccagaggcagcctgctgagctggagcagcgccccctgccccagcctgccccaggtgcccgacagccccatcttcaccaacagcctgtgcaaccaggagaagggcggcctggagcccagaagactggtgagaggcgtgaagggcagaagcatcagcatgaaggcccccaccaccagcagagccaagcagggccccttcaagaccatgcccctgagatggagcttcggcagcaaggagaagccccccggcgccagcgtggagctggtggagtacctggagagcagaagaagacccagaagcaccagccagagcatcgtgagcctgctgaccggcaccgccggcgaggacgagaagagcgccagccccagaagcaacgtggccctgcccgccaacagcgaggacggcggcagagccatcgagagaggccccgccggcgtgccctgccccagcgcccagcccaaccactgcctggcccccggcaacagcgacggccccaacaccgccagaaagctgaaggagaacgccggccaggacatcaagctgcccagaaagttcgacctgcccctgaccgtgatgcccagcgtggagcacgagaagcccgccagacccgagggccagaaggccatgaactggaaggagagcttccagatgggcagcaagagcagcccccccagcccctacatgggcttcagcggcaacagcaaggacagcagaagaggcaccagcgagctggacagacccctgcagggcaccctgaccctgctgagaagcgtgttcagaaagaaggagaacagaagaaacgagagagccgaggtgagcccccaggtgccccccgtgagcctggtgagcggcggcctgagccccgccatggacggccaggcccccggcagcccccccgccctgagaatccccgagggcctggccagaggcctgggcagcagactggagagagacgtgtggagcgcccccagcagcctgagactgcccagaaaggccagcagagcccccagaggcagcgccctgggcatgagccagagaaccgtgcccggcgagcaggccagctacggcaccttccagagagtgaagtaccacaccctgagcctgggcagaaagaagaccctgcccgagagcagcttctag

SEQ ID NO: 25546 - DNA, 3357 bp, Artificial Sequence
  Description of Artificial Sequence: Synthetic coding sequence
atggacctgggccccggcgacgccgccggcggcggccccctggcccccagacccagaagaagaagaagcctgagaagactgttcagcagattcctgctggccctgggcagcagaagcagacccggcgacagcccccccagaccccagcccggccactgcgacggcgacggcgagggcggcttcgcctgcgcccccggccccgtgcccgccgcccccggcagccccggcgaggagagaccccccggcccccagccccagctgcagctgcccgccggcgacggcgccagaccccccggcgcccagggcctgaagaaccacggcaacacctgcttcatgaacgccgtggtgcagtgcctgagcaacaccgacctgctggccgagttcctggccctgggcagatacagagccgcccccggcagagccgaggtgaccgagcagctggccgccctggtgagagccctgtggaccagagagtacaccccccagctgagcgccgagttcaagaacgccgtgagcaagtacggcagccagttccagggcaacagccagcacgacgccctggagttcctgctgtggctgctggacagagtgcacgaggacctggagggcagcagcagaggccccgtgagcgagaagctgccccccgaggccaccaagaccagcgagaactgcctgagccccagcgcccagctgcccctgggccagagcttcgtgcagagccacttccaggcccagtacagaagcagcctgacctgcccccactgcctgaagcagagcaacaccttcgaccccttcctgtgcgtgagcctgcccatccccctgagacagaccagattcctgagcgtgaccctggtgttccccagcaagagccagagattcctgagagtgggcctggccgtgcccatcctgagcaccgtggccgccctgagaaagatggtggccgaggagggcggcgtgcccgccgacgaggtgatcctggtggagctgtaccccagcggcttccagagaagcttcttcgacgaggaggacctgaacaccatcgccgagggcgacaacgtgtacgccttccaggtgccccccagccccagccagggcaccctgagcgcccaccccctgggcctgagcgccagccccagactggccgccagagagggccagagattcagcctgagcctgcacagcgagagcaaggtgctgatcctgttctgcaacctggtgggcagcggccagcaggccagcagattcggcccccccttcctgatcagagaggacagagccgtgagctgggcccagctgcagcagagcatcctgagcaaggtgagacacctgatgaagagcgaggcccccgtgcagaacctgggcagcctgttcagcatcagagtggtgggcctgagcgtggcctgcagctacctgagccccaaggacagcagacccctgtgccactgggccgtggacagagtgctgcacctgagaagacccggcggccccccccacgtgaagctggccgtggagtgggacagcagcgtgaaggagagactgttcggcagcctgcaggaggagagagcccaggacgccgacagcgtgtggcagcagcagcaggcccaccagcagcacagctgcaccctggacgagtgcttccagttctacaccaaggaggagcagctggcccaggacgacgcctggaagtgcccccactgccaggtgctgcagcagggcatggtgaagctgagcctgtggaccctgcccgacatcctgatcatccacctgaagagattctgccaggtgggcgagagaagaaacaagctgagcaccctggtgaagttccccctgagcggcctgaacatggccccccacgtggcccagagaagcaccagccccgaggccggcctgggcccctggcccagctggaagcagcccgactgcctgcccaccagctaccccctggacttcctgtacgacctgtacgccgtgtgcaaccaccacggcaacctgcaggcctactgcagaaacagcctggacggccagtggtacagctacgacgacagcaccgtggagcccctgagagaggacgaggtgaacaccagaggcgcctacatcctgttctaccagaagagaaacagcatccccccctggagcgccagcagcagcatgagaggcagcaccagcagcagcctgagcgaccactggctgctgagactgggcagccacgccggcagcaccagaggcagcctgctgagctggagcagcgccccctgccccagcctgccccaggtgcccgacagccccatcttcaccaacagcctgtgcaaccaggagaagggcggcctggagcccagaagactggtgagaggcgtgaagggcagaagcatcagcatgaaggcccccaccaccagcagagccaagcagggccccttcaagaccatgcccctgagatggagcttcggcagcaaggagaagccccccggcgccagcgtggagctggtggagtacctggagagcagaagaagacccagaagcaccagccagagcatcgtgagcctgctgaccggcaccgccggcgaggacgagaagagcgccagccccagaagcaacgtggccctgcccgccaacagcgaggacggcggcagagccatcgagagaggccccgccggcgtgccctgccccagcgcccagcccaaccactgcctggcccccggcaacagcgacggccccaacaccgccagaaagctgaaggagaacgccggccaggacatcaagctgcccagaaagttcgacctgcccctgaccgtgatgcccagcgtggagcacgagaagcccgccagacccgagggccagaaggccatgaactggaaggagagcttccagatgggcagcaagagcagcccccccagcccctacatgggcttcagcggcaacagcaaggacagcagaagaggcaccagcgagctggacagacccctgcagggcaccctgaccctgctgagaagcgtgttcagaaagaaggagaacagaagaaacgagagagccgaggtgagcccccaggtgccccccgtgagcctggtgagcggcggcctgagccccgccatggacggccaggcccccggcagcccccccgccctgagaatccccgagggcctggccagaggcctgggcagcagactggagagagacgtgtggagcgcccccagcagcctgagactgcccagaaaggccagcagagcccccagaggcagcgccctgggcatgagccagagaaccgtgcccggcgagcaggccagctacggcaccttccagagagtgaagtaccacaccctgagcctgggcagaaagaagaccctgcccgagagcagcttctag

SEQ ID NO: 25547 - DNA, 2445 bp, Artificial Sequence
  Description of Artificial Sequence: Synthetic coding sequence
atgagagtgaaggaccccaccaaggccctgcccgagaaggccaagagaagcaagagacccaccgtgccccacgacgaggacagcagcgacgacatcgccgtgggcctgacctgccagcacgtgagccacgccatcagcgtgaaccacgtgaagagagccatcgccgagaacctgtggagcgtgtgcagcgagtgcctgaaggagagaagattctacgacggccagctggtgctgaccagcgacatctggctgtgcctgaagtgcggcttccagggctgcggcaagaacagcgagagccagcacagcctgaagcacttcaagagcagcagaaccgagccccactgcatcatcatcaacctgagcacctggatcatctggtgctacgagtgcgacgagaagctgagcacccactgcaacaagaaggtgctggcccagatcgtggacttcctgcagaagcacgccagcaagacccagaccagcgccttcagcagaatcatgaagctgtgcgaggagaagtgcgagaccgacgagatccagaagggcggcaagtgcagaaacctgagcgtgagaggcatcaccaacctgggcaacacctgcttcttcaacgccgtgatgcagaacctggcccagacctacaccctgaccgacctgatgaacgagatcaaggagagcagcaccaagctgaagatcttccccagcagcgacagccagctggaccccctggtggtggagctgagcagacccggccccctgaccagcgccctgttcctgttcctgcacagcatgaaggagaccgagaagggccccctgagccccaaggtgctgttcaaccagctgtgccagaaggcccccagattcaaggacttccagcagcaggacagccaggagctgctgcactacctgctggacgccgtgagaaccgaggagaccaagagaatccaggccagcatcctgaaggccttcaacaaccccaccaccaagaccgccgacgacgagaccagaaagaaggtgaaggcctacggcaaggagggcgtgaagatgaacttcatcgacagaatcttcatcggcgagctgaccagcaccgtgatgtgcgaggagtgcgccaacatcagcaccgtgaaggaccccttcatcgacatcagcctgcccatcatcgaggagagagtgagcaagcccctgctgtggggcagaatgaacaagtacagaagcctgagagagaccgaccacgacagatacagcggcaacgtgaccatcgagaacatccaccagcccagagccgccaagaagcacagcagcagcaaggacaagagccagctgatccacgacagaaagtgcatcagaaagctgagcagcggcgagaccgtgacctaccagaagaacgagaacctggagatgaacggcgacagcctgatgttcgccagcctgatgaacagcgagagcagactgaacgagagccccaccgacgacagcgagaaggaggccagccacagcgagagcaacgtggacgccgacagcgagcccagcgagagcgagagcgccagcaagcagaccggcctgttcagaagcagcagcggcagcggcgtgcagcccgacggccccctgtaccccctgagcgccggcaagctgctgtacaccaaggagaccgacagcggcgacaaggagatggccgaggccatcagcgagctgagactgagcagcaccgtgaccggcgaccaggacttcgacagagagaaccagcccctgaacatcagcaacaacctgtgcttcctggagggcaagcacctgagaagctacagcccccagaacgccttccagaccctgagccagagctacatcaccaccagcaaggagtgcagcatccagagctgcctgtaccagttcaccagcatggagctgctgatgggcaacaacaagctgctgtgcgagaactgcaccaagaacaagcagaagtaccaggaggagaccagcttcgccgagaagaaggtggagggcgtgtacaccaacgccagaaagcagctgctgatcagcgccgtgcccgccgtgctgatcctgcacctgaagagattccaccaggccggcctgagcctgagaaaggtgaacagacacgtggacttccccctgatgctggacctggcccccttctgcagcgccacctgcaagaacgccagcgtgggcgacaaggtgctgtacggcctgtacggcatcgtggagcacagcggcagcatgagagagggccactacaccgcctacgtgaaggtgagaacccccagcagaaagctgagcgagcacaacaccaagaagaagaacgtgcccggcctgaaggccgccgacaacgagagcgccggccagtgggtgcacgtgagcgacacctacctgcaggtggtgcccgagagcagagccctgagcgcccaggcctacctgctgttctacgagagagtgctgtag

SEQ ID NO: 25548 - DNA, 870 bp, Artificial Sequence
  Description of Artificial Sequence: Synthetic coding sequence
atgagagtgaaggaccccaccaaggccctgcccgagaaggccaagagaagcaagagacccaccgtgccccacgacgaggacagcagcgacgacatcgccgtgggcctgacctgccagcacgtgagccacgccatcagcgtgaaccacgtgaagagagccatcgccgagaacctgtggagcgtgtgcagcgagtgcctgaaggagagaagattctacgacggccagctggtgctgaccagcgacatctggctgtgcctgaagtgcggcttccagggctgcggcaagaacagcgagagccagcacagcctgaagcacttcaagagcagcagaaccgagccccactgcatcatcatcaacctgagcacctggatcatctggtgctacgagtgcgacgagaagctgagcacccactgcaacaagaaggtgctggcccagatcgtggacttcctgcagaagcacgccagcaagacccagaccagcgccttcagcagaatcatgaagctgtgcgaggagaagtgcgagaccgacgagatccagaagggcggcaagtgcagaaacctgagcgtgagaggcatcaccaacctgggcaacacctgcttcttcaacgccgtgatgcagaacctggcccagacctacaccctgaccgacctgatgaacgagatcaaggagagcagcaccaagctgaagatcttccccagcagcgacagccagctggaccccctggtggtggagctgagcagacccggccccctgaccagcgccctgttcctgttcctgcacagcatgaaggagaccgagaagggccccctgagccccaaggtgctgttcaaccagctgtgccagaagtgggtgcacctgcacctgatctag

SEQ ID NO: 25549 - DNA, 549 bp, Artificial Sequence
  Description of Artificial Sequence: Synthetic coding sequence
atgagagtgaaggaccccaccaaggccctgcccgagaaggccaagagaagcaagagacccaccgtgccccacgacgaggacagcagcgacgacatcgccgtgggcctgacctgccagcacgtgagccacgccatcagcgtgaaccacgtgaagagagccatcgccgagaacctgtggagcgtgtgcagcgagtgcctgaaggagagaagattctacgacggccagctggtgctgaccagcgacatctggctgtgcctgaagtgcggcttccagggctgcggcaagaacagcgagagccagcacagcctgaagcacttcaagagcagcagaaccgagccccactgcatcatcatcaacctgagcacctggatcatctggtgctacgagtgcgacgagaagctgagcacccactgcaacaagaaggtgctggcccagatcgtggacttcctgcagaagcacgccagcaagacccagaccagacccggccccatcctgatccacctgttcagcatcaactgcctgggcgcccacagcgagagcgtgtgctag

SEQ ID NO: 25550 - DNA, 1485 bp, Artificial Sequence
  Description of Artificial Sequence: Synthetic coding sequence
atgagaagcaagaaggtggtgcagaacagcagattcttcctgccccagaccctgagctgggcccccagattcaaggacttccagcagcaggacagccaggagctgctgcactacctgctggacgccgtgagaaccgaggagaccaagatcagcaccgtgaaggaccccttcatcgacatcagcctgcccatcatcgaggagagagtgagcaagcccctgctgtggggcagaatgaacaagtacagaagcctgagagagaccgaccacgacagatacagcggcaacgtgaccatcgagaacatccaccagcccagagccgccaagaagcacagcagcagcaaggacaagagccagctgatccacgacagaaagtgcatcagaaagctgagcagcggcgagaccgtgacctaccagaagaacgagaacctggagatgaacggcgacagcctgatgttcgccagcctgatgaacagcgagagcagactgaacgagagccccaccgacgacagcgagaaggaggccagccacagcgagagcaacgtggacgccgacagcgagcccagcgagagcgagagcgccagcaagcagaccggcctgttcagaagcagcagcggcagcggcgtgcagcccgacggccccctgtaccccctgagcgccggcaagctgctgtacaccaaggagaccgacagcggcgacaaggagatggccgaggccatcagcgagctgagactgagcagcaccgtgaccggcgaccaggacttcgacagagagaaccagcccctgaacatcagcaacaacctgtgcttcctggagggcaagcacctgagaagctacagcccccagaacgccttccagaccctgagccagagctacatcaccaccagcaaggagtgcagcatccagagctgcctgtaccagttcaccagcatggagctgctgatgggcaacaacaagctgctgtgcgagaactgcaccaagaacaagcagaagtaccaggaggagaccagcttcgccgagaagaaggtggagggcgtgtacaccaacgccagaaagcagctgctgatcagcgccgtgcccgccgtgctgatcctgcacctgaagagattccaccaggccggcctgagcctgagaaaggtgaacagacacgtggacttccccctgatgctggacctggcccccttctgcagcgccacctgcaagaacgccagcgtgggcgacaaggtgctgtacggcctgtacggcatcgtggagcacagcggcagcatgagagagggccactacaccgcctacgtgaaggtgagaacccccagcagaaagctgagcgagcacaacaccaagaagaagaacgtgcccggcctgaaggccgccgacaacgagagcgccggccagtgggtgcacgtgagcgacacctacctgcaggtggtgcccgagagcagagccctgagcgcccaggcctacctgctgttctacgagagagtgctgtag

SEQ ID NO: 25551 - DNA, 870 bp, Artificial Sequence; identical to SEQ ID NO: 25548
  Description of Artificial Sequence: Synthetic coding sequence

SEQ ID NO: 25552 - DNA, 2445 bp, Artificial Sequence; identical to SEQ ID NO: 25547
  Description of Artificial Sequence: Synthetic coding sequence

SEQ ID NO: 25553 - DNA, 159 bp, Artificial Sequence
  Description of Artificial Sequence: Synthetic coding sequence
atgagagtgaaggaccccaccaaggccctgcccgagaaggccaagagaagcaagagacccaccgtgccccacgacgaggacagcagcgacgacatcgccgtgggcctgacctgccagcacgtgagccacgccatcagcgtgaaccacgtgaagagatag

SEQ ID NO: 25554 - DNA, 324 bp, Artificial Sequence
  Description of Artificial Sequence: Synthetic coding sequence
atgctggacctggcccccttctgcagcgccacctgcaagaacgccagcgtgggcgacaaggtgctgtacggcctgtacggcatcgtggagcacagcggcagcatgagagagggccactacaccgcctacgtgaaggtgagaacccccagcagaaagctgagcgagcacaacaccaagaagaagaacgtgcccggcctgaaggccgccgacaacgagagcgccggccagtgggtgcacgtgagcgacacctacctgcaggtggtgcccgagagcagagccctgagcgcccaggcctacctgctgttctacgagagagtgctgtag

SEQ ID NO: 25555 - DNA, 1923 bp, Artificial Sequence
  Description of Artificial Sequence: Synthetic coding sequence
atggacagatgcaagcacgtgggcagactgagactggcccaggaccacagcatcctgaacccccagaagtggtgctgcctggagtgcgccaccaccgagagcgtgtgggcctgcctgaagtgcagccacgtggcctgcggcagatacatcgaggaccacgccctgaagcacttcgaggagaccggccaccccctggccatggaggtgagagacctgtacgtgttctgctacctgtgcaaggactacgtgctgaacgacaaccccgagggcgacctgaagctgctgagaagcagcctgctggccgtgagaggccagaagcaggacacccccgtgagaagaggcagaaccctgagaagcatggccagcggcgaggacgtggtgctgccccagagagccccccagggccagccccagatgctgaccgccctgtggtacagaagacagagactgctggccagaaccctgagactgtggttcgagaagagcagcagaggccaggccaagctggagcagagaagacaggaggaggccctggagagaaagaaggaggaggccagaagaagaagaagagaggtgaagagaagactgctggaggagctggccagcaccccccccagaaagagcgccagactgctgctgcacacccccagagacgccggccccgccgccagcagacccgccgccctgcccaccagcagaagagtgcccgccgccaccctgaagctgagaagacagcccgccatggcccccggcgtgaccggcctgagaaacctgggcaacacctgctacatgaacagcatcctgcaggtgctgagccacctgcagaagttcagagagtgcttcctgaacctggaccccagcaagaccgagcacctgttccccaaggccaccaacggcaagacccagctgagcggcaagcccaccaacagcagcgccaccgagctgagcctgagaaacgacagagccgaggcctgcgagagagagggcttctgctggaacggcagagccagcatcagcagaagcctggagctgatccagaacaaggagcccagcagcaagcacatcagcctgtgcagagagctgcacaccctgttcagagtgatgtggagcggcaagtgggccctggtgagccccttcgccatgctgcacagcgtgtggagcctgatccccgccttcagaggctacgaccagcaggacgcccaggagttcctgtgcgagctgctgcacaaggtgcagcaggagctggagagcgagggcaccaccagaagaatcctgatccccttcagccagagaaagctgaccaagcaggtgctgaaggtggtgaacaccatcttccacggccagctgctgagccaggtgacctgcatcagctgcaactacaagagcaacaccatcgagcccttctgggacctgagcctggagttccccgagagataccactgcatcgagaagggcttcgtgcccctgaaccagaccgagtgcctgctgaccgagatgctggccaagttcaccgagaccgaggccctggagggcagaatctacgcctgcgaccagtgcaacagcaagagaagaaagagcaaccccaagcccctggtgctgagcgaggccagaaagcagctgatgatctacagactgccccaggtgctgagactgcacctgaagagattcagatggagcggcagaaaccacagagagaagatcggcgtgcacgtggtgttcgaccaggtgctgaccatggagccctactgctgcagagacatgctgagcagcctggacaaggagaccttcgcctacgacctgagcgccgtggtgatgcaccacggcaagggcttcggcagcggccactacaccgcctactgctacaacaccgagggcggcgcctgcgccctgctgtgcggcgtgggcgacaccgagagaggctag

SEQ ID NO: 25556 - DNA, 1923 bp, Artificial Sequence; identical to SEQ ID NO: 25555
  Description of Artificial Sequence: Synthetic coding sequence

SEQ ID NO: 25557 - DNA, 2067 bp, Artificial Sequence
  Description of Artificial Sequence: Synthetic coding sequence
atggacagatgcaagcacgtgggcagactgagactggcccaggaccacagcatcctgaacccccagaagtggtgctgcctggagtgcgccaccaccgagagcgtgtgggcctgcctgaagtgcagccacgtggcctgcggcagatacatcgaggaccacgccctgaagcacttcgaggagaccggccaccccctggccatggaggtgagagacctgtacgtgttctgctacctgtgcaaggactacgtgctgaacgacaaccccgagggcgacctgaagctgctgagaagcagcctgctggccgtgagaggccagaagcaggacacccccgtgagaagaggcagaaccctgagaagcatggccagcggcgaggacgtggtgctgccccagagagccccccagggccagccccagatgctgaccgccctgtggtacagaagacagagactgctggccagaaccctgagactgtggttcgagaagagcagcagaggccaggccaagctggagcagagaagacaggaggaggccctggagagaaagaaggaggaggccagaagaagaagaagagaggtgaagagaagactgctggaggagctggccagcaccccccccagaaagagcgccagactgctgctgcacacccccagagacgccggccccgccgccagcagacccgccgccctgcccaccagcagaagagtgcccgccgccaccctgaagctgagaagacagcccgccatggcccccggcgtgaccggcctgagaaacctgggcaacacctgctacatgaacagcatcctgcaggtgctgagccacctgcagaagttcagagagtgcttcctgaacctggaccccagcaagaccgagcacctgttccccaaggccaccaacggcaagacccagctgagcggcaagcccaccaacagcagcgccaccgagctgagcctgagaaacgacagagccgaggcctgcgagagagagggcttctgctggaacggcagagccagcatcagcagaagcctggagctgatccagaacaaggagcccagcagcaagcacatcagcctgtgcagagagctgcacaccctgttcagagtgatgtggagcggcaagtgggccctggtgagccccttcgccatgctgcacagcgtgtggagcctgatccccgccttcagaggctacgaccagcaggacgcccaggagttcctgtgcgagctgctgcacaaggtgcagcaggagctggagagcgagggcaccaccagaagaatcctgatccccttcagccagagaaagctgaccaagcaggtgctgaaggtggtgaacaccatcttccacggccagctgctgagccaggtgacctgcatcagctgcaactacaagagcaacaccatcgagcccttctgggacctgagcctggagttccccgagagataccactgcatcgagaagggcttcgtgcccctgaaccagaccgagtgcctgctgaccgagatgctggccaagttcaccgagaccgaggccctggagggcagaatctacgcctgcgaccagtgcaacagcaagagaagaaagagcaaccccaagcccctggtgctgagcgaggccagaaagcagctgatgatctacagactgccccaggtgctgagactgcacctgaagagattcagatggagcggcagaaaccacagagagaagatcggcgtgcacgtggtgttcgaccaggtgctgaccatggagccctactgctgcagagacatgctgagcagcctggacaaggagaccttcgcctacgacctgagcgccgtggtgatgcaccacggcaagggcttcggcagcggccactacaccgcctactgctacaacaccgagggcggcttctgggtgcactgcaacgacagcaagctgaacgtgtgcagcgtggaggaggtgtgcaagacccaggcctacatcctgttctacacccagagaaccgtgcagggcaacgccagaatcagcgagacccacctgcaggcccaggtgcagagcagcaacaacgacgagggcagaccccagaccttcagctag

SEQ ID NO: 25558 - DNA, 2067 bp, Artificial Sequence; identical to SEQ ID NO: 25557
  Description of Artificial Sequence: Synthetic coding sequence

SEQ ID NO: 25559 - DNA, 48 bp, Artificial Sequence
  Description of Artificial Sequence: Synthetic coding sequence
atggacagatgcaagcacgtgggcagactgagactggcccaggactag

SEQ ID NO: 25560 - DNA, 114 bp, Artificial Sequence
  Description of Artificial Sequence: Synthetic coding sequence
atggacagatgcaagcacgtgggcagactgagactggcccaggaccacagcatcctgaacccccagaagtggtgctgcctggagtgcgccaccaccgagagcgtgtgggcctag

SEQ ID NO: 25561 - DNA, 1005 bp, Artificial Sequence
  Description of Artificial Sequence: Synthetic coding sequence
atgaccagccagcccagcctgcccgccgacgacttcgacatctaccacgtgctggccgagtgcaccgactactacgacaccctgcccgtgaaggaggccgacggcaaccagccccacttccagggcgtgaccggcctgtggaacctgggcaacacctgctgcgtgaacgccatcagccagtgcctgtgcagcatcctgcccctggtggagtacttcctgaccggcaagtacatcaccgccctgcagaacgactgcagcgaggtggccaccgccttcgcctacctgatgaccgacatgtggctgggcgacagcgactgcgtgagccccgagatcttctggagcgccctgggcaacctgtaccccgccttcaccaagaagatgcagcaggacgcccaggagttcctgatctgcgtgctgaacgagctgcacgaggccctgaagaagtaccactacagcagaagaagaagctacgagaagggcagcacccagagatgctgcagaaagtggatcaccaccgagaccagcatcatcacccagctgttcgaggagcagctgaactacagcatcgtgtgcctgaagtgcgagaagtgcacctacaagaacgaggtgttcaccgtgttcagcctgcccatccccagcaagtacgagtgcagcctgagagactgcctgcagtgcttcttccagcaggacgccctgacctggaacaacgagatccactgcagcttctgcgagaccaagcaggagaccgccgtgagagccagcatcagcaaggcccccaagatcatcatcttccacctgaagagattcgacatccagggcaccaccaagagaaagctgagaaccgacatccactaccccctgaccaacctggacctgaccccctacatctgcagcatcttcagaaagtaccccaagtacaacctgtgcgccgtggtgaaccacttcggcgacctggacggcggccactacaccgccttctgcaagaacagcgtgacccaggcctag

SEQ ID NO: 25562 - DNA, 2136 bp, Artificial Sequence
  Description of Artificial Sequence: Synthetic coding sequence
atggcccaggtgagagagaccagcctgcccagcggcagcggcgtgagatggatcagcggcggcggcggcggcgccagccccgaggaggccgtggagaaggccggcaagatggaggaggccgccgccggcgccaccaaggccagcagcagaagagaggccgaggagatgaagctggagcccctgcaggagagagagcccgcccccgaggagaacctgacctggagcagcagcggcggcgacgagaaggtgctgcccagcatccccctgagatgccacagcagcagcagccccgtgtgccccagaagaaagcccagacccagaccccagcccagagccagaagcagaagccagcccggcctgagcgcccccccccccccccccgccagacccccccccccccccccccccccccccccccccgcccccagacccagagcctggagaggcagcagaagaagaagcagacccggcagcagaccccagaccagaagaagctgcagcggcgacctggacggcagcggcgaccccggcggcctgggcgactggctgctggaggtggagttcggccagggccccaccggctgcagccacgtggagagcttcaaggtgggcaagaactggcagaagaacctgagactgatctaccagagattcgtgtggagcggcacccccgagaccagaaagagaaaggccaagagctgcatctgccacgtgtgcagcacccacatgaacagactgcacagctgcctgagctgcgtgttcttcggctgcttcaccgagaagcacatccacaagcacgccgagaccaagcagcaccacctggccgtggacctgtaccacggcgtgatctactgcttcatgtgcaaggactacgtgtacgacaaggacatcgagcagatcgccaaggagaccaaggagaagatcctgagactgctgaccagcaccagcaccgacgtgagccaccagcagttcatgaccagcggcttcgaggacaagcagagcacctgcgagaccaaggagcaggagcccaagctggtgaagcccaagaagaagagaagaaagaagagcgtgtacaccgtgggcctgagaggcctgatcaacctgggcaacacctgcttcatgaactgcatcgtgcaggccctgacccacatccccctgctgaaggacttcttcctgagcgacaagcacaagtgcatcatgaccagccccagcctgtgcctggtgtgcgagatgagcagcctgttccacgccatgtacagcggcagcagaaccccccacatcccctacaagctgctgcacctgatctggatccacgccgagcacctggccggctacagacagcaggacgcccacgagttcctgatcgccatcctggacgtgctgcacagacacagcaaggacgacagcggcggccaggaggccaacaaccccaactgctgcaactgcatcatcgaccagatcttcaccggcggcctgcagagcgacgtgacctgccaggcctgccacagcgtgagcaccaccatcgacccctgctgggacatcagcctggacctgcccggcagctgcgccaccttcgacagccagaaccccgagagagccgacagcaccgtgagcagagacgaccacatccccggcatccccagcctgaccgactgcctgcagtggttcaccagacccgagcacctgggcagcagcgccaagatcaagtgcaacagctgccagagctaccaggagagcaccaagcagctgaccatgaagaagctgcccatcgtggcctgcttccacctgaagagattcgagcacgtgggcaagcagagaagaaagatcaacaccttcatcagcttccccctggagctggacatgacccccttcctggccagcaccaaggagagcagaatgaaggagggccagccccccaccgactgcgtgcccaacgagaacaagtacagcctgttcgccgtgatcaaccaccacggcaccctggagagcggccactacaccagcttcatcagacagcagaaggaccagtggttcagctgcgacgacgccatcatcaccaaggccaccatcgaggacctgctgtacagcgagggctacctgctgttctaccacaagcagggcctggagaaggactag

SEQ ID NO: 25563 - DNA, 3222 bp, Artificial Sequence
  Description of Artificial Sequence: Synthetic coding sequence
atggcctgggtgaagttcctgagaaagcccggcggcaacctgggcaaggtgtaccagcccggcagcatgctgagcctggcccccaccaagggcctgctgaacgagcccggccagaacagctgcttcctgaacagcgccgtgcaggtgctgtggcagctggacatcttcagaagaagcctgagagtgctgaccggccacgtgtgccagggcgacgcctgcatcttctgcgccctgaagaccatcttcgcccagttccagcacagcagagagaaggccctgcccagcgacaacatcagacacgccctggccgagagcttcaaggacgagcagagattccagctgggcctgatggacgacgccgccgagtgcttcgagaacatgctggagagaatccacttccacatcgtgcccagcagagacgccgacatgtgcaccagcaagagctgcatcacccaccagaagttcgccatgaccctgtacgagcagtgcgtgtgcagaagctgcggcgccagcagcgaccccctgcccttcaccgagttcgtgagatacatcagcaccaccgccctgtgcaacgaggtggagagaatgctggagagacacgagagattcaagcccgagatgttcgccgagctgctgcaggccgccaacaccaccgacgactacagaaagtgccccagcaactgcggccagaagatcaagatcagaagagtgctgatgaactgccccgagatcgtgaccatcggcctggtgtgggacagcgagcacagcgacctgaccgaggccgtggtgagaaacctggccacccacctgtacctgcccggcctgttctacagagtgaccgacgagaacgccaagaacagcgagctgaacctggtgggcatgatctgctacaccagccagcactactgcgccttcgccttccacaccaagagcagcaagtgggtgttcttcgacgacgccaacgtgaaggagatcggcaccagatggaaggacgtggtgagcaagtgcatcagatgccacttccagcccctgctgctgttctacgccaaccccgacggcaccgccgtgagcaccgaggacgccctgagacaggtgatcagctggagccactacaagagcgtggccgagaacatgggctgcgagaagcccgtgatccacaagagcgacaacctgaaggagaacggcttcggcgaccaggccaagcagagagagaaccagaagttccccaccgacaacatcagcagcagcaacagaagccacagccacaccggcgtgggcaagggccccgccaagctgagccacatcgaccagagagagaagatcaaggacatcagcagagagtgcgccctgaaggccatcgagcagaagaacctgctgagcagccagagaaaggacctggagaagggccagagaaaggacctgggcagacacagagacctggtggacgaggacctgagccacttccagagcggcagcccccccgcccccaacggcttcaagcagcacggcaacccccacctgtaccacagccagggcaagggcagctacaagcacgacagagtggtgccccagagcagagccagcgcccagatcatcagcagcagcaagagccagatcctggcccccggcgagaagatcaccggcaaggtgaagagcgacaacggcaccggctacgacaccgacagcagccaggacagcagagacagaggcaacagctgcgacagcagcagcaagagcagaaacagaggctggaagcccatgagagagaccctgaacgtggacagcatcttcagcgagagcgagaagagacagcacagccccagacacaagcccaacatcagcaacaagcccaagagcagcaaggaccccagcttcagcaactggcccaaggagaaccccaagcagaagggcctgatgaccatctacgaggacgagatgaagcaggagatcggcagcagaagcagcctggagagcaacggcaagggcgccgagaagaacaagggcctggtggagggcaaggtgcacggcgacaactggcagatgcagagaaccgagagcggctacgagagcagcgaccacatcagcaacggcagcaccaacctggacagccccgtgatcgacggcaacggcaccgtgatggacatcagcggcgtgaaggagaccgtgtgcttcagcgaccagatcaccaccagcaacctgaacaaggagagaggcgactgcaccagcctgcagagccagcaccacctggagggcttcagaaaggagctgagaaacctggaggccggctacaagagccacgagttccaccccgagagccacctgcagatcaagaaccacctgatcaagagaagccacgtgcacgaggacaacggcaagctgttccccagcagcagcctgcagatccccaaggaccacaacgccagagagcacatccaccagagcgacgagcagaagctggagaagcccaacgagtgcaagttcagcgagtggctgaacatcgagaacagcgagagaaccggcctgcccttccacgtggacaacagcgccagcggcaagagagtgaacagcaacgagcccagcagcctgtggagcagccacctgagaaccgtgggcctgaagcccgagaccgcccccctgatccagcagcagaacatcatggaccagtgctacttcgagaacagcctgagcaccgagtgcatcatcagaagcgccagcagaagcgacggctgccagatgcccaagctgttctgccagaacctgcccccccccctgccccccaagaagtacgccatcaccagcgtgccccagagcgagaagagcgagagcacccccgacgtgaagctgaccgaggtgttcaaggccaccagccacctgcccaagcacagcctgagcaccgccagcgagcccagcctggaggtgagcacccacatgaacgacgagagacacaaggagaccttccaggtgagagagtgcttcggcaacacccccaactgccccagcagcagcagcaccaacgacttccaggccaacagcggcgccatcgacgccttctgccagcccgagctggacagcatcagcacctgccccaacgagaccgtgagcctgaccacctacttcagcgtggacagctgcatgaccgacacctacagactgaagtaccaccagagacccaagctgagcttccccgagagcagcggcttctgcaacaacagcctgagctag

SEQ ID NO: 25564 - DNA, 3222 bp, Artificial Sequence; identical to SEQ ID NO: 25563
  Description of Artificial Sequence: Synthetic coding sequence

SEQ ID NO: 25565 - DNA, 2235 bp, Artificial Sequence
  Description of Artificial Sequence: Synthetic coding sequence
atgagctggaagagaaactacttcagcggcggcagaggcagcgtgcagggcatgttcgcccccagaagcagcaccagcatcgcccccagcaagggcctgagcaacgagcccggccagaacagctgcttcctgaacagcgccctgcaggtgctgtggcacctggacatcttcagaagaagcttcagacagctgaccacccacaagtgcatgggcgacagctgcatcttctgcgccctgaagggcatcttcaaccagttccagtgcagcagcgagaaggtgctgcccagcgacaccctgagaagcgccctggccaagaccttccaggacgagcagagattccagctgggcatcatggacgacgccgccgagtgcttcgagaacctgctgatgagaatccacttccacatcgccgacgagaccaaggaggacatctgcaccgcccagcactgcatcagccaccagaagttcgccatgaccctgttcgagcagtgcgtgtgcaccagctgcggcgccaccagcgaccccctgcccttcatccagatggtgcactacatcagcaccaccagcctgtgcaaccaggccatctgcatgctggagagaagagagaagcccagccccagcatgttcggcgagctgctgcagaacgccagcaccatgggcgacctgagaaactgccccagcaactgcggcgagagaatcagaatcagaagagtgctgatgaacgccccccagatcatcaccatcggcctggtgtgggacagcgaccacagcgacctggccgaggacgtgatccacagcctgggcacctgcctgaagctgggcgacctgttcttcagagtgaccgacgacagagccaagcagagcgagctgtacctggtgggcatgatctgctactacggcaagcactacagcaccttcttcttccagaccaagatcagaaagtggatgtacttcgacgacgcccacgtgaaggagatcggccccaagtggaaggacgtggtgaccaagtgcatcaagggccactaccagcccctgctgctgctgtacgccgacccccagggcacccccgtgagcacccaggacctgcccccccaggccgagttccagagctacagcagaacctgctacgacagcgaggacagcggcagagagcccagcatcagcagcgacaccagaaccgacagcagcaccgagagctacccctacaagcacagccaccacgagagcgtggtgagccacttcagcagcgacagccagggcaccgtgatctacaacgtggagaacgacagcatgagccagagcagcagagacaccggccacctgaccgacagcgagtgcaaccagaagcacaccagcaagaagggcagcctgatcgagagaaagagaagcagcggcagagtgagaagaaagggcgacgagccccaggccagcggctaccacagcgagggcgagaccctgaaggagaagcaggcccccagaaacgccagcaagcccagcagcagcaccaacagactgagagacttcaaggagaccgtgagcaacatgatccacaacagacccagcctggccagccagaccaacgtgggcagccactgcagaggcagaggcggcgaccagcccgacaagaagccccccagaaccctgcccctgcacagcagagactgggagatcgagagcaccagcagcgagagcaagagcagcagcagcagcaagtacagacccacctggagacccaagagagagagcctgaacatcgacagcatcttcagcaaggacaagagaaagcactgcggctacacccagctgagccccttcagcgaggacagcgccaaggagttcatccccgacgagcccagcaagccccccagctacgacatcaagttcggcggccccagcccccagtacaagagatggggccccgccagacccggcagccacctgctggagcagcaccccagactgatccagagaatggagagcggctacgagagcagcgagagaaacagcagcagccccgtgagcctggacgccgccctgcccgagagcagcaacgtgtacagatactgcctggccttcgagcagcagcactgcctgctgcagcagtgcgagccccccacctggggcttccaggcctggctgagacaggtggagggctggcccctgctgctgagcctgtgcgccctgagcaccagctacaacaacagcaccctgtgctggaagaacagaggcacctag

SEQ ID NO: 25566 - DNA, 5055 bp, Artificial Sequence
  Description of Artificial Sequence: Synthetic coding sequence
atgagctggaagagaaactacttcagcggcggcagaggcagcgtgcagggcatgttcgcccccagaagcagcaccagcatcgcccccagcaagggcctgagcaacgagcccggccagaacagctgcttcctgaacagcgccctgcaggtgctgtggcacctggacatcttcagaagaagcttcagacagctgaccacccacaagtgcatgggcgacagctgcatcttctgcgccctgaagggcatcttcaaccagttccagtgcagcagcgagaaggtgctgcccagcgacaccctgagaagcgccctggccaagaccttccaggacgagcagagattccagctgggcatcatggacgacgccgccgagtgcttcgagaacctgctgatgagaatccacttccacatcgccgacgagaccaaggaggacatctgcaccgcccagcactgcatcagccaccagaagttcgccatgaccctgttcgagcagtgcgtgtgcaccagctgcggcgccaccagcgaccccctgcccttcatccagatggtgcactacatcagcaccaccagcctgtgcaaccaggccatctgcatgctggagagaagagagaagcccagccccagcatgttcggcgagctgctgcagaacgccagcaccatgggcgacctgagaaactgccccagcaactgcggcgagagaatcagaatcagaagagtgctgatgaacgccccccagatcatcaccatcggcctggtgtgggacagcgaccacagcgacctggccgaggacgtgatccacagcctgggcacctgcctgaagctgggcgacctgttcttcagagtgaccgacgacagagccaagcagagcgagctgtacctggtgggcatgatctgctactacggcaagcactacagcaccttcttcttccagaccaagatcagaaagtggatgtacttcgacgacgcccacgtgaaggagatcggccccaagtggaaggacgtggtgaccaagtgcatcaagggccactaccagcccctgctgctgctgtacgccgacccccagggcacccccgtgagcacccaggacctgcccccccaggccgagttccagagctacagcagaacctgctacgacagcgaggacagcggcagagagcccagcatcagcagcgacaccagaaccgacagcagcaccgagagctacccctacaagcacagccaccacgagagcgtggtgagccacttcagcagcgacagccagggcaccgtgatctacaacgtggagaacgacagcatgagccagagcagcagagacaccggccacctgaccgacagcgagtgcaaccagaagcacaccagcaagaagggcagcctgatcgagagaaagagaagcagcggcagagtgagaagaaagggcgacgagccccaggccagcggctaccacagcgagggcgagaccctgaaggagaagcaggcccccagaaacgccagcaagcccagcagcagcaccaacagactgagagacttcaaggagaccgtgagcaacatgatccacaacagacccagcctggccagccagaccaacgtgggcagccactgcagaggcagaggcggcgaccagcccgacaagaagccccccagaaccctgcccctgcacagcagagactgggagatcgagagcaccagcagcgagagcaagagcagcagcagcagcaagtacagacccacctggagacccaagagagagagcctgaacatcgacagcatcttcagcaaggacaagagaaagcactgcggctacacccagctgagccccttcagcgaggacagcgccaaggagttcatccccgacgagcccagcaagccccccagctacgacatcaagttcggcggccccagcccccagtacaagagatggggccccgccagacccggcagccacctgctggagcagcaccccagactgatccagagaatggagagcggctacgagagcagcgagagaaacagcagcagccccgtgagcctggacgccgccctgcccgagagcagcaacgtgtacagagaccccagcgccaagagaagcgccggcctggtgcccagctggagacacatccccaagagccacagcagcagcatcctggaggtggacagcaccgccagcatgggcggctggaccaagagccagcccttcagcggcgaggagatcagcagcaagagcgagctggacgagctgcaggaggaggtggccagaagagcccaggagcaggagctgagaagaaagagagagaaggagctggaggccgccaagggcttcaacccccaccccagcagattcatggacctggacgagctgcagaaccagggcagaagcgacggcttcgagagaagcctgcaggaggccgagagcgtgttcgaggagagcctgcacctggagcagaagggcgactgcgccgccgccctggccctgtgcaacgaggccatcagcaagctgagactggccctgcacggcgccagctgcagcacccacagcagagccctggtggacaagaagctgcagatcagcatcagaaaggccagaagcctgcaggacagaatgcagcagcagcagagcccccagcagcccagccagcccagcgcctgcctgcccacccaggccggcaccctgagccagcccaccagcgagcagcccatccccctgcaggtgctgctgagccaggaggcccagctggagagcggcatggacaccgagttcggcgccagcagcttcttccacagccccgccagctgccacgagagccacagcagcctgagccccgagagcagcgccccccagcacagcagccccagcagaagcgccctgaagctgctgaccagcgtggaggtggacaacatcgagcccagcgccttccacagacagggcctgcccaaggcccccggctggaccgagaagaacagccaccacagctgggagcccctggacgcccccgagggcaagctgcagggcagcagatgcgacaacagcagctgcagcaagctgcccccccaggagggcagaggcatcgcccaggagcagctgttccaggagaagaaggaccccgccaaccccagccccgtgatgcccggcatcgccaccagcgagagaggcgacgagcacagcctgggctgcagccccagcaacagcagcgcccagcccagcctgcccctgtacagaacctgccaccccatcatgcccgtggccagcagcttcgtgctgcactgccccgaccccgtgcagaagaccaaccagtgcctgcagggccagagcctgaagaccagcctgaccctgaaggtggacagaggcagcgaggagacctacagacccgagttccccagcaccaagggcctggtgagaagcctggccgagcagttccagagaatgcagggcgtgagcatgagagacagcaccggcttcaaggacagaagcctgagcggcagcctgagaaagaacagcagccccagcgacagcaagccccccttcagccagggccaggagaagggccactggccctgggccaagcagcagagcagcctggagggcggcgacagacccctgagctgggaggagagcaccgagcacagcagcctggccctgaacagcggcctgcccaacggcgagaccagcagcggcggccagcccagactggccgagcccgacatctaccaggagaagctgagccaggtgagagacgtgagaagcaaggacctgggcagcagcaccgacctgggcaccagcctgcccctggacagctgggtgaacatcaccagattctgcgacagccagctgaagcacggcgcccccagacccggcatgaagagcagcccccacgacagccacacctgcgtgacctaccccgagagaaaccacatcctgctgcacccccactggaaccaggacaccgagcaggagaccagcgagctggagagcctgtaccaggccagcctgcaggccagccaggccggctgcagcggctggggccagcaggacaccgcctggcaccccctgagccagaccggcagcgccgacggcatgggcagaagactgcacagcgcccacgaccccggcctgagcaagaccagcaccgccgagatggagcacggcctgcacgaggccagaaccgtgagaaccagccaggccaccccctgcagaggcctgagcagagagtgcggcgaggacgagcagtacagcgccgagaacctgagaagaatcagcagaagcctgagcggcaccgtggtgagcgagagagaggaggcccccgtgagcagccacagcttcgacagcagcaacgtgagaaagcccctggagaccggccacagatgcagcagcagcagcagcctgcccgtgatccacgaccccagcgtgttcctgctgggcccccagctgtacctgccccagccccagttcctgagccccgacgtgctgatgcccaccatggccggcgagcccaacagactgcccggcaccagcagaagcgtgcagcagttcctggccatgtgcgacagaggcgagaccagccagggcgccaagtacaccggcagaaccctgaactaccagagcctgccccacagaagcagaaccgacaacagctgggccccctggagcgagaccaaccagcacatcggcaccagattcctgaccacccccggctgcaacccccagctgacctacaccgccaccctgcccgagagaagcaagggcctgcaggtgccccacacccagagctggagcgacctgttccacagccccagccacccccccatcgtgcaccccgtgtacccccccagcagcagcctgcacgtgcccctgagaagcgcctggaacagcgaccccgtgcccggcagcagaacccccggccccagaagagtggacatgccccccgacgacgactggagacagagcagctacgccagccacagcggccacagaagaaccgtgggcgagggcttcctgttcgtgctgagcgacgcccccagaagagagcagatcagagccagagtgctgcagcacagccagtggtag

SEQ ID NO: 25567 - DNA, 2178 bp, Artificial Sequence
  Description of Artificial Sequence: Synthetic coding sequence
atggacaccgagttcggcgccagcagcttcttccacagccccgccagctgccacgagagccacagcagcctgagccccgagagcagcgccccccagcacagcagccccagcagaagcgccctgaagctgctgaccagcgtggaggtggacaacatcgagcccagcgccttccacagacagggcctgcccaaggcccccggctggaccgagaagaacagccaccacagctgggagcccctggacgcccccgagggcaagctgcagggcagcagatgcgacaacagcagctgcagcaagctgcccccccaggagggcagaggcatcgcccaggagcagctgttccaggagaagaaggaccccgccaaccccagccccgtgatgcccggcatcgccaccagcgagagaggcgacgagcacagcctgggctgcagccccagcaacagcagcgcccagcccagcctgcccctgtacagaacctgccaccccatcatgcccgtggccagcagcttcgtgctgcactgccccgaccccgtgcagaagaccaaccagtgcctgcagggccagagcctgaagaccagcctgaccctgaaggtggacagaggcagcgaggagacctacagacccgagttccccagcaccaagggcctggtgagaagcctggccgagcagttccagagaatgcagggcgtgagcatgagagacagcaccggcttcaaggacagaagcctgagcggcagcctgagaaagaacagcagccccagcgacagcaagccccccttcagccagggccaggagaagggccactggccctgggccaagcagcagagcagcctggagggcggcgacagacccctgagctgggaggagagcaccgagcacagcagcctggccctgaacagcggcctgcccaacggcgagaccagcagcggcggccagcccagactggccgagcccgacatctaccaggagaagctgagccaggtgagagacgtgagaagcaaggacctgggcagcagcaccgacctgggcaccagcctgcccctggacagctgggtgaacatcaccagattctgcgacagccagctgaagcacggcgcccccagacccggcatgaagagcagcccccacgacagccacacctgcgtgacctaccccgagagaaaccacatcctgctgcacccccactggaaccaggacaccgagcaggagaccagcgagctggagagcctgtaccaggccagcctgcaggccagccaggccggctgcagcggctggggccagcaggacaccgcctggcaccccctgagccagaccggcagcgccgacggcatgggcagaagactgcacagcgcccacgaccccggcctgagcaagaccagcaccgccgagatggagcacggcctgcacgaggccagaaccgtgagaaccagccaggacagcagcaacgtgagaaagcccctggagaccggccacagatgcagcagcagcagcagcctgcccgtgatccacgaccccagcgtgttcctgctgggcccccagctgtacctgccccagccccagttcctgagccccgacgtgctgatgcccaccatggccggcgagcccaacagactgcccggcaccagcagaagcgtgcagcagttcctggccatgtgcgacagaggcgagaccagccagggcgccaagtacaccggcagaaccctgaactaccagagcctgccccacagaagcagaaccgacaacagctgggccccctggagcgagaccaaccagcacatcggcaccagattcctgaccacccccggctgcaacccccagctgacctacaccgccaccctgcccgagagaagcaagggcctgcaggtgccccacacccagagctggagcgacctgttccacagccccagccacccccccatcgtgcaccccgtgtacccccccagcagcagcctgcacgtgcccctgagaagcgcctggaacagcgaccccgtgcccggcagcagaacccccggccccagaagagtggacatgccccccgacgacgactggagacagagcagctacgccagccacagcggccacagaagaaccgtgggcgagggcttcctgttcgtgctgagcgacgcccccagaagagagcagatcagagccagagtgctgcagcacagccagtggtag

SEQ ID NO: 25568 - DNA, 5055 bp, Artificial Sequence; identical to SEQ ID NO: 25566
  Description of Artificial Sequence: Synthetic coding sequence

SEQ ID NO: 25569 - DNA, 462 bp, Artificial Sequence
  Description of Artificial Sequence: Synthetic coding sequence
atgagctggaagagaaactacttcagcggcggcagaggcagcgtgcagggcatgttcgcccccagaagcagcaccagcatcgcccccagcaagggcctgagcaacgagcccggccagaacagctgcttcctgaacagcgccctgcaggtgctgtggcacctggacatcttcagaagaagcttcagacagctgaccacccacaagtgcatgggcgacagctgcatcttctgcgccctgaagggcatcttcaaccagttccagtgcagcagcgagaaggtgctgcccagcgacaccctgagaagcgccctggccaagaccttccaggacgagcagagattccagctgggcatcatggacgacgccgccgagtgcttcgagaacctgctgatgagaatccacttccacatcgccgacgagaccaaggaggacatctgcaccgcccagcactgcatcagccactag

SEQ ID NO: 25570 - DNA, 2460 bp, Artificial Sequence
  Description of Artificial Sequence: Synthetic coding sequence
atggacctggacgagctgcagaaccaggccaagctgagactggccctgcacggcgccagctgcagcacccacagcagagccctggtggacaagaagctgcagatcagcatcagaaaggccagaagcctgcaggacagaatgcagcagcagcagagcccccagcagcccagccagcccagcgcctgcctgcccacccaggccggcaccctgagccagcccaccagcgagcagcccatccccctgcaggtgctgctgagccaggaggcccagctggagagcggcatggacaccgagttcggcgccagcagcttcttccacagccccgccagctgccacgagagccacagcagcctgagccccgagagcagcgccccccagcacagcagccccagcagaagcgccctgaagctgctgaccagcgtggaggtggacaacatcgagcccagcgccttccacagacagggcctgcccaaggcccccggctggaccgagaagaacagccaccacagctgggagcccctggacgcccccgagggcaagctgcagggcagcagatgcgacaacagcagctgcagcaagctgcccccccaggagggcagaggcatcgcccaggagcagctgttccaggagaagaaggaccccgccaaccccagccccgtgatgcccggcatcgccaccagcgagagaggcgacgagcacagcctgggctgcagccccagcaacagcagcgcccagcccagcctgcccctgtacagaacctgccaccccatcatgcccgtggccagcagcttcgtgctgcactgccccgaccccgtgcagaagaccaaccagtgcctgcagggccagagcctgaagaccagcctgaccctgaaggtggacagaggcagcgaggagacctacagacccgagttccccagcaccaagggcctggtgagaagcctggccgagcagttccagagaatgcagggcgtgagcatgagagacagcaccggcttcaaggacagaagcctgagcggcagcctgagaaagaacagcagccccagcgacagcaagccccccttcagccagggccaggagaagggccactggccctgggccaagcagcagagcagcctggagggcggcgacagacccctgagctgggaggagagcaccgagcacagcagcctggccctgaacagcggcctgcccaacggcgagaccagcagcggcggccagcccagactggccgagcccgacatctaccaggagaagctgagccaggtgagagacgtgagaagcaaggacctgggcagcagcaccgacctgggcaccagcctgcccctggacagctgggtgaacatcaccagattctgcgacagccagctgaagcacggcgcccccagacccggcatgaagagcagcccccacgacagccacacctgcgtgacctaccccgagagaaaccacatcctgctgcacccccactggaaccaggacaccgagcaggagaccagcgagctggagagcctgtaccaggccagcctgcaggccagccaggccggctgcagcggctggggccagcaggacaccgcctggcaccccctgagccagaccggcagcgccgacggcatgggcagaagactgcacagcgcccacgaccccggcctgagcaagaccagcaccgccgagatggagcacggcctgcacgaggccagaaccgtgagaaccagccaggacagcagcaacgtgagaaagcccctggagaccggccacagatgcagcagcagcagcagcctgcccgtgatccacgaccccagcgtgttcctgctgggcccccagctgtacctgccccagccccagttcctgagccccgacgtgctgatgcccaccatggccggcgagcccaacagactgcccggcaccagcagaagcgtgcagcagttcctggccatgtgcgacagaggcgagaccagccagggcgccaagtacaccggcagaaccctgaactaccagagcctgccccacagaagcagaaccgacaacagctgggccccctggagcgagaccaaccagcacatcggcaccagattcctgaccacccccggctgcaacccccagctgacctacaccgccaccctgcccgagagaagcaagggcctgcaggtgccccacacccagagctggagcgacctgttccacagccccagccacccccccatcgtgcaccccgtgtacccccccagcagcagcctgcacgtgcccctgagaagcgcctggaacagcgaccccgtgcccggcagcagaacccccggccccagaagagtggacatgccccccgacgacgactggagacagagcagctacgccagccacagcggccacagaagaaccgtgggcgagggcttcctgttcgtgctgagcgacgcccccagaagagagcagatcagagccagagtgctgcagcacagccagtggtag

SEQ ID NO: 25571 - DNA, 4605 bp, Artificial Sequence
  Description of Artificial Sequence: Synthetic coding sequence
atgagctggaagagaaactacttcagcggcggcagaggcagcgtgcagggcatgttcgcccccagaagcagcaccagcatcgcccccagcaagggcctgagcaacgagcccggccagaacagctgcttcctgaacagcgccctgcaggtgctgtggcacctggacatcttcagaagaagcttcagacagctgaccacccacaagtgcatgggcgacagctgcatcttctgcgccctgaagggcatcttcaaccagttccagtgcagcagcgagaaggtgctgcccagcgacaccctgagaagcgccctggccaagaccttccaggacgagcagagattccagctgggcatcatggacgacgccgccgagtgcttcctgttcttcagagtgaccgacgacagagccaagcagagcgagctgtacctggtgggcatgatctgctactacggcaagcactacagcaccttcttcttccagaccaagatcagaaagtggatgtacttcgacgacgcccacgtgaaggagatcggccccaagtggaaggacgtggtgaccaagtgcatcaagggccactaccagcccctgctgctgctgtacgccgacccccagggcacccccgtgagcacccaggacctgcccccccaggccgagttccagagctacagcagaacctgctacgacagcgaggacagcggcagagagcccagcatcagcagcgacaccagaaccgacagcagcaccgagagctacccctacaagcacagccaccacgagagcgtggtgagccacttcagcagcgacagccagggcaccgtgatctacaacgtggagaacgacagcatgagccagagcagcagagacaccggccacctgaccgacagcgagtgcaaccagaagcacaccagcaagaagggcagcctgatcgagagaaagagaagcagcggcagagtgagaagaaagggcgacgagccccaggccagcggctaccacagcgagggcgagaccctgaaggagaagcaggcccccagaaacgccagcaagcccagcagcagcaccaacagactgagagacttcaaggagaccgtgagcaacatgatccacaacagacccagcctggccagccagaccaacgtgggcagccactgcagaggcagaggcggcgaccagcccgacaagaagccccccagaaccctgcccctgcacagcagagactgggagatcgagagcaccagcagcgagagcaagagcagcagcagcagcaagtacagacccacctggagacccaagagagagagcctgaacatcgacagcatcttcagcaaggacaagagaaagcactgcggctacacccagctgagccccttcagcgaggacagcgccaaggagttcatccccgacgagcccagcaagccccccagctacgacatcaagttcggcggccccagcccccagtacaagagatggggccccgccagacccggcagccacctgctggagcagcaccccagactgatccagagaatggagagcggctacgagagcagcgagagaaacagcagcagccccgtgagcctggacgccgccctgcccgagagcagcaacgtgtacagagaccccagcgccaagagaagcgccggcctggtgcccagctggagacacatccccaagagccacagcagcagcatcctggaggtggacagcaccgccagcatgggcggctggaccaagagccagcccttcagcggcgaggagatcagcagcaagagcgagctggacgagctgcaggaggaggtggccagaagagcccaggagcaggagctgagaagaaagagagagaaggagctggaggccgccaagggcttcaacccccaccccagcagattcatggacctggacgagctgcagaaccagggcagaagcgacggcttcgagagaagcctgcaggaggccgagagcgtgttcgaggagagcctgcacctggagcagaagggcgactgcgccgccgccctggccctgtgcaacgaggccatcagcaagctgagactggccctgcacggcgccagctgcagcacccacagcagagccctggtggacaagaagctgcagatcagcatcagaaaggccagaagcctgcaggacagaatgcagcagcagcagagcccccagcagcccagccagcccagcgcctgcctgcccacccaggccggcaccctgagccagcccaccagcgagcagcccatccccctgcaggtgctgctgagccaggaggcccagctggagagcggcatggacaccgagttcggcgccagcagcttcttccacagccccgccagctgccacgagagccacagcagcctgagccccgagagcagcgccccccagcacagcagccccagcagaagcgccctgaagctgctgaccagcgtggaggtggacaacatcgagcccagcgccttccacagacagggcctgcccaaggcccccggctggaccgagaagaacagccaccacagctgggagcccctggacgcccccgagggcaagctgcagggcagcagatgcgacaacagcagctgcagcaagctgcccccccaggagggcagaggcatcgcccaggagcagctgttccaggagaagaaggaccccgccaaccccagccccgtgatgcccggcatcgccaccagcgagagaggcgacgagcacagcctgggctgcagccccagcaacagcagcgcccagcccagcctgcccctgtacagaacctgccaccccatcatgcccgtggccagcagcttcgtgctgcactgccccgaccccgtgcagaagaccaaccagtgcctgcagggccagagcctgaagaccagcctgaccctgaaggtggacagaggcagcgaggagacctacagacccgagttccccagcaccaagggcctggtgagaagcctggccgagcagttccagagaatgcagggcgtgagcatgagagacagcaccggcttcaaggacagaagcctgagcggcagcctgagaaagaacagcagccccagcgacagcaagccccccttcagccagggccaggagaagggccactggccctgggccaagcagcagagcagcctggagggcggcgacagacccctgagctgggaggagagcaccgagcacagcagcctggccctgaacagcggcctgcccaacggcgagaccagcagcggcggccagcccagactggccgagcccgacatctaccaggagaagctgagccaggtgagagacgtgagaagcaaggacctgggcagcagcaccgacctgggcaccagcctgcccctggacagctgggtgaacatcaccagattctgcgacagccagctgaagcacggcgcccccagacccggcatgaagagcagcccccacgacagccacacctgcgtgacctaccccgagagaaaccacatcctgctgcacccccactggaaccaggacaccgagcaggagaccagcgagctggagagcctgtaccaggccagcctgcaggccagccaggccggctgcagcggctggggccagcaggacaccgcctggcaccccctgagccagaccggcagcgccgacggcatgggcagaagactgcacagcgcccacgaccccggcctgagcaagaccagcaccgccgagatggagcacggcctgcacgaggccagaaccgtgagaaccagccaggccaccccctgcagaggcctgagcagagagtgcggcgaggacgagcagtacagcgccgagaacctgagaagaatcagcagaagcctgagcggcaccgtggtgagcgagagagaggaggcccccgtgagcagccacagcttcgacagcagcaacgtgagaaagcccctggagaccggccacagatgcagcagcagcagcagcctgcccgtgatccacgaccccagcgtgttcctgctgggcccccagctgtacctgccccagccccagttcctgagccccgacgtgctgatgcccaccatggccggcgagcccaacagactgcccggcaccagcagaagcgtgcagcagttcctggccatgtgcgacagaggcgagaccagccagggcgccaagtacaccggcagaaccctgaactaccagagcctgccccacagaagcagaaccgacaacagctgggccccctggagcgagaccaaccagcacatcggcaccagattcctgaccacccccggctgcaacccccagctgacctacaccgccaccctgcccgagagaagcaagggcctgcaggtgccccacacccagagctggagcgacctgttccacagccccagccacccccccatcgtgcaccccgtgtacccccccagcagcagcctgcacgtgcccctgagaagcgcctggaacagcgaccccgtgcccggcagcagaacccccggccccagaagagtggacatgccccccgacgacgactggagacagagcagctacgccagccacagcggccacagaagaaccgtgggcgagggcttcctgttcgtgctgagcgacgcccccagaagagagcagatcagagccagagtgctgcagcacagccagtggtag

SEQ ID NO: 25572 - DNA, 243 bp, Artificial Sequence
  Description of Artificial Sequence: Synthetic coding sequence
atgagctggaagagaaactacttcagcggcggcagaggcagcgtgcagggcatgttcgcccccagaagcagcaccagcatcgcccccagcaagggcctgagcaacgagcccggccagaacagctgcttcctgaacagcgccctgcaggtgctgtggcacctggacatcttcagaagaagcttcagacagctgaccacccacaagtgcatgggcgacagctgcatcttctgcgccctgaagtag

SEQ ID NO: 25573 - DNA, 3279 bp, Artificial Sequence
  Description of Artificial Sequence: Synthetic coding sequence
atgatggacagccccaagatcggcaacggcctgcccgtgatcggccccggcaccgacatcggcatcagcagcctgcacatggtgggctacctgggcaagaacttcgacagcgccaaggtgcccagcgacgagtactgccccgcctgcagagagaagggcaagctgaaggccctgaagacctacagaatcagcttccaggagagcatcttcctgtgcgaggacctgcagtgcatctaccccctgggcagcaagagcctgaacaacctgatcagccccgacctggaggagtgccacaccccccacaagccccagaagagaaagagcctggagagcagctacaaggacagcctgctgctggccaacagcaagaagaccagaaactacatcgccatcgacggcggcaaggtgctgaacagcaagcacaacggcgaggtgtacgacgagaccagcagcaacctgcccgacagcagcggccagcagaaccccatcagaaccgccgacagcctggagagaaacgagatcctggaggccgacaccgtggacatggccaccaccaaggaccccgccaccgtggacgtgagcggcaccggcagacccagcccccagaacgagggctgcaccagcaagctggagatgcccctggagagcaagtgcaccagcttcccccaggccctgtgcgtgcagtggaagaacgcctacgccctgtgctggctggactgcatcctgagcgccctggtgcacagcgaggagctgaagaacaccgtgaccggcctgtgcagcaaggaggagagcatcttctggagactgctgaccaagtacaaccaggccaacaccctgctgtacaccagccagctgagcggcgtgaaggacggcgactgcaagaagctgaccagcgagatcttcgccgagatcgagacctgcctgaacgaggtgagagacgagatcttcatcagcctgcagccccagctgagatgcaccctgggcgacatggagagccccgtgttcgccttccccctgctgctgaagctggagacccacatcgagaagctgttcctgtacagcttcagctgggacttcgagtgcagccagtgcggccaccagtaccagaacagacacatgaagagcctggtgaccttcaccaacgtgatccccgagtggcaccccctgaacgccgcccacttcggcccctgcaacaactgcaacagcaagagccagatcagaaagatggtgctggagaaggtgagccccatcttcatgctgcacttcgtggagggcctgccccagaacgacctgcagcactacgccttccacttcgagggctgcctgtaccagatcaccagcgtgatccagtacagagccaacaaccacttcatcacctggatcctggacgccgacggcagctggctggagtgcgacgacctgaagggcccctgcagcgagagacacaagaagttcgaggtgcccgccagcgagatccacatcgtgatctgggagagaaagatcagccaggtgaccgacaaggaggccgcctgcctgcccctgaagaagaccaacgaccagcacgccctgagcaacgagaagcccgtgagcctgaccagctgcagcgtgggcgacgccgccagcgccgagaccgccagcgtgacccaccccaaggacatcagcgtggcccccagaaccctgagccaggacaccgccgtgacccacggcgaccacctgctgagcggccccaagggcctggtggacaacatcctgcccctgaccctggaggagaccatccagaagaccgccagcgtgagccagctgaacagcgaggccttcctgctggagaacaagcccgtggccgagaacaccggcatcctgaagaccaacaccctgctgagccaggagagcctgatggccagcagcgtgagcgccccctgcaacgagaagctgatccaggaccagttcgtggacatcagcttccccagccaggtggtgaacaccaacatgcagagcgtgcagctgaacaccgaggacaccgtgaacaccaagagcgtgaacaacaccgacgccaccggcctgatccagggcgtgaagagcgtggagatcgagaaggacgcccagctgaagcagttcctgacccccaagaccgagcagctgaagcccgagagagtgaccagccaggtgagcaacctgaagaagaaggagaccaccgccgacagccagaccaccaccagcaagagcctgcagaaccagagcctgaaggagaaccagaagaagcccttcgtgggcagctgggtgaagggcctgatcagcagaggcgccagcttcatgcccctgtgcgtgagcgcccacaacagaaacaccatcaccgacctgcagcccagcgtgaagggcgtgaacaacttcggcggcttcaagaccaagggcatcaaccagaaggccagccacgtgagcaagaaggccagaaagagcgccagcaagcccccccccatcagcaagccccccgccggcccccccagcagcaacggcaccgccgcccacccccacgcccacgccgccagcgaggtgctggagaagagcggcagcaccagctgcggcgcccagctgaaccacagcagctacggcaacggcatcagcagcgccaaccacgaggacctggtggagggccagatccacaagctgagactgaagctgagaaagaagctgaaggccgagaagaagaagctggccgccctgatgagcagcccccagagcagaaccgtgagaagcgagaacctggagcaggtgccccaggacggcagccccaacgactgcgagagcatcgaggacctgctgaacgagctgccctaccccatcgacatcgccagcgagagcgcctgcaccaccgtgcccggcgtgagcctgtacagcagccagacccacgaggagatcctggccgagctgctgagccccacccccgtgagcaccgagctgagcgagaacggcgagggcgacttcagatacctgggcatgggcgacagccacatccccccccccgtgcccagcgagttcaacgacgtgagccagaacacccacctgagacaggaccacaactactgcagccccaccaagaagaacccctgcgaggtgcagcccgacagcctgaccaacaacgcctgcgtgagaaccctgaacctggagagccccatgaagaccgacatcttcgacgagttcttcagcagcagcgccctgaacgccctggccaacgacaccctggacctgccccacttcgacgagtacctgttcgagaactactag

SEQ ID NO: 25574 - DNA, 357 bp, Artificial Sequence
  Description of Artificial Sequence: Synthetic coding sequence
atgttccactggcaggccaccatcatgggccccaacgacagcccctaccagggcggcgtgttcttcctgaccatccacttccccaccgactaccccttcaagccccccaaggtggccttcaccaccagaatctaccaccccaacatcaacagcaacggcagcatctgcctggacatcctgagaagccagtggagccccgccctgaccatcagcaaggtgctgctgagcatctgcagcctgctgtgcgaccccaaccccgacgaccccctggtgcccgagatcgccagaatctacaagaccgacagagagaagtacaacagaatcgccagagagtggacccagaagtacgccatgtag

SEQ ID NO: 25575 - DNA, 444 bp, Artificial Sequence
  Description of Artificial Sequence: Synthetic coding sequence
atggccctgaagagaatccacaaggagctgaacgacctggccagagacccccccgcccagtgcagcgccggccccgtgggcgacgacatgttccactggcaggccaccatcatgggccccaacgacagcccctaccagggcggcgtgttcttcctgaccatccacttccccaccgactaccccttcaagccccccaaggtggccttcaccaccagaatctaccaccccaacatcaacagcaacggcagcatctgcctggacatcctgagaagccagtggagccccgccctgaccatcagcaaggtgctgctgagcatctgcagcctgctgtgcgaccccaaccccgacgaccccctggtgcccgagatcgccagaatctacaagaccgacagagagaagtacaacagaatcgccagagagtggacccagaagtacgccatgtag

SEQ ID NO: 25576 - DNA, 444 bp, Artificial Sequence; identical to SEQ ID NO: 25575
  Description of Artificial Sequence: Synthetic coding sequence

SEQ ID NO: 25577 - DNA, 357 bp, Artificial Sequence; identical to SEQ ID NO: 25574
  Description of Artificial Sequence: Synthetic coding sequence

SEQ ID NO: 25578 - DNA, 5361 bp, Artificial Sequence
  Description of Artificial Sequence: Synthetic coding sequence
atgggcctgctgcagctgctggccttcagcttcctggccctgtgcagagccagagtgagagcccaggagcccgagttcagctacggctgcgccgagggcagctgctaccccgccaccggcgacctgctgatcggcagagcccagaagctgagcgtgaccagcacctgcggcctgcacaagcccgagccctactgcatcgtgagccacctgcaggaggacaagaagtgcttcatctgcaacagccaggacccctaccacgagaccctgaaccccgacagccacctgatcgagaacgtggtgaccaccttcgcccccaacagactgaagatctggtggcagagcgagaacggcgtggagaacgtgaccatccagctggacctggaggccgagttccacttcacccacctgatcatgaccttcaagaccttcagacccgccgccatgctgatcgagagaagcagcgacttcggcaagacctggggcgtgtacagatacttcgcctacgactgcgaggccagcttccccggcatcagcaccggccccatgaagaaggtggacgacatcatctgcgacagcagatacagcgacatcgagcccagcaccgagggcgaggtgatcttcagagccctggaccccgccttcaagatcgaggacccctacagccccagaatccagaacctgctgaagatcaccaacctgagaatcaagttcgtgaagctgcacaccctgggcgacaacctgctggacagcagaatggagatcagagagaagtactactacgccgtgtacgacatggtggtgagaggcaactgcttctgctacggccacgccagcgagtgcgcccccgtggacggcttcaacgaggaggtggagggcatggtgcacggccactgcatgtgcagacacaacaccaagggcctgaactgcgagctgtgcatggacttctaccacgacctgccctggagacccgccgagggcagaaacagcaacgcctgcaagaagtgcaactgcaacgagcacagcatcagctgccacttcgacatggccgtgtacctggccaccggcaacgtgagcggcggcgtgtgcgacgactgccagcacaacaccatgggcagaaactgcgagcagtgcaagcccttctactaccagcaccccgagagagacatcagagaccccaacttctgcgagagatgcacctgcgaccccgccggcagccagaacgagggcatctgcgacagctacaccgacttcagcaccggcctgatcgccggccagtgcagatgcaagctgaacgtggagggcgagcactgcgacgtgtgcaaggagggcttctacgacctgagcagcgaggaccccttcggctgcaagagctgcgcctgcaaccccctgggcaccatccccggcggcaacccctgcgacagcgagaccggccactgctactgcaagagactggtgaccggccagcactgcgaccagtgcctgcccgagcactggggcctgagcaacgacctggacggctgcagaccctgcgactgcgacctgggcggcgccctgaacaacagctgcttcgccgagagcggccagtgcagctgcagaccccacatgatcggcagacagtgcaacgaggtggagcccggctactacttcgccaccctggaccactacctgtacgaggccgaggaggccaacctgggccccggcgtgagcatcgtggagagacagtacatccaggacagaatccccagctggaccggcgccggcttcgtgagagtgcccgagggcgcctacctggagttcttcatcgacaacatcccctacagcatggagtacgacatcctgatcagatacgagccccagctgcccgaccactgggagaaggccgtgatcaccgtgcagagacccggcagaatccccaccagcagcagatgcggcaacaccatccccgacgacgacaaccaggtggtgagcctgagccccggcagcagatacgtggtgctgcccagacccgtgtgcttcgagaagggcaccaactacaccgtgagactggagctgccccagtacaccagcagcgacagcgacgtggagagcccctacaccctgatcgacagcctggtgctgatgccctactgcaagagcctggacatcttcaccgtgggcggcagcggcgacggcgtggtgaccaacagcgcctgggagaccttccagagatacagatgcctggagaacagcagaagcgtggtgaagacccccatgaccgacgtgtgcagaaacatcatcttcagcatcagcgccctgctgcaccagaccggcctggcctgcgagtgcgacccccagggcagcctgagcagcgtgtgcgaccccaacggcggccagtgccagtgcagacccaacgtggtgggcagaacctgcaacagatgcgcccccggcaccttcggcttcggccccagcggctgcaagccctgcgagtgccacctgcagggcagcgtgaacgccttctgcaaccccgtgaccggccagtgccactgcttccagggcgtgtacgccagacagtgcgacagatgcctgcccggccactggggcttccccagctgccagccctgccagtgcaacggccacgccgacgactgcgaccccgtgaccggcgagtgcctgaactgccaggactacaccatgggccacaactgcgagagatgcctggccggctactacggcgaccccatcatcggcagcggcgaccactgcagaccctgcccctgccccgacggccccgacagcggcagacagttcgccagaagctgctaccaggaccccgtgaccctgcagctggcctgcgtgtgcgaccccggctacatcggcagcagatgcgacgactgcgccagcggctacttcggcaaccccagcgaggtgggcggcagctgccagccctgccagtgccacaacaacatcgacaccaccgaccccgaggcctgcgacaaggagaccggcagatgcctgaagtgcctgtaccacaccgagggcgagcactgccagttctgcagattcggctactacggcgacgccctgcagcaggactgcagaaagtgcgtgtgcaactacctgggcaccgtgcaggagcactgcaacggcagcgactgccagtgcgacaaggccaccggccagtgcctgtgcctgcccaacgtgatcggccagaactgcgacagatgcgcccccaacacctggcagctggccagcggcaccggctgcgacccctgcaactgcaacgccgcccacagcttcggccccagctgcaacgagttcaccggccagtgccagtgcatgcccggcttcggcggcagaacctgcagcgagtgccaggagctgttctggggcgaccccgacgtggagtgcagagcctgcgactgcgaccccagaggcatcgagaccccccagtgcgaccagagcaccggccagtgcgtgtgcgtggagggcgtggagggccccagatgcgacaagtgcaccagaggctacagcggcgtgttccccgactgcaccccctgccaccagtgcttcgccctgtgggacgtgatcatcgccgagctgaccaacagaacccacagattcctggagaaggccaaggccctgaagatcagcggcgtgatcggcccctacagagagaccgtggacagcgtggagagaaaggtgagcgagatcaaggacatcctggcccagagccccgccgccgagcccctgaagaacatcggcaacctgttcgaggaggccgagaagctgatcaaggacgtgaccgagatgatggcccaggtggaggtgaagctgagcgacaccaccagccagagcaacagcaccgccaaggagctggacagcctgcagaccgaggccgagagcctggacaacaccgtgaaggagctggccgagcagctggagttcatcaagaacagcgacatcagaggcgccctggacagcatcaccaagtacttccagatgagcctggaggccgaggagagagtgaacgccagcaccaccgagcccaacagcaccgtggagcagagcgccctgatgagagacagagtggaggacgtgatgatggagagagagagccagttcaaggagaagcaggaggagcaggccagactgctggacgagctggccggcaagctgcagagcctggacctgagcgccgccgccgagatgacctgcggcaccccccccggcgccagctgcagcgagaccgagtgcggcggccccaactgcagaaccgacgagggcgagagaaagtgcggcggccccggctgcggcggcctggtgaccgtggcccacaacgcctggcagaaggccatggacctggaccaggacgtgctgagcgccctggccgaggtggagcagctgagcaagatggtgagcgaggccaagctgagagccgacgaggccaagcagagcgccgaggacatcctgctgaagaccaacgccaccaaggagaagatggacaagagcaacgaggagctgagaaacctgatcaagcagatcagaaacttcctgacccaggacagcgccgacctggacagcatcgaggccgtggccaacgaggtgctgaagatggagatgcccagcaccccccagcagctgcagaacctgaccgaggacatcagagagagagtggagagcctgagccaggtggaggtgatcctgcagcacagcgccgccgacatcgccagagccgagatgctgctggaggaggccaagagagccagcaagagcgccaccgacgtgaaggtgaccgccgacatggtgaaggaggccctggaggaggccgagaaggcccaggtggccgccgagaaggccatcaagcaggccgacgaggacatccagggcacccagaacctgctgaccagcatcgagagcgagaccgccgccagcgaggagaccctgttcaacgccagccagagaatcagcgagctggagagaaacgtggaggagctgaagagaaaggccgcccagaacagcggcgaggccgagtacatcgagaaggtggtgtacaccgtgaagcagagcgccgaggacgtgaagaagaccctggacggcgagctggacgagaagtacaagaaggtggagaacctgatcgccaagaagaccgaggagagcgccgacgccagaagaaaggccgagatgctgcagaacgaggccaagaccctgctggcccaggccaacagcaagctgcagctgctgaaggacctggagagaaagtacgaggacaaccagagatacctggaggacaaggcccaggagctggccagactggagggcgaggtgagaagcctgctgaaggacatcagccagaaggtggccgtgtacagcacctgcctgtag

SEQ ID NO: 25579 - DNA, 330 bp, Artificial Sequence
  Description of Artificial Sequence: Synthetic coding sequence
atgaccaacgacagcccctaccagggcggcgtgttcttcctgaccatccacttccccaccgactaccccttcaagccccccaaggtggccttcaccaccaagatctaccaccccaacatcaacagcaacggcagcatctgcctggacatcctgagaagccagtggagccccgccctgaccgtgagcaaggtgctgctgagcatctgcagcctgctgtgcgaccccaaccccgacgaccccctggtgcccgagatcgcccacacctacaaggccgacagagagaagtacaacagactggccagagagtggacccagaagtacgccatgtag

SEQ ID NO: 25580 - DNA, 558 bp, Artificial Sequence
  Description of Artificial Sequence: Synthetic coding sequence
atgctgaccctggccagcaagctgaagagagacgacggcctgaagggcagcagaaccgccgccaccgccagcgacagcaccagaagagtgagcgtgagagacaagctgctggtgaaggaggtggccgagctggaggccaacctgccctgcacctgcaaggtgcacttccccgaccccaacaagctgcactgcttccagctgaccgtgacccccgacgagggctactaccagggcggcaagttccagttcgagaccgaggtgcccgacgcctacaacatggtgccccccaaggtgaagtgcctgaccaagatctggcaccccaacatcaccgagaccggcgagatctgcctgagcctgctgagagagcacagcatcgacggcaccggctgggcccccaccagaaccctgaaggacgtggtgtggggcctgaacagcctgttcaccgacctgctgaacttcgacgaccccctgaacatcgaggccgccgagcaccacctgagagacaaggaggacttcagaaacaaggtggacgactacatcaagagatacgccagatag

SEQ ID NO: 25581 - DNA, 462 bp, Artificial Sequence
  Description of Artificial Sequence: Synthetic coding sequence
atgctgaccctggccagcaagctgaagagagacgacggcctgaagggcagcagaaccgccgccaccgccagcgacagcaccagaagagtgagcgtgagagacaagctgctggtgaaggacgagggctactaccagggcggcaagttccagttcgagaccgaggtgcccgacgcctacaacatggtgccccccaaggtgaagtgcctgaccaagatctggcaccccaacatcaccgagaccggcgagatctgcctgagcctgctgagagagcacagcatcgacggcaccggctgggcccccaccagaaccctgaaggacgtggtgtggggcctgaacagcctgttcaccgacctgctgaacttcgacgaccccctgaacatcgaggccgccgagcaccacctgagagacaaggaggacttcagaaacaaggtggacgactacatcaagagatacgccagatag

SEQ ID NO: 25582 - DNA, 516 bp, Artificial Sequence
  Description of Artificial Sequence: Synthetic coding sequence
atgctgaccctggccagcaagctgaagagagacgacggcctgaagggcagcagaaccgccgccaccgccagcgacagcaccagaagagtgagcgtgagagacaagctgctggtgaaggaggtggccgagctggaggccaacctgccctgcacctgcaaggtgcacttccccgaccccaacaagctgcactgcttccagctgaccgtgacccccgacgagggctactaccagggcggcaagttccagttcgagaccgaggtgcccgacgcctacaacatggtgccccccaaggtgaagtgcctgaccaagatctggcaccccaacatcaccgagaccggcgagatctgcctgagcctgctgagagagcacagcatcgacggcaccggctgggcccccaccagaaccctgaaggacgtggtgtggggcctgaacagcctgttcaccgacctgctgaacttcgacgaccccctgaacatcgaggccgccgagcaccacctgagagacaaggaggactag

SEQ ID NO: 25583 - DNA, 513 bp, Artificial Sequence
  Description of Artificial Sequence: Synthetic coding sequence
atgaccgagctgcagagcgccctgctgctgagaagacagctggccgagctgaacaagaaccccgtggagggcttcagcgccggcctgatcgacgacaacgacctgtacagatgggaggtgctgatcatcggcccccccgacaccctgtacgagggcggcgtgttcaaggcccacctgaccttccccaaggactaccccctgagaccccccaagatgaagttcatcaccgagatctggcaccccaacgtggacaagaacggcgacgtgtgcatcagcatcctgcacgagcccggcgaggacaagtacggctacgagaagcccgaggagagatggctgcccatccacaccgtggagaccatcatgatcagcgtgatcagcatgctggccgaccccaacggcgacagccccgccaacgtggacgccgccaaggagtggagagaggacagaaacggcgagttcaagagaaaggtggccagatgcgtgagaaagagccaggagaccgccttcgagtag

SEQ ID NO: 25584 - DNA, 552 bp, Artificial Sequence
  Description of Artificial Sequence: Synthetic coding sequence
atgatcaagctgttcagcctgaagcagcagaagaaggaggaggagagcgccggcggcaccaagggcagcagcaagaaggccagcgccgcccagctgagaatccagaaggacatcaacgagctgaacctgcccaagacctgcgacatcagcttcagcgaccccgacgacctgctgaacttcaagctggtgatctgccccgacgagggcttctacaagagcggcaagttcgtgttcagcttcaaggtgggccagggctacccccacgacccccccaaggtgaagtgcgagaccatggtgtaccaccccaacatcgacctggagggcaacgtgtgcctgaacatcctgagagaggactggaagcccgtgctgaccatcaacagcatcatctacggcctgcagtacctgttcctggagcccaaccccgaggaccccctgaacaaggaggccgccgaggtgctgcagaacaacagaagactgttcgagcagaacgtgcagagaagcatgagaggcggctacatcggcagcacctacttcgagagatgcctgaagtag

SEQ ID NO: 25585 - DNA, 3879 bp, Artificial Sequence
  Description of Artificial Sequence: Synthetic coding sequence
atggccgaccccgccgcccccacccccgccgcccccgcccccgcccaggcccccgcccccgcccccgaggccgtgcccgcccccgccgccgcccccgtgcccgcccccgcccccgccagcgacagcgccagcggccccagcagcgacagcggccccgaggccggcagccagagactgctgttcagccacgacctggtgagcggcagatacagaggcagcgtgcacttcggcctggtgagactgatccacggcgaggacagcgacagcgagggcgaggaggagggcagaggcagcagcggctgcagcgaggccggcggcgccggccacgaggagggcagagccagccccctgagaagaggctacgtgagagtgcagtggtaccccgagggcgtgaagcagcacgtgaaggagaccaagctgaagctggaggacagaagcgtggtgcccagagacgtggtgagacacatgagaagcaccgacagccagtgcggcaccgtgatcgacgtgaacatcgactgcgccgtgaagctgatcggcaccaactgcatcatctaccccgtgaacagcaaggacctgcagcacatctggcccttcatgtacggcgactacatcgcctacgactgctggctgggcaaggtgtacgacctgaagaaccagatcatcctgaagctgagcaacggcgccagatgcagcatgaacaccgaggacggcgccaagctgtacgacgtgtgcccccacgtgagcgacagcggcctgttcttcgacgacagctacggcttctaccccggccaggtgctgatcggccccgccaagatcttcagcagcgtgcagtggctgagcggcgtgaagcccgtgctgagcaccaagagcaagttcagagtggtggtggaggaggtgcaggtggtggagctgaaggtgacctggatcaccaagagcttctgccccggcggcaccgacagcgtgagccccccccccagcgtgatcacccaggagaacctgggcagagtgaagagactgggctgcttcgaccacgcccagagacagctgggcgagagatgcctgtacgtgttccccgccaaggtggagcccgccaagatcgcctgggagtgccccgagaagaactgcgcccagggcgagggcagcatggccaagaaggtgaagagactgctgaagaagcaggtggtgagaatcatgagctgcagccccgacacccagtgcagcagagaccacagcatggaggaccccgacaagaagggcgagagcaagaccaagagcgaggccgagagcgccagccccgaggagacccccgacggcagcgccagccccgtggagatgcaggacgagggcgccgaggagccccacgaggccggcgagcagctgccccccttcctgctgaaggagggcagagacgacagactgcacagcgccgagcaggacgccgacgacgaggccgccgacgacaccgacgacaccagcagcgtgaccagcagcgccagcagcaccaccagcagccagagcggcagcggcaccagcagaaagaagagcatccccctgagcatcaagaacctgaagagaaagcacaagagaaagaagaacaagatcaccagagacttcaagcccggcgacagagtggccgtggaggtggtgaccaccatgaccagcgccgacgtgatgtggcaggacggcagcgtggagtgcaacatcagaagcaacgacctgttccccgtgcaccacctggacaacaacgagttctgccccggcgacttcgtggtggacaagagagtgcagagctgccccgaccccgccgtgtacggcgtggtgcagagcggcgaccacatcggcagaacctgcatggtgaagtggttcaagctgagacccagcggcgacgacgtggagctgatcggcgaggaggaggacgtgagcgtgtacgacatcgccgaccaccccgacttcagattcagaaccaccgacatcgtgatcagaatcggcaacaccgaggacggcgccccccacaaggaggacgagcccagcgtgggccaggtggccagagtggacgtgagcagcaaggtggaggtggtgtgggccgacaacagcaagaccatcatcctgccccagcacctgtacaacatcgagagcgagatcgaggagagcgactacgacagcgtggagggcagcaccagcggcgccagcagcgacgagtgggaggacgacagcgacagctgggagaccgacaacggcctggtggaggacgagcaccccaagatcgaggagccccccatcccccccctggagcagcccgtggcccccgaggacaagggcgtggtgatcagcgaggaggccgccaccgccgccgtgcagggcgccgtggccatggccgcccccatggccggcctgatggagaaggccggcaaggacggcccccccaagagcttcagagagctgaaggaggccatcaagatcctggagagcctgaagaacatgaccgtggagcagctgctgaccggcagccccaccagccccaccgtggagcccgagaagcccaccagagagaagaagttcctggacgacatcaagaagctgcaggagaacctgaagaagaccctggacaacgtggccatcgtggaggaggagaagatggaggccgtgcccgacgtggagagaaaggaggacaagcccgagggccagagccccgtgaaggccgagtggcccagcgagacccccgtgctgtgccagcagtgcggcggcaagcccggcgtgaccttcaccagcgccaagggcgaggtgttcagcgtgctggagttcgcccccagcaaccacagcttcaagaagatcgagttccagccccccgaggccaagaagttcttcagcaccgtgagaaaggagatggccctgctggccaccagcctgcccgagggcatcatggtgaagaccttcgaggacagaatggacctgttcagcgccctgatcaagggccccaccagaaccccctacgaggacggcctgtacctgttcgacatccagctgcccaacatctaccccgccgtgcccccccacttctgctacctgagccagtgcagcggcagactgaaccccaacctgtacgacaacggcaaggtgtgcgtgagcctgctgggcacctggatcggcaagggcaccgagagatggaccagcaagagcagcctgctgcaggtgctgatcagcatccagggcctgatcctggtgaacgagccctactacaacgaggccggcttcgacagcgacagaggcctgcaggagggctacgagaacagcagatgctacaacgagatggccctgatcagagtggtgcagagcatgacccagctggtgagaagaccccccgaggtgttcgagcaggagatcagacagcacttcagcaccggcggctggagactggtgaacagaatcgagagctggctggagacccacgccctgctggagaaggcccaggccctgcccaacggcgtgcccaaggccagcagcagccccgagccccccgccgtggccgagctgagcgacagcggccagcaggagcccgaggacggcggccccgcccccggcgaggccagccagggcagcgacagcgagggcggcgcccagggcctggccagcgccagcagagaccacaccgaccagaccagcgagaccgcccccgacgccagcgtgccccccagcgtgaagcccaagaagagaagaaagagctacagaagcttcctgcccgagaagagcggctaccccgacatcggcttccccctgttccccctgagcaagggcttcatcaagagcatcagaggcgtgctgacccagttcagagccgccctgctggaggccggcatgcccgagtgcaccgaggacaagtag

SEQ ID NO: 25586 - DNA, 1269 bp, Artificial Sequence
  Description of Artificial Sequence: Synthetic coding sequence
atgcagcagccccagccccagggccagcagcagcccggccccggccagcagctgggcggccagggcgccgcccccggcgccggcggcggccccggcggcggccccggccccggcccctgcctgagaagagagctgaagctgctggagagcatcttccacagaggccacgagagattcagaatcgccagcgcctgcctggacgagctgagctgcgagttcctgctggccggcgccggcggcgccggcgccggcgccgcccccggcccccacctgccccccagaggcagcgtgcccggcgaccccgtgagaatccactgcaacatcaccgagagctaccccgccgtgccccccatctggagcgtggagagcgacgaccccaacctggccgccgtgctggagagactggtggacatcaagaagggcaacaccctgctgctgcagcacctgaagagaatcatcagcgacctgtgcaagctgtacaacctgccccagcaccccgacgtggagatgctggaccagcccctgcccgccgagcagtgcacccaggaggacgtgagcagcgaggacgaggacgaggagatgcccgaggacaccgaggacctggaccactacgagatgaaggaggaggagcccgccgagggcaagaagagcgaggacgacggcatcggcaaggagaacctggccatcctggagaagatcaagaagaaccagagacaggactacctgaacggcgccgtgagcggcagcgtgcaggccaccgacagactgatgaaggagctgagagacatctacagaagccagagcttcaagggcggcaactacgccgtggagctggtgaacgacagcctgtacgactggaacgtgaagctgctgaaggtggaccaggacagcgccctgcacaacgacctgcagatcctgaaggagaaggagggcgccgacttcatcctgctgaacttcagcttcaaggacaacttccccttcgacccccccttcgtgagagtggtgagccccgtgctgagcggcggctacgtgctgggcggcggcgccatctgcatggagctgctgaccaagcagggctggagcagcgcctacagcatcgagagcgtgatcatgcagatcagcgccaccctggtgaagggcaaggccagagtgcagttcggcgccaacaagagccagtacagcctgaccagagcccagcagagctacaagagcctggtgcagatccacgagaagaacggctggtacaccccccccaaggaggacggctag

SEQ ID NO: 25587 - DNA, 486 bp, Artificial Sequence
  Description of Artificial Sequence: Synthetic coding sequence
atgaaggagctgcaggacatcgccagactgagcgacagattcatcagcgtggagctggtggacgagagcctgttcgactggaacgtgaagctgcaccaggtggacaaggacagcgtgctgtggcaggacatgaaggagaccaacaccgagttcatcctgctgaacctgaccttccccgacaacttccccttcagcccccccttcatgagagtgctgagccccagactggagaacggctacgtgctggacggcggcgccatctgcatggagctgctgacccccagaggctggagcagcgcctacaccgtggaggccgtgatgagacagttcgccgccagcctggtgaagggccagggcagaatctgcagaaaggccggcaagagcaagaagagcttcagcagaaaggaggccgaggccaccttcaagagcctggtgaagacccacgagaagtacggctgggtgaccccccccgtgagcgacggctag

SEQ ID NO: 25588 - DNA, 681 bp, Artificial Sequence
  Description of Artificial Sequence: Synthetic coding sequence
atgcacggcagagcctacctgctgctgcacagagacttctgcgacctgaaggagaacaactacaagggcatcaccgccaagcccgtgagcgaggacatgatggagtgggaggtggagatcgagggcctgcagaacagcgtgtggcagggcctggtgttccagctgaccatccacttcaccagcgagtacaactacgccccccccgtggtgaagttcatcaccatccccttccaccccaacgtggacccccacaccggccagccctgcatcgacttcctggacaaccccgagaagtggaacaccaactacaccctgagcagcatcctgctggccctgcaggtgatgctgagcaaccccgtgctggagaaccccgtgaacctggaggccgccagaatcctggtgaaggacgagagcctgtacagaaccatcctgagactgttcaacagacccctgcagatgaaggacgacagccaggagctgcccaaggaccccagaaagtgcatcagacccatcaagaccaccagcttcagcgactactaccagacctggagcagaatcgccaccagcaaggccaccgagtactacagaacccccctgctgaaggtgcccaacttcatcggccagtactacaagtggaagaagatggacctgcagcaccagaaggagtggaacctgaagtag

SEQ ID NO: 25589 - DNA, 966 bp, Artificial Sequence
  Description of Artificial Sequence: Synthetic coding sequence
atgcacggcagagcctacctgctgctgcacagagacttctgcgacctgaaggagaacaactacaagggcatcaccgccaagcccgtgagcgaggacatgatggagtgggaggtggagatcgagggcctgcagaacagcgtgtggcagggcctggtgttccagctgaccatccacttcaccagcgagtacaactacgccccccccgtggtgaagttcatcaccatccccttccaccccaacgtggacccccacaccggccagccctgcatcgacttcctggacaaccccgagaagtggaacaccaactacaccctgagcagcatcctgctggccctgcaggtgatgctgagcaaccccgtgctggagaaccccgtgaacctggaggccgccagaatcctggtgaaggacgagagcctgtacagaaccatcctgagactgttcaacagacccctgcagatgaaggacgacagccaggagctgcccaaggaccccagaaagtgcatcagacccatcaagaccaccagcttcagcgactactaccagacctggagcagaatcgccaccagcaaggccaccgagtactacagaacccccctgctgaaggtgcccaacttcatcggccagtactacaagtggaagaagatggacctgcagcaccagaaggagtggaacctgaagtacagcgtgatcaagtgctggctggccagaaagagaatgccccacgaggtgacccacagcatggaggagatcaagctgtgccccaccctgatccccaccaccgacgagatcttcctggagagccccaccgccatcaacagcatcaccgacatctacgagaccgaggaggagggctggaagagcgacaccagcctgtacgagaacgacaccgacgagcccagagaggaggaggtggaggacctgatcagctggaccaacaccctgaacaccaacaccagcgaggactag

SEQ ID NO: 25590 - DNA, 504 bp, Artificial Sequence
  Description of Artificial Sequence: Synthetic coding sequence
atggccgacgaggccaccagaagagtggtgagcgagatccccgtgctgaagaccaacgccggccccagagacagagagctgtgggtgcagagactgaaggaggagtaccagagcctgatcagatacgtggagaacaacaagaacgccgacaacgactggttcagactggagagcaacaaggagggcaccagatggttcggcaagtgctggtacatccacgacctgctgaagtacgagttcgacatcgagttcgacatccccatcacctaccccaccaccgcccccgagatcgccgtgcccgagctggacggcaagaccgccaagatgtacagaggcggcaagatctgcctgaccgaccacttcaagcccctgtgggccagaaacgtgcccaagttcggcctggcccacctgatggccctgggcctgggcccctggctggccgtggagatccccgacctgatccagaagggcgtgatccagcacaaggagaagtgcaaccagtag

SEQ ID NO: 25591 - DNA, 3177 bp, Artificial Sequence
  Description of Artificial Sequence: Synthetic coding sequence
atgagcagcagccccctgagcaagaagagaagagtgagcggccccgaccccaagcccggcagcaactgcagccccgcccagagcgtgctgagcgaggtgcccagcgtgcccaccaacggcatggccaagaacggcagcgaggccgacatcgacgagggcctgtacagcagacagctgtacgtgctgggccacgaggccatgaagagactgcagaccagcagcgtgctggtgagcggcctgagaggcctgggcgtggagatcgccaagaacatcatcctgggcggcgtgaaggccgtgaccctgcacgaccagggcaccgcccagtgggccgacctgagcagccagttctacctgagagaggaggacatcggcaagaacagagccgaggtgagccagcccagactggccgagctgaacagctacgtgcccgtgaccgcctacaccggccccctggtggaggacttcctgagcggcttccaggtggtggtgctgaccaacacccccctggaggaccagctgagagtgggcgagttctgccacaacagaggcatcaagctggtggtggccgacaccagaggcctgttcggccagctgttctgcgacttcggcgaggagatgatcctgaccgacagcaacggcgagcagcccctgagcgccatggtgagcatggtgaccaaggacaaccccggcgtggtgacctgcctggacgaggccagacacggcttcgagagcggcgacttcgtgagcttcagcgaggtgcagggcatggtggagctgaacggcaaccagcccatggagatcaaggtgctgggcccctacaccttcagcatctgcgacaccagcaacttcagcgactacatcagaggcggcatcgtgagccaggtgaaggtgcccaagaagatcagcttcaagagcctggtggccagcctggccgagcccgacttcgtggtgaccgacttcgccaagttcagcagacccgcccagctgcacatcggcttccaggccctgcaccagttctgcgcccagcacggcagaccccccagacccagaaacgaggaggacgccgccgagctggtggccctggcccaggccgtgaacgccagagccctgcccgccgtgcagcagaacaacctggacgaggacctgatcagaaagctggcctacgtggccgccggcgacctggcccccatcaacgccttcatcggcggcctggccgcccaggaggtgatgaaggcctgcagcggcaagttcatgcccatcatgcagtggctgtacttcgacgccctggagtgcctgcccgaggacaaggaggtgctgaccgaggacaagtgcctgcagagacagaacagatacgacggccaggtggccgtgttcggcagcgacctgcaggagaagctgggcaagcagaagtacttcctggtgggcgccggcgccatcggctgcgagctgctgaagaacttcgccatgatcggcctgggctgcggcgagggcggcgagatcatcgtgaccgacatggacaccatcgagaagagcaacctgaacagacagttcctgttcagaccctgggacgtgaccaagctgaagagcgacaccgccgccgccgccgtgagacagatgaacccccacatcagagtgaccagccaccagaacagagtgggccccgacaccgagagaatctacgacgacgacttcttccagaacctggacggcgtggccaacgccctggacaacgtggacgccagaatgtacatggacagaagatgcgtgtactacagaaagcccctgctggagagcggcaccctgggcaccaagggcaacgtgcaggtggtgatccccttcctgaccgagagctacagcagcagccaggacccccccgagaagagcatccccatctgcaccctgaagaacttccccaacgccatcgagcacaccctgcagtgggccagagacgagttcgagggcctgttcaagcagcccgccgagaacgtgaaccagtacctgaccgaccccaagttcgtggagagaaccctgagactggccggcacccagcccctggaggtgctggaggccgtgcagagaagcctggtgctgcagagaccccagacctgggccgactgcgtgacctgggcctgccaccactggcacacccagtacagcaacaacatcagacagctgctgcacaacttcccccccgaccagctgaccagcagcggcgcccccttctggagcggccccaagagatgcccccaccccctgaccttcgacgtgaacaaccccctgcacctggactacgtgatggccgccgccaacctgttcgcccagacctacggcctgaccggcagccaggacagagccgccgtggccaccttcctgcagagcgtgcaggtgcccgagttcacccccaagagcggcgtgaagatccacgtgagcgaccaggagctgcagagcgccaacgccagcgtggacgacagcagactggaggagctgaaggccaccctgcccagccccgacaagctgcccggcttcaagatgtaccccatcgacttcgagaaggacgacgacagcaacttccacatggacttcatcgtggccgccagcaacctgagagccgagaactacgacatccccagcgccgacagacacaagagcaagctgatcgccggcaagatcatccccgccatcgccaccaccaccgccgccgtggtgggcctggtgtgcctggagctgtacaaggtggtgcagggccacagacagctggacagctacaagaacggcttcctgaacctggccctgcccttcttcggcttcagcgagcccctggccgcccccagacaccagtactacaaccaggagtggaccctgtgggacagattcgaggtgcagggcctgcagcccaacggcgaggagatgaccctgaagcagttcctggactacttcaagaccgagcacaagctggagatcaccatgctgagccagggcgtgagcatgctgtacagcttcttcatgcccgccgccaagctgaaggagagactggaccagcccatgaccgagatcgtgagcagagtgagcaagagaaagctgggcagacacgtgagagccctggtgctggagctgtgctgcaacgacgagagcggcgaggacgtggaggtgccctacgtgagatacaccatcagatag

SEQ ID NO: 25592 - DNA, 1521 bp, Artificial Sequence
  Description of Artificial Sequence: Synthetic coding sequence
atgggcttccaccacgtgggccaggccggcctggagcccctgaccagcggcgaccccagcgccctggccagccagagcgccggcatcaccggcgtgagctactgcgcctggcccggcttcagcatcgaggtgggcgagtggggcagactggagggcttccccaccagcagagtggccgtgagactggtgctggccctgttcaccgacggccccagcaacaacgcctgcggcaaccccttctgccagctgtggccccacgtgatctgcctgctgtgcctgcagtgggccagagacgagttcgagggcctgttcaagcagcccgccgagaacgtgaaccagtacctgaccgaccccaagttcgtggagagaaccctgagactggccggcacccagcccctggaggtgctggaggccgtgcagagaagcctggtgctgcagagaccccagacctgggccgactgcgtgacctgggcctgccaccactggcacacccagtacagcaacaacatcagacagctgctgcacaacttcccccccgaccagctgaccagcagcggcgcccccttctggagcggccccaagagatgcccccaccccctgaccttcgacgtgaacaaccccctgcacctggactacgtgatggccgccgccaacctgttcgcccagacctacggcctgaccggcagccaggacagagccgccgtggccaccttcctgcagagcgtgcaggtgcccgagttcacccccaagagcggcgtgaagatccacgtgagcgaccaggagctgcagagcgccaacgccagcgtggacgacagcagactggaggagctgaaggccaccctgcccagccccgacaagctgcccggcttcaagatgtaccccatcgacttcgagaaggacgacgacagcaacttccacatggacttcatcgtggccgccagcaacctgagagccgagaactacgacatccccagcgccgacagacacaagagcaagctgatcgccggcaagatcatccccgccatcgccaccaccaccgccgccgtggtgggcctggtgtgcctggagctgtacaaggtggtgcagggccacagacagctggacagctacaagaacggcttcctgaacctggccctgcccttcttcggcttcagcgagcccctggccgcccccagacaccagtactacaaccaggagtggaccctgtgggacagattcgaggtgcagggcctgcagcccaacggcgaggagatgaccctgaagcagttcctggactacttcaagaccgagcacaagctggagatcaccatgctgagccagggcgtgagcatgctgtacagcttcttcatgcccgccgccaagctgaaggagagactggaccagcccatgaccgagatcgtgagcagagtgagcaagagaaagctgggcagacacgtgagagccctggtgctggagctgtgctgcaacgacgagagcggcgaggacgtggaggtgccctacgtgagatacaccatcagatag

SEQ ID NO: 25593 - DNA, 3177 bp, Artificial Sequence; identical to SEQ ID NO: 25591
  Description of Artificial Sequence: Synthetic coding sequence

SEQ ID NO: 25594 - DNA, 816 bp, Artificial Sequence
  Description of Artificial Sequence: Synthetic coding sequence
atgagcagcagccccctgagcaagaagagaagagtgagcggccccgaccccaagcccggcagcaactgcagccccgcccagagcgtgctgagcgaggtgcccagcgtgcccaccaacggcatggccaagaacggcagcgaggccgacatcgacgagggcctgtacagcagacagctgtacgtgctgggccacgaggccatgaagagactgcagaccagcagcgtgctggtgagcggcctgagaggcctgggcgtggagatcgccaagaacatcatcctgggcggcgtgaaggccgtgaccctgcacgaccagggcaccgcccagtgggccgacctgagcagccagttctacctgagagaggaggacatcggcaagaacagagccgaggtgagccagcccagactggccgagctgaacagctacgtgcccgtgaccgcctacaccggccccctggtggaggacttcctgagcggcttccaggtggtggtgctgaccaacacccccctggaggaccagctgagagtgggcgagttctgccacaacagaggcatcaagctggtggtggccgacaccagaggcctgttcggccagctgttctgcgacttcggcgaggagatgatcctgaccgacagcaacggcgagcagcccctgagcgccatggtgagcatggtgaccaaggacaaccccggcgtggtgacctgcctggacgaggccagacacggcttcgagagcggcgacttcgtgagcttcagcgaggtgcagggcatggtggagctgaacggcaaccagcccatggagatcaaggtgctgggctag

SEQ ID NO: 25595 - DNA, 522 bp, Artificial Sequence
  Description of Artificial Sequence: Synthetic coding sequence
atgctgtgcgtgatctaccacctggacaaccccgtgggcaagatgagcagcagccccctgagcaagaagagaagagtgagcggccccgaccccaagcccggcagcaactgcagccccgcccagagcgtgctgagcgaggtgcccagcgtgcccaccaacggcatggccaagaacggcagcgaggccgacatcgacgagggcctgtacagcagacagctgtacgtgctgggccacgaggccatgaagagactgcagaccagcagcgtgctggtgagcggcctgagaggcctgggcgtggagatcgccaagaacatcatcctgggcggcgtgaaggccgtgaccctgcacgaccagggcaccgcccagtgggccgacctgagcagccagttctacctgagagaggaggacatcggcaagaacagagccgaggtgagccagcccagactggccgagctgaacagctacgtgcccgtgaccgcctacaccggccccctggtggaggacttcctgagcggcttctag

SEQ ID NO: 25596 - DNA, 855 bp, Artificial Sequence
  Description of Artificial Sequence: Synthetic coding sequence
atgctgtgcgtgatctaccacctggacaaccccgtgggcaagatgagcagcagccccctgagcaagaagagaagagtgagcggccccgaccccaagcccggcagcaactgcagccccgcccagagcgtgctgagcgaggtgcccagcgtgcccaccaacggcatggccaagaacggcagcgaggccgacatcgacgagggcctgtacagcagacagctgtacgtgctgggccacgaggccatgaagagactgcagaccagcagcgtgctggtgagcggcctgagaggcctgggcgtggagatcgccaagaacatcatcctgggcggcgtgaaggccgtgaccctgcacgaccagggcaccgcccagtgggccgacctgagcagccagttctacctgagagaggaggacatcggcaagaacagagccgaggtgagccagcccagactggccgagctgaacagctacgtgcccgtgaccgcctacaccggccccctggtggaggacttcctgagcggcttccaggtggtggtgctgaccaacacccccctggaggaccagctgagagtgggcgagttctgccacaacagaggcatcaagctggtggtggccgacaccagaggcctgttcggccagctgttctgcgacttcggcgaggagatgatcctgaccgacagcaacggcgagcagcccctgagcgccatggtgagcatggtgaccaaggacaaccccggcgtggtgacctgcctggacgaggccagacacggcttcgagagcggcgacttcgtgagcttcagcgaggtgcagggcatggtggagctgaacggcaaccagcccatggagatcaaggtgctgtag

SEQ ID NO: 25597 - DNA, 705 bp, Artificial Sequence
  Description of Artificial Sequence: Synthetic coding sequence
atgagcaagccccacttcccccccgccctgcccgcccccgccgccatccccggcatcaagggcgaggagaacggctgcctgctgctgcccacctacagcgtgcccggcagcatgctgtgcgtgatctaccacctggacaaccccgtgggcaagatgagcagcagccccctgagcaagaagagaagagtgagcggccccgaccccaagcccggcagcaactgcagccccgcccagagcgtgctgagcgaggtgcccagcgtgcccaccaacggcatggccaagaacggcagcgaggccgacatcgacgagggcctgtacagcagacagctgtacgtgctgggccacgaggccatgaagagactgcagaccagcagcgtgctggtgagcggcctgagaggcctgggcgtggagatcgccaagaacatcatcctgggcggcgtgaaggccgtgaccctgcacgaccagggcaccgcccagtgggccgacctgagcagccagttctacctgagagaggaggacatcggcaagaacagagccgaggtgagccagcccagactggccgagctgaacagctacgtgcccgtgaccgcctacaccggccccctggtggaggacttcctgagcggcttccaggtggtggtgctgaccaacacccccctggaggaccagctgagagtgggcgagttctgccacaacagaggctag

SEQ ID NO: 25598 - DNA, 588 bp, Artificial Sequence
  Description of Artificial Sequence: Synthetic coding sequence
atgagcaagccccacttcccccccgccctgcccgcccccgccgccatccccggcatcaagggcgaggagaacggctgcctgctgctgcccacctacagcgtgcccggcagcatgctgtgcgtgatctaccacctggacaaccccgtgggcaagatgagcagcagccccctgagcaagaagagaagagtgagcggccccgaccccaagcccggcagcaactgcagccccgcccagagcgtgctgagcgaggtgcccagcgtgcccaccaacggcatggccaagaacggcagcgaggccgacatcgacgagggcctgtacagcagacagctgtacgtgctgggccacgaggccatgaagagactgcagaccagcagcgtgctggtgagcggcctgagaggcctgggcgtggagatcgccaagaacatcatcctgggcggcgtgaaggccgtgaccctgcacgaccagggcaccgcccagtgggccgacctgagcagccagttctacctgagagaggaggacatcggcaagaacagagccgaggtgagccagcccagactggccgagctgaacagctacgtgcccgtgtag

SEQ ID NO: 25599 - DNA, 843 bp, Artificial Sequence
  Description of Artificial Sequence: Synthetic coding sequence
atggccaccgaggcccccgtgaacatcgccccccccgagtgcagcaccgtggtgagcaccgccgtggacagcctgatctggcagcccaacagcctgaacatgcacatgatcagacccaagagcgccaagggcagaaccagacccagcctgcagaagagccagggcgtggaggtgtgcgcccaccacatccccagccccccccccgccatcccctacgagctgcccagcagccagaagcccggcgcctgcgcccccaagagccccaaccagggcgccagcgacgagatccccgagctgcagcagcaggtgcccaccggcgccagcagcagcctgaacaagtaccccgtgctgcccagcatcaacagaaagaacctggaggaggaggccgtggagaccgtggccaagaaggccagcagcctgcagctgagcagcatcagagccctgtaccaggacgagaccggcaccatgaagaccagcgaggaggacagcagagccagagcctgcgccgtggagagaaagttcatcgtgagaaccaagaagcagggcagcagcagagccggcaacctggaggagcccagcgaccaggagcccagactgctgctggccgtgagaagccccaccggccagagattcgtgagacacttcagacccaccgacgacctgcagaccatcgtggccgtggccgagcagaagaacaagaccagctacagacactgcagcatcgagaccatggaggtgcccagaagaagattcagcgacctgaccaagagcctgcaggagtgcagaatcccccacaagagcgtgctgggcatcagcctggaggacggcgagggctggccctag

SEQ ID NO: 25600 - DNA, 1155 bp, Artificial Sequence
  Description of Artificial Sequence: Synthetic coding sequence
atggccttcccctgcagaagaagcctgaccgccaagaccctggcctgcctgctggtgggcgtgagcttcctggccctgcagcagtggttcctgcaggcccccagaagccccagagaggagagaagcccccaggaggagacccccgagggccccaccgacgcccccgccgccgacgagccccccagcgagctggtgcccggccccccctgcgtggccaacgccagcgccaacgccaccgccgacttcgagcagctgcccgccagaatccaggacttcctgagatacagacactgcagacacttccccctgctgtgggacgcccccgccaagtgcgccggcggcagaggcgtgttcctgctgctggccgtgaagagcgcccccgagcactacgagagaagagagctgatcagaagaacctggggccaggagagaagctacggcggcagacccgtgagaagactgttcctgctgggcacccccggccccgaggacgaggccagagccgagagactggccgagctggtggccctggaggccagagagcacggcgacgtgctgcagtgggccttcgccgacaccttcctgaacctgaccctgaagcacctgcacctgctggactggctggccgccagatgcccccacgccagattcctgctgagcggcgacgacgacgtgttcgtgcacaccgccaacgtggtgagattcctgcaggcccagccccccggcagacacctgttcagcggccagctgatggagggcagcgtgcccatcagagacagctggagcaagtacttcgtgcccccccagctgttccccggcagcgcctaccccgtgtactgcagcggcggcggcttcctgctgagcggccccaccgccagagccctgagagccgccgccagacacacccccctgttccccatcgacgacgcctacatgggcatgtgcctggagagagccggcctggcccccagcggccacgagggcatctggcccttcggcgtgcagctgcccggcgcccagcagagcagcttcgacccctgcatgtacagagagctgctgctggtgcacagattcgccccctacgagatgctgctgatgtggaaggccctgcacagccccgccctgagctgcgacagaggccacagagtgagctag

SEQ ID NO: 25601 - DNA, 792 bp, Artificial Sequence
  Description of Artificial Sequence: Synthetic coding sequence
atggccttcccctgcagaagaagcctgaccgccaagaccctggcctgcctgctggtgggcgtgagcttcctggccctgcagcagagaagaagacagagagtgccccccaccctgcccagacccgccagagcccaccccggcctgcccgccgtgccccaggagagaagctacggcggcagacccgtgagaagactgttcctgctgggcacccccggccccgaggacgaggccagagccgagagactggccgagctggtggccctggaggccagagagcacggcgacgtgctgcagtgggccttcgccgacaccttcctgaacctgaccctgaagcacctgcacctgctggactggctggccgccagatgcccccacgccagattcctgctgagcggcgacgacgacgtgttcgtgcacaccgccaacgtggtgagattcctgcaggcccagccccccggcagacacctgttcagcggccagctgatggagggcagcgtgcccatcagagacagctggagcaagtacttcgtgcccccccagctgttccccggcagcgcctaccccgtgtactgcagcggcggcggcttcctgctgagcggcctggcccccagcggccacgagggcatccccagcgcctgcagcctgcccggcgcccagcagagcagcttcgacccctgcatgtacagagagctgctgctggtgcacagattcgccccctacgagatgctgctgatgtggaaggccctgcacagccccgccctgagctgcgacagaggccacagagtgagctag

SEQ ID NO: 25602 - DNA, 366 bp, Artificial Sequence
  Description of Artificial Sequence: Synthetic coding sequence
atggccttcccctgcagaagaagcctgaccgccaagaccctggcctgcctgctggtgggcgtgagcttcctggccctgcagcagtggttcctgcaggcccccagaagccccagagaggagagaagcccccaggaggagacccccgagggccccaccgacgcccccgccgccgacgagccccccagcgagctggtgcccggccccccctgcgtggccaacgccagcgccaacgccaccgccgacttcgagcagctgcccgccagaatccaggacttcctgagatacagacactgcagacacttccccctgctgtgggacgcccccgccaagtgcgccggcggcagaggcgtgttcctgctgctgtag

SEQ ID NO: 25603 - DNA, 1158 bp, Artificial Sequence
  Description of Artificial Sequence: Synthetic coding sequence
atggccttcccctgcagaagaagcctgaccgccaagaccctggcctgcctgctggtgggcgtgagcttcctggccctgcagcagtggttcctgcaggcccccagaagccccagagaggagagaagcccccaggaggagacccccgagggccccaccgacgcccccgccgccgacgagccccccagcgagctggtgcccggccccccctgcgtggccaacgccagcgccaacgccaccgccgacttcgagcagctgcccgccagaatccaggacttcctgagatacagacactgcagacacttccccctgctgtgggacgcccccgccaagtgcgccggcggcagaggcgtgttcctgctgctggccgtgaagagcgcccccgagcactacgagagaagagagctgatcagaagaacctggggccaggagagaagctacggcggcagacccgtgagaagactgttcctgctgggcacccccggccccgaggacgaggccagagccgagagactggccgagctggtggccctggaggccagagagcacggcgacgtgctgcagtgggccttcgccgacaccttcctgaacctgaccctgaagcacctgcacctgctggactggctggccgccagatgcccccacgccagattcctgctgagcggcgacgacgacgtgttcgtgcacaccgccaacgtggtgagattcctgcaggcccagccccccggcagacacctgttcagcggccagctgatggagggcagcgtgcccatcagagacagctggagcaagtacttcgtgcccccccagctgttccccggcagcgcctaccccgtgtactgcagcggcggcggcttcctgctgagcggccccaccgccagagccctgagagccgccgccagacacacccccctgttccccatcgacgacgcctacatgggcatgtgcctgggcgccagaagacccggcgcccagagacccagaggccaccccggccccagcgcctgcagcctgcccggcgcccagcagagcagcttcgacccctgcatgtacagagagctgctgctggtgcacagattcgccccctacgagatgctgctgatgtggaaggccctgcacagccccgccctgagctgcgacagaggccacagagtgagctag

SEQ ID NO: 25604 - DNA, 1086 bp, Artificial Sequence
  Description of Artificial Sequence: Synthetic coding sequence
atgagcggcgccggcgtgggcggcgccagcgaggagagccaggccatgcaggcccacgtgagcatcatcctgcccgtgcacaacgccgagccctggctggacgagtgcctgagaagcgtgctgcagcaggacttcgagggcaccatggagctgagcgtgttcaacgacgccagcaaggacaagagcggcgccatcatcgagaagtggagagtgaagctggaggacagcggcgtgcacgtgatcatcggcggccacgacagccccagccccagaggcgtgggctacgccaagaaccaggccgtggcccagagcagcggcagctacctgtgcttcctggacagcgacgacgtgatgatgccccagagagtgagactgcagcacgaggccgccgtgcagcaccccagcagcatcatcggctgcagagtgagaagagacccccccaacagcaccgagagatacaccagatggatcaaccagctgacccccgagcagctgctgacccaggtgttcaccagcaacggccccaccgtgatcatgcccacctggttctgcagcagagcctggttcagccacgtgggccccttcaacgagggcggccagggcgtgcccgaggacctgctgttcttctacgagcacctgagaaagggcggcggcgtgatcagagtggaccagagcctgctgctgtacagacaccacccccaggccgccacccactgcgtgctggagaccaccatctggacccacagagtgagattcctggaggagcaggccctgcccagatgggccgccttcaccatctggaacgccggcaagcagggcagaagactgtacagaagcctgaccgccggcagccagagaaaggtggtggccttctgcgacgtggacgagaacaagatcagaaagggcttctactgccacgaggacagccaggagagacccaagcccagaatccccatcctgcacttcagagccgccagaccccccttcgtgatctgcgtgaagctggacctgaccggcggcgccttcgaggacaacctgagaagcctgcacctgcaggagggccaggacttcctgcacttcagctag

SEQ ID NO: 25605 - DNA, 1812 bp, Artificial Sequence
  Description of Artificial Sequence: Synthetic coding sequence
atggccgtggccagaaagatcagaaccctgctgaccgtgaacatcctggtgttcgtgggcatcgtgctgttcagcgtgtactgcagactgcagggcagaagccaggagctggtgagaatcgtgagcggcgacagaagagtgagaagcagacacgccaaggtgggcaccctgggcgacagagaggccatcctgcagagactggaccacctggaggaggtggtgtacaaccagctgaacggcctggccaagcccatcggcctggtggagggccccggcggcctgggccagggcggcctggccgccaccctgagagacgacggccaggaggccgagggcaagtacgaggagtacggctacaacgcccagctgagcgacagaatcagcctggacagaagcatccccgactacagacccagaaagtgcagacagatgagctacgcccaggacctgccccaggtgagcgtggtgttcatcttcgtgaacgaggccctgagcgtgatcctgagaagcgtgcacagcgtggtgaaccacacccccagccagctgctgaaggaggtgatcctggtggacgacaacagcgacaacgtggagctgaagttcaacctggaccagtacgtgaacaagagataccccggcctggtgaagatcgtgagaaacagcagaagagagggcctgatcagagccagactgcagggctggaaggccgccaccgcccccgtggtgggcttcttcgacgcccacgtggagttcaacaccggctgggccgagcccgccctgagcagaatcagagaggacagaagaagaatcgtgctgcccgccatcgacaacatcaagtacagcaccttcgaggtgcagcagtacgccaacgccgcccacggctacaactggggcctgtggtgcatgtacatcatccccccccaggactggctggacagaggcgacgagagcgcccccatcagaacccccgccatgatcggctgcagcttcgtggtggacagagagtacttcggcgacatcggcctgctggaccccggcatggaggtgtacggcggcgagaacgtggagctgggcatgagagtgtggcagtgcggcggcagcatggaggtgctgccctgcagcagagtggcccacatcgagagaaccagaaagccctacaacaacgacatcgactactacgccaagagaaacgccctgagagccgccgaggtgtggatggacgacttcaagagccacgtgtacatggcctggaacatccccatgagcaaccccggcgtggacttcggcgacgtgagcgagagactggccctgagacagagactgaagtgcagaagcttcaagtggtacctggagaacgtgtaccccgagatgagagtgtacaacaacaccctgacctacggcgaggtgagaaacagcaaggccagcgcctactgcctggaccagggcgccgaggacggcgacagagccatcctgtacccctgccacggcatgagcagccagctggtgagatacagcgccgacggcctgctgcagctgggccccctgggcagcaccgccttcctgcccgacagcaagtgcctggtggacgacggcaccggcagaatgcccaccctgaagaagtgcgaggacgtggccagacccacccagagactgtgggacttcacccagagcggccccatcgtgagcagagccaccggcagatgcctggaggtggagatgagcaaggacgccaacttcggcctgagactggtggtgcagagatgcagcggccagaagtggatgatcagaaactggatcaagcacgccagacactag

SEQ ID NO: 25606 - DNA, 714 bp, Artificial Sequence
  Description of Artificial Sequence: Synthetic coding sequence
atggaggtgctgccctgcagcagagtggcccacatcgagagaaccagaaagccctacaacaacgacatcgactactacgccaagagaaacgccctgagagccgccgaggtgtggatggacgacttcaagagccacgtgtacatggcctggaacatccccatgagcaaccccggcgtggacttcggcgacgtgagcgagagactggccctgagacagagactgaagtgcagaagcttcaagtggtacctggagaacgtgtaccccgagatgagagtgtacaacaacaccctgacctacggcgaggtgagaaacagcaaggccagcgcctactgcctggaccagggcgccgaggacggcgacagagccatcctgtacccctgccacggcatgagcagccagctggtgagatacagcgccgacggcctgctgcagctgggccccctgggcagcaccgccttcctgcccgacagcaagtgcctggtggacgacggcaccggcagaatgcccaccctgaagaagtgcgaggacgtggccagacccacccagagactgtgggacttcacccagagcggccccatcgtgagcagagccaccggcagatgcctggaggtggagatgagcaaggacgccaacttcggcctgagactggtggtgcagagatgcagcggccagaagtggatgatcagaaactggatcaagcacgccagacactag

SEQ ID NO: 25607 - DNA, 1065 bp, Artificial Sequence
  Description of Artificial Sequence: Synthetic coding sequence
atgatcggctgcagcttcgtggtggacagagagtacttcggcgacatcggcctgctggaccccggcatggaggtgtacggcggcgagaacgtggagctgggcatgagagagaccgagggcttccagcaggacaaggtgaactacaagcagaacaagagaggcagaaagaccagacagagagtgaagagaagcagaagcgaggcccacagagcccagcccagccccggcgccacccacggcgcccacagcagagcccccggccccagaaccgagcccaccgccgagccctggggccacgccagacccaccgccgccctgcccgccaccggcgtgtggcagtgcggcggcagcatggaggtgctgccctgcagcagagtggcccacatcgagagaaccagaaagccctacaacaacgacatcgactactacgccaagagaaacgccctgagagccgccgaggtgtggatggacgacttcaagagccacgtgtacatggcctggaacatccccatgagcaaccccggcgtggacttcggcgacgtgagcgagagactggccctgagacagagactgaagtgcagaagcttcaagtggtacctggagaacgtgtaccccgagatgagagtgtacaacaacaccctgacctacggcgaggtgagaaacagcaaggccagcgcctactgcctggaccagggcgccgaggacggcgacagagccatcctgtacccctgccacggcatgagcagccagctggtgagatacagcgccgacggcctgctgcagctgggccccctgggcagcaccgccttcctgcccgacagcaagtgcctggtggacgacggcaccggcagaatgcccaccctgaagaagtgcgaggacgtggccagacccacccagagactgtgggacttcacccagagcggccccatcgtgagcagagccaccggcagatgcctggaggtggagatgagcaaggacgccaacttcggcctgagactggtggtgcagagatgcagcggccagaagtggatgatcagaaactggatcaagcacgccagacactag

SEQ ID NO: 25608 - DNA, 294 bp, Artificial Sequence
  Description of Artificial Sequence: Synthetic coding sequence
atggaggtgctgccctgcagcagagtggcccacatcgagagaaccagaaagccctacaacaacgacatcgactactacgccaagagaaacgccctgagagccgccgaggtgtggatggacgacttcaagagccacgtgtacatggcctggaacatccccatgagcaaccccggcgtggacttcggcgacgtgagcgagagactggccctgagacagagactgaagtgcagaagcttcaagtggtacctggagaacgtgtaccccgagatgagagtgtacaacaacaccctgtag

SEQ ID NO: 25609 - DNA, 714 bp, Artificial Sequence; identical to SEQ ID NO: 25606
  Description of Artificial Sequence: Synthetic coding sequence

SEQ ID NO: 25610 - DNA, 165 bp, Artificial Sequence
  Description of Artificial Sequence: Synthetic coding sequence
atggaggtgctgccctgcagcagagtggcccacatcgagagaaccagaaagccctacaacaacgacatcgactactacgccaagagaaacgccctgagagccgccgaggtgtggatggacgacttcaagagccacgtgtacatggcctggaacatccccatgtag

SEQ ID NO: 25611 - DNA, 714 bp, Artificial Sequence; identical to SEQ ID NO: 25606
  Description of Artificial Sequence: Synthetic coding sequence

SEQ ID NO: 25612 - DNA, 1812 bp, Artificial Sequence; identical to SEQ ID NO: 25605
  Description of Artificial Sequence: Synthetic coding sequence

SEQ ID NO: 25613 - DNA, 1155 bp, Artificial Sequence
  Description of Artificial Sequence: Synthetic coding sequence
atgggccccggccccagccccaactggaccctggaccccgagcccagatgcagactgtggagcgagcccagactgcccgccggccccggcgtgctggccgccggcagccccagactgccctgcagatacgtgatgaccagcgagttcaccctgggccccaccgccgagttcttcagagagcacaacttcttccacctggaccccgccaacgtggtgatgttcgagcagagactgctgcccgccgtgaccttcgacggcaaggtgatcctggagagaaaggacaaggtggccatggcccccgacggcaacggcggcctgtactgcgccctggaggaccacaagatcctggaggacatggagagaagaggcgtggagttcgtgcacgtgtactgcgtggacaacatcctggtgagactggccgaccccgtgttcatcggcttctgcgtgctgcagggcgccgactgcggcgccaaggtggtggagaaggcctaccccgaggagcccgtgggcgtggtgtgccaggtggacggcgtgccccaggtggtggagtacagcgagatcagccccgagaccgcccagctgagagccagcgacggcagcctgctgtacaacgccggcaacatctgcaaccacttcttcaccagaggcttcctgaaggccgtgaccagagagttcgagcccctgctgaagccccacgtggccgtgaagaaggtgccctacgtggacgaggagggcaacctggtgaagcccctgaagcccaacggcatcaagatggagaagttcgtgttcgacgtgttcagattcgccaagaacttcgccgccctggaggtgctgagagaggaggagttcagccccctgaagaacgccgagcccgccgacagagacagccccagaaccgccagacaggccctgctgacccagcactacagatgggccctgagagccggcgccagattcctggacgcccacggcgcctggctgcccgagctgcccagcctgccccccaacggcgacccccccgccatctgcgagatcagccccctggtgagctacagcggcgagggcctggaggtgtacctgcagggcagagagttccagagccccctgatcctggacgaggaccaggccagagagccccagctgcaggagagctag

SEQ ID NO: 25614 - DNA, 1524 bp, Artificial Sequence
  Description of Artificial Sequence: Synthetic coding sequence
atggccagcgagcaggacgtgagagccagactgcagagagccggccaggagcacctgctgagattctgggccgagctggcccccgagcccagagccgccctgctggccgagctggccctgctggagcccgaggccctgagagagcactgcagaagagccgccgaggcctgcgccagaccccacggccccccccccgacctggccgccagactgagacccctgccccccgagagagtgggcagagccagcagaagcgaccccgagaccagaagaagatgggaggaggagggcttcagacagatcagcctgaacaaggtggccgtgctgctgctggccggcggccagggcaccagactgggcgtgacctaccccaagggcatgtacagagtgggcctgcccagcagaaagaccctgtaccagctgcaggccgagagaatcagaagagtggagcagctggccggcgagagacacggcaccagatgcaccgtgccctggtacgtgatgaccagcgagttcaccctgggccccaccgccgagttcttcagagagcacaacttcttccacctggaccccgccaacgtggtgatgttcgagcagagactgctgcccgccgtgaccttcgacggcaaggtgatcctggagagaaaggacaaggtggccatggcccccgacggcaacggcggcctgtactgcgccctggaggaccacaagatcctggaggacatggagagaagaggcgtggagttcgtgcacgtgtactgcgtggacaacatcctggtgagactggccgaccccgtgttcatcggcttctgcgtgctgcagggcgccgactgcggcgccaaggtggtggagaaggcctaccccgaggagcccgtgggcgtggtgtgccaggtggacggcgtgccccaggtggtggagtacagcgagatcagccccgagaccgcccagctgagagccagcgacggcagcctgctgtacaacgccggcaacatctgcaaccacttcttcaccagaggcttcctgaaggccgtgaccagagagttcgagcccctgctgaagccccacgtggccgtgaagaaggtgccctacgtggacgaggagggcaacctggtgaagcccctgaagcccaacggcatcaagatggagaagttcgtgttcgacgtgttcagattcgccaagaacttcgccgccctggaggtgctgagagaggaggagttcagccccctgaagaacgccgagcccgccgacagagacagccccagaaccgccagacaggccctgctgacccagcactacagatgggccctgagagccggcgccagattcctggacgcccacggcgcctggctgcccgagctgcccagcctgccccccaacggcgacccccccgccatctgcgagatcagccccctggtgagctacagcggcgagggcctggaggtgtacctgcagggcagagagttccagagccccctgatcctggacgaggaccaggccagagagccccagctgcaggagagctag

SEQ ID NO: 25615 - DNA, 4323 bp, Artificial Sequence
  Description of Artificial Sequence: Synthetic coding sequence
atggccggcatcatcaagaagcagatcctgaagcacctgagcagattcaccaagaacctgagccccgacaagatcaacctgagcaccctgaagggcgagggccagctgaccaacctggagctggacgaggaggtgctgcagaacgtgctggagctgcccacctggctggccatcaccagagtgtactgcaacagagccagcatcagaatccagtggaccaagctgaagacccaccccatctgcctgtgcctggacaaggtggaggtggagatgaagacctgcgaggaccccagaccccccaacggccagagccccatcgccctggccagcggccagagcgagtacggcttcgccgagaaggtggtggagggcatgttcatcatcgtgaacagcatcaccatcaagatccacagcaaggccttccacgccagcttcgagctgtggcagctgcagggctacagcgtgaaccccaactggcagcagagcgacctgagactgaccagaatcaccgacccctgcagaggcgaggtgctgaccttcaaggagatcacctggcagaccctgagaatcgaggccgacgccaccgacaacggcgaccaggaccccgtgaccacccccctgagactgatcaccaaccagggcagaatccagatcgccctgaagagaagaaccaaggactgcaacgtgatcagcagcaagctgatgttcctgctggacgacctgctgtgggtgctgaccgacagccagctgaaggccatgatgaagtacgccgagagcctgagcgaggccatggagaagagcgcccaccagagaaagagcctggcccccgagcccgtgcagatcaccccccccgcccccagcgcccagcagagctgggcccaggccttcggcggcagccagggcaacagcaacagcagcagcagcagactgagccagtacttcgagaagttcgacgtgaaggagagcagctaccacctgctgatcagcagactggacctgcacatctgcgacgacagccagagcagagagcccggcgtgagcgccaacagactgatgggcggcgccatgcagctgaccttcagaaagatggccttcgactactaccccttccactgggccggcgacagctgcaagcactgggtgagacactgcgaggccatggagaccagaggccagtgggcccagaagctggtgatggagttccagagcaagatggagaagtggcacgaggagaccggcctgaagcccccctggcacctgggcgtggacagcctgttcagaagaaaggccgacagcctgagcagccccagaaagaaccccctggagagaagccccagccagggcagacagcccgccttccagccccccgcctggaacagactgagaagcagctgcatggtggtgagagtggacgacctggacatccaccaggtgagcaccgccggccagcccagcaagaagcccagcaccctgctgagctgcagcagaaagctgcacaacctgcccacccaggtgagcgccatccacatcgagttcaccgagtactacttccccgacaaccaggagctgcccgtgccctgccccaacctgtacatccagctgaacggcctgaccttcaccatggaccccgtgagcctgctgtggggcaacctgttctgcctggacctgtacagaagcctggagcagttcaaggccatctacaagctggaggacagcagccagaaggacgagcacctggacatcagactggacgccttctggctgaaggtgagcttccccctggagaagagagagagagccgagctgcacagaccccaggccctggtgttcagcgccagcggcatgatcgccaccaacaccagacacgccccccactgcagctgcagcgacctgcagagcctgttcagaggcttcgccgccgccgagttcttccacagcaactacgaccacttccccaaggtgcccggcggcttcagcctgctgcacatgctgttcctgcaccacgccttccagatggacagctgcctgccccagcccaacaccctgcccccccagagacccaaggccagctgggacctgtggagcgtgcacttcacccagatcagcctggacttcgagggcaccgagaacttcaagggccacaccctgaacttcgtggcccccttccccctgagcatctgggcctgcctgcccctgagatggcagcaggcccaggccagaaagctgctgctggccagcgagggcagactgaagcccagcgccagcttcggcagccccgtgcagagcgaggccctggcccccgacagcatgagccaccccagaagcaagaccgagcacgacctgaagagcctgagcggcctgaccgaggtgatggagatcctgaaggagggcagcagcggcatggacaacaagggccccctgaccgagctggaggacgtggccgacgtgcacatgctggtgcacagccccgcccacgtgagagtgagactggaccactaccagtacctggccctgctgagactgaaggaggtgctgcagagactgcaggagcagctgaccaaggacaccgagagcatgaccggcagccccctgcagaaccagaccgcctgcatcggcgtgctgttccccagcgccgaggtggccctgctgatgcaccccgcccccggcgccgtggacgccgacagcgccggcagcgacagcaccagcctggtggacagcgagctgagccccagcgaggacagagagctgaagagcgacgccagcagcgaccagggccccgccagccccgagaaggtgctggaggagagcagcatcgagaaccaggacgtgagccaggagagaccccacagcaacggcgagctgcaggacagcggccccctggcccagcagctggccggcaagggccacgaggccgtggagagcctgcaggccaagaagctgagcagaacccaggccagcagcagccccgccgccctgaagccccccgccggcagagagaccgccgtgaacggccagggcgagctgatccccctgaagaacatcgagggcgagctgagcagcgccatccacatgaccaaggacgccaccaaggaggccctgcacgccaccatggacctgaccaaggaggccgtgagcctgaccaaggacgccttcagcctgggcagagacagaatgaccagcaccatgcacaagatgctgagcctgccccccgccaaggagcccatggccaagaccgacgagggcgtggccgcccccgtgagcggcggcgccgccagactgagattcttcagcatgaagagaaccgtgagccagcagagcttcgacggcgtgagcctggacagcagcggccccgaggacagaatcagcgtggacagcgacggcagcgacagcttcgtgatgctgctggagagcgagagcggccccgagagcgtgccccccggcagcctgagcaacgtgagcgacaacgccggcgtgcagggcagccccctggtgaacaactacggccagggcagccccgccgccaacagcagcgtgagccccagcggcgaggacctgatcttccaccccgtgagcgtgctggtgctgaaggtgaacgaggtgagcttcggcatcgaggtgagaggcgaggacctgaccgtggccctgcaggccgaggagctgaccctgcagcagctgggcaccgtgggcctgtggcagttcctgcacggccagtgccccggcacctgcttccaggagagcagcaccctgaagaccggccacatcagacccgccgtgggcctgagattcgaggtgggccccggcgccgccgtgcacagccccctggccagccagaacggcttcctgcacctgctgctgcacggctgcgacctggagctgctgaccagcgtgctgagcggcctgggccccttcctggaggacgaggagatccccgtggtggtgcccatgcagatcgagctgctgaacagcagcatcaccctgaaggacgacatcccccccatctaccccaccagccccggccccatccccatcaccctggccatggagcacgtggtgctgaagagaagcgacgacggcgtgttccacatcggcgccgccgcccaggacaagcccagcgccgaggtgctgaagagcgagaagagacagccccccaaggagcaggtgttcctggtgcccaccggcgaggtgttcgagcagcaggtgaaggagctgcccatcctgcagaaggagctgatcgagaccaagcaggccctggccaacgccaaccaggacaaggagaagctgctgcaggagatcagaaagtacaaccccttcttcgagctgtag

SEQ ID NO: 25616 - DNA, 4203 bp, Artificial Sequence
  Description of Artificial Sequence: Synthetic coding sequence
atggccggcatcatcaagaagcagatcctgaagcacctgagcagattcaccaagaacctgagccccgacaagatcaacctgagcaccctgaagggcgagggccagctgaccaacctggagctggacgaggaggtgctgcagaacgtgctggagctgcccacctggctggccatcaccagagtgtactgcaacagagccagcatcagaatccagtggaccaagctgaagacccaccccatctgcctgtgcctggacaaggtggaggtggagatgaagacctgcgaggaccccagaccccccaacggccagagccccatcgccctggccagcggccagagcgagtacggcttcgccgagaaggtggtggagggcatgttcatcatcgtgaacagcatcaccatcaagatccacagcaaggccttccacgccagcttcgagctgtggcagctgcagggctacagcgtgaaccccaactggcagcagagcgacctgagactgaccagaatcaccgacccctgcagaggcgaggtgctgaccttcaaggagatcacctggcagaccctgagaatcgaggccgacgccaccgacaacggcgaccaggaccccgtgaccacccccctgagactgatcaccaaccagggcagaatccagatcgccctgaagagaagaaccaaggactgcaacgtgatcagcagcaagctgatgttcctgctggacgacctgctgtgggtgctgaccgacagccagctgaaggccatgatgaagtacgccgagagcctgagcgaggccatggagaagagcgcccaccagagaaagagcctggcccccgagcccgtgcagatcaccccccccgcccccagcgcccagcagagctgggcccaggccttcggcggcagccagggcaacagcaacagcagcagcagcagactgagccagtacttcgagaagttcgacgtgaaggagagcagctaccacctgctgatcagcagactggacctgcacatctgcgacgacagccagagcagagagcccggcgtgagcgccaacagactgatgggcggcgccatgcagctgaccttcagaaagatggccttcgactactaccccttccactgggccggcgacagctgcaagcactgggtgagacactgcgaggccatggagaccagaggccagtgggcccagaagctggtgatggagttccagagcaagatggagaagtggcacgaggagaccggcctgaagcccccctggcacctgggcgtggacagcctgttcagaagaaaggccgacagcctgagcagccccagaaagaaccccctggagagaagccccagccagggcagacagcccgccttccagccccccgcctggaacagactgagaagcagctgcatggtggtgagagtggacgacctggacatccaccaggtgagcaccgccggccagcccagcaagaagcccagcaccctgctgagctgcagcagaaagctgcacaacctgcccacccaggtgagcgccatccacatcgagttcaccgagtactacttccccgacaaccaggagctgcccgtgccctgccccaacctgtacatccagctgaacggcctgaccttcaccatggaccccgtgagcctgctgtggggcaacctgttctgcctggacctgtacagaagcctggagcagttcaaggccatctacaagctggaggacagcagccagaaggacgagcacctggacatcagactggacgccttctggctgaaggtgagcttccccctggagaagagagagagagccgagctgcacagaccccaggccctggtgttcagcgccagcggcatgatcgccaccaacaccagacacgccccccactgcagctgcagcgacctgcagagcctgttcagaggcttcgccgccgccgagttcttccacagcaactacgaccacttccccaaggtgcccggcggcttcagcctgctgcacatgctgttcctgcaccacgccttccagatggacagctgcctgccccagcccaacaccctgcccccccagagacccaaggccagctgggacctgtggagcgtgcacttcacccagatcagcctggacttcgagggcaccgagaacttcaagggccacaccctgaacttcgtggcccccttccccctgagcatctgggcctgcctgcccctgagatggcagcaggcccaggccagaaagctgctgctggccagcgagggcagactgaagcccagcgccagcttcggcagccccgtgcagagcgaggccctggcccccgacagcatgagccaccccagaagcaagaccgagcacgacctgaagagcctgagcggcctgaccgaggtgatggagatcctgaaggagggcagcagcggcatggacaacaagggccccctgaccgagctggaggacgtggccgacgtgcacatgctggtgcacagccccgcccacgtgagagtgagactggaccactaccagtacctggccctgctgagactgaaggaggtgctgcagagactgcaggagcagctgaccaaggacaccgagagcatgaccggcagccccctgcagaaccagaccgcctgcatcggcgtgctgttccccagcgccgaggtggccctgctgatgcaccccgcccccggcgccgtggacgccgacagcgccggcagcgacagcaccagcctggtggacagcgagctgagccccagcgaggacagagagctgaagagcgacgccagcagcgaccagggccccgccagccccgagaaggtgctggaggagagcagcatcgagaaccaggacgtgagccaggagagaccccacagcaacggcgagctgcaggacagcggccccctggcccagcagctggccggcaagggccacgaggccgtggagagcctgcaggccaagaagctgagcagaacccaggccagcagcagccccgccgccctgaagccccccgccggcagagagaccgccgtgaacggccagggcgagctgatccccctgaagaacatcgagggcgagctgagcagcgccatccacatgaccaaggacgccaccaaggaggccctgcacgccaccatggacctgaccaaggaggccgtgagcctgaccaaggacgccttcagcctgggcagagacagaatgaccagcaccatgcacaagatgctgagcctgccccccgccaaggagcccatggccaagaccgacgagggcgtggccgcccccgtgagcggcggcgccgccagactgagattcttcagcatgaagagaaccgtgagccagcagagcttcgacggcgtgagcctggacagcagcggccccgaggacagaatcagcgtggacagcgacggcagcgacagcttcgtgatgctgctggagagcgagagcggccccgagagcgtgccccccggcagcctgagcaacgtgagcgacaacgccggcgtgcagggcagccccctggtgaacaactacggccagggcagccccgccgccaacagcagcgtgagccccagcggcgaggacctgatcttccaccccgtgagcgtgctggtgctgaaggtgaacgaggtgagcttcggcatcgaggtgagaggcgaggacctgaccgtggccctgcaggccgaggagctgaccctgcagcagctgggcaccgtgggcctgtggcagttcctgcacggccagtgccccggcacctgcttccaggagagcagcaccctgaagaccggccacatcagacccgccgtgggcctgagattcgaggtgggccccggcgccgccgtgcacagccccctggccagccagaacggcttcctgcacctgctgctgcacggctgcgacctggagctgctgaccagcgtgctgagcggcctgggccccttcctggaggacgaggagatccccgtggtggtgcccatgcagatcgagctgctgaacagcagcatcaccctgaaggacgacatcccccccatctaccccaccagccccggccccatccccatcaccctggccatggagcacgtggtgctgaagagaagcgacgacggcgtgttccacatcggcgccgccgcccaggacaagcccagcgccgaggtgctgaagagcgagaagagacagccccccaaggagcaggtgttcctggtgcccaccggcgaggtgttcgagcagcagacctag

SEQ ID NO: 25617 - DNA, 4395 bp, Artificial Sequence
  Description of Artificial Sequence: Synthetic coding sequence
atggccggcatcatcaagaagcagatcctgaagcacctgagcagattcaccaagaacctgagccccgacaagatcaacctgagcaccctgaagggcgagggcgagctgaagaacctggagctggacgaggaggtgctgcagaacatgctggacctgcccacctggctggccatcaacaaggtgttctgcaacaaggccagcatcagaatcccctggaccaagctgaagacccaccccatctgcctgagcctggacaaggtgatcatggagatgagcacctgcgaggagcccagaagccccaacggccccagccccatcgccaccgccagcggccagagcgagtacggcttcgccgagaaggtggtggagggcatcagcgtgagcgtgaacagcatcgtgatcagaatcggcgccaaggccttcaacgccagcttcgagctgagccagctgagaatctacagcgtgaacgcccactgggagcacggcgacctgagattcaccagaatccaggacccccagagaggcgaggtgctgaccttcaaggagatcaactggcagatgatcagaatcgaggccgacgccacccagagcagccacctggagatcatgtgcgcccccgtgagactgatcaccaaccagagcaagatcagagtgaccctgaagagaagactgaaggactgcaacgtgatcgccaccaagctggtgctgatcctggacgacctgctgtgggtgctgaccgacagccagctgaaggccatggtgcagtacgccaagagcctgagcgaggccatcgagaagagcaccgagcagagaaagagcatggcccccgagcccacccagagcagcaccgtggtggccagcgcccagcaggtgaagaccacccagaccagcaacgcccccgacgtgaacgacgccatcgtgaagctgttcaacgacttcgacgtgaaggagaccagccaccacctggtgatcagccacctggacctgcacatctgcgacgacatccacgccaaggagaaggagagcaacagaagaatcaccggcggcgccatgcagctgagcttcacccagctgaccatcgactactacccctaccacaaggccggcgacagctgcaaccactggatgtacttcagcgacgccaccaagaccaagaacggctgggccaacgagctgctgcacgagttcgagtgcaacgtggagatgctgaagcaggccgtgaaggaccacaacgtgggcagcccccccaagagccccacccacgccagcccccagcacacccagaccgagaaggactaccccctgaagggcacctgcagaacccccagcgtgctgagccagcagagcaaggccaagctgatgagcagcagcgtggtggtgagactggccgacttcaacatctaccaggtgagcaccgccgagcagtgcagaagcagccccaagagcatgatctgctgcaacaagaagagcctgtacctgccccaggagatgagcgccgtgtacatcgagttcaccgagtactactaccccgacggcaaggacttccccatccccagccccaacctgtacagccagctgaacgccctgcagttcaccgtggacgagagaagcatcctgtggctgaaccagttcctgctggacctgaagcagagcctgaaccagttcatggccgtgtacaagctgaacgacaacagcaagagcgacgagcacgtggacgtgagagtggacggcctgatgctgaagttcgtgatccccagcgaggtgaagagcgagtgccaccaggaccagcccagagccatcagcatccagagcagcgagatgatcgccaccaacaccagacactgccccaactgcagacacagcgacctggaggccctgttccaggacttcaaggactgcgacttcttcagcaagacctacaccagcttccccaagagctgcgacaacttcaacctgctgcaccccatcttccagagacacgcccacgagcaggacaccaagatgcacgagatctacaagggcaacatcaccccccagctgaacaagaacaccctgaagaccagcgccgccaccgacgtgtgggccgtgtacttcagccagttctggatcgactacgagggcatgaagagcggcaagggcagacccatcagcttcgtggacagcttccccctgagcatctggatctgccagcccaccagatacgccgagagccagaaggagccccagacctgcaaccaggtgagcctgaacaccagccagagcgagagcagcgacctggccggcagactgaagagaaagaagctgctgaaggagtactacagcaccgagagcgagcccctgaccaacggcggccagaagcccagcagcagcgacaccttcttcagattcagccccagcagcagcgaggccgacatccacctgctggtgcacgtgcacaagcacgtgagcatgcagatcaaccactaccagtacctgctgctgctgttcctgcacgagagcctgatcctgctgagcgagaacctgagaaaggacgtggaggccgtgaccggcagccccgccagccagaccagcatctgcatcggcatcctgctgagaagcgccgagctggccctgctgctgcaccccgtggaccaggccaacaccctgaagagccccgtgagcgagagcgtgagccccgtggtgcccgactacctgcccaccgagaacggcgacttcctgagcagcaagagaaagcagatcagcagagacatcaacagaatcagaagcgtgaccgtgaaccacatgagcgacaacagaagcatgagcgtggacctgagccacatccccctgaaggaccccctgctgttcaagagcgccagcgacaccaacctgcagaagggcatcagcttcatggactacctgagcgacaagcacctgggcaagatcagcgaggacgagagcagcggcctggtgtacaagagcggcagcggcgagatcggcagcgagaccagcgacaagaaggacagcttctacaccgacagcagcagcatcctgaactacagagaggacagcaacatcctgagcttcgacagcgacggcaaccagaacatcctgagcagcaccctgaccagcaagggcaacgagaccatcgagagcatcttcaaggccgaggacctgctgcccgaggccgccagcctgagcgagaacctggacatcagcaaggaggagaccccccccgtgagaaccctgaagagccagagcagcctgagcggcaagcccaaggagagatgcccccccaacctggcccccctgtgcgtgagctacaagaacatgaagagaagcagcagccagatgagcctggacaccatcagcctggacagcatgatcctggaggagcagctgctggagagcgacggcagcgacagccacatgttcctggagaagggcaacaagaagaacagcaccaccaactacagaggcaccgccgagagcgtgaacgccggcgccaacctgcagaactacggcgagaccagccccgacgccatcagcaccaacagcgagggcgcccaggagaaccacgacgacctgatgagcgtggtggtgttcaagatcaccggcgtgaacggcgagatcgacatcagaggcgaggacaccgagatctgcctgcaggtgaaccaggtgacccccgaccagctgggcaacatcagcctgagacactacctgtgcaacagacccgtgggcagcgaccagaaggccgtgatccacagcaagagcagccccgagatcagcctgagattcgagagcggccccggcgccgtgatccacagcctgctggccgagaagaacggcttcctgcagtgccacatcgagaacttcagcaccgagttcctgaccagcagcctgatgaacatccagcacttcctggaggacgagaccgtggccaccgtgatgcccatgaagatccaggtgagcaacaccaagatcaacctgaaggacgacagccccagaagcagcaccgtgagcctggagcccgcccccgtgaccgtgcacatcgaccacctggtggtggagagaagcgacgacggcagcttccacatcagagacagccacatgctgaacaccggcaacgacctgaaggagaacgtgaagagcgacagcgtgctgctgaccagcggcaagtacgacctgaagaagcagagaagcgtgacccaggccacccagaccagccccggcgtgccctggcccagccagagcgccaacttccccgagttcagcttcgacttcaccagagagcagctgatggaggagaacgagagcctgaagcaggagctggccaaggccaagatggccctggccgaggcccacctggagaaggacgccctgctgcaccacatcaagaagatgaccgtggagtag

SEQ ID NO: 25618 - DNA, 1569 bp, Artificial Sequence
  Description of Artificial Sequence: Synthetic coding sequence
atggccggcatcatcaagaagcagatcctgaagcacctgagcagattcaccaagaacctgagccccgacaagatcaacctgagcaccctgaagggcgagggcgagctgaagaacctggagctggacgaggaggtgctgcagaacatgctggacctgcccacctggctggccatcaacaaggtgttctgcaacaaggccagcatcagaatcccctggaccaagctgaagacccaccccatctgcctgagcctggacaaggtgatcatggagatgagcacctgcgaggagcccagaagccccaacggccccagccccatcgccaccgccagcggccagagcgagtacggcttcgccgagaaggtggtggagggcatcagcgtgagcgtgaacagcatcgtgatcagaatcggcgccaaggccttcaacgccagcttcgagctgagccagctgagaatctacagcgtgaacgcccactgggagcacggcgacctgagattcaccagaatccaggacccccagagaggcgaggtgctgaccttcaaggagatcaactggcagatgatcagaatcgaggccgacgccacccagagcagccacctggagatcatgtgcgcccccgtgagactgatcaccaaccagagcaagatcagagtgaccctgaagagaagactgaaggactgcaacgtgatcgccaccaagctggtgctgatcctggacgacctgctgtgggtgctgaccgacagccagctgaaggccatggtgcagtacgccaagagcctgagcgaggccatcgagaagagcaccgagcagagaaagagcatggcccccgagcccacccagagcagcaccgtggtggccagcgcccagcaggtgaagaccacccagaccagcaacgcccccgacgtgaacgacgccatcgtgaagctgttcaacgacttcgacgtgaaggagaccagccaccacctggtgatcagccacctggacctgcacatctgcgacgacatccacgccaaggagaaggagagcaacagaagaatcaccggcggcgccatgcagctgagcttcacccagctgaccatcgactactacccctaccacaaggccggcgacagctgcaaccactggatgtacttcagcgacgccaccaagaccaagaacggctgggccaacgagctgctgcacgagttcgagtgcaacgtggagatgctgaagcaggccgtgaaggaccacaacgtgggcagcccccccaagagccccacccacgccagcccccagcacacccagaccgagaaggactaccccctgaagggcacctgcagaacccccagcgtgctgagccagcagagcaaggccaagctgatgagcagcagcgtggtggtgagactggccgacttcaacatctaccaggtgagcaccgccgagcagtgcagaagcagccccaagagcatgatctgctgcaacaagaagagcctgtacctgccccaggagatgagcgccgtgtacatcgagttcaccgagtactactaccccgacggcaaggacttccccaccgccttcctgagcagatag

SEQ ID NO: 25619 - DNA, 756 bp, Artificial Sequence
  Description of Artificial Sequence: Synthetic coding sequence
atgagcggcagcaaccccaaggccgccgccgccgccagcgccgccggccccggcggcctggtggccggcaaggaggagaagaagaaggccggcggcggcgtgctgaacagactgaaggccagaagacaggccccccaccacgccgccgacgacggcgtgggcgccgccgtgaccgagcaggagctgctggccctggacaccatcagacccgagcacgtgctgagactgagcagagtgaccgagaactacctgtgcaagcccgaggacaacatctacagcatcgacttcaccagattcaagatcagagacctggagaccggcaccgtgctgttcgagatcgccaagccctgcgtgagcgaccaggaggaggacgaggaggagggcggcggcgacgtggacatcagcgccggcagattcgtgagataccagttcacccccgccttcctgagactgagaaccgtgggcgccaccgtggagttcaccgtgggcgacaagcccgtgagcaacttcagaatgatcgagagacactacttcagagagcacctgctgaagaacttcgacttcgacttcggcttctgcatccccagcagcagaaacacctgcgagcacatctacgagttcccccagctgagcgaggacgtgatcagactgatgatcgagaacccctacgagaccagaagcgacagcttctacttcgtggacaacaagctgatcatgcacaacaaggccgactacgcctacaacggcggccagtag

SEQ ID NO: 25620 - DNA, 756 bp, Artificial Sequence; identical to SEQ ID NO: 25619
  Description of Artificial Sequence: Synthetic coding sequence

SEQ ID NO: 25621 - DNA, 3828 bp, Artificial Sequence
  Description of Artificial Sequence: Synthetic coding sequence
atggagaacttcatcctgtacgaggagatcggcagaggcagcaagaccgtggtgtacaagggcagaagaaagggcaccatcaacttcgtggccatcctgtgcaccgacaagtgcaagagacccgagatcaccaactgggtgagactgaccagagagatcaagcacaagaacatcgtgaccttccacgagtggtacgagaccagcaaccacctgtggctggtggtggagctgtgcaccggcggcagcctgaagaccgtgatcgcccaggacgagaacctgcccgaggacgtggtgagagagttcggcatcgacctgatcagcggcctgcaccacctgcacaagctgggcatcctgttctgcgacatcagccccagaaagatcctgctggagggccccggcaccctgaagttcagcaacttctgcctggccaaggtggagggcgagaacctggaggagttcttcgccctggtggccgccgaggagggcggcggcgacaacggcgagaacgtgctgaagaagagcatgaagagcagagtgaagggcagccccgtgtacaccgcccccgaggtggtgagaggcgccgacttcagcatcagcagcgacctgtggagcctgggctgcctgctgtacgagatgttcagcggcaagccccccttcttcagcgagagcatcagcgagctgaccgagaagatcctgtgcgaggaccccctgccccccatccccaaggacagcagcagacccaaggccagcagcgacttcatcaacctgctggacggcctgctgcagagagacccccagaagagactgacctggaccagactgctgcagcacagcttctggaagaaggccttcgccggcgccgaccaggagagcagcgtggaggacctgagcctgagcagaaacaccatggagtgcagcggcccccaggacagcaaggagctgctgcagaacagccagagcagacaggccaagggccacaagagcggccagcccctgggccacagcttcagactggagaaccccaccgagttcagacccaagagcaccctggagggccagctgaacgagagcatgttcctgctgagcagcagacccacccccagaaccagcaccgccgtggaggtgagccccggcgaggacatgacccactgcagcccccagaagaccagccccctgaccaagatcaccagcggccacctgagccagcaggacctggagagccagatgagagagctgatctacaccgacagcgacctggtggtgacccccatcatcgacaaccccaagatcatgaagcagccccccgtgaagttcgacgccaagatcctgcacctgcccacctacagcgtggacaagctgctgttcctgaaggaccaggactggaacgacttcctgcagcaggtgtgcagccagatcgacagcaccgagaagagcatgggcgccagcagagccaagctgaacctgctgtgctacctgtgcgtggtggccggccaccaggaggtggccaccagactgctgcacagccccctgttccagctgctgatccagcacctgagaatcgcccccaactgggacatcagagccaaggtggcccacgtgatcggcctgctggccagccacaccgccgagctgcaggagaacacccccgtggtggaggccatcgtgctgctgaccgagctgatcagagagaacttcagaaacagcaagctgaagcagtgcctgctgcccaccctgggcgagctgatctacctggtggccacccaggaggagaagaagaagaaccccagagagtgctgggccgtgcccctggccgcctacaccgtgctgatgagatgcctgagagagggcgaggagagagtggtgaaccacatggccgccaagatcatcgagaacgtgtgcaccaccttcagcgcccagagccagggcttcatcaccggcgagatcggccccatcctgtggtacctgttcagacacagcaccgccgacagcctgagaatcaccgccgtgagcgccctgtgcagaatcaccagacacagccccaccgccttccagaacgtgatcgagaaggtgggcctgaacagcgtgatcaacagcctggccagcgccatctgcaaggtgcagcagtacatgctgaccctgttcgccgccatgctgagctgcggcatccacctgcagagactgatccaggagaagggcttcgtgagcaccatcatcagactgctggacagccccagcacctgcatcagagccaaggccttcctggtgctgctgtacatcctgatctacaacagagagatgctgctgctgagctgccaggccagactggtgatgtacatcgagagagacagcagaaagaccacccccggcaaggagcagcagagcggcaacgagtacctgagcaagtgcctggacctgctgatctgccacatcgtgcaggagctgcccagaatcctgggcgacatcctgaacagcctggccaacgtgagcggcagaaagcaccccagcaccgtgcaggtgaagcagctgaagctgtgcctgcccctgatgcccgtggtgctgcacctggtgaccagccaggtgttcagaccccaggtggtgaccgaggagttcctgttcagctacggcaccatcctgagccacatcaagagcgtggacagcggcgagaccaacatcgacggcgccatcggcctgaccgccagcgaggagttcatcaagatcaccctgagcgccttcgaggccatcatccagtaccccatcctgctgaaggactacagaagcaccgtggtggactacatcctgccccccctggtgagcctggtgcagagccagaacgtggagtggagactgttcagcctgagactgctgagcgagaccaccagcctgctggtgaaccaggagttcggcgacggcaaggagaaggccagcgtggacagcgacagcaacctgctggccctgatcagagacgtgctgctgccccagtacgagcacatcctgctggagcccgaccccgtgcccgcctacgccctgaagctgctggtggccatgaccgagcacaaccccaccttcaccagactggtggaggagagcaagctgatccccctgatcttcgaggtgaccctggagcaccaggagagcatcctgggcaacaccatgcagagcgtgatcgccctgctgagcaacctggtggcctgcaaggacagcaacatggagctgctgtacgagcagggcctggtgagccacatctgcaacctgctgaccgagaccgccaccctgtgcctggacgtggacaacaagaacaacaacgagatggccgcccccctgctgttcagcctgctggacatcctgcacagcatgctgacctacaccagcggcatcgtgagactggccctgcaggcccagaagagcggcagcggcgaggacccccaggccgccgaggacctgctgctgctgaacagacccctgaccgacctgatcagcctgctgatccccctgctgcccaacgaggaccccgagatcttcgacgtgagcagcaagtgcctgagcatcctggtgcagctgtacggcggcgagaaccccgacagcctgagccccgagaacgtggagatcttcgcccacctgctgaccagcaaggaggaccccaaggagcagaagctgctgctgagaatcctgagaagaatgatcaccagcaacgagaagcacctggagagcctgaagaacgccggcagcctgctgagagccctggagagactggcccccggcagcggcagcttcgccgacagcgccgtggcccccctggccctggagatcctgcaggccgtgggccactag

SEQ ID NO: 25622 - DNA, 210 bp, Artificial Sequence
  Description of Artificial Sequence: Synthetic coding sequence
atgcagaagtactgcatctaccagcacttccagttccagctgctgatccagcacctgtggatcgccgccaactgcgacatctgggccaaggtggccagagtgatcggcctgctggccagccacaagaccgacctgcaggagaacacccccgtggtggaggccttccccaacagccccagaacccccaccctgcccggcgtgctgacctag

SEQ ID NO: 25623 - DNA, 210 bp, Artificial Sequence; identical to SEQ ID NO: 25622
  Description of Artificial Sequence: Synthetic coding sequence

SEQ ID NO: 25624 - DNA, 7377 bp, Artificial Sequence
  Description of Artificial Sequence: Synthetic coding sequence
atgatcagcaccctggccaccttcccccccttcctgcacaaggacatcatcgagtacctgagcaccagcttcctgcccatggccatcctgggcagcagcagaagagagggcgtgcccgcccacgtgaacctgagcgccagcagcatgctgatgatcgccatgcagtacaccagcaaccccgtgtaccactgccagctgctggagtgcctgatgaagtacaagcaggaggtgtggaaggacctgctgtacgtgatcgcctacggccccagccaggtgaagccccccgccgtgcagatgctgttccactactggcccaacctgaagccccccggcgccatcagcgagtacagaggcctgcagtacaccgcctggaaccccatccactgccagcacatcgagtgccacaacgccatcaacaagcccgccgtgaagatgtgcatcgaccccagcctgagcgtggccctgggcgacaagcccccccccctgtacctgtgcgaggagtgcagcgagagaatcgccggcgaccacagcgagtggctgatcgacgtgctgctgccccaggccgagatcagcgccatctgccagaagaagaactgcagcagccacgtgagaagagccgtggtgacctgcttcagcgccggctgctgcggcagacacggcaacagacccgtgagatactgcaagagatgccacagcaaccaccacagcaacgaggtgggcgccgccgccgagacccacctgtaccagaccagccccccccccatcaacaccagagagtgcggcgccgaggagctggtgtgcgccgtggaggccgtgatcagcctgctgaaggaggccgagttccacgccgagcagagagagcacgagctgaacagaagaagacagctgggcctgagcagcagccaccacagcctggacaacgccgacttcgacaacaaggacgacgacaagcacgaccagagactgctgagccagttcggcatctggttcctggtgagcctgtgcacccccagcgagaacacccccaccgagagcctggccagactggtggccatggtgttccagtggttccacagcaccgcctacatgatggacgacgaggtgggcagcctggtggagaagctgaagccccagttcgtgaccaagtggctgaagaccgtgtgcgacgtgagattcgacgtgatggtgatgtgcctgctgcccaagcccatggagttcgccagagtgggcggctactgggacaagagctgcagcaccgtgacccagctgaaggagggcctgaacagaatcctgtgcctgatcccctacaacgtgatcaaccagagcgtgtgggagtgcatcatgcccgagtggctggaggccatcagaaccgaggtgcccgacaaccagctgaaggagttcagagaggtgctgagcaagatgttcgacatcgagctgtgccccctgcccttcagcatggaggagatgttcggcttcatcagctgcagattcaccggctaccccagcagcgtgcaggagcaggccctgctgtggctgcacgtgctgagcgagctggacatcatggtgcccctgcagctgctgatcagcatgttcagcgacggcgtgaacagcgtgaaggagctggccaaccagagaaagagcagagtgagcgagctggccggcaacctggccagcagaagagtgagcgtggccagcgaccccggcagaagagtgcagcacaacatgctgagccccttccacagccccttccagagccccttcagaagccccctgagaagccccttcagaagccccttcaagaacttcggccaccccggcggcagaaccatcgacttcgactgcgaggacgacgagatgaacctgaactgcttcatcctgatgttcgacctgctgctgaagcagatggagctgcaggacgacggcatcaccatgggcctggagcacagcctgagcaaggacatcatcagcatcatcaacaacgtgttccaggccccctggggcggcagccacacctgccagaaggacgagaaggccatcgagtgcaacctgtgccagagcagcatcctgtgctaccagctggcctgcgagctgctggagagactggcccccaaggaggagagcagactggtggagcccaccgacagcctggaggacagcctgctgagcagcagacccgagttcatcatcggccccgagggcgaggaggaggagaaccccgccagcaagcacggcgagaaccccggcaactgcaccgagcccgtggagcacgccgccgtgaagaacgacaccgagagaaagttctgctaccagcagctgcccgtgaccctgagactgatctacaccatcttccaggagatggccaagttcgaggagcccgacatcctgttcaacatgctgaactgcctgaagatcctgtgcctgcacggcgagtgcctgtacatcgccagaaaggaccacccccagttcctggcctacatccaggaccacatgctgatcgccagcctgtggagagtggtgaagagcgagttcagccagctgagcagcctggccgtgcccctgctgctgcacgccctgagcctgccccacggcgccgacatcttctggaccatcatcaacggcaacttcaacagcaaggactggaagatgagattcgaggccgtggagaaggtggccgtgatctgcagattcctggacatccacagcgtgaccaagaaccacctgctgaagtacagcctggcccacgccttctgctgcttcctgaccgccgtggaggacgtgaaccccgccgtggccaccagagccggcctgctgctggacaccatcaagagacccgccctgcagggcctgtgcctgtgcctggacttccagttcgacaccgtggtgaaggacagacccaccatcctgagcaagctgctgctgctgcacttcctgaagcaggacatccccgccctgagctgggagttcttcgtgaacagattcgagaccctgagcctggaggcccagctgcacctggactgcaacaaggagttccccttccccaccaccatcaccgccgtgagaaccaacgtggccaacctgagcgacgccgccctgtggaagatcaagagagccagattcgccagaaacagacagaagagcgtgagaagcctgagagacagcgtgaagggccccgtggagagcaagagagccctgagcctgcccgagaccctgaccagcaagatcagacagcagagccccgagaacgacaacaccatcaaggacctgctgcccgaggacgccggcatcgaccaccagaccgtgcaccagctgatcaccgtgctgatgaagttcatggccaaggacgagagcagcgccgagagcgacatcagcagcgccaaggccttcaacaccgtgaagagacacctgtacgtgctgctgggctacgaccagcaggagggctgcttcatgatcgccccccagaagatgagactgagcacctgcttcaacgccttcatcgccggcatcgcccaggtgatggactacaacatcaacctgggcaagcacctgctgcccctggtggtgcaggtgctgaagtactgcagctgcccccagctgagacactacttccagcagccccccagatgcagcctgtggagcctgaagccccacatcagacagatgtggctgaaggccctgctggtgatcctgtacaagtacccctacagagactgcgacatcagcaagatcctgctgcacctgatccacatcaccgtgaacaccctgaacgcccagtaccacagctgcaagccccacgccaccgccggccccctgtacagcgacaacagcaacatcagcagatacagcgagaaggagaagggcgagatcgagctggccgagtacagagagaccggcgccctgcaggacagcctgctgcactgcgtgagagaggagagcatccccaagaagaagctgagaagcttcaagcagaagagcctggacatcggcaacgccgacagcctgctgttcaccctggacgagcacagaagaaagagctgcatcgacagatgcgacatcgagaagccccccacccaggccgcctacatcgcccagagacccaacgaccccggcagaagcagacagaacagcgccaccagacccgacaacagcgagatccccgagaaccccgccatggagggcttccccgacgccagaagacccgtgatccccgaggtgagactgaactgcatggagaccttcgaggtgaaggtggacagccccgtgaagcccgcccccaaggaggacctggacctgatcgacctgagcagcgacagcaccagcggccccgagaagcacagcatcctgagcaccagcgacagcgacagcctggtgttcgagcccctgccccccctgagaatcgtggagagcgacgaggaggaggagaccatgaaccagggcgacgacggccccagcggcaagaacgccgccagcagccccagcgtgcccagccaccccagcgtgctgagcctgagcaccgcccccctggtgcaggtgagcgtggaggactgcagcaaggacttcagcagcaaggacagcggcaacaaccagagcgccggcaacaccgacagcgccctgatcaccctggaggaccccatggacgccgagggcagcagcaagcccgaggagctgcccgagttcagctgcggcagccccctgaccctgaagcagaagagagacctgctgcagaagagcttcgccctgcccgagatgagcctggacgaccaccccgaccccggcaccgagggcgagaagcccggcgagctgatgcccagcagcggcgccaagaccgtgctgctgaaggtgcccgaggacgccgagaaccccaccgagagcgagaagcccgacaccagcgccgagagcgacaccgagcagaaccccgagagaaaggtggaggaggacggcgccgaggagagcgagttcaagatccagatcgtgcccagacagagaaagcagagaaagatcgccgtgagcgccatccagagagagtacctggacatcagcttcaacatcctggacaagctgggcgagcagaaggaccccgaccccagcaccaagggcctgagcaccctggagatgcccagagagagcagcagcgcccccaccctggacgccggcgtgcccgagaccagcagccacagcagcatcagcacccagtacagacagatgaagagaggcagcctgggcgtgctgaccatgagccagctgatgaagagacagctggagcaccagagcagcgccccccacaacatcagcaactgggacaccgagcagatccagcccggcaagagacagtgcaacgtgcccacctgcctgaaccccgacctggagggccagcccctgagaatgagaggcgccaccaagagcagcctgctgagcgcccccagcatcgtgagcatgttcgtgcccgcccccgaggagttcaccgacgagcagcccaccgtgatgaccgacaagtgccacgactgcggcgccatcctggaggagtacgacgaggagaccctgggcctggccatcgtggtgctgagcaccttcatccacctgagccccgacctggccgcccccctgctgctggacatcatgcagagcgtgggcagactggccagcagcaccaccttcagcaaccaggccgagagcatgatggtgcccggcaacgccgccggcgtggccaagcagttcctgagatgcatcttccaccagctggcccccaacggcatcttcccccagctgttccagagcaccatcaaggacggcaccttcctgagaaccctggccagcagcctgatggacttcaacgagctgagcagcatcgccgccctgagccagctgctggagggcctgaacaacaagaagaacctgcccgccggcggcgccatgatcagatgcctggagaacatcgccaccttcatggaggccctgcccatggacagccccagcagcctgtggaccaccatcagcaaccagttccagaccttcttcgccaagctgccctgcgtgctgcccctgaagtgcagcctggacagcagcctgagaatcatgatctgcctgctgaagatccccagcaccaacgccaccagaagcctgctggagcccttcagcaagctgctgagcttcgtgatccagaacgccgtgttcaccctggcctacctggtggagctgtgcggcctgtgctacagagccttcaccaaggagagagacaagttctacctgagcagaagcgtggtgctggagctgctgcaggccctgaagctgaagagccccctgcccgacaccaacctgctgctgctggtgcagttcatctgcgccgacgccggcaccaagctggccgagagcaccatcctgagcaagcagatgatcgccagcgtgcccggctgcggcaccgccgccatggagtgcgtgagacagtacatcaacgaggtgctggacttcatggccgacatgcacaccctgaccaagctgaagagccacatgaagacctgcagccagcccctgcacgaggacaccttcggcggccacctgaaggtgggcctggcccagatcgccgccatggacatcagcagaggcaaccacagagacaacaaggccgtgatcagatacctgccctggctgtaccacccccccagcgccatgcagcagggccccaaggagttcatcgagtgcgtgagccacatcagactgctgagctggctgctgctgggcagcctgacccacaacgccgtgtgccccaacgccagcagcccctgcctgcccatccccctggacgccggcagccacgtggccgaccacctgatcgtgatcctgatcggcttccccgagcagagcaagaccagcgtgctgcacatgtgcagcctgttccacgccttcatcttcgcccagctgtggaccgtgtactgcgagcagagcgccgtggccaccaacctgcagaaccagaacgagttcagcttcaccgccatcctgaccgccctggagttctggagcagagtgacccccagcatcctgcagctgatggcccacaacaaggtgatggtggagatggtgtgcctgcacgtgatcagcctgatggaggccctgcaggagtgcaacagcaccatcttcgtgaagctgatccccatgtggctgcccatgatccagagcaacatcaagcacctgagcgccggcctgcagctgagactgcaggccatccagaaccacgtgaaccaccacagcctgagaaccctgcccggcagcggccagagcagcgccggcctggccgccctgagaaagtggctgcagtgcacccagttcaagatggcccaggtggagatccagagcagcgaggccgccagccagttctaccccctgtag

SEQ ID NO: 25625 - DNA, 7908 bp, Artificial Sequence
  Description of Artificial Sequence: Synthetic coding sequence
atgagcaccaaggccgagcagttcgccagcaagatcagatacctgcaggagtaccacaacagagtgctgcacaacatctaccccgtgcccagcggcaccgacatcgccaacaccctgaagtacttcagccagaccctgctgagcatcctgagcagaaccggcaagaaggagaaccaggacgccagcaacctgaccgtgcccatgaccatgtgcctgttccccgtgcccttccccctgacccccagcctgagaccccaggtgagcagcatcaaccccaccgtgaccagaagcctgctgtacagcgtgctgagagacgcccccagcgagagaggcccccagagcagagacgcccagctgagcgactaccccagcctggactaccagggcctgtacgtgaccctggtgaccctgctggacctggtgcccctgctgcagcacggccagcacgacctgggccagagcatcttctacaccaccacctgcctgctgcccttcctgaacgacgacatcctgagcaccctgccctacaccatgatcagcaccctggccaccttcccccccttcctgcacaaggacatcatcgagtacctgagcaccagcttcctgcccatggccatcctgggcagcagcagaagagagggcgtgcccgcccacgtgaacctgagcgccagcagcatgctgatgatcgccatgcagtacaccagcaaccccgtgtaccactgccagctgctggagtgcctgatgaagtacaagcaggaggtgtggaaggacctgctgtacgtgatcgcctacggccccagccaggtgaagccccccgccgtgcagatgctgttccactactggcccaacctgaagccccccggcgccatcagcgagtacagaggcctgcagtacaccgcctggaaccccatccactgccagcacatcgagtgccacaacgccatcaacaagcccgccgtgaagatgtgcatcgaccccagcctgagcgtggccctgggcgacaagcccccccccctgtacctgtgcgaggagtgcagcgagagaatcgccggcgaccacagcgagtggctgatcgacgtgctgctgccccaggccgagatcagcgccatctgccagaagaagaactgcagcagccacgtgagaagagccgtggtgacctgcttcagcgccggctgctgcggcagacacggcaacagacccgtgagatactgcaagagatgccacagcaaccaccacagcaacgaggtgggcgccgccgccgagacccacctgtaccagaccagccccccccccatcaacaccagagagtgcggcgccgaggagctggtgtgcgccgtggaggccgtgatcagcctgctgaaggaggccgagttccacgccgagcagagagagcacgagctgaacagaagaagacagctgggcctgagcagcagccaccacagcctggacaacgccgacttcgacaacaaggacgacgacaagcacgaccagagactgctgagccagttcggcatctggttcctggtgagcctgtgcacccccagcgagaacacccccaccgagagcctggccagactggtggccatggtgttccagtggttccacagcaccgcctacatgatggacgacgaggtgggcagcctggtggagaagctgaagccccagttcgtgaccaagtggctgaagaccgtgtgcgacgtgagattcgacgtgatggtgatgtgcctgctgcccaagcccatggagttcgccagagtgggcggctactgggacaagagctgcagcaccgtgacccagctgaaggagggcctgaacagaatcctgtgcctgatcccctacaacgtgatcaaccagagcgtgtgggagtgcatcatgcccgagtggctggaggccatcagaaccgaggtgcccgacaaccagctgaaggagttcagagaggtgctgagcaagatgttcgacatcgagctgtgccccctgcccttcagcatggaggagatgttcggcttcatcagctgcagattcaccggctaccccagcagcgtgcaggagcaggccctgctgtggctgcacgtgctgagcgagctggacatcatggtgcccctgcagctgctgatcagcatgttcagcgacggcgtgaacagcgtgaaggagctggccaaccagagaaagagcagagtgagcgagctggccggcaacctggccagcagaagagtgagcgtggccagcgaccccggcagaagagtgcagcacaacatgctgagccccttccacagccccttccagagccccttcagaagccccctgagaagccccttcagaagccccttcaagaacttcggccaccccggcggcagaaccatcgacttcgactgcgaggacgacgagatgaacctgaactgcttcatcctgatgttcgacctgctgctgaagcagatggagctgcaggacgacggcatcaccatgggcctggagcacagcctgagcaaggacatcatcagcatcatcaacaacgtgttccaggccccctggggcggcagccacacctgccagaaggacgagaaggccatcgagtgcaacctgtgccagagcagcatcctgtgctaccagctggcctgcgagctgctggagagactggcccccaaggaggagagcagactggtggagcccaccgacagcctggaggacagcctgctgagcagcagacccgagttcatcatcggccccgagggcgaggaggaggagaaccccgccagcaagcacggcgagaaccccggcaactgcaccgagcccgtggagcacgccgccgtgaagaacgacaccgagagaaagttctgctaccagcagctgcccgtgaccctgagactgatctacaccatcttccaggagatggccaagttcgaggagcccgacatcctgttcaacatgctgaactgcctgaagatcctgtgcctgcacggcgagtgcctgtacatcgccagaaaggaccacccccagttcctggcctacatccaggaccacatgctgatcgccagcctgtggagagtggtgaagagcgagttcagccagctgagcagcctggccgtgcccctgctgctgcacgccctgagcctgccccacggcgccgacatcttctggaccatcatcaacggcaacttcaacagcaaggactggaagatgagattcgaggccgtggagaaggtggccgtgatctgcagattcctggacatccacagcgtgaccaagaaccacctgctgaagtacagcctggcccacgccttctgctgcttcctgaccgccgtggaggacgtgaaccccgccgtggccaccagagccggcctgctgctggacaccatcaagagacccgccctgcagggcctgtgcctgtgcctggacttccagttcgacaccgtggtgaaggacagacccaccatcctgagcaagctgctgctgctgcacttcctgaagcaggacatccccgccctgagctgggagttcttcgtgaacagattcgagaccctgagcctggaggcccagctgcacctggactgcaacaaggagttccccttccccaccaccatcaccgccgtgagaaccaacgtggccaacctgagcgacgccgccctgtggaagatcaagagagccagattcgccagaaacagacagaagagcgtgagaagcctgagagacagcgtgaagggccccgtggagagcaagagagccctgagcctgcccgagaccctgaccagcaagatcagacagcagagccccgagaacgacaacaccatcaaggacctgctgcccgaggacgccggcatcgaccaccagaccgtgcaccagctgatcaccgtgctgatgaagttcatggccaaggacgagagcagcgccgagagcgacatcagcagcgccaaggccttcaacaccgtgaagagacacctgtacgtgctgctgggctacgaccagcaggagggctgcttcatgatcgccccccagaagatgagactgagcacctgcttcaacgccttcatcgccggcatcgcccaggtgatggactacaacatcaacctgggcaagcacctgctgcccctggtggtgcaggtgctgaagtactgcagctgcccccagctgagacactacttccagcagccccccagatgcagcctgtggagcctgaagccccacatcagacagatgtggctgaaggccctgctggtgatcctgtacaagtacccctacagagactgcgacatcagcaagatcctgctgcacctgatccacatcaccgtgaacaccctgaacgcccagtaccacagctgcaagccccacgccaccgccggccccctgtacagcgacaacagcaacatcagcagatacagcgagaaggagaagggcgagatcgagctggccgagtacagagagaccggcgccctgcaggacagcctgctgcactgcgtgagagaggagagcatccccaagaagaagctgagaagcttcaagcagaagagcctggacatcggcaacgccgacagcctgctgttcaccctggacgagcacagaagaaagagctgcatcgacagatgcgacatcgagaagccccccacccaggccgcctacatcgcccagagacccaacgaccccggcagaagcagacagaacagcgccaccagacccgacaacagcgagatccccgagaaccccgccatggagggcttccccgacgccagaagacccgtgatccccgaggtgagactgaactgcatggagaccttcgaggtgaaggtggacagccccgtgaagcccgcccccaaggaggacctggacctgatcgacctgagcagcgacagcaccagcggccccgagaagcacagcatcctgagcaccagcgacagcgacagcctggtgttcgagcccctgccccccctgagaatcgtggagagcgacgaggaggaggagaccatgaaccagggcgacgacggccccagcggcaagaacgccgccagcagccccagcgtgcccagccaccccagcgtgctgagcctgagcaccgcccccctggtgcaggtgagcgtggaggactgcagcaaggacttcagcagcaaggacagcggcaacaaccagagcgccggcaacaccgacagcgccctgatcaccctggaggaccccatggacgccgagggcagcagcaagcccgaggagctgcccgagttcagctgcggcagccccctgaccctgaagcagaagagagacctgctgcagaagagcttcgccctgcccgagatgagcctggacgaccaccccgaccccggcaccgagggcgagaagcccggcgagctgatgcccagcagcggcgccaagaccgtgctgctgaaggtgcccgaggacgccgagaaccccaccgagagcgagaagcccgacaccagcgccgagagcgacaccgagcagaaccccgagagaaaggtggaggaggacggcgccgaggagagcgagttcaagatccagatcgtgcccagacagagaaagcagagaaagatcgccgtgagcgccatccagagagagtacctggacatcagcttcaacatcctggacaagctgggcgagcagaaggaccccgaccccagcaccaagggcctgagcaccctggagatgcccagagagagcagcagcgcccccaccctggacgccggcgtgcccgagaccagcagccacagcagcatcagcacccagtacagacagatgaagagaggcagcctgggcgtgctgaccatgagccagctgatgaagagacagctggagcaccagagcagcgccccccacaacatcagcaactgggacaccgagcagatccagcccggcaagagacagtgcaacgtgcccacctgcctgaaccccgacctggagggccagcccctgagaatgagaggcgccaccaagagcagcctgctgagcgcccccagcatcgtgagcatgttcgtgcccgcccccgaggagttcaccgacgagcagcccaccgtgatgaccgacaagtgccacgactgcggcgccatcctggaggagtacgacgaggagaccctgggcctggccatcgtggtgctgagcaccttcatccacctgagccccgacctggccgcccccctgctgctggacatcatgcagagcgtgggcagactggccagcagcaccaccttcagcaaccaggccgagagcatgatggtgcccggcaacgccgccggcgtggccaagcagttcctgagatgcatcttccaccagctggcccccaacggcatcttcccccagctgttccagagcaccatcaaggacggcaccttcctgagaaccctggccagcagcctgatggacttcaacgagctgagcagcatcgccgccctgagccagctgctggagggcctgaacaacaagaagaacctgcccgccggcggcgccatgatcagatgcctggagaacatcgccaccttcatggaggccctgcccatggacagccccagcagcctgtggaccaccatcagcaaccagttccagaccttcttcgccaagctgccctgcgtgctgcccctgaagtgcagcctggacagcagcctgagaatcatgatctgcctgctgaagatccccagcaccaacgccaccagaagcctgctggagcccttcagcaagctgctgagcttcgtgatccagaacgccgtgttcaccctggcctacctggtggagctgtgcggcctgtgctacagagccttcaccaaggagagagacaagttctacctgagcagaagcgtggtgctggagctgctgcaggccctgaagctgaagagccccctgcccgacaccaacctgctgctgctggtgcagttcatctgcgccgacgccggcaccaagctggccgagagcaccatcctgagcaagcagatgatcgccagcgtgcccggctgcggcaccgccgccatggagtgcgtgagacagtacatcaacgaggtgctggacttcatggccgacatgcacaccctgaccaagctgaagagccacatgaagacctgcagccagcccctgcacgaggacaccttcggcggccacctgaaggtgggcctggcccagatcgccgccatggacatcagcagaggcaaccacagagacaacaaggccgtgatcagatacctgccctggctgtaccacccccccagcgccatgcagcagggccccaaggagttcatcgagtgcgtgagccacatcagactgctgagctggctgctgctgggcagcctgacccacaacgccgtgtgccccaacgccagcagcccctgcctgcccatccccctggacgccggcagccacgtggccgaccacctgatcgtgatcctgatcggcttccccgagcagagcaagaccagcgtgctgcacatgtgcagcctgttccacgccttcatcttcgcccagctgtggaccgtgtactgcgagcagagcgccgtggccaccaacctgcagaaccagaacgagttcagcttcaccgccatcctgaccgccctggagttctggagcagagtgacccccagcatcctgcagctgatggcccacaacaaggtgatggtggagatggtgtgcctgcacgtgatcagcctgatggaggccctgcaggagtgcaacagcaccatcttcgtgaagctgatccccatgtggctgcccatgatccagagcaacatcaagcacctgagcgccggcctgcagctgagactgcaggccatccagaaccacgtgaaccaccacagcctgagaaccctgcccggcagcggccagagcagcgccggcctggccgccctgagaaagtggctgcagtgcacccagttcaagatggcccaggtggagatccagagcagcgaggccgccagccagttctaccccctgtag

SEQ ID NO: 25626 - DNA, 7974 bp, Artificial Sequence
  Description of Artificial Sequence: Synthetic coding sequence
atgaacagcaagagacacaagatcgccagcaagatcagatacctgcaggagtaccacaacagagtgctgcacaacatctaccccgtgcccagcggcaccgacatcgccaacaccctgaagtacttcagccagaccctgctgagcatcctgagcagaaccggcaagaaggagaaccaggacgccagcaacctgaccgtgcccatgaccatgtgcctgttccccgtgcccttccccctgacccccagcctgagaccccaggtgagcagcatcaaccccaccgtgaccagaagcctgctgtacagcgtgctgagagacgcccccagcgagagaggcccccagagcagagacgcccagctgagcgactaccccagcctggactaccagggcctgtacgtgaccctggtgaccctgctggacctggtgcccctgctgcagcacggccagcacgacctgggccagagcatcttctacaccaccacctgcctgctgcccttcctgaacgacgacatcctgagcaccctgccctacaccatgatcagcaccctggccaccttcccccccttcctgcacaaggacatcatcgagtacctgagcaccagcttcctgcccatggccatcctgggcagcagcagaagagagggcgtgcccgcccacgtgaacctgagcgccagcagcatgctgatgatcgccatgcagtacaccagcaaccccgtgtaccactgccagctgctggagtgcctgatgaagtacaagcaggaggtgtggaaggacctgctgtacgtgatcgcctacggccccagccaggtgaagccccccgccgtgcagatgctgttccactactggcccaacctgaagccccccggcgccatcagcgagtacagaggcctgcagtacaccgcctggaaccccatccactgccagcacatcgagtgccacaacgccatcaacaagcccgccgtgaagatgtgcatcgaccccagcctgagcgtggccctgggcgacaagcccccccccctgtacctgtgcgaggagtgcagcgagagaatcgccggcgaccacagcgagtggctgatcgacgtgctgctgccccaggccgagatcagcgccatctgccagaagaagaactgcagcagccacgtgagaagagccgtggtgacctgcttcagcgccggctgctgcggcagacacggcaacagacccgtgagatactgcaagagatgccacagcaaccaccacagcaacgaggtgggcgccgccgccgagacccacctgtaccagaccagccccccccccatcaacaccagagagtgcggcgccgaggagctggtgtgcgccgtggaggccgtgatcagcctgctgaaggaggccgagttccacgccgagcagagagagcacgagctgaacagaagaagacagctgggcctgagcagcagccaccacagcctggacaacgccgacttcgacaacaaggacgacgacaagcacgaccagagactgctgagccagttcggcatctggttcctggtgagcctgtgcacccccagcgagaacacccccaccgagagcctggccagactggtggccatggtgttccagtggttccacagcaccgcctacatgatggacgacgaggtgggcagcctggtggagaagctgaagccccagttcgtgaccaagtggctgaagaccgtgtgcgacgtgagattcgacgtgatggtgatgtgcctgctgcccaagcccatggagttcgccagagtgggcggctactgggacaagagctgcagcaccgtgacccagctgaaggagggcctgaacagaatcctgtgcctgatcccctacaacgtgatcaaccagagcgtgtgggagtgcatcatgcccgagtggctggaggccatcagaaccgaggtgcccgacaaccagctgaaggagttcagagaggtgctgagcaagatgttcgacatcgagctgtgccccctgcccttcagcatggaggagatgttcggcttcatcagctgcagattcaccggctaccccagcagcgtgcaggagcaggccctgctgtggctgcacgtgctgagcgagctggacatcatggtgcccctgcagctgctgatcagcatgttcagcgacggcgtgaacagcgtgaaggagctggccaaccagagaaagagcagagtgagcgagctggccggcaacctggccagcagaagagtgagcgtggccagcgaccccggcagaagagtgcagcacaacatgctgagccccttccacagccccttccagagccccttcagaagccccctgagaagccccttcagaagccccttcaagaacttcggccaccccggcggcagaaccatcgacttcgactgcgaggacgacgagatgaacctgaactgcttcatcctgatgttcgacctgctgctgaagcagatggagctgcaggacgacggcatcaccatgggcctggagcacagcctgagcaaggacatcatcagcatcatcaacaacgtgttccaggccccctggggcggcagccacacctgccagaaggacgagaaggccatcgagtgcaacctgtgccagagcagcatcctgtgctaccagctggcctgcgagctgctggagagactggcccccaaggaggagagcagactggtggagcccaccgacagcctggaggacagcctgctgagcagcagacccgagttcatcatcggccccgagggcgaggaggaggagaaccccgccagcaagcacggcgagaaccccggcaactgcaccgagcccgtggagcacgccgccgtgaagaacgacaccgagagaaagttctgctaccagcagctgcccgtgaccctgagactgatctacaccatcttccaggagatggccaagttcgaggagcccgacatcctgttcaacatgctgaactgcctgaagatcctgtgcctgcacggcgagtgcctgtacatcgccagaaaggaccacccccagttcctggcctacatccaggaccacatgctgatcgccagcctgtggagagtggtgaagagcgagttcagccagctgagcagcctggccgtgcccctgctgctgcacgccctgagcctgccccacggcgccgacatcttctggaccatcatcaacggcaacttcaacagcaaggactggaagatgagattcgaggccgtggagaaggtggccgtgatctgcagattcctggacatccacagcgtgaccaagaaccacctgctgaagtacagcctggcccacgccttctgctgcttcctgaccgccgtggaggacgtgaaccccgccgtggccaccagagccggcctgctgctggacaccatcaagagacccgccctgcagggcctgtgcctgtgcctggacttccagttcgacaccgtggtgaaggacagacccaccatcctgagcaagctgctgctgctgcacttcctgaagcaggacatccccgccctgagctgggagttcttcgtgaacagattcgagaccctgagcctggaggcccagctgcacctggactgcaacaaggagttccccttccccaccaccatcaccgccgtgagaaccaacgtggccaacctgagcgacgccgccctgtggaagatcaagagagccagattcgccagaaacagacagaagagcgtgagaagcctgagagacagcgtgaagggccccgtggagagcaagagagccctgagcctgcccgagaccctgaccagcaagatccccatgagactgaccagacacgagcagagcgcccccgccctgggcggcacccccgagcagacccccggccagcagagccccgagaacgacaacaccatcaaggacctgctgcccgaggacgccggcatcgaccaccagaccgtgcaccagctgatcaccgtgctgatgaagttcatggccaaggacgagagcagcgccgagagcgacatcagcagcgccaaggccttcaacaccgtgaagagacacctgtacgtgctgctgggctacgaccagcaggagggctgcttcatgatcgccccccagaagatgagactgagcacctgcttcaacgccttcatcgccggcatcgcccaggtgatggactacaacatcaacctgggcaagcacctgctgcccctggtggtgcaggtgctgaagtactgcagctgcccccagctgagacactacttccagcagccccccagatgcagcctgtggagcctgaagccccacatcagacagatgtggctgaaggccctgctggtgatcctgtacaagtacccctacagagactgcgacatcagcaagatcctgctgcacctgatccacatcaccgtgaacaccctgaacgcccagtaccacagctgcaagccccacgccaccgccggccccctgtacagcgacaacagcaacatcagcagatacagcgagaaggagaagggcgagatcgagctggccgagtacagagagaccggcgccctgcaggacagcctgctgcactgcgtgagagaggagagcatccccaagaagaagctgagaagcttcaagcagaagagcctggacatcggcaacgccgacagcctgctgttcaccctggacgagcacagaagaaagagctgcatcgacagatgcgacatcgagaagccccccacccaggccgcctacatcgcccagagacccaacgaccccggcagaagcagacagaacagcgccaccagacccgacaacagcgagatccccgagaaccccgccatggagggcttccccgacgccagaagacccgtgatccccgaggtgagactgaactgcatggagaccttcgaggtgaaggtggacagccccgtgaagcccgcccccaaggaggacctggacctgatcgacctgagcagcgacagcaccagcggccccgagaagcacagcatcctgagcaccagcgacagcgacagcctggtgttcgagcccctgccccccctgagaatcgtggagagcgacgaggaggaggagaccatgaaccagggcgacgacggccccagcggcaagaacgccgccagcagccccagcgtgcccagccaccccagcgtgctgagcctgagcaccgcccccctggtgcaggtgagcgtggaggactgcagcaaggacttcagcagcaaggacagcggcaacaaccagagcgccggcaacaccgacagcgccctgatcaccctggaggaccccatggacgccgagggcagcagcaagcccgaggagctgcccgagttcagctgcggcagccccctgaccctgaagcagaagagagacctgctgcagaagagcttcgccctgcccgagatgagcctggacgaccaccccgaccccggcaccgagggcgagaagcccggcgagctgatgcccagcagcggcgccaagaccgtgctgctgaaggtgcccgaggacgccgagaaccccaccgagagcgagaagcccgacaccagcgccgagagcgacaccgagcagaaccccgagagaaaggtggaggaggacggcgccgaggagagcgagttcaagatccagatcgtgcccagacagagaaagcagagaaagatcgccgtgagcgccatccagagagagtacctggacatcagcttcaacatcctggacaagctgggcgagcagaaggaccccgaccccagcaccaagggcctgagcaccctggagatgcccagagagagcagcagcgcccccaccctggacgccggcgtgcccgagaccagcagccacagcagcatcagcacccagtacagacagatgaagagaggcagcctgggcgtgctgaccatgagccagctgatgaagagacagctggagcaccagagcagcgccccccacaacatcagcaactgggacaccgagcagatccagcccggcaagagacagtgcaacgtgcccacctgcctgaaccccgacctggagggccagcccctgagaatgagaggcgccaccaagagcagcctgctgagcgcccccagcatcgtgagcatgttcgtgcccgcccccgaggagttcaccgacgagcagcccaccgtgatgaccgacaagtgccacgactgcggcgccatcctggaggagtacgacgaggagaccctgggcctggccatcgtggtgctgagcaccttcatccacctgagccccgacctggccgcccccctgctgctggacatcatgcagagcgtgggcagactggccagcagcaccaccttcagcaaccaggccgagagcatgatggtgcccggcaacgccgccggcgtggccaagcagttcctgagatgcatcttccaccagctggcccccaacggcatcttcccccagctgttccagagcaccatcaaggacggcaccttcctgagaaccctggccagcagcctgatggacttcaacgagctgagcagcatcgccgccctgagccagctgctggagggcctgaacaacaagaagaacctgcccgccggcggcgccatgatcagatgcctggagaacatcgccaccttcatggaggccctgcccatggacagccccagcagcctgtggaccaccatcagcaaccagttccagaccttcttcgccaagctgccctgcgtgctgcccctgaagtgcagcctggacagcagcctgagaatcatgatctgcctgctgaagatccccagcaccaacgccaccagaagcctgctggagcccttcagcaagctgctgagcttcgtgatccagaacgccgtgttcaccctggcctacctggtggagctgtgcggcctgtgctacagagccttcaccaaggagagagacaagttctacctgagcagaagcgtggtgctggagctgctgcaggccctgaagctgaagagccccctgcccgacaccaacctgctgctgctggtgcagttcatctgcgccgacgccggcaccaagctggccgagagcaccatcctgagcaagcagatgatcgccagcgtgcccggctgcggcaccgccgccatggagtgcgtgagacagtacatcaacgaggtgctggacttcatggccgacatgcacaccctgaccaagctgaagagccacatgaagacctgcagccagcccctgcacgaggacaccttcggcggccacctgaaggtgggcctggcccagatcgccgccatggacatcagcagaggcaaccacagagacaacaaggccgtgatcagatacctgccctggctgtaccacccccccagcgccatgcagcagggccccaaggagttcatcgagtgcgtgagccacatcagactgctgagctggctgctgctgggcagcctgacccacaacgccgtgtgccccaacgccagcagcccctgcctgcccatccccctggacgccggcagccacgtggccgaccacctgatcgtgatcctgatcggcttccccgagcagagcaagaccagcgtgctgcacatgtgcagcctgttccacgccttcatcttcgcccagctgtggaccgtgtactgcgagcagagcgccgtggccaccaacctgcagaaccagaacgagttcagcttcaccgccatcctgaccgccctggagttctggagcagagtgacccccagcatcctgcagctgatggcccacaacaaggtgatggtggagatggtgtgcctgcacgtgatcagcctgatggaggccctgcaggagtgcaacagcaccatcttcgtgaagctgatccccatgtggctgcccatgatccagagcaacatcaagcacctgagcgccggcctgcagctgagactgcaggccatccagaaccacgtgaaccaccacagcctgagaaccctgcccggcagcggccagagcagcgccggcctggccgccctgagaaagtggctgcagtgcacccagttcaagatggcccaggtggagatccagagcagcgaggccgccagccagttctaccccctgtag

SEQ ID NO: 25627 - DNA, 7974 bp, Artificial Sequence
  Description of Artificial Sequence: Synthetic coding sequence
atgagcaccaaggccgagcagttcgccagcaagatcagatacctgcaggagtaccacaacagagtgctgcacaacatctaccccgtgcccagcggcaccgacatcgccaacaccctgaagtacttcagccagaccctgctgagcatcctgagcagaaccggcaagaaggagaaccaggacgccagcaacctgaccgtgcccatgaccatgtgcctgttccccgtgcccttccccctgacccccagcctgagaccccaggtgagcagcatcaaccccaccgtgaccagaagcctgctgtacagcgtgctgagagacgcccccagcgagagaggcccccagagcagagacgcccagctgagcgactaccccagcctggactaccagggcctgtacgtgaccctggtgaccctgctggacctggtgcccctgctgcagcacggccagcacgacctgggccagagcatcttctacaccaccacctgcctgctgcccttcctgaacgacgacatcctgagcaccctgccctacaccatgatcagcaccctggccaccttcccccccttcctgcacaaggacatcatcgagtacctgagcaccagcttcctgcccatggccatcctgggcagcagcagaagagagggcgtgcccgcccacgtgaacctgagcgccagcagcatgctgatgatcgccatgcagtacaccagcaaccccgtgtaccactgccagctgctggagtgcctgatgaagtacaagcaggaggtgtggaaggacctgctgtacgtgatcgcctacggccccagccaggtgaagccccccgccgtgcagatgctgttccactactggcccaacctgaagccccccggcgccatcagcgagtacagaggcctgcagtacaccgcctggaaccccatccactgccagcacatcgagtgccacaacgccatcaacaagcccgccgtgaagatgtgcatcgaccccagcctgagcgtggccctgggcgacaagcccccccccctgtacctgtgcgaggagtgcagcgagagaatcgccggcgaccacagcgagtggctgatcgacgtgctgctgccccaggccgagatcagcgccatctgccagaagaagaactgcagcagccacgtgagaagagccgtggtgacctgcttcagcgccggctgctgcggcagacacggcaacagacccgtgagatactgcaagagatgccacagcaaccaccacagcaacgaggtgggcgccgccgccgagacccacctgtaccagaccagccccccccccatcaacaccagagagtgcggcgccgaggagctggtgtgcgccgtggaggccgtgatcagcctgctgaaggaggccgagttccacgccgagcagagagagcacgagctgaacagaagaagacagctgggcctgagcagcagccaccacagcctggacaacgccgacttcgacaacaaggacgacgacaagcacgaccagagactgctgagccagttcggcatctggttcctggtgagcctgtgcacccccagcgagaacacccccaccgagagcctggccagactggtggccatggtgttccagtggttccacagcaccgcctacatgatggacgacgaggtgggcagcctggtggagaagctgaagccccagttcgtgaccaagtggctgaagaccgtgtgcgacgtgagattcgacgtgatggtgatgtgcctgctgcccaagcccatggagttcgccagagtgggcggctactgggacaagagctgcagcaccgtgacccagctgaaggagggcctgaacagaatcctgtgcctgatcccctacaacgtgatcaaccagagcgtgtgggagtgcatcatgcccgagtggctggaggccatcagaaccgaggtgcccgacaaccagctgaaggagttcagagaggtgctgagcaagatgttcgacatcgagctgtgccccctgcccttcagcatggaggagatgttcggcttcatcagctgcagattcaccggctaccccagcagcgtgcaggagcaggccctgctgtggctgcacgtgctgagcgagctggacatcatggtgcccctgcagctgctgatcagcatgttcagcgacggcgtgaacagcgtgaaggagctggccaaccagagaaagagcagagtgagcgagctggccggcaacctggccagcagaagagtgagcgtggccagcgaccccggcagaagagtgcagcacaacatgctgagccccttccacagccccttccagagccccttcagaagccccctgagaagccccttcagaagccccttcaagaacttcggccaccccggcggcagaaccatcgacttcgactgcgaggacgacgagatgaacctgaactgcttcatcctgatgttcgacctgctgctgaagcagatggagctgcaggacgacggcatcaccatgggcctggagcacagcctgagcaaggacatcatcagcatcatcaacaacgtgttccaggccccctggggcggcagccacacctgccagaaggacgagaaggccatcgagtgcaacctgtgccagagcagcatcctgtgctaccagctggcctgcgagctgctggagagactggcccccaaggaggagagcagactggtggagcccaccgacagcctggaggacagcctgctgagcagcagacccgagttcatcatcggccccgagggcgaggaggaggagaaccccgccagcaagcacggcgagaaccccggcaactgcaccgagcccgtggagcacgccgccgtgaagaacgacaccgagagaaagttctgctaccagcagctgcccgtgaccctgagactgatctacaccatcttccaggagatggccaagttcgaggagcccgacatcctgttcaacatgctgaactgcctgaagatcctgtgcctgcacggcgagtgcctgtacatcgccagaaaggaccacccccagttcctggcctacatccaggaccacatgctgatcgccagcctgtggagagtggtgaagagcgagttcagccagctgagcagcctggccgtgcccctgctgctgcacgccctgagcctgccccacggcgccgacatcttctggaccatcatcaacggcaacttcaacagcaaggactggaagatgagattcgaggccgtggagaaggtggccgtgatctgcagattcctggacatccacagcgtgaccaagaaccacctgctgaagtacagcctggcccacgccttctgctgcttcctgaccgccgtggaggacgtgaaccccgccgtggccaccagagccggcctgctgctggacaccatcaagagacccgccctgcagggcctgtgcctgtgcctggacttccagttcgacaccgtggtgaaggacagacccaccatcctgagcaagctgctgctgctgcacttcctgaagcaggacatccccgccctgagctgggagttcttcgtgaacagattcgagaccctgagcctggaggcccagctgcacctggactgcaacaaggagttccccttccccaccaccatcaccgccgtgagaaccaacgtggccaacctgagcgacgccgccctgtggaagatcaagagagccagattcgccagaaacagacagaagagcgtgagaagcctgagagacagcgtgaagggccccgtggagagcaagagagccctgagcctgcccgagaccctgaccagcaagatccccatgagactgaccagacacgagcagagcgcccccgccctgggcggcacccccgagcagacccccggccagcagagccccgagaacgacaacaccatcaaggacctgctgcccgaggacgccggcatcgaccaccagaccgtgcaccagctgatcaccgtgctgatgaagttcatggccaaggacgagagcagcgccgagagcgacatcagcagcgccaaggccttcaacaccgtgaagagacacctgtacgtgctgctgggctacgaccagcaggagggctgcttcatgatcgccccccagaagatgagactgagcacctgcttcaacgccttcatcgccggcatcgcccaggtgatggactacaacatcaacctgggcaagcacctgctgcccctggtggtgcaggtgctgaagtactgcagctgcccccagctgagacactacttccagcagccccccagatgcagcctgtggagcctgaagccccacatcagacagatgtggctgaaggccctgctggtgatcctgtacaagtacccctacagagactgcgacatcagcaagatcctgctgcacctgatccacatcaccgtgaacaccctgaacgcccagtaccacagctgcaagccccacgccaccgccggccccctgtacagcgacaacagcaacatcagcagatacagcgagaaggagaagggcgagatcgagctggccgagtacagagagaccggcgccctgcaggacagcctgctgcactgcgtgagagaggagagcatccccaagaagaagctgagaagcttcaagcagaagagcctggacatcggcaacgccgacagcctgctgttcaccctggacgagcacagaagaaagagctgcatcgacagatgcgacatcgagaagccccccacccaggccgcctacatcgcccagagacccaacgaccccggcagaagcagacagaacagcgccaccagacccgacaacagcgagatccccgagaaccccgccatggagggcttccccgacgccagaagacccgtgatccccgaggtgagactgaactgcatggagaccttcgaggtgaaggtggacagccccgtgaagcccgcccccaaggaggacctggacctgatcgacctgagcagcgacagcaccagcggccccgagaagcacagcatcctgagcaccagcgacagcgacagcctggtgttcgagcccctgccccccctgagaatcgtggagagcgacgaggaggaggagaccatgaaccagggcgacgacggccccagcggcaagaacgccgccagcagccccagcgtgcccagccaccccagcgtgctgagcctgagcaccgcccccctggtgcaggtgagcgtggaggactgcagcaaggacttcagcagcaaggacagcggcaacaaccagagcgccggcaacaccgacagcgccctgatcaccctggaggaccccatggacgccgagggcagcagcaagcccgaggagctgcccgagttcagctgcggcagccccctgaccctgaagcagaagagagacctgctgcagaagagcttcgccctgcccgagatgagcctggacgaccaccccgaccccggcaccgagggcgagaagcccggcgagctgatgcccagcagcggcgccaagaccgtgctgctgaaggtgcccgaggacgccgagaaccccaccgagagcgagaagcccgacaccagcgccgagagcgacaccgagcagaaccccgagagaaaggtggaggaggacggcgccgaggagagcgagttcaagatccagatcgtgcccagacagagaaagcagagaaagatcgccgtgagcgccatccagagagagtacctggacatcagcttcaacatcctggacaagctgggcgagcagaaggaccccgaccccagcaccaagggcctgagcaccctggagatgcccagagagagcagcagcgcccccaccctggacgccggcgtgcccgagaccagcagccacagcagcatcagcacccagtacagacagatgaagagaggcagcctgggcgtgctgaccatgagccagctgatgaagagacagctggagcaccagagcagcgccccccacaacatcagcaactgggacaccgagcagatccagcccggcaagagacagtgcaacgtgcccacctgcctgaaccccgacctggagggccagcccctgagaatgagaggcgccaccaagagcagcctgctgagcgcccccagcatcgtgagcatgttcgtgcccgcccccgaggagttcaccgacgagcagcccaccgtgatgaccgacaagtgccacgactgcggcgccatcctggaggagtacgacgaggagaccctgggcctggccatcgtggtgctgagcaccttcatccacctgagccccgacctggccgcccccctgctgctggacatcatgcagagcgtgggcagactggccagcagcaccaccttcagcaaccaggccgagagcatgatggtgcccggcaacgccgccggcgtggccaagcagttcctgagatgcatcttccaccagctggcccccaacggcatcttcccccagctgttccagagcaccatcaaggacggcaccttcctgagaaccctggccagcagcctgatggacttcaacgagctgagcagcatcgccgccctgagccagctgctggagggcctgaacaacaagaagaacctgcccgccggcggcgccatgatcagatgcctggagaacatcgccaccttcatggaggccctgcccatggacagccccagcagcctgtggaccaccatcagcaaccagttccagaccttcttcgccaagctgccctgcgtgctgcccctgaagtgcagcctggacagcagcctgagaatcatgatctgcctgctgaagatccccagcaccaacgccaccagaagcctgctggagcccttcagcaagctgctgagcttcgtgatccagaacgccgtgttcaccctggcctacctggtggagctgtgcggcctgtgctacagagccttcaccaaggagagagacaagttctacctgagcagaagcgtggtgctggagctgctgcaggccctgaagctgaagagccccctgcccgacaccaacctgctgctgctggtgcagttcatctgcgccgacgccggcaccaagctggccgagagcaccatcctgagcaagcagatgatcgccagcgtgcccggctgcggcaccgccgccatggagtgcgtgagacagtacatcaacgaggtgctggacttcatggccgacatgcacaccctgaccaagctgaagagccacatgaagacctgcagccagcccctgcacgaggacaccttcggcggccacctgaaggtgggcctggcccagatcgccgccatggacatcagcagaggcaaccacagagacaacaaggccgtgatcagatacctgccctggctgtaccacccccccagcgccatgcagcagggccccaaggagttcatcgagtgcgtgagccacatcagactgctgagctggctgctgctgggcagcctgacccacaacgccgtgtgccccaacgccagcagcccctgcctgcccatccccctggacgccggcagccacgtggccgaccacctgatcgtgatcctgatcggcttccccgagcagagcaagaccagcgtgctgcacatgtgcagcctgttccacgccttcatcttcgcccagctgtggaccgtgtactgcgagcagagcgccgtggccaccaacctgcagaaccagaacgagttcagcttcaccgccatcctgaccgccctggagttctggagcagagtgacccccagcatcctgcagctgatggcccacaacaaggtgatggtggagatggtgtgcctgcacgtgatcagcctgatggaggccctgcaggagtgcaacagcaccatcttcgtgaagctgatccccatgtggctgcccatgatccagagcaacatcaagcacctgagcgccggcctgcagctgagactgcaggccatccagaaccacgtgaaccaccacagcctgagaaccctgcccggcagcggccagagcagcgccggcctggccgccctgagaaagtggctgcagtgcacccagttcaagatggcccaggtggagatccagagcagcgaggccgccagccagttctaccccctgtag

SEQ ID NO: 25628 - DNA, 399 bp, Artificial Sequence
  Description of Artificial Sequence: Synthetic coding sequence
atgagagagggccaggagatgggccccacccccgtgcccagcaaccccctgctgcacagaagcttcccctgctggcccagaggctggagccaccccgtgcccaccagagagctgctgctggagcccgcccagcccgccgacctgctgccccccgcccccaccgccggcccctgcagcctggccagctggatgctgagccagcccggcagaggcagccaggtgaagaccggcggcacccccaccgccaccgcccaggacgccgaggcccccctgcccgactgcgacctgtgcctgagccccgcccccgtgggcacctggcagcccagagccaaggccggctgggccggcgaccccagaaacctgagcggcaacaccttcagccccggctgggagcagtag

SEQ ID NO: 25629 - DNA, 1803 bp, Artificial Sequence
  Description of Artificial Sequence: Synthetic coding sequence
atgttcaccctgagcctgctgagcagaggccacggcaagctgggccaggacaagcagaagctggaggtgtacttcgagcccgaggactacctgaactggagaagccccgaggactacgtgcccgtgagcaagccccaggacaagaacaacgccagccagcacagctggagcctgttcctgcccaagaccttcagcaccagaaagggcgccctgatcctgtacagcgagggcttcgccatcagcgcctggacccccaaggagagaagaaagggcccctactgccccagaggcccctggagaaagctggacctggagctgcacaccctgcaggacctgaaggaggccatcctggcctacggcagacagcagctgaacctgcccatgggcgacgccggcaagagactggagagagagaagaagagaaagaccaccgtgttcctgcccagccacagcgccagcagcgagaagaagcacctgcactacctgtgcgacaccgccctgaacagacaggcccactacgacccccagctgctgcagggcgagcaggacagagcctggcagccctacctgcacttcagaagccagctggagagccaggcccagagacagatccagcccggccacagcgccaagagatacctgagaggcctgctgagaacctggccccccgacgccatgtacagactgtggtgcgccggctacatcaaggacagcgtgctgctgcaggacagccagctgaacgtgcccaagaagctgagaccccagcaggacctgagcggcgtgccccccaagtaccacctgctgcccgtgttccccagcttctggatccagcagggcaagagcttcgagcagagacagcagggcctggacgagggcgaggccggcgccgccggccacgtggaccagggccccctggccaagaaccacggcagccagggcaccagactgccccccagaagaaagcagccctggcaggaggacgagacccaggccgaggacaccagcatcgagaaccacctgtgcctgtacgccagcaaggagagctacaacgagaagacccagcagaccagcagaaaggccttcggccacggcagaatcgaccacagctggctgcccagcgacaagagccacatcaccttctgcggcggcgccttccccaacagaaaggccgacctgagcgacaagcagagaaacgtgaagctgcacaaggccagaagcagccacctgctgcaggtgctgcccgccgagagaagcctgttcccccccgtggccagcgccaccggcagcagaatcatcacccccggcgaggtgaagaagaagaaggcccccaaggccctgaagctgccccccatcagcgaggagccccccagagtgctggagcccctgaagagccagttcaaggccaacgagccccccaccgagctgttcatcctgcccgtggagatccactaccacaccaagcagccccccaaggagaaggcccacagaagaggcgccccccaccccgagagcgagcccgagagcagcgaggagagcacccccgtgtggagaccccccctgaagcacgccagcctggagaccccctgggagctgaccgtgcacctgcccgtggacgccagcagagacaccctgagcccccagggcagcagcagcctgccccccgccagcctgggcaacctgaccctgaagggcagcaaggccagacacaccagagtgcacagccagggcaagggcgtgtggaagggcgacgacgacgcccccccccacgacgtggccccccccctggacctgctgcccccctag

SEQ ID NO: 25630 - DNA, 360 bp, Artificial Sequence
  Description of Artificial Sequence: Synthetic coding sequence
atgagcggcagcccccaggccagctacccccagacccacagcttcaccctgaagcaccaggagatcagaaccttctggaacctgaacatgagaggcctgggcggcgagggcggcaccgaggaggagagcagcctgggccaggccggcggcaagctgaagaccgccgcctggcccagctgggtggccgaggtgggcgccgccggcgccctggccgaccccggcggccagaagagcggcagcttcctgcccagccagcagctgcagtgcatccccggccccggcctgtacgccggcgaggccagcaaggaccccgtgctgagaaagctgcccttccagtgcggcagaacccacaacccctag

SEQ ID NO: 25631 - DNA, 405 bp, Artificial Sequence
  Description of Artificial Sequence: Synthetic coding sequence
atgctggtggtgggcgccggccccctgggcgccgccgcctggagccagagactggactggggcagatgccagctgaagctgctgggccagcacggccaggacgtgctgcacaccaacctgggcgaggagaacgtgtgcatcgccggccccctgctgctgccctgccccgacagccagccctgcctgacccccccccaccccgcccaggccctggtgcagctgtgggtgccctgcccctgcctgtgccccagagtgggcgccagcaccgcctggctggagggcgacacccccgccctgccccagcacctgggccccagcatcaccaccaccggcagatgggccacccccaagaagatccccggcctgaccgtgccccccgagaacatggacagcatgtggggctag

SEQ ID NO: 25632 - DNA, 447 bp, Artificial Sequence
  Description of Artificial Sequence: Synthetic coding sequence
atggactgcgtgccccccatccagtgcagctgcagcatgggcggcagataccaccaccccgccggcgaggccttctggaccggcgagagatgcgagcagttctgccactgccaggccagcacccacgccgtgtgctgcagccccagcagctgcggccccggccagagatgcgagaccctgagaggcatcttcggctgccaccccctgagccccggcatctaccaggccaccatgcacagccacgtggccagcttcgacagaaagagcgtggagttccccggcacctgcgccagcgccttcaccaagagctgcggcagcagcagcagcctgagactgttcaaggtggagatcggcaaggagaagcaggtgcagcagagccactgcgtgcacttcaaggacgtgggcagctgggaccccggcctgagcgccgagagagcccccacctag

SEQ ID NO: 25633 - DNA, 615 bp, Artificial Sequence
  Description of Artificial Sequence: Synthetic coding sequence
atgggcccccagcacggcaccggccccgaccccccccccctgtgccactgcccccacaccgccggcggcggcgccggcggcaccggcgcccccgccttcggcctgcagggcatctgggtgcccctggccgtgggcgacagaagaggcccctgcggccagggcgccagcatgggcgcccccggccagcccagacagggcggcagaggcaagggccaggaggccagcgcccagaccagatacggcggcaacagcccccacggcagaggccagaacagactggagggccccggcgtgcaggtgtgctgcaacagagccagaagagccagaggctgcccccaccccggccagagacaccacgtggtgctgagccagtggagcggcagcggcctggtgggcggcatcgaggacaccgccgacctggcccccccccccggcgccggcctgagccccctggcccacagcaagggcagagaccagagaggcggcggcctgcacccccccagccccagatgcagcccccccccctaccaccccgtgcagagatgccccagaagatgggagagctgcgagggcagaccccacctggcctgcagcggctgccccgccagctgctag

SEQ ID NO: 25634 - DNA, 543 bp, Artificial Sequence
  Description of Artificial Sequence: Synthetic coding sequence
atgcagagaggccccctgagccccagccccagcgacggcctgggcgccctgggcaccacctaccccggcgtgcacagaggccagagcatggccggcctgagagtgcccgccttcaacgccggcctgagagccatcacccccagcagagccgagacccagcaccccgagaccaccagcagcggcatgcacagagagcccctgagcagcacccccatcgcccactgggagggcgcccagagccccggcgcccagagcgtgctggccatgctggtgcacagaaccgccgcctacaccctgcaggtgctggagcccaagaaggaccccggcagagagctgcccgccacccccagaagctgggcccccgccagacagcccagccccctgcacagcatcagacagaccatgcccgccaagcccagcctggtgaagagagagagaagaaaccaggccctggccagagaggccccctggttcccccagagaacccagtggaagaccagcgagggccccggcagcagcagcggcagaagaggcagaagatag

SEQ ID NO: 25635 - DNA, 456 bp, Artificial Sequence
  Description of Artificial Sequence: Synthetic coding sequence
atgccctacgagaccagaagctggatcaccctgctgagaacccagagaagagaggagtgcggcctgcactgcaccagcctgcccagcctggccagagacctgaagttccacaccaccgagcccaacaccagcagacccagcagcaacgacctgagaaacagaaagctgtgcctggccgccgacaagctgagccagtgcccctgggacctgcaggacgtgtggaacgaggagagacagctgagccagtgcgagctgagcggcggcccccagaagaacgtgggcagaagagtgttccccatcagacagaccgtgctgcagcccagaccccccaagagaagcaaccccggcctgctgttcagcggcaccgagtgcggctgcatcctgcccttcctgtgcttcctgagcagatacctgctgaccgtgcacatgagaggcctgggcaagctgagcgtgtag

SEQ ID NO: 25636 - DNA, 369 bp, Artificial Sequence
  Description of Artificial Sequence: Synthetic coding sequence
atgacctggctggacaagggcgtgtggacccaggaggacgagaacagctgcagcttcagcgagagcgacttccccggctgcagagaccagatcaaccccagcatccccagcatctggaccgccgtgagcggcatgatgatcagcctggaggtgagatggtggatcaagggcaagcagggctacgtgatcagcctgggccacgccctgagccccagactggagtgcagcggcaccttcagcgcccactgcatcctgggcctgcccggcggcagcagctacccccccgccagcgtgagccaggtggtgggcaccaccgccctgtacctggtggaggaggcctgggccgaggccggcaagatgagaagctag

SEQ ID NO: 25637 - DNA, 660 bp, Artificial Sequence
  Description of Artificial Sequence: Synthetic coding sequence
atggccgccagaagcgtggacgacatcagcatcaagctgctgcacgagaagggccccgccaccgaccacggcgtgaacgtgctgcccagcaccgtgcccggcagagaggagggcatgaccgacagaaagcactggttcagcttcggcacccagcccaacgtgcccggcctgcaggagcccctggactacagagccgccaaccaggcctggcaggccgtgctggccgaggtgcccagaggcggccccggctgcgccgccctgagagacctgggcagatgcggcggccccgacgtgagcaccagaagacagtggagacccctgcccttcagctgccccctgagccacaccacccagccccccctgggcggccactgcagaggcagcagcgccggcagattccacggcagagaccagaccagccccggcaccgtgcagcagctgcccagcgcccacgtgctgaagcccggctgcacccagcacggcgacctgagccccggccaggccagccccccccccgccgccgccctgggccccagccccaaggcctggacccacaccctgggcagaccccagctgtgggccggcctgggcagccacagattcggcgtgcccggccccggcaccagaaacaccctggccgcctgctgcgtgcaggagtag

SEQ ID NO: 25638 - DNA, 471 bp, Artificial Sequence
  Description of Artificial Sequence: Synthetic coding sequence
atggccaccccccccgcccccggcgccggcaccgccgcccccagcgcccccagaccccccccccccagacccagctggctgagactggaccccgccgccagaggcgccagactgcccttccccggcagccccggcaccaccagaagagcccccagagagagcgcccccctggcccccgccctgagaagcgaccccggccagcccctggccgcctgcaacggcccccccggcgagcccagagccgaccccggcgtgagcaccagatgcgccgccaccatgatcccccagggcaagctgaccggcggcagaagctgcggcagcagacccagaatgggcagaggcgagagagccgagctgagcttccccgccgccgcccccagactgaagagaggcctgggcttctggttcttcttctgcggcaacagcagcgtggagatcctgctggcctgccacaccacccaccccttctag

SEQ ID NO: 25639 - DNA, 435 bp, Artificial Sequence
  Description of Artificial Sequence: Synthetic coding sequence
atgagcctgaagagcctgttctgcaacagcgaggccaaggacaacaagtgctaccacacctacagcgagagcagctggagcgagaccaagaagatcgtgatcgccaccaagatccacagcttccagaccttcagcagctgctacagcgactgccacggcatcctgggcgtgctgctgcaccagctggagaccagcgtggccggcggcaccttctgcctgagcatcgcccacgcctggtgggccagattcgcccacagcagctggaaggccgccctgggcagctgctaccagcccggcttccacacctgccagggccaggccagactgggcagcgtgagaggcgtgtgggccagcgagcacggcgtgcagccccagagaaccggcagacacaccggctgctgcggcagagtgggcagcttcagacactgcagctag

SEQ ID NO: 25640 - DNA, 750 bp, Artificial Sequence
  Description of Artificial Sequence: Synthetic coding sequence
atgagagtgagatggctgagattctggctgctgttctggctgctgctgggcttcatcagccaccagcccacccccgtgatcaacaccctggccgaccacagacacagagagaccgacttcggcggcagcccctggatcatcatcatcatcgtgttcctgggcagatacaagttcaccatcctgttctgcaccatctacctgtgcgtgcccttcctgaagaccatcttctggagcagaaacggccacgacagaagcagagacgtgcagcagagagccagaagaagcaacagaagaagacaggagggcatcaagatcggcctggaggacatctgcaccctgtggaagcaggccgagaccaaggtgcaggccaagatcagaaagatgaaggtgaccaagaaggtgaaccaccactacaagatcaacggcaagagaaagaccgccaaggagcagaagatgttccagagagcccaggagctgagatggagagccgaggactaccacaagtgcaagatcacccccagcgccagaaagcccctgtgcaactgggtgagcctgttcgtgttcctggccttcggcagcctgcccggccaggacatggacaccttcttcagcctgcagctgtgcgcccaggccctgcagagagagatggccgagagaaaggccgcctacaagcaccacagccccatccccgtgggcaacagagtggtgcagaagcacctgcacccccaccccgtgggccccctgatctag

SEQ ID NO: 25641 - DNA, 402 bp, Artificial Sequence
  Description of Artificial Sequence: Synthetic coding sequence
atggcctgcgccatccagctggccagcagcgaggccagagacagagccagacccagagacagaaccttcctgcagaagagacagctgggcgccggcgtgtggctgctgggcgagagaaccagcaacaccatgctgaactggaacggcgagagaggccacccctgcctggtgctggtgttcaagagaaacatcgaggccgacttcaagagcagcttcagcagcgagcacttcttcttcatccccctggacgactgcaactgcaaggaggagctggccgtgatcagcgacggcagaaccatcgtgtgctaccaccacagcgtggacatcagctacgagcacaccaagcagaccctgaaccagatcctgtgcatgatcatgaagaagcacatgttcaagtgctag

SEQ ID NO: 25642 - DNA, 1851 bp, Artificial Sequence
  Description of Artificial Sequence: Synthetic coding sequence
atgccccccctggagacccagagcagcctggccccccccagcctgcagaccccccccgccagcctgaccaccccccccctggagaacctgcccagcctggcccccccccccctgcagaccgccagcgcccccctgaccaccccccacctggagacccccccctgccccgccccctgccccctgcaggccccccccagccccctgaccacccccccccccgagacccccagcagcatcgccaccccccccccccaggccccccccgccctggccagcccccccctgcagggcctgcccagcccccccctgagccccctggccaccccccccccccaggccccccccgccctggccctgccccccctgcaggccccccccagcccccccgccagcccccccctgagccccctggccacccccagcccccaggcccccaacgccctggccgtgcacctgctgcaggcccccttcagccccccccccagcccccccgtgcaggcccccttcagcccccccgccagcccccccgtgagccccagcgccaccccccccagccaggccccccccagcctggccgccccccccctgcaggtgccccccagcccccccgccagcccccccatgagccccagcgccaccccccccccccaggcccccccccccctggccgccccccccctgcaggtgccccccagcccccccgccagcccccccatgagccccagcgccacccccccccccagagtgccccccctgctggccgccccccccctgcaggtgccccccagcccccccgccagcctgcccatgagccccctggccaagccccccccccaggccccccccgccctggccaccccccccctgcaggccctgcccagcccccccgccagcttccccggccaggcccccttcagccccagcgccagcctgcccatgagccccctggccaccccccccccccaggccccccccgtgctggccgcccccctgctgcaggtgccccccagcccccccgccagccccaccctgcaggcccccagaagaccccccacccccggccccgacaccagcgtgagcggccccagactgaccctggccctggcccccggccccccccccccccccagcagaagccccagcagcaccctgagcggccccgacctggccggccacagcagcagcgccaccagcacccccgaggagctgagaggctacgacagcggccccgagggcggcgccgccgccagccccccccccgacgccgagctggccgcctgccaccccgccgcctggagcagaggccccgccccccccctggccttcagaggcgcccccggcgcccccctgccctggccccccgccaccggccccggcagcgccgacggcctgtgcaccatctacgagaccgagggccccgagagcgccacccccgcccccggcgccctggaccccggccccagccccggcaccagcggcggcaaggccgccgccggcgccggcgccggcgccagcagcagaagccccaagcaggccagactgggcgagctgcccctgggcgccctgcaggccagcgtggtgcagcacctgctgagcagaaccctgctgctggccgccgccgagggcgccgccggcggcagcggcggcggccccggcggcgccgagggcggcggcgtgaccggcggcgccagagccgccctgagcgacgccgagctgggcagatgggccgagctgctgagccccctggacgagagcagagccagcatcaccagcgtgaccagcttcagccccgacgacgtggccagcccccagggcgactggaccgtggtggaggtggagaccttccactag

SEQ ID NO: 25643 - DNA, 549 bp, Artificial Sequence
  Description of Artificial Sequence: Synthetic coding sequence
atgttctgctgcctgggctacgagtggctgagcggcggctgcaagacctggcacagcgcctgggtgatcaacaccctggccgaccacagacacagaggcaccgacttcggcggcagcccctggctgctgatcatcaccgtgttcctgagaagctacaagttcgccatcagcctgtgcaccagctacctgtgcgtgagcttcctgaagaccatcttccccagccagaacggccacgacggcagcaccgacgtgcagcagagagccagaagaagcaacagaagaagacaggagggcatcaagatcgtgctggaggacatcttcaccctgtggagacaggtggagaccaaggtgagagccaagatctgcaagatgaaggtgaccaccaaggtgaacagacacgacaagatcaacggcaagagaaagaccgccaaggagcacctgagaaagctgagcatgaaggagagagagcacggcgagaaggagagacaggtgagcgaggccgaggagaacggcaagctggacatgaaggagatccacacctacatgtag

SEQ ID NO: 25644 - DNA, 1224 bp, Artificial Sequence
  Description of Artificial Sequence: Synthetic coding sequence
atgtacaacgccttctggaaccacctgaaggagcagctgctgagcaccccccccgacttcacctgcgccctggagctgctgaaggacgtgaaggagaacagactgagaaacgagatcgaggaggccctggacaccgacctgctgaagcaggaggccgagcacggcgccctggacgtgccccacctgagcaactacatcctgaacctgatggccctgctgtgcgcccccgtgagagacgaggccatccagaagctggagaccatcagagaccccgtgcagctgctgagaggcatcctgagagtgctgggcctgatgaagatggacatggtgaactacaccatccagagcttcagaccctacctgcaggagcacagcatccagtacgagcaggccaagttccaggagctgctggacaagcagcccagcctgctggactacaccaccaagtggctgaccaaggccgccaccgacatcaccaccctgtgccccagcagccccgacagccccagcagcagctgcagcatggcctgcagcctgcccagcggcgccggcaacaacagcgagccccccagccccaccatggtgctgtaccagggctacctgaacctgctgctgtgggacctggagaacgtggagttccccgagaccctgctgatggacagaatcagactgcaggagctggccttccagctgcaccagctgaccgtgctggccagcgtgctgctggtggccagaagcttcagcggcgaggtgctgttcagaagccccgagttcgtggacagactgaagtgcaccaccaaggccctgaccgaggagttcatcagcagacccgaggagaccatgctgagcgtgagcgagcaggtgagccaggaggtgcaccagggcctgaaggacatgggcctgaccaccctgagcagcgagaacaccgccagcctgctgggccagctgcagaacatcaccaagaaggagaactgcatcagaagcatcgtggaccagtggatcagattcttcctgaagtgctgcctgctgcacggcatgcaggagagcctgctgcacttccccggcggcctgatcctgatcgagaaggagctggccgagctgggctggaagttcctgaacctgatgcaccacaaccagcaggtgttcggcccctactacgccgagatcctgaagcacatcatccaccccgcccaggcccaggagaccgacgtggagcccaactag

SEQ ID NO: 25645 - DNA, 432 bp, Artificial Sequence
  Description of Artificial Sequence: Synthetic coding sequence
atgctgagaaagacctgcggcggccagcaggaggacagcagaggcatgggcccccacctgcccagagtgcccgacggcgtggtgctgggcgtggaggagcccgagggcaaggcccagggcagagtgagaggcgagctgtgccccggcgccctggccagaatccacatgggccacagctgcaccagactgagcgccgagggcatcgccatgctgctgggcaccgccggccccagcagactgcccgccgcccccgacgccagccaggcccccctgagaagcccctgggccctgagcgtggccgccgccctgtgcagccccgtgagctgccacccctgcggcagacacgtggtgaccttcggccactgccccgcccagggcccctggggcctgggcaccttcggccacagcttcttcggctgcctgtgcaagtag

SEQ ID NO: 25646 - DNA, 486 bp, Artificial Sequence
  Description of Artificial Sequence: Synthetic coding sequence
atgggccacagacccaacctgggccagcccccccaccccaacgccgtggccgccgccctgcacgccagcctgtgccccgccaactggggcacctgccccctgggcaagcccggctaccccggctgcctgtggttccagcccctgctgctgttccccggctgcctgtgcagccccgacggccccttccccagagccgtgttcaccagcgccggcaagggccccctgcagaccgacctgggcagaggcagagtgccccccagagaccagcagacccccaagagcagaccctgccccagagcccccgtggccagcaacagacagagcggcggcagcgccgtgagcgcccccctgagcggcgccagaagagcctggaagagcgccttcgccgccccccccagaagcagactgagaccccagaagggcgtgccctggaccgagaagagagccagaggcggcggcagagccggcccctgcagaagaacctag

SEQ ID NO: 25647 - DNA, 690 bp, Artificial Sequence
  Description of Artificial Sequence: Synthetic coding sequence
atggccgccgcccccgacgtgggcaacggcggcagcaagaacgtgagaaagcccagacccggcaagtgccagcccaagagcagacacagcctgccccagacccagaagcccgaggaggtgagaaagtgcggcggcatctgcctgcccgtgtgcctgcaggaccccggcgcctgccccagctggctgcccctggaggagggcctgagaagacccgccttcggccacagaaccgaggccggccccagaggcaagggcttcggcagacacagaggcaacagcggcctgagagccgccgaggtgacccacggcccctgctgggaggccgccgacgtgccctgcctgagactgaccaagccccacggcctgagagtgaccgccggctgcagcgagtggagaagaaacgtggtggccagacaggtgcccgaggccagcgccgagctgtgcagcagaaaccagccctgggccgccgccacccccggcagcctgcaccccagcccccagcccggcgtgctggagggcacccccaccaacctgaacagaaccctgcccagcggcatcagaggcagccagcccctgccccagggccagccccccctgcccggcagaagcagctgggagaccaagaccagagagcccatccccccccccgtgagactggaggccagagaggtgggcggcgtgagcctgtag

SEQ ID NO: 25648 - DNA, 480 bp, Artificial Sequence
  Description of Artificial Sequence: Synthetic coding sequence
atggacgtggtggaggtggccggcagctggtgggcccaggagagagaggacatcatcatgaagtacgagaagggccacagagccggcctgcccgaggacaagggccccaagcccttcggcagctacaacaacaacatcgaccacttcggcatgcagcacgagaccgagctgccccccctgaccgccagagaggtgaagcagatcagaagagagatcagcagaaagagcaagtgggtgaagatgctgggcgagtgggacacctacaagaacagcagaaagctgatcgacagagcctaccagggcatccccatgaacatcagaggccccatgtggagcgtgctgctgaacatcgaggagatcaagctgaagaaccccggcagataccagatcatgaaggagaagggcaagagaagcagcgagcacatccagcagatggacctggacgccgccggcaccaccctgcacccccccggcgtgtag

SEQ ID NO: 25649 - DNA, 462 bp, Artificial Sequence; identical to SEQ ID NO: 22893
  Description of Artificial Sequence: Synthetic coding sequence

SEQ ID NO: 25650 - DNA, 1116 bp, Artificial Sequence
  Description of Artificial Sequence: Synthetic coding sequence
atgggcggccccgtgctgggccactggtggcacagcggcggcatgagcctggccgtgcccagcctgcccccccccggcaagagcagcgtgttcctgttcctgcaggagaagaaggccaacaacaagaagcagaaggccaagagagtgctggaggtgcagctgcagaccctgaacatccagaaggaggagctgaacaccgacctgtaccacatgaagagaagcctgagatacttcgaggagaagagcaaggacctggccgtgagactgcagcacagcctgcagagaaagggcgagctggagagcgtgctgagcgacgtgatggccacccagaagaagaaggccaaccagctgagcagccccagcaaggccggcaccgagtggaagctggagcagagcatgagagaggaggccctgctgaaggtgcagctgacccagctgaaggagagcttccagcaggtgcagctggagagagacgagtacagcgagcacctgaagggcgagagagccagatggcagcagagaatgagaaagatgagccaggagatctgcaccctgaagaaggagaagcagcaggacatgagaagagtggagaagctggagagaagcctgagcaagctgaagaaccagatggccgagcccctgccccccgagccccccgccgtgcccagcgaggtggagctgcagcacctgagaaaggagctggagagagtggccggcgagctgcaggcccaggtgaagaacaaccagagaatcagcctgctgaaccagagacaggaggagagaatcagagagcaggaggagagactgagaaagcaggaggagagaatccaggagcagcacaagagcctgcagcagctggccaagccccagagcgtgttcgaggagcccaacaacgagaacaagagcaccctgcagctggagcagcaggtgaaggagctgcaggagaagctgggcgaggtgaaggagagcgagaccagcacccccagcaagaagggctgggaggccggcagcagcctgtggggcggcgaggtgcccggccagagacagctgcccgcctggggcctggtgaccaccgccccccccagagccgtgctgttcctggccagctgcctgtag

SEQ ID NO: 25651 - DNA, 384 bp, Artificial Sequence
  Description of Artificial Sequence: Synthetic coding sequence
atgggcaacctgtgcggctgcatccagggcgacagcaagaagcccagcaagaagagagtgaagagaaagccctacagcaccaccaaggtgaccagcggcagcaccttcaacgagaacaccagaagatacgccgtgcacaccaaccagtgcagaagaccccacggcagcagagtgaagaagaagagatacccccaggaggacgacttccaccacaccgtgttcagcaacctggagagactggacaagctgcagcccaccctggaggccagcgaggagagcctggtgcacaaggacagaggcgacggcgagagacccgtgaacgtgagagtggtgcaggtggcccccctgagaagagagagcagagccatcgacaccggcgagtag
